United States Patent 9,061,059 (MODIFIED POLYNUCLEOTIDES FOR TREATING PROTEIN DEFICIENCY) - sequence listing, part 109

SEQ ID NO: 212341 - DNA, 2643 bp, Artificial Sequence
  Description of Artificial Sequence: Synthetic coding sequence
atgccccgggacggcgtgcccgccggcaacaccacccccgccgccgcgcaggccgcggctcagtctcctgactcagccacagcaggggcaccccaggtcctcgactctctcaagcgttatccagactggaatcccgaaatcctcccgagccgacggaacgaaggcaaccgtaaagaaaacgagacccctaggcgtcgatcgcacagccctagccccaggcgatctaggcgctcctcttcatcccaccgcttccggagaagcaggtctcccatgcattacatgtaccgacctcggagcagatcacccagaatctgtcatcgctttatcagtaggtaccggtcacgtagccggtctcgatccccctatcgcattagaaatccttttcgcggttcaccaaagtgttttcgctcggtgtcaccagagcggatgtcaagacggtctgtccgttcaagtgatcggaaaaaggcattggaggatgtggtacaaaggtcggggcatgggaccgaattcaataaacagaagcatctcgaagcagctgacaagggacactcccctgctcagaaacctaaaactagcagtgggactaagcccagtgtcaaaccaacatcggcaaccaaatcagacagcaatctcgggggacattctattagatgcaagagcaaaaacctggaagacgacactctttcagagtgcaagcaagtcagcgataaggctgtctcactgcagaggaaacttaggaaggagcagtctctgcactacggatccgtgcttctcattaccgaacttcccgaggacggttgtactgaggaagatgtgaggaagctgttccagccatttgggaaggtgaacgacgtgctgattgttccctatcggaaagaagcttacctggagatggagtttaaagaggcaatcaccgccatcatgaagtacatagaaactacacctctgacgatcaagggaaagtctgtgaaaatttgcgtgccagggaaaaagaaggctcagaacaaggaggtcaagaaaaaaaccctcgagtccaagaaggtgtccgctagtacgctgaagagggacgctgacgcatccaaagcagtcgaaatagtgacatcaactagtgctgccaagaccgggcaggctaaggcctctgtggcaaaggttaataaatccacaggcaaatcggccagctccgttaaatcggtggtgactgtcgctgttaagggaaataaagcctccattaaaaccgccaaaagtgggggcaagaagagcctcgaggcaaaaaaaacgggcaatgtgaagaacaaggattcaaataagccagttactatcccggagaactccgagatcaagacctctattgaagtgaaggcaacggagaactgtgcaaaggaagccatttctgatgcggctctggaggccaccgaaaatgaaccgttgaacaaagaaacagaggaaatgtgtgtgatgttagtgtcgaatttgccaaataagggatattccgtggaggaggtatacgacctcgccaagccgttcgggggtctaaaggatatattgatactgagcagccataagaaagcatatatcgaaattaaccgcaaagcagctgaatccatggtaaaattttatacatgttttcctgtgctgatggacgggaaccaactctcaatctccatggctcctgaaaatatgaacattaaagatgaggaggcaatcttcattacattggtgaaggaaaatgacccagaagccaatattgataccatttacgacaggtttgtgcatctggataacttgccagaggatgggctgcagtgtgtcctgtgtgtggggctgcaattcggtaaagtggaccaccacgtcttcatttctaacagaaataaggcgattctccagttggacagccctgagtctgcacagtccatgtatagcttcttaaaacagaatccacagaacattggagatcatatgctgacatgcagcctctccccaaagatcgacctacctgaagtgcaaatagaacatgaccctgaattagagaaagaaagtcccggcctgaagaactcgccgatagacgaatctgaggttcagactgccacagactcaccgagtgttaaacccaacgagctggaagaggagagtacaccgtcaattcagactgaaactctggtgcagcaggaagaaccatgcgaggaggaggctgagaaagccacatgcgattcggattttgcagtcgagacgctggaattggagacccagggagaagaagtgaaagaggagatcccactggtagccagcgcatcagtttccattgagcagtttaccgagaacgcggaggaatgtgcccttaatcagcaaatgttcaactccgacttagagaaaaaaggcgcagaaatcattaacccaaagaccgcactccttcccagcgattccgtattcgccgaagagagaaacttaaagggaatattggaggagtctcctagcgaggctgaggactttatatccggaatcacccagaccatggtggaggcagtagccgaggtcgaaaaaaacgagaccgtgagcgaaattctaccctctacctgtatcgttactctcgtgccgggaattcctacaggcgatgagaagacagtcgataagaagaatatctcttag

SEQ ID NO: 212342 - DNA, 2757 bp, Artificial Sequence
  Description of Artificial Sequence: Synthetic coding sequence
atggacagcccccccctgaaggccctgaacagcaacagcatctacttcctccttctgttccactgtatgctcatctccgaagtccagatcgaacatgatcccgaactagagaaggagtcacccggtcttaagaattccccgattgacgagtcagaggtgcagaccgctactgactctccttccgtcaagcctaacgaacttgaggaagagagtactccatctattcagacagagacactcgtgcaacaggaggagccatgcgaggaggaggctgagaaggccacctgtgacagtgacttcgccgtggagacacttgagctggaaacccagggtgaggaggtgaaggaggaaatccccttagtcgcttcagcgagtgtttctattgagcagttcacggagaatgccgaagagtgtgccctgaatcagcagatgttcaattctgacctggaaaagaagggtgccgagattatcaatcccaaaacggcactacttccttccgacagtgtgtttgctgaggagaggaatctgaaggggattctggaagagtccccatcagaagccgaagatttcattagtggtattacacagacaatggtggaagcagttgcagaggtagaaaagaacgaaacggtctcagagatactgccaagcacctgcatagtgacactggtaccaggtatcccaacgggcgatgagaagaccgtggataagaaaaacatcagtgaaaaaaagggaaacatggacgagaaggaagagaaggaatttaatactaaagagacacgcatggacctgcagatcggaactgagaaggctgagaagaacgaaggcagaatggatgcagaaaaggtggagaagatggcagccatgaaggaaaagcctgctgagaatactctgtttaaggcctacccgaataaaggggtcgggcaggcaaataagccggatgagacctccaaaacctccattctagcggtttctgacgtgtcttcttccaagccgagtattaaagcagtgatcgtgtccagtcctaaagcaaaggctaccgtcagcaagacagagaatcagaaaagtttccccaagtcagtccctcgtgaccagatcaatgctgagaagaagctcagcgctaaagaatttggattgctgaaacctacctctgctagaagcggcctggcagaaagtagcagcaaattcaagccgacccagagctcccttactcgcggcggctcgggaaggatttccgctttgcagggtaagttatcaaagctcgactaccgtgacatcacaaaacagtcacaggagactgaggccagaccatctataatgaaacgtgacgactcgaataataaaacgctggcggagcagaacacgaagaaccctaaatccaccactggccgcagcagtaagtctaaagaggaaccgttgtttccgtttaacctggacgaatttgtgacagtggatgaagtgattgaggaggtgaatccctcacaggctaaacagaatcctctgaaaggtaaaaggaaagagacactcaagaacgtacctttctccgagctgaacttgaaaaagaagaagggaaaaactagtacacctagaggcgtggagggcgagctgtctttcgtgacactggacgagattggcgaggaggaggatgccgcggcccatcttgcccaagcactcgtcactgtggacgaggtgatcgatgaagaagaactaaatatggaagaaatggtgaaaaactcgaattccttgttcacactggatgaattgattgatcaagacgactgcattagccacagtgagcccaaagatgtcacagttttgtctgtggcagaagagcaggacctgttgaaacaggagagactggtcaccgtggatgagatcggggaagtcgaggaactgcccctgaatgagtctgccgacattactttcgcaacactgaatactaagggcaacgaaggagacacagtgcgcgattctataggcttcatcagctctcaagtgcctgaagatcccagcacgctggtcactgttgatgagatccaagacgactctagcgacctgcacctggtgactctggatgaagtcaccgaggaggacgaggattccctggcggacttcaacaatctgaaggaagaactaaacttcgtcactgttgacgaagttggtgaggaggaagatggtgataatgacctgaaggtggagctcgctcagagcaagaacgatcaccccaccgacaagaagggaaatagaaagaagcgggcagttgacacaaaaaaaacaaagctggaaagcctctcccaggtggggcccgtcaacgagaatgttatggaggaggatctaaagactatgatcgagcgccatctcactgcaaagacaccgaccaaaagggtacgaatcggcaagacgctaccatccgaaaaggctgtggtgacagagcctgccaaaggtgaggaggctttccagatgagtgaagtggacgaggagagcggcctcaaggactctgagccagaacggaaacgcaagaagacagaggattctagctctgggaagagcgtggcttccgatgtgccggaggaactcgactttctagtgcccaaggccgggttcttttgtccgatctgctcactcttctattctggcgagaaagcgatgaccaaccattgtaagtctacaagacacaagcagaataccgagaagtttatggcgaagcaaagaaaagaaaaggaacagaacgaggctgaagagagaagctcacggtag

SEQ ID NO: 212343 - DNA, 5937 bp, Artificial Sequence
  Description of Artificial Sequence: Synthetic coding sequence
atgagccggccccggttcaacccccggggcgacttccccctgcagcgacccagagcgcccaacccatcaggaatgagaccccccgggcctttcatgcgacccgggtccatgggtcttccacgcttttaccccgccggtcgcgcccgtggcatcccccaccggtttgcagggcacgaatcataccagaacatgggacctcagaggatgaacgtgcaggttacgcagcacagaacagatccacgcctcaccaaggagaagctagacttccacgaggctcagcaaaaaaagggcaaaccacacggttccaggtgggatgacgaaccacacatctcagctagtgtggccgtaaaacagtctagcgtcacacaagtgactgagcagagccctaaggtgcagtctcgatatactaaagagagcgccagctcgattcttgcaagctttggtctgtcaaacgaggatctggaagagttatctagatatccagacgaacaacttactcccgaaaacatgcccctgatcctgcgggatatccgcatgcgcaagatgggaagacgtctgccgaatttaccatctcagagtaggaacaaggagacactggggtcagaagcagtgtccagcaacgtcattgactacggtcacgcctcaaagtacggttatactgaggatccactggaggtgcgaatctatgacccagagatccccaccgatgaggtggagaacgagttccagagccagcagaacattagcgcctcagttcccaaccccaatgtgatctgcaattcaatgtttcctgtggaagacgttttccggcagatggacttccctggggagagttctaacaataggagctttttctccgttgagtccggaacaaagatgagcgggctgcacatctctgggggccagtctgtcctcgagcctatcaagagcgtgaatcagagcatcaatcagactgtcagccagacaatgtcacagtcgcttatcccacctagtatgaaccagcagcctttctctagtgagctgatttcatccgtcagccagcaagagaggattccccacgaacccgtgattaactccagcaatgttcacgttgggtcccgcgggagcaagaaaaactaccagtcgcaagccgacattcccatccgttctcccttcgggatagtaaaggcttcctggctgccaaagtttagtcatgccgacgcccagaagatgaagagactccccacccctagcatgatgaacgattactatgccgcaagccccaggatttttcctcatctgtgttcgttgtgcaatgtagagtgctctcacctcaaggattggatccaacatcagaatacatccacccatattgaaagctgtaggcagctgagacaacagtaccctgactggaacccggagattctgccctcacggcgaaatgaaggaaaccgtaaagagaatgagactccacgtaggcggtcacattctccttctccgaggcgtagtcgcaggtcgtcaagcagccatcggttccgccggtcccgttcacccatgcactacatgtatcgaccaagaagccggagcccccgaatctgtcacaggtttatcagtagataccgcagtcgatcccgctcccggagtccatacagaatccggaaccccttccggggttcccccaaatgcttcaggagcgtatcgcctgagcgtatgtcgaggagatctgtgcggagctcagatcggaagaaggcccttgaggacgtggttcagaggagcgggcacgggacagaattcaacaagcagaaacatttggaggctgccgacaaaggacacagtcccgcacagaagccgaaaacatcctctggtacaaaacctagtgtcaaacccacctctgctaccaagtccgactctaacctcggcgggcattctattagatgcaaaagtaagaatttggaagatgacacactgagcgagtgtaagcaagtgagcgataaagctgtttcactacagcggaaactgagaaaggaacagtccctgcattatggttccgtcttgttgatcaccgagctgccagaagacggatgtacagaggaagacgtccgtaagcttttccagcctttcggtaaagtgaacgacgttctgattgtcccttataggaaggaggcctacttagagatggaattcaaggaggccattaccgctatcatgaagtacatcgaaacgaccccacttacaatcaaaggcaagtctgtcaagatctgtgtgcccggtaaaaaaaaagctcaaaataaagaggtcaagaaaaagacattggaaagtaaaaaggtgagtgcttcaacgctcaaaagagatgctgatgcttcaaaagctgtggagatcgtgaccagcacgagtgcagctaaaacaggtcaggctaaggctagcgtcgctaaagtgaacaaaagcaccggcaagagtgccagtagcgttaaatctgttgtaaccgtggcagtcaagggcaacaaagctagcattaaaacggctaaaagcggtggtaagaaatcccttgaagcgaagaagaccggaaacgtgaaaaataaggactccaacaaacccgttacgatccccgagaactccgaaatcaaaacgtctattgaggtgaaagccacggaaaattgtgctaaggaagcaatttctgatgctgcacttgaggcgaccgaaaatgaacccttaaataaggagaccgaggagatgtgcgttatgctcgtgtcaaacctgcctaacaaaggctatagcgttgaggaagtgtatgatttagccaagccattcggtggcttaaaagacatccttattctaagctctcataaaaaagcctacatcgagatcaacaggaaagctgctgagagcatggtaaaattctacacttgtttcccagtgctaatggacggtaatcagttgtcaatctcaatggcccctgagaacatgaatatcaaagacgaagaggcaatttttataaccctcgtcaaagagaatgacccggaggctaacattgacaccatctatgaccgattcgttcatctagacaacctgcctgaggatggccttcaatgcgtactgtgcgtgggactacagttcggcaaagtggaccaccatgtttttattagcaaccgaaacaaggctatattgcagcttgactccccggaatccgcgcagtccatgtattccttcctcaaacaaaatccccagaatattggggatcacatgctcacctgttcgctgtcccccaaaattgacttgcccgaagttcagatcgagcacgacccagagctggagaaagagtctcccggtctgaagaattctcccatagacgagagcgaagtccagactgctaccgactccccaagcgtgaaacccaacgaactcgaagaagagtccactccttcgattcaaactgagaccctggtgcaacaggaggaaccttgcgaagaagaagctgaaaaggccacatgtgattctgactttgccgtcgagacattggagctcgagacccagggggaggaagttaaggaggagatccctctcgtcgctagtgcctccgtgagcattgaacagttcacagaaaacgccgaagaatgcgccctgaatcagcagatgttcaatagcgatttggaaaaaaaaggggcggaaatcatcaatccaaagactgccctgctgccttccgactctgttttcgccgaagagaggaacctgaagggcatactggaggaatctccttcagaggccgaggacttcatttccggtatcacacaaaccatggtcgaggcggtcgccgaggtagaaaagaatgaaacagtgtctgaaatactgcctagtacttgtatcgtcactctggtgcccggtattcctaccggagacgagaagacggttgacaaaaagaatatttccgagaaaaagggaaacatggacgagaaggaggagaaggaatttaacacaaaagagacacgaatggatctgcaaatcggcacagagaaggccgaaaagaatgagggcaggatggacgctgaaaaagtggagaaaatggccgctatgaaggagaagccagctgagaacaccctgttcaaagcgtacccaaacaaaggcgtcggacaggccaacaagcctgacgaaacctccaaaacgagcattttagccgtttcggacgtttcttcttccaaacctagcatcaaggccgttatagtctccagtccaaaagcaaaggctactgtgtcaaagactgagaaccagaagagttttccgaaatctgtgccacgtgatcagatcaatgcagagaagaagctgagcgcgaaagagttcggcctgctcaagccaacatcggcccgcagtggcctcgctgagtctagttccaaatttaaaccaacccagagttcactgactagaggtggctcaggaaggatctctgcgctacagggcaaattaagcaaactcgactatcgtgacattacgaagcagtcccaggaaactgaagctcgtcccagcatcatgaaaagggatgatagcaataacaaaacgctcgcagagcaaaataccaaaaaccctaagtccacaaccgggagatcctccaaatccaaagaggaaccgttatttccattcaatctggatgagtttgtaaccgtcgacgaggtgatcgaggaagtgaatccttcccaggccaagcagaatcctctgaagggaaagcggaaggagactctgaaaaatgtgccattttctgagcttaacttgaaaaagaagaagggtaagacaagcacgcctcgaggagtggaaggtgaactgtccttcgtaacactcgacgaaatcggcgaagaagaagatgctgccgctcatcttgctcaggctcttgtgacagtggacgaagtcattgatgaggaggagcttaacatggaagagatggtcaaaaattctaattctctcttcacactggatgaactgattgatcaagacgactgcatcagccacagtgagcctaaagatgtaactgttctgagcgtcgccgaggagcaggatctattaaaacaggagaggctcgtgacagtcgatgagatcggggaggttgaagaactccccttaaatgaaagcgccgacattaccttcgccaccctaaacacaaagggcaatgagggcgacaccgtccgcgattctatcgggttcatctcaagccaggtcccagaggacccatccacactggttaccgtcgacgagatccaagatgatagcagcgacctccatctggtaaccctggatgaggtgacagaagaggatgaggactcacttgccgacttcaataatttaaaggaggaattaaacttcgtcactgtcgatgaagtgggcgaagaggaggacggcgataacgacctcaaggtcgagctggcacagtctaaaaatgatcacccaaccgataaaaaaggaaataggaagaaaagagctgtggacaccaaaaagaccaagctggagtccctttctcaggtgggtccggttaacgaaaacgtaatggaagaagatctcaagactatgatcgaacgtcacctgacagctaagactcccactaaacgtgtccgtatcggcaaaacattgccgagcgagaaagccgtggtgacagaacctgctaagggtgaggaggcattccaaatgagcgaggtggatgaggagtcgggactcaaggacagcgagcccgaaagaaagcgcaaaaaaacggaagatagttcctcaggaaagagtgttgccagcgacgtgcccgaggaactggacttcctcgtccctaaggcaggattcttctgccctatttgcagcctgttttatagtggggaaaaagctatgaccaatcattgtaaatctactcggcacaaacagaatacagagaagtttatggcaaagcagcgaaaagaaaaggaacagaacgaagccgaagaacgcagctctcgatag

SEQ ID NO: 212344 - DNA, 90 bp, Artificial Sequence
  Description of Artificial Sequence: Synthetic coding sequence
atgagccggccccggttcaacccccggggcgacttccccctgcagaggccacgtgccccaaaccctagtgggatgcgccctcccggctag

SEQ ID NO: 212345 - DNA, 594 bp, Artificial Sequence
  Description of Artificial Sequence: Synthetic coding sequence
atgagccggccccggttcaacccccggggcgacttccccctgcagcggccgcgcgctccaaacccaagtgggatgcgccctcccgggccctttatgagacccggcagcatgggactaccgcgcttctaccctgcaggcagagctcgtggaatcccgcatagattcgcaggccacgaaagttaccaaaacatgggtccacagcgcatgaatgtacaggttacccagcatcggacagatccacgcttgacgaaagagaagcttgacttccatgaagcccaacaaaagaagggtaaacctcatggaagtcgctgggacgacgaaccccacatttctgcaagcgtggctgttaaacagtccagcgtcacccaggtcacagagcaatctcctaaggttcagtcgaggtacacgaaggaatctgccagctctatcctggcatccttcggcctgagcaatgaggaccttgaagaattaagccgctacccagatgagcagttgacacctgaaaatatgcctctcatcctgcgggatatacgtatgcgcaagatggggcgccgtctgcctaacttaccctctcaatcccggaataaagagtag

SEQ ID NO: 212346 - DNA, 111 bp, Artificial Sequence
  Description of Artificial Sequence: Synthetic coding sequence
atgagccggccccggttcaacccccggggcgacttccccctgcagcgcccccgcgcgccgaacccaagtggcatgagacctcctggccctttcatgagacctgggtcatag

SEQ ID NO: 212347 - DNA, 189 bp, Artificial Sequence
  Description of Artificial Sequence: Synthetic coding sequence
atgagccggccccggttcaacccccggggcgacttccccctgcagcgccctcgggcgccaaaccccagcggcatgcgaccacccggtccttttatgagaccaggaagtatggggctaccacggttttaccccgcaggccgggcacgcggaatcccgcatcggtttgcaggccacgaaagttaccagtag

SEQ ID NO: 212348 - DNA, 189 bp, Artificial Sequence
  Description of Artificial Sequence: Synthetic coding sequence
atgagccggccccggttcaacccccggggcgacttccccctgcagaggccaagagcccccaatccttccggtatgcggcctccaggcccctttatgcgccccggcagcatgggcctgccccggttttacccagctgggagggcccgcggcattccccataggttcgccggccatgaatcttaccagtag

SEQ ID NO: 212349 - DNA, 1758 bp, Artificial Sequence
  Description of Artificial Sequence: Synthetic coding sequence
atggacagcccccccctgaaggccctgaacagcaacagcatctacttcctgctgctgttccattgtatgttgatctccgaggtacagatagaacacgacccggaacttgagaaagaaagccccggcctgaagaactcccctattgacgaatctgaagtccagacagctaccgatagcccatccgtgaaaccaaatgagctggaagaagaatccacaccaagcatccagacggagactctcgtgcagcaggaagaaccttgcgaggaggaagcagagaaagctacctgcgattctgattttgcagtcgagacactggagctggaaacacagggggaagaagtaaaggaagagatccctctggtggcaagtgcctccgtgagcattgaacaatttactgagaatgcagaagagtgtgctctcaaccaacagatgttcaattctgatctggagaaaaaaggtgcggaaattattaaccccaagaccgcgcttctccccagcgattctgtgtttgctgaagaacgcaatttgaaagggatcctggaagaatcccccagcgaagcggaggatttcattagcgggataacacagactatggttgaggccgtagcagaggtggaaaagaacgaaaccgtcagtgagatcctcccctcgacttgcatcgtgaccttggtcccagggataccaacaggtgacgaaaagacagtagataaaaaaaacattagtgagaagaagggaaacatggacgaaaaggaggagaaggagtttaataccaaggagacccggatggatttgcagatcggcactgagaaggccgagaagaatgagggccgcatggatgctgaaaaggttgaaaagatggcggccatgaaagagaagcccgcggagaatacattgttcaaagcctacccaaataagggcgtggggcaagctaataaacccgatgaaactagtaagacgtctattctggctgtctctgacgttagtagtagtaagcctagcattaaagccgtgatcgtttcgtcccctaaggcaaaggcgaccgtctctaagactgaaaaccagaagtccttcccaaaatccgtgcctagggaccaaatcaacgccgaaaagaaactgagcgcgaaggaattcggcctgctgaagcccacatcagccaggtccggtcttgctgaaagctccagcaagtttaagcccacccagagttcattgactagggggggttctggccgtatttctgcgctgcaggggaagctgtccaagctggactaccgcgatatcacaaaacagtcccaggaaacggaagctaggccctccattatgaagagggacgattcaaacaataagaccctggccgaacagaatacaaaaaaccctaagagtactaccgggcgttcctcaaaaagtaaggaggaacccttgttcccttttaacctggatgagtttgttaccgtggacgaggtgatcgaggaggtgaatcccagtcaagccaaacagaaccctctaaagggcaagcgcaaagagacactgaaaaacgttcctttttctgagttgaatctgaagaagaaaaaaggcaagacatcaacacctcgaggggttgaaggagaactaagctttgtcaccctggatgaaattggagaggaagaggatgcagccgcgcatttagctcaggcactggtcaccgtggacgaagtaatcgacgaagaggaacttaacatggaagagatggtgaagttcaagttcaccttttatattaggtag

SEQ ID NO: 212350 - DNA, 3075 bp, Artificial Sequence
  Description of Artificial Sequence: Synthetic coding sequence
atgccccgggacggcgtgcccgccggcaacaccacccccgccgccgctcaagctgcagcacaaagtccagattctgccaccgccggagctccacaggtgttggactccctaaaacgctttgtgttattcctcgaaaattttgcgccattagtcaattccttgaacttaggaattgctaatccactcctgttaggcccctcgccgctgcattttgcccagattaagacccagctcgcactgcagcagcttaacgctgtagcctcccatgggtcaactcccccttatactctgttgaatcaggctttcttaaaaattgccatgtctagaccgcggttcaacccaagaggcgattttcctctccagcggccaagagcccccaacccttccggcatgaggcccccgggtccattcatgcgaccgggctcgatgggtctgccccgtttctatcccgcggggagggcaaggggtattccccatcggttcgcgggtcacgagagctaccagaatatgggcccccagaggatgaatgtccaggttacacaacaccggaccgatccccgcctcacaaaggagaaactggacttccacgaagctcagcaaaagaaagggaaaccgcacggctctcgatgggacgacgagccacatatctctgcctcagtagccgtgaagcagtcatccgtgacccaggtcacggagcagagcccaaaggtgcaatctaggtacactaaagaatctgctagcagtattcttgcttcgttcggactgtctaatgaagatctcgaggagctgagcagataccccgacgagcaattaaccccagaaaacatgccccttatcctgagagatataaggatgcgcaagatgggacgcaggctcccaaacctcccaagccagtcccgcaataaagagactttgggctcggaggctgtgtcaagtaacgtgatcgactacgggcatgcctcaaagtatggttacaccgaggaccccttggaggtacggatctacgatcctgagatccccaccgacgaggtggagaacgagtttcagtcacaacagaacatctctgcgagcgtacccaaccccaatgtgatttgcaactccatgttccccgtggaggacgtctttaggcagatggattttcccggtgagtcctcaaataataggtcatttttctccgtggagtccggcaccaaaatgagcggtctgcatatctccgggggacaatctgtactcgagccaatcaagtctgttaatcagtctatcaatcagaccgttagccagacgatgtcgcaatcactcatacctccctccatgaatcagcaaccattttcgtcagagcttatttcgtcagtgagtcagcaagaacgcattccacacgagcctgtgataaatagctctaacgtgcatgtcgggtctaggggaagtaaaaaaaattaccagagccaggcagacatcccaatccgatcacccttcggtatagtcaaggctagctggttgccaaagttttcccacgcagatgcccagaagatgaaacgtctgccgaccccttctatgatgaacgactattatgcggccagccctcgcatattccctcacttgtgtagtctgtgcaacgtggagtgttcgcacttgaaggactggatccagcatcaaaacactagcacacatatcgaatcgtgcaggcagcttcggcagcagtatcctgattggaatcctgagattctgccctcaagaaggaacgaagggaacaggaaagagaacgaaacgccgaggcggcggtctcatagccctagtcctcgaaggtccagaaggtcaagcagctctcataggttccgaagaagtcgctcccctatgcactacatgtacaggccaagatcccggtcccctcgcatatgccaccggtttatttcccggtacaggagtagatcacggtcgaggtctccgtatcggatcagaaacccctttcgaggatcacccaagtgtttcagatccgttagccccgaacggatgtccagacggtctgtccggtcctccgacaggaaaaaggccctggaagacgtggtgcagagaagcggacacggtaccgagtttaataaacagaagcatctcgaggccgccgacaaaggccatagccccgctcagaaacctaagacgagctcaggtacaaaaccctccgtcaaaccaacgtctgcaactaagagcgattccaacttaggcggtcactctatacgctgcaagagtaaaaacttggaagacgataccctgtcagaatgcaagcaggtgtctgataaggctgtgagtcttcaaagaaaactgcgcaaagagcagtctctgcattatggaagcgtcctgttgatcactgaactgccagaagatggatgcacagaagaggacgtcagaaaactcttccaacctttcggtaaagtcaatgacgtcctgattgtaccttacaggaaagaagcatatctcgagatggagtttaaggaagcaatcacggcaatcatgaagtatatcgagactacccctctgacaattaaagggaaatccgttaagatctgcgtgccaggcaagaaaaaagcccaaaataaggaagtgaagaagaagaccctggagagcaaaaaagtgtcagcttctactttgaaaagagatgcggacgcatcaaaggcagtcgaaatagtcacctcgacctcagcagagtccgttgatcaaacccaacagttagtccctctggtcaggaatacagcccgagatcatgatggaacaccggagaatgagggtgaggagaccgtccagtcggcactttttggattccaatacgacgcaagcgaccacaccatggcctggttaggcccaaataccgtgccagaggtgaaggaaatgattctgcaggacccccagcttcagactactcagcttccacaaacaacgcaggcccctgacattacctggggaatgctcaaaaagacgacttataaagctgaacagattctgctccagacacaaaagccattcaccccagataacttatttttggcattgttgtccggagatgctaaacctgagtacgagcagtag

SEQ ID NO: 212351 - DNA, 1317 bp, Artificial Sequence
  Description of Artificial Sequence: Synthetic coding sequence
atgcaggccgaggaccggagccagttcggcagcgccgccgagatgctaagcgagcaaacagctgccctgggaacaggctgggaatccatgaatgtacagttagacggagccgagccccaggtagagaggggctcccaggaagaaagaccctggcgcactgtgcccggccccctagagcacctgtgctgtgaccttgaagaagaacctcagtccctccaggagaaggcccagtcagccccctgggtccctgccatcccccaggagggtaacaccggggactgggagatggccgctgcactgctcgccgctgggtctcagggcctagtgacaatcaaagacgtgtccttgtgcttttctcaggaggaatggaggagcctggatccaagccagacggacttttacggagaatacgtgatgcaggaaaattgcggaattgtagtgagcctccgctttcctatccccaagctggatatgctctcccaattagaaggaggcgaggagcagtgggtcccagacccccaggatctggaggaacgcgacattttgcgagttacatatacaggagacggatcagagcatgaaggagatacgcctgaattggaagctgagcctcctagaatgttaagcagcgtatcggaggatacagtcttgtggaaccctgaacatgacgagagttgggacagtatgccctcctcctctcgcggaatgctactgggcccccccttcttgcaagaagattcctttagcaacctcctatgcagtaccgaaatggattctctcctcagacctcacacctgtccacagtgcggtaagcagtttgtgtgggggtcccatctagcccggcaccagcagactcataccggcgagcgaccttactcttgcctcaagtgtgaaaagacatttggccgcaggcaccatctgatccgacaccagaagacccatctacatgataagacaagccgatgttcagaatgtggcaaaaacttccggtgtaactcacatctagcgtcccatcagagggtacatgcagaaggaaagagttgtaagggccaggaggtaggcgagagtccgggcacccggaagcggcaacgagcacctcctgtccccaaatgccacgtatgcaccgagtgcggcaagtcatttggacggcggcaccacttggtacgacactggctaacccacacaggcgaaaaaccctttcagtgtccacggtgcgagaagtccttcggacgaaaacaccacttggatcggcacctcctcactcaccaggggcagtccccgcgcaattcttgggacagagggacgtcggtgttctag

SEQ ID NO: 212352 - DNA, 1248 bp, Artificial Sequence
  Description of Artificial Sequence: Synthetic coding sequence
atgctgagcgagcagaccgccgccctgggcaccggctgggagagcatgaatgtccagctggatggcgcagaaccacaggtagagcgaggctctcaggaggagcgaccctggcgtaccgtgccggggcccctcgagcacctatgttgcgatctggaagaagaaccacaaagcctacaggagaaagctcagtctgcaccctgggtacctgcaatcccccaagaaggcaacaccggcgattgggaaatggccgctgccctgctggcagcggggagccaggtgagctcagcatcgctcggcgtctcatgcggaccaattaccgctgcgttcgtcctgctgtcccaccagccgatcgacgagctggctcacatgatcataaatggatttcctatccctaaattagacatgctcagccagctggaagggggggaagaacagtgggtgcctgatccccaggatctcgaggaaagagatattctccgcgtgacctacacgggggacggttcggaacacgaaggagacacgccagagctcgaagccgagcctcctaggatgttgtcttcagtaagcgaagacacagtgctgtggaaccctgaacatgatgagtcttgggacagtatgccatcctcatctcgtgggatgctccttggccccccattcctgcaggaggactctttcagcaacctcctttgtagtaccgaaatggatagcctgttgagacctcatacttgtccccagtgtgggaagcagtttgtctggggcagccaccttgctcgccaccagcagacacacaccggcgagcgcccctatagctgcctgaagtgcgaaaagacattcggcaggcgccatcacctaattcggcaccaaaagacacacctgcatgacaaaaccagccggtgtagtgagtgcggaaagaattttcgctgtaacagccatctggcgagccaccagagggtacacgcagaaggcaagtcgtgcaagggccaagaggttggcgagagtccgggaacccgcaagcgccagcgggcccctcctgtgcctaaatgccacgtctgcactgaatgtggtaagtcatttggtaggaggcatcatcttgtcaggcattggctgacccacacaggagagaagccattccagtgtccccgctgcgagaaatccttcggccgaaagcatcacttggaccgtcacctactcacccatcaggggcaatctccccgcaactcatgggaccgcggaacatcagtcttctag

SEQ ID NO: 212353 - DNA, 1317 bp, Artificial Sequence
  Description of Artificial Sequence: Synthetic coding sequence
atgcaggccgaggaccggagccagttcggcagcgccgccgagatgctgtctgaacagactgcagcactgggcacaggctgggagagcatgaatgtgcagctggatggcgccgagccccaggtggagcgcggctctcaagaagaaagaccctggagaacagtaccagggcccctggaacatctgtgctgtgacctggaggaggagccgcagagccttcaggagaaggcacagtctgctccatgggtgccagccattccacaagagggaaatacaggggactgggaaatggctgcagctttgctcgcggccgggtctcaagggctagtgacgatcaaggacgtgtccctctgcttcagccaggaggaatggcgcagcctggatcccagccagaccgacttctacggtgagtacgtgatgcaggagaactgtggcatcgtggtcagtcttcggtttccgatccccaagttggatatgctttctcagctggagggtggggaagaacaatgggtgcctgacccgcaggatctggaagaaagagatatccttcgagttacttacacaggggacggtagcgaacacgaaggggatactccagagcttgaggctgaacctccccgtatgctctcatcggtctcagaagatacggtgctttggaatcccgagcatgatgaatcgtgggactctatgccctcttcctcccggggcatgctgctcggtcctcccttcctacaggaggattcctttagcaatctcctgtgcagcactgaaatggatagcctgttgaggcctcacacgtgtccccagtgcggaaagcagtttgtgtggggttcacacctggccaggcatcagcagacgcacacaggggagcggccttatagctgtctgaagtgtgagaaaaccttcggccgaaggcaccatcttatccgccatcagaagacacatttgcacgataagacgtccagatgcagcgagtgcggcaagaacttccgctgtaacagccatctagcctctcaccagcgagtccacgctgaggggaagtcctgcaaagggcaggaagtaggagaatcccccggaacaagaaagcgccagcgggcgccacctgttcccaagtgccacgtgtgtaccgagtgcggtaaatcctttgggcggagacaccaccttgtgcgtcattggctcacacacaccggggagaagccctttcagtgcccccgctgcgaaaaaagtttcggcaggaagcaccaccttgatcgacatctccttacacaccagggccagagcccaagaaatagttgggatcgtgggacctccgtgttttag

SEQ ID NO: 212354 - DNA, 1275 bp, Artificial Sequence
  Description of Artificial Sequence: Synthetic coding sequence
atgctgagcgagcagaccgccgccctgggcaccggctgggagagcatgaacgtgcagctggatggagccgagcctcaggtggaacggggttcgcaggaggaacggccatggaggacagtacccggccccctggagcatttgtgctgtgatctggaggaagagcctcagtccctgcaggagaaagcacaaagcgctccctgggttccggctataccccaggagggcaacacaggagattgggaaatggccgctgccctgcttgcggcggggtcccagggccttgtcacaatcaaagacgtgtccctgtgtttttcccaggaagagtggaggtctctggaccctagccaaaccgatttttacggggaatatgtcatgcaagagaactgtggcatcgttgtgagcctgcgcttcccgattcctaagctggacatgctgtcacagcttgaagggggagaggagcaatgggtgccagaccctcaggatctcgaagagagagatatccttagagtcacctatacgggggatggcagcgagcacgagggggacacacctgagttagaagccgaaccgccacggatgctctccagcgtgtcagaagataccgtgctctggaatcccgaacacgacgagtcctgggatagcatgccctcgtctagcagggggatgttattggggcctcccttcttgcaggaggattcattctccaacttactgtgcagcaccgaaatggattccctcttgagaccacacacctgtccgcagtgtgggaagcagtttgtttgggggagccacctcgcacggcatcaacagacccacacaggcgaacgaccttattcttgcttgaaatgcgagaaaacatttggcagacggcatcacctgatcagacaccagaagactcacctgcacgacaaaacctcacgctgctctgaatgtggaaagaacttccgctgcaatagccatctcgcttcccatcagcgcgtacacgccgaagggaaatcctgtaaaggccaggaggtcggcgaatctcccgggactcggaagcggcagagggcacccccggtacccaagtgccacgtttgtactgaatgcggcaaaagttttggccgcagacaccatttggttcgacactggttaactcacactggcgagaagcccttccaatgtcccaggtgcgagaagtcatttggcagaaaacatcaccttgaccgccatctgcttacacatcagggccagtcgccccgcaactcctgggatcgtggtactagtgtcttctag

SEQ ID NO: 212355 - DNA, 411 bp, Artificial Sequence
  Description of Artificial Sequence: Synthetic coding sequence
atgcaggccgaggaccggagccagttcggcagcgccgccgagatgctctctgagcaaacagccgctcttggcaccggctgggaatcaatgaacgtccagctggatggtgcggagccgcaagtcgaaaggggatcccaggaggagaggccatggcggacggtccctggccccctggaacatctgtgctgtgacctcgaggaggaaccccaatccttacaagagaaggcgcagtcagcaccctgggtccctgctattccgcaggagggcaataccggggactgggagatggccgccgctctgctcgcagccggaagtcagggactcgtgaccattaaggacgtgtcactctgcttctcacaagaggaatggcggtccttggacccttcccaaacggacttctacggcgaatag

SEQ ID NO: 212356 - DNA, 324 bp, Artificial Sequence
  Description of Artificial Sequence: Synthetic coding sequence
atgctgagcgagcagaccgccgccctgggcaccggctgggagagcatgaatgtgcagctggacggggccgaacctcaagtagagcgcggctctcaggaggaacggccttggcggactgtgcccggaccactggagcacctatgttgtgacctcgaggaggagccccagtcattacaggagaaagcccagagcgccccttgggtgccggcaattccccaagaaggaaataccggggattgggaaatggcagctgctttgctggcggccggatcacagggacttgtgactatcaaggatgtcagcttgtgcttctcacaagaatag

SEQ ID NO: 212357 - DNA, 234 bp, Artificial Sequence
  Description of Artificial Sequence: Synthetic coding sequence
atgctgagcgagcagaccgccgccctgggcaccggctgggagagcatgaatgtccaactggatggcgccgagccgcaggtggaacgagggtcccaagaagaacggccttggcgtaccgtcccaggccccttagagcacttatgctgcgatttagaggaggaaccacagagtctgcaagaaaaggcccagtctgcaccctgggttccagccatcccacaagaaggaaacacatag

SEQ ID NO: 212358 - DNA, 3984 bp, Artificial Sequence
  Description of Artificial Sequence: Synthetic coding sequence
atgcggagcttcctgcagcaggacgtgaacaagaccaagagccggctgaacgtgcttaatgggcttgcaaacaacatggatgacctcaagatcaatactgacatcacaggcgccaaggaggaactgctagacgataataattttatatccgataaggaaagcggggtccacaagccgaaagactgccagactagttttcagaaaaacaatacgctgacgcttccagaagagctgagcaaagacaagtcagagaatgcactctccggtggtcaatcgagcctatttatacacgcaggtgcccccacagtaagcagcgagaacttcatcttacccaaaggagctgctgtgaacggccccgtctctcatagctctctgaccaagacatctaatatgaacaagggtagtgtgtctttaacaaccggccaacccgttgaccaacctaccacagagtcatgcagcactctcaaagtggccgccgatttgcagctcagcacgccccaaaaagccagccaacaccaagtgctgtttctgctctctgacgtggctcacgctaagaatccaacacacagcaacaaaaagctgcccaccagcgcaagcgtaggctgcgacatccagaactccgtcggctctaatatcaagagcgacggaacactgatcaaccaggtggaagtcggagaggacggagaggatcttttagttaaagacgattgcgtgaatactgttaccggcatcagttcgggcactgatggcttccgctcagagaacgataccaactgggatccacagaaggagtttattcagttccttatgaccaatgaggagacagtcgacaaggcccctcctcacagcaaaatcggcctagagaagaagagaaaacgtaagatggacgtttctaaaatcacaaggtataccgaagactgcttttctgacagcaactgcgtgcctaacaagtccaagatgcaggaggtggattttctcgagcaaaatgaagaactgcaggctgtggatagccagaagtatgcgctcagtaaagtgaagcccgaatccactgatgaggatttggagtccgtggatgctttccagcacctcatctacaacccagacaagtgtggtgaagagtcatcaccagtgcataccagcacattcctgtctaacaccctaaagaagaagtgcgaagagtctgacagcgaaagcccagcgactttcagtactgaggagccgtctttctacccatgcaccaagtgcaatgtgaactttcgggagaaaaaacatctccatcggcacatgatgtatcatcttgacgggaactcgcactttcgccacttgaatgtgcccaggccatacgcctgccgcgagtgtgggcgcaccttcagagataggaactccttgctgaaacacatgattattcaccaggaacgccgacagaaacttatggaagaaatcagagaattgaaggagctgcaggacgaggggcgctccgccaggctgcaatgtccgcaatgtgtctttggtaccaactgtccaaagacttttgtgcagcacgcaaagactcacgagaaagacaagagatactattgttgcgaagagtgtaatttcatggccgtgactgaaaacgaactcgagtgtcaccgggggatcgcacacggagcagtcgtcaaatgccctatggtaaccagtgatattgcacaaaggaagactcagaagaaaaccttcatgaaagatagcgtggttggaagcagcaaaaagtctgcgacttatatttgtaagatgtgcccattcacaacttccgccaagagtgtcctaaagaagcacacagagtacctgcactcttcctcctgcgtggactcctttggctcccctctggggcttgacaaacgcaaaaacgacattttggaggaacccgtagatagcgactcaaccaagactttgaccaagcaacagagcactactttccccaagaattcagcattgaagcaggatgtgaaaagaacatttggctcaaccagccagagtagcagcttcagcaagatacacaagcgtccccaccgtatccagaaagctcgtaagagcatagcacaatctggcgtgaacatgtgcaatcagaattcttcccctcacaagaatgtgaccattaagtcctcagtggatcagaagccaaagtatttccaccaggccgctaaggagaagtccaatgctaaggcaaacagccactatctgtaccgtcacaaatatgagaactatcggatgatcaagaaaagcggcgaatcctatcccgtgcactttaaaaaagaagaggcatcaagccttaattcattgcatctgttttcttcttctagtaattcacacaataacttcattagtgatccacacaagcccgatgctaagcgccctgaaagttttaaggatcaccgtcgcgtcgccgtgaagcgggtgattaaggagagtaagaaggagtcttccgtggggggggaggacctggattcttatcccgattttcttcataaaatgaccgtcgtggtactccaaaaactgaactccgcagagaagaaagattcatacgagacagaggatgaatcttcctgggacaacgtggagctgggtgattacacgacccaggcaatcgaagacgagacatactccgacattaaccaggagcacgttaacctcttccccctttttaagagcaaagtggaaggccaggagcccggggaaaacgctaccctgtcatacgatcagaatgatggtttttatttcgagtactatgaggacactggcagcaataattttctgcacgaaattcacgaccctcaacatcttgaaactgctgacgcctctctctccaagcacagctcagtctttcactggaccgatctgtcactggagaagaagtcttgcccgtactgtcctgctacttttgagaccggcgtcggtctgtctaatcacgtgagggggcacttgcacagagcaggcttatcttatgaggcaaggcacgtagtaagccccgagcagatcgcgaccagcgataagatgcagcatttcaaaaggactgggacggggactcccgtaaaacgggttagaaaggctatagagaagtctgagacgacgtcggaacatacatgccagctgtgcgggggttggttcgatacaaaaataggactgagcaatcacgttcgcggccacctaaagaggctgggaaaaaccaagtgggacgcgcataagtctcccatctgcgtactgaatgagatgatgcagaacgaggagaaatatgagaagatcctgaaggccctgaattcccgacgaatcattccccgccccttcgttgcccagaaattggcatcctccgatgattttatctcccagaacgtgattcccctcgaagcctatcgcaatgggttgaagactgaggcactgtccgtgtcagcttccgaggaggaggggttaaattttctcaatgaatacgatgagacaaagcccgaactgcccagtggtaaaaaaaaccagagtctcaccctgatagagctcctgaaaaacaaaaggatgggtgaggagcgaaatagcgcaatctcgcctcagaaaattcacaatcaaaccgcaaggaaaagatttgtacaaaaatgtgtcctaccgctcaacgaggacagcccattgatgtaccagcctcagaagatggacctgactatgcacagtgcccttgactgtaagcagaagaaatcccggagccggtctgggtccaagaagaaaatgcttacgctgccgcacggagccgacgaagtgtacattctgaggtgccggttctgcggcctggtgttccggggaccactcagcgtgcaggaggactggattaagcatcttcagagacacattgtgaacgctaacctgccacgaacgggtgcaggtatggtggaggtgacatcactgttaaagaaacccgcctcgatcacagagactagtttctcactgctgatggctgaggctgcttcctag

SEQ ID NO: 212359 - DNA, 318 bp, Artificial Sequence
  Description of Artificial Sequence: Synthetic coding sequence
atgctgatccggcagaacctggccctggactgcaagcagaagaagagtaggagtcgtagtggatccaaaaaaaagatgcttacactgccccacggtgctgacgaagtgtacatcctcagatgcagattctgcggcttagtatttcgcggacccttgagcgtgcaggaagactggattaagcatctccagagacacattgtaaatgcaaacttgccccggacgggtgcaggcatggtggaggtgacaagtctcctaaaaaaacctgcctccattacagagactagttttagcctattaatggccgaggcagcgagctag

SEQ ID NO: 212360 - DNA, 318 bp, Artificial Sequence
  Description of Artificial Sequence: Synthetic coding sequence
atgctgatccggcagaacctggccctggactgcaagcagaagaagtctagaagtcgttctggtagtaaaaagaaaatgctgacgttgccacatggtgccgacgaggtctatatcttgaggtgccgattttgtggcctggttttccgggggcctctgtctgtgcaggaagattggatcaagcatctccaaaggcacattgtcaatgctaatctccctaggaccggagctggcatggtagaggtgacaagtttgcttaagaaacctgcctccatcacggagacctcatttagcttgcttatggccgaggctgcttcttag

SEQ ID NO: 212361 - DNA, 3984 bp, Artificial Sequence
  Description of Artificial Sequence: Synthetic coding sequence
atgcggagcttcctgcagcaggacgtgaacaagaccaagagccggcttaatgtattaaatggactagccaacaacatggatgacttgaagatcaatactgatattactggggctaaagaggaactgctggatgataacaattttattagtgataaggagagcggagttcataaacccaaggactgccagacaagcttccaaaaaaataatacccttacattgccagaggaactgtctaaggataaatccgagaatgcgctctcaggggggcagtcctctctcttcatccatgcaggcgcacccactgtgtccagtgaaaattttattctgcccaaaggggcggccgtgaacggccccgttagccactcaagcctgacaaagacatctaatatgaacaagggaagcgtctcgttgaccactgggcagcctgtggatcaacccacaactgaatcctgcagcaccctgaaggtagctgctgatctgcagctgtctactccgcaaaaggcatctcagcatcaagtgctcttcctgctctctgacgttgcgcacgctaagaaccctacacactctaataagaaactccctacatctgcgtcagttggatgcgacatccaaaattccgtgggctccaacatcaagtctgacgggacgctaattaaccaggtggaggtgggtgaggacggtgaggaccttctcgtcaaggacgattgtgttaacacagtgacaggcatatcatccgggaccgacggtttccggtcagaaaatgacacaaactgggatccacaaaaagagttcattcagtttctaatgactaacgaggagacagtcgacaaagcgccaccgcattcaaagatcggacttgaaaaaaaacggaagcgaaagatggacgtgtctaagatcacgcggtataccgaggattgcttcagcgatagtaactgcgtgcctaataaaagcaaaatgcaagaagtcgattttctcgagcagaatgaagaactgcaggcagtggatagtcagaagtacgcacttagcaaagtcaagccggaatctaccgacgaagatctagagtccgtggatgcctttcagcacctcatttacaaccctgacaagtgtggcgaagaatctagccccgtgcatacgtccacttttctatctaacactttgaaaaagaagtgcgaagagtccgactccgagagccccgcgacattctccaccgaagagccgtccttttatccctgcaccaaatgcaatgtgaacttcagagagaaaaagcacctgcatcgacatatgatgtatcacttagatggcaattctcacttcaggcacctcaatgtcccaaggccctatgcttgccgtgagtgtggaaggacattcagggacagaaattcattgctgaagcacatgattatccaccaagaaaggaggcagaagctgatggaagaaatacgcgaactgaaggaattgcaggacgaaggcagaagcgctcgactacagtgccctcagtgtgtgtttggtactaactgtccaaaaacttttgttcagcacgccaagacccacgaaaaagacaaacgatattactgctgcgaggaatgtaacttcatggcagttactgaaaacgagctggagtgccaccgaggaattgcgcatggggcagtggtcaagtgtcccatggtaacatccgacatcgcccaacggaagactcaaaagaaaaccttcatgaaggacagcgttgtaggtagcagtaagaaaagtgccacatatatctgcaagatgtgcccctttactacttctgcaaagtcagtcctgaaaaagcacaccgagtatctacattcatcctcctgcgtggactcctttgggtccccgctggggctggacaagcgcaagaatgacatactcgaggaacccgtcgacagcgacagcaccaaaacgctcacaaagcaacagagcacgacgttccccaaaaacagcgctctgaagcaggatgtgaaaagaactttcgggagcacaagccagtcatcttcgtttagtaaaatacataagcgccctcaccgaatacagaaagcaagaaaaagtattgcccagagtggcgtcaacatgtgcaatcaaaattcctcgccgcataagaatgtgaccatcaagtcctcggtggaccaaaaaccaaaatacttccatcaggccgctaaggaaaaatcaaatgcaaaggctaatagtcattacctctaccgacacaagtacgaaaactatcgtatgattaaaaagagcggagagtcatatcccgtgcacttcaaaaaggaagaggctagctctctgaattctctgcacttattcagttcatcttccaacagtcacaacaactttatcagtgatccccacaaacccgacgcgaagagacctgagagttttaaggaccaccggagggtggcagtgaagcgcgtgataaaggagtctaagaaggagtcgtcagtaggaggtgaggatctcgattcttaccccgatttcctccacaagatgacagtggtcgtgctgcaaaaactcaactccgccgaaaagaaggactcctacgaaactgaggacgaatcgtcttgggataatgtagaacttggggactacactacccaggcaattgaggatgaaacatactctgacatcaatcaagaacatgtgaacctgtttcccctgttcaagtctaaagttgaaggacaggaaccaggtgagaatgccacactttcatacgaccagaacgatgggttttactttgaatattatgaagatactgggagcaataatttcctacacgagatccacgacccacagcatttggaaacagccgacgcctcactttccaaacacagtagtgtgttccactggacagacttaagcctcgaaaagaagtcgtgcccttactgccccgcaacttttgaaactggtgtgggacttagtaatcacgtaagagggcacctgcacagggcaggcctatcttacgaggcaaggcacgtagttagcccagagcagattgcaactagcgacaaaatgcagcattttaagcggaccggcactggtacccccgtcaagcgggtgcggaaggcaatcgagaaaagtgaaaccacgtctgaacacacttgccagctatgtggcggctggttcgatacaaaaataggactgtccaaccacgtgcgtggccacttaaagcggttgggcaagaccaaatgggatgctcataagtcaccaatctgtgtgcttaatgaaatgatgcaaaacgaagagaagtacgagaagattctcaaagctctcaactcccggcgtattattccacgtccgttcgtcgcacagaagctggccagttctgatgattttatatctcagaatgtgataccactggaggcctacagaaatggcctgaagacagaagcgctgagcgtgtccgctagcgaggaggaaggtctgaacttcttgaatgaatacgacgagacaaaaccagaactcccttctggcaagaaaaaccagagcctgacacttatcgagctcctgaagaacaaacgcatgggagaagaaagaaattctgccatctctccacagaaaatccacaatcaaaccgccagaaaacgctttgtacagaagtgtgttctgccattaaacgaggattccccattaatgtatcagccccaaaaaatggacttgacaatgcactctgctctggattgcaaacagaaaaagagtagaagtcggagcggatctaagaagaagatgctcacgctacctcatggggcagacgaggtgtacatcctgcggtgtagattttgcgggttggtgttccgaggcccactctccgtccaggaggactggataaagcatcttcagaggcacatcgttaacgctaatctgccgcggacgggcgccgggatggtggaggtcacatctctgctaaaaaaacctgcctcaattacagagacttctttctctttgctaatggcagaagcggcctcctag

SEQ ID NO: 212362 - DNA, 1953 bp, Artificial Sequence
  Description of Artificial Sequence: Synthetic coding sequence
atgatgtaccacctggacggcaacagccacttccggcacctgaacgttccccgtccttacgcttgtagggagtgtgggagaacctttagagacaggaattcactactcaaacacatgattatccatcaggagcgcagacagaagttaatggaggaaatcagggaattaaaggagctgcaagacgagggcaggagtgcccggcttcagtgtcctcaatgcgtgtttgggacgaattgtcctaagactttcgtccaacacgcaaagactcatgagaaagataaacggtactattgttgcgaggagtgtaatttcatggccgtaacagaaaacgaattagaatgtcacaggggcatcgctcacggagccgtcgttaaatgtccaatggtgaccagtgatattgctcagaggaagacccaaaagaaaactttcatgaaggattccgtggtgggtagctccaagaagagcgcaacctacatttgcaagatgtgcccctttactaccagcgcaaaaagtgtgctgaagaagcacactgaatacctgcattcctccagttgcgtggactccttcggtagccctctgggccttgacaaaagaaaaaatgacatcctggaagaacctgtggactctgacagcacaaagaccctaacaaaacagcagtccaccaccttccccaagaattctgccctcaagcaagacgtaaagaggaccttcgggtcgacatcacagtcgtcatctttctctaagatccataagaggcctcacagaatccagaaggctcggaagtcgatagctcagtctggcgttaacatgtgcaaccaaaactcttctcctcataagaacgtcaccatcaaaagctccgtggatcagaaaccaaaatacttccaccaggccgccaaggagaagtcaaacgccaaagcaaacagtcattatctataccggcataagtatgagaactaccgcatgattaaaaagagcggtgagagctatcctgtgcacttcaagaaggaagaagcctcatctctcaactcgctgcacctgttctcttcgtccagcaatagccacaataactttatcagcgacccccataagccagacgcgaagcgcccagaaagcttcaaggatcatcgccgggtggctgtgaagagggtgatcaaagaatcaaagaaggagtcctccgtggggggcgaggatctcgattcctatccagattttctgcataagatgaccgtagtagtgctgcagaaattgaattctgctgagaaaaaagatagctacgagacagaggatgaaagcagttgggacaacgtggagcttggcgactacacgactcaagccatagaagacgaaacatacagcgatattaatcaagagcacgtgaacctgttccctctttttaagagtaaagtggagggacaggaaccaggagagaacgcaacgctgtcttatgatcaaaacgatggcttttactttgagtactatgaagacactggatctaacaattttctgcatgagatccatgacccacagcacctcgagaccgccgacgcatctctgtccaagcattcttcagttttccattggacagacctatctctcgaaaaaaagtcttgtccctactgccccgcgacattcgagactggcgttggcctgtctaaccatgtcaggggccatctgcatcgagccggcttgagttacgaggcgcgccatgtagtcagtcccgagcagattgccacatcagataaaatgcagcattttaagcggacaggtacagggacccccgtgaaacgagtgcggaaggcaatcgagaagtctgagaccacctccgagcatacttgtcagttgtgtggggggtggtttgacactaagattggcttatctaatcatgtacgtgggcatttgaaacgcctgggaaaaacaaagtgggatgcccacaaatcgccaatctgcgtctag

SEQ ID NO: 212363 - DNA, 924 bp, Artificial Sequence
  Description of Artificial Sequence: Synthetic coding sequence
atgcggagcttcctgcagcaggacgtgaacaagaccaagagccggctaaacgtgcttaacgggctggcgaacaatatggacgacctgaagattaacacagacatcacaggcgcgaaggaagagctgttggacgacaataattttatctccgataaggagtctggcgttcataagcccaaggactgccagacatctttccagaaaaacaataccttaaccctccccgaagagctgtcaaaagataagtccgagaatgcattgtctggcgggcagtcatctctgttcatacacgccggcgccccaacagtgtctagtgagaatttcattctgcccaagggtgctgctgtcaacggcccggttagccatagctccctgaccaagactagtaacatgaacaaagggagcgtttccttgaccacagggcagcctgtggatcaaccgacaactgagtcgtgcagtaccctcaaggtagccgcggacctccagctgagcaccccgcagaaagcatcacagcaccaggtgctgttcctgctgtctgacgtcgcccacgcaaagaacccgacccacagtaacaaaaaattacctacctctgcgtccgttgggtgcgatatccagaactccgtaggcagcaatatcaagtcagatgggacgctgattaatcaagtggaagtgggggaggatggagaggatctccttgtgaaagacgattgcgtgaataccgtgacgggcatctctagtggaaccgacgggttcagatccgagaacgatacaaattgggaccctcagaaagagtttatccagttcttaatgactaacgaggaaacagtcgacaaagcacccccgcattcaaagattggccttgagaagaagaaggcaaaaaacggatgcaaacaggacaatagtctctaccgcggactcctctag

SEQ ID NO: 212364 - DNA, 1518 bp, Artificial Sequence
  Description of Artificial Sequence: Synthetic coding sequence
atgaccaaggcccaggagagcctgaccctggaggacgtggccgtggacttcacttgggaggagtggcagtttttgtcacccgcgcagaaggacctctacagggacgtgatgctagagaactattctaatcttgtgtccgtgggttaccaagctgggaagcctgatgcactgaccaaactggagcagggtgaacctctctggaccttggaggatgaaatccattcaccagctcatccagaaattgagaaagccgatgatcaccttcagcagcccctccagaaccaaaaaattctgaagcggacgggacaaaggtatgagcacggccggacgttaaagtcatatttggggctgaccaatcagagcagacgctataatcgcaaagaacctgcggaatttaacggagatggtgcattccttcatgataaccatgagcagatgccaactgagatcgagttccccgagtcgcggaagccaattagtactaagtcccagttcctgaagcaccaacagacccataatattgaaaaggcacacgaatgtaccgattgcgggaaagccttcctgaagaagtcccagcttactgagcataagaggattcataccgggaagaagccgcatgtctgcagtttatgtggtaaagccttttataagaaatataggctgaccgaacacgagagagcccaccgcggtgagaaaccacatggatgttccttgtgtggaaaagctttttataaacggtacagactgaccgaacatgagcgtgcacacaagggggaaaagccctacgggtgtagcgagtgcgggaaggcttttccacgcaagtctgagctaacagaacatcagaggatccatactggcattaaaccgcaccaatgtagcgagtgcgggcgggcattttcacggaaatccctcctggtggtgcaccagaggactcatacaggcgagaaaccccacacatgtagtgaatgcggcaaggggtttatccagaaggggaatctcaacattcaccagaggacccacaccggcgagaagccctacggatgcatcgattgcggtaaagcatttagccagaagtcctgcctggtggcgcatcaaaggtaccacaccggaaagactccgttcgtatgcccggaatgcggacagccatgcagtcagaaatctgggctgatccgccaccaaaaaatccacagcggcgaaaagccctacaagtgcagtgattgcgggaaggcttttctcaccaaaactatgcttatagtccaccaccgtacccatacaggcgagaggccctacgggtgcgacgagtgtgaaaaggcgtatttttatatgtcctgtttagttaaacataagaggatccatagccgggagaagagaggcgactccgttaaggtcgaaaatccatccacagctagccactcactgagcccttctgagcacgttcaaggtaagtctccggtaaacatggttaccgtggctatggtcgctggccaatgcgagtttgcgcacatactgcatagttag

SEQ ID NO: 212365 - DNA, 1833 bp, Artificial Sequence
  Description of Artificial Sequence: Synthetic coding sequence
atgcccagcgcccggggcaagagcaagagcaaggcccccatcaccttcggggatcttgctatctacttcagccaagaagaatgggagtggctgagtccaatacaaaaggacctgtatgaggacgtcatgcttgaaaattaccgaaatctggtctctctgggactgagttttcgtaggcccaacgtgataacccttctcgagaaaggcaaggctccctggatggtggagccagtccgcagaagacgcgcacctgactcaggatccaagtgcgaaacaaagaagctgccaccgaaccagtgcaacaaatcgggacagtccatctgccagaaactggtcagtgcccagcagaaggcacctacgcgcaaaagcggttgtaataagaactccgtgcttgtcaaaccgaagaaaggccacagtggaaagaagccactgaaatgcaatgactgtggaaagactttctcccgaagcttctccttaaagctacaccaaaacattcacaccggggaaaagccattcgagtgcagtaattgtcgcaaggctttccgccagatctcctccatcttgctgcaccagcgaatccactccggaaagaagtcacacgagtgcaacaaatgtggcgagagtttcaaccagcggaccactctgatacttcacatgagaatacacgatggaaaggagatcctggattgtggcaaggctctgtcccagtgccagagcttcaatattcatcagaagattcacgtcgtgggtaacgtgtgccagtgccgaaagtgcgggaaggcgtttaaccagatgtcttcccttcttctccacaagaagatacataacggtaaaaagacacacaaatacaacaagtgcggccgcggcttcaaaaagaagagcgtctttgtggtacacaagcgcattcacgctggcgaaaagatccccgagaacgctaaggcattgtcacagtcactccagcagcggagccaccacttagagaacccctttaaatgcaggaagtgcggaaagctgtttaaccgtatatcaccgctgatgctacatcagcggattcacacgagcgagaagccctacaagtgtgacaagtgcgataaattctttaggagactttctactttgatacttcatctgaggattcacaacggtgagaagctctaccggtgtaacaagtgtgaaaaggtgtgcaatcgacatagctccctgattcagcatcaaaaagtacacaccaaaaaaaaaaagcttttcgagtgtaaagagtgcggaaagatgttttcgggcacggccaacttaaagattcaccagaacattcatagcgaagaaaagccattcaaatgcaataaatgctccaaggtatttggtaggcagtcctttttgattgagcaccagcgcattcacactggagaaaaaccttaccaatgcgaggagtgcggaaaagccttttctcataggatatcactgacacggcacaaaagaatccacacagaagaccggccttacgagtgcgatcagtgtgggaaggcattttctcagtccgctcacctggcacagcacgaaagaatacatacaggagaaaagccatatacttgcaaaacctgcggtaaagctttttcccagcgaacctctctgatattacatgagagatctcacaccggtgaaaagccttacgaatgcaatgagtgtggcaaggccttctcttccggatctgacttaatccggcatcaaaggtcccactcaagcgagaagccttacgagtgctcaaagtgcggaaaagcctacagtcgatcatcctctctgatacgccaccagaacacccattctgaggagaaggcgtag

SEQ ID NO: 212366 - DNA, 2217 bp, Artificial Sequence
  Description of Artificial Sequence: Synthetic coding sequence
atgcggaccctggtgaacgccctgagcggcggcggccaggagatcaaacccgaggggaaatgcgcccacaatggaatgtgcttccggtgtgaggaggtcgcaccagacacttgcgaggcctatccttatcccggtctggtcgtgtcagtggccgggaaagaagggcctaaccccgatcataaaagaggctttctggatctggcccaggaagggattcaggccttaccatatcagctatccgctcatttaagcgtctggaccctgaagggagaagagagaatgccaagtgccaggggcaaatcaaagagcaaggcccccattacgtttggggaccttgcaatctatttctcccaggaggagtgggagtggctgtctcccatacaaaaggatttgtatgaggatgtgatgctcgagaactaccgaaatttggtgtcactgggcctgagttttaggagaccaaatgtcataaccctgctagagaagggcaaggccccttggatggtagagccagtgcgacgaagaagagcccctgagctcgtgaccgtggctctctttagttcctttggagaagtgatgttctcccgaatggtcctgatgctcatggacgtgtgtcaatacctcgtgattgacgaactcgattcggggagcaagtgtgaaacaaagaagcttccacctaaccagtgtaacaaaagcggacagagcatctgccagaaattagtttccgctcaacaaaaagcacccacacgcaaatccgggtgtaataagaactccgtccttgtcaaacctaagaaaggccattccggaaagaagcctctgaaatgtaacgattgtggcaagactttttcccgtagcttttcccttaaactacaccaaaacattcacaccggtgagaagcctttcgagtgctctaactgtcggaaagcattccgtcaaatctctagcatcctgctgcatcaaagaattcacagtggtaaaaagtctcacgagtgtaataagtgtggcgaaagtttcaaccaaagaactaccctgattttgcacatgaggatccacgatggaaaggagatcctcgactgcgggaaagccctctcccagtgtcagtcgttcaatatccaccaaaaaattcatgtagtaggtaacgtatgtcagtgtcgaaagtgtggcaaagcctttaatcagatgagctctctcctgctgcacaaaaagattcataatggcaagaaaacccataaatataataagtgcggtcggggatttaagaaaaaaagcgtctttgtcgtgcataaacggatccacgcaggtgaaaaaatccccgagaacgctaaagccctgtcccaatccctgcagcagcgatctcaccatctcgaaaaccccttcaagtgcagaaagtgtgggaagctctttaatcgaatcagcccactgatgctgcatcagcggatccacactagtgaaaaaccttataaatgtgataagtgcgacaagtttttccgcaggctgtctacccttatactgcacttgcgcattcataacggcgagaagctgtaccgatgcaacaaatgcgagaaggtatgcaacaggcactctagccttattcagcaccaaaaagtgcatacaaaaaagaagaaactgttcgaatgtaaggagtgcggcaaaatgttttcaggcaccgccaatctgaagattcatcaaaacatccactctgaagagaagccttttaagtgcaacaaatgtagcaaggtttttgggcgacagtctttccttatcgaacatcagcgcatccacacaggggaaaaaccttaccaatgcgaagagtgcggcaaagctttctctcatcggatttcgttaacccggcataagaggattcacacagaggatcgcccatacgaatgcgaccagtgcggaaaggcattcagccagagcgcccatcttgcacagcacgagcggatccacacaggtgagaagccttacacatgcaagacttgcggcaaggctttctcacagagaacttctcttatactccatgagcggagccataccggggagaagccttacgagtgtaatgagtgtggaaaggcttttagctctgggagcgatctgattcgtcaccaacgatctcactcctccgaaaaaccatacgagtgcagcaagtgtggaaaggcttattccagaagctctagtctgattaggcaccagaacacccacagcgaggaaaaagcgtag

SEQ ID NO: 212367 - DNA, 975 bp, Artificial Sequence
  Description of Artificial Sequence: Synthetic coding sequence
aagaacagcgtgctggtgaagcccaagaagggccacagcggcaagaagccgctcaagtgtaatgattgtgggaagactttcagccggtcattctcactgaaattgcatcagaacattcacacaggggagaagccattcgaatgtagtaactgtagaaaagcttttagacagatcagcagcatccttctgcatcaacgaatccacagtggaaagaagtctcatgaatgtaacaagtgcggcgaatccttcaaccagcggaccacactgatcctccacatgaggattcacgatggaaagaaccctttcaagtgcaggaagtgtggcaaactattcaataggattagcccgcttatgcttcatcagcggatccacacaagcgagaaaccctacaaatgcgaagagtgcggtaaaatgttctctgggaccgccaacctgaaaatacatcagaacatccacagcgaagagaaaccatttaagtgtaacaaatgcagcaaagtgtttggcagacagagcttcctgatcgagcaccagcggatccacaccggagagaaaccttaccagtgtgaggaatgcggcaaggcattctcacaccgtatctctctgacaaggcacaagcgcattcacacggaggaccgaccgtatgagtgcgaccagtgcgggaaggcgttttcccagtcagcccatctggcgcagcatgagcgaatccatacaggtgaaaaaccttacacctgtaagacctgcggcaaggctttctcacagcgcacatctctgattctgcacgagcgttctcacaccggcgagaaaccctacgagtgcaatgagtgcggcaaagcgttttcctcaggaagtgatttaattcgacatcagcgctcacactcctctgagaaaccctacgagtgctccaagtgcggtaaggcatacagtaggagcagctcccttatccgacaccaaaacacccattcagaagaaaagtag

SEQ ID NO: 212368 - DNA, 1179 bp, Artificial Sequence
  Description of Artificial Sequence: Synthetic coding sequence
atgcggatccacgacggcaaggagatcctggactgcggcaaggccctctcgcagtgccagtccttcaacattcaccagaagatacacgtggttggaaatgtctgtcagtgccggaagtgcggtaaggctttcaaccaaatgagctctttgctattgcacaaaaagatccataacgggaaaaagactcacaaatacaacaaatgcggaaggggcttcaagaagaaaagcgtgtttgtggtacataagaggattcatgctggcgagaaaattcctgaaaacgctaaagctctttcgcagtctctgcagcaacggagtcaccatcttgagaaccctttcaaatgtaggaaatgtggcaaactgtttaaccggatttccccactgatgctacatcaacgaattcacacatctgagaagccttacaagtgcgacaaatgtgacaaattttttagacgactgagtactctgattctgcacctgaggatccataatggtgagaaactgtataggtgtaacaaatgcgagaaagtgtgcaaccgtcacagctccctaatacagcaccagaaagtgcacaccaagaagaagaaactcttcgagtgcaaggagtgtggtaaaatgttttctggcacggctaacttgaagatccaccaaaatatccactcagaggagaagccctttaagtgcaataaatgcagcaaagtgttcggtcggcagtcattcctaatagaacaccaacgaatacacacaggggagaaaccttaccagtgcgaggagtgtggcaaggcatttagccaccgaatcagcctgacccgacataagcgcatacacaccgaagaccggccgtacgagtgtgatcagtgtggtaaagctttctcgcagtctgcccacctcgcccaacatgaacgcatacatacaggggagaagccctacacctgtaagacatgcggaaaagcattcagccaaagaacaagcttgatcctgcacgaaaggtcgcacacgggggagaagccttacgaatgtaacgagtgcggaaaagctttttcatccggcagcgacttaattaggcaccaaagaagccattcatccgagaaaccttatgaatgctccaagtgcggcaaggcctactcaaggagctccagcctgattagacaccagaacacccacagcgaggagaaggcctag

SEQ ID NO: 212369 - DNA, 1833 bp, Artificial Sequence
  Description of Artificial Sequence: Synthetic coding sequence
atgcccagcgcccggggcaagagcaagagcaaggcccccatcacctttggagacctagccatatatttctcgcaagaagaatgggagtggctaagccctatccagaaggacctctacgaagatgtgatgctggaaaactacaggaacctagtcagcctagggctctctttccggcgtcccaatgtgattactttgctcgagaaaggtaaggcaccctggatggtcgagcctgttaggcgacggcgggcacccgacagtgggagcaaatgcgagacaaaaaagttgcctccaaaccagtgcaacaagtctgggcagagcatctgtcaaaagctagtgtctgcccagcagaaggctcccacacgaaaatcaggctgcaacaagaactctgttttagtgaagcccaagaagggccattcaggcaaaaagcctctgaaatgcaatgattgcggtaagacctttagtaggtcttttagccttaaactgcaccagaatatccacactggcgaaaaaccttttgagtgctcgaattgtcgcaaggcttttcggcagatttctagcatcctgctgcaccagaggatccactctgggaaaaagagccacgagtgcaataagtgtggtgaatccttcaaccagcgtaccactctgatcttacatatgagaattcacgatggcaaggagattctcgattgtggcaaggccctatcacaatgccagagttttaacattcatcagaagatacacgtcgtggggaatgtgtgccaatgtagaaaatgcggtaaagcattcaatcaaatgtcctctcttttgctgcacaagaaaatccataacggtaagaagactcacaagtacaataagtgcggtcggggatttaaaaagaaatcggttttcgtggtgcacaagcggattcacgccggtgagaagatccccgaaaatgcgaaggccttaagtcagtcactgcagcagcggagccaccatctggagaaccccttcaagtgcagaaaatgtggcaaactctttaaccgcatcagtcccctgatgttgcaccaaagaatacatacctctgagaaaccttacaagtgtgacaagtgtgataagttctttcgccggttgtctaccttaattcttcatttgagaattcacaacggggaaaaactgtaccgatgcaacaaatgtgaaaaggtatgcaatagacactccagcttgatccaacatcagaaggtccacactaaaaagaagaaactatttgagtgcaaagagtgcggaaaaatgttctcagggaccgctaacctgaagattcaccagaatatccactccgaagagaaaccctttaaatgtaacaaatgcagcaaagtttttggccggcaaagcttcctgatcgagcaccagagaatccatacgggtgaaaaaccatatcagtgtgaagagtgtggaaaggccttttcccacagaatctctctcactcgacacaagcgaattcacacagaggacagaccatacgaatgcgatcagtgtgggaaggccttctcacagtcagcacacttggctcagcatgagcggatccacaccggcgagaaaccatacacctgtaagacatgtggcaaggcgtttagccagcggaccagcctcatattacacgagcggtctcacacgggagaaaagccttatgagtgcaacgaatgtggtaaggcgtttagttcaggatcagacctgatccggcaccagcggtcgcatagttctgagaagccgtatgaatgttcgaaatgcggtaaagcttatagcagaagtagcagcctgatcagacatcagaacacgcacagtgaagaaaaagcgtag

SEQ ID NO: 212370 - DNA, 1728 bp, Artificial Sequence
  Description of Artificial Sequence: Synthetic coding sequence
atggccatgagccaggagagcctgaccttcaaggacgtgttcgtggattttacattggaggagtggcaacaacttgacagcgcacagaaaaatttataccgagacgtgatgcttgagaattacagccatctcgtatccgtggggcacctagtggggaaaccagacgtgatcttccgcctgggccctggcgatgagtcctggatggcagatggcgggacacccgtgaggacatgcgcagtatgggaagtggatgaacagatcgaccactataaagaaagccaggacaaatttttatggcaagctgcctttatcggtaaagagacactgaaggatgaaagcggacaagagtgtaaaatctgtagaaaaatcatttacctcaacacagactttgtaagcgttaagcaacgactgcccaagtactacagttgggaaagatgcagcaagcatcatctgaatttcctcggccagaatagaagctacgtaaggaaaaaggatgatggttgcaaggcctattggaaggtgtgcttacactacaacctgcacaaagcgcagcctgccgagcgattcttcgaccctaatcagaggggcaaggccctgcaccaaaaacaggctctccgaaagtcccagcgatcccagacaggcgaaaagttatataaatgcaccgaatgcggcaaagttttcatccaaaaggctaacttagtcgtacatcaacggacgcacactggagaaaagccatacgagtgttgtgagtgcgctaaagccttctcacagaagtccaccctgatcgcgcaccaaaggacccatacaggtgaaaaaccatacgagtgtagcgagtgcggcaaaacctttatccagaagtccactctgatcaaacatcagcgcacacacactggagagaagccgtttgtctgtgacaagtgtcccaaagctttcaaatcatcttatcacctgatccggcacgagaagactcatatccggcaggcgttctacaagggcattaaatgcactacaagctcgttgatctatcagcgaatccacacatccgaaaagccccaatgtagtgagcatggcaaagccagcgatgaaaaaccttcacctacaaaacactggcggacccatacgaaagagaacatctatgaatgctccaagtgcgggaagtcttttagaggtaaatcacatttaagcgttcatcaacgcatccatactggagaaaaaccatacgaatgctcgatttgtggcaaaaccttttccgggaagagtcatctgtctgtgcaccatcggactcatacaggcgagaaaccatacgagtgtcgccggtgcggtaaagcttttggggaaaagagcactctgatagtccaccagcgaatgcataccggtgagaagccctataagtgtaacgagtgcggcaaggcattttcggagaagagtccactaattaaacaccagcgcattcatactggggagcggccctatgagtgcacagattgtaagaaagcttttagcagaaagtctaccttgatcaagcatcagaggatccacacaggagaaaaaccctataaatgcagtgaatgcggtaaggccttcagtgtgaaatccacacttatagtccaccaccggacgcacacgggcgagaaaccctacgagtgtcgggactgtggtaaggcgttttccggcaagagtactttaattaagcaccagagatcccacacaggcgataaaaacctttag

SEQ ID NO: 212371 - DNA, 1746 bp, Artificial Sequence
  Description of Artificial Sequence: Synthetic coding sequence
atggccatgagccaggagagcctgaccttcaaggacgtgttcgtggattttacattagaagagtggcagcaacttgactctgcccagaagaatctataccgggacgtgatgctggagaattacagtcatttggtgagcgtgggccacctggttggaaagcccgatgtaattttcaggctgggtccaggcgacgagtcatggatggctgacggcggcaccccagtgagaacttgcgcaggcgaggataggcctgaggtgtgggaagtggatgaacagatagaccattataaggagagccaagacaagtttttgtggcaggcagcattcattgggaaggaaaccctcaaggatgagtcggggcaggaatgcaaaatttgtcggaaaattatatatcttaacacggacttcgtttccgtcaaacagcggttgccaaagtattattcttgggagcgttgcagcaagcaccatctgaatttcttagggcagaacaggtcttacgtccgtaagaaagatgatggatgcaaagcctattggaaagtctgccttcactataatctgcacaaggcccagcccgcagaacggttcttcgacccgaaccagcgggggaaggcccttcatcaaaagcaggccctcaggaagagccagcgcagccaaacaggagagaagctctacaagtgtaccgagtgtgggaaagtgtttattcagaaggccaatcttgttgttcaccagaggactcacaccggagaaaagccatacgagtgttgtgaatgtgcaaaggccttcagtcaaaaaagcacccttatcgcacaccagcggacacacacaggcgagaaaccctacgaatgctcggagtgtggaaaaacatttatccagaagagcactttgataaaacaccagaggactcatactggggaaaagccttttgtgtgcgataagtgtcctaaagccttcaaaagcagctatcacctcatccgccatgaaaagacccacatccggcaggccttctacaaaggaattaaatgtacaacatcttcactaatataccagaggatacatacatctgagaagcctcagtgcagcgagcacggaaaagcttcggacgaaaagcccagccctactaaacattggagaacccatacgaaggagaacatctacgagtgtagcaagtgtggaaagagttttaggggtaaatcccacctctccgtgcaccagaggatccatacaggggagaagccatacgagtgcagcatctgcggtaaaacgttctctgggaaatctcatctgtcagttcatcaccgaactcatacgggcgaaaaaccctatgagtgccgcaggtgcggcaaagcctttggcgaaaaatctactctgatcgttcatcagaggatgcacacaggtgagaaaccatacaagtgcaacgaatgcggaaaggccttctccgagaagagtcctctgattaaacatcagcgtatacacacaggagaacgcccatacgaatgtaccgactgtaagaaggcattcagcaggaagtctacgctcatcaagcaccagaggatacacacaggggaaaagccctacaagtgttcagagtgtggcaaagctttttctgtgaagtctacacttattgtgcatcacaggacacatacgggtgagaagccgtatgagtgccgggattgcggcaaagccttctctggcaaaagcactctgattaagcatcagcgaagccacaccggggataagaatctgtag

SEQ ID NO: 212372 - DNA, 3714 bp, Artificial Sequence
  Description of Artificial Sequence: Synthetic coding sequence
atgggcgacatgaagacccccgacttcgacgacctgctggccgcctttgatattccagacatcgacgcaaatgaagctatccattctggccctgaggaaaacgagggccctggtggcccaggaaaacccgagccgggtgttgggtctgaatctgaggataccgcggccgctagcgcaggggatggccccggcgttcccgcccaagcctcagaccacggactgccgcctccggatatctctgttgtctcagtgatcgtcaagaacacagtgtgccctgaacagtcagaggctttggcaggtgggtcggcaggagatggtgcccaggcagccggggtaactaaggaaggtcccgtcggcccgcacaggatgcaaaatggatttggctccccggagccatccctgccagggactccgcactcccccgcacccccctcaggggggacttggaaggaaaaaggcatggagggtaaaacgcccttggacctgtttgcccatttcggccctgagcccggcgaccattcggaccctctgcctccctctgctcctagcccaactagagaaggagcactgactcctcctcccttccctagcagtttcgaacttgctcaggagaacggtcctggcatgcagcctccagtctcatcccccccgttgggtgccctgaagcaggagtcatgctccccacatcaccctcaggtgcttgcccagcaggggagcggctcctcaccaaaagcgaccgacatacctgcaagtgcatcccccccccctgttgctggtgtgccttttttcaaacaatcacccgggcaccagagccctctggcctcaccaaaagtgcctgtttgccagcccctcaaggaggaggacgatgatgaagggcccgtggacaagagttctcctggaagtccacagtctccctcctccggcgccgaggcggccgacgaagactcaaacgatagccccgcgtccagctcctctagacctttgaaagtcagaatcaagactatcaaaactagttgtggcaacataacacgaaccgtgacccaggtgccttctgaccccgacccgcctgctccactggccgagggcgcctttctggccgaggcaagcttactgaagctctctcctgccacacctactagtgagggcccaaaagttgtaagcgtgcaactgggagatgggaccaggttaaaagggactgtcctgccggtagctacaatacaaaatgccagtacagctatgctcatggcagcttcagtggcgcgcaaggcagtcgtgctgcccggaggcacagcaacatctcctaaaatgatcgctaaaaacgtcctggggctggtgcctcaggccctgcccaaagccgatggcagagctggtctgggaaccggaggccagaaggtgaacggggccagcgtggtaatggtccagccctcaaagaccgccacagggccctccactggcgggggtactgtgatcagcaggacccagtccagccttgtggaagcctttaacaaaatcctgaactctaagaacctgctgccagcctacaggccaaatcttagtccccctgcagaggccggtctcgcattgccccctacagggtacaggtgcctggagtgcggcgacgctttctctctggaaaagtctctcgccagacattacgaccgaagaagcatgagaatcgaggttacgtgcaatcactgcgctaggcgtctggttttttttaataagtgttccttgctgctgcatgctagggagcataaagacaagggactggtgatgcaatgttctcatttagtcatgagaccggttgccctggaccagatggtgggtcagcctgatattaccccactgctgcctgtggcagtgcctcctgtgagcggacccctggctctgcctgcgcttggcaagggtgagggggccatcacatcttctgccatcaccacagtggctgctgaggcacccgttttgccactatcaactgaacccccagcagcccctgcaacttcggcttacacatgcttccgttgtctcgagtgtaaagagcagtgcagggacaaggccggcatggcagcgcatttccaacagctgggccctcctgcccctggtgctaccagcaacgtctgcccaacatgtcctatgatgttaccaaaccggtgctcatttagtgcacatcagcggatgcataagaatcgccctcctcatgtgtgccctgagtgtggaggaaacttcctacaggccaactttcagacccatctgcgagaggcatgtctgcatgtctcaaggagagtcggctatcgttgcccatcctgttctgtggtgttcggcggcgtgaactcaatcaagagccacatccaaacatcccactgtgaagtcttccacaagtgccccatttgcccgatggcctttaaatccggacctagcgcccatgctcacctttattctcagcacccatcattccagactcagcaggccaagctaatatataagtgtgcgatgtgcgacacagttttcactcacaagcctctgttatctagtcacttcgaccagcacttactgccacagcgcgtcagcgtgttcaagtgtccatcatgtccactgctattcgctcaaaagcggacaatgctggagcacctgaaaaacacccaccagtctggacggctagaagaaacagctggaaaaggggcgggaggggcactcctgacacctaagactgaacctgaggagctcgctgtgtcccagggcggggccgcccccgccaccgaagagagtagctcaagctccgaggaagaggaagttccttcaagtcccgaacctcctcggcctgctaagcgcccccgtcgtgagctcgggagtaaaggtctgaagggagggggagggggtcctgggggctggacctgcgggctctgtcattcctggttcccagagagagacgagtatgtggctcacatgaagaaagaacacggcaaatcagtcaagaagttcccatgccggttgtgtgaaagaagtttttgcagtgcaccttcactcagacggcacgtccgcgtcaaccatgaaggcattaaaagggtctacccttgccgatattgtactgaaggaaagaggacgtttagctccaggctgatcctcgaaaaacacgtccaagtgagacatggcctgcagctcggcgcacagtcaccagggagaggcaccacacttgctcggggatcttccgctagggctcagggcccggggcgcaagcgccggcagagctccgatagctgttcggaggagcctgacagcaccacacccccagctaaatctcctagaggtggacccgggtctggaggccatggtccactgcggtatagaagcagttcctccaccgagcagtccctgatgatgggcctccgggtagaagatggggcgcagcagtgtctggactgtggcttatgcttcgctagtccaggcagccttagtaggcatcggtttatcagccacaagaaaagaagaggggtcgggaaggcaagcgccttgggcctaggtgatggcgaggaggaagcccccccctcaaggtctgatcctgatggcggagattcacctttgccggcttctgggggaccgttgacctgcaaggtgtgcggaaagtcctgcgacagtcctttaaacttgaaaacgcacttccggacccacggcatggcttttattagggcgcgccaaggcgctgtgggagacaattag

SEQ ID NO: 212373 - DNA, 3714 bp, Artificial Sequence
  Description of Artificial Sequence: Synthetic coding sequence
atgggcgacatgaagacccccgacttcgacgacctgctggccgcctttgacatcccagacatcgatgccaatgaagctattcacagcggccctgaagagaacgagggccctggtggtcctggcaaacccgaacccggtgtcggcagcgaatccgaagatactgctgcagcatcagcaggcgacggccctggggtacccgcacaggcctccgaccatggtttaccacccccagacatcagcgtcgtgagcgtgatcgtgaagaatacggtctgtccagagcagtcggaagcgctcgccggagggagcgctggtgacggggctcaagccgccggcgtgactaaggaagggcctgtcgggcctcaccgcatgcagaatggcttcggaagccccgagcctagcttaccgggcaccccccacagcccagctcccccttcagggggaacttggaaggagaaaggaatggagggaaaaactccgttggacttatttgcccatttcggtccagagcccggcgatcacagtgatcccctgccgccttcggctcccagtcccacaagggaaggcgctcttaccccgccacctttcccctcaagtttcgagttggcccaagagaacggaccgggaatgcagcccccagtgtcaagcccacctttaggagcgctgaagcaggaatcttgctcaccacatcacccacaggtgctggcccagcaaggatcaggaagctcaccaaaggccacagacatccctgccagcgccagccccccccccgtggctggggtaccattctttaagcagagccccggtcatcagtctcctcttgcaagtcccaaggtccccgtgtgtcaaccactcaaggaagaggatgatgatgagggaccggtcgacaaatcaagccccggttccccacagagtccatcttcaggagctgaagccgcagacgaggactcgaacgacagcccagcgtctagctctagtcggcccttaaaggtacgcattaaaaccataaagacatcttgtggtaacattacacgcaccgtgactcaggtccccagcgaccctgaccctcccgcccctctggccgaaggcgcttttttggctgaagcttccctccttaaactgtcccctgcaacccctacgtctgagggaccaaaggtggtgtcagtgcagctcggtgacgggacccgtctgaaaggcacagtcctgccagtcgcaactatacagaacgcgtccactgctatgttgatggccgccagcgtcgcccgcaaggcggttgtacttccgggaggtactgctacatctcccaaaatgatcgctaagaacgtactcgggctcgtgcctcaagccctgcccaaagctgacggcagagccggccttggaacaggcgggcaaaaagtgaatggcgcctcggtggtaatggtgcagccatctaaaaccgcgactggaccctccacaggcggaggaactgtgatctctcgaacccagagcagccttgtcgaagcctttaacaaaatcctcaattcaaagaatctactgccggcctatagacctaaccttagccccccagcggaggcaggtctggccctgccaccgacagggtatcgctgcctcgagtgtggagacgcctttagcctcgagaaatccctggcacgccattacgataggcggtccatgcggatcgaggttacatgcaatcactgcgcgagacgcttggtattttttaacaagtgctccctgttgctgcacgcgagagaacataaagacaagggtcttgtcatgcagtgttcacatttggtgatgagaccagtggctctggaccagatggtgggacagcccgacatcacccctctgctacctgtggctgtgccgcctgtctctggtccactggccttgcccgccctcggaaagggagagggggctattacctctagtgcaattacaaccgttgcagctgaggccccagtgttacccctgtcaacagaaccaccagccgcccctgcaacttcggcctacacatgcttccggtgcctggaatgcaaggagcagtgtcgggacaaagccgggatggctgcacacttccagcaacttggtccgcctgcacctggcgccaccagcaacgtctgccctacctgccctatgatgctgcccaacaggtgcagcttttccgcacatcaacggatgcacaaaaatcgtcctccccatgtgtgtccggagtgcggcggaaatttcctgcaggctaactttcaaacccacctgcgagaggcttgcctgcatgtgagccggagggtgggctatcgctgccccagctgctccgttgttttcgggggagtcaactccatcaagtctcacatccagacgagtcactgcgaggtgtttcacaagtgtccaatctgcccaatggccttcaagtccggaccatccgcccacgcacacttgtattcgcagcatccttccttccagactcagcaagctaagctcatctataaatgtgccatgtgtgatacggtgttcactcataagccactcctgtccagccacttcgatcagcacttgctcccgcaacgagtctccgtcttcaaatgtccatcttgtcccctgctttttgctcagaaaagaaccatgttggagcacttgaaaaacactcatcagtccggcagactggaagagacagccggtaaaggcgccggcggcgctttgttgacacccaaaaccgagcctgaagagctggcagtctcccaggggggagccgcccccgcaacagaggagagcagtagcagttccgaggaagaggaggtaccttctagccccgagccccccaggcccgccaaacgccccaggcgcgagctaggctcaaaaggtctgaagggcggggggggcggtcctgggggttggacctgcggtttatgccacagctggttccccgaacgcgacgaatacgtggcccatatgaaaaaggaacacggcaaatccgtaaaaaaattcccctgcaggctgtgcgagaggtcattttgcagtgcacctagtttgcgtaggcatgtgagagtgaatcatgagggaattaaaagggtgtatccctgtagatactgcaccgaagggaaacgaacattctctagccgcttgatccttgagaaacatgttcaggtccggcacggcctgcagctcggggctcaaagcccagggcggggaacgacgctggcccgaggatcctctgctcgggctcagggcccaggaaggaagcgccgccagtcgtccgacagctgctctgaagagcctgattctactacgccaccagccaagagtcctagagggggacccggctccggagggcacggccctttgagatatcggagcagtagctctactgaacaatcattgatgatgggactgagggtggaggatggtgcacagcaatgtctggactgtggcctgtgtttcgctagtcctggcagtctatctcgccacaggtttattagccacaaaaaacgccgaggagtggggaaggcgagcgcactcggtcttggggatggagaggaggaggctcctccgagccgatccgacccggacggaggcgatagtcccctacccgcgtctggcggtcccctgacctgcaaggtgtgtggcaagtcatgcgactccccacttaatcttaagacccactttcgcacccatggaatggctttcatccgggcgaggcagggagccgtgggtgacaactag

SEQ ID NO: 212374 - DNA, 3312 bp, Artificial Sequence
  Description of Artificial Sequence: Synthetic coding sequence
atgggcgacatgaagacccccgacttcgacgacctgctggccgccttcgatataccggatattgatgcaaacgaagccatccattcgggaccggaggaaaatgaggggccagggggccccggcaaacctgaaccgggggtcggttccgaatctgaagacacggccgctgcgagtgccggggatggaccgggcgtccctgcccaggctagtgatcacggcctgcctccccccgatattagcgtggtgtccgtgatagttaaaaataccgtgtgtccagagcagtcagaggccctcgcaggaggatctgccggcgacggggcgcaagccgccggggtgacgaaggaggggccagtcgggcctcaccgcatgcagaatggtttcggcagcccggaaccttcactgcccggaacaccccacagccctgctcctcctagtggggggacctggaaagagaaaggcatggagggaaagacccctctggatctgtttgcacatttcggccctgaaccgggagatcacagcgatccccttccgcccagtgctccgtctcctacacgggagggcgcactcaccccccctccctttcctagttcttttgaactggcccaggagaacggacccggtatgcagccacccgtgtccagcccacctctcggagccctcaaacaggagagttgtagtccccatcacccacaggtccttgctcagcagggttccggcagtagtccaaaagccaccgatatcccagcctccgcttcgcctcctcccgttgcaggggtgccctttttcaagcaatcacctggtcaccagtcccctctggcctctccaaaagtaccagtttgccagccccttaaggaggaggacgatgacgaagggccagtcgataagagttcacccggctcacctcagagtccttcatcaggcgccgaggccgctgacgaggatagtaacgacagcccagcaagttcctcatcccggcctttgaaagtacgcatcaagacgatcaaaaccagctgtggaaatatcacaaggaccgtgacccaggtaccttctgatccagatccccccgctcctctggccgaaggtgcttttctggccgaggcgtcccttctcaagctaagcccagcaacaccaacatctgaaggcccaaaggtggtatccgttcagctaggcgatggaacccgcttaaagggcaccgtattgccggtggctactatccagaacgcttcgacagcgatgctcatggcagctagcgttgcgaggaaagcagtcgttcttcctggcgggaccgccacatcccctaagatgatcgccaagaacgtactggggttggttccccaggcactgcccaaggcggacggcagagcgggcctaggcaccggcgggcagaaagtgaatggggcgtctgtcgttatggttcagcccagtaagacggccaccggccccagcaccggcggtgggactgtgatatcgcgaacgcaaagctcgttagtggaagcttttaataaaatcttgaattctaaaaatttgctcccagcctatagacctaacttatcaccgccagctgaggccggattggctttgccccccactggctatagatgtcttgaatgtggagacgccttcagccttgaaaagtccctggcccgacattatgacaggaggtcaatgaggatagaagtcacgtgcaaccactgtgcccgaaggttagtttttttcaataagtgcagcttgctgctgcacgctcgggagcacaaagataaaggcctcgttatgcagtgctctcacctagtcatgaggccagtggcattggatcagatggtagggcagcccgacattaccccactcctgccagttgctgtccccccggtgtcagggccgttagctctgccagcacttggcaagggagaaggagccattacaagtagcgccatcactaccgtcgccgcggaggcacccgtacttcctctttctacagagcctcctgctgcccctgctacgtcggcatacacctgcttccgatgtctagagtgtaaggagcagtgcagagataaagctggaatggccgctcactttcagcagctggggccgcccgctcctggcgctacctcgaatgtgtgccccacatgccccatgatgctgcctaaccggtgttcctttagtgcgcaccagcgaatgcacaagaacagacctccgcacgtgtgtccagagtgcggaggaaacttcctgcaggctaacttccaaacccacctgcgcgaggcatgtcttcacgtgtctcggagagtggggtacaggtgccctagttgttccgttgttttcggtggcgtaaacagtataaaatcacatattcagacttcccactgcgaagtgtttcacaagtgcccgatttgcccgatggcctttaaaagcgggcccagtgcacacgcacacctctattctcaacatcctagtttccagacacagcaagccaaactgatttacaaatgtgcgatgtgtgatacagtcttcacccataaacccctgctttctagccactttgaccagcatctgttgccccagcgtgtgtccgttttcaagtgtccctcatgtccgctgctgtttgcgcagaaacgcactatgctggaacacctgaaaaacacacaccagagcggacgtttagaggagacagccggtaaaggcgcgggcggcgcccttttgacccctaagactgagccggaggagcttgctgtatcccagggcggcgcagctccagccaccgaagagtccagcagcagcagcgaagaggaggaagtcccctcttccccagagccaccccggccagctaagaggccccggagggaactggggagcaagggtctaaagggtggcggcggcggacccggcggatggacatgcggtctgtgccattcatggtttcctgagcgggatgagtacgttgcccatatgaagaaagagcacggtaaatcagtgaaaaagtttccctgtagactttgcgagcggtccttttgtagcgccccgagcctaaggcggcacgtcagagtgaatcatgagggtataaagagggtgtacccatgtaggagtaagggtcctggcctcagagccgtgccacttcttccatcatgtccactgccgttccaggtgctacaccgaggaaagactcatctgcaacagccccccgacccccgcgaaacctgtccaggccctgcccgcctggctgcatggggtcccgtaccttggcccggcgaccatcttggctcaggattccagtgtcaaagtcctggcgctcgatctgagacaccgcctgtgttttag

SEQ ID NO: 212375 - DNA, 2121 bp, Artificial Sequence
  Description of Artificial Sequence: Synthetic coding sequence
tgaaccgtgctgcccgtggccaccatccagaacgccagcaccgccatgctgatggcagctagcgtcgctagaaaggccgtggtccttcccggcgggaccgctacatcaccaaagatgattgcaaaaaacgttctaggactggtccctcaggcacttcctaaagctgacggtagggctggcttagggacgggggggcagaaggtgaacggcgccagcgtagtgatggtgcagccctcaaagaccgctacaggacctagtactggtgggggaaccgtgatctccaggactcaaagctccctcgtagaggcattcaacaaaattctgaactccaagaacctgctcccagcatacagaccgaatctcagtccgcccgccgaagcaggtctggccctgcctcccacaggctaccgatgcttggagtgcggagacgcatttagtctggagaagtccttagctcggcactatgacaggcggagcatgcgcatcgaggtaacctgcaaccactgcgcccgtcgtctagttttcttcaacaagtgctccctgttgttgcacgcccgggaacataaggacaaaggactggtcatgcagtgctcgcacttggtgatgcggccagttgcgcttgaccagatggttggccaacccgatattacacctctgttgcctgttgccgtgccacccgtgtccggacctctggctctgccggccctaggaaagggcgaaggggctattaccagctctgctatcacaacagtggctgctgaggctcccgtgctgcccctgtctacagaaccacctgcggcgcccgcaacttccgcctacacctgcttccggtgcctggagtgcaaagagcaatgtagagacaaggctggaatggccgcccacttccaacagctcgggcctcccgctcccggagccacctccaacgtgtgtcccacttgtccgatgatgctccctaacaggtgttccttctctgcccaccaacgtatgcataagaaccgtccccctcatgtttgtccagagtgtgggggaaactttctgcaggcaaattttcagactcaccttcgggaggcctgtttacacgtgagtcgcagagtgggatatcggtgtccatcttgttctgtagtattcggaggcgtgaattccattaagagccacattcagacatcccactgtgaggtttttcacaagtgtccaatttgccccatggcttttaaatctgggccaagcgcccatgcccacctatatagtcagcacccatccttccaaacccaacaagctaaattaatctacaaatgtgcaatgtgtgatacagtgttcacgcacaaacctttgctttcctctcatttcgaccaacacctgctgccacagcgagtgtccgtattcaaatgtcccagttgtccgctgctctttgcccagaagaggacaatgctggaacatctcaaaaatacacaccaatccggcagactggaggagacagcaggcaaaggagctgggggtgcccttctgacgcctaagaccgaaccggaggagttagctgtttcccaggggggcgcagcaccagcaacagaggaatctagttcttcttcagaggaagaagaagtgccttctagccccgagccacccagacccgccaagcgacctaggcgggaactggggtcaaaaggattgaaaggcggaggtggcggccctggcggatggacctgcggtctctgtcattcgtggtttcctgagagggatgaatatgtagcacatatgaagaaagaacacggcaaaagcgttaaaaaatttccctgtcgcctgtgcgagaggagcttttgttccgcccccagcctgcggcgacacgtgcgcgttaatcatgaagggatcaaacgcgtctacccctgcagatccaaaggaccagggctgagagctgtgccactgctgccctcttgccctctgccttttcaagtgttgcatagagggaaaacccacttgcagcaaccacccgatccacgcgaaacctgtcccgggcccgcacggttagcggcttggggtccagtgccgtggccgggtgatcatctcgggagtggttttcagtgtcagtcaccgggtgcccgtagtgaaaccccacctgtattctag

SEQ ID NO: 212376 - DNA, 450 bp, Artificial Sequence
  Description of Artificial Sequence: Synthetic coding sequence
atgccctgctgcagccaccggcggtgccgggaggaccccggcacctctgaaagccaggagatggaggagtgggccttgttagatatttcccaacgaaagctgtacaaagaggtgatgctggaaacatttcgtaacctaactagtgtcggcaagagttggaaggatcagaacatcgaatatgagtaccagaaccctcggaggaatttccgaagtctgatcgaaaagaaagttaacgaaatcaaggacgattcacattgcggcgagactttcacacaggtaccggatgatcgtctgaactttcaggagaagaaggcatcccctgagatcaagtcttgcgatagtttcgtgtgcggagaggtgggacttggaaactccagttttaatatgaatatcaggggcgacattggccacaaagcatacgagtatcaggagtatggccctaagccttag

SEQ ID NO: 212377 - DNA, 1701 bp, Artificial Sequence
  Description of Artificial Sequence: Synthetic coding sequence
atgccctgctgcagccaccggcggtgccgggaggaccccggcaccagtgagtcacaggaaatggaccccgtcgccttcgatgatgtggctgtgaactttactcaggaagaatgggccctgctggacatcagccagagaaagctttacaaagaggtcatgctggagacgttcagaaacctgacaagtgttggaaaatcctggaaagatcagaacatagaatacgagtatcagaaccccaggcgaaatttcagaagtttgatcgagaaaaaggtcaatgagattaaagacgactctcactgcggcgagacttttacccaggtgcccgatgatcggctgaatttccaagagaagaaagcctcccccgagatcaagagttgcgatagcttcgtgtgcggcgaggtggggctgggcaattcttcatttaacatgaatatccggggggatataggccataaggcctacgagtaccaggagtacggtccgaagccctgcaaatgccaacaacccaagaaggcttttcggtaccacccttcatttcgcaccccccaaagggatcatactggggaaaaaccctatgcttgcaaggaatgtggcaagactttcatctcccattcaagtatacagagacatgtcgtgatgcactctggcgacggaccctacaaatgcaaattttgcggcaaggccttccattgtctgtctctgtatttgatccacgagcgcattcacactggggagaaaccgtacgagtgtaaacagtgtggaaaaagcttctcatatagtgctacgctcaggatccatgagagaacacacacgggggagaaaccgtatgagtgtcagcagtgtggcaaagcttttcactctcctagatgttaccgacggcacgaaaggatccacaccggggaaaaagcctatcaatgtaaggaatgtggcaaagcattcacctgcccacagtatgtacggatacacgaacggacacacagtagaaagaaaccttatgagtgcacccaatgcggaaaagcgcttagtagccttacaagctttcagacgcacatacgcatgcactctggcgagagaccttatgagtgtaagatttgcggcaaaggcttctgtagcgctaacagtttccaaaggcatgaaaaaacacatagcggtgaaaaaccctacaaatgcaagcagtgcggtaaggcattcatccattctagtagcctcagatatcacgagagaatacataccggtgagaaaccctacgagtgtaagcagtgcgggaaggccttcagatcttcatctcacttacaacttcacgggaggactcacacaggagaaaaaccatatgaatgccaggaatgtggcaaggcattccgaagcatgaagaatctgcagtctcacgaacgtactcagactcacgtcaggattcactccggagagaggccatacaagtgtaagctgtgtggcaagggtttttattgtccaaaaagtctgcagcggcacgaaaaaactcatacaggcgaaaaactgtacgaatgtaaacaatgtggggaagcattctcttccagttcttcttttcggtaccatgagaggacccataccggagagaaaccatataagtgtaagcagtgcggcaaagcttttagggccgcctccgttttaagaatgcacggccggacacacccagaggataaaccttatgagtgcaaacagtag

SEQ ID NO: 212378 - DNA, 2061 bp, Artificial Sequence
  Description of Artificial Sequence: Synthetic coding sequence
atggaggtggtgaccttcggcgacgtggccgtgcacttcagccgggaggagtggcagtgcctggatcctggccagagagctttgtaccgcgaagtgatgctggaaaaccactccagtgtggccggcttggcaggctttctggttttcaagccagagctgatatctcggctggagcagggggaagagccatgggtgctcgatctgcaaggggcggagggcaccgaagcacctcgcactagcaaaactgacagcaccatccgcacggagaacgaacaagcctgtgaagacatggacatattgaaatcagagtcttacggcacagtggtgcggatatcccctcaggactttccccaaaaccccgggttcggagacgtgtcagattccgaagtgtggctggatagccatctcggatcacccggtctgaaggttaccggtttcacgtttcaaaacaactgtctcaatgaggagaccgtcgtacctaaaactttcaccaaagacgccccacagggatgcaaagagttgggaagctcaggactcgactgccagcccctcgaatcccagggagaaagtgctgagggcatgtcacaaaggtgcgaggaatgcggcaaaggaattcgagctacaagtgacatagccttgcattgggagattaacacacagaagatctctcgatgccaggagtgccaaaaaaagctgtccgattgcttgcagggtaaacacacaaataattgtcacggagagaaaccatacgagtgcgcggaatgtggtaaggtgttcaggttgtgctcccagctcaatcagcaccagcgaatccatactggggaaaaaccttttaagtgtactgaatgcggcaaggctttcaggctgagctcgaagctgattcagcaccagcgcatacataccggggaaaagccataccggtgcgaggagtgtgggaaggccttcggacagtcctcctctctgattcatcatcagcgtatccacacaggggaacgtccctatggctgtcgggagtgtgggaaagcctttagccagcagtcccagttggtcagacatcaacggacacacactggggagcgcccttatccatgcaaagagtgcggaaaagcctttagccagtcctctactctggctcaacatcagcggatgcacactggcgaaaaagctcagattctgaaggcatcagactccccgtcactcgtggcccatcaaagaatccatgccgtggaaaagccgttcaaatgcgacgaatgcggaaaagccttccgttggatctccagattatcccagcatcagctcatccacaccggcgaaaagccatacaagtgtaataaatgcaccaaggctttcggatgttctagtcgactcatcagacatcagcgaactcataccggcgaaaagccgtttaagtgtgacgaatgcggaaagggtttcgtgcagggatcccaccttattcagcatcagaggatccacacaggtgaaaagccatacgtctgcaatgactgcgggaaagccttcagccagtcttcgagcctaatttatcaccagaggattcacaagggcgagaaaccgtacgagtgtttgcaatgtggtaaggcgtttagcatgtcgactcaactgacaatccaccaacgcgtgcataccggcgagagaccttacaagtgtaatgaatgtggcaaagccttctcccagaattcgactcttttccagcatcagatcatccatgccggagtgaaaccatatgagtgttctgagtgcggaaaagcttttagccgatctagttacctgattgaacatcaaagaatacacacacgtgcgcagtggttttacgaatatgggaatgccctcgaaggaagtacctttgttagccgcaagaaggtcaatacaattaagaagctgcaccagtgcgaggactgtgagaagatattccgctggcggagccacctcatcatccaccagcgcattcacaccggtgagaaaccatataaatgcaacgattgcggaaaagccttcaatcgcagctcacgtttaacacagcaccagaagatccacatgggatag

SEQ ID NO: 212379 - DNA, 2094 bp, Artificial Sequence
  Description of Artificial Sequence: Synthetic coding sequence
atgggcttcctgggctgctggtgcgtgagcttccaggaggtggtgacctttggggacgtcgccgttcacttctcaagagaggaatggcaatgcctggatcccggtcagagggccctttatagagaagtgatgttagaaaatcactcctctgtcgcaggattggcagggtttctggtgttcaagcctgaattgatcagccggctggagcagggtgaagagccttgggtgcttgatcttcagggggccgagggcaccgaggcaccaaggacgtccaagacagattcaactattcggactgagaacgaacaggcgtgcgaagatatggatatactgaaatcagagtcttatgggactgtcgtcaggatctcgccacaagattttccccagaatccgggcttcggcgatgttagtgacagcgaagtatggttggatagtcacttgggaagtcccggcttgaaggtcaccgggtttacctttcaaaacaattgcctgaacgaggagaccgtggtgccgaaaactttcacaaaagatgccccacaaggctgcaaggagttgggatcctcgggtctggattgtcagcccctggaaagtcaaggggagtctgcggaaggaatgtcccaaaggtgcgaggaatgtggcaaaggtatccgcgccacctccgacatcgcactgcactgggagattaacacgcaaaaaatctcgcgttgccaagaatgtcaaaagaaactttctgactgcttacaaggaaaacacaccaacaactgccacggcgaaaagccttatgaatgcgctgagtgtggaaaggtgttcaggttgtgttcccagctgaatcagcatcagcgcatccataccggggaaaagcctttcaaatgtactgagtgcgggaaggcctttcggctgtcttcgaagctgatccagcatcagcgaattcatactggagaaaaaccataccgttgtgaagaatgcggaaaggcatttggccaaagctcttctctgattcaccaccagcggattcataccggcgagaggccctatggatgtcgcgaatgcggcaaggctttcagtcagcagtctcaactggtccgtcaccagcgcacccacacaggcgagcggccatatccctgcaaggagtgtggtaaggccttcagtcaatccagtaccctggctcagcaccagcggatgcacactggtgaaaaggcacagatcctgaaggcatctgatagccccagtctggtggcccatcaacgaatccacgcagtcgaaaagccatttaagtgtgacgaatgtggtaaggccttcagatggatatcccggttatcccagcaccagctcatccacaccggcgagaaaccatacaagtgtaacaaatgcaccaaagccttcgggtgcagctcccgactcattcgtcaccagcgcactcatacaggggagaaaccattcaagtgtgatgaatgcggcaaaggcttcgtccaggggtcgcaccttatccagcaccaaaggatacacacaggcgaaaagccctacgtctgcaatgactgtggaaaggccttctctcagtcctcatcactcatctaccaccagaggatccacaaaggcgagaagccctacgagtgtctccagtgtgggaaggccttttcaatgtccacccagctgactatccaccagagggtacacacaggagagagaccatataaatgcaacgagtgcggcaaggctttttcacaaaactctaccctattccagcatcaaattatccacgcaggggtaaagccctatgagtgcagtgaatgcggaaaagctttctcccgcagttcataccttattgaacatcagcggattcacaccagggcccagtggttttacgagtatggaaacgctctggaaggcagcaccttcgtatctcgtaaaaaggttaacaccatcaagaaactgcaccagtgcgaggactgtgaaaaaatctttcgatggagaagtcaccttattattcatcagagaatccatactggtgagaaaccatacaaatgtaacgactgcgggaaggcttttaaccgttctagtagactgacacagcaccagaaaatccacatgggatag

SEQ ID NO: 212380 - DNA, 447 bp, Artificial Sequence
  Description of Artificial Sequence: Synthetic coding sequence
atggaggtggtgaccttcggcgacgtggccgtgcacttcagccgggaggagtggcagtgtttagaccccggtcagagggctctgtatcgggaggtaatgcttgagaatcatagttccgtcgccgggctggcgggctttctcgtattcaaacctgagcttattagcaggctggagcagggcgaagaaccttgggtccttgaccttcagggtgctgagggcacagaagccccccgtacctccaagactgggttcctcggaaggcccacgatggggcaggaaccccgccacccccacgcacctccagcaacccctgtacctggccttccaaagcactgcagccagagattaaccttgccacctccggggctatcgtcctctcctctgggccactttctagtgcatgatcaggatagacgtcgcgggaccagcgccatctggatggtttag

SEQ ID NO: 212381 - DNA, 2061 bp, Artificial Sequence
  Description of Artificial Sequence: Synthetic coding sequence
atggaggtggtgaccttcggcgacgtggccgtgcacttcagccgggaggagtggcagtgcctggatcctggccagagagcattatacagggaagtcatgctcgaaaatcatagctccgtcgctgggctggccgggtttctggtgttcaaaccagagctcatctctagattagagcaaggcgaggagccatgggtccttgatctgcagggagctgaggggaccgaggcgcctcggaccagtaagaccgattccacaattcgcacagagaatgagcaggcctgcgaagacatggatatcctcaagtcagaatcttacggaaccgtggtgcgcataagtccacaggacttcccgcagaatcctggcttcggagatgttagtgattccgaggtttggttggattcccatctcggcagtccaggactgaaagtgacaggttttaccttccaaaacaactgcctgaatgaggagacagtcgtgcctaaaacctttacgaaagacgctccccaggggtgcaaggagctcggcagctctggcttagactgtcagccattagaaagccaaggtgagagcgcagagggcatgtcacagcgctgtgaggagtgcgggaagggcattagggctacatcagacatcgctctgcattgggagatcaatacccaaaaaatttcaaggtgccaggaatgtcagaagaagctttcggactgccttcagggcaaacacacgaataactgtcacggcgagaagccttatgaatgcgcggagtgtggcaaggtgtttcgactttgttcacagctgaaccagcatcagcgaatccacacaggcgagaagccttttaagtgcacggaatgtggaaaggcatttaggctgtccagtaagctgatccagcatcagagaattcacaccggtgagaaaccatatcgctgtgaagagtgtggaaaggcgtttggacagtcctcttcgttgatccaccaccaacgcattcacaccggcgagcgaccctacggctgtagagaatgcggcaaggctttttcccagcagagccagttggtacggcatcagagaacccataccggcgagagaccctacccatgcaaggagtgcgggaaggccttctcccagagctccacgttggcccaacatcagaggatgcacaccggcgagaaggcccagattctgaaagcctccgatagcccttcactcgttgctcaccaacggatccacgctgtcgaaaagcctttcaagtgtgatgaatgcggcaaagccttccggtggatctcaagactgtcccaacatcaattgatccacacaggagagaagccatataaatgtaacaaatgcacaaaagccttcggatgctcttcgcgtctcatacgccaccagcggacgcacacgggagagaagccatttaagtgcgatgagtgtgggaaagggttcgtccagggtagccaccttatccagcatcagcggatacacaccggagagaaaccgtatgtgtgtaatgactgtgggaaagctttttcccagagttcttcgctgatctaccaccagcgaatccacaagggtgagaagccctatgagtgcttacagtgcgggaaggcctttagtatgagtactcaattgacaattcaccagcgggttcatacaggagagcgtccttataagtgcaacgaatgcggtaaggccttctcccagaactcaacgctttttcagcaccaaattattcacgccggcgtgaaaccatatgaatgcagtgaatgtgggaaagccttttccagatcaagctacctaatcgaacaccaaaggatccacacacgggctcagtggttctatgaatatggcaacgcactggaagggtctactttcgtgtcacggaaaaaagttaatacgataaagaaactccaccagtgcgaagactgtgagaaaatatttcgatggcgatcccaccttataattcatcagcggattcatactggcgagaagccatacaagtgcaacgattgtggcaaggcctttaatcgttcttcgaggctcacacagcatcagaagatacacatgggatag

SEQ ID NO: 212382 - DNA, 1773 bp, Artificial Sequence
  Description of Artificial Sequence: Synthetic coding sequence
atggacatcctgaagagcgagagctacggcaccgtggtgcggatctctcctcaggatttccctcaaaatcccgggttcggcgatgtttccgactcggaagtctggctcgatagccacctgggtagtcccggtttaaaagtcaccggcttcacattccagaacaactgtctcaatgaggagacagtcgtccctaaaactttcaccaaggacgctccccagggatgtaaagagcttggctctagcggattagactgccagccgttagaatcccaaggcgagtccgctgaaggaatgtcgcaaaggtgcgaggaatgcggaaaagggatccgtgctacatcagacatcgccctgcattgggaaattaacacgcaaaaaatctcccgctgtcaggaatgccagaagaaactttcagattgcctgcagggcaagcacaccaacaactgccacggggagaaaccttacgaatgcgctgaatgtgggaaggtcttccgactgtgctcacaactgaatcaacatcagcgcattcatacgggggagaagccgttcaaatgtaccgaatgcggcaaggcttttcgcctctccagcaagctgatccagcatcaaaggatccataccggtgagaaaccataccgctgtgaagaatgtggcaaagcgttcgggcagtcatcaagcctgattcaccaccagcgcatacatacgggggaaagaccttatgggtgccgggagtgcggcaaagcattctcccagcagagtcagttggtaaggcaccagaggacacatacgggggagaggccttacccttgcaaagagtgtggtaaagcattcagccagtcatcaactctcgcccagcaccaacggatgcacaccggcgagaaagcgcagatccttaaggcctccgacagcccctcactcgtggcccaccagcggatccatgccgtggaaaaacccttcaaatgcgacgagtgtgggaaagcttttcgctggatttcacgactcagccagcaccagctgatccacaccggcgagaagccatataaatgcaataaatgcaccaaggccttcggatgtagttcacggctcatacggcaccagagaacgcacacaggcgagaagccattcaaatgcgatgagtgtggtaagggcttcgtgcaggggagtcatctcatccagcaccagaggatccataccggcgagaaaccttatgtgtgtaatgattgtggaaaagccttttcccagtcaagctcactgatctatcaccaacgaattcacaagggcgagaagccctatgagtgcctgcagtgtggcaaggcgttcagtatgtctactcagctgactattcatcaacgcgtccatacaggcgagaggccttacaagtgcaacgagtgtgggaaggcttttagtcagaacagtacactatttcagcaccagatcattcacgccggggtgaaaccttacgaatgcagtgagtgtggaaaggcattctccagaagttcttacttgatcgaacaccagcgcattcacaccagagctcagtggttttacgaatatggtaacgccctggaaggttccaccttcgtttcgcgtaaaaaagttaatactattaagaagctgcatcagtgtgaagactgtgagaagatctttagatggcgcagccacctaattatacaccagcgtattcatactggagaaaagccatacaagtgtaacgactgcgggaaggcatttaatcggagctcaaggctgacccaacatcagaagatccatatggggtag

SEQ ID NO: 212383 - DNA, 1470 bp, Artificial Sequence
  Description of Artificial Sequence: Synthetic coding sequence
atgaaggagctggaccccaagaacgacatcagcgaggacaagctgtcggtggtcggcgaagctacaggtggtcctaccagaaacggggcccgcgggccagggagcgagggggtctgggagccaggcagctggcccgagaggccccgtggagacgctggcgctgaatgggagcctctgggtattccgcagggaaacaagctgctggggggcagtgtccccgcctgccacgaactcaaagcattcgcaaaccagggatgcgttctagtgcctccgcgtttagacgatcctaccgaaaagggcgcctgtcccccagttcggagaggcaaaaatttttccagcactagtgacctgtctaaaccccctatgccatgcgaagagaagaagacttacgactgctcagagtgcggcaaagccttctctcggagctctagtcttattaagcaccagagaattcatactggcgagaaacctttcgagtgcgacacatgtggcaagcatttcatcgagcgttctagcttgaccatccatcagcgagttcacacgggcgagaaaccttacgcgtgtggcgactgcgggaaagctttcagccagcggatgaacttaactgtacatcaacgcacacatacaggcgagaaaccatacgtgtgcgatgtgtgtggaaaagcatttcggaagacttctagcctaacacaacacgagcggattcacactggtgaaaagccctatgcctgcggcgactgcgggaaagcattctcacaaaatatgcatctaatcgtgcaccagcgcacccataccggcgagaaaccatacgtctgtccagaatgcggaagagctttcagccagaatatgcatctcaccgagcatcaacgcacacacacaggcgaaaaaccatatgcatgcaaggagtgtggcaaagcattcaacaaatcttcatccttgactctgcatcagcgcaaccatacgggcgaaaagccgtatgtctgcggggaatgtggcaaagccttttctcagtcttcatacctgatccagcaccagagatttcacatcggtgtcaaacctttcgagtgctcagagtgcggcaaagcatttagtaagaactcatcactgactcagcatcagcggatccataccggggagaaaccgtatgagtgctatatttgcaagaagcatttcaccgggaggtcaagcttaattgtccatcagatcgtgcacacaggcgagaaaccatatgtgtgcggagagtgcggcaaagccttctctcagtcggcgtatctaattgaacaccaacgtattcacacaggcgaaaagccctacagatgtgggcagtgcggaaaatcttttataaaaaatagctctctgactgtgcatcagagaattcataccggggaaaagccttaccggtgcggcgaatgtggaaagaccttctcccgaaacacaaatctcacccgccatctcaggattcatacttag

SEQ ID NO: 212384 - DNA, 2286 bp, Artificial Sequence
  Description of Artificial Sequence: Synthetic coding sequence
atggacagcggcggcggcagcctgggcctgcacacccccgacagccggatggcacacaccatgattatgcaagattttgtcgcaggcatggccgggaccgcccacatcgatggggaccacatcgtggtcagcgttccagaggcggtgttggtgagcgacgtagtcacggacgacggtatcacccttgaccacggcctggcagccgaggtagtccatgggcccgacattatcacagagactgatgtggtaacagagggtgtcatcgtgcctgaggctgttctcgaggctgacgtggccatcgaggaagatctggaggaggatgacggggatcatatcctcacatctgagttaatcaccgagaccgtgcgcgtgccagaacaggtgttcgtggcggatcttgttaccgggcccaacggacatctagagcatgtggtgcaggactgtgttagtggggtcgatagtcctactatggtatctgaagaggtgctggtcacgaactcagataccgaaactgtgatccaggccgctgggggcgtaccaggatcaacagttaccatcaagacggaagacgatgatgacgatgacgttaagagcacctcagaggactacttgatgatttccctggacgatgtcggtgaaaagctggagcatatgggcaacacccctctcaagatcggatcggatggttctcaggaagacgcgaaagaggatggatttggaagtgaggtcataaaggtgtacattttcaaagcagaggctgaggatgacgttgaaataggaggcaccgagatcgtgacagaaagtgagtacacgtcaggccatagcgttgcgggagtgctggaccagtcaagaatgcagagagaaaaaatggtgtatatggctgtgaaagacagtagccaagaggaggatgatattagagatgagagacgagtttctcgccggtatgaagactgccaagcatctgggaacacactggatagcgctcttgagagcagatcatctactgctgcgcaatacttacaaatttgtgatgggataaatacaaataaagtgctgaaacagaaagccaagaaacggcgcagaggagagacacgacagtggcagaccgctgtgattatcggccccgacggtcaacccttgacggtctacccttgccatatctgtaccaagaagttcaagagccggggtttcctgaagcgacatatgaagaatcatccagaccacctgatgagaaaaaaataccagtgcaccgactgtgatttcaccaccaacaaaaaagtgtccttccataaccatctagagtcacataagcttatcaataaggtcgacaagacgcatgaattcacagagtacacaagacgctacagggaggctagcccgctgtcaagcaacaaactgattctccgcgacaaagaaccaaagatgcataaatgcaaatactgtgactatgagaccgccgagcagggcctgctgaaccggcacctgcttgcagttcatagcaagaacttcccccatgtctgcgtggagtgcggtaaggggttcaggcatccctcagaactcaaaaaacatatgaggacccataccggggaaaagccctaccagtgtcagtattgcatatttcgttgcgccgatcagtcgaatctcaagacgcatatcaagtccaagcacggtaataatctgccatataagtgcgaacactgcccgcaggcctttggagacgagcgcgaacttcagaggcatctggacctcttccaaggacataagacccaccaatgtccacactgcgaccataaatctacgaactccagcgacctgaagcgccatatcattagtgtccacacaaaggactttcctcacaaatgtgaggtgtgtgataaggggttccataggccctccgagcttaagaagcactctgacattcacaaaggacggaagatccatcagtgcaggcactgcgattttaaaacatcggaccctttcattttgtctggccacattctgagtgtacacacaaaggaccagcccctgaagtgtaagaggtgtaagcgggggttcagacagcagaacgaactcaagaagcacatgaagacacacactggcaggaaaatctaccagtgcgagtactgcgaatactccacaactgacgcctctggtttcaaaagacacgtcatcagcatccacaccaaagattatccacatcgttgtgaattttgtaaaaagggcttcagacgccctagcgaaaaaaaccagcacatcatgcgacatcataaggaagcactgatgtag

SEQ ID NO: 212385 - DNA, 2286 bp, Artificial Sequence
  Description of Artificial Sequence: Synthetic coding sequence
atggacagcggcggcggcagcctgggcctgcacacccccgacagccgaatggcccataccatgatcatgcaggatttcgtagccgggatggcagggactgcccacattgacggggatcatatcgtagtgagtgtgccggaggccgttctggtgtccgacgtagtaactgacgatgggatcactctggaccatggtttggcggccgaggtggtgcacggacccgatattattaccgagaccgatgtcgtgactgagggagtaattgtcccagaggctgtgctcgaagccgacgtggcaatcgaagaagatctggaagaggacgatggtgaccacattttaacatcagagctgatcacagagacggttcgggttccagagcaggtgtttgtggctgatctggtcacagggcccaacggccacctggagcatgtggtccaggattgcgtgagtggtgttgattcccccaccatggtgtcagaggaagttctggtcacaaacagtgacacagaaacagtgattcaggcagccgggggtgtgcctggatcaactgtgacaataaagaccgaggacgacgacgatgacgacgtgaaaagtacatcagaggattacttgatgatctctctggacgacgtcggcgaaaagctagagcatatggggaacactccactcaagattggcagtgatggcagtcaggaagatgcaaaggaggacggctttggctctgaagtcataaaggtgtatatattcaaggcagaggccgaggacgacgtggagataggggggactgaaatcgtgacagaatcggagtatacaagtggccattcagtcgctggagtgttggaccaaagcagaatgcagcgcgagaaaatggtgtacatggcagttaaagactcctcccaggaagaggatgacattagagacgagcggagagtgagccggcggtacgaggactgtcaggccagcggaaacactctcgactctgcactggagagccggagttcaaccgcagcccagtacttgcagatctgcgacggaattaacaccaataaagttctgaagcagaaggcgaaaaagaggagacgcggcgaaacccgccaatggcagacagcggttataatcgggcccgatgggcagcccctaactgtttatccctgccatatttgcacaaaaaagttcaaaagccgtggattcctcaagaggcatatgaagaaccatccagatcatttgatgagaaagaagtatcagtgcaccgattgcgatttcacaaccaacaaaaaagtgagctttcataatcacttagagtcccacaagcttatcaataaggtggataagactcatgagtttaccgagtacacccgcaggtatcgggaagccagcccccttagttccaacaagttgattctcagagacaaagagcctaagatgcacaagtgcaagtactgcgattatgagaccgctgagcagggcctgctaaaccggcacctgctcgcagtacactccaagaattttccccacgtctgcgttgagtgcggtaaaggtttcagacaccctagcgaattaaagaaacacatgcgcactcatacaggagaaaaaccctaccagtgccagtattgcatttttcgatgcgccgatcagagcaacctcaaaacacacattaaaagcaaacacggcaataacctgccgtacaaatgtgaacattgtcctcaggcttttggcgatgagcgtgaactacaacgtcatttggacttatttcaaggacacaagactcatcagtgcccacattgcgatcataagagcacaaactcatcagatttgaagagacacatcattagtgtccacactaaggacttcccccataagtgtgaagtgtgcgacaaagggtttcaccgcccgagcgaactcaagaagcactccgatattcacaaagggcggaagatccatcagtgtagacactgcgacttcaaaaccagtgacccgtttatcctttctggacacatactcagtgtgcacaccaaagatcaacccctaaaatgcaaacgatgtaaacgcggcttccggcaacagaacgaactgaaaaagcacatgaagactcatacaggcaggaagatttatcagtgcgaatactgcgagtactcaacaaccgacgcctcaggttttaaacgccatgtgatctccatccacaccaaagactacccccacagatgtgagttttgcaaaaagggctttcgacggccatccgaaaagaaccaacatataatgaggcaccataaggaggcactgatgtag

SEQ ID NO: 212386 - DNA, 2310 bp, Artificial Sequence
  Description of Artificial Sequence: Synthetic coding sequence
atgcaggacttcgtggccggcatggccggcaccgcccacatcgacggagaccatatcgtggtgagcgtaccagaggccgttctagtgagcgatgtggtgactgacgatggcattacgctggatcacgggctcgccgcggaagtcgtacacgggccagacatcatcactgaaaccgacgtcgtcacagaaggagtgatcgtgccagaggctgtgctagaagccgacgtagccattgaagaggatcttgaagaagatgacggggaccacattctcacttccgagctgattaccgagactgtgagagttccagagcaggtgtttgtggccgacctggtaacaggacccaacggccacttggagcatgtggtccaagactgtgttagtggggttgactctcccaccatggtgtcggaggaggtgcttgtgaccaactccgacacagagactgtcattcaggccgccggtggggtgcctggttcaaccgtgaccatcaagacagaagatgatgacgatgatgacgtgaaatctacgagtgaagattacctgatgatctcgctggatgatgtcggcgagaagctggaacacatggggaatacccccctgaagatcgggagcgacggaagtcaagaagacgctaaagaagatggtttcggcagtgaagtgattaaagtctacatctttaaagccgaggcagaggatgacgttgaaatcgggggtactgaaatcgttactgagagcgaatatactagcggccactcggtggctggcgtcttggaccagagtaggatgcaacgggaaaaaatggtgtatatggctgtgaaagactccagccaggaggaagatgacatttcttgtgctgagatagctgatgaggtgtatatggaggtgattgtgggtgaggaggaggggacttccctgcccgaaatccaattggaggatagcgacgtgaacaaaaccgtggtgccggtcgtttgggcagcagcatacgggaacacactagacagcgcgctggaatcccgaagctcaacggccgcccaatacctccagatttgtgatggcatcaatactaataaggtgttaaagcagaaagctaagaaacgcagacgcggtgagacccggcaatggcagacagcggtcatcattggtcctgacgggcaacctctgactgtgtatccatgtcacatatgcacaaaaaaatttaaatcccgaggttttctgaagcgtcacatgaaaaaccacccagaccaccttatgcgaaagaaatatcaatgcactgattgcgactttacgactaataagaaagtgagcttccacaaccacttggaatcccacaagttaatcaacaaggtggataagacgcacgagttcacagagtataccagaagatacagggaagcctctcccctctcttccaacaagctcatcctcagagataaggagccaaaaatgcataagtgcaaatattgcgattacgaaacggccgagcagggcctgctgaaccgccacctgttggcagtccactcaaaaaattttccacatgtttgtgtggagtgtggtaaggggttccgacatccttccgagctgaaaaaacatatgaggacccatacaggagagaaaccttatcagtgtcaatactgcattttcaggtgtgctgaccaatctaacttgaagacccatatcaaaagcaagcacggaaataacctgccatacaagtgcgaacactgccctcaagcattcggcgacgagcgggagttgcagcggcatctggacctgttccaggggcacaagacacatcagtgtccccattgcgaccacaagtcgacaaactcgtccgacctgaaaaggcatattattagtgttcatactaaggattttcctcacaaatgtgaagtgtgtgacaagggcttccaccgaccatcagagctaaagaagcattcagacatccataagggacgaaaaattcaccagtgccggcactgcgactttaagacctcggacccttttatcctgagcggccacatactcagcgtgcatactaaggaccaacccctgaaatgcaagcgatgcaagcgcggttttcgacagcaaaatgaattgaagaagcacatgaaaacccacaccggtcgcaagatctatcagtgtgagtactgcgaatactccacaaccgatgcctcgggatttaaacgccacgtgatctcaattcacacgaaagactatccccacaggtgcgagttctgtaagaaagggttccgccggcccagcgaaaaaaatcagcatattatgagacaccacaaagaagcgctgatgtag

SEQ ID NO: 212387 - DNA, 1812 bp, Artificial Sequence
  Description of Artificial Sequence: Synthetic coding sequence
atgatcagcctggacgacgtgggcgagaagctggagcacatgggcaacacacccttgaaaataggttcagacgggagccaagaggatgcaaaggaggacggattcggaagtgaggtaatcaaggtgtatatattcaaggctgaagccgaggatgacgtggagatcggaggcacagagattgtgacagagagcgaatatacttcaggtcattccgtggccggggtcctcgatcaatccaggatgcagcgcgagaaaatggtatatatggccgtcaaggatagttctcaggaagaagatgacatctcgtgtgccgagatcgccgacgaggtgtacatggaagtcatcgttggggaggaagagggcacttcactgccagaaattcagcttgaagatagcgatgtgaataagaccgtggtgccagtggtgtgggcagccgcctacggtgacgagcggcgcgttagccgacgctatgaagattgccaggccagcggaaacaccttggacagtgctctggaatcccggtcctcaacagcggcgcagtacctccagatttgtgacggtattaataccaataaagtcctgaaacagaaagccaaaaagcgacgacgcggcgagactcggcagtggcaaactgctgtgatcatcggaccagacggtcaaccactcacagtatacccatgtcatatctgtacgaaaaagttcaaatcacgcggctttctgaaacgccacatgaaaaaccatcccgaccacctgatgcgcaagaagtaccaatgcaccgactgtgactttacgacaaataagaaggtatcgtttcataatcacctggagtctcacaagctaataaacaaagtcgacaagactcatgaattcacagaatacacaagacgctacagggaggcctcacccctgtcatcaaataagttgatcctccgggacaaggagcccaagatgcacaaatgcaagtactgtgactatgagactgccgagcaaggcctgctgaataggcacttgctcgcagtgcactcgaagaattttccacatgtttgtgttgaatgcggaaagggctttagacaccctagtgaattaaagaagcatatgagaactcacactggcgagaagccataccaatgccagtactgtatctttagatgcgcagaccagagcaatctcaagacccacataaaatcaaaacacggcaacaacttaccctacaaatgcgaacattgtccccaggcatttggcgatgagcgcgaactgcagaggcatctggacctctttcaggggcacaaaactcaccaatgcccccactgcgaccataaaagtaccaacagcagtgatctgaagcggcacataattagcgttcacactaaggacttccctcacaaatgtgaagtttgtgacaaaggattccaccggccctctgaattgaagaagcacagcgatattcacaagggccgcaaaattcatcagtgccggcattgtgattttaaaacatcagatcctttcattttaagtggccatatcctgagcgtgcatacaaaggaccaacccctgaagtgcaaacgttgcaagcgcggcttccggcaacagaacgaacttaagaagcatatgaagacacacaccgggcgaaaaatctaccagtgtgagtactgtgagtattccacgacagacgcctcggggtttaagagacatgtgatctcgatccatactaaagattatcctcaccgctgtgagttctgcaagaagggcttccggaggcccagtgagaagaatcagcatataatgcggcatcacaaagaagccctcatgtag

SEQ ID NO: 212388 - DNA, 1611 bp, Artificial Sequence
  Description of Artificial Sequence: Synthetic coding sequence
atgggccccctgcagttccgggacgtggccatcgagttcagcctggaggagtggcactgcctcgacacagcacaaaggaacctttacaggaacgtaatgctggaaaattatagaaatctggtcttcctgggcattgtggtgtcaaagcccgatctgataacatgcttagaacaaggcaaaaaacctcttactatgaaaaagcatgaaatggtcgcgaatcctagcgtgacttgctcacactttgctagagatctctggccggagcagtccatcaaggatagctttcagaaggtgacactgcgcagatatgagaattacggccacgataatctgcagtttaagaagggttgtgaaagtgttgacgaatgcaaggtccacaaaagggggtataatggcttaaaccaatacttgacaacaacgcagagcaagatcttccaatgcgataagtatgtgaaggtgatccacaaattctctaacagtaatcgccataaaattcgccacacggggaaaaaaccctttaagtgcatagagtgtggtaaggcctttaaccagagtagcaccttaacaacacataaaaaaatccacacaggagagaagccttttaagtgtgaagaatgtggcaaggcatttaactggtcatctcatctgaccacccataaaaggattcacaccggggagaagaggtacaagtgcgaagactgtggtaaagctttcagtagatttagctatctaacagcacacaaaatcatacatagcggtgagaagccatataagtgcgaggagtgcggcaaagccttcaaaagatcgagtaatctgaccacacataagataattcacacgggtgagaaaccgtacaaatgcgaagagtgtgggaaagctttcaaacggtcatccatactgactgcccataagattattcactcaggcgaaaaaccctacaaatgtgaggagtgtggcaaggcctttaaacacccttccgttctgactacccacaaaagaatccatacaggtgaaaaaccttacaagtgcgaagagtgcgggcgggcatttaagtatttttcctcattaacaactcacaagattatccacagtggagagaagccttacaagtgtgaagagtgcggcaaagcctttaattggagcagtcatctgaccactcataaacgcatccatacgggtgaaaaaccgtacaagtgtgaggagtgtggcgaggcgtttaagtactcatcctctctgacaacccataaaattattcacactgggcagcagccctttaaatgtgaggagtgcgggaaagcgttcaagtgcttctccatcctgaccactcacaaaagaatacacacaggagagaagccctacaagtgtgaggagtgcggaaaagcatttaattcctcaagccacctaacagcccacaagcgtatccataccggggaaaagccttataagtgtgaacggtgcggcaaggcattcaaacggagcttcattctcacccggcataaacgtatccatacaggcgagaaaccatacaaatgtgaggaatgtgggaagggcttcaagtgcccatcaacgctgactacacataaggttatccacaccggggaaaaactgtag

SEQ ID NO: 212389 - DNA, 1935 bp, Artificial Sequence
  Description of Artificial Sequence: Synthetic coding sequence
atggagatccccgcccccgagcccgagaagaccgccctgagcagccaagatcctgcattatccctgaaagagaatctggaagatatctccggttggggactgccggaggcgcggtccaaagaatccgtaagctttaaagacgtggcagtggatttcactcaggaggagtgggggcagttggattctccccagagggccctatacagagacgtcatgctcgaaaactaccagaacctactagccctgggccctccattgcacaagcccgacgtaattagccatctcgaaagaggagaggagccctggagtatgcagagagaagtccctcggggtccttgtcctgagtgggagctcaaagcagtcccctctcagcaacagggtatctgtaaggaggagcctgcccaggaacctatcatggaacgaccattggggggcgcacaggcatggggaagacaggccggagcgctgcagcgcagtcaggccgcaccatgggccccggcgcctgccatggtgtgggacgtgcccgtggaggagttcccattgcggtgtcctttatttgcccagcaacgcgtgccggaaggcggacccctgctcgacactaggaagaatgtccaggcgacagaaggacggactaaggccccggcccggctttgtgccggagaaaacgcctctaccccctctgagccagaaaaatttccacaggtccgcaggcagcggggcgcaggcgctggcgagggcgagttcgtctgcggagagtgtggaaaggcattcagacagtcctcctctttaaccctgcacaggcggtggcactcccgcgagaaagcctacaagtgcgatgagtgcggaaaggctttcacgtggtctacaaacctgctggagcataggcggatccacacgggcgagaaaccctttttctgcggagagtgcggaaaggccttctcatgccactccagtctgaacgttcatcagaggatccatacaggcgagcggccttacaagtgtagtgcctgcgaaaaggcgttcagctgttccagtctgcttagtatgcacttacgtgtgcacacaggggaaaaaccgtatcgttgcggggaatgcggaaaggcttttaaccagaggacacacctcaccagacaccaccgaattcataccggcgaaaagccctatcagtgcgggtcatgtggaaaggctttcacttgccattcctctctgaccgttcatgagaaaatccacagcggagacaagcctttcaaatgttccgattgcgagaaagcgtttaactctcgaagccgactgacattacatcagagaacccacacgggagagaaacctttcaaatgcgccgattgcggcaagggtttctcctgccatgcctacctgctcgtgcacaggcgcatccattccggtgagaagccattcaaatgtaatgaatgtggcaaggccttcagctcacatgcctacctgattgttcacagaagaatccacaccggcgaaaagccctttgattgtagccaatgctggaaggccttcagttgtcattcatctctcatcgttcaccaacgcatccacactggcgagaaaccctataagtgtagcgaatgcgggagggccttctctcaaaaccattgtctcatcaaacatcagaaaatccacagcggggagaaaagttttaaatgtgaaaaatgtggcgaaatgtttaactggagcagccacttgacagagcatcagagacttcacagtgaaggtaagccgctggcaatccagttcaataagcacctgctttcgacgtactatgtacccggtagcctcctgggagctggagacgccgggctcagggatgttgatcctatcgatgcgctcgacgttgcaaaactgctctgtgtggttcccccccgcgcaggcaggaactttagcctcggttcaaaacccagaaattag

SEQ ID NO: 212390 - DNA, 1935 bp, Artificial Sequence
  Description of Artificial Sequence: Synthetic coding sequence
atggagatccccgcccccgagcccgagaagaccgccctgagcagccaggatcccgcactgagcctgaaggaaaacctggaagatatcagcggatggggcctgcccgaggcccgctccaaggaatccgtatcctttaaagacgtagctgtcgacttcactcaggaagaatggggacagttggactcaccacagcgcgccctctatcgcgatgtgatgctggaaaattaccagaacctgctggccctgggtccacccctgcacaagcctgatgtgatatcccacctggaacggggggaggaaccctggtccatgcagcgggaagtgccccgggggccgtgccccgaatgggaactaaaggccgtccctagtcagcagcagggtatttgcaaagaggagcccgcgcaggagcctattatggagcgcccactcgggggcgcgcaggcttggggtcggcaggccggagctctgcagcgatctcaggccgcaccatgggctcctgcgcccgcaatggtctgggatgtgcctgttgaggaattccccctccgctgcccactgtttgctcaacagcgcgtcccagaggggggcccactgttggatacacgaaagaatgtgcaggcaactgagggccgcacaaaggctccagctcgcctctgcgccggagagaatgcatccaccccatcagaacccgaaaagttcccacaagtgaggcggcaacggggcgcaggggcaggtgagggtgaattcgtgtgcggcgagtgtggaaaggcctttaggcagtcaagctccttgacgctgcatagacgctggcactctcgtgagaaggcctacaaatgtgatgagtgcggcaaagccttcacttggtctaccaatctgctggagcatagacgaattcatacaggcgagaagccattcttctgtggcgagtgtggtaaagcgtttagttgccatagttccttaaatgtgcatcaacgcatccacaccggagaaagaccttataaatgtagcgcctgcgagaaggcattctcctgcagctctcttctctctatgcacttacgggtccacacgggcgaaaaaccctatagatgtggagagtgtggaaaggcattcaatcagcggacacatcttactaggcatcaccggatccatacaggtgagaaaccctatcagtgcgggtcatgtggcaaggcattcacatgtcattcctcccttactgtgcacgaaaaaatccatagtggcgataagccatttaaatgcagtgactgtgaaaaggcatttaactccaggagccggcttacactgcatcagcggacccatacaggagagaagcctttcaaatgcgccgactgcggcaaggggttctcctgtcacgcctacctcctggtgcatcgccgtatccactcaggagaaaagccgtttaagtgtaacgaatgtgggaaggctttcagcagtcatgcttacttgatagtccatagaagaatacatacgggcgagaagcctttcgactgttcacaatgctggaaagccttcagctgtcactcctctcttatcgtccaccagagaattcacaccggagagaagccttacaaatgctctgagtgcggccgggccttttcgcaaaatcattgtctcattaaacatcagaaaatacactctggcgaaaaatcctttaagtgtgagaagtgtggcgagatgttcaactggagctcgcacttgacagagcaccagcgcttgcactcagagggcaaacccctggctatccagttcaataaacatctcctgtcgacctattatgttcctggatctcttttgggcgcgggggatgcaggactaagggacgtggaccctatcgacgccctcgatgtggccaagctgctgtgtgtggttccacctcgagccggtaggaacttctctctggggtctaaacccagaaattag

SEQ ID NO: 212391 - DNA, 1839 bp, Artificial Sequence
  Description of Artificial Sequence: Synthetic coding sequence
atggagatccccgcccccgagcccgagaagaccgccctgagcagccaggaccctgctctgagcctgaaggagaatctggaggacatttccggatggggactacccgaagcaagatctaaggaaagtgtgtcctttaaggatgttgctgtggacttcacacaggaggagtgggggcaactggatagtcctcagcgagctctctacagagatgtgatgctggaaaattaccagaatctcctggcgctcgaatgggagctcaaagccgtgccttcccagcagcagggaatctgtaaggaagaaccagctcaggagcccatcatggagcgccctctgggcggtgctcaggcttggggccgccaggccggggctcttcaaagatctcaggccgctccatgggccccagcacctgccatggtgtgggacgtgcctgtggaggagtttcccttaagatgtcctctgtttgctcaacagagagtgcctgaaggtggtccattgctggatacacgcaagaatgtgcaggcgaccgagggcagaaccaaagctcctgccagactgtgtgcaggcgaaaatgcctccaccccttcagaaccggaaaagttccctcaggttaggcggcagcggggggcaggcgccggcgagggcgagtttgtctgcggagaatgcgggaaggccttccgtcaaagcagctcactgactctgcatcgtcgctggcactcgagagaaaaagcttataaatgtgatgagtgtggaaaggcattcacctggtcgacgaacctccttgagcatagaaggatccacactggggaaaaaccatttttctgtggcgaatgtggcaaggcgttctcgtgtcactcctcactgaacgtccatcagaggatccatactggcgagaggccatacaaatgctcagcttgcgaaaaagcctttagctgctcttcacttttaagcatgcacctaagggtgcatacaggagagaaaccctataggtgtggagagtgtggcaaggccttcaatcagcgaactcaccttactcggcaccacagaatccataccggagaaaagccctaccaatgcggcagctgtggaaaggcttttacctgtcacagctctctcacggtgcatgaaaagatacactccggcgacaagccctttaaatgcagcgactgtgagaaggcattcaattcaaggtctagactcaccttgcaccagcggacgcacactggcgaaaagccgttcaaatgcgctgactgtggaaaggggttctcctgccacgcttacctgttggtgcatcggcgaatccacagcggtgagaagccgtttaaatgcaacgagtgcggaaaggccttttccagccacgcctacctgatcgttcataggcgcattcatactggagaaaagccattcgactgctctcaatgctggaaggccttctcatgccactcttcactcatagtacatcaaaggattcacacaggagagaaaccttataagtgttcagaatgtggaagagccttcagccagaatcactgcctaattaagcatcagaagatccactctggcgagaagtcctttaaatgtgagaagtgcggggagatgtttaattggagtagtcacctgacagagcaccagaggctacactctgagggcaagccactagcaatccagttcaataagcacttacttagcacttactacgttcctgggtcccttctcggcgccggcgacgccggtctccgagatgtagaccctatcgacgctctcgatgtcgctaagctgctttgtgtggtaccccctcgagccggcagaaatttcagtcttggttcaaaaccccggaattag

SEQ ID NO: 212392 - DNA, 210 bp, Artificial Sequence
  Description of Artificial Sequence: Synthetic coding sequence
atggagatccccgcccccgagcccgagaagaccgccctgagcagccaggaccccgcactgagtctcaaagagaacttagaggacatcagcggttggggccttcccgaggcgcgatccaagagcctcgctctggtgacacaggcaggagtgcagtggagaaacttgggctccctccagcctcctccactggggtttaagcagttctcctag

SEQ ID NO: 212393 - DNA, 1935 bp, Artificial Sequence
  Description of Artificial Sequence: Synthetic coding sequence
atggccgaggccgtggccgcccccatcagcccctggaccatggccgcaaccatccaagcaatggagagaaagatagaaagccaggctgccagactcctgtcgctcgaaggcagaactggcatggccgaaaagaaactggctgactgtgaaaaaaccgcggtcgaatttggaaaccagttggagggaaaatgggccgtactaggcactctgcttcaggagtacggcctgctgcagaggagactcgaaaacgttgagaatctgctgcgtaacagaaacttctggatcctcaggctgccccctgggtccaagggagagagccccaaagaatggggcaagttggaggattggcaaaaggaactgtataagcatgttatgagaggtaattacgaaacattggtttccctagactacgccatttccaagccagaagtgctgagtcagatcgagcaggggaaggaaccttgcaactggaggcgccccggacccaaaattcctgatgtgccagtggacccatccccgggatcgggccctcccgtacctgccccagaccttctcatgcagattaagcaggagggggagctacaactccaggagcagcaggcgttgggcgttgaagcttgggccgccggccagcctgacatcggagaagaaccgtggggattgagccagctcgactccggcgctggggatatcagcaccgatgctactagtggggtgcactcaaacttctctacaacaatccctcccacctcttggcagaccgatctgccccctcatcacccttccagtgcctgctccgacggtacgcttaagctcaatacagcggcgagcactgaggacgtgaaaatagttatcaagactgaagtccaggaggaggaagtcgtcgccacccccgtgcacccgactgatctggaagcccatggcacattgttcggtccaggacaggctacaagattttttccatcccctgcccaggagggcgcgtgggagagtcagggcagctcgttcccatcccaagacccggtgttgggactccgggaacctgcccgccctgagcgtgatatgggcgagctctcaccggccgtagcccaggaggaaacacctcccggtgactggctgtttggcggtgtaagatggggctggaactttagatgcaagcctccggtgggcctaaatcccagaaccgggcccgaggggctgccttatagctcccccgacaatggagaagcgattctggatccctcgcaagcaccaaggccatttaacgagccatgtaagtatcccgggagaactaaaggattcggccataagcccggtcttaagaagcaccctgccgccccgccagggggtcgcccctttacgtgtgctacatgcgggaaaagttttcagctacaggtgtcactgtcagctcaccaacgtagttgcggggcgcctgacggctcaggccccggcaccggcgggggcgggagtggatctgggggcggcggcggaggtagtgggggggggagtgcgcgcgacggatcagccctgagatgcggggaatgtggaaggtgctttaccagacctgcccatcttattagacacaggatgcttcacacgggggaacggccatttccgtgcactgagtgtgagaagcgtttcaccgaacggtccaagttgatcgaccactatcgcacacataccggcgtcagaccattcacctgcacggtatgcggtaaaagctttatccgcaaggatcacctgaggaaacaccagaggaatcatgccgctggggctaaaacacccgctcgtgggcagcccctgcccacaccacccgcccctcctgaccctttcaaatcgcctgcctcaaaaggaccacttgctagcaccgatttagtgacagactggacatgcgggctttctgttctgggccccacggacgggggagacatgtag

SEQ ID NO: 212394 - DNA, 1938 bp, Artificial Sequence
  Description of Artificial Sequence: Synthetic coding sequence
atggccgaggccgtggccgcccccatcagcccctggaccatggccgctaccatacaggccatggaaaggaagattgagagtcaggctgcccggttgctgagcttagagggcagaaccgggatggctgaaaagaagcttgcagactgtgaaaaaaccgcggtggagttcggtaaccagttagagggtaagtgggcagtcctcggcactcttctgcaggaatatgggctccttcagaggaggcttgagaatgtagagaacctgctccgcaaccgtaatttctggatcctcaggctgccacccggcagcaagggggaatctcctaaagagtggggtaagctggaggattggcagaaagagctctacaaacatgtgatgcggggaaactacgagacactggtgtccttggactatgcaatcagcaagccagaagtgctgtcgcaaatcgagcaaggcaaggaaccatgtaactggcggagacccggcccgaaaatacccgatgtgccagtggatccatcacctggttcaggccctcccgtccccgcccctgacctcctgatgcagattaaacaggagggcgagctacagctgcaggagcagcaagcactaggcgttgaggcctgggcggccgggcagcccgatattggggaagaaccctggggcttgtctcagctcgacagcggagctggcgacatcagtaccgacgccacatccggtgtgcactccaacttttcgaccacaatacctccgacatcttggcagacagacctgccaccccatcatccaagttccgcatgctcagatgggacactgaaactgaatacagctgcgtcaacagaagccgatgtgaaaatagtgattaaaacagaagtacaggaggaagaggtggtggcaaccccagtccaccccaccgaccttgaagctcacggcacactctttggcccaggacaggccactcgtttcttcccatcccccgcccaggagggagcgtgggaatcccaaggtagctccttccctagccaggatcccgttctggggctccgggaacctgctagacctgagagagatatgggagagctgtccccggccgtggctcaggaggaaacccctcccggcgactggctgtttgggggagttcggtggggatggaacttcaggtgtaagccacctgtcggtctgaacccaagaaccgggcctgaggggctgccatacagttctccagataacggagaggcaatcctcgacccatcgcaggcccctcggccattcaatgaaccctgtaagtaccctggcaggaccaaaggttttgggcacaaacccggcctgaaaaagcatccagccgcaccccccgggggccgccctttcacttgcgctacatgtggaaagtccttccaattgcaagtgtccctcagcgcacatcagaggtcatgtggcgcccccgatggatctggtcccggcacaggcggaggaggttcagggtcaggcggtggaggagggggtagtggaggtggaagtgctagagacggatcagccctgaggtgtggcgagtgcggcaggtgcttcacgcgccctgctcacctcatcagacaccgcatgctgcatacaggagaacgcccatttccatgcactgaatgtgagaagcggttcaccgagagaagcaaactgatcgatcactaccggacccacacaggcgtccgaccgtttacctgtacagtttgtggcaaatcctttatcagaaaggatcacttgaggaagcaccaacggaaccatgccgctggcgcgaaaactccagcacggggtcagccacttcccacaccacctgcaccacccgatcccttcaaatctcccgcctctaagggcccccttgctagcaccgacctggtcactgattggacgtgcggcttgagcgtgctcggacccaccgatggaggtgacatgtag

SEQ ID NO: 212395 - DNA, 2172 bp, Artificial Sequence
  Description of Artificial Sequence: Synthetic coding sequence
atgagcctgctgaaggagcggaagcccaagaagccccactacatcccccgacccccaggcaagcccttcaagtataagtgctttcagtgcccattcacttgcaatgaaaagtctcacctgtttaaccatatgaagtatgggctgtgtaagaattccattacccttgtttctgaacaggacagggtgcctaaatgtcctaagtccaactccctggaccctaagcagacaaatcaacccgatgcaacagctaaacccgctagttcgaaatccgtggcaaatggcctctccgcttttgattcaaagctccagcatagctccgcacgggaagacattaaggaaaatctagaactgcaggctcgcgggacccaccgttgtctcggacagaaacccgctctgcacagggcttccccctgcaagtctccagctcccgaggctgctttgggcgctcaacctgccctcgagggagccgcgcgaccgtctgcttttgtgccggttggggagcaccgattgaaggggccagataacgccgaagcaccagaaacactggctctccataatcctacagcaaaggccgtttctttccacacgaaaagcgccttccacacacctggctatccttggaaagccggcagtccctttctaccaccggaatttccacacaagatttctagtacaaaaggtttaggggcaattagtccgtatatgcaccctacaatacctgagtatcccccccatttctatactgagcatgggctagcgaccatatactccccctaccttctggcgggatcgtctcctgagtgtgatgccccccttttgagcgtatacggcacccaggatcccaggcactttctccctcaccctgggcctatcccaaaacacttggcgcctagcccggctacgtatgatcattatcggttcttccagcaatatccatccaatctgcctattccctacggattttacagaccagaatcggctttcagcagttatgggctcaggctcccgcccgtcacggggctgaccagggaccaatcctcccacctgctggaagaggccactctggtctatcccgctagctcccctagcaggttgaatccaagcgaccccaacaggaagcatgtcgagttcgaaagccctatccccgaagctaaagatagctcaaaggctgggcagcgagataccgagggatcaaaaatgagtccaagagctggcagtgcggccacaggttctcctgggagaccaagccctacagactttatgcaaacctcccagacttgcgagggtctgtatgatctgagcaataaagccgcttcctctgccctgggtcggctgtacccccccgagcagagcctcacagccttcagaccagtaaaaaagtctaccgaatgtctgcctgcccaggctgccgagactacggctgagagtccagttagtctaaatgtggttaacggggaccctcctgctcctactggaagcgcaagcctcgtctctgaggcagccccgagttctcccgatgattcaagtggcatggggccactaaacctttccaaaaagtccgaaatcaacctggccgccacccacgaacccacataccaaggaagccctcaagctgagactgcgtccttctcagagctgcaagacttgccactaaacctgtccgtaaaagatccctgcaacacacaagccccccgccccgcctttcccggtcgcccacgggctgctgagcctgccgccgcagttcctcaaaaaacaggaacggagggatcagaggatggtccttcacaccccgagacgaagccaggaagtctagacggggacggcgcccctccaaccggccccggggaagaggctcctgacgcttgtgccgtcgatagctcggaggagcaaaaacagacagcagctgtcgctctgtgtcagcttgcagcctacagccccaggaacatcagagtgggggatggtgacgccgccgcccctgagcccgcatgccgccaagacactccaactcttagcagtatggaatctcaggaagcccaatgcgacctgcgccccaagggccagaaacggacgtccctgagagatgccggcaagtcccagcaaggtgccaagaaggccaaactccaggataccgccagagtttttacactacggaggcgggcgcgtgtaagctag

SEQ ID NO: 212396 - DNA, 951 bp, Artificial Sequence
  Description of Artificial Sequence: Synthetic coding sequence
atgagcccccgggccggcagcgccgccaccggcagccccggccggccctctcctaccgactttatgcagacctcccagacttgtgaggggctctatgatctatccaacaaagccgcttcatcagccctgggccgcctgtatccacctgagcagagcctcaccgcgttccgccccgtcaagaagtccacagagtgtctgccagctcaggcggctgaaacaacagccgaaagcccagttagcctgaacgtggtaaatggggacccccccgcgcctaccggtagcgccagcttggttagtgaagccgccccttcctctcctgatgactcaagcgggaaaagcgaaattaacttagctgctacacatgagcctacgtaccaggggtcaccccaagctgagactgcttccttttccgaactccaggacttgcctctgaacctgagtgtgaaggatccttgtaacactcaggctccacgccccgcatttccaggacggcctagagctgccgagccagcagccgcggtgcctcagaaaacaggcaccgaaggatccgaagacggcccttcccaccccgaaaccaagcccggttccctggacggcgatggtgcccctcccaccggccccggggaggaagcacctgacgcctgtgccgtagatagcagtgaagagcagaaacaaactgcagctgtggcactgtgtcagttggccgcttatagccctcggaacattcgtgtgggggatggcgacgcagcagcgcctgaacctgcatgcagacaagacacacctaccctgtcctccatggagtcgcaagaggcacaatgcgatctgaggcccaaagggcagaaacggacttcactccgcgacgctggcaagtcacagcaaggagcaaagaaagccaaactacaggatactgctagggtgttcaccttacgcaggagagccagagttagctag

SEQ ID NO: 212397 - DNA, 891 bp, Artificial Sequence
  Description of Artificial Sequence: Synthetic coding sequence
atgtacttcagccaggaggagtgggagctgctggaccccacccagaaggcactgtacaacgatgtgatgcaggaaaactacgagaccgtcatcagccttgctctctttgtgttgcccaagcctaaggttattagctgtctcgagcagggtgaagaaccatgggtgcaagtatctcctgagtttaaagacagcgctggaaaatcccctacaggcctgaagctcaagaatgacaccgagaaccatcaaccagtgagcctgtctgatctggagatccaggcttcagccggcgtaatttcaaagaaggcgaaggtgaaggtgccccagaagactgctggcaaggaaaaccatttcgacatgcatagagtgggtaagtggcaccaagattttcccgtcaaaaagagaaagaagctctctacttggaagcaggaacttctgaagcttatggaccggcataagaaggattgcgcacgtgagaaacccttcaagtgccaggagtgcggcaagacctttcgtgtgtccagcgacttgataaagcaccagcgcattcatacggaggaaaaaccctacaagtgtcagcaatgcgacaagcgcttcaggtggtccagcgacttaaataaacacctgaccactcaccagggaattaagccatacaagtgctcctggtgcggcaagtcattttcccagaatactaacttacacacccaccagcgaacccacaccggcgagaaaccatttacctgccacgaatgcggtaagaagtttagtcagaattcccatcttattaaacatcgaaggacacataccggcgagcagccttatacatgctccatctgccggaggaactttagcaggcggtcctcattgctacggcatcagaagctgcacctctag

SEQ ID NO: 212398 - DNA, 891 bp, Artificial Sequence
  Description of Artificial Sequence: Synthetic coding sequence
atgtacttcagccaggaggagtgggagctgctggaccccacccagaaggccctgtacaacgatgtgatgcaggagaactatgagacggttatcagtctggcccttttcgtcttgcccaagccaaaggtgatttcttgtctggagcagggagaggaaccttgggtgcaggtgagcccagagttcaaagactcagcgggaaagtcaccgacaggactcaagctcaagaacgacacggaaaaccaccaacccgtatccctttcagatctggaaattcaggcgagcgcaggggttatcagtaagaaggccaaagttaaagtgccccagaaaaccgccggcaaggaaaaccactttgacatgcacagggtaggcaagtggcaccaagatttcccagtgaagaagcgaaagaaactgagcacctggaaacaagaactgctaaaactgatggatcgccataaaaaggattgcgctcgtgagaagccttttaaatgccaggagtgtggcaagacattccgggtttccagtgaccttataaaacaccagcgtatccacactgaggagaaaccgtataagtgccaacaatgtgataagcgcttcaggtggtcttcggatctgaataaacatctcaccactcatcaaggtataaagccatacaagtgctcctggtgtggcaaaagcttctcccagaataccaatcttcacacccaccaacgtactcatacaggggagaagccatttacatgtcacgagtgcggtaagaagttttcacagaacagccacctgattaagcatagaaggacgcacacaggagagcagccatacacatgctcaatttgcagaaggaacttttccagaaggagctctctgctgagacaccagaagctacacctgtag

SEQ ID NO: 212399 - DNA, 1248 bp, Artificial Sequence
  Description of Artificial Sequence: Synthetic coding sequence
atggccatgcgggagctgaacgccgacagctgcagcagcccccagatgggagccatgtgggaaacatcagggtcagtgaaggaaaactcatcacagtcaaaaaaatactccactaagatagaaaatttgggcccagagagtgcgtgtcgacatttttggtcctttagataccacgaagccacaggtcctctggagactataagccagctccagaagctgtgtcaccagtggttgagaccagagatccattccaaggagcagattctggagatgctggtgttagagcagtttctttcgatcctgcccaaggaaactcagaattgggtccagaagcatcatccccagaacgtcaagcaagctctcgtgctcgtggagttcctgcagcgtgaaccagatggcacgaaaaacgagagcctgctcacttttgaggacgtcgctgtgtattttagcgaggaagaatggcaattgttgaatccattagagaaaaccctctacaatgacgttatgcaggacatctatgagactgtgatatccctcggtctgaaacttaaaaacgacactgggaacgatcatccaatttccgtgtctacgtctgagattcagacctccggctgcgaggtgtctaagaaaacccggatgaagattgcacagaagacaatgggcagagagaatcccggagacacacatagcgttcagaagtggcaccgggcatttccccggaaaaaaagaaagaagcccgcaacatgcaagcaggagctgcccaaacttatggacctgcatggtaaagggcccaccggcgagaagccattcaaatgccaggagtgcggcaaatcttttagggtctcgagcgacctaatcaaacatcaccggattcacaccggcgaaaagccctacaaatgccaacagtgtgatcgccggtttaggtggagctcagacttgaataaacattttatgacccaccagggaatcaagccttacaggtgctcgtggtgcgggaaatcgttcagtcacaacaccaatctgcacactcaccaacgcattcatacaggcgagaaaccattcaaatgcgatgagtgtgggaagcgtttcatccagaactctcatttgattaaacaccaacggacccacacaggggagcagccttatacgtgctccctatgtaaacgcaattttagtcgccgcagctcccttttacggcaccagaaacttcataggcggagggaggcttgccttgtgtcccctaactag

SEQ ID NO: 212400 - DNA, 1533 bp, Artificial Sequence
  Description of Artificial Sequence: Synthetic coding sequence
atggccatgcgggagctgaacgccgacagctgcagcagcccccagatgggagctatgtgggaaacatctggctctgtaaaggaaaactccagtcagagcaagaaatactctactaaaatagaaaacctggggcctgaatcggcctgtcgccacttttggagtttccggtatcacgaagcaaccggtcccttagagacaatctcacagctgcagaaactttgccaccagtggctgcggcctgagatccacagcaaagaacaaatactggaaatgttggtgctcgagcagtttttgtccattctgcctaaggagacacagaactgggtccagaaacaccacccacaaaacgttaaacaagccttggtgcttgtcgaattccttcagagggaaccagacgggaccaagaacgaagtgacagcacacgagttgggaaaggaggccgttctacttggagggactgccgtcgctccaggcttcaagtggaaaccagctgagccgcaacccatgggggtgtttcaaaaggagtactggaacacttacagagtgctgcaggagcaattgggctggaacactcacaaagagacgcagcctgtttacgagcgcgcagtccacgatcaacagatgctggcactgagcgaacagaagagaatcaaacactggaagatggcatctaagctgatcctgcctgaatccttgtctctgctaacgtttgaagacgtggccgtgtatttttctgaagaagagtggcaactgctgaatccgctcgagaaaacactgtacaacgacgtcatgcaagatatttacgaaaccgtgatcagcctggggttaaaattgaaaaacgacactgggaacgatcaccctatcagtgtctccacaagcgagattcagacctccggctgcgaagtcagtaaaaagacccgtatgaaaattgctcaaaaaacgatgggcagagaaaaccccggggatacacacagtgtccagaagtggcacagagctttcccccgcaaaaagcggaaaaagcctgccacctgtaaacaagaactgcctaaactgatggaccttcacggcaagggaccgaccggcgaaaagccttttaagtgtcaggagtgtggaaaaagtttcagagtatccagtgacctgataaaacaccatagaattcacaccggagaaaaaccatacaagtgtcagcagtgcgacagaaggttcaggtggtcttccgatctgaataaacattttatgacgcaccagggaatcaaaccatacaggtgttcgtggtgcggaaagtctttttctcataacaccaacctccatactcaccaacgaatacacacgggcgagaaaccattcaagtgtgacgagtgcggcaagcggttcatccaaaacagccatctgattaagcaccagcgcactcataccggtgaacagccatatacctgctcactatgcaaaaggaatttctctcgaaggtcttccctgctcaggcaccagaagctgcaccgccggcgcgaggcctgcttggttagccctaattag

SEQ ID NO: 212401 - DNA, 1548 bp, Artificial Sequence
  Description of Artificial Sequence: Synthetic coding sequence
atggagagcctgggcctgcacaccgtgaccctgagcgacggcaccactgcctatgtgcagcaagcagtgaagggcgaaaaactgctggaggggcaggttattcagctcgaggacggaacgacagcgtacatccaccaggtcacggttcagaaggaggccctgtcctttgaagatgggcaaccggtccagctcgaagatgggtccatggcttatattcatagaacccccagagagggttacgatccttctacccttgaggctgtccaactcgaggacggctccaccgcctacattcatcacccagtcgctgtcccaagtgagagcaccatcctagcggtccagaccgaagtggggctcgaggatctcgctgccgaggacgatgaaggctttagcgccgatgccgtagtggccctggagcagtatgcaagcaaagtgcttcacgatagtcagatcccacgaaatggaaaaggccagcaggtgggcgatagagcgtttcgctgcggatataagggctgcggcaggctttataccaccgcccatcaccttaaggtccacgagcgggcacacaccggggaccgcccctatcgctgtgacttcccttcctgcgggaaggcctttgctactggatatggcctgaagtcccacgttaggacccacacgggagaaaagccttacaagtgtcccgaggaactttgctcaaaggctttcaaaacctccggtgatcttcaaaagcatgtgcggacacatactggcgaaaggccatttcagtgccctttcgaaggatgcggacggagcttcactacgagcaatatccgcaaggtgcatgttaggactcacaccggagagagaccatatacatgccccgagccgcactgtggaaggggctttacttcggcgactaattacaagaatcacgtgagaatacacaccggtgagaagccttatgtttgcacagttcccggttgcggcaagaggttcaccgaatattcttccctgtacaagcatcacgtggttcatacccactgtaaaccttacacttgtagtacttgtggaaagacatataggcagactagcacactggccatgcacaagcgttctgcccacggggagctggaggccaccgaggaatcagagcaagcactgtacgagcagcaacagctggaggctgctagtgctgctgaggaatccccccccccaaagcggccaagaattgcctatctgtcagaagtgaaagaggagcgcgacgacattccagcgcaggtcgcaatggtaaccgaggaagatggtgccccacaggtagcgcttattactcaagatggcgctcaacaggttaccattatcacctcaggggccgtggtcgctgaggacagctctgtggcgtccctccggcaccagcaggtcgctctgcttgccacagcgaatggcactcacattgctgtgcagctcgaggaacaacagaccctggaagaggcaatcaatgttgctaccgcagctatgcaacagggagccgtgacgctcgagactacggtgagcgagtcagggtgttag

SEQ ID NO: 212402 - DNA, 1713 bp, Artificial Sequence
  Description of Artificial Sequence: Synthetic coding sequence
atggagagcctgggcctgcacaccgtgaccctgagcgacggcaccaccgcttacgtgcagcaagcagtaaagggagaaaagttgttggaagggcaggtgatccaactcgaggacggcacgaccgcctatatacaccaggtgactgttcaaaaggaagccctgtcttttgaggacggccagcccgttcagctggaagacggcagcatggcgtatattcatcggacccctagagaagggtatgacccttccactctcgaagcagtccaattagaagacggaagcactgcctatatacaccaccctgtggcagtgccctctgagtctacgatcctggccgtgcagaccgaagtgggtctggaagacctcgccgctgaggatgatgaggggtttagcgctgacgcagtggtggccctggagcagtatgcatcaaaggtgctccacgattctcagatacccagaaatgggaaaggccagcaagtcggcgatagagcatttcgctgcggctacaaggggtgcggacgcctgtataccaccgctcatcacctcaaggttcatgagagagcccataccggcgacaggccctaccgatgtgactttccctcctgcggaaaagcgttcgcaacaggatacggactgaagtcacatgtaagaacacacactggggagaaaccatacaaatgtccagaagaactgtgcagcaaagcttttaagaccagcggggatctgcagaagcatgtaaggactcacaccggcgaaaggcctttccagtgccctttcgagggctgcgggcggtcatttaccacctcaaatattcggaaggtacatgtgcgaactcatacaggggagcgcccgtatacctgtcccgaaccccactgtggccgcgggtttacgtctgccaccaattataagaaccacgtgagaattcataccggcgagaaaccctacgtctgcaccgtacccggatgcggcaagcgatttacagaatacagttccttatacaagcaccacgtagtgcacacgcactgtaaaccatacacctgtagcacatgtgggaaaacctatagacaaacatctacgttggccatgcataagcgctccgcccacggcgagcttgaagcaaccgaggaatcagagcaagccttgtatgagcagcaacagcttgaagccgcaagtgctgcggaggagtcacctcctccaaagagacccagaatcgcctacttgtcagaggtgaaggaagaaagggatgacattcctgcccaagtcgccatggtgactgaagaggatggagctccccaagtggcactgataactcaggatggggcccagcaggtgagcctgtctcccgaggaccttcaggccctcggaagcgccatatctatggtgacacagcacgggagcacaacacttacaattcctagcccagatgccgacctggccacctccggcacacacacagtaacaatggtcagtgccgacgggacccagacccagccagttaccatcatcacatcaggtgccgtggtggcagaggatagctcagtggcttccctcagacatcagcaagttgctctccttgcaactgctaatgggacacacattgcggtacagctggaagaacagcagacccttgaggaagccatcaatgtggcgacggccgcaatgcagcagggcgcagtgacattggagactactgtgagcgaatcaggctgctag

SEQ ID NO: 212403 - DNA, 1287 bp, Artificial Sequence
  Description of Artificial Sequence: Synthetic coding sequence
atggagagcctgggcctgcacaccgtgaccctgagcgacggcaccactgcttacgttcagcaagccgtgaaaggcgagaaattactggagggacaagtgatccagctggaagatggtacaaccgcctacattcatcaagtcaccgtgcagaaagaagccttgtcatttgaagatggccagcccgtgcagctggaggacggctctatggcatacattcacagaactccgagggagggctatgatccttctaccctagaggccgtgcagctcgaagacggatctactgcatacatccatcatcctgtcgcagtgccttctgagagcacaattcttgccgtgcagaccgaggttgggcttgaagatcttgccgccgaagatgatgagggcttcagcgcggacgccgtcgtggctctagagcagtacgctagcaaagtcctgcacgattcacaaattccccgtaacggaaaggggcagcaggtaggcgatcgagccttccgctgtggctacaagggatgtggacgactgtacaccactgcccaccacttgaaagtgcacgaaagggctcacacaggagatcgaccctaccgctgtgattttccgtcttgtggaaaggcctttgcaacaggatatggactgaagtcacatgtgcgaacccacactggggagaaaccttataagtgccccgaagaattgtgctcaaaagcgtttaaaactagcggtgaccttcagaagcacgtacgcacccacaccggtgaacggcctttccagtgtccgttcgaaggctgcggacgctcctttacgaccagcaacattcgcaaagtgcacgttaggacgcataccggggagagaccttatacctgccccgagccacattgcggccgcggattcacctcagcaaccaattataagaatcatgtgcgcatacacactggtgagaagccttacgtctgtacagttcccggatgcggtaagcgatttacagagtactcgtctctgtacaaacaccacgtggtgcacactcactgcaaaccctacacatgctcaacttgcgggaaaacctatcggcagacgtcaacattggccatgcataaacggtctggtcattgcggacacgccgctagaggctgcgatcccggtgacaacagcgtgggcgagtggctcctatctcccaggggcctgggacccacaccctgctggagaaagtgccacctccacggacacagttgccctcagggaccacgtttatggttgacacacaggcgctggcctcacaggtctctcggatag

SEQ ID NO: 212404 - DNA, 1635 bp, Artificial Sequence
  Description of Artificial Sequence: Synthetic coding sequence
atggagagcctgggcctgcacaccgtgaccctgagcgacggcaccactgcctacgtgcagcaggccgttaagggcgagaagctcctggagggccaggtgattcagcttgaagacggaactacagcctacattcaccaggtgacagtccagaaagaaggttatgatccgtccactctcgaagccgtgcagctcgaggacggctctactgcttacatccaccatcccgtagcggttccctctgagagtacaatactcgctgttcagaccgaagttgggctggaagacctagccgctgaagacgatgagggcttctcggcggacgcagtcgtcgccctagaacagtacgcaagcaaagtgcttcacgacagtcagattcctcgtaacggcaaggggcagcaggtgggtgatcgcgcgtttcgatgcggctataagggatgcgggcgcctgtatactacggcccatcacctgaaagtccacgagcgggcccacactggagataggccctatcgatgtgactttccaagctgcgggaaagcttttgctactggttatggactgaagtctcacgtcaggactcacaccggcgagaaaccttataagtgcccagaagaactttgcagcaaggcattcaaaacctcaggggacttgcaaaaacacgtaagaacccatacaggtgaacgaccgttccagtgcccgttcgaaggatgtggtcgatctttcactacatcaaatatccgcaaggtgcacgttcggacacacactggagagcggccttatacatgccccgagccacattgcggcagagggttcacttctgcaacaaattataaaaaccacgtgagaatccatactggcgagaaaccctatgtttgcacggtgcccggctgtgggaaacgttttaccgaatactcatccctgtacaaacatcacgtggtgcacacccactgcaaaccatacacttgcagtacgtgcggaaagacttacagacagacctctactttggcaatgcataagcgttcagcccacggagaactagaggccacggaagagtccgaacaggccctatatgagcagcaacagctggaagctgcatccgccgcagaggagagcccaccccccaaaagaccaaggatcgcctacttgtcggaggtcaaagaggagcgcgacgatatccccgctcaggtagcaatggtgacggaggaagatggagcgcctcaggtagctctcatcactcaggatggggcccagcaggtcagcttgtcccccgaagacctccaggcactgggatccgcaatcagcatggtcacgcagcacggttccacaactttgacaataccctcgcccgatgccgatcttgcaactagcggcacccatactgtgactatggtgtccgcggatgggactcagacacagcctgtaacaataatcaccagtggggccgtagttgctgaagactcctcagtggcaagtctgcgacaccagcaagtggctctccttgccaccgctaacggtacacacattgcagtccagctggaagagcaacagactctcgaggaggccattaacgtggctaccgccgccatgcagcagggcgcagtgactctagaaacgacggttagcgagagtggatgctag

SEQ ID NO: 212405 - DNA, 1209 bp, Artificial Sequence
  Description of Artificial Sequence: Synthetic coding sequence
atggagagcctgggcctgcacaccgtgaccctgagcgacggcaccaccgcctacgtccagcaggctgttaagggcgagaaactgctggaagggcaggtcattcagctagaggacgggacgactgcctatattcaccaggttacggtgcagaaggaggccctttctttcgaggatgggcagcctgtacaactggaagatggatctatggcctacattcatcggactccccgtgaaggctatgacccttccaccctggaggctgtccagctggaggacgggagcactgcatatatccaccatcccgtggctgtgcccagcgagtctacaatactggcggtgcaaactgaagtgggactggaggatctcgcagccgaagatgatgagggctttagcgcagacgccgtggtcgccctggaacagtatgccagcaaggtgctgcacgatagtcagatcccccgaaacggaaagggccagcaggtgggtgacagggctttccgctgtggctacaagggctgcggaaggttgtacaccacagcacatcatcttaaagtacatgagcgggcgcacaccggtgatcggccatacaggtgtgacttcccttcctgtggtaaagccttcgctactgggtacgggctaaagtctcatgtgcgaactcacacaggtgaaaagccatataaatgcccagaggagttatgtagcaaagcattcaagaccagcggtgatctgcagaagcatgtgaggacccacacaggcgaacggccttttcaatgtccatttgagggctgcggcagatcatttacaaccagcaatataagaaaagtgcatgtgcggacgcatacaggtgagaggccctacacctgtcctgagccccactgcgggaggggattcaccagtgccacaaattacaagaaccatgtgagaattcacactggggagaaaccctacgtatgcacggtgcccggctgtgggaagcggttcacagagtacagctcactgtataagcatcacgttgtccacactcatcactgcgggcatgcggcaagaggctgcgacccaggagacaattccgttggagagtggcttctgagccccagagggctcggccccaccccgtgctggcgcaagtgccacctacatggtcatagttgtccgcagggacctaggctctggctgacacataggcggtggcctcaccgttctttagggtag

SEQ ID NO: 212406 - DNA, 1023 bp, Artificial Sequence
  Description of Artificial Sequence: Synthetic coding sequence
atggagagcctgggcctgcacaccgtgaccctgagcgacggcaccacagcctatgtgcagcaagctgttaagggggagaaactgctggagggccaggttattcagctcgaagacggtactaccgcctatattcatcaagtgaccgtgcagaaagaagccctgagcttcgaggacggccagcctgttcagctggaggatggaagtatggcatatatccacagaacaccacgagagggttacgatccttcgacacttgaagctgtgcagctggaagatggctccacagcctatattcatcaccccgtggctgtcccaagcgaatcaaccatcctcgcagttcagacagaggtcgggctcgaagacctggcagccgaagacgacgaagggttctcggcagatgctgtggtagctctggaacagtatgctagtaaggtactgcacgactcccaaatcccacgcaatggtaaggggcagcaagtgggagacagggccttcaggtgcggctataaggggtgtggcagactgtataccactgctcaccacctcaaagtacacgagcgggctcataccggggacaggccttaccggtgcgattttccttcttgtgggaaagcgtttgcaactggctacggcctgaaatctcacgtcagaacacacacaggagagaagccttataagtgccctgaggagctatgctccaaggcctttaaaacttcaggagacttacagaaacacgtccggacccacactggggagcgaccctttcagtgtcctttcgagggctgcggacgcagtttcactacatctaacatacgaaaggtccacgtgcggacacacaccggcgagcgcccttacacttgccctgagccccactgtggccggggttttacatccgccactaactacaagaatcatgtgagaattcatacaggtgagaagccttatgtctgtacagtaccaggatgtgggaagcgcttcacagagtattccagcctatacaaacatcacgtagtacacacatag

SEQ ID NO: 212407 - DNA, 1638 bp, Artificial Sequence
  Description of Artificial Sequence: Synthetic coding sequence
atggactgcgtgatcttcgaggaggtggccgtgaacttcacccccgaagagtgggcgcttctggatcatgctcagaggtcgttgtaccgggacgtgatgctggaaacctgccgtaatttggcttccttagattgttatatctacgtgcgtaccagcgggtcatctagccagcgcgatgtttttggaaatggtatttccaatgacgaagagatcgtgaaatttaccggaagtgactcctggtcaatctttggtgaaaactggcggttcgataacactggagaccagcaccagatcccacagaggcacctgcgaagtcaacttggacgattgtgtgagtcaaacgagggccatcagtgtggtgagacactttcacaaacagccaatctacttgttcataagagctaccctaccgaggcgaaaccatctgagtgtaccaagtgtgggaaggctttcgagaataggcaaagaagccacaccgggcaacgaccttgcaaggaatgtggtcaggcctgcagttgcctcagctgtcagagccctcccatgaagacacaaaccgtggagaagccttgcaactgccaggattcacgaactgcctccgtaacctatgttaagtcactcagtagtaaaaagtcatacgagtgccagaaatgtgggaaagcgttcatttgtcctagcagtttcagaggacatgtgaattctcaccacggtcaaaagacccacgcctgtaaagtgtgcgggaagaccttcatgtactactcttacttgacaagacacgtgcggacccatactggagagaaaccttacgagtgcaaggaatgcgggaaggcttttagctgtccaagttacttcagggaacacgtcagaacccacacaggggaaaaaccctacgagtgcaagcactgcggcaaatcctttagttgctatagttctttccgcgatcacgtacggactcatactggggagaaaccgtgtcagtgtaagcattgcgggaaggcctttacgtgctattcctccctgagggagcatggccgcactcatagtggtgagaagccctacgagtgcaaggagtgcggtaaggcattcaggtacccctcctccctgcgggcccacatgcggatgcatactggcgagaagccctatgtctgtaaacagtgtggaaaagcattcgggtgcccgacatatttcaggaggcacgtcaagactcatagtggggtgaaaccgtatcaatgcaaagagtgcggtaaggcatactctttcagctcctctctccgcatccacgtgagaacgcatacaggtgagaagccttttgagtgcaaacattgcgggaaagctttctcctgtcattcgtctctgcgggagcatgtccgaactcactcgggggaaaaaccctacgagtgtaaccaatgcggtaaggccttctcacacgcccagtacttccagaagcacgtgagatcacattcgggggtgaaaccttatgaatgtaccgagtgtggcaaggcttactcttgctccagctccctgcgggttcatgtcaggacacacaccggcgagagaccatatgagtgtaaacagtgcgggaagaccttccggtatctcgccagtcttcaggctcatgtccgcacgcatgctggggcctag

SEQ ID NO: 212408 - DNA, 1308 bp, Artificial Sequence
  Description of Artificial Sequence: Synthetic coding sequence
cggctgtgcgagagcaacgagggccaccagtgcggcgagaccctgtcccaaaccgctaatctactggttcataagagctaccctacggaggctaagcccagtgaatgtacgaagtgtgggaaaacgttcatgtattactcttacttgaccaggcacgtccgaacacataccggcgaaaagccatatgagtgcaaagagtgcggaaaggccttctcttgcccatcctactttcgcgagcatgtgcgcacccacacaggggagaagccgtacgaatgtaaacactgcgggaagagcttttcctgctattccagcttccgggatcacgttcgcacgcataccggcgaaaagccatgtcagtgcaagcactgtggtaaagctttcacatgttatagctcactgagagaacacggccgaacacactctggagagaagccatacgaatgtaaggagtgtggaaaggctttcagatatccttcaagccttagagctcatatgcgcatgcacacaggtgagaagccttacgtgtgtaagcagtgtggcaaggccttcgggtgccccacatacttccggaggcacgtaaagacccattctggggttaaaccatatcagtgtaaggaatgtggaaaggcctactctttctcatcctcccttcgcatccatgtgcgtactcataccggagaaaaaccctttgagtgcaagcactgtggtaaggcattcagctgccactccagtttgagagaacacgtacgaacccactctggcgagaagccctatgaatgtaaccagtgtggcaaggcattttcgcacgcacagtatttccagaagcatgtacggtctcatagcggggtgaagccatacgagtgtactgaatgcgggaaagcatactcctgttctagcagccttcgcgtgcatgttaggacccacactggcgaacgaccatacgaatgcaaacaatgcggtaagaccttcagctggccttcagatttaagagtgcacatgagaacccactcaggcgaaaagcgctgcggatgtaagcagtgcggcaagtcattcagttccccctcatcctttaaagggcacatcagaactcatacaggggaaaagctctacacctgtcgcgaatgcgggaaggtattctcatctccaagctattttaggacccaagtgcgcattcatatcggggaaaaaccctacgtgtgcgaacagcgcggaaaggtgttctcctggtcctcatcatttcggggccatctgcgaacccatagccgggagaaaccctatgagtgcaaggaatgtactaaggccttctag

SEQ ID NO: 212409 - DNA, 1497 bp, Artificial Sequence
  Description of Artificial Sequence: Synthetic coding sequence
atgctggaggagggcgtgctgcccagccccggccccgccctgccccaggaggagaatacaggggaagaaggcatggcggcaggattacttaccgctggcccaagaggcagcacgtttttcagttcggtcaccgtcgcttttgcccaggagcggtggaggtgtttagtttcgacaccgcgagatcggttcaaagagggcatccctggaaagtcaagaagcctggtactgcttgggcttcccgtgtcccagcccgggatgaattcccagttggagcagcgcgaaggtgcatggatgcttgaaggggaggacttacgctctcccagtcctgggtggaagattatttctggatccccccccgagcaggcactgtccgaagcaagttttcaggatccgtgcgtcgaaatgccccctggggattccgaccatgggacttcagacttagagaagtcattcaatctccgcccagtattgtcccctcagcagcgggtccctgtggaagcacggccgcggaagtgcgagacgcacacagagtcttttaagaattcagaaattctcaagcctcacagggctaaaccatacgcctgcaacgagtgtggaaaagcattcagttactgctcttccttgtcccaacatcaaaaaagccataccggcgagaaaccctatgaatgctctgaatgcggcaaggcatttagccagtcctcaagtctgatccagcaccagcggatccataccggagagaagccctacaaatgctccgagtgcggtcgggcttttagccaaaatgctaatttaaccaagcaccagcggacccataccggggagaagccctaccgctgcagcgagtgtgagaaagcattctctgactgttccgccctggtgcagcaccaaagaattcataccggcgaaaagccctacgagtgtagcgactgcggaaaggcatttagacacagtgcaaaccttactaaccaccagcggactcatactggagaaaagccatataaatgtagcgagtgcggtaaagcattctcttattgtgccgccttcatccagcaccagcgaatccacacaggagagaagccttaccgctgcgccgcctgtgggaaagcattctctcaatcggccaatctgacaaaccaccagcggacacacacaggggaaaaaccttacaagtgctctgaatgtggaaaagcgttcagtcaatccactaatcttatcatccatcaaaaaactcataccggcgagaaaccttataaatgtaacgagtgcggcaaatttttttccgagtcctctgcgctaatccgccatcacattatccacaccggcgagaagccctacgaatgtaatgagtgtggcaaagcatttaaccagagctcttctctgtctcagcaccagcgtattcataccggggtcaagccttacgaatgcagtgaatgtggcaaggctttccggtgctctagcgcctttgtacggcatcagcgcttgcatgcaggagaatag

SEQ ID NO: 212410 - DNA, 1425 bp, Artificial Sequence
  Description of Artificial Sequence: Synthetic coding sequence
atggccgccggcctgctgaccgccggcccccggggcagcaccttctttagctcagtcaccgtcgcatttgcccaggaaaggtggagatgtcttgtatcaactcccagggatcgatttaaagaggggatccccggaaaatcaaggtcattagtccttctcggcctacccgtcagccagcccggtatgaactctcagctggagcagcgggagggagcctggatgctggagggcgaagacctgagaagtcctagtcccggatggaagataatttctggaagccctcccgagcaggcactgtcagaagccagcttccaggacccatgcgtggagatgccaccaggagactctgaccacggcacctccgacctcgaaaagtctttcaacctgcgccccgttctttcccctcaacagagagtgcccgtggaggcccgccctagaaaatgcgagactcacaccgaatccttcaagaatagcgaaatacttaaaccacacagggcaaaaccttacgcttgtaatgaatgcggcaaagccttctcctactgcagtagcctgagccagcaccagaagagccatacaggcgaaaagccatacgaatgctctgaatgtggaaaagcatttagccaaagttcaagtcttatccagcatcagcgaatccacacgggcgagaaaccatacaagtgctcagagtgtgggcgagctttttctcaaaatgccaacctgacaaaacaccaaaggactcacacgggggaaaagccctacagatgttccgaatgcgagaaggcgttcagtgattgttctgcattagtacaacatcaaagaatacataccggagaaaaaccctacgaatgcagcgactgcgggaaagctttccgccactctgcgaatttaacgaaccatcagaggacacataccggagagaaaccctacaaatgttctgaatgtggaaaggcattttcttattgcgctgcctttatccagcaccagaggatccacaccggagagaagccataccggtgcgctgcttgcggtaaagctttttctcagtccgctaatctgaccaaccatcaacgaacccacaccggtgagaaaccctataaatgctccgaatgcgggaaagcatttagccagagcactaatctgattatccatcaaaaaacccacaccggggaaaaaccttacaagtgtaatgaatgcgggaagttctttagcgagagcagcgccctcatacgccaccacattatacacacgggagagaagccctacgaatgcaacgaatgcggaaaggctttcaaccaatcctcctcactgtcgcagcaccaacgcatacacactggagttaagccctacgaatgtagcgaatgcggcaaggcctttaggtgctcctctgcattcgtgaggcatcagcgccttcatgcaggcgagtag

SEQ ID NO: 212411 - DNA, 1728 bp, Artificial Sequence
  Description of Artificial Sequence: Synthetic coding sequence
atggaccccgaggacgagggcgtggccggcgtgatgagcgtgggcccaccagctgccagactacaggaacctgtgactttccgggacgtcgcagtcgatttcacccaagaggaatggggacagctcgatccgacccagcgtattctgtaccgcgatgtcatgcttgagactttcggacatctcctttcgatcggccccgagctaccaaagcccgaggtgatctcccagctggaacagggtacggaactttgggttgccgagaggggcactactcaagggtgtcatccggcctgggagcctaggagcgaaagccaggcatcccgtaaggaagaaggactgccagaggaggagcctagccatgtgactggaagggaggggttccccactgacgcgccctaccccaccacacttggtaaggacagagagtgccaatcccaatctcttgccctcaaagaacagaataatctgaaacaactggagttcggtctaaaagaggcgcctgtgcaggatcaggggtacaagacactacggctgagagagaactgcgtgctctccagtagtcccaacccttttccagaaatttcaaggggagagtatctctatacgtatgacagccaaattacagactctgagcacaactcctctctggtgagtcagcagacggggtcccctggcaaacagcctggagaaaactccgattgccacagggacagcagtcaagctattcctataaccgaacttacgaagtcccaagtccaagataagccgtacaagtgcacagactgtggaaaatcctttaaccacaacgcccatctgacagtgcacaagcggatacacactggagagagaccatacatgtgtaaagagtgcggcaaagcttttagccagaatagtagtctggtccagcacgagcgtatacacaccggggacaagccctataagtgtgcagagtgcgggaaatccttttgccacagtactcacttaactgtgcataggagaatccatacaggcgaaaaaccctacgagtgccaagactgcggacgggcgttcaaccaaaactcgtcgctgggacggcataagaggacacacactggagaaaaaccatacacatgctcagtttgcggcaaatccttctccaggactacctgcctcttcctccatctcagaacccacaccgaggaaagaccatacgagtgcaaccattgcggcaaaggctttcgccatagctcctccctcgcccaacatcagaggaaacacgctggagagaaaccatttgaatgtcgccagagacttatcttcgaacagactcccgccctgacaaagcacgagtggactgaagccttgggctgcgatccaccactgtcccaggatgagagaactcaccgtagtgaccgaccttttaaatgtaatcaatgtggaaaatgcttcattcagagtagccatctgatccgtcatcagatcactcacactagagaagaacagccccatgggaggtccagacgcagagaacagtcgtcatcccggaatagccatctggtccagcaccagcaccccaattcccgcaagtcaagcgcgggtggggccaaagcaggccagcctgagtctcgcgccttggctctgtttgatatccagaagataatgcaggaaaaaaaccccgtgcacgtaattggcgtggaggagcctagcgtcggcgcctcaatgctgtttgacattagggaatccacctag

SEQ ID NO: 212412 - DNA, 519 bp, Artificial Sequence
  Description of Artificial Sequence: Synthetic coding sequence
atggaccccgaggacgagggcgtggccggcgtgatgagcgtgggcccaccagcagcaaggttgcaggtcacaatcactactatcacaactgctgccggcagtggacaggcatctcccgcccagaccgaccccttcacgagtagacgtgatgaatcagggaccgccgtcaacgccctggacacatggggcaattcagatgcaggcaggggcgtggtcacggtcctcgctggccagcggggagggcgggacagcaatcaggctcctgggccccgtatgcgcatgcttcacgccgctttgagtagtcccgcgcccagaagcccatgtcctggtgcttgggcacagccactcgggggcaacgatgggagccccaggacagagtgcgacgaatctgaccatcaaggccgaccactgagagattgcgggaggaccgctgtgcaaggcgggcagtgtcttcaaggacatcttgccatccgggcccctctgtcaagacagtccggctgcggtctgtgttctccatag

SEQ ID NO: 212413 - DNA, 873 bp, Artificial Sequence
  Description of Artificial Sequence: Synthetic coding sequence
atgtgcaaggagtgcggcaaggccttcagccagaacagcagcctggtgcagcatgagagaattcacactggggataagccgtacaagtgtgctgaatgcgggaaatccttttgtcattccactcacctgactgtccaccgccgcatccacaccggcgaaaaaccctacgaatgtcaagattgtggccgggcgtttaaccagaacagtagtcttggtcggcacaagcgcacccataccggcgagaagccttacacatgttccgtgtgcggtaaatccttttcaagaactacatgcctctttctccacctgcgtactcatacagaagagagaccatacgagtgtaatcactgtggaaagggcttcagacacagtagtagcctcgcacagcaccagaggaaacacgccggagaaaaacccttcgaatgtcgccagcgtctgatattcgaacaaaccccagcccttactaaacatgagtggacggaggctttaggctgcgatccgccgctctctcaggatgaacggacccaccgcagcgatcgccctttcaagtgtaaccagtgtggcaaatgcttcattcagagttcgcatttgatacggcaccagataacacatacgcgcgaggagcagccccacggccggtctcggagaagagaacagtcaagtagtcgaaattctcacctggtgcaacatcaacatcccaactctagaaaatctagcgctggcggggctaaggccgggcagcctgaaagtcgtgccctggcactcttcgacatacaaaagatcatgcaggagaagaatccagtccatgtgatcggcgtcgaagaaccctccgttggtgcatctatgctctttgacattcgggaaagcacttag

SEQ ID NO: 212414 - DNA, 822 bp, Artificial Sequence
  Description of Artificial Sequence: Synthetic coding sequence
atgagccccaagcgggacggcctgggcaccggcgacggcctgcacagccaggtgctgcaggagcaagtgtccactggagacaacctgcatgaatgcgactcacaaggcccaagcaaagacactctggtgagagaaggaaagacttataaatgcaaagagtgtgggtccgtgtttaacaagaacagcctcttggtgagacaccagcagatccacactggagttaaaccttatgaatgccaggagtgcggaaaagcatttcctgagaaggtcgatttcgtgagaccaatgcggatccataccggtgagaagccatgtaaatgtgtggagtgtggcaaagtgtttaaccgaagatcccatctcttgtgttacaggcagattcatacgggtgagaagccttacgagtgctccgagtgtggcaagacattctcttaccacagcgtgtttattcaacatagggtcactcataccggggaaaaattgtttgggtgtaaagaatgcggcaagacattttactataatagctccctcaccagacacatgaaaatccacaccggggagaagccctgtaagtgcagcgagtgcggaaagaccttcacataccgctccgtgttcttcagacattctatgacccatacggccggcaagccatacgagtgcaaagaatgcggcaagggtttctactactcctactctctgacccgccacacacgcagccatactggagagaagccgtatgagtgtttagagcacagaaaagacttcggctatcactccgccttcgcacagcagagtaaaatccacagcggtggcaaaaatttatag

SEQ ID NO: 212415 - DNA, 822 bp, Artificial Sequence
  Description of Artificial Sequence: Synthetic coding sequence
atgagccccaagcgggacggcctgggcaccggcgacggcctgcacagccaggtgcttcaagaacaggtctccacgggtgacaacctccacgagtgtgattcccagggcccttcaaaagacacactggtgcgggaaggcaagacatacaagtgcaaagagtgcgggtccgtcttcaataaaaatagccttcttgtgagacaccaacagatccacactggagtgaaaccttatgagtgccaggaatgcgggaaagccttccctgaaaaagttgactttgtccggcctatgcggatccacacaggcgaaaaaccgtgcaagtgtgtcgaatgtggcaaggtttttaaccgtcggtcccacctgttgtgctaccgccagatacataccggagagaaaccttatgaatgctcagagtgcggcaaaactttcagctatcactccgtctttatccagcacagggtaacccatacaggggagaaactgtttggttgtaaggaatgcgggaaaaccttctactataattctagtttaacacggcatatgaagatccataccggggaaaaaccatgtaaatgtagtgagtgtggcaagacattcacctaccggtctgtcttctttcgacacagtatgactcataccgctgggaagccatacgagtgtaaagagtgcggaaaaggattctactattcctacagtttgacccgtcataccagatctcacacaggcgagaagccctatgagtgcctggagcataggaaggatttcggataccactccgccttcgcacagcagagtaaaatccatagtggagggaagaacctgtag

SEQ ID NO: 212416 - DNA, 3630 bp, Artificial Sequence
  Description of Artificial Sequence: Synthetic coding sequence
atggagtgctactacatcgtgatcagcagcacccacctgagcaacgggcactttaggaatattaaaggggtctttcggggtccgctgtcgaagaacggcaacaagaccctggactatgcggaaaaagagaatactatagccaaggcgctagaggacctcaaagcaaatttttactgtgaactatgcgataaacaatactacaagcaccaggaatttgacaaccatatcaattcttacgatcacgcccataagcagaggttgaaggaactgaaacagagggaatttgcgagaaacgtcgcgagcaaaagccgcaaggatgaacggaaacaagaaaaagctctgcagagactccacaagcttgccgagctgcggaaagagaccgtctgtgcaccaggaagtggaccaatgttcaaatctaccacggtaaccgttagagaaaattgcaatgaaatcagccaacgagtggtcgtggacagcgtgaacaatcagcaggatttcaagtatactttgattcatagtgaagagaataccaaggatgcaaccactgttgctgaggaccccgaaagcgcaaacaattacactgcgaagaacaatcaagttggcgatcaagcacagggcatccatagacataaaatcggcttcagcttcgcatttccaaagaaggcgtctgtgaaattagaatcatcggctgctgctttcagcgaatattcagacgacgcatccgtgggaaaaggcttttcacgtaagtcccgctttgtgccatcagcctgtcatttacagcagtcctcccctacagatgtgctgctctccagtgaggaaaagacaaactcattccacccacctgaggctatgtgtagggataaagaaacagtacagacacaggaaattaaggaagtgtcatctgagaaggacgctcttcttcttccaagcttctgtaagttccaattacaactgtccagtgacgcggacaattgccagaactcagtccctctggcagatcaaatccccctggagagtgtagtgatcaacgaggacatcccagtgagcggaaattcattcgaattgctaggaaacaaatctaccgtcctggatatgagcaacgactgtattagtgttcaagctacaacagaggagaacgttaagcataacgaagcgtccaccaccgaggtcgagaataaaaatggccctgagacccttgcaccctccaacaccgaggaagtaaatatcactatccacaaaaagactaacttttgcaagaggcagtgtgagccatttgtgcctgtcttaaataagcaccgcagtacagtcctgcagtggccctccgaaatgctggtctataccactaccaaaccctcaatctcctatagctgcaacccgctctgcttcgactttaaatctaccaaggtcaataacaatctagacaagaataaacctgatcttaaagatctgtgttcacagcagaagcaggaagacatctgtatgggacccttgtccgactataaggatgttagcaccgaaggactgacagactacgaaatcggatctagtaaaaataagtgctcacaggtgacaccactgttggccgatgatatattgagttctagttgtgactctggcaagaacgagaacactggtcagcggtacaaaaatattagttgcaaaatacgggagaccgaaaagtataatttcaccaagagccagattaagcaggacactctggacgaaaagtacaacaaaatccgtctgaaagagacacacgaatactggtttcacaaatctcgacggaagaaaaagcgtaagaaactatgccaacaccaccatatggaaaagacaaaagaaagtgagacgaggtgtaaaatggaagctgaaaactcatacaccgaaaatgcaggaaaatatctcctagaacctatatcagaaaaacaatatctcgcagccgagcaactgcttgactcccatcagcttttagataaaaggccaaagtctgagtctatttcgctgtctgataacgaggaaatgtgtaaaacctggaatacggaatacaacacctatgacacaattagttcaaaaaatcattgcaagaaaaatactattctacttaatgggcagtccaatgcaactatgattcattctggcaaacacaacttaacgtattctagaacgtattgttgttggaagaccaaaatgtcttcctgctcgcaggaccatcggtccctggtcctgcagaacgatatgaagcacatgtctcaaaaccaggcagtgaaacggggctataactccgtcatgaacgagtccgagcgcttctaccgaaagagacgccagcatagccattcatactctagtgatgagagcctcaaccgccagaatcacttgccagaagaattccttcggccgccatccacaagtgtcgcaccctgcaagcctaagaagaaacgtcggagaaaacgggggagattccacccaggatttgagactttggagctaaaggagaataccgattatccagtaaaagataactccagcctcaatcccttggaccgattgatatcagaagacaagaaagaaaagatgaaacctcaagaggttgccaagatagaaagaaatagtgagcagactaaccaattgcggaataaactcagcttccaccccaacaatctcctgccttcagagaccaacggggaaactgaacatctcgagatggagactacgtccggggagttaagcgatgtgagcaatgatcctacgacctccgtttgtgtggcctccgctcctacaaaggaggccattgacaacaccctattggagcacaaagagcggtctgagaatattaatctgaatgagaagcagattccttttcaggtcccaaacattgagagaaatttcaggcaatcccagcccaaatcatacctgtgtcattacgaactggcagaggccctgcctcagggaaagatgaacgagaccccaacggagtggctgagatacaactctgggatactgaacacgcagcccccactccctttcaaggaagcccacgtgtctggtcacactttcgtgacagccgaacagattcttgcacccttggctctaccggagcaggcgttgttgattcctctcgagaaccacgataagtttaagaatgtcccctgcgaagtctatcagcacattctgcaaccaaatatgctggcgaataaagttaaattcacctttccacccgcagcccttcccccaccttccactcctttacagccactgcctctccagcaaagcctttgtagcacctcagtcacgaccatccatcacaccgtgctgcaacagcacgccgcagccgctgccgctgcggccgccgctgccgccgctggtactttcaaagtcctgcagccacatcaacagtttctatctcagattcctgcgcttactaggactagcctgccccagctcagcgtcggccctgtcggacctagactctgtcccgggaatcagccaacttttgttgctcccccgcagatgcccataattcctgcaagtgtgcttcacccttctcacctggccttcccttctctgcctcatgccctgttcccaagcttactctcacctcatcctactgtgatccctcttcagcctctattctag

SEQ ID NO: 212417 - DNA, 210 bp, Artificial Sequence
  Description of Artificial Sequence: Synthetic coding sequence
atgcccgccaacgaggacgccccccagcccggcgagcacggcagcgcgtgcgaagtttcagtgtcgtttgaggatgttacagtcgatttttctcgcgaggagtggcagcagctcgactccacgcaacgtcgcctgtatcaggacgttatgctcgagaactactcgcaccttctctctgtcggcaaagataaccatccagtcaagctgtag

SEQ ID NO: 212418 - DNA, 1986 bp, Artificial Sequence
  Description of Artificial Sequence: Synthetic coding sequence
atgcccgccaacgaggacgccccccagcccggcgagcacggcagcgcttgcgaagtgtccgtcagctttgaagacgtcactgtggatttttcacgtgaggaatggcagcagctcgactcaacacagaggcggctgtaccaagacgtcatgctggagaattacagccatctgctgagcgtagggttcgaggtgccaaagccggaagtaatcttcaaactcgagcaaggcgaaggcccttggactctggaaggggaggcgcctcaccagtcttgctccgacgggaaattcggaatcaaacctagccagagaaggatctctggcaaatcaaccttccattccgagatggagggcgaagacacccgggacgactccctgtattcaatcctggaagaactgtggcaggacgctgagcagatcaagcggtgtcaagaaaaacacaacaaactgctcagccggaccaccttccttaataagaaaatccttaataccgagtgggattacgaatataaggacttcggaaagttcgtgcatccttctcctaacttaattctgtcacaaaagcgtccgcacaaacgggattcctttgggaaaagtttcaaacacaatttggacctgcacattcacaataaatcaaatgcagctaaaaatctcgacaaaacaatcggacatggccaggtctttactcagaacagtagttacagccatcacgaaaacacccatactggagtgaaattttgtgagaggaatcagtgcggtaaggttctgtctctgaagcactcattgagccaaaacgtgaaatttcccattggggagaaggcgaatacctgcacggaattcggtaagatcttcacccagagaagccactttttcgcgcctcagaagatccatacggtggagaagccacacgaactgagcaaatgtgtgaatgtgttcacccaaaaacctctgctctcaatctacctgagagtgcatagggatgaaaagctctatatatgtaccaaatgcggtaaggccttcattcagaattcagagctgataatgcacgaaaagacgcacactagggagaagccatataagtgtaacgagtgtggaaagtctttcttccaggtgtcatccctgctgcgtcaccagactacacacacaggcgagaagctctttgagtgctccgagtgtggaaaggggttctcactaaactccgcactgaacatccatcagaagatccataccggggagcggcaccacaagtgctcggagtgtggaaaggcgttcacacagaaaagcactctgcgaatgcaccagaggatccatacgggggaaaggagctacatatgtacccagtgtggtcaggccttcattcagaaagcacaccttatcgctcatcagcgtattcatacaggcgagaagccatatgaatgttccgactgtggaaagagctttccgagcaagtcccagctccaaatgcacaagcgaatccacactggggagaaaccttacatatgcacggaatgtgggaaggcctttacgaatcgatcaaacctgaatacccatcagaagtcccataccggtgaaaagtcttatatctgtgctgagtgtggcaaggcctttaccgaccgctctaatttcaacaagcatcagaccatacacactggggagaagccctatgtgtgcgccgattgcggcagagcttttattcagaagagtgaactcataacacatcaacgtatccacactacagagaaaccctacaagtgcccagattgcgagaagagcttttccaagaagccccacctgaaagtgcaccagcgcatacacaccggggagaagccgtatatctgcgcagaatgtgggaaggccttcaccgatcggtctaattttaacaaacaccaaaccatccatactggcgataagccatacaaatgctctgattgcggtaaaggcttcacccagaaatctgtgctgagcatgcacaggaacatacatacctag

SEQ ID NO: 212419 - DNA, 312 bp, Artificial Sequence
  Description of Artificial Sequence: Synthetic coding sequence
atgcccgccaacgaggacgccccccagcccggcgagcacggcagcgcctgtgaggtctccgtgtctttcgaagacgttactgtggacttctctcgcgaagaatggcagcagctcgattctacacagcggcggctctatcaggatgtcatgctggagaattacagtcatttgttgtcagtgggattcgaggtgcccaagccagaagttatcttcaaactggagcaaggagaaggcccctggaccttggagggcgaggctcctcatcagagctgtagtgggatttcaacctacttcgtgacctcaaccgtctag

SEQ ID NO: 212420 - DNA, 1986 bp, Artificial Sequence
  Description of Artificial Sequence: Synthetic coding sequence
atgcccgccaacgaggacgccccccagcccggcgagcacggcagcgcttgcgaagtttcagtcagtttcgaggacgtgactgtggacttctccagggaggagtggcaacagcttgacagtacccagcggcgactttatcaggatgtgatgctggaaaattattctcatctgctttcagtcggtttcgaagtccctaagccggaggtgatttttaaactcgagcaaggggaaggaccatggactctcgaaggagaggccccgcatcagagttgttccgatggaaaattcggcatcaagccttctcaacgacggataagtggtaagtccacattccattccgaaatggaaggcgaggacacacgggatgatagcctgtattcgatccttgaggaactgtggcaggatgcagaacagattaagcgttgccaggagaagcacaataaactgctcagccgcaccacctttctgaacaaaaagattctaaacaccgagtgggactacgagtacaaggattttggaaaatttgtgcatccatctcccaacttgatacttagccagaagaggcctcacaagcgcgatagtttcggcaagtccttcaaacacaacctcgacctgcacattcacaataaaagtaacgcagcaaaaaacctggataagaccattggtcacgggcaagtgttcactcagaacagctcgtactcccaccacgagaatactcataccggtgtgaagttttgcgagcggaatcaatgcggaaaggtcctatctctgaaacacagtctaagtcagaatgtgaagttccctattggtgagaaggctaatacctgcaccgagtttggcaagattttcacccagaggtcccatttcttcgctcctcagaagatccatactgttgagaaaccacacgagctgtctaaatgcgtgaatgtgtttacccagaagccattattatccatctacctgagagtccacagagacgagaaactctatatttgtaccaagtgcggcaaagctttcattcaaaatagcgagctcatcatgcacgaaaaaacacacactcgtgaaaagccgtacaaatgtaacgagtgtgggaagtcatttttccaggtgtcctccctccttaggcatcaaaccacccacacaggggagaagttattcgaatgctcagagtgcggcaagggtttcagcctgaactcggcactgaatattcatcagaaaatccacaccggcgaaaggcaccacaagtgttcagagtgcggcaaggcgtttacccagaagagtactcttcggatgcaccagcgtatacacaccggcgaaaggtcatatatatgcacccaatgcgggcaagccttcattcagaaggcgcatctaatcgcccaccagcgcattcacactggagaaaagccgtacgagtgttcggactgcggtaagtccttcccttctaaatcacagctacaaatgcacaaaaggattcacacaggtgaaaaaccttacatctgcacagaatgcggcaaagcattcaccaatcgtagcaacctgaacacgcaccagaaatcccataccggggaaaagagctatatctgtgccgagtgcggcaaggcattcacagaccgctccaatttcaataagcatcagaccatccatactggagaaaagccctatgtgtgcgccgactgcgggcgagcctttattcaaaagtcagagctgatcacacaccagcgcatccatactacagagaagccgtacaagtgccccgattgcgaaaagtcatttagcaagaaaccccatctcaaggtgcatcagaggattcacactggtgaaaagccatatatatgcgccgagtgtgggaaagcattcaccgatcggtcaaacttcaataagcaccagacaatccacaccggcgacaaaccctataaatgctccgactgtggtaagggcttcacacagaaatcagttttgtccatgcataggaatatacacacgtag

SEQ ID NO: 212421 - DNA, 369 bp, Artificial Sequence
  Description of Artificial Sequence: Synthetic coding sequence
atgcccgccaacgaggacgccccccagcccggcgagcacggcagcgcctgtgaggtgagcgtctcctttgaagacgtgaccgtggacttttctcgggaggaatggcagcaattagactctacccaacggcgcctctatcaggatgtgatgcttgagaattattcccaccttctgtcggtcggcttcgaagtgccgaagccagaggtcattttcaagttggaacagggggaaggtccctggaccctggaaggcgaggcaccgcaccagtcctgcagtgacggcaaattcggtattaagcccagtcaacggcggatcagtggcaaatcaacttttcactcagaaatggaaggcgaggacactctctgctag

SEQ ID NO: 212422 - DNA, 1551 bp, Artificial Sequence
  Description of Artificial Sequence: Synthetic coding sequence
atgcacggccggaaggacgacgcccagaagcagcccgtgaagaaccagctgggcctcaacccacagagccacctgcctgagctgcagcttttccaagctgaggggaaaatctacaaatatgatcacatggaaaagtcagtgaattccagctcccttgtttccccgcctcagaggatcagttcaaccgtgaagacgcacatctctcacacttatgagtgcaactttgttgactcactctttactcagaaagagaaggctaatattggtacagaacattacaaatgcagcgagcggggaaaggcattccaccagggcctccacttcactatccatcagattatccacactaaggagacgcagtttaagtgcgatatttgtggtaagatttttaacaagaagtccaacctcgctagccaccagcgaattcatactggagagaagccgtataagtgtaacgaatgcggtaaggtgtttcacaatatgagccatctggctcaacatcggcggatccatactggagagaagccatataagtgtaatgagtgtgggaaagtcttcaatcagattagtcacctggcccaacatcagaggattcatactggggagaagccatataagtgcaacgagtgtgggaaagtcttccaccaaatcagtcacctggctcaacaccggaccatccacactggggagaagccttatgagtgtaacaagtgcggcaaagtgttcagtaggaattcttaccttgtgcaacacctgatcatccacacaggagagaagccatatcgctgtaacgtgtgcggcaaggtgtttcatcacatctctcatctggcccagcatcagcggattcacacaggcgagaagccctataagtgtaacgaatgtggtaaagtgttttcacacaagtcctcacttgtgaaccattggaggatccacactggggagaaaccgtataagtgcaacgaatgcggcaaagtctttagccataagagcagcctggttaatcattggcgcatccacactggtgagaaaccgtataagtgtaacgagtgcgggaaagtgtttagccgtaatagctacctggctcaacacctgatcatccacgccggcgaaaagccatacaagtgtgacgagtgcgacaaggcttttagtcagaactcacatttggtgcagcatcatcgcatacacactggcgagaaaccttacaagtgtgatgagtgtgggaaagtcttttcacagaattcctatttggcttaccactggcggatccatactggagagaaggcctataagtgcaatgaatgtggaaaagttttcggcctgaactcgagcctcgcccaccaccgaaagatccacaccggggagaagcctttcaagtgtaatgaatgcggcaaagcgttttctatgagaagcagcctcaccaatcatcatgctatacacaccggcgaaaaacactttaagtgtaacgagtgtgggaagttgttccgagataacagctatctggtccgccaccaaagatttcatgcaggtaaaaagagcaatacttgcaactag

SEQ ID NO: 212423 - DNA, 1467 bp, Artificial Sequence
  Description of Artificial Sequence: Synthetic coding sequence
atgcacggccggaaggacgacgcccagaagcagcccgtgaagaaccagctcggactcaatccccagagtcacctccccgagttacagctgtttcaggcagaggggaagatttataagtatgaccacatggaaaagtctgtgaactcctcctccctagtaagcccgccccaacgcatcagctcaactgtcaaaacgcacatcagtcatacttatgagtgtaacttcgtagacagtctgtttacacaaaaagaaaaggctaatatcggcactgaacactataaatgttccgagaggggaaaagcctttcatcagggactgcactttacgatccatcagatcattcacaccaaagaaacccaatttaaatgcgatatttgcggcaaaatattcaacaaaaaatctaacctggcttctcaccagcgtattcacacgggtgagaaaccctacaagtgtaacgaatgtggaaaagttttccacaatatgtcacacctagcccagcaccgccggatacacaccggcgagaaaccatacaagtgtaatgagtgcggcaaagtatttaaccagatttcacaccttgctcagcaccagaggatacatacaggggaaaagccctataagtgcaacgaatgtggaaaggtctttcatcagatttcgcatcttgcgcagcatcggacaatccacacgggggagaagccctacgaatgcaacaaatgcggaaaggtattcagcagaaacagctatctggtgcaacacctgatcattcacactggggaaaaaccctaccgctgtaacgtatgcggtaaagtctttagtcacaagtcctctctagttaaccactggagaatacacacaggcgagaaaccctacaagtgcaacgagtgcggcaaagtttttagtcacaagagctccctagtgaaccattggcgcattcatacaggagagaaaccttacaaatgcaacgagtgcggcaaggtttttagtcggaattcttatctcgcacagcacctcatcatccacgctggagagaagccttacaagtgcgacgaatgtgataaagcattctctcagaacagccacctggttcagcaccataggatccatacaggggaaaagccatacaaatgtgacgaatgcggcaaggttttctctcagaatagctacctggcctaccactggagaatacatacgggagaaaaagcatataagtgcaacgaatgcggaaaggtcttcgggttaaacagctctttagcacatcatcgaaaaatccatactggggagaagcccttcaagtgcaacgaatgcggtaaagctttttctatgagaagctccttgacgaaccaccacgcgatccacacaggagaaaaacacttcaaatgtaatgagtgtggcaaactctttcgggacaactcctaccttgtgaggcaccagagatttcacgcagggaaaaagagcaatacatgtaactag

SEQ ID NO: 212424 - DNA, 1467 bp, Artificial Sequence
  Description of Artificial Sequence: Synthetic coding sequence
atgcacggccggaaggacgacgcccagaagcagcccgtgaagaaccagttggggttgaatcctcagagccacctgcctgagctacaattgttccaggcagaggggaaaatctacaaatatgatcatatggagaagagtgtcaactccagttcgctggttagccccccgcagaggatctcaagcacagtgaaaacgcatatctctcatacttacgaatgcaatttcgtcgatagtctgttcacacagaaggagaaagcaaacatcggcactgaacactacaagtgctctgagcgtgggaaagcgtttcaccaaggtttgcacttcaccatccatcagattattcatacaaaggaaacacagtttaaatgcgacatttgcgggaagatctttaataagaagtccaatctggctagtcaccagaggattcacacaggtgagaagccatacaagtgtaatgaatgcggcaaagtgttccacaatatgtcccacctggctcaacatcgccgaatacacactggtgaaaaaccctacaagtgtaatgagtgcgggaaggtgtttaaccagatttcccaccttgctcagcaccaaagaatccacaccggtgagaagccatacaaatgcaatgagtgcggcaaagtcttccatcagatcagtcacctcgcccaacaccgaactatccacacaggagaaaagccctatgaatgcaataaatgcggtaaggtttttagcaggaattcatatctcgtccaacacctcatcatacacacaggagagaaaccttaccggtgtaacgtgtgtggaaaggtgtttagtcacaagtccagtttggtcaatcactggcggattcacaccggagaaaagccctacaagtgcaacgaatgtggcaaggttttcagccacaaatcaagtctcgtgaaccactggagaatccataccggcgagaaaccctacaaatgcaacgagtgtggaaaagtattttcccggaactcatacctggctcagcacctgattatccatgctggggagaagccatacaaatgtgatgaatgtgacaaggccttctctcagaattcgcacttagtgcaacaccacagaatccacaccggggagaaaccgtacaagtgcgatgaatgcgggaaggtttttagccaaaattcttacctggcctaccactggaggatccacaccggcgagaaggcatacaagtgtaatgagtgcggaaaggttttcggactgaacagcagccttgctcaccacaggaagattcacacaggggaaaagcctttcaagtgtaacgagtgcggcaaagccttcagcatgcggtccagcctgaccaaccaccacgccatccacacgggtgaaaagcacttcaagtgtaacgagtgcggtaaactgtttcgggacaatagctacttggttaggcaccagcggttccacgctgggaaaaaaagcaatacctgtaactag

SEQ ID NO: 212425 - DNA, 1551 bp, Artificial Sequence
  Description of Artificial Sequence: Synthetic coding sequence
atgcacggccggaaggacgacgcccagaagcagcccgtgaagaaccaactgggcttgaacccacagtcccacctgcccgagctgcagttgtttcaggccgagggcaagatctacaagtacgatcacatggagaagtcagtaaacagcagcagcctggtgagtcctccccagcgcatttcgagtaccgtgaagacccacatatctcacacttacgagtgcaattttgtggatagcctctttacccagaaggaaaaggctaatatcggcaccgagcactataagtgctctgaaaggggcaaagccttccatcagggcctacacttcactatccatcagattatacatacaaaggaaactcagttcaaatgtgatatctgcggaaagatctttaataagaagtcaaacttggctagtcaccagcggattcataccggggaaaaaccctacaaatgcaatgagtgtgggaaagttttccacaatatgagccacctggcccagcaccggcggatccacacaggagaaaagccatacaagtgtaatgaatgtgggaaggtgttcaatcagatctcacatctcgcccagcaccaacgcatccacacaggcgaaaaaccatacaagtgtaacgagtgcggtaaagtatttcatcaaatcagtcatctagctcagcatcgcacgattcacaccggcgagaaaccgtacgaatgtaataaatgtggcaaagtgttctctagaaactcatatctggtgcagcacttaataattcacacaggggagaagccctatcggtgcaatgtttgcggaaaagtattccaccacattagccatctcgcccagcaccagcggatccatactggggaaaagccttataagtgtaatgagtgtggcaaagttttctcccacaagtcaagcctggtcaaccattggcgcatccatactggggagaagccttataaatgcaacgaatgtgggaaagtctttagtcacaaaagctccctcgtgaatcactggagaatacacacgggagagaagccgtataagtgcaacgagtgtggaaaagtgttctcccggaacagctatctggcacaacatttgataatccatgcgggcgagaagccttataagtgcgacgaatgtgacaaggcattcagccagaatagccacttagtccagcatcatcgaatccacactggagagaagccttataagtgtgacgagtgcggaaaggtgtttagccagaactcttacttagcgtatcactggaggatccacacgggcgagaaggcatacaaatgcaatgagtgcggcaaggtcttcggcctgaacagctccttagctcatcaccgtaagatccataccggcgagaagcccttcaagtgtaacgaatgcggcaaggccttttctatgaggagttcccttactaaccatcatgccattcacacgggagagaaacatttcaagtgcaatgagtgcggcaaactctttcgggataattcttacctggtgcgccaccagcgttttcatgccggtaagaaatctaacacctgtaattag

SEQ ID NO: 212426 - DNA, 1551 bp, Artificial Sequence
  Description of Artificial Sequence: Synthetic coding sequence
atgcacggccggaaggacgacgcccagaagcagcccgtgaagaaccagttaggactaaaccctcagagccacctcccagagctgcaactctttcaggctgaggggaagatttataagtatgatcatatggagaagtcagttaactctagtagcctggtatctccacctcagagaatttctagtacggtcaagacgcacatttcccacacatatgagtgcaatttcgtggactccctcttcacgcagaaggagaaggcaaacatcggcaccgagcactataagtgcagcgagagaggcaaggctttccaccaggggctgcatttcacaattcatcagattattcatactaaagagacacagttcaaatgcgacatttgcggcaagattttcaacaaaaaatcaaatctggcatctcatcaaagaatacatactggcgagaagccttacaaatgcaatgagtgtgggaaggtgtttcacaacatgagccacttggctcagcatcggcgcatacacactggggagaagccttacaagtgtaacgagtgcgggaaagtattcaaccagataagccacctagctcagcaccagcggattcataccggggagaaaccctataaatgcaacgaatgcggaaaggtgttccaccagattagccacttggcccagcatagaacaatacacactggagagaagccctacgagtgtaataagtgcggaaaggtattctcccgcaacagctacttggtccagcatctgatcatccataccggtgaaaagccataccgttgcaacgtgtgcggaaaagtgtttcatcacatttcgcaccttgcacaacaccagagaatccacactggggagaaaccatacaagtgtaacgagtgtggcaaagtgttttctcacaagtccagcctggtcaatcattggcggattcacacaggtgaaaaaccatacaaatgtaatgagtgtggaaaggtgttttcgcataaatctagtctcgtcaaccattggcgtattcataccggagagaagccatacaaatgcaatgaatgtggtaaagtgtttagtcggaattcatacttagcccagcatcttatcatccatgcaggggagaaaccctataaatgtgacgaatgtgataaagcttttagccagaacagtcacttggttcaacatcatagaatccacaccggggaaaaaccctataaatgtgatgaatgcggcaaggtcttctcccaaaacagttacttggcctaccactggcgtatccacacgggcgagaaagcgtataagtgcaacgaatgtgggaaggtctttgggttgaacagctctctggcacaccacagaaaaatccataccggagaaaagccctttaagtgcaacgaatgcggcaaggccttttctatgagaagttcacttacaaaccaccacgcaatccacacgggcgagaagcatttcaaatgcaacgagtgcggaaagctctttcgcgacaactcctacctagtcaggcaccagcggttccacgctggaaagaagtcaaatacctgcaactag

SEQ ID NO: 212427 - DNA, 1551 bp, Artificial Sequence
  Description of Artificial Sequence: Synthetic coding sequence
atgcacggccggaaggacgacgcccagaagcagcccgtgaagaaccagttgggcttgaaccctcagtcccacttaccagaactgcagctctttcaagcagaaggtaagatatacaagtacgatcatatggaaaagtccgtgaattccagttctttggtgtcaccccctcagcggataagtagtacggtaaaaacacatattagccatacctatgagtgcaatttcgtggactctttgtttacccagaaagaaaaggcgaacataggcaccgagcactataagtgcagtgagcggggcaaggctttccaccaaggtctccactttacaatccatcagatcattcacactaaagaaactcaatttaaatgtgacatctgcggcaaaatttttaacaagaaatcaaatctagcctcccaccaaaggatacacaccggagaaaaaccctacaagtgcaatgaatgcggaaaagtgtttcataacatgagccatctcgcccagcatcgaaggattcacacaggggagaaaccatataagtgtaatgagtgtgggaaagtgttcaaccaaattagccatctggctcagcaccaacgaattcataccggagagaagccttataaatgtaacgagtgcggaaaggtctttcatcagatcagccatctagctcagcatagaactatccacaccggtgagaagccatacgaatgcaacaagtgcggaaaagtgtttagcaggaactcctatctcgtccagcatcttattatccacactggtgagaaaccctataggtgcaatgtttgtggcaaggtgtttcatcatatctcccacctggcccagcaccagcggattcatactggggagaaaccctacaaatgtaacgaatgcgggaaagtattttcccacaagagctcacttgtgaatcactggagaatacacacaggtgagaagccctataaatgtaatgagtgtggcaaagttttcagtcataaaagctcacttgttaatcattggcggatccacacaggagagaaaccatacaaatgcaatgagtgtggcaaggtcttttcacgaaactcctatctcgcccagcatctgataattcacgcaggtgagaagccctataagtgtgacgagtgcgataaagcattcagccagaatagccacctggtgcaacatcatcgcatccacactggcgagaagccatacaaatgcgatgagtgtggcaaagttttctcacaaaactcttacctggcgtatcattggaggatacacacgggggaaaaggcctataaatgcaatgagtgtggtaaggtctttgggctcaattcttccctggcgcatcaccggaaaatccataccggcgagaagccctttaagtgtaatgagtgcggcaaagccttttctatgcgctcaagcctgaccaaccaccatgctatccataccggcgagaaacattttaagtgtaatgagtgtggcaaactgtttcgagacaatagctacctcgtgcggcatcagcgctttcacgcaggcaagaaatcaaatacctgtaattag

SEQ ID NO: 212428 - DNA, 1551 bp, Artificial Sequence
  Description of Artificial Sequence: Synthetic coding sequence
atgcacggccggaaggacgacgcccagaagcagcccgtgaagaaccagctgggactgaatccccagtcccatttgcctgagctgcaactgttccaggcagaaggcaaaatttacaaatatgatcatatggagaagagtgttaacagtagcagcctggtttccccacctcagcggatttcatccaccgtaaaaacacacattagccatacttacgagtgtaacttcgtcgacagcctgtttacccaaaaagagaaagccaacatcggcaccgaacactacaagtgtagcgagcgcgggaaggcattccaccaggggctgcattttacaatccaccagatcatccacacaaaagaaacacagttcaagtgtgatatatgtggtaaaattttcaacaagaaatcaaatctggcctcacatcagaggatccatacaggggagaagccttacaaatgcaatgaatgcggcaaagtttttcataacatgtctcacctggctcagcaccggcgcatccacaccggcgaaaagccatacaaatgcaatgaatgtggcaaagtgttcaatcagatctctcatctcgctcagcatcagaggattcacaccggggagaagccatataagtgtaatgagtgtggtaaggtatttcaccagatctcccacctggcacagcacaggactatccacacaggggagaaaccttacgagtgcaataaatgtggtaaggttttcagccggaattcatacctggttcagcacttgatcatccatacaggagagaagccttatagatgcaacgtgtgcggtaaggtgtttcatcatatctcccacttggcgcaacatcagaggatccacacaggcgaaaagccttataagtgcaacgaatgtgggaaggtcttctctcataagagctctctcgtgaatcattggcgaattcacacaggagagaagccctacaaatgtaacgaatgcggaaaagtattcagtcataagagctccctcgtgaaccactggaggatccatacaggggaaaagccatacaaatgtaatgaatgcggcaaggttttctcaagaaactcttacctggcacagcacctgatcatccatgcaggagagaagccctataagtgcgatgagtgtgataaggcgttttcacagaactctcatttagtacagcaccaccgtatccatacaggagagaagccctacaaatgcgacgaatgcgggaaagtgttctctcagaattcatatctcgcttatcattggcgtattcatactggtgagaaggcctacaagtgcaatgagtgtggtaaagtgtttggcctaaacagctcgcttgcacatcacaggaagatccatacaggggaaaagccttttaagtgtaacgaatgcggtaaggccttttctatgagatcttccctcaccaatcaccatgccatacatacaggcgagaagcattttaagtgcaatgagtgcggcaagttgtttagagacaactcctacttggtgcggcaccagcggtttcatgctggcaaaaaaagcaacacgtgcaattag

SEQ ID NO: 212429 - DNA, 5034 bp, Artificial Sequence
  Description of Artificial Sequence: Synthetic coding sequence
atggaggtgcccgagcccacctgccccgccccccccgcccgggaccagccagccccaaccccagggccacccggtgcccctggcggccaagccagtcctcacctgacacttggaccagtgctacttcccccagagcagggtctcgctccgccgacagtctttctgaaggccttgccaatccccctgtaccacaccgtgccccccggggggttgcagcctcgggctcctctggtaaccggaagcctcgacggagggaatgttccgtttatcctatccccggtcctgcagccagaggggcccgggcctactcaggttggcaagcccgcagctcctaccctcacagtgaacatcgtaggtacactgcccgtactgtccccaggcctcggccccaccctgggctcacctggaaaagtcagaaatgccgggaaatatctgtgtcctcactgtggcagagattgtcttaagcccagcgtcttggagaagcacattaggagccataccggagagaggccttttccttgtgctacttgtggaattgcatttaagacacaatctaacctttataaacatcgcagaactcagacacatttaaacaattccagacttagttcggagagcgagggggccggaggcggcctgcttgaggagggcgacaaagccggcgagcctccgcgtcccgaaggccggggagaaagcaggtgtcagggtatgcacgagggtgcctccgaacggcctctgtcaccaggggcgcacgtgcctctccttgcaaagaacttagatgtgcgaactgaggcggccccatgccccggaagcgcctttgccgaccgagaagctccatgggattcggcaccgatggcttcacccggactgcccgccgctagcacccagccttggcgaaaactacccgaacaaaaaagccccaccgccgggaagccttgcgccctccagaggcagcaggctactgccgcagaaaagccatgggatgctaaagccccagaaggcagattacgcaaatgcgagtcaaccgactccggatacctgtcccggtcagattctgctgaacaaccacatgcgccctgcagccccctgcatagcttgagcgagcactcggctgagtccgagggcgagggcggtccgggccccggcccaggtgtggcgggggcagaacccggagcacgcgaggctggactggaattggagaaaaaacggctggaggaacggattgctcaactgatcagccacaaccaggccgtggtcgacgatgctcagttggataatgtgagaccccggaaaacaggactgagcaagcaaggaagtatagacctgccaaccccttacacctacaaggactctttccacttcgatatcagagccttagagcccggccggcgcagggcccccggtcctgtccgctccacatggacgcctccagacaaaagcaggccgctgttcttccactcagttccgacacagctgtctacgactgtggaatgcgtacccgtcacaaggtccaacagtctgccatttgtcgagggatcgcgcacctggctggagccacgggaaccaagggacccatggtcacggacacagaaaccactcagcccacggcccgggccggcacgcttggggtgccgttctggtttgagttccactgatgtgccgagtgggcacccaagggcactggtgcggcaggctgcggttgaagacttaccggggacacctattggcgatgcgctagtcccagcggaagacactgacgccaaaagaaccgccgctcgcgaagccatggccggcaagggacgagccggggggagaaaatgcggccagaggcgcctgaaaatgttctcccaggaaaagtggcaagtttacggggacgaaacatttaaacgaatctatcagaagatgaaggcgagcccccacggaggtaaaaaggcccgcgaggtagggatgggaagtggagccgagttggggttcccgctgcagaaggaggcggctggatcctccggcaccgtgccaacacaagatcgtcgtactcctgttcatgaggatatcagcgccggggccaccccagaaccttggggaaaccctccagccctggaagcctctttagtgacagaacccactaagcacggggagactgtcgcccgccgaggggattctgatcgaccccgcgtcgaggaggcagtctccagcccagcgctggggggcagagactctccgtgtagcgggagccgatcacccctcgtttcccctaacggccgtcttgaactgggttggcagatgccaccagccccagggcccctgaagggcggcgatgtggaagcgcctaggcctgtctggccagatccaaaactagagggcggagcgcgaggcgtcggcgatgtccaggaaacctgtttgtgggcccagactgtgctgagatggccctctaggggatctggtgaggataagctgcccagcgagcggaagaaacttaaggtggaggacctccacagctggaaacagcctgaaccggtgtcagccgaaacgcctgggggaccaacccagcccgcttctttatcttcccagaagcaagatgcagacccaggcgaagttcccggcggcagtaaagagagcgcgaggcaggtgggagagccccttgagagttccggggcatctctagcggccgctagcgtggcccttaagcgcgtcggtcccagagataaagccacccctctgcacccagcggccccagcgcctgctgaacatccatccttggccactcctccccaggctcctcgcgtgctgtctgcccttgcggacaacgctttctctccaaaatatctgctcaggctaccccaggctgagaccccgttacccttgcccataccatggggtccacggcatagccaggatagcctgtgtagctctggatggcctgaagagcgggcctctttcgtcggctccggactcggaactccattgtctccaagtccggccagtggaccttctccgggggaggccgatagcattttagaagaccccagctgtagccgcccccaggatggaagaaagggtgctcagctgggtggcgataaaggcgaccgaatggccacaagtcgaccggcggcccgggaactgcccatttccgctccaggcgctcctcgggaggcaacatcatctccccccaccccaacctgtgaggctcacctggttcaagacatggagggcgatagccatagaattcaccgactgtgtatggggtcaacactggccagggctcgcttatcgggcgatgtgctgaacccatgggtgcccaattgggaactcggcgagcctccaggtaacgctccagaagacccaagttcaggaccgttggtcggaccagatccctgctcaccgctgcagcccggcagctttctgaccgcgttaacccggccccagggcgtgcctcctggctggccagagttggcgttatcttcccattcaggtaccagtagatctcactcaacaaggtcgcctcattccacgcaaaaccctttccccagtctgaaggcagaaccacgcctgacatggtgttgtctgagtcggtctgttcccctcccggctgagcagaaagccaaagccgccagcgtatacttggctgtgcattttcctggtagcagcctgcgcgatgagggccctaatgggcctccaggttcgaacggagggtggacgtggacatcccccggtgagggggggcctgcccagatgtcaaagttttcctaccctacagtcccgggagtcatgccacagcatcaagtgtcggaaccggaatggaagaaggggctgccttggagagccaaaatgtcaagaggcaatagcaagcagcggaagttgaaaatcaatcctaagcggtacaagggtaactttctccaaagctgtgtgcagttgagggccagccgtctgcggacaccaacctgggtgcgccgacgtagccgtcatcctcctgctcttgagggcttaaaaccctgcagaacacccggccagacaagttccgagattgcaggactcaaccttcaggaagagcccagctgcgcaacgagtgagagtcctccttgctgtgggaaggaggagaagaaagagggcgactgcaggcaaacccttgggactctgagcctggggacatcatcaagaatcgtcagggagatggataagcggaccgtgaaagacatctcgccaagtgcgggtgaacacggggactgcaccactcattccaccgccgccacctcaggcctctcactgcagtctgacacatgcctggccgtggtgaatgatgtccccctgccaccaggtaaaggcctggacttaggcttacttgaaacccagttgcttgcgagccaggactccgtgagcacagatccaaagccctacatcttctcagatgcccagagacccagttcgtttggcagtaaggggacgtttccccaccacgacatcgcgaccagcgtggccgcagtctgtattagcctcccggtgcgtaccgaccatattgcgcaggagattcacagcgccgagtctcgagatcattctcaaacagctgggcggacgcttacatcaagtagcccagactcaaaagttaccgaggagggtagggcccagaccctgctcccaggtcgtccctcctcaggacagcggatctccgactcggtcccccttgagagtacagaaaaaacacacctggaaattccagcatccggccctagtagcgcctcctcccaccacaaggagggccggcataagacgttttttccctccaggggccagtacggctgcggcgaaatgaccgtaccttgtccaagcctcggctcggacggccgcaaaaggcaagttagcggtctgatcacgcgaaaggattccgttgtcccctctaagccagagcagcctattgaaatacctgaagccccttctaagagtttgaaaaagcgatccttggagggtatgagaaaacaaactcgcgtggagtttagcgacacaagcagtgacgacgaggacaggctggtcattgagatctag

SEQ ID NO: 212430 - DNA, 264 bp, Artificial Sequence
  Description of Artificial Sequence: Synthetic coding sequence
atgggccccctgaccttccgggacgtggccatcgagttcagcctgaaggaatggcagtgtctggacaccgcacagcggaacctgtaccgcaatgttatgctggaaaactaccgtaatttggtgtttttgggtattacggtctctaaacccgatctgataacatgcttggaacagggtaaagaggcatggtcaatgaagcggcacgagataatggtggccaagccaacagagtcgtactcagtgacccagagcggcatgcagtag

SEQ ID NO: 212431 - DNA, 1788 bp, Artificial Sequence
  Description of Artificial Sequence: Synthetic coding sequence
atgggccccctgaccttccgggacgtggccatcgagttcagcctgaaagaatggcagtgcctggacaccgcccaacggaacctttatcgaaacgttatgctcgaaaattataggaacctggtgtttctcggcattactgtgagcaaaccagatctgattacatgcctggaacagggtaaagaggcatggagcatgaagcgacacgaaataatggtggccaaaccgaccgtcatgtgcagccacttcgcccaggacctgtggcccgagcaaaacatcaaggactcatttcagaaggtaacactgaagcgctatgggaagtgtcgtcatgagaatcttccgctgcgcaaggggtgcgagtccatggacgagtgcaaaatgcacaagggtgggtgcaatggactgaaccagtgtctcactgctacacaatccaagatcttccagtgcgacaagtatgtgaaggtggcccataaattttcaaactctaacagacacgaaatccgccatacaaaaaaaaaaccgtttaagtgcaccaagtgcggcaagtccttcggaatgattagctgcctaacggagcatagccgcattcacacacgcgtgaacttttataaatgtgaggagtgtggaaaggcattcaattggagttccactctgacaaaacacaagcggatacacacgggcgagaagccatacaagtgcgaagagtgcgggaaagcgtttaatcagagctccaacctcatcaagcacaaaaaaatccacaccggcgagaagccatataagtgcgaggaatgtgggaaaaccttcaataggttctctacactgacgacgcacaaaattatccataccggcgaaaagccctacaaatgcaaagagtgcgggaaggctttcaatagatccagtacacttacaactcaccgaaaaatccataccggggagaagccctataagtgcgaggaatgtgggaaagctttcaaacagtcaagtaacctcacaacacacaaaattatccatacaggtgagaagccttacaagtgcaaaaaatgcggaaaggcctttaaccagtctgcccatctgacgacacatgaagtcatccacacaggcgagaagccttataagtgtgagaagtgtggtaaggccttcaatcacttcagccacctgaccacccacaaaatcatccacacaggagagaagccttataaatgtaaagaatgcgggaaggcattcaaacatagctctacactaactaaacataaaattatccatactggcgaaaaaccttataagtgtaaggaatgtgagaaggccttcaatcagtcatctaagctgactgagcacaaaaaaattcatactggcgagaagccttacgaatgcgaaaagtgcggcaaggctttcaaccaaagctccaatctgacacgacacaagaagtcacataccgaggagaaaccttataagtgcgaagaatgcggaaaaggatttaaatggccctccacgctgacaatccacaagataatccacacaggcgagaagccctataagtgcgaggagtgtggcaaagcatttaaccagtcctccaaactgacaaaacacaagaagatccacaccggggaaaagccgtacacctgtgaagagtgcggcaaagccttcaatcaaagtagcaacttgaccaagcataaacgcatccatacaggggagaaaccttataagtgcgaggaatgtgataaggccttcaagtggtcgagcgtgttgactaagcacaaaattatccatacaggcgagaagttacagatttag

SEQ ID NO: 212432 - DNA, 1689 bp, Artificial Sequence
  Description of Artificial Sequence: Synthetic coding sequence
atgggccccctgaccttccgggacgtggccatcgagttcagcctgaaagagtggcagtgcctagacacagcccagcgaaacttgtaccggaatgtcatgcttgagaactaccggaatctggtgttccttgttatgtgctctcatttcgcccaggatctgtggccggagcaaaacattaaagactcatttcagaaagttacactgaagcggtacggaaaatgtaggcacgaaaatttgcctctgcgcaaaggctgtgagagtatggatgagtgcaaaatgcataaagggggatgtaacgggttgaaccagtgcctgactgcaacccagtcgaagattttccagtgcgataagtacgtcaaggttgcccataaattcagcaactcgaacagacatgagattcgacacaccaaaaagaaaccatttaagtgcactaaatgtggcaaaagtttcggaatgatctcctgtctgaccgagcactcaagaattcacacccgagtcaatttctataagtgtgaggagtgcgggaaagcattcaactggtctagcaccctaacaaagcataaacggattcataccggcgaaaagccgtacaaatgcgaggagtgcgggaaggcgtttaaccagtcctctaatctgatcaaacataagaaaattcatacaggagagaagccttataagtgcgaggagtgcggcaaaacgtttaatcgttttagcactctgaccacccataaaatcatccatacgggtgaaaagccctacaagtgcaaggaatgcggcaaggcctttaaccggagcagtactctgactacccaccgtaaaattcatacaggcgaaaaaccttacaagtgtgaagagtgcggtaaggcgtttaagcaatcatcaaacctaacaactcacaaaatcatccatacgggcgaaaagccttataaatgcaagaagtgtgggaaggcgtttaatcagtcggcccacttgaccacccacgaagtgatacataccggggagaaaccatataaatgcgagaaatgtggcaaggcgttcaatcacttttcgcatctcactacccacaaaatcattcatactggggagaaaccatataaatgcaaggagtgtggcaaagccttcaaacacagtagtacactgacaaagcataaaattattcacaccggagaaaaaccatacaaatgtaaagaatgcgaaaaagcttttaatcagtccagcaaacttaccgaacacaagaagatccatacaggagagaagccctatgaatgcgagaaatgtggcaaagcatttaaccagtcttcaaacctgacacgacacaagaagagtcacaccgaggagaagccctataagtgtgaagagtgcggaaaggggtttaagtggccttctactctcacgatacacaagattattcacaccggggaaaagccttacaagtgcgaggagtgcgggaaagccttcaatcagtctagcaagctcaccaagcataagaaaattcatacaggcgagaagccatacacctgtgaggagtgcggtaaagctttcaatcagtcatcgaatcttaccaagcataagcggatccacacaggggagaagccttacaaatgcgaggaatgtgataaggccttcaaatggagttcagtcttgaccaaacacaaaatcatccatacgggggagaaattgcagatctag

SEQ ID NO: 212433 - DNA, 1413 bp, Artificial Sequence
  Description of Artificial Sequence: Synthetic coding sequence
atgcacaagggcggctgcaacggcctgaaccagtgcctgaccgccactcaaagcaagatttttcagtgcgataagtatgtcaaagtggcccacaaatttagtaacagcaatcgccacgagatccgtcacacaaagaaaaagccatttaaatgtacgaagtgcggtaaatctttcggcatgatttcctgtcttaccgagcactcaagaatccatactcgagttaacttttacaagtgtgaggaatgcggaaaagcctttaactggtcaagtaccctgaccaagcacaaacgcattcacaccggggaaaagccatataaatgcgaggagtgcggcaaggccttcaaccaaagctccaacctcatcaaacacaaaaagatacacaccggagagaaaccctataagtgcgaagagtgtggcaagacatttaatcgattttcaaccctcactactcataagattatccacacgggtgagaagccatataaatgcaaagagtgcgggaaggccttcaacagatcaagcacattaacaacacaccgcaagatccatacgggtgagaaaccttataaatgcgaagagtgtggcaaggccttcaaacaaagctccaaccttactacccataaaatcatacacactggcgagaaaccgtacaagtgcaagaagtgcggtaaggctttcaaccaatctgcgcacctaacaacacacgaggttatccatactggggaaaagccgtataagtgtgagaagtgcggcaaggcattcaaccacttcagtcacctcacaacccacaaaatcatccacaccggggaaaagccttataaatgcaaggagtgtgggaaagcatttaaacatagctccacgctcaccaagcataagataattcacactggcgagaagccttacaaatgcaaggaatgcgagaaagcattcaaccaatccagcaaactgacggagcacaagaaaatccacacaggcgaaaaaccctacgagtgcgagaagtgtgggaaagcatttaaccagtcaagtaatttaacgcggcataaaaaatcccacaccgaagaaaaaccatataagtgcgaggagtgcggcaaaggcttcaaatggcctagcacgctcactatccataagattatccacacaggtgaaaagccgtataagtgcgaggagtgtgggaaagcctttaatcagtctagtaagctcacaaagcataagaaaatacacactggggagaagccatatacttgcgaagaatgtggcaaggcctttaaccagagcagcaacctgacgaagcataaaaggattcatactggcgaaaagccatacaagtgcgaagaatgcgacaaagcgttcaagtggtcctctgtgctgacaaaacataagattatccataccggcgagaagttacagatatag

SEQ ID NO: 212434 - DNA, 1806 bp, Artificial Sequence
  Description of Artificial Sequence: Synthetic coding sequence
atgggccccctggagttccgggacgtggccatcgagttcagcctggaggagtggcattgtcttgacactgctcagcagaacctgtaccgggacgtgatgcttgagaactatcgccatctcgtgtttctgggaatagtggtcacgaagcctgatctcatcacatgtctggagcagggaaagaagccctttacagtgaagaggcacgaaatgatcgccaaaagtcccgtaatgtgctttcacttcgcacaggatttatgcccggaacaaagcctgaaggacagttttcagaaagtgatcgtaaccaggtacgaaaaaagggaatacggtaacctggaactcaaaaagggctgcgagagcgtagacgaggggaaagtacacaaacgaggatacaacgggttaaatcagtgtctgactgcaacccagtctaaggtgtttcaatgtgatacctacgtgaaggtgtcccacatattctcaaattccaaccgacacaaaatacgtgacaccggcaaaaaaccctttaaatgcatcgagtgcggcaaggccttcaaccaaagttccacattagccactcataagaaaatacacactggagaaatcacctgcaaatgtgaggagtgtggcaaggccttcaatagatctagtcatttgactagccacaagaggattcatacgggggagaagagatataagtgcgaagactgtgggaaggagctgaagtatagttccaccctaacagctcacaaacgaatccacacaggagaaaaacgctataaatgcgaagattgtggcaaggagttaaagtactccagtactctcacagcccataagcgcatccacacaggtgagaagccatataagtgtgacaagtgcggacgggccttcatcagctcctctatcctctacgtacataagatctcacatacagaagaaaaaccctacaaatgtgaagaatgtggcaaggctttcaaactcagttctattctgagcacacacaaacggatccataccggggagaagccatacaagtgcgaagaatgcgggaaggcctttagacggagtcttgttctgcgcacgcataaacgcatccacaccggtgagaagccctacaaatgtgacaaatgtgggaaagcctttatcagctcttcgctgctatataaacacaagatctcgcatagcgagaagaaaccatacaaatgcgaggagtgcggtaaagcttttaagagatcctccactcttaccatccataaaatctcccatactgaggagaagccctacaagtgtcaggaatgcgataaagtctttaagcgctcctccgcgttgtccacccacaagattatacacagcggcgagaaaccttataagtgtgaagaatgcggtaaggctttcaaacgaagttcgaacctcactacgcacaaaatatctcatacagaagaaaaactgtataaatgccaggaatgcgataaagccttcaaatactcctcggctctttccacacataagatcattcactctggagagaacccttataaatgcgaggaatgcggtaaagcattcaagcggtcctcagtgctgagtaagcataagattatacatacgggcgctaagccttacaagtgcgaagagtgcggcaaggcgtttaaaaggagctcacagttaaccagtcacaaaatctctcatacaggggaaaagccatacaaatgtgaggagtgtggaaaggcatttaatctctcaagtgatctaaatacccataagagaatccacatcgggcagaaagcctacatcgttaaaaacatggccaacctctag

SEQ ID NO: 212435 - DNA, 369 bp, Artificial Sequence
  Description of Artificial Sequence: Synthetic coding sequence
atgcggaagcacatcaaggagcgggagctgagcctgatggagcagattaaggagttcatcctagagcgcaacactatgaacgtgcctacagtggggaagccatttagcggtagacactcactgctatcgattcgcgaattcactctcggaagatcccctatgaacgtaatgaatgtgggcgaaccatccgagaagaaaccaacatgtatgataatccgggaatttattctggaaaagaatcccatcctggtgcgcaacgtaggaaagactagcgcagaagtgcagttgttgttgaatacccgagaattcatcctagagattaattccaggaacagggaaatcaaagagttcgcagaatgcttctcatag

SEQ ID NO: 212436 - DNA, 1911 bp, Artificial Sequence
  Description of Artificial Sequence: Synthetic coding sequence
atggccccccggccccccaccgccgccccccaggagagcgtgaccttcaaagacgtgtcggtggacttcacacaggaggagtggtaccatgtagaccctgctcaaagatcactgtatcgtgacgttatgctcgagaactacagccacctggtctcactcgggtaccaggttagtaagcccgaagtcatctttaagcttgagcaaggagaagagccttggattagtgagggagagattcaacggcctttctatccagactggaaaaccaggccagaagtcaaatcatcgcatctccagcaggatgtgagcgaagtgagtcactgcactcacgaccttctgcacgccaccttggaagacagttgggatgtatcttcccaactcgacagacagcaagagaattggaaacggcacctgggctccgaagctagcactcagaagaagatcatcactccccaagagaatttcgagcaaaataagttcggtgaaaactccaggctgaatacaaatctggtaacccagctcaacatccccgcccggatccgccctagtgagtgtgagaccttaggcagcaatttaggtcataacgcagatctccttaatgagaataatatattggccaaaaaaaaaccctacaagtgcgacaaatgccggaaagcgttcatccaccggtcatctctgacgaaacacgaaaaaacccataaaggggagggggcctttccaaacggaaccgaccagggaatataccccggcaaaaagcatcacgagtgcacagactgtggtaagacattcctttggaagacgcagctgaccgaacatcaaagaatacacaccggtgagaagccattcgaatgtaatgtctgtgggaaggcattccgtcacagctcgagcctggggcagcatgagaacgcgcatactggggaaaagccatatcagtgtagcttgtgtgggaaagcctttcagagaagctcatcattagtgcagcaccaaaggattcacactggagaaaaaccataccggtgtaatttatgtggtcgttcgttccgacacggcacttctcttacacagcacgaggtgacacactcgggagagaagcctttccagtgcaaagagtgcggcaaggctttttctcgatgctccagtctggtgcagcacgagaggacacacaccggcgagaagcccttcgagtgcagcatctgcggtagggcattcgggcagagtccttccttgtacaaacacatgaggatacataagcgcggaaaaccgtaccagtcctcgaattattctatagacttcaaacattctacaagcttgacgcaggacgagtcgacccttacagaagtgaaatcctaccattgcaacgactgcggtgaagatttctctcacatcacagactttacagaccaccagcgcatccacactgccgagaatccatatgactgtgaacaagctttttcgcagcaggctatttctcatccgggagagaaaccctatcagtgcaacgtctgcgggaaagccttcaagcgttcgacatctttcatcgagcaccaccggatccatacgggcgagaagccttacgagtgtaatgagtgcggagaggcattcagcaggagaagcagcctgacacaacatgagcgcacccatactggggagaagccctacgagtgtattgattgtgggaaggcattttcccagtccagctcattaatccaacatgagaggacccacacgggcgaaaaaccctatgagtgtaacgagtgcggtcgtgcctttagaaagaaaaccaacctgcatgaccatcagaggatacataccggcgagaagccctacagttgcaaagagtgcgggaaaaacttttcccgaagctccgctctcacaaaacaccagcgaatccacacaaggaacaagctttag

SEQ ID NO: 212437 - DNA, 3576 bp, Artificial Sequence
  Description of Artificial Sequence: Synthetic coding sequence
atgcccggcacccccggcagcctggagatgggcctgctgaccttccgggatgtagccatcgagttctcgcctgaggaatggcagtgcctggataccgcccaacagaatctctacagaaatgtgatgctcgaaaactacagaaacctcgccttcctgggcattgccctgagtaaacccgacctaattacatatttagaacagggtaaagagccttggaatatgaaacaacacgaaatggtggatgagcctaccggcatctgtccgcattttccacaggatttttggccggagcaaagtatggaagattcattccagaaagtactactccgcaaatatgaaaagtgcgggcatgaaaaccttcagttgcgtaaaggctgcaaatctgttgacgaatgcaaagtgcataaagaagggtacaataagctgaatcaatgtctgaccactgcgcaaagcaaggtatttcagtgtggcaagtacctcaaagtgttctacaaattcttaaacagcaaccggcacaccataagacacacaggtaaaaagtgtttcaagtgcaagaagtgcgtcaaatctttctgtatccgacttcataagacccaacacaagtgtgtctacataaccgaaaagagctgcaaatgcaaagaatgcgagaagactttccactggtcctctacgctgactaatcacaaagagatccatactgaagacaaaccttataaatgtgaggagtgtggcaaagcctttaagcagctttcaactcttactacacataaaattatctgtgctaaagagaagatctataagtgcgaggagtgtggcaaggccttcctctggagttctacgctgactcggcataaacgtatccacacgggggagaaaccatataaatgcgaagaatgcggtaaggcattttctcacagcagtaccctagccaagcacaaaagaatccatactggagagaaaccttataagtgcgaagagtgtgggaaggctttcagcaggagtagcactctcgctaagcacaaacgcatacatacaggtgaaaaaccctataaatgtaaggagtgcggaaaagccttcagtaattcctccacactggcaaatcataaaattacccacaccgaagagaagccatataaatgtaaagagtgtgacaaggccttcaagaggctttccacactgaccaaacacaagatcatacacgccggcgagaaactgtataagtgtgaagaatgtgggaaagcctttaaccgttccagcaacttgaccattcataagttcattcatactggcgaaaaaccttataaatgtgaagaatgcggtaaagccttcaactggtcttccagccttactaagcacaagagatttcatacaagggagaaaccttttaagtgcaaggagtgtggcaaagcattcatttggtcatctacactcaccagacacaagcgaatacacactggtgagaaaccctataagtgcgaggaatgcggtaaagctttccggcagtctagtactttaactaagcataagattatacacacaggcgaaaagccctataagtttgaggaatgcggcaaagccttcagacaatctttaacccttaataaacacaagatcatccattcacgcgagaagccttataagtgtaaagagtgtggcaaagctttcaaacaatttagtacactgactacccacaagattattcacgccggcaagaagctctacaaatgtgaagagtgcgggaaagctttcaaccacagctccagtttaagtacccacaaaattatccacactggcgagaaaagttacaagtgcgaggagtgtggcaaagcttttctttggagtagcactttacgtaggcataaacgtatacataccggagaaaagccttacaaatgtgaggagtgcggcaaagccttcagccactcatcggcccttgccaaacataaaaggattcacaccggggaaaaaccctataaatgtaaagaatgtggcaaggccttctctaacagttctactttggcaaatcataagattacacacaccgaggagaagccatacaagtgcaaagaatgcgacaaaactttcaagcggttgagcaccctcacaaagcacaagattatacatgctggcgagaagctgtacaagtgtgaggaatgcgggaaggccttcaatcgcagctctaacttaactatccacaagtttatccacacaggagaaaaaccctacaaatgtgaggaatgcgggaaagcttttaactggagttctagcctcaccaagcataagcgaatccatacgagggagaaaccttttaagtgtaaggaatgcggaaaggccttcatctggtctagcactttgacgcgtcacaagaggatccatactggcgagaaaccctataagtgcgaggaatgtgggaaagcttttagcaggtcatcaacacttacaaagcacaaaactattcacacgggcgaaaaaccttataaatgcaaagaatgcggtaaagccttcaaacattcgtcggccctggcaaagcataagatcatccatgccggcgaaaagctgtacaaatgtgaagagtgtgggaaagcattcaaccagagctccaacctgaccacccataaaattatccataccaaggagaagccttcaaagtccgaagaatgcgacaaagcatttatttggtcctccaccctcaccgagcataaacggatccataccagggagaaaacttacaagtgcgaagagtgtggcaaggcttttagccagcctagccacttgacgactcacaagcgcatgcatactggggaaaagccttataaatgtgaagaatgcggaaaagccttttcacagtccagtacgctcaccacgcacaagattatccacaccggggaaaagccgtacaaatgcgaggagtgtggaaaagccttcagaaagagttccaccctcacagaacacaaaattatccacactggagagaaaccttacaagtgcgaagaatgcggaaaggcattcagtcagagttccacccttacacggcacacccgaatgcacacaggagaaaaaccctacaaatgtgaagagtgtggtaaggcattcaaccggtcaagcaagcttactactcacaagattatacacacaggggaaaagccgtacaagtgtgaggagtgcgggaaggctttcattagcagcagcactttaaacgggcataaaaggattcatacgcgggaaaagccatataaatgcgaggagtgtggaaaggcattcagccagtcttcaaccctcacgagacacaaaagactccacaccggagagaagccttacaagtgtggagagtgcgggaaagcattcaaagagtcgtccgctctgacgaagcacaaaatcatacacactggagagaaaccctataagtgcgaaaagtgtgggaaagcctttaaccagtccagcatcctgaccaatcacaaaaaaattcacactatcaccccagttatacccctcctatgggaggcggaggcagggggcagccgcggccaggaaatggaaacaatcctagctaatactgtgaagccactgctgtactag

SEQ ID NO: 212438 - DNA, 3480 bp, Artificial Sequence
  Description of Artificial Sequence: Synthetic coding sequence
atgcccggcacccccggcagcctggagatgggcctgctgaccttccgtgacgtcgccattgagttttcccccgaggagtggcagtgtctggatactgctcaacagaacctgtaccggaacgtcatgctcgaaaactaccgcaacctggcgttcttagggatctgtcctcactttccacaggacttttggccggaacaatctatggaggactctttccaaaaagtgctcctgcggaaatatgagaagtgtggacacgagaacttgcagcttcggaagggctgtaaatctgtggatgagtgcaaggttcacaaggagggctataataagcttaaccagtgcttgacaactgcacaaagtaaagtttttcagtgtgggaagtacctgaaggtgttctataaattcctgaactcaaatcggcacaccatcaggcatacgggaaagaaatgcttcaagtgcaagaagtgcgtgaagagtttctgtatcagactgcataagacgcaacataagtgtgtgtatatcaccgagaagtcctgcaaatgcaaggaatgcgaaaagacctttcattggtctagcacgcttaccaaccataaggagatacacaccgaggacaaaccctacaaatgcgaagagtgtggaaaagctttcaagcaattgtcaacccttactactcacaagatcatttgcgccaaggaaaagatctacaagtgtgaagaatgtggcaaagcctttctatggtcttcaacactgactcgtcataagaggattcacactggtgaaaaaccctataaatgtgaagagtgcggaaaggctttttcgcactcaagtaccctggccaagcataagagaatccacacgggcgaaaaaccttacaagtgcgaagagtgcgggaaagcgtttagcagatcaagcacgcttgcaaaacataagagaatccatacaggtgagaagccctataaatgtaaggagtgcggcaaggctttctcaaattctagcacactggctaatcacaagatcactcacactgaagaaaaaccctacaagtgtaaagagtgcgacaaagcttttaaacgcctttcaacactcacaaaacataaaattatccacgcaggtgaaaaactgtacaaatgcgaggaatgcggaaaggcttttaacaggtcatctaacctgacaattcacaaattcattcatactggggagaagccttacaaatgtgaagagtgcgggaaagccttcaactggtcttctagcttaaccaaacacaagcgtttccacacccgagaaaaaccatttaagtgcaaagagtgcggaaaggcctttatatggtcttcgactctcaccagacacaaacgcatacacaccggcgaaaaaccctacaaatgcgaagaatgcgggaaggcattccggcagagttccactctgactaaacataaaataattcacactggggagaaaccttataagttcgaggaatgcggcaaagcctttcgccagagcttaaccctgaacaagcataagatcattcatagtagggaaaaaccttataagtgcaaagaatgcggaaaagccttcaagcagttttcaacgctgacaacgcacaagatcattcacgcaggcaaaaaattgtacaagtgcgaagagtgcggcaaagcgttcaaccactcaagctccctctctacgcacaaaatcattcacactggagagaagtcatacaaatgcgaggaatgcgggaaggccttcctctggtcaagcacgctgcgcagacataagagaatccatacgggggagaaaccatacaagtgcgaagaatgtggtaaagcatttagtcactccagtgccctagccaagcataagcgcattcataccggcgaaaagccttacaagtgcaaggagtgtggcaaagctttctcgaacagctcaactctggccaaccacaagattacacacaccgaagaaaaaccttacaaatgcaaggagtgtgataagaccttcaaacgccttagtaccctgacgaagcataagattatccatgccggggaaaaactgtacaagtgcgaagagtgcggcaaagcattcaaccggagcagtaatctcaccatccataagttcatccataccggggagaaaccatataagtgcgaagagtgcggcaaagcttttaattggtccagcagcttgactaagcacaagagaattcacaccagagaaaagccttttaagtgtaaagaatgcggcaaagccttcatctggtctagcacgctcacaaggcacaagcggattcacactggcgaaaagccttacaagtgcgaggaatgtggcaaagccttttccaggagtagtacactcaccaagcacaaaaccatccatacaggtgagaaaccttacaaatgtaaggaatgtggcaaggctttcaaacatagctcggctttagctaaacacaagatcattcatgctggtgagaagttatataagtgtgaggaatgtggcaaagccttcaaccagtcctctaacctgacaacccacaaaattatacacactaaggaaaagccgtctaaatccgaggaatgcgacaaggccttcatttggtcctccacacttacggagcataaacgtatccatacgagggaaaaaacatataagtgcgaggagtgcgggaaggccttttctcagccaagccacctgaccactcacaaacgaatgcacaccggagaaaagccatataagtgcgaagagtgtggtaaggccttctcccagagctcgactctgaccacgcataaaattatacacactggtgaaaagccttacaaatgtgaagagtgcggtaaagctttccggaagagtagcaccctcaccgagcacaagatcatacatactggcgaaaagccatacaagtgcgaagaatgtgggaaagccttcagtcagtcgtctacgctgacaagacatacacgcatgcacactggagagaagccttataaatgtgaagagtgcggtaaggcatttaaccgatcgtcgaagttgaccacgcacaaaatcatccacaccggggagaagccgtataaatgtgaagaatgtggtaaagccttcatttcgtcttccactctcaacggccataagagaattcacactagagagaaaccgtataaatgtgaagagtgtggaaaagcattctcacagtcctctaccctgaccaggcacaaaaggctccatacaggcgaaaaaccctataagtgtggggagtgcggaaaagcattcaaggagtcctcagcacttactaaacacaaaatcatccacacgggagagaaaccgtacaaatgcgagaaatgcggcaaggctttcaatcagagctcgatcttaaccaaccacaaaaagatccacaccatcactcctgttatcccactcctctgggaagccgaagctgggggaagccgcggccaagaaatggaaaccatcctggctaatactgttaagcctctgctgtactag

SEQ ID NO: 212439 - DNA, 1761 bp, Artificial Sequence
  Description of Artificial Sequence: Synthetic coding sequence
atgggccccctgaccttccgggacgtgaagatcgagttcagcctggaggaatggcaatgcctcgatactgctcaacgcaatctctacagggacgttatgctggagaattatcgaaacttagtgtttcttggaattgcggtgagtaaaccagatctgataacgtggctggagcaaggtaaggagccttggaacctcaaacggcacgagatggtcgataagactcctgtgatgtgctctcacttcgcccaggatgtgtggcccgaacattctatcaaagactcctttcagaaggtgatcctcaggacctatggaaaatacggccatgagaatttgcaactcagaaaagatcacaagagtgtcgacgcctgtaaagtgtacaagggcgggtacaatggcttgaaccagtgcctgactacaaccgactccaagatatttcaatgtgataaatacgtgaaggtgttccacaaattccctaacgtcaaccggaacaagatcaggcacacaggcaaaaagcccttcaaatgcaaaaatcgcggaaagtcattctgtatgttaagccaattgacccagcacaagaaaatccatacgagggagtactcctacaagtgcgaggagtgcgggaaggccttcaattggtcctcaacccttaccaagcacaaaatcatccacacgggtgaaaaaccatataagtgcgaagaatgcggtaaagcattcaaccgctccagtaatctgaccaaacacaagatcattcacactggggaaaagccgtacaagtgtgaggagtgcggtaaagctttcaatagaagctccactctaaccaaacataagcggatccacaccgaagaaaaaccttataagtgcgaggaatgtgggaaggcttttaaccaatttagtatactcaacaagcacaagaggatccacatggaggacaagccctacaaatgtgaggaatgtggaaaggcctttcgggtgtttagcatcttgaaaaagcataaaataatccatacaggcgagaagccgtacaagtgcgaagaatgcggcaaggcctttaaccagttttccaatttgaccaagcacaagatcatccacaccggcgagaaaccgtacaaatgtgatgagtgtggtaaagcgttcaaccagtcctctaccttgactaagcacaaaaggatccatacaggcgaaaagccctacaagtgtgaggagtgcggcaaagcatttaaacagagctctactctgacggaacataagatcatccacaccggcgaaaaaccgtacaaatgcgagaaatgcgggaaagcctttagctggtcttccgccttcacaaaacacaagcggaaccatatggaagataagccctataagtgcgaagagtgcgggaaggctttttctgtcttcagtactctgactaaacacaaaattatccacacaagagaaaaaccatacaaatgtgaggagtgtggcaaggcatttaaccagagttctatcttcacaaagcataagatcattcatacagaggggaaatcttataagtgtgaaaaatgcggcaacgcattcaatcaatcaagcaaccttacggctcgtaaaattatctacactggggaaaaaccatacaagtacgaggagtgtgataaagctttcaacaaattcagcactctgatcacacaccagatcatctataccggtgaaaaaccttgcaaacacgagtgcggaagagccttcaataaatcctccaactataccaaggagaagttgcaaacctag

SEQ ID NO: 212440 - DNA, 1665 bp, Artificial Sequence
  Description of Artificial Sequence: Synthetic coding sequence
atgggccccctgaccttccgggacgtgaagatcgagttcagcctggaagagtggcaatgtcttgacacagcccaaaggaacctttatcgggatgttatgctcgagaactacagaaacctcgtttttctggtcatgtgcagccactttgcgcaggatgtttggcccgaacactcgattaaggacagttttcagaaagtgatcctcagaacatacggcaaatatggtcatgagaatctgcagttacggaaagaccataagtccgtggacgcctgtaaggtatacaagggtgggtataatggtctcaaccaatgtctaaccacgactgattccaagatttttcaatgtgacaaatatgttaaagtgttccataagtttcccaatgtgaacagaaataagatccgccacacaggcaagaaaccttttaagtgcaaaaaccgaggcaagagtttctgcatgctatcccaattgacccagcacaaaaaaatacatactagggaatattcttataagtgtgaggagtgcggtaaggcatttaattggtcatccaccctgacgaagcataaaattattcacactggcgagaaaccatacaaatgcgaagaatgcggcaaagctttcaacagatcctccaacctgaccaagcacaagatcatccacacaggagagaagccctacaaatgtgaagaatgtgggaaggcattcaaccggagttctacattgaccaagcataaacgcatccatacagaggagaagccatataaatgtgaggagtgcggaaaggctttcaatcagttctccattctcaacaaacacaagcggatccatatggaggataaaccttacaagtgtgaagagtgcggcaaggcttttagagtgttttccatcctcaagaaacacaaaatcatccacacaggtgagaagccatataagtgtgaagagtgtggaaaggcttttaaccagtttagtaacctcaccaagcacaagataatacatacaggcgagaagccatacaagtgtgatgaatgcgggaaagccttcaatcagtcctcaaccctgactaagcacaagaggattcacaccggcgagaagccctataagtgcgaggaatgcgggaaagctttcaagcagtcttcaacactgacagaacataaaatcatccatacaggtgagaagccttacaaatgcgagaagtgcggcaaggccttcagctggtcctccgcattcactaaacataaacggaatcatatggaagataaaccatacaagtgtgaggagtgtggtaaagctttctcagtgttctccactctgaccaagcataagatcatccacacccgcgagaaaccatataagtgcgaagaatgtggcaaagccttcaaccagagttcgatatttactaaacataagatcattcatacggagggaaagtcctacaaatgcgagaagtgcgggaatgcttttaatcagtcttccaacttgacggcacggaaaatcatttacactggagagaagccatacaagtatgaggaatgcgacaaagcctttaacaagttctccacactgattacacatcagattatttacactggagagaaaccgtgcaagcatgagtgcggccgggcgttcaataagtcatccaattatacaaaggaaaagctccagacgtag

SEQ ID NO: 212441 - DNA, 1554 bp, Artificial Sequence
  Description of Artificial Sequence: Synthetic coding sequence
atggtggacaagacccccgtgatgtgcagccacttcgcccaggacgtgtggcctgagcactctattaaggatagcttccaaaaagtgatactgcgcacatatgggaagtacgggcacgagaacctgcagcttcgtaaggaccacaagtccgtggacgcgtgtaaagtttacaagggtggatataatgggctgaaccaatgtttgaccaccacagattctaaaatcttccagtgtgacaaatacgtgaaggtctttcacaagttcccaaacgtcaaccgaaataaaataagacatactggcaagaaaccatttaagtgtaagaatagagggaagtcgttctgcatgctgtctcagttgacgcagcataagaagatacacacccgagaatactcctataagtgtgaggagtgcggtaaggccttcaactggagcagcaccctcaccaaacataagattatccataccggcgagaagccctataagtgcgaggaatgtggcaaagccttcaaccgatcctcaaatctgactaagcataagattatccatacaggcgaaaagccctacaaatgcgaagagtgtggcaaagcttttaacagaagctcgacactgactaagcacaaaagaatacatacagaagagaagccttacaagtgcgaggagtgtggcaaagcattcaaccagttttcaatcttaaataaacataagagaattcacatggaagataaaccctataagtgcgaggagtgcggaaaagcttttcgtgtgttttcaatcctcaaaaagcacaaaatcatccacactggagaaaagccctataagtgcgaggaatgcggtaaggccttcaaccagtttagcaacctgacgaaacataaaatcatccacacaggggagaagccatataagtgcgacgaatgcgggaaagcattcaatcagtcctcaacccttaccaaacacaaacggatacacacaggagaaaaaccctacaaatgcgaggagtgtggaaaagcattcaaacagagttcaactctcaccgagcacaagataattcacaccggcgagaagccttataagtgcgaaaagtgtggcaaagctttttcatggtcttccgctttcacaaaacacaagaggaaccacatggaagataagccgtacaagtgtgaggagtgcggcaaggccttctcagtgttcagtacattgactaagcataaaattattcacacaagggaaaagccatacaagtgcgaggaatgtggcaaggcttttaatcagtcaagtatctttacgaagcacaaaataatccacacagagggtaagagctacaaatgtgagaagtgcgggaatgccttcaaccagagttccaatttaacggcgcgaaagatcatctacaccggggaaaagccttacaaatatgaagaatgcgataaagcctttaataaattttccactctcatcacacaccagataatttatacaggggaaaagccctgtaagcatgagtgtggccgggcgtttaataagagctctaattacactaaggagaagctgcaaacatag

SEQ ID NO: 212442 - DNA, 1863 bp, Artificial Sequence
  Description of Artificial Sequence: Synthetic coding sequence
atgggccccctgcagttccgggacgtggccatcgagttcagcctggaagagtggcactgtttagatacagcgcaaagaaacctgtaccgcaacgtgatgctcgaaaactactcaaacctggtcttcttaggaatagtggtgtccaaacccgacttaatcgcccatctcgaacagggcaagaaacctctgacaatgaaaagacacgaaatggtggcaaatccctccgtgatttgttcccacttcgctcaggatctgtggccggagcagaatattaaggacagttttcaaaaggttattctgaggcggtacgagaaacgtggccatggcaacttgcagctgataaaacggtgcgaatctgtggatgaatgcaaggtgcacaccggcggctacaacggattaaatcagtgctcaaccaccactcagagtaaggtgttccaatgcgataaatacggaaaggtcttccataaattctcaaactccaataggcataacattaggcatacagaaaagaagccttttaaatgtattgagtgcggcaaggcatttaatcagttctcgactctgattactcataagaaaattcatactggcgaaaagccatacatctgcgaagagtgcggaaaggcttttaagtattcttcagccctgaatactcacaaaagaatccatacaggagagaaaccctataagtgcgacaagtgtgacaaagcctttattgcctccagtaccctcagtaagcacgaaatcattcataccggcaagaaaccctacaaatgtgaggaatgcgggaaggcattcaaccagtctagcacactcacgaagcataagaaaatccacaccggtgaaaagccttacaaatgcgaagaatgcgggaaggcctttaatcagagcagtacccttacaaagcacaaaaaaatccacaccggcgagaaaccatacgtgtgcgaggaatgtggcaaggccttcaaatattcaagaatcctcacaacccataagcgcatccataccggtgagaagccgtataaatgcaataagtgcggcaaggctttcatcgcctcatctacactgagtcgtcacgagttcatacatatgggaaagaagcactacaagtgcgaggagtgtggaaaagccttcatttggtcaagtgtgcttactagacacaagcgggttcacacaggggaaaaaccgtacaaatgcgaagaatgtggaaaagcattcaaatatagcagtacattatcaagtcataagagatctcacaccggcgaaaagccatataagtgtgaggagtgtggtaaggcattcgttgctagttcaaccctgtcaaaacacgagattatccacacaggcaagaagccatataaatgcgaagagtgtggcaaggcttttaaccagtctagtagcctgacgaaacataagaagatccatactggtgagaaaccgtataaatgtgaggaatgcggcaaagcattcaatcagagttcgagcctgaccaagcacaaaaagatccacacgggtgaaaaaccttacaagtgtgaggaatgcggcaaagcattcaatcagtcctccacgctcattaaacacaaaaagattcatacccgggagaagccgtacaagtgcgaggaatgtgggaaagcttttcacctgtcaactcacttgacaacgcataagatcctccataccggagaaaagccgtaccggtgtagggaatgcgggaaggcgttcaaccactcagccaccctcagctcccacaagaaaattcactccggcgagaagccatacgagtgtgacaaatgtggcaaagcgtttatctccccttcctcgctgagccgacatgagattattcacactggggagaagccttag

SEQ ID NO: 212443 - DNA, 1779 bp, Artificial Sequence
  Description of Artificial Sequence: Synthetic coding sequence
atgggccccctgcagttccgggacgtggccatcgagttcagcctggaggagtggcattgtctggatacagcccaaaggaacctgtacaggaacgtgatgctggagaattatagcaacttggtcttcctcggaattgtggtgtcaaaacccgatttaatcgcgcaccttgagcaggggaaaaagcccctgaccatgaaaaggcatgaaatggtggcaaatccatccgtaatttgctcgcactttgcccaagatttgtggccagaacaaaatattaaagactcgtttcagaaggttatcctgcgtcggtatgaaaagagaggtcacggcaacctgcagttgatcaaaaggtgcgagtctgtcgatgaatgtaaggtgcatactggaggttataacggtctcaaccaatgctctacaacaactcagagcaaggtttttcagtgcgacaaatatggcaaggtcttccacaaattctctaacagcaatagacacaatattcgccacactgagaagaagccctttaaatgcattgagtgtgggaaggctttcaatcagttttccacacttataacccacaagaagatccacacaggggaaaagccatacatatgtgaagaatgcggaaaggcctttaagtactcgagtgccttaaacacacacaagagaatccacacaggcgagaagccatataagtgtgacaaatgtgacaaggccttcatcgcttcgtcaaccctgtcgaaacacgagatcatccataccggcaagaagccctacaaatgcgaagagtgcgggaaagccttcaaccagtcttcaactctcacaaaacataaaaagatccacactggggagaaaccatataagtgcgaggagtgtggcaaggcttttaaccagagcagtaccctcacaaagcacaaaaaaatacacactggagagaaaccttacgtctgcgaggagtgcggcaaagcatttaagtattctcggatattgactactcataaacgtatccatactggtgagaaaccatacaagtgtaacaagtgcggaaaagcctttatagcttcgagtaccctttcaagacatgagtttattcatatggggaagaagcattacaaatgtgaagaatgcggcaaggcctttatctggtcttccgtattaacccgccataaaagggtgcatacgggcgagaaaccttacaagtgtgaagagtgtggcaaggcgtttgttgcttccagtactctgtccaaacacgagattattcacaccggcaaaaaaccatacaagtgcgaagaatgcggtaaggcttttaaccagagttctagcttaaccaagcacaaaaaaatccacacgggcgagaagccgtacaagtgtgaagagtgtgggaaggcttttaatcagagcagcagtctgactaagcataaaaagatccataccggtgaaaagccttataagtgcgaggagtgcggaaaggctttcaaccagagcagtactctcatcaagcacaagaaaattcacacacgtgagaagccatacaaatgcgaggagtgcggcaaggcctttcacctgtccacccaccttactacgcacaagatcctccacacaggggaaaaaccctatcggtgtcgggagtgcggcaaagctttcaaccactccgcaacattgagctcccacaagaagatccacagcggagagaagccctatgagtgcgacaagtgcggaaaagcttttatcagcccctcttcactgtctaggcacgaaattattcacactggcgagaaaccttag

SEQ ID NO: 212444 - DNA, 183 bp, Artificial Sequence
  Description of Artificial Sequence: Synthetic coding sequence
atggtggccaaccccagcgtgatctgcagccacttcgcccaggacttatggcccgagcagaatatcaaagattcctttcagaaagtgatcctacgacgctacgaaaaacggggccatgggaatctccagctgattaaaagatgcgaatcaaccccctcggaaaaagagaaaaagaagaaatag

SEQ ID NO: 212445 - DNA, 1719 bp, Artificial Sequence
  Description of Artificial Sequence: Synthetic coding sequence
atgcccggccccctgggcagcctggagatgggcgtgctgaccttccgcgatgtcgccttggagttctctctggaagagtggcaatgtctcgacaccgcccagcagaatctctaccgaaatgtgatgctagagaattatcggaatctcgtgttcgttggcatagcagcaagcaagccagacctgattacctgcctggagcagggcaaagaaccttggaatgtgaaacgtcatgagatggtcaccgagccgcctgtggtctatagctactttgctcaggacctttggccgaagcaggggaaaaaaaattactttcagaaggtcatattgaggacctacaagaagtgtggacgggagaatttgcagctcagaaagtactgtaagagtatggacgagtgcaaagttcataaggaatgttacaatggtctaaaccagtgtctcaccacaactcagaacaagattttccagtacgacaaatacgtcaaggtgtttcacaaattctctaattctaatcgccacaagattggacatactggaaagaaaagttttaaatgtaaggaatgtgagaaaagcttttgcatgcttagtcatctggctcagcataagagaatccacagtggcgagaagccatataagtgtaaggaatgcggaaaggcctacaacgaagccagcaacttgtccacccataagaggattcacacggggaagaaaccatataaatgtgaagagtgtggcaaggctttcaaccgcttatctcacctaacaactcataagataatccatacaggcaagaaaccttacaagtgcgaggaatgtggcaaggcattcaaccagagtgctaacctcaccacacacaagcggatccacactggggagaagccgtataagtgcgaggagtgtggacgtgctttttcccagagctcaacgctcactgcacacaaaattatacacgccggcgagaagccctacaaatgcgaggagtgtgggaaagcattttcccagtcgtccaccctaacaacgcataagatcatccacaccggtgagaagttttataaatgcgaggagtgcggtaaagcattttctcgcctttctcacctgaccactcataagcgcattcatagcggggaaaaaccttacaagtgcgaagagtgcggcaaagcttttaaacagagttccacccttaccactcacaagcggatccacgccggagagaagttctataaatgcgaggtttgttcaaaggccttctctagatttagtcatctgacaacccataaaaggatccatacaggggaaaaaccttacaagtgcgaggagtgtgggaaagcatttaacctatccagtcagctgacaacccataagattatccacactggggagaagccttataaatgcgaagaatgcggcaaagctttcaatcagagctctaccttgagtaaacacaaggtcatacatacaggagagaagccttataagtgtgaggagtgcggtaaggcatttaaccaatctagccatctcaccacgcacaaaatgattcatacaggcgaaaaaccatacaaatgtgaggaatgtggtaaagcgtttaacaactcttccatcctcaataggcataagatgattcacactggagaaaagctatacaaaccggagtcatgcaacaacgcctgtgataacatagccaagatctccaagtacaagaggaattgtgcaggcgagaaatag

SEQ ID NO: 212446 - DNA, 3114 bp, Artificial Sequence
  Description of Artificial Sequence: Synthetic coding sequence
atgagcttctggagcgagaagtgcacccggctgatcctgtacgacctcaagatcgctctgaagaacggctccctgacattctgggacgtaactattgagttcgctctcgaggaatggcagtgcttggatatggcacagcagaacctctacagaaatgtcatgttagaaaactatcggaatttagtatttctgggcatcgccgtgagcaaattggatctgattacctgtttgaagcaaggaaaggaaccatggaatatgaagcgccatgaaatggtcacaaagccccctgtcattagcagccacttcacccaggacttctggcccgaccagtcaatcaaagacagttttcaggaaatcatactgcgcacttacgcccgctgcggtcacaagaatttgagactgaggaaggattgcgagtctgtgaatgaaggaaagatgcacgaggaggcctataacaagctaaatcaatgttggaccactactcagggcaaaattttccagtgtaataagtacgtgaaggttttccacaaatacagcaacagtaacaggtacaaaatcattcacactggtaagaaaccttacaaatgtgaagaatgtggcaaagccttcaagcagagctctcacctgacgcgtcataaagcaatccacacaggcgagaaaccgtataaatgtgaagaatgtgggaaggcattcaatcactttagcgcacttaggaagcaccagattatccacactggtaaaaaaccttataaatgtgaggagtgcgggaaggctttctcacagtcctctactttgcgaaaacacgagattatccacaccgaggagaaaccctataaatacgaggaatgtggaaaggctttctctaacctttccgcattgaggaagcatgagatcatccacactggccaaaaaccttataagtgtgaggagtgtggcaaagcatttaaatggagcagtaagctgacagtccacaaggttattcacactgctgaaaaaccttgcaaatgcgaagagtgtggtaaagctttcaagagattctcagcgcttaggaaacataagatcatacataccggaaaacagccatacaaatgtgaggagtgcagcaaggccttctctaatttctcagccctgcgaaagcacgaaattatccatactggcgaaaagccctataagtgtgaggagtgtgggaaggcctttaagtggagtagtaagctcaccgtacataaggtgatacacatggaagagaagccatgcaagtgcgaagagtgtggaaaggccttcaagcactttagcgccctgaggaagcacaaaattattcacactgggaaaaagccttataagtgtgaagagtgcgggaaagcctttaacaatagttctactctgatgaaacataagattatccataccggcaagaagccctacaagtgtgaagagtgcggtaaagccttcaagcagagcagccacctgacccgccataaggccattcacacaggggaaaagccctacaagtgcgaagagtgtggtaaagccttcaatcacttttctgctctcagaaagcaccagatcatccatactggaaaaaaaccttataagtgcgaagaatgtgggaaagctttctcacagtcgtctaccctaagaaagcatgagattatccatacaggtgaaaagccgtacaagtgcgaagagtgtggtaaagcctttaagtggtcctcacacttgacccgccataaggtgatccacaccgaagagaaaccctataagtgcgaagagtgcggcaaagcctttaatcatttctcagctcttcggaagcacaagattattcacacaggcaagaagccttataagtgcgaggaatgcggcaaggcattcagtcagagtagtacccttcgaaaacacgagattatacatacaggggagaaaccctacaagtgcgaagagtgtggaaaagcattcaagtggtcttcaaagctgactgtccataaagttatccacaccgctgaaaaaccctgtaaatgcgaggaatgtggaaaggccttcaaacacttctccgctttgcgtaagcacaaaattattcatacgggcaagaaaccttacaagtgcgaagagtgcggcaaagctttcaataatagttctacccttcgaaaacacgaaatcatccacaccggtgaaaagagttacaaatgcgaagaatgtgctctccggaaacatgagatcatccacacagggaagaaaccgtacaaatgcgaggagtgcggaaaggcgttcaataattctagtacacttaggaaacataagatcatctatactggtaaaaaaccttacaagtgcgaggagtgtggtaaagccttcaaacagtccagccatctgactagacataaggccgtgcatacaggggagaaaccatacaaatgcggagaatgtggcaaggccttcaacaactcttccaccctgaaaaagcacaagcttatccacacgcgcgaaaagtcatataagtgcgaagagtgtggcaaggcattttctaactttagtgctctgagaaaacacaaaatcattcacaccggagaaaagccctacaaatgcgaggaatgcgaatgcggcaaagcattcaacaatagcagtactttaatgaaacacaaaatcatccacactggagaaaagccctacaagtgcgaggagtgtggtaaagggtttaacaatttcagcactcttatgaaacataagattatacacactggggaaaaaccttacaaatgtgaagaatgcggcaaagcattcaagcagtcctcgcacctgactaaacataaatccatccacactggcgaaaagccatataagtgtgaagagcgtgggaaggccttttcacacttttctcggctgactaaacataggataatacatacaggcaagaagccctataagtgcgaggagtgcggcgagaaaccctataagtgtgaggaatgtggaaaggcatttaatcagtcatctcatctgacacagcacaaaaccattcatacaggcggaaagacttacaagtgcgaggagtgcggcaaagcctttaaccacctgtccgccctgacaaagcataaaattatccataccggagaaaagccgtag

SEQ ID NO: 212447 - DNA, 3021 bp, Artificial Sequence
  Description of Artificial Sequence: Synthetic coding sequence
atgagccggcggaagcagagcaacccccggcagatcaagcggagcttaggggatatggaggctcgcgaggaggttcagctggtcggagccagccacatggagcagaaggctaccgcacctgaggcaccaagtcccccttccgccgatgtcaacagcccccctccactcccacctcccaccagcccaggcgggccaaaggagctggaaggtcaggagcctgaacccaggccgaccgaggaggagcctggatctccatggtctgggcctgacgagctggagcctgttgtgcaggacggccagcgcaggattcgcgctcggctgagcttggctacaggtctgtcctgggggcccttccatggctctgtccagacacgggccagcagtcctagacaggccgagccctctcccgctcttacgctgctgttggtggacgaagcctgctggttgaggaccctgccccaagcacttacagaagcggaggcaaatacggaaatccaccggaaggatgatgctctttggtgccgcgtcactaaaccggtgcctgctggggggttactctcagtgcttctgactgctgagcctcactctacgccaggacaccccgtgaaaaaagagccagccgaacctacctgtccagccccagcgcacgacctacaactcctgccccagcaggccggaatggccagcattttagccaccgccgtaattaataaagatgtattcccttgtaaggattgcggtatctggtacagatctgagagaaatcttcaagcgcacctgctgtactattgcgcctcaaggcagggcacaggcagccccgcagccgcagctaccgacgagaaacccaaagaaacttatcccaatgaaagagtctgtccctttccacagtgtcgtaaaagctgcccgtccgcatcctcactcgagattcacatgcgcagccatagcggcgaacgaccctttgtttgtctgatatgtctgtctgcatttaccaccaaagcgaactgtgagagacaccttaaagtacacaccgataccctcagtggagtctgccactcatgtgggttcatcagcacaacccgcgacatactctattcccatttggtgactaatcatatggtatgtcagccaggtagcaaaggcgaaatttactcaccaggagctgggcacccagccaccaagctcccaccggactcacttggaagcttccagcagcaacatactgcattgcaggggcctctcgcaagtgcggatttggggttggcccctacccccagtcctgggctagaccgaaaagcactcgccgaagccaccaacggagaggctcgggcagaaccgctggcgcagaacggtgggtcctcagagccgccggcagccccccgcagcattaaggtcgaagccgtggaggagcctgaggcagcccctattttaggtcctggagaacctggaccacaagccccctctagaactccttcccctcgttctcccgcgccagcgcgtgtgaaggctgagctctctagtcctacccccggcagttctcctgttcccggcgagttgggactggcaggggccttgttcttgcctcagtatgtctttggccccgatgcagctccgcccgctagcgagattctcgctaagatgtccgaactggtacatagtaggctacagcaaggggccggcgccggtgccggtggggcccagacaggactgtttccaggggctccaaagggggctacgtgcttcgagtgcgagattaccttttccaatgtcaataattactacgtccataaacggctgtattgctcaggccgccgggcgccggaagacgcgccagcagcgagacgtccgaaagcgcctccgggcccggccagagcacctcctgggcagcccgcggagccagacgccccacgatccagtccaggccccggcgccagggaggagggggccgggggtgcagccacccctgaggatggggccggcggccgcggaagcgagggatcccagagtcctggctcaagcgtggacgatgcagaagatgacccctctcggacattgtgcgaagcctgtaacattcgcttttcacgacatgagacctacacagttcataaacggtattattgtgcctctcggcatgacccaccgcctcgacgccccgccgctccccccggacccccaggtccagccgcccccccagcccccagccctgcagcccccgtgcgtacacggcgaaggagaaagctttatgagctacacgccgccggtgcacccccgcccccaccccctggccacgctccagctccagaatcgccaaggccgggttctggctctggatcaggcccaggactggcacccgcaagaagccccggaccagcagccgatgggcccattgatctgtcaaagaaacctcgcaggcctctcccaggcgcacccgcccctgccctagcagattaccacgagtgcactgcctgtcgcgtgagctttcacagcctggaggcatacctcgcccacaagaaatacagctgtcccgctgcccccccccctggagcgctggggctccctgccgcggcctgcccttattgccctccaaatggccctgtgaggggggacctcctggagcatttccggctggcacacggcttactgttgggagctccccttgctggccctggtgtggaggcgcgaacacctgcagatcggggtccatctccggcaccagctcccgcggcaagtccccagcccgggtcgagaggaccacgggatggcctaggacccgaaccgcaggagcctccccccggaccacccccctctccagctgccgccccagaagcagtgcccccacctcccgccccgccatcgtattctgataagggtgtgcagacgccgtccaaaggcaccccagccccactcccaaacgggaatcaccgttactgtagactctgtaacattaaattttcctccctgtccacattcattgctcacaagaagtattattgcagctctcacgccgcggaacacgtcaagtag

SEQ ID NO: 212448 - DNA, 2649 bp, Artificial Sequence
  Description of Artificial Sequence: Synthetic coding sequence
atgtactactgcagcggccggcagcgggaggccgcccccgtgagcgaagaaaacgaggatagcgctcaccagataagcagcctgtgcccattcccgcaatgcactaaaagcttttccaacgcccgtgccctggagatgcatctgaattcccactcgggggtgaagatggaggagttcctcccgccaggggctagcttgaaatgtacagtgtgttcatatacagcagactcggtgatcaatttccaccagcatcttttttctcacttgacccaagccgcttttaggtgtaatcactgccatttcggctttcagacccaaagagagttacttcaacatcaggaactgcatgtgccttctggaaagttaccaagggagtccgatatggagcattccccctcagcgaccgaagacagtctgcagcctgctacagaccttttaacccggtcggagctgccacagagccagaaagcaatgcagacgaaggacgcgagttccgacacggaattagacaagtgtgagaagaaaacacaacttttcctgaccaatcagcggcccgaaatccagccaacgacgaacaagcagtccttcagctataccaagattaagtccgagccaagttccccccgactcgccagttctcctgtgcaacccaacatcgggccgtcattccccgtaggcccgttccttagtcagttctcatttccccaggatattaccatggttccacaagccagcgaaatacttgccaaaatgtcagagctggttcatcgtagactgcggcacggtagctccagctatccacccgttatatattcgcccttgatgcctaagggcgcaacatgttttgaatgtaatatcacgttcaacaatctggataactacctagtgcataaaaagcattattgttcgtcaaggtggcagcagatggcaaagtctccggaatttccctccgtgagcgagaagatgcccgaggcactgtcccccaataccggccagacatctatcaacctgctgaacccggccgctcacagtgccgaccctgagaatccactactccaaacttcttgtatcaattcatcaactgtgctggatcttataggtcctaatggcaagggccacgacaaagatttctctacacaaaccaaaaagctctcaaccagctccaataacgatgataaaatcaacggaaagccggtggatgttaagaacccctcagtcccattggtcgacggtgaaagtgaccccaataagactacttgcgaggcatgtaacatcaccttcagtagacacgagacttacatggtgcacaaacagtactattgtgctacaagacatgacccccctctcaagagaagtgcctctaataaagtcccggccatgcagcggaccatgcgcacccggaaaaggaggaagatgtacgagatgtgcctgcctgaacaagaacagaggcccccgttggtgcagcaacgcttcttagacgtagcaaacctgaacaatccttgtaccagtactcaggagcctaccgagggcttgggcgaatgttaccatccccgctgcgacatcttccccgggatcgtgtccaaacatctagagacttcactcacaataaacaagtgcgtgcccgtcagcaagtgcgataccacccattcctctgtgagttgtctcgaaatggacgtgccgattgatctctccaaaaagtgcctctctcagtccgagaggaccacaacaagtccaaagcggttgcttgactatcacgaatgcaccgtgtgtaaaattagtttcaataaggtggaaaattaccttgcgcataagcaaaatttttgccctgtaacggctcatcagaggaacgacctgggacagctggacggcaaggtgttccccaatcctgaaagcgagcgaaacagcccagacgttagttacgaacggagcattattaagtgcgagaaaaatgggaaccttaagcaacccagccctaacggtaatctctttagttcacaccttgcaactcttcagggcctgaaagtcttttctgaggccgctcaactcattgctacaaaagaggaaaaccgccaccttttcctgccccagtgtctgtaccctggtgccattaagaaggctaagggcgcggaccagctgtcaccctattacggcattaagccttctgactatatttctgggtctctcgtgatccataacaccgacatcgagcagtccaggaacgccgaaaatgagtcccccaaaggccaagcatcctctaacggctgcgctgcactgaaaaaagatagcctgccactgctacccaagaaccgcggaatggtcattgtgaacggggggctcaaacaggacgaaaggccagccgccaatccacagcaggagaacataagtcaaaacccacagcacgaagatgatcataagtcccccagctggataagcgaaaatcctcttgccgctaatgaaaacgtttccccgggaataccctccgccgaggaacagcttagctcaattgctaagggagttaatggttccagccaggccccaaccagtggtaagtattgccgtttgtgcgacattcagtttaacaacctgagtaattttattactcacaagaagttctactgcagctctcatgcagccgagcacgtgaagtag

SEQ ID NO: 212449 - DNA, 3456 bp, Artificial Sequence
  Description of Artificial Sequence: Synthetic coding sequence
atgagccggcggaagcagagcaagccccggcagatcaagcggcccctggaggacgctattgaagatgaagaagaggaatgtccttccgaggaaaccgacatcatttccaagggcgactttcctttagaagaaagttttagtactgagtttggtccagaaaacctcagctgcgaagaggtcgaatacttttgcaacaaaggcgatgatgagggaatccaggagactgcagagtcagatggcgacacccaatcagaaaaaccaggacagcctggagttgagaccgatgattgggatgggcccggcgaattagaagttttccagaaagatggagaaaggaaaattcagtctcgccaacagttgcccgtgggtaccacctggggtccctttccggggaagatggatctcaacaacaatagcctcaagacaaaagcacaggtgcctatggtgcttactgctggacccaagtggctgctcgatgtgacatggcagggagtggaagataacaaaaataattgcattgtttacagtaaaggaggccagctctggtgcaccactactaaagcaatctctgaaggcgaggagctgatagcgtttgtggtcgacttcgattctcgccttcaagcggcctcacagatgactcttactgaaggaatgtatccggcaaggctgcttgattccattcagctgttgccgcagcaggccgcaatggcttctattcttcctaccgcgatcgtgaataaggatattttcccgtgcaaatcctgtggcatctggtacagaagcgagagaaatctgcaggcccaccttatgtattattgtagcggccgccagagagaggccgcgcccgtctccgaggagaatgaggatagcgcccaccaaataagctctctctgtccctttccacaatgcactaaaagcttctcgaatgctagagcgctggagatgcatctaaatagtcattccggtgttaagatggaagagttcttgcctccgggagcaagcctcaaatgcacagtgtgtagttatacggcagatagcgttattaacttccaccagcatctcttctcacacttgactcaggcagcttttcggtgcaaccactgtcacttcgggttccagacccaaagagaactgctccaacatcaggagttgcacgtccctagtggtaagctgccgagggagtcagatatggaacatagcccctccgcaactgaggactcattgcagcccgccactgatctactgacaagatctgagttaccccagtcccagaaggccatgcaaacaaaagatgcctccagcgacaccgagctggacaagtgcgaaaaaaaaacccagctgtttctcaccaaccagcggcctgaaatccaacctactaccaacaagcaatcgtttagctacactaagataaagtcagaaccatcctctcccaggttggcttccagtccagtccaacccaacatcggtccgtctttccctgtgggccctttcctcagtcaattctcctttccacaggatatcacaatggttccacaagccagtgagattctggctaaaatgtcggagttagtacatcggcgactgcgccatggctcttcaagctacccaccagtcatttacagccccctaatgcccaaaggcgctacctgtttcgaatgtaacattacatttaataatctcgataattacctagttcataagaaacactactgcagctccagatggcagcagatggcaaagtctccggagttccccagcgtatcagaaaagatgcccgaagctctatcacccaacactgggcagacgtccatcaacctcctaaatcctgcagctcactccgctgaccccgaaaatcccctgctgcaaacatcctgcattaattcgagcaccgtcctggacctcattggtccgaatgggaagggccacgacaaggacttttcaactcaaactaaaaagcttagtacttccagcaataatgatgacaaaattaatgggaagcccgttgacgttaagaatcccagtgtcccattggtagacggggaaagcgatcccaataagacaacgtgtgaggcatgtaatattacattttctcgtcacgaaacctacatggtgcacaagcaatactactgcgcaacgcggcatgacccccccttgaagcgatccgctagcaacaaagtgcctgcgatgcagcggacaatgcggactcgtaagagacgcaaaatgtatgaaatgtgccttcccgaacaagagcagaggcctcctttggtgcaacagagattccttgatgtagctaatcttaacaatccatgcacctcaactcaggaacctaccgaaggactgggcgagtgctaccatcccaggtgtgacatcttccccggaatagtgagcaaacatcttgaaacctcgctgactatcaataagtgtgttcctgtgtccaagtgtgacaccacccattcttcagtttcttgtcttgaaatggacgtgcctattgacctctcaaaaaaatgtctgagtcaatctgaaaggaccacaacctcacccaagagattgctcgactatcacgagtgtaccgtgtgcaaaatttctttcaacaaagtcgagaactaccttgctcataagcagaatttttgtcccgtgacagcccatcagaggaacgatctggggcagttagacgggaaggtgttcccaaatcctgagtcagaaagaaatagtccagacgtgtcttacgagcggtctattatcaaatgtgaaaagaacgggaatttaaagcaaccctcaccgaacggcaacctgttcagcagtcacctagcaacactgcaaggtcttaaggtgttctcagaggctgctcagctcattgcaactaaagaagaaaatagacacttattccttccccagtgcctatatccaggtgccatcaagaaagccaaaggcgccgaccagctgtcaccttattatggaatcaagcccagcgattacatcagcgggtctctggtgatccacaacaccgacattgagcagtcccgtaacgccgagaacgaatcgccaaaagggcaagcaagctccaatggatgtgcagccctaaagaaggactccctgccgcttctgccgaaaaaccgtggcatggtgatcgttaacggagggttaaagcaggatgaacgaccagcagctaatcctcagcaagagaatatcagccagaatcctcagcatgaggatgaccataaaagcccatcctggatatccgagaatccgttagccgccaatgaaaacgtgtcaccagggatccctagcgccgaggagcagttgagttctatcgctaagggcgtgaacggaagctcacaggcccccacatctggcaagtattgtcgactgtgcgatattcaatttaataatctgtccaatttcattacccacaagaaattctactgcagcagccacgccgctgagcacgtgaagtag

SEQ ID NO: 212450 - DNA, 3060 bp, Artificial Sequence
  Description of Artificial Sequence: Synthetic coding sequence
atggacctgaacaacaacagcctgaagaccaaggcccaggtgcccatggttctgacagcggggccgaagtggctgctagacgttacctggcagggcgtggaagataacaagaataactgcatcgtgtactccaaaggcggtcagctttggtgcacaaccacgaaagctatatcagagggtgaggagctcatagcatttgtggttgacttcgactcccgacttcaggcagcttcccagatgacactgacagaggggatgtatccagcccgcctgctcgattctattcagctactccctcagcaggccgctatggcctctattcttcccaccgccatcgttaataaagacattttcccatgtaaatcttgtggaatctggtaccgatcagagcgcaatctccaggcgcacttgatgtattactgttctgggaggcagcgggaggctgctccggtttcagaggaaaacgaggattccgcccatcagattagctccttgtgcccctttccacagtgcaccaagagctttagtaatgcacgggccctggaaatgcacctgaattcacatagtggagtgaaaatggaggagttcctgcctccgggcgcctcactgaagtgcacagtctgcagttatacagctgattccgtgatcaattttcatcaacatctgttcagtcacttgacccaagcagcctttcggtgcaaccactgccattttggcttccaaactcaacgggaacttctgcaacatcaagagcttcatgtgccgagtgggaagcttcctcgcgagtcagatatggagcatagtccaagcgccacggaagacagcctccagccagcgactgacctgttgactcggagcgaactgccacaaagtcagaaagcgatgcaaaccaaagatgccagctcagatacggaactggacaagtgcgagaagaagacccaactattcttaaccaaccagcgccccgagatccagccgacaactaacaagcagtctttctcttacaccaaaatcaagtccgaaccatcttccccgaggctggcatcttctcccgtgcagccaaacattggcccgagctttcccgtcgggcctttcttaagtcaattctccttcccccaggacatcactatggtgccccaggcaagcgaaattctcgccaagatgtctgaattggtgcataggcgtctgcggcacggtagtagctcgtacccccccgtcatctatagcccactgatgcccaagggggcaacctgttttgagtgtaatatcactttcaataatctggacaactatctggtccacaagaagcactactgcagctcacggtggcaacagatggcaaagagccctgaatttcccagtgtcagcgagaagatgcctgaagctttgagcccgaacaccggccagacctcaattaatttgctgaatcccgcggcacattctgccgaccctgagaatcctctcctgcagacgtcctgcattaactcatctaccgttttagatctgattgggccgaacggaaaaggccacgataaagacttttcaacccagacgaaaaaattatccacatcgtcgaacaacgacgacaaaattaacggcaagccagtcgacgttaagaatcctagtgtgccgttggtagacggtgaaagcgatccaaacaagacgacctgcgaggcgtgtaacattacattcagcaggcacgagacgtatatggtgcataaacagtactattgcgcaaccaggcacgaccccccactgaaaaggtccgcgtctaataaggtccctgctatgcagcggaccatgcggacgcggaagaggaggaagatgtacgagatgtgcctcccagaacaggagcagcgacccccgcttgtgcagcagcggtttctcgatgttgccaatctaaacaacccctgtacatccacccaggagcctaccgagggacttggggagtgttaccacccgcgctgcgacatattccctggtattgtgtctaagcacctcgagacgagcctgaccattaataaatgtgtcccggtgtctaagtgcgatacaacacattccagcgtgtcttgtttagagatggacgtcccaatcgacttaagcaagaagtgtttgtcccagagtgagcgaacaaccacaagtccgaagaggctgctagactatcacgaatgtactgtctgcaaaataagctttaacaaggtggaaaactacttggcacataagcagaatttctgcccggttaccgcccatcagaggaacgacctgggccagctggatggcaaggtttttcccaatcctgaatccgagcgaaactctcccgatgtttcatacgagagatcaatcattaagtgtgaaaagaacggcaatcttaaacagccttctcctaacggaaatttatttagctcacatctggcgacgttacagggcttgaaagtgttcagcgaggctgcacagctgatcgccactaaggaagagaacagacacctgtttcttccacaatgcttgtacccaggcgctataaaaaaggcaaaaggcgctgatcagctgtccccatactacggtataaagcccagcgattatatctctggatcgcttgtcatccataatacagacattgagcagagccggaacgctgagaacgagagccccaaaggtcaggcttcaagcaacggctgtgccgccctgaagaaggactctctgcctctattacctaaaaaccgcggtatggtgatcgtcaacggaggcctgaaacaggacgaaaggcccgcagctaacccccagcaggagaacataagccagaatccacagcatgaggacgatcataaatcccctagctggatcagtgagaaccctctggccgctaacgagaacgtcagccccggtattccctccgccgaggagcagttgagttctatcgcaaagggtgtgaatggctcatctcaggcaccaacctccggaaaatactgcaggctgtgcgacatccagtttaataatttgtccaacttcatcacacataaaaaattctattgctcatcacatgcagcggagcatgttaagtag

SEQ ID NO: 212451 - DNA, 3060 bp, Artificial Sequence
  Description of Artificial Sequence: Synthetic coding sequence
atggacctgaacaacaacagcctgaagaccaaggcccaggtgcccatggttcttacagctgggcccaaatggctcttggacgtaacctggcagggggtcgaagacaacaagaacaattgtattgtatactccaaaggaggacagttatggtgcactaccacaaaagcaatttccgagggagaggagctaattgcatttgtggtggacttcgacagccggctgcaagccgcctcccaaatgaccctgaccgagggcatgtacccagctagactgctggatagcatacagctgttaccccagcaggcagccatggctagcatactgcctacagcgatcgtcaataaggacatctttccctgcaaatcttgtggcatatggtaccgatctgaaaggaatcttcaagctcaccttatgtactactgcagtggaaggcagcgggaggccgcacccgtcagtgaagagaacgaggatagcgcgcaccagatctcaagtttgtgtccattcccccaatgcaccaagagcttttccaacgcgcgggccttggagatgcatttgaactcccactcaggcgtgaagatggaagagtttctgccccccggcgcctctctcaagtgtacagtgtgttcctacaccgcagattccgtgatcaacttccatcagcacttgttttcacacctgacccaggcagcttttcggtgcaatcattgccatttcggttttcagactcagcgggaactcctccagcatcaggaactgcacgtgccttctggaaagctgccgagggaaagcgatatggagcattcaccctccgccacagaagattctctccagccagccacagacctgctgaccaggagtgaattacctcagtcgcaaaaggctatgcaaaccaaagatgcctcctctgacaccgagctggacaagtgtgagaagaagacacaactatttttgactaatcagcgaccagagattcagcctacaaccaacaaacagtctttcagctacacaaaaattaagagcgaaccgtctagcccccgacttgcttccagccctgtgcagcccaacattggcccttcatttccagtcggcccattcctctctcagtttagcttcccacaggacatcactatggtgcctcaggctagcgagatactggccaagatgtctgagctagtccataggcgcctgagacacggatcgagctcctaccctcccgtcatatattcccccctgatgccaaagggagctacatgcttcgaatgcaacattacctttaataatctggacaattacctggtgcacaagaagcattactgttcctctcgctggcagcagatggctaaaagtcccgaatttccctcggtgagcgaaaaaatgcctgaagctctcagccccaatactggccagacgtcaatcaatttgctgaatcctgcagcacattcagccgaccccgagaatcctctccttcagacttcatgtataaacagttctactgtcttagatcttatcggtcctaacggaaagggccacgacaaggatttttccacgcagacgaagaaactgtcaacctccagcaataatgacgataaaatcaatggcaaaccggtggacgtgaagaacccgagcgttcctctcgtagacggagagtctgatcctaataaaacaacttgcgaggcctgtaacattacttttagtcggcatgaaacatacatggtccacaagcagtactattgtgctactaggcatgaccctcccctcaagaggtcagcgtccaataaggtgcccgccatgcagagaactatgcgcacccgcaaaagaagaaaaatgtatgagatgtgcctgccagagcaggagcaaagaccaccattagtacagcagcgctttctcgacgtggccaatctcaataacccatgtacgagcacacaggagcccacagaaggactcggagagtgttatcacccacgatgcgatatcttcccaggcattgtcagcaagcacctggagacctccctgactatcaacaagtgcgttccagtgtctaaatgtgacaccacccacagctctgttagttgccttgaaatggatgtaccaattgatctcagcaaaaagtgtctgtcacaatcagagcggacgaccacctcccctaagcgactccttgattaccatgagtgtacagtttgcaagatatcattcaataaggtggagaattatttggctcacaaacagaacttctgcccggtcactgctcaccagagaaacgaccttggtcagctcgacgggaaagtgttccctaaccctgagtcagagaggaacagccctgacgtatcatacgagaggtctataattaaatgcgagaagaatggaaatctgaagcagccgtcccctaatggcaatctgttctccagtcacctcgcgaccctgcaaggactaaaagtgttcagtgaggccgcccagctcatcgcaaccaaggaggagaaccgacatctgttcttgccccaatgcctgtacccaggcgcaattaaaaaagcaaagggagcagaccagctgtctccttactacggcatcaagccttccgattacatctcaggatccctggtgattcataacaccgacatcgagcagagccgcaacgccgagaacgagagtcccaaaggccaggctagctccaatggatgtgcggctctcaagaaggacagccttccccttttaccaaagaacaggggtatggtaatcgtcaatggaggtttgaagcaggatgagcgtccagccgcaaatcctcagcaggaaaatatctcccagaacccacagcacgaagacgaccataaatcccccagctggataagcgaaaaccctctagccgccaacgagaatgtttcccccggcatcccctccgcagaggaacaactctcttcgatcgccaaaggagtgaacggttcctcacaggcccccacctctggcaaatactgtcgcctgtgcgacattcagttcaacaatctctcgaatttcattacccacaagaagttctactgctcttcccatgccgcggaacatgtgaagtag

SEQ ID NO: 212452 - DNA, 2418 bp, Artificial Sequence
  Description of Artificial Sequence: Synthetic coding sequence
atggacgaggacggcctggagctgcagcaggagcccaacagcttcttcgacgctactggcgctgatggtacccacatggacggggaccagattgtggttgaagttcaggagacagtattcgtctctgacgtcgtggatagcgacatcaccgtgcataatttcgtacccgacgatcccgatagcgtggtcatccaggacgtgattgaagacgtcgtgatcgaggacgtccaatgcccagacattatggaggaggcagacgtgtccgagacagttattattccggagcaagttctagatagtgacgtcacagaggaggttagtctggcccactgtacagtcccagatgacgtgctggcctcggatatcactagtgccagcatgagcatgcctgagcacgtcctgactggggattccattcatgtgagcgacgtgggccacgtcgggcatgttggccatgttgagcacgtggtgcatgattcagtagtcgaagcagagattgttacggaccccctgactaccgacgtggtcagcgaagaggtcttggtggcggactgtgcctcggaggcggtgatagacgctaatggaattcccgtggaccagcaggacgatgataagggtaactgcgaggactatctcatgatcagtttggatgacgccgggaaaattgagcacgacgggtcttcaggaatgactatggatacagaatcagaaatcgacccttgcaaggtcgacggcacatgtcctgaggtgattaaggtgtacatctttaaggccgatcctggcgaagacgacctggggggtacagtggatatcgtggagagtgagcccgagaacgaccatggggtggaattgttggaccagaattcttcaatccgggtgccacgcgagaagatggtctacatgactgtaaacgatagtcagcccgaagacgaggatttgaacgtcgctgagattgccgacgaggtgtacatggaggtgattgtgggcgaagaggacgccgctgccgccgcagccgctgccgccgtccacgaacagcaaatggacgataacgaaattaaaacctttatgcccatagcctgggcagccgcatatggaaacaactcggatgggatagaaaatcggaatggaactgctagtgctctgcttcatattgatgaatccgctggacttggtcgtctggctaagcagaagcccaaaaaacgacggaggccggatagcaggcagtatcagacagctatcattatcggcccagatgggcaccccttaacggtgtacccttgcatgatctgcggcaagaagtttaaaagcagaggctttctgaagcgccacatgaagaatcacccggagcatttggctaaaaaaaaataccgttgtacggattgcgattacactactaacaagaagatctctctgcataatcacctggagtcacacaagttaacttctaaagcagagaaggccatagaatgcgacgagtgcggcaagcactttagccatgcaggcgccttatttactcacaagatggttcataaagagaagggtgccaacaagatgcacaaatgcaagttctgtgagtacgaaactgcggaacaaggcctcctgaacaggcacctgttagccgttcatagcaagaacttcccccacatctgcgtggagtgcggaaagggctttagacaccctagcgagctgaagaaacacatgaggatccacaccggcgagaagccttatcagtgccagtactgcgagtatagatccgctgattcctccaatctcaaaactcacgtgaaaacaaaacacagcaaggagatgcctttcaagtgtgatatatgcctactgactttttccgataccaaggaggtccagcagcatgctctgatacaccaggaaagtaaaacgcaccagtgtctgcactgcgatcataagagcagcaactccagtgaccttaagcgtcatatcatttccgtgcacacaaaggattacccccataagtgtgacatgtgcgacaagggattccaccgcccgtccgagctgaaaaaacatgtagctgcccacaaaggaaaaaaaatgcaccagtgtcggcattgtgatttcaagatcgctgacccatttgtgctgtccagacacatcttgtccgtgcatacgaaggacctccccttccgatgcaagcggtgtagaaaaggattcaggcagcagtcggagctgaagaaacacatgaagacgcactctggccgtaaagtgtaccagtgtgagtattgcgaatactcaacaacagacgcctcaggcttcaaacggcacgtgatctcaatccacaccaaagattaccctcataggtgtgaatactgcaagaaagggttcagacggcccagtgaaaagaaccaacacattatgcgccaccacaaggaggtggggctgccatag

SEQ ID NO: 212453 - DNA, 2268 bp, Artificial Sequence
  Description of Artificial Sequence: Synthetic coding sequence
atggacgaggacggcctggagctgcagcaggagcccaacagcttcttcgatgcgactggggcagacggcacacatatggatggagatcagatcgttgtagaggtgcaagagaccgtcttcgtgagcgatgtagtcgacagtgatatcactgtgcataacttcgtgcccgatgaccccgactccgtagtgatacaagacgtcatagaggatgtggtgattgaagacgtgcagtgtcctgacatcatggaggaagccgacgtgagcgaaaccgtaatcatccctgagcaggtgttagactcagatgtaacggaagaagtctctttggcccactgtacggtgcccgatgacgtactcgcgtctgacatcaccagtgccagcatgtcaatgcccgaacatgttctcactggtgatagtatacacgtgtcagacgtaggtcacgtcggccatgtgggacatgtggaacatgtggtgcacgatagtgtcgtggaggcagaaattgttacagatcctttgaccacagatgtggtcagcgaagaggtgctcgtggcagattgcgcgtctgaggccgtcattgatgctaatggtatccccgtggaccagcaggatgacgacaaggggaattgcgaggactacctgatgatctcctgtgggaccgtcgacattgtggaatccgaaccagaaaacgatcatggagtggagttattagatcaaaactcaagcatcagggtcccacgggagaagatggtctatatgacagtgaacgactcccagccggaggatgaggacctgaacgttgccgaaattgccgatgaagtctacatggaggtgattgtgggcgaggaggatgccgctgcagcagctgcagccgcagctgtgcacgaacagcagatggacgacaatgagatcaagaccttcatgccaatcgcttgggccgctgcttatggcaataactctgacgggatcgagaaccggaacgggacggcatccgcattactgcatatcgatgaatctgcaggcctcgggcgattggcaaagcagaagccaaagaaacggaggcggccagactcccgccagtaccagactgctattatcatcggacccgacggacaccctctaactgtgtacccctgcatgatttgtggcaaaaaatttaagagcaggggtttcctgaagcgccacatgaagaatcatcctgagcatctggccaagaagaaataccggtgcaccgactgtgattacacaacgaataagaagatcagcctacataaccacttggagagccataaactcacatccaaggccgagaaagccattgagtgtgacgaatgcggcaaacatttctcacacgccggggctctgttcacacacaaaatggtgcataaagagaaaggagcgaacaaaatgcacaaatgcaagttctgcgaatatgaaacggctgagcagggattgctgaatcggcacctgctcgctgttcacagtaaaaattttccacatatatgcgtagagtgtggcaagggcttccgtcacccatctgagctgaaaaagcacatgcgtatccacaccggcgaaaagccttaccagtgtcaatattgcgagtatcgctcagcagacagcagcaatcttaaaactcatgtgaagactaagcacagcaaagaaatgccctttaagtgtgacatttgcttgctcaccttttccgacacgaaagaagttcagcagcacgccctgatccaccaggaaagtaaaactcaccaatgcctgcactgcgaccacaagtcgagcaactcttccgacctgaagcgacacatcatatctgtgcacaccaaagattatccacacaagtgtgatatgtgcgacaaaggattccatagacctagtgaactgaaaaaacatgtagccgcccataaaggaaagaagatgcaccaatgtagacactgtgatttcaagatagccgacccattcgtgctaagccggcacattctgtcggtccacaccaaagacctgccctttagatgtaagagatgtagaaaaggattccggcagcagtcggagttgaaaaagcacatgaaaacacattcaggccggaaagtttatcagtgtgaatactgtgagtacagcacgacagatgcatctggctttaaaaggcatgtcatttctattcatactaaagactatcctcaccgatgcgaatactgcaagaaaggatttcgcaggccctcagagaaaaatcagcatatcatgcggcaccacaaggaagtggggttgccttag

SEQ ID NO: 212454 - DNA, 2418 bp, Artificial Sequence
  Description of Artificial Sequence: Synthetic coding sequence
atggacgaggacggcctggagctgcagcaggagcccaacagcttcttcgacgccacaggggcggacggaactcacatggacggggaccagattgtggtagaggtgcaagaaacagttttcgtctctgatgtggtggatagcgatattacagttcataacttcgttcctgacgatccagactctgttgtgatccaggacgtgatcgaggacgtggtgattgaggacgtccaatgtcctgatataatggaagaggccgacgtctccgaaactgttataatcccagaacaggtcctggattccgacgtcactgaagaagtaagcctggcgcactgtacagttccagatgacgtgctggcctccgacattacctcagctagcatgtcaatgccagaacatgttctgactggggacagtatccatgtatcagacgtgggccatgtaggccacgttgggcacgtggagcacgtagtccatgattccgtcgtcgaggcagagatagtcacggatccgttgacgaccgatgtcgtgtccgaggaggtcctggtagctgactgtgcttctgaagccgtgatcgacgctaacggtatacctgtggaccagcaggatgacgataaaggcaattgtgaggattaccttatgatatcacttgatgacgccggcaagattgaacacgacgggagcagcgggatgaccatggataccgaatccgaaattgatccttgtaaagtggacggtacgtgcccagaggtcattaaagtgtacattttcaaagctgaccctggtgaagatgacctgggagggactgtggatatcgtggagtccgagcctgaaaacgaccatggcgtggagctgttggatcagaattctagcatacgcgtcccccgggagaagatggtgtatatgactgttaatgattcccagccagaagatgaagacctgaatgttgccgagatagccgacgaggtgtatatggaggttatagttggggaggaggatgccgccgccgcagcagctgccgccgccgtacatgaacagcagatggatgacaatgaaattaagaccttcatgccaatcgcctgggccgcagcttacggcaacaacagcgacggcatcgagaatagaaatggcacagcgtcagcactgctgcatatcgatgagtctgcgggccttggacggcttgccaaacagaagcctaagaagcgtcggaggcctgactctagacagtatcagaccgccattatcatcggccctgatgggcatccattgacagtttacccttgtatgatctgtggcaagaagttcaaaagcagagggtttttgaagcgtcacatgaagaaccaccccgagcacctagccaaaaaaaaatatcggtgcaccgactgcgactacacaacaaataaaaaaatttcgcttcataaccacctggagtcccataagctcaccagtaaagccgagaaggcaatagaatgcgacgagtgcggaaagcatttttcacacgccggagccctgtttacccacaagatggtccacaaagaaaaaggcgctaataaaatgcacaaatgtaaattttgtgagtacgagaccgccgaacaggggctactgaatagacatctcctggctgtacattctaaaaattttccacacatctgcgttgagtgcgggaaaggctttcggcacccaagtgagttaaaaaagcacatgagaattcacacgggggagaagccatatcaatgccaatattgtgagtatcggtcagctgatagcagcaacctcaaaacccacgtaaaaaccaaacactcgaaggaaatgcccttcaaatgtgacatctgcctcctgacattcagtgataccaaagaggtgcagcaacatgcgctgatacaccaggaatcaaagacccatcagtgcttgcactgcgaccacaagagctctaactcctctgacctgaaaagacatataatatcggtacataccaaggactaccctcacaagtgtgacatgtgtgacaaaggcttccacagacccagtgagttaaagaagcacgttgctgcacacaaaggcaagaaaatgcaccagtgtaggcattgcgatttcaagattgccgacccattcgtgctgagccggcatatactgagcgttcacaccaaggaccttccattccggtgtaagcgatgcaggaaaggtttcagacagcagagcgagctgaaaaaacacatgaaaacacattctggaaggaaggtttatcagtgcgaatactgtgaatatagtactactgatgcatccggattcaaacggcacgtaatctccattcacactaaggactacccccaccgatgcgaatactgcaagaagggatttagaaggccctctgaaaaaaatcagcacatcatgcggcaccacaaggaagtcggtcttccctag

SEQ ID NO: 212455 - DNA, 2418 bp, Artificial Sequence
  Description of Artificial Sequence: Synthetic coding sequence
atggacgaggacggcctggagctgcagcaggagcccaacagcttcttcgatgcaactggagccgacggaacacacatggatggcgaccagatagtggtagaagtacaggaaaccgtgttcgtctcagatgtcgtggactctgatattacggtgcacaatttcgtgcctgacgaccctgactctgttgtgattcaggacgttatagaagatgtggtgattgaggacgtccaatgtccagacatcatggaggaagccgacgtgtcagagacggtcattatcccagaacaggtgctggacagtgatgttaccgaggaggtcagcttagcacactgcacagtacctgacgacgtgctggccagcgacatcacctccgccagcatgtcaatgcccgaacatgttctgaccggcgactcaattcacgtttcagatgtggggcacgttggccacgtagggcacgttgagcatgttgtgcacgacagcgtggtggaagctgagatcgtgactgatcctcttaccactgatgtggtctcagaggaagtattggtggctgactgcgcctccgaggccgtcatcgatgcaaacggaatcccggtcgaccaacaagacgatgataagggcaactgtgaggattatttgatgatcagcctggatgatgccgggaaaattgagcacgacgggtcatccggaatgactatggacaccgaatcggagatcgatccttgcaaagttgacggtacatgccccgaggttatcaaagtgtatatctttaaagcagatccaggtgaggacgatctcggaggtaccgtcgatatagtggagagtgagccagaaaatgatcacggcgtagagctacttgaccagaactcctccattagagttcctagagagaagatggtgtatatgacagtgaatgactctcagccggaagatgaagaccttaacgtcgctgagattgccgatgaagtctacatggaggtcatagtcggggaagaggatgccgcagccgctgccgccgccgctgcagtgcatgaacaacagatggacgacaacgaaattaaaaccttcatgcctatcgcctgggccgcagcatatgggaacaactctgacggaattgagaaccgcaatgggactgcctccgctcttcttcatatcgatgaatcagctggcctcgggaggctggctaagcagaagccaaagaagaggcgacgaccagattctcggcagtatcagaccgccatcatcattggccctgacgggcatcctttaactgtttatccatgcatgatttgcggcaaaaagttcaagagtcgggggttcttgaagagacatatgaagaatcatcctgagcatcttgctaagaaaaaatacagatgtacggattgcgactacaccacaaacaagaagatatctctgcacaaccacctggagtctcacaagctgacctccaaggcagagaaggcgattgaatgcgacgaatgtggaaaacacttttcccatgccggggcactattcacccacaagatggtgcacaaagagaagggcgctaacaagatgcacaaatgcaaattttgcgaatatgaaactgctgagcaggggctgctaaaccggcacctactggccgtacactcgaagaacttcccacacatttgtgtggaatgcgggaaaggttttcggcaccctagcgaactcaagaaacatatgagaattcacactggggaaaagccctatcaatgccagtattgtgaataccgttcagccgattcttccaacctgaaaacacacgtgaaaacaaagcattcgaaggaaatgccattcaaatgtgacatatgcttgttgaccttcagcgatactaaggaggttcaacagcacgctctgattcatcaggagtcaaaaactcatcagtgcttacattgtgatcacaagtctagtaattcttcagatttaaaacggcacattatctctgtgcacacaaaagactatccccacaaatgtgacatgtgtgataaaggcttccatcgcccaagcgaactgaagaagcacgtggccgcacataaaggaaagaaaatgcaccagtgtcggcattgcgacttcaaaattgccgatccttttgtgttatccagacatatactgtccgtccacaccaaagacttgccatttcgatgcaagagatgcagaaagggattccggcagcagtcggaattgaaaaaacacatgaaaacccattcaggccggaaagtgtaccagtgtgaatactgtgaatactccaccacagacgcgagcggcttcaagcggcacgttataagcattcatactaaggattaccctcaccgttgtgagtactgcaaaaaaggttttcggcgcccttctgagaaaaaccagcacattatgaggcaccataaggaggtaggattaccttag

SEQ ID NO: 212456 - DNA, 99 bp, Artificial Sequence
  Description of Artificial Sequence: Synthetic coding sequence
atggacgaggacggcctggagctgcagcaggagcccaacagcttctttgatgctacaggggctgatgggacgcatatggatggcgaccagattgtttag

SEQ ID NO: 212457 - DNA, 408 bp, Artificial Sequence
  Description of Artificial Sequence: Synthetic coding sequence
atggacgaggacggcctggagctgcagcaggagcccaacagcttcttcgacgccacgggggccgacgggacccatatggatggcgatcagattgtcgttgaagtgcaggaaaccgttttcgtaagtgatgttgtggatagtgacatcacggttcacaatttcgtgcctgatgatccagatagtgtcgttattcaggatgtgatcgaagatgtggtgatcgaagacgttcagtgtccggacatcatggaagaagcggatgtatctgagactgtgattattccagagcaggtgctcgacagcgatgtcactgaagaagtgtctctggcccattgcacagtgccagacgatgtcctggcaagcgatatcacatcagcctcgatgtccatgcctgaacacgtgttgacctag

SEQ ID NO: 212458 - DNA, 1584 bp, Artificial Sequence
  Description of Artificial Sequence: Synthetic coding sequence
atggacaccgagagcgagatcgacccctgcaaggtggacggcacctgtcccgaggttatcaaagtgtatatcttcaaagcagacccaggcgaagacgatttagggggaacagtggatatcgtggagtccgagccagagaatgatcatggcgtcgaattgctggatcagaattcgtccatccgggtgccacgggagaaaatggtctacatgacagtcaacgacagccagccggaggacgaggatctgaacgtggcagaaattgctgatgaggtgtacatggaagtcattgtgggggaggaggacgcagccgccgccgcagccgccgcagcggttcacgagcagcagatggacgacaacgagataaagacattcatgcctattgcgtgggctgccgcatatgctattattatcggtcccgacggccatcccttgaccgtgtatccctgcatgatctgcgggaagaagttcaagagtcgcggattcctgaagcgccacatgaagaaccaccctgagcacctggcaaaaaagaaataccgatgcaccgattgtgattacacaacaaacaaaaagatctccctccataaccatttggagtcacataagctaacaagcaaagccgagaaggctatcgagtgtgatgaatgcggaaagcatttttcccacgccggtgccctgttcacccacaaaatggtgcacaaggaaaaaggcgccaacaaaatgcacaaatgcaagttctgtgagtacgagacagctgaacaggggctgttgaatcgacatctcctggctgtccactcaaagaattttccacatatttgcgtagaatgtggaaaagggttccgtcatccaagtgaacttaaaaaacatatgagaattcatacaggggaaaagccctaccagtgtcagtactgtgagtaccgctccgccgacagcagcaacctgaaaactcacgtgaaaacaaaacatagtaaggaaatgccctttaaatgcgatatttgcctgctcaccttcagtgacacaaaggaggtccagcaacacgcactcatacatcaagaaagcaaaactcaccagtgcctccattgcgaccataagagcagcaatagctctgacctgaagcgccacattataagcgtgcacactaaagattatccacacaagtgtgatatgtgtgataaagggtttcaccgaccgagcgaattgaaaaagcatgtcgccgcccacaaggggaaaaagatgcatcaatgccgacattgcgattttaagattgccgacccctttgtgctgtcccgccacattctctccgttcacactaaggatctgcccttccgctgcaagagatgccgcaaaggatttcgacagcagagtgaactcaaaaaacacatgaagacacacagcggccgcaaggtgtaccagtgtgaatattgcgaatatagcactaccgacgcatcaggcttcaagagacatgtcatatcaatccacaccaaggactaccctcatcggtgtgagtactgcaaaaagggcttcaggagacctagtgagaagaaccaacacatcatgcgccaccacaaggaggtgggactcccgtag

SEQ ID NO: 212459 - DNA, 789 bp, Artificial Sequence
  Description of Artificial Sequence: Synthetic coding sequence
atggacgaggacggcctggagctgcagcaggagcccaacagcttctttgatgctactggcgctgacggcacccacatggatggcgatcagattgttgtggaggtgcaggagaccgtatttgtctccgacgtcgtggatagtgatatcacagtgcacaattttgtcccggatgaccccgacagcgtcgtaatccaggacgtgattgaggatgtggtgattgaagatgtgcagtgccccgacatcatggaagaggccgatgtgagcgagaccgttatcataccggagcaggttctggattcggacgttaccgaggaggttagtctggctcactgtacagtgccagatgacgtcctggcctcagatattacatctgccagtatgagcatgcccgaacacgtcctgaccggcgacagcatccacgtgagcgacgtagggcacgtgggacatgttgggcatgtcgagcatgttgtgcatgacagtgtcgttgaggccgagatcgtgacagaccctctgaccactgatgtcgtgagtgaggaagtactggtcgccgactgtgcctcggaggctgtcatcgatgccaacggaattcctgtggatcagcaagacgacgataaaggaaactgtgaggactatctaatgatttcctgcaataattccgacggaatcgaaaatagaaacggcaccgccagcgcactgctccacattgacgagtctgcagggttaggccggcttgccaaacagaagcctaagaaacggaggcggcctgacagtcgccagtatcagacgtag

SEQ ID NO: 212460 - DNA, 1731 bp, Artificial Sequence
  Description of Artificial Sequence: Synthetic coding sequence
atgaccatggacaccgagagcgagatcgacccctgcaaggtggacggaacatgccccgaagttattaaagtgtatatttttaaggccgaccctggtgaggatgaccttggtggcacagtcgacatcgttgaaagtgagcccgagaacgatcacggggtggaactcctcgatcagaactcttccattagggtgccaagggagaagatggtatatatgacagttaacgactctcagccggaagatgaagatctcaatgtcgcagaaattgctgacgaggtatatatggaagtcattgtcggagaggaagacgctgctgcagcagccgctgcagcagcggttcacgaacagcagatggatgataatgagatcaagacattcatgccgattgcttgggctgccgcgtatggtaacaatagtgatggaatcgagaacaggaacgggaccgctagcgccctccttcacatcgatgagtccgcaggacttggacggctagccaaacagaaaccaaaaaagcgccggaggcctgattcacgccagtatcagactgcaataattatagggccagatgggcaccccctaacagtgtacccttgcatgatctgtgggaagaagtttaagagccgaggctttctgaagcgccacatgaaaaatcacccagagcatcttgcaaagaagaagtaccgctgcacagattgtgattacactaccaataagaaaatttccttgcacaaccatttagaatcccataaactgaccagcaaggctgaaaaggccatcgagtgcgacgagtgtgggaaacatttctctcatgccggagcacttttcacccataagatggtgcacaaagagaaaggcgcaaataagatgcataaatgcaagttctgtgagtacgagactgcggaacaggggctgctaaataggcatctgcttgccgtccattcgaaaaatttccctcatatctgcgtagagtgcggaaaaggattcaggcatccatccgagcttaaaaaacatatgcggatacacaccggagaaaaaccctatcagtgtcagtactgcgagtatcgctctgctgattcttcaaatctcaagactcacgtgaaaaccaaacacagtaaggaaatgcctttcaagtgtgatatctgccttctgaccttttccgatacaaaggaggttcaacagcacgccctgatccatcaggaaagtaagacccatcagtgtctccactgcgaccataaatcctcgaactccagtgacctgaagcgacacatcatttctgtgcacaccaaagactatcctcataagtgcgacatgtgtgacaaaggcttccatagacccagtgagctgaaaaagcacgttgcggcccacaaagggaagaaaatgcaccagtgtaggcattgcgatttcaagatagccgacccatttgtgctgagtcgtcacatcctctctgtgcacactaaagatctgcccttccgatgcaaacggtgcagaaaggggtttcgccagcaaagcgaacttaaaaaacacatgaagacacattccgggcggaaggtgtaccaatgtgagtattgcgagtattctaccaccgatgcttccgggttcaaacgccatgtcattagtattcatactaaggactaccctcatcgatgtgaatactgcaaaaaggggttccggcggcctagcgaaaaaaaccaacacatcatgcggcaccacaaggaagtggggctgccctag

SEQ ID NO: 212461 - DNA, 2535 bp, Artificial Sequence
  Description of Artificial Sequence: Synthetic coding sequence
atggacgaggacggcctggagctgcagcaggagcccaacagcttcttcgacgccaccgacagagttagcttttgccaccctggatggagcactgtcgccccatctggctcaacagcaacaagcgcctctcaggcacaggtcatatgctcagcatctcgggtgactggcgctaccggagcggatggcactcacatggacggcgaccagatagttgtggaagtgcaggagactgtgttcgttagcgacgttgtcgatagtgatattactgtccataactttgtgccagacgaccccgactcggtagttatccaggacgttatcgaagacgtggtgattgaggacgtgcaatgtccagatatcatggaagaagctgacgtgtccgaaacggtgatcatccctgagcaggtgctggattccgatgtgactgaagaggtcagcctcgcccattgtaccgtgcccgacgatgtcctggcgagcgacatcacttcggcctccatgtcaatgcccgaacacgtacttactggcgacagcattcacgtttccgatgtaggccatgtggggcacgtcggtcacgtggaacacgtcgtgcatgactccgtggttgaggcagagattgttaccgatcctctcaccaccgacgtggtctctgaagaggtccttgtagctgactgcgctagcgaagcggtgatcgacgccaacggaatccccgtcgatcagcaagatgatgataagggtaattgcgaagactacttaatgatcagccttgacgacgctgggaagatcgagcatgatggatcatcaggtatgacgatggacactgaaagtgaaatcgatccctgtaaggtcgacggcacctgtccagaagttattaaggtgtatatcttcaaagcggatccaggtgaggatgatctcggagggaccgtcgacattgtggagtctgaacccgaaaatgaccacggggtcgagctgctagaccagaatagcagtattagagtcccccgggaaaagatggtgtatatgaccgtgaatgactcccagcctgaagatgaggatctcaatgtggcagagattgcagacgaagtctacatggaggtcatcgtaggcgaggaggacgcggccgccgcagcagcagcggctgccgtccacgagcagcagatggatgacaatgagatcaagaccttcatgcctatagcatgggcagctgcatacgggaataattctgacggcatagaaaaccgaaatggcacggcttctgcattgctgcatattgatgagtcagccggtctgggacggctcgcaaaacagaagcccaaaaaaaggcggcggcccgactctaggcagtatcaaactgcgattatcattgggccagacgggcacccactcaccgtgtacccttgtatgatctgtggtaagaagttcaaatctcggggctttcttaagcggcacatgaagaaccatccggagcacctggcgaaaaagaagtatcgctgcacagactgtgactatacaactaataaaaaaatctcactgcacaaccacttggaatctcacaaactgaccagtaaagcagaaaaagctattgaatgtgatgagtgtggaaagcacttttcacacgcaggtgccctgttcacacataagatggtacacaaggagaagggagcgaacaagatgcacaagtgcaaattttgtgaatatgaaacagccgagcaaggcctcctgaatcgacacttgctggctgtccacagtaagaactttccccatatttgtgtcgagtgtggaaagggcttcaggcacccatcggagcttaagaagcacatgcgtattcacactggcgagaagccttatcagtgtcagtactgtgaatacaggagcgcagattcatctaatctcaagacccatgtgaagactaagcattctaaggagatgcctttcaagtgcgatatttgtttgttgacattcagtgataccaaagaggtccagcagcacgccttaattcaccaagaaagtaaaacccaccagtgtcttcactgcgaccacaagagctcaaattcaagcgacctgaaaaggcacatcattagcgtgcatacaaaagattacccccataagtgtgacatgtgtgataagggatttcatcggccatctgaactaaagaagcatgtggcagcccataaaggtaagaagatgcatcagtgccgacactgcgacttcaagattgcagatccctttgtgttgagccgtcacattcttagcgtccataccaaggacctcccttttcggtgcaagcggtgccggaaagggttccggcagcaatccgaactgaaaaaacatatgaagactcactccggcagaaaggtgtatcagtgcgagtactgtgagtattctaccacggatgcctcggggtttaagaggcacgtgataagcatccataccaaggattatccgcaccgctgcgaatactgcaaaaaaggctttaggaggccatcagagaagaaccagcacattatgcgtcaccataaggaagtgggattgccctag

SEQ ID NO: 212462 - DNA, 522 bp, Artificial Sequence
  Description of Artificial Sequence: Synthetic coding sequence
ggcggctgcagccagtacctgctgctgttcgtggacgacgccggcaagatcgagcatgatggatcctcaggcatgaccatggatacggaaagcgaaatcgatccctgtaaggtggatggaacctgcccagaggtgatcaaagtgtacatctttaaagcagaccccggcgaggatgacttaggtgggacagttgatatcgtggagtccgaaccggagaacgatcacggggtcgagctgctggaccagaacagctcgataagggtccccagggaaaagatggtgtatatgacagtgaacgatagccagcccgaagacgaagatctcaacgttgctgaaatcgcagacgaagtatacatggaggtgatcgtgggggaagaagatgccgccgctgcggctgcagccgcagcagtccacgaacaacagatggatgacaatgaaatcaagacctttatgccaatcgcctgggctgcagcgtacggcaacaactctgacggcatcgagaatcgcaacggaaccgcttag

SEQ ID NO: 212463 - DNA, 2406 bp, Artificial Sequence
  Description of Artificial Sequence: Synthetic coding sequence
atggacgaggacgagttcgagctgcagccccaggagcccaacagcttcttcgacggtatcggagcagatgccactcacatggacggcgaccagatcgttgtggagattcaggaggccgtctttgtcagtaacatcgtggactcagatattaccgttcacaactttgttccagatgacccagatagtgtcgtgattcaagacgtggtggaagacgtagtaatcgaggaagacgtccaatgtagcgatattcttgaagaagctgacgtctccgaaaacgtgatcatacccgaacaagttctcgactccgatgtgactgaagaagtgagtctgccgcactgtacagtgcctgacgatgtgctcgcctcggacattacttctacgtccatgagcatgcccgagcatgtcctcacctccgaatctatgcacgtgtgcgacatcggacacgtggaacacatggtgcacgatagcgttgtggaggcggagatcataacagatccgctgaccagcgacattgtgtctgaggaagtgcttgtggctgattgcgctccagaggccgtcatcgacgcctccggaatttcagttgaccagcaggataatgacaaagcttcatgcgaggactacttaatgatttctctggacgatgctggcaaaatagaacacgatggatctacaggcgtgaccattgacgccgagtccgagatggacccctgtaaagtcgacagtacctgtcccgaagtaattaaggtgtacatatttaaagcagaccccggtgaggacgacctgggcggtactgttgacatagtggaaagtgaacctgagaacgatcacggagtggagctattggatcagaatagtagtatacgggtcccaagagagaaaatggtctacatgaccgttaacgatagccagcaggaggatgaagatctgaatgtcgcagaaattgcagacgaggtttacatggaagtaattgtcggtgaggaggatgccgccgtcgcggccgccgccgccgccgtgcacgaacagcagatagatgaagatgaaatgaaaacgttcgtaccaattgcctgggcagctgcttatggaaacaattcagatggcatagagaacagaaatgggacggcgagcgcactccttcatattgacgagtcagccggcctgggccgtcttgcaaaacaaaaacccaagaaaaaacgtcgccctgatagccgccaataccagactgccattataatcggacccgacggtcatccactcactgtatacccctgtatgatctgcggaaagaagtttaagagccgcgggttccttaagagacatatgaagaatcaccccgagcaccttgcgaaaaaaaagtatcactgtaccgactgtgactacactacaaacaagaagatctctctgcataatcaccttgaatcacacaaactgacgagtaaagctgagaaggctattgagtgtgacgaatgcgggaagcatttttctcacgccggcgccctgttcacgcataagatggttcacaaggagaaaggcgcaaacaagatgcacaagtgcaaattctgcgagtatgaaaccgctgagcagggcctgctgaatagacacctcctcgccgtccacagtaagaatttcccacatatctgtgtcgagtgtggtaaggggttcagacacccatcagagctgcgcaaacacatgcgcatccacacaggagagaagccctaccagtgtcagtattgcgaatacagaagcgccgactcaagcaacctgaagactcatattaagaccaagcactccaaggaaatgccatttaagtgtgacatatgcctgctgacattctcggacaccaaagaggtgcaacagcacactctggtccatcaagagtctaaaactcatcagtgtctgcattgtgaccacaaatcttccaattccagcgaccttaagcggcacgtgatcagtgttcatactaaggattacccgcacaaatgtgagatgtgtgagaagggattccaccggccctcagaactgaagaaacacgtggctgtacacaaggggaagaaaatgcatcaatgccggcactgcgactttaagattgcagacccattcgtactttctagacacatcctgagcgtacacactaaagatctgccatttaggtgtaaacgctgccgcaaggggttccgccagcagaacgaactgaagaaacacatgaagacacactctgggcggaaagtctatcaatgcgagtactgtgagtattccacaaccgacgcctctggatttaagaggcatgttatctctattcacactaaggactatccacacagatgtgagtactgtaaaaaagggttccgtcgtccaagtgaaaagaatcagcatatcatgaggcatcataaagaggtcgggctcccctag

SEQ ID NO: 212464 - DNA, 2406 bp, Artificial Sequence
  Description of Artificial Sequence: Synthetic coding sequence
atggacgaggacgagttcgagctgcagccccaggagcccaacagcttttttgatggtatcggcgccgacgccacccacatggacggtgaccaaatcgtggttgaaattcaggaggctgtattcgtttcgaatatcgtggactcagatattacggtgcacaactttgttcccgatgaccccgactctgtagtgatccaggacgtcgtggaggatgtggtgattgaggaagatgttcagtgtagcgacattcttgaagaggcggatgtatcagaaaatgtgatcatacctgaacaggtgctggactcagatgtgaccgaagaggtgtcgctccctcattgcacggttcccgacgacgtgctcgcaagtgatatcacgtccactagtatgtctatgccagagcatgtccttacttctgaaagcatgcatgtatgtgatatcggacatgttgagcacatggtgcacgattctgtggtggaggcagaaatcattacagacccactcacgtccgacatagtttctgaagaggttttagtcgctgactgtgcccccgaggctgtgatagacgcatctggaatttccgtagaccagcaggacaatgacaaagctagttgcgaagattacctcatgatctcactggacgatgccggcaagattgaacacgatggatctacaggtgtgacgattgatgctgaaagcgagatggacccctgtaaggtcgactctacttgccccgaggtcataaaagtatacatctttaaggctgaccccggcgaggatgacctgggcggcacggtggacatagtcgaatcagagcctgaaaacgatcacggagtggagctcctggaccaaaactcatctataagagtgccgcgcgaaaaaatggtctacatgacggtgaatgatagtcaacaggaggacgaggatctgaatgtggcggagatcgcagacgaggtgtacatggaggtcatcgtgggggaagaggacgccgcagtagccgccgctgccgccgcagtgcatgagcagcaaattgatgaggacgaaatgaaaacattcgtcccaattgcctgggctgctgcgtatggcaataattctgacggaattgagaaccgcaatggtacagctagcgccctccttcatattgacgagtccgccggcctcgggcgcttggccaagcaaaagccaaagaaaaagaggcggcccgattcaaggcagtatcaaactgccatcatcattggtccggacgggcatcctctcaccgtctacccctgcatgatctgcgggaagaaatttaaatcaaggggctttctcaaaaggcacatgaagaatcatcccgagcacctggccaagaagaagtatcactgcacagactgtgactacactacgaacaagaagatatctctgcacaaccacctcgagtcccacaagcttacgtcgaaggctgagaaggcaatagaatgtgacgaatgcggcaagcacttttctcacgcaggcgcactgttcactcataagatggttcacaaagaaaagggcgccaacaaaatgcacaaatgtaagttctgtgaatatgaaacggcagagcaagggctgctgaataggcaccttttggccgtgcactccaagaatttccctcacatatgcgtagagtgtggcaaaggttttagacatcctagcgagctgcgcaagcatatgcgcattcacaccggagaaaaaccatatcaatgccagtattgcgagtatagatcagcagactcttccaacctgaagactcacattaaaaccaagcatagtaaggagatgccattcaagtgtgacatctgcctgctgaccttttctgacaccaaagaggtccagcagcacacactggtgcatcaagagtctaagacacaccagtgcctgcattgcgatcataaaagttctaacagttcagacctcaagcgtcatgtgatctcagtgcacacaaaagattacccacacaagtgcgagatgtgcgagaagggtttccatcgcccgagcgagctgaagaagcacgtggccgtgcataagggaaaaaaaatgcaccagtgtcgacactgcgactttaaaattgcagaccccttcgtcctgtcccggcatatcctgagcgttcatacgaaagaccttccatttcggtgcaaacgctgcagaaagggattcaggcaacagaatgagctgaaaaaacacatgaagactcacagtggacggaaggtttaccagtgtgagtactgcgagtattccaccacagacgccagcggatttaagcgccatgtgatttcaatccacaccaaggactaccctcatcgctgtgaatactgtaagaaaggttttaggaggccatccgagaaaaaccagcatatcatgagacaccacaaagaggttggacttccatag

SEQ ID NO: 212465 - DNA, 1833 bp, Artificial Sequence
  Description of Artificial Sequence: Synthetic coding sequence
atggacgaggacgagttcgagctgcagccccaggagcccaacagcttttttgatggtatagtcgacgacgccggcaagattgaacacgacggatctacaggtgtcactattgacgctgagagtgaaatggacccatgcaaggtggacagtacttgcccggaagtaatcaaagtatacatcttcaaagccgaccctggcgaagatgacttagggggtacagttgacatagtcgagtcagaaccagagaatgaccacggtgttgaactcctcgatcagaacagctcgatccgggtgccccgggagaaaatggtgtacatgaccgtgaatgactcccaacaggaagatgaggacctaaatgtggcagagatcgcggatgaggtctacatggaagtgattgtcggagaagaggacgcagctgtggctgctgccgccgctgcagtgcacgagcagcagatcgacgaggatgagatgaagaccttcgttcccattgcctgggcagctgcatatggcaacaattctgacggaatcgaaaaccgcaacggtaccgcctcagcgctgctgcacatagacgagagtgccggactcgggcgcttagccaagcagaaacctaaaaaaaagaggcggcctgatagtagacagtatcagactgctattataatcggccctgacggacatcccctgacggtttatccgtgcatgatctgtggaaagaaattcaagtctagaggatttctgaagcgtcacatgaaaaatcatcctgaacaccttgctaagaagaagtaccattgtacagactgtgattacacaacaaataaaaagatctccttgcacaatcatctagagtcccacaagttgacctcaaaggccgagaaggccattgagtgtgatgagtgcggcaagcatttcagtcacgccggagcactgttcacacataaaatggtgcacaaggagaaaggagccaataagatgcataagtgtaaattctgcgagtacgaaacggccgaacagggcctcctgaatcgacacctactggccgtgcatagtaaaaactttccccatatctgtgtggaatgcgggaaaggttttcggcacccttctgagctcaggaaacacatgcgaatccacactggcgagaagccctatcagtgccagtactgtgaatatcgcagtgctgactccagcaatctgaagacccatatcaaaactaaacacagtaaagagatgcccttcaagtgcgacatttgcttgttgaccttctctgatactaaggaagtccagcagcacacactggtacaccaggaatccaagacccatcaatgtctccactgcgatcataagtcttcaaattcctctgatttgaagaggcacgtcatttcagtgcatactaaggactacccgcacaagtgtgaaatgtgcgaaaagggttttcacaggccttctgaattgaaaaagcatgtcgcagtgcataaggggaaaaaaatgcaccaatgcaggcattgtgacttcaagatcgccgaccctttcgtcttaagccgacacatcttgagcgtgcacacaaaggacctgccattcaggtgtaagcggtgtaggaagggctttcgacagcagaacgaactgaagaaacacatgaagacacactcagggcggaaggtttaccagtgtgaatattgcgaatattcaactaccgacgcttcgggtttcaaaagacacgtcatttccatccataccaaggactaccctcatagatgtgaatattgtaaaaaaggctttcggcggcccagcgaaaaaaaccaacacattatgagacaccacaaggaagttgggttgccatag

SEQ ID NO: 212466 - DNA, 276 bp, Artificial Sequence
  Description of Artificial Sequence: Synthetic coding sequence
atggacgaggacgagttcgagctgcagccccaggagcccaacagcttcttcgatggaattggcgccgatgccacccatatggacggggaccagattgtagtggagatccaggaggcagttttcgtttccaacatagtggattccgacatcacagttcacaacttcgtaccagacgatccagattcagtagtgatccaggacgttgtggaggatgttgtgatcgaggaagatgttcaatgtagcgacattctggaggaagcggatgtatcagaatag

SEQ ID NO: 212467 - DNA, 2175 bp, Artificial Sequence
  Description of Artificial Sequence: Synthetic coding sequence
atggacggcgaccagatcgtggtggagatccaggaggccgtgttcgtatctaatatcgtggattcagatatcacagtgcataactttgtgcctgatgatcctgatagtgtcgtgattcaggacgtcgtcgaggacgtagtgattgaggaggacgttcagtgttcagatattttggaagaggctgatgtatccgaaaacgtcataatcccagagcaggtgctggactctgatgtgacggaagaggtcagtttacctcactgcaccgtacctgatgacgtgttggctagtgacatcaccagtacttctatgagtatgccagaacatgtactgacctccgagagcatgcacgtgtgcgacataggtcacgttgagcatatggtacacgatagtgtcgtcgaggccgaaattattactgaccctctgacgtcggatattgtctccgaggaagtgttggtcgcagattgcgccccggaagccgtcatagacgcttccgggatttctgtcgaccaacaggataatgacaaggcctcctgtgaggattaccttatgatcagcctcgatgacgctgggaaaatcgaacacgacgggtccaccggcgtcacaattgatgcggaaagcgaaatggacccttgcaaggtggactctacctgtccagaggttattaaggtgtatattttcaaggcagatccaggagaagatgacctcggtggaactgtggacattgttgaatccgaacccgagaatgatcatggagtggaactgctcgaccagaatagcagtataagggtgccacgcgaaaaaatggtctacatgaccgtgaacgattctcagcaggaggacgaagatttaagcaataattcggacggaattgaaaatcgcaatgggacagcttccgccctcctgcacatagacgaaagcgcaggtctaggaagactggccaaacagaaacctaaaaagaaacgtcgaccggacagtcgccagtaccagacagctataatcatcgggccagacggacatcccctgactgtttatccttgcatgatatgtggaaaaaagtttaaaagcaggggctttctgaagcgacatatgaaaaatcaccccgaacaccttgccaaaaagaagtaccactgtacagactgcgactatacaaccaacaagaagatctctctccacaatcatctcgagagtcacaagttaacaagcaaagctgaaaaagccatcgagtgcgatgagtgcggcaagcacttttctcacgccggagccttatttacacataagatggtacacaaagagaagggtgctaacaagatgcataagtgcaaattctgtgagtacgagacagcagagcaaggtcttctgaatagacaccttctggccgtgcacagcaaaaacttcccacacatctgtgtagaatgcgggaaaggatttcgtcaccctagcgagttgcggaaacatatgcggattcatactggggagaagccctaccaatgtcaatactgcgagtaccggagtgctgacagctcaaacttaaaaacccacattaaaacaaaacactctaaggaaatgccttttaagtgcgatatctgcctgttgacctttagcgacacaaaggaggtccagcagcacacactggtgcatcaggaaagcaagacccaccagtgtcttcactgcgatcacaagagtagcaatagcagtgacctgaagcgccacgtcatttctgtgcacactaaggactatccgcataagtgcgagatgtgcgaaaaaggttttcaccggccttctgagctgaaaaagcatgtggctgtgcacaaaggcaaaaagatgcaccaatgtcgacactgcgactttaaaatcgccgatccatttgtgttaagcaggcacatactgtctgtccacactaaggacctaccctttaggtgcaagcgctgtagaaagggcttccggcaacagaacgaactgaagaaacatatgaagactcattcaggccggaaagtttatcagtgtgagtactgcgagtactctacgactgatgcatcaggttttaagaggcatgtgatcagtattcacaccaaagattatccgcataggtgcgagtactgcaagaaaggctttaggaggccttctgaaaagaaccagcacatcatgcgacatcacaaggaagtcggactgccatag

SEQ ID NO: 212468 - DNA, 1617 bp, Artificial Sequence
  Description of Artificial Sequence: Synthetic coding sequence
atggcccgggagctgagcgagagcaccgccctggacgcccagagcacagaagaccagatggagctgctggtcataaaggtcgaggaagaggaagctggcttcccgagcagccctgacctgggaagcgagggaagtagagagaggtttcggggtttcagataccccgaggccgccggcccccgggaggccctctcaagattgcgagaactgtgtcgacagtggctccaacccgaaatgcactccaaagaacaaatcttggagctgttggtccttgagcagtttctcaccatcttacctggaaaccttcaaagttgggtcagagagcaacatccagagagcggcgaggaagtcgtcgtgctgttagaataccttgagcgccagcttgatgagcctgcccctcaagtatccggcgtggaccaggggcaggaactcttgtgttgtaagatggctctcctgactccagccccaggttcccagtcctcccaatttcagctaatgaaagctctgttgaaacacgagtcggttggaagccagcctctgcaggaccgggtgctgcaggtgccagtgttagcacacggtggatgttgtcgggaggacaaggtcgtggcgagccggctaactccagagagccagggtcttctgaaagtggaggatgtggccctgactcttacccctgaatggacccagcaggatagttcccagggcaacctctgtagagacgaaaagcaggaaaatcacggtagtttggtgtccttgggggatgagaagcagactaaaagtcgcgatctgcccccggctgaagagctgcccgagaaagagcacggaaaaatttcctgccatctgagggaagacattgcacaaatccccacatgtgccgaggcaggggagcaggagggaaggcttcagaggaagcagaaaaatgccaccggagggcgtcgccacatatgtcatgagtgtggtaagtccttcgcacaatcttccggattgagcaaacatcgacgaatacataccggtgagaaaccctatgagtgcgaggaatgcggcaaggcgttcattggaagttcagcactcgtgatccaccagcgcgtgcacacgggggaaaaaccttatgaatgcgaagaatgtggcaaagctttttctcactctagtgatctgatcaagcaccagagaacccacaccggggagaagccctatgagtgtgacgattgtgggaaaacattctctcagagttgcagtttgctggagcaccatcggatccacaccggtgaaaagccctatcagtgctccatgtgtggaaaagcctttcggagatcttcccatctcctgagacatcagagaatccacactggagacaaaaatgttcaggagccggagcagggggaagcctggaagtcaagaatggagtcacagctggagaacgtggagacaccgatgtcctacaaatgcaacgaatgcgagcgatcctttacccagaacactggcctaatcgagcatcagaaaattcataccggcgagaaaccttaccagtgcaacgcctgtgggaagggcttcactcggatttcctatttggtacaacaccagcggtcccatgtcgggaagaatatcctgagtcaatag

SEQ ID NO: 212469 - DNA, 1173 bp, Artificial Sequence
  Description of Artificial Sequence: Synthetic coding sequence
atggccctgctgacccccgcccccggcagccagagcagccagttccagctcatgaaggccctgttgaagcacgagtctgttgggtctcagcctcttcaagatcgtgtgctgcaggtgcctgtcctcgcccacggggggtgctgccgcgaggataaagtagtggcatcacgcctcactccagagagccaggggctgctcaaggtggaggatgtggcacttacattgacccctgagtggactcagcaggatagttcccagggcaacctatgccgggacgagaaacaggaaaaccacgggtcactggtgagcctgggcgatgaaaaacagacaaaatcgcgggaccttccacctgccgaggaactcccagaaaaggagcatggcaagattagctgtcatctccgagaagatatcgctcagatacctacttgtgcagaggcaggagaacaggaaggccggctgcaaaggaaacaaaagaatgccacaggaggccggagacacatttgccatgagtgcggaaagagcttcgcgcagtcttccggtttgagtaaacacagaagaatacatacaggggagaaaccctatgagtgcgaagagtgtgggaaagcatttatcggctctagtgcactggtgattcaccagcgcgtgcataccggggagaagccatatgagtgtgaggaatgcggcaaggcctttagccactccagcgacctgatcaagcatcagcggactcacacgggggagaagccctacgaatgtgacgattgtgggaagaccttcagtcagtcttgctcgctccttgagcatcacagaattcataccggtgaaaagccctaccaatgtagtatgtgcggcaaagcttttcgtcggagcagccacttgctgaggcatcagcgaatccataccggggataagaatgtgcaagagccagaacagggtgaggcgtggaagtcgcgtatggagagtcagttagaaaatgtggagaccccaatgtcatacaaatgtaatgagtgtgagcgaagcttcacacagaacaccggccttattgagcaccagaagatccacactggcgaaaaaccctaccagtgtaacgcctgcgggaaaggcttcacacgtatcagttacctagtccagcaccaaagatcacatgtaggaaagaacatcctttcacagtag

SEQ ID NO: 212470 - DNA, 1617 bp, Artificial Sequence
  Description of Artificial Sequence: Synthetic coding sequence
atggcccgggagctgagcgagagcaccgccctggacgcccagagcacagaagaccagatggaattgcttgtcatcaaggtggaagaggaagaagctgggttcccttcttctccagacctcgggagcgagggatcgcgcgaaaggtttcggggcttcaggtaccccgaagcagccggcccacgggaggcgttgagtagactacgggagctttgtcgccaatggttgcagcccgaaatgcactcgaaggagcagattctcgagcttcttgttctggaacagttcttgaccatcctccccggtaacttgcagtcctgggtcagagagcagcatccggagtctggtgaagaggtggtggtgctcttagaatacctcgaacggcaactcgacgagccagctccgcaggtctctggcgtcgatcagggacaggaactgttgtgttgcaaaatggcattgcttactccagcacccgggtcccagtcgtcacaattccagctgatgaaagccctgcttaagcacgagtcggtgggttcccagcctctgcaagatagagtgctgcaagttccagtcttagcacacggaggatgctgtcgggaagataaagtcgtggcctccagacttacgcccgaaagccaggggttgctgaaggtcgaggatgtcgcactcactctcacgcctgagtggacacagcaggactcaagtcagggaaacttatgcagggatgaaaagcaagaaaatcacggctcactggtgagcttgggcgatgagaaacaaacaaagagtagagacctacccccagccgaagagctgcctgaaaaggaacatggcaaaatttcctgccaccttagagaggacatcgcgcagatcccgacatgtgccgaggccggcgaacaggaaggcagactacagcgaaaacagaaaaacgccactggcggaaggcgacacatttgccacgagtgcggtaagagcttcgctcagtcttccggcctctcaaagcacagacggatccacaccggggagaagccttatgagtgcgaagagtgtgggaaggcatttatagggagttccgctttagttattcatcagcgtgtccatacaggcgagaaaccatatgaatgcgaagagtgtgggaaagccttttcccacagttccgacctgattaagcaccagcgtacacataccggcgagaagccatacgaatgcgacgattgtggcaagacattctctcagtcatgttcccttctagagcaccatcggatacatacgggcgagaagccatatcagtgtagcatgtgtgggaaggcctttcggagatcatcacacttgctgcggcatcagcggattcacaccggtgacaaaaatgtccaggagcctgagcagggcgaggcttggaaaagcagaatggaaagccagctcgaaaacgtggaaaccccaatgtcatataagtgtaatgagtgcgaaaggtctttcactcagaatacaggcttgattgaacaccagaagattcatactggagaaaagccctatcagtgcaacgcatgcggcaaaggattcacacggatttcgtatctcgtgcagcatcagcggtcgcatgtgggcaagaatatactatcacagtag

SEQ ID NO: 212471 - DNA, 537 bp, Artificial Sequence
  Description of Artificial Sequence: Synthetic coding sequence
atggcccgggagctgagcgagagcaccgccctggacgcccagagcactgaggaccagatggagctgctggtgatcaaggtcgaggaggaagaagctggttttccaagttccccagatctcggaagcgaagggtctagagagcgcttccgagggttccgctatcccgaagccgctggaccaagggaagccctgtcacgcctccgagagctctgccgccagtggctccagccagagatgcacagcaaggagcagattctggaattgctggttttagaacagtttctaacaatccttcccggtaatctgcagtcctgggttcgcgagcagcaccctgagtccggggaagaggtcgtggtgctgctcgaatatttggagcgccaactcgacgaacctgcccctcaagtggagcgtacaggtttagttagtgagcggtgcgggttattcccgcctgagattcccgaccagagtgaggggcatagctttaatatccaagagttctttatctcatttttgtaccgagagccgccttggcagtag

SEQ ID NO: 212472 - DNA, 993 bp, Artificial Sequence
  Description of Artificial Sequence: Synthetic coding sequence
cggcagcggttccggggcttccggtaccccgaggccgccggccccagggaagccctgtcccgactgcgggaactctgtggacaatggctgcagcccgagatgcactccaaggagcagatattggagttattagttcttgagcaatttcttaccattctccccggcaacctgcaatcatgggttcgcgaacagcatccggagtcaggggaagaagtggtagtgctgctggaatatctcgagcgccagctggacgaacccgcgcctcaggtagagcgtactggactggtcagtgaacggtgcgcccggggaatcccattgagaagcagatcatcctcaagcttgtttgtattggcctttctgccctggcagggaatcactcacagttgcaggccatttgtggtctccggcggagaaatccagacaaagagcagggacctacctccagttaagaagttacccgagaaggaacacggaaaaatatgtcatctgagggaggatattgctcaaatccccactcatgcagaagccggcgagcaggagggtagattacagcggaaacaaaagaacgctatcggttcgcgacggcattattgtcacgagtgcggaaagtcttttgcccagagcagcggtctgacgaagcacaggcgcattcacaccggcgaaaagccctacgaatgcgaggattgtgggaagacctttattggatccagcgctcttgtaatccaccaacgcgttcatactggcgagaagccctatgagtgcgaggagtgtggcaaggtattttctcattctagtaacctcattaagcatcaacggacacacaccggagagaagccgtatgagtgtgacgactgcgggaaaacttttagccagtcctgtagcctgcttgagcaccataagatacacaccggggagaagccctaccagtgcaacatgtgtgggaaggcgttccgccgcaactctcatctgcttcgccatcagaggattcactag

SEQ ID NO: 212473 - DNA, 1638 bp, Artificial Sequence
  Description of Artificial Sequence: Synthetic coding sequence
atggcccgggagccccggaagaacgccgccctggacgcccagagcgcagaggaccaaacggggctactgacggtaaaggtggagaaagaggaggcgagcgcccttaccgcggaggtccgggcaccctgctctcccgctagaggtcctgaacggtcacgccagagattccgaggcttccgatacccagaagcagccggtcccagagaggccctgagtaggctacgggagctgtgtgggcagtggctgcagccagagatgcattctaaagagcagatcctggagctcctggtcctcgagcaatttctgactatcctaccagggaatttacagtcctgggtgagggaacagcatcctgagagcggagaagaagtggtggttctgctggagtacctcgaaagacaattggatgaacccgctcctcaagtcccagtgggggaccaaggtcaggagttactctgttgcaaaatggccctattaacgcagacgcaggggtcacagagtagccagtgtcagcctatgaaggctctctttaaacacgagagcctgggttcgcaaccattacacgaccgggtactgcaggtgcctggcttagctcagggcgggtgttgtcgagaggatgctatggtagcatcccggctgacccccggttcccagggattattgaaaatggaggatgtggctctcactctgactcccggctggactcaactggacagctctcaggttaacctgtatagagatgagaagcaggaaaaccatagcagtcttgtctccctgggcggtgaaattcagaccaaaagccgtgacctccctcctgtgaagaagctgcccgagaaggagcatgggaaaatctgtcatctgcgggaagatatagctcaaatacctacccacgccgaggccggcgagcaagaaggcaggcttcaacgtaagcaaaaaaacgccatcggcagccgacgccactactgtcatgagtgcggtaagagctttgcccagtcttcaggattgaccaagcataggcggattcataccggagaaaagccttatgagtgtgaggactgcggcaagactttcattggatccagcgctctggtcatccaccagcgggtacacactggtgagaagccctacgagtgcgaggaatgcggcaaggttttttcacacagctcaaatttgatcaaacaccaaagaacccacacaggagagaaaccctatgaatgtgatgattgcggtaaaaccttcagccagtcctgttcgctgctggaacatcataagatccacaccggagagaaaccttaccaatgcaacatgtgtggaaaagccttccggagaaactctcatctattgcgccaccagaggattcatggagataaaaacgttcagaatcccgaacatggcgagtcatgggaatctcagggtcgcactgagtcacagtgggaaaacaccgaggctccggtcagttacaaatgcaacgagtgtgaacggagcttcactcgtaatcggtccctaattgaacaccagaagatccacaccggggagaaaccctatcagtgcgatacatgcgggaagggcttcacgagaacttcctaccttgtgcagcaccagcgaagtcatgtgggcaaaaagaccctctcacagtag

SEQ ID NO: 212474 - DNA, 1173 bp, Artificial Sequence
  Description of Artificial Sequence: Synthetic coding sequence
atggccctgctgacccagacccagggcagccagagcagccagtgccagccgatgaaggccttgtttaagcatgaaagcctggggtctcagccattacatgaccgcgtgttacaggtgccgggcttagctcaggggggctgctgcagggaagacgctatggtcgcatctcgccttacccctggctctcaaggccttttgaagatggaagacgtggctctgaccctgacgcctggctggactcagcttgacagctcacaagtcaatttgtaccgcgacgagaagcaggagaaccactcttcgctcgttagtcttgggggggaaatccagactaagagtcgggacttgccacccgtcaaaaaacttccggaaaaggaacatggcaaaatttgccatttgagggaggatatcgctcagatcccaacacatgctgaggccggggagcaagagggccgtctgcaaaggaagcaaaagaacgcgatcggttcccgtcggcactattgccatgaatgcggaaagtccttcgcacaatcctcaggactgactaagcatcgacgaatacatactggggaaaagccctatgaatgtgaggattgtggcaagacatttatagggtcaagcgccctggtcattcaccagcgggtccacaccggcgagaaaccatatgagtgcgaagagtgtggcaaagtgttcagtcactcctctaacctaatcaaacaccagaggacgcacaccggtgagaagccttacgaatgtgacgactgtggaaaaacatttagccaaagctgtagccttctggagcatcacaaaatccatacaggtgagaagccataccagtgtaatatgtgcggcaaagcattccggaggaacagtcatttacttcgtcatcaaagaatccacggggataagaacgtgcaaaaccccgaacatggcgaatcctgggaatctcagggcaggaccgaaagccaatgggaaaacaccgaagcaccagtctcctacaaatgcaatgaatgcgagcggagttttactcgaaaccgctcactgatcgagcaccagaaaatccatacaggagagaagccttaccagtgtgacacgtgtgggaagggattcacccggacaagctacctagtgcaacatcagcgtagccacgtgggtaaaaagactttatctcagtag

SEQ ID NO: 212475 - DNA, 501 bp, Artificial Sequence
  Description of Artificial Sequence: Synthetic coding sequence
cccacccacgccgaggccggcgagcaggagggccggctgcagcggaaacagaagaacgcgattggatcccggcgacactattgtcacgaatgcgggaaatcttttgcccagtctagcgggctaactaagcataggcggattcacacgggggagaaaccctatgagtgtgaggattgcgggaagacattcatcggctcttccgcccttgtgatacaccagcgagtgcacaccggtgagaagccatatgaatgtgaagaatgtgggaaggtcttttcccacagcagtaacctcatcaagcatcaaagaacccatactggggaaaaaccttatgaatgtgatgattgcgggaagaccttctcccaatcctgttcactgcttgaacaccacaagatccatactggcgagaagccgtatcagtgcaacatgtgtggaaaggcctttcgaagaaattctcatctcctccggcaccaacgcatccacgtcgtgaccgagatagtatag

SEQ ID NO: 212476 - DNA, 438 bp, Artificial Sequence
  Description of Artificial Sequence: Synthetic coding sequence
atggagttccccgacctgggcaagcactgcagcgagaagacctgcaagcagttagactttcttcccgtgaaatgtgacgcctgcaagcaggatttctgcaaggaccactttccttacgcagcccacaagtgcccatttgctttccaaaaagatgtgcatgtgccagtgtgcccgctttgtaacactcccatccccgttaaaaagggacagattcccgatgtggtggtcggcgatcatattgatagagattgcgattcccatcccggcaaaaaaaaggaaaagattttcacataccgatgctccaaggagggctgcaagaaaaaagaaatgcttcaaatggtatgtgcacagtgtcatggtaacttttgtattcaacataggcaccctctggaccactcctgccgccacgggagtcggccaaccattaaggccggttag

SEQ ID NO: 212477 - DNA, 543 bp, Artificial Sequence
  Description of Artificial Sequence: Synthetic coding sequence
atggagttccccgacctgggcaagcactgcagcgagaagacctgcaaacagctagattttctgcctgtgaagtgcgatgcatgcaagcaggacttttgcaaggatcactttccttatgcggctcataaatgcccttttgcattccagaaggatgtccatgtcccggtgtgtcctctctgcaatactcccattccagtgaaaaaaggacagattcccgatgtggtcgtcggcgaccacatcgatagagactgcgactcacaccccgggaaaaaaaaggaaaagatattcacctaccgatgttccaaagagggctgtaagaagaaggagatgctacagatggtatgtgcccaatgtcacggaaatttttgcatccagcaccgacacccgctggaccactcttgtcggcacggtagtcggcctaccattaaggcaggatgtagcccgatgacagtctcggaatctaggcctctgggcgatttcctgacccttgctcctggcggcctggcacagaggttggggtactggttcacacgcttgatgtag

SEQ ID NO: 212478 - DNA, 774 bp, Artificial Sequence
  Description of Artificial Sequence: Synthetic coding sequence
atggagttccccgacctgggcgcccactgcagcgagcccagctgccagcgccttgactttctgcctctcaagtgcgatgcatgtagcggtatcttctgcgctgaccatgtcgcctatgctcagcaccactgcggctccgcttatcagaaggatatccaggtccccgtgtgtccactctgtaatgtgccagtaccagtggcgagaggcgagccccccgacagagctgtcggcgagcatatcgaccgcgactgtagatccgaccccgctcagcagaaacgcaagattttcaccaacaaatgtgaaagagcaggatgtcgccagcgggaaatgatgaaactgacctgcgagcgttgctcaaggaacttttgcattaagcaccgtcatccattggatcacgactgctccggcgaaggccacccgacaagtcgggcaggcttagcagccatctctcgcgcccaggccgtagctagcacaagtacagtaccctccccgtcccagacgatgccgtcatgcaccagcccctctcgggccaccacccgaagtccttcctggaccgccccgccggtcatcgcattgcagaacggactgagcgaggatgaggcgctgcagagagcgctggagatgagtctcgccgaaacaaagcctcaagttccttcctgtcaggaggaagaagacctggcactagcacaagccctgtctgcctccgaagccgaatatcaacgtcagcaggcgcagagccgctctagcaagccaagcaactgttctctgtgctag

SEQ ID NO: 212479 - DNA, 531 bp, Artificial Sequence
  Description of Artificial Sequence: Synthetic coding sequence
atggagttccccgacctgggcgcccactgcagcgagcccagctgccagagactcgacttcctgcccctgaagtgcgatgcatgtagcggcattttttgcgcagaccatgttgcttatgcacagcatcattgcggctcagcctatcagaaggatatccaggtaccagtgtgtccactgtgcaatgtcccagtccctgtcgccaggggagagccccctgatagagctgtaggtgaacacatcgatcgcgactgccgatccgatcctgcccaacaaaaaaggaaaatcttcacgaataagtgtgaacgggctggctgccgacagcgcgaaatgatgaagcttacatgcgagcggtgtagtagaaacttctgcattaagcacagacaccctctggaccatgattgctccggcgagggtcaccctaccagccgtgccgggctggccgccatctcacgggcccaggccgtcgctagcaccagcaccgtcccttccccctcacagacgatgccttcttgcacaagcccctctcgctag

SEQ ID NO: 212480 - DNA, 774 bp, Artificial Sequence
  Description of Artificial Sequence: Synthetic coding sequence
atggagttccccgacctgggcgcccactgcagcgagcccagctgccaaagacttgatttcttgcctttaaaatgcgatgcgtgctctggcatcttttgtgccgatcacgtagcttatgctcaacaccactgtgggagtgcatatcagaaagatatacaggttcctgtgtgtcctctgtgcaatgtgcccgtcccagtggcaagaggtgaaccccccgatcgcgctgtgggggaacacattgaccgtgattgccgttcagatcctgcccaacagaagcgtaaaatcttcactaataagtgcgagcgcgccggctgtagacagcgcgaaatgatgaagctgacatgcgaacgttgttcgcgaaacttttgcattaagcacagacatccactggatcatgattgctcgggagaagggcacccaacaagcagggccggcctagccgcaataagcagagcccaggctgtggcatcgacatccacagtcccatcaccctctcaaaccatgcccagttgtaccagccccagcagggcaaccactcggagcccaagctggacagctcctccagtgatagctctgcaaaacgggctgagcgaagatgaagcacttcagcgcgccctggagatgtctctcgctgagaccaagccacaagttccctcttgtcaggaggaggaggaccttgccctggctcaggccttgtctgcctcagaggccgagtaccagcgtcagcaggcacagtcccggagcagcaaaccttcaaattgcagtctttgctag

SEQ ID NO: 212481 - DNA, 531 bp, Artificial Sequence
  Description of Artificial Sequence: Synthetic coding sequence
atggagttccccgacctgggcgcccactgcagcgagcccagctgccaaaggctggattttctgcccttaaagtgcgacgcctgctctggcatattttgcgctgatcacgtggcatatgctcagcaccattgcggaagcgcctaccaaaaggacatccaggtgccggtttgtcctctctgcaatgtgcctgtaccagtggcacgcggggagccgcccgatagggcagttggagaacacatcgatcgagattgccgaagcgaccctgcccagcagaaaagaaaaatctttacaaacaaatgtgagagagcaggctgccgccaacgcgagatgatgaaacttacttgtgagagatgctccagaaatttctgcataaagcaccgtcaccccctggatcatgattgtagcggcgaggggcacccgacttctcgggccggacttgcagccatctcgagggctcaggccgtggccagtactagcacagtgccctccccttctcagacgatgccatcatgcaccagccctagtagatag

SEQ ID NO: 212482 - DNA, 153 bp, Artificial Sequence
  Description of Artificial Sequence: Synthetic coding sequence
atggagttccccgacctgggcgcccactgcagcgagcccagctgccaacggcttgatttccttcctctcaagtgtgacgcgtgcagtggaattttctgcgccgaccatgtggcttatgcacaacatcactgcggtagtgcctaccagaagtag

SEQ ID NO: 212483 - DNA, 678 bp, Artificial Sequence
  Description of Artificial Sequence: Synthetic coding sequence
atggagttccccgacctgggcgcccactgcagcgagcccagctgccagcgccttgatttcctgcccctcaagtgcgacgcctgttcaggaatcttctgtgccgaccatgtggcttatgctcagcatcattgcggttccgcctaccagaaggacattcaggtgcctgtgtgcccgctatgtaacgtccccgtgcctgttgcgaggggagaacctccggatcgagccgttggtgagcatattgatcgcgactgtcgaagcgatcctgcacagcagaaaaggaaaatctttacaaataagtgtgaaagagctggctgtaggcagcgcgagatgatgaagcttacttgcgagaggtgttctagaaacttttgtattaaacaccgccatcctctggaccacgattgttccggtgagggacaccccacttctagagccggactggcagcaatctccagggcacaggcagtggcgagtacgagcaccgtcccgtctccgtcacaaacaatgccgtcctgcacatcccccagtagggcaaccacaaggtctcctagttggaccgcacctccggtgattgcactccaaaacggtttagttagctgggccgaggtgggctggacagagaccaacacccagagagtgaagagcaaggacgccgggctgctaagccccttcgtcgagtag

SEQ ID NO: 212484 - DNA, 684 bp, Artificial Sequence
  Description of Artificial Sequence: Synthetic coding sequence
atgggcgacgccggcagcgagcggagcaaggcccccagcctgccccccaggtgcccctgtggcttttggggatcttccaaaactatgaatctttgctcaaaatgttttgccgatttccaaaaaaagcaaccagatgacgacagcgcccctagcacgagtaatagtcagtcggacctgttctctgaagagaccaccagcgataataacaacacgtccatcaccaccccaactctgtccccttctcagcagccgctacctacagagcttaacgtgacaagccccagtaaagaggaatgtgggccgtgcactgacaccgcccacgtttcgctcatcactcccactaaaaggtcctgcgggaccgactcccagtcagaaaatgaagcctcccctgttaagcgccctcgactgctggagaacacagagaggagtgaggaaacatctcgctccaagcagaagagcaggcgccggtgtttccagtgccagaccaaactggagctggtgcagcaagagcttggatcatgtcgctgtgggtacgttttttgcatgctccataggcttccagagcagcacgattgcacttttgatcacatggggagaggccgagaggaggcaatcatgaagatggtaaaactcgatagaaaggtgggacgatcatgtcaaagaatcggggaagggtgcagctag

SEQ ID NO: 212485 - DNA, 642 bp, Artificial Sequence
  Description of Artificial Sequence: Synthetic coding sequence
atggcccaggagaccaaccagacccccggccccatgctgtgcagcaccggctgcggattttacgggaatccgcgcacaaacggaatgtgctccgtgtgctataaggagcatctgcagcgccaacagaactccggccggatgagccctatgggcaccgctagcggaagcaattcccccacttctgattccgcctccgtgcagcgagcagataccagtctgaacaactgcgagggggctgcgggcagcacaagcgagaagtccagaaatgtccccgtggccgccctgccggtgacccagcagatgacggagatgagcataagtagggaagataaaataactactccgaagactgaggtgtccgaacctgtcgtcactcagcctagtcctagcgtttctcagccctccacgagtcagagtgaggagaaagcaccagagttgccaaagcctaaaaagaaccggtgttttatgtgtcggaaaaaagtaggtctaactggcttcgactgtaggtgcggcaacctgttctgcggactgcaccggtacagcgataaacacaattgcccatacgactataaagcagaagccgctgccaaaataaggaaagagaaccctgtcgtggtcgctgaaaaaatacagcgaatctag

SEQ ID NO: 212486 - DNA, 642 bp, Artificial Sequence
  Description of Artificial Sequence: Synthetic coding sequence
atggcccaggagaccaaccagacccccggccccatgctgtgcagcacggggtgcggcttctatggcaacccccgaaccaatggcatgtgctccgtctgctacaaagaacatctgcagcgccagcagaactctggaagaatgagccctatgggcacggcttccggtagtaattctcccaccagcgattccgctagcgtacagcgggctgatacaagcctgaataactgtgagggagctgcgggttccacatccgagaaaagcaggaatgtccccgtggccgccctgccggtgactcagcaaatgaccgagatgagcatctcccgcgaagataagatcaccactccaaagaccgaagtgtctgaaccagtggttactcaaccctcgcctagcgtgtcacagccaagtacttcacagtctgaagaaaaagcccctgagctgcctaaacctaagaagaaccgctgctttatgtgccgaaaaaaggtgggactcacgggattcgactgtcgctgcgggaaccttttttgcggactacacagatactcggataaacacaattgcccttacgactataaggcagaagctgccgcgaagattcgcaaagagaaccctgtcgtggtcgccgaaaagattcagagaatctag

SEQ ID NO: 212487 - DNA, 636 bp, Artificial Sequence
  Description of Artificial Sequence: Synthetic coding sequence
atggccaagcccgagcaggccgccgacggcggcgtgcggggccggggtgcgaggccccccgcacaagaggctcaacgaagacgaaggcaccccgtggtcgtggcacgagatctggcacccggcgttccaggcagcttgcactccacacaaaagaatatggctcaagaaacgaaccagacacctggtcctatgctctgttccaccggttgtgggttttacggcaaccccaggacaaacggaatgtgctccgtgtgctataaagaacacctgcagagacagcagaactcaggacgcatgtcacctatgggaactgcaagcggaagcaacagccctacaagcgactcggccagcgttcagcgagctgacactagcctgaataattgcgagggagcagcggggagtacttcagaaaaatcaaggaatgtcccggtggctgcgctgccagttacccaacagatgactgagatgagcatcagtagggaggacaagatcactactcctaaaactgaggtgagtgagcccgtggtgacccagccaagcccaagtgtatctcagccaagtacttcgcagagcgaggagaaagctcctgaattaccaaagcccaagaagaaccggtgttttatgtgtaggaaatag

SEQ ID NO: 212488 - DNA, 642 bp, Artificial Sequence
  Description of Artificial Sequence: Synthetic coding sequence
atggcccaggagaccaaccagacccccggccccatgctgtgcagcacaggttgtgggttttatggaaatcctcgaactaatgggatgtgctcagtgtgttataaagaacacctccaacggcaacagaactctggtcgcatgtcacccatggggacagcaagcggctccaactctccaacatccgacagcgcgagtgtccagagagccgataccagcttgaacaattgcgagggtgcggccggtagcacttcggagaaatccaggaatgtgcccgttgctgctctccccgtgactcaacagatgaccgaaatgtctatctcccgggaagataaaatcaccactccgaaaaccgaagtgagcgaacccgtcgtgactcaacccagtccttctgtgtcccagccttccaccagtcaaagcgaagagaaagctccagagctacccaaaccgaagaaaaaccgctgcttcatgtgcagaaagaaggtggggctgactggctttgactgcagatgtggaaacctcttctgcggtctgcaccggtacagtgacaagcacaattgtccatacgattacaaggctgaggccgcagctaagattcgcaaagagaatcctgtcgttgtggccgaaaaaattcaacgcatctag

SEQ ID NO: 212489 - DNA, 642 bp, Artificial Sequence
  Description of Artificial Sequence: Synthetic coding sequence
atggcccaggagaccaaccagacccccggccccatgctgtgcagcacagggtgcggtttttatggtaaccctaggacgaacggaatgtgctctgtttgctataaggagcatctccagcgccagcaaaatagcggccggatgtcccccatggggacagcctctgggagcaattcccccactagtgattcagcatctgtgcagcgggccgataccagtctgaataactgtgaaggcgctgctggaagtacgagtgagaagagtaggaatgttccggttgcagctttgccggtgactcagcagatgacagagatgtcaatttcacgggaggacaaaataacgactcctaagacggaagtctctgagcccgtcgttacacagccatccccttccgtgtctcagcctagcacatctcagagcgaggagaaggcacccgagcttcccaagccgaagaagaatcggtgcttcatgtgccgaaagaaggtgggtctgacaggctttgattgccggtgtggaaatcttttctgtggcttacacagatacagcgacaaacacaattgcccatatgactacaaggccgaggcagctgcaaaaatcaggaaggagaaccctgtggtggtggctgagaagattcagagaatctag

SEQ ID NO: 212490 - DNA, 627 bp, Artificial Sequence
  Description of Artificial Sequence: Synthetic coding sequence
atggcccaggagaccaaccacagccaggtgcccatgctgtgcagcactgggtgcgggttctatggaaatcctcgtactaacggaatgtgctccgtttgctacaaggagcatctgcagcgccaaaacagcagtaatggccggataagtccacccgccacctccgtcagcagtctgtcggagagtttgcccgtgcaatgtacagatgggtctgtccctgaggctcagtcggctctggacagtacttcttcatcaatgcaacctagccctgtcagcaaccagagtctcttgtccgagagtgtagccagttcccagctcgactcaacctcagtggacaaagccgtgccagaaacggaggatgtgcaggccagtgtgagcgatacagcacagcaaccttctgaagagcagagcaaaagtttggagaaacccaagcagaaaaagaatagatgcttcatgtgtagaaagaaagtgggactcactggctttgagtgtcgatgcggaaatgtgtactgcggcgttcaccggtattctgacgttcacaattgctcatacaactacaaggccgacgcagccgagaagataagaaaagagaaccctgttgtggtgggcgagaagattcagaagatctag

SEQ ID NO: 212491 - DNA, 627 bp, Artificial Sequence
  Description of Artificial Sequence: Synthetic coding sequence
atggcccaggagaccaaccacagccaggtgcccatgctgtgcagcaccgggtgcggattctatggaaatcctcgaaccaacggtatgtgctctgtgtgctacaaggaacatttacaacggcagaactcctcaaatggtcggatttcccccccagctaccagcgtgtcatccctctcagagtccttacccgtgcaatgcaccgacggcagtgtgccagaagcccagtccgctcttgactctacctcaagctccatgcagccctctcccgtgtccaatcagtctctgctgagcgaatccgtggcaagctcccaactggattcaacatcagtcgataaagccgtgcctgaaacggaggacgtgcaagcaagcgtctctgacaccgcacagcagcctagcgaggaacaaagcaagtcactggagaaacccaaacagaagaagaataggtgcttcatgtgtcgcaagaaggttgggctgacggggttcgagtgccgttgcggcaacgtctactgtggagtgcacagatattctgacgtacacaattgtagttacaattacaaagcagatgccgctgaaaaaatccgcaaagaaaaccccgttgtggttggcgaaaagattcagaagatttag

SEQ ID NO: 212492 - DNA, 591 bp, Artificial Sequence
  Description of Artificial Sequence: Synthetic coding sequence
atggcccaggagaccaaccacagccaggtgcccatgctgtgcagcacaggatgcgggttctacggaaatccacgcaccaatggaatgtgctccgtgtgctataaggaacacctgcaacgacaaaattctagcaatggccgcatctcgccgccagtgcagtgtacagatggcagcgttcctgaggcgcaaagcgcccttgacagcacttcatcttctatgcagccctctcctgtctccaatcaaagtctgctctccgagtccgtcgcctcctctcaactggatagcaccagtgtggacaaagctgttcctgagaccgaggatgttcaagcctctgtctctgataccgcccagcagccttcggaggaacaaagcaagagtcttgaaaaacctaaacaaaagaagaaccgttgctttatgtgccgtaaaaaggtgggcctgaccggttttgagtgcagatgtggcaacgtttactgcggggtgcaccgctactcagacgtccacaattgctcttataattataaggcagatgcagcagagaaaattagaaaggaaaacccagtggttgttggtgaaaaaatccagaagatttag

SEQ ID NO: 212493 - DNA, 627 bp, Artificial Sequence
  Description of Artificial Sequence: Synthetic coding sequence
atggcccaggagaccaaccacagccaggtgcccatgctgtgcagcaccggatgcggcttctacggaaatcctagaaccaacggaatgtgctcagtgtgttacaaggagcacctgcagaggcagaatagcagcaatggccgcatcagtccccctgctacctctgtctcttctctctccgagagcttgcctgtacagtgcacggacggctccgtgccggaagcacagtctgctcttgactcgacttctagctcaatgcagcctagtcctgtaagcaaccagagtttactttcagagtctgttgccagcagtcagctggacagcacatctgttgataaagccgtaccagaaaccgaagatgtacaggcgtccgtcagcgatactgcccaacagccctcggaggagcagagcaagtctctggaaaaaccaaaacagaagaaaaacagatgcttcatgtgccggaaaaaagttggcttgaccggctttgagtgtcggtgcgggaacgtgtattgtggtgtacaccggtactccgacgtgcataattgcagctacaactacaaggcagacgccgccgaaaagattaggaaggagaatccagtggtggtgggggagaaaattcagaagatctag

SEQ ID NO: 212494 - DNA, 627 bp, Artificial Sequence
  Description of Artificial Sequence: Synthetic coding sequence
atggcccaggagaccaaccacagccaggtgcccatgctgtgcagcaccggttgtgggttttacggcaatcctagaacgaacggcatgtgtagcgtgtgctacaaggagcacctccagcgccagaattcgtctaacggtcgcatcagcccccctgccacctccgtcagctccctctctgaatcattacctgtccagtgcactgatggaagtgtaccggaagcccagagtgccctggattctactagctccagtatgcagccctcaccagtcagtaatcagtcccttctgagcgagtcagtcgcatcaagtcagctcgattcaaccagcgtggataaggcagttcccgagaccgaggatgtgcaggcctccgtcagtgacacggcgcagcagccatcagaggagcagtctaaaagcctggagaaacccaagcagaaaaaaaatcggtgtttcatgtgcagaaaaaaggtgggcttaaccgggttcgagtgtcgctgtggcaacgtgtattgtggcgtgcataggtacagcgatgttcataactgctcttataactacaaggccgatgccgctgagaagattcgtaaagagaatccagtggttgtgggggagaagatccagaaaatctag

SEQ ID NO: 212495 - DNA, 627 bp, Artificial Sequence
  Description of Artificial Sequence: Synthetic coding sequence
atggcccaggagaccaaccacagccaggtgcccatgctgtgcagcaccggctgcggcttctacggaaaccctcgcacaaatggcatgtgtagcgtgtgctataaagagcacttgcagagacagaattctagcaacggtcggataagccctccagccacttcagtgtcaagtctttctgaatctctgccagtacagtgcaccgatgggtctgtacctgaggcacagagcgcactcgactcaacttcctcctcaatgcagccgtcccccgtttccaatcagagtctgctgtccgagtcggtcgcgtcgagtcagcttgactcaacctctgtggataaggccgttccagagaccgaagatgtgcaagcctccgtgtccgataccgctcagcaaccgagcgaagagcaatcgaagtccttggaaaagcccaagcaaaagaagaaccgatgttttatgtgccgcaagaaggtgggcctgaccgggttcgaatgtcgttgtgggaacgtttattgtggcgtccataggtactcagatgtccataactgttcctacaattataaggcagatgctgccgagaagataaggaaggagaacccagtggtggttggtgaaaagattcagaagatttag

SEQ ID NO: 212496 - DNA, 2085 bp, Artificial Sequence
  Description of Artificial Sequence: Synthetic coding sequence
atggagaacaagagcctggagagcagccagaccgacctgaagctggtggcgcacccccgtgccaagagtaaggtttggaaatactttggatttgacaccaacgccgagggctgcatcttgcagtggaaaaagatttactgcagaatttgtatggcgcagattgcatatagcggcaacactagcaatctgtcctaccacctggaaaaaaaccaccccgaggaattctgcgagtttgttaaaagcaacactgaacagatgcgcgaagcctttgccacagccttttcgaagcttaaacctgagagtagccagcagccaggtcaggacgcgcttgccgtcaaggcagggcatggatacgactctaaaaagcagcaggagcttactgcagcagttttggggttaatctgcgaggggctctaccctgccagtatagttgatgaaccaacgttcaaggtgctcctcaaaacagcagacccccgatatgagctccccagtaggaagtatattagcaccaaagcaattcctgagaagtacggcgcagtcagagaagtgattctgaaggagcttgccgaggccacttggtgcggaatctccacagatatgtggaggagcgaaaatcagaaccgcgcctacgtgactctggcagctcattttctgggcctgggagcccccaactgtctgagcatggggtcccggtgtttgaagacctttgaggtgcctgaggaaaacaccgccgagactataacccgggtcctgtacgaggttttcatcgagtggggaattagtgccaaggtctttggtgccacgactaattatgggaaagatatcgtcaaggcttgctctctgttggatgtggcagttcatatgccgtgccttggacacacttttaacgccgggatccagcaggcattccagctacctaaactcggcgccctcctgagccgttgtagaaaactcgttgagtatttccagcaatctgcggtcgccatgtatatgctttatgaaaagcagaaacagcaaaacgtagcacattgcatgctcgtcagcaacagagtgtcctggtggggtagtacattagccatgctgcagagattaaaagagcagcaatttgtgattgccggagttctggtcgaagactcaaataatcaccacctcatgctggaagcctccgagtgggcgacgattgaaggtctcgttgagctcctgcagccattcaagcaggtcgcagaaatgctgagcgccagtcgctatcctactatatccatggtgaaaccccttctgcacatgctgctgaataccaccttaaacatcaaggaaacggattctaaggagctgtctatggctaaagaggttattgccaaagagctgagtaagacatatcaggagacacccgaaatagatatgtttctgaacgtcgcaactttcctggatccgcggtacaagcggctacccttcctgagtgcctttgaacgccagcaggtggagaatcgtgtcgtagaggaagccaagggcctgctcgacaaggtcaaggatggcggttatagacctgccgaggataaaattttcccagtgcctgaagagccacctgtaaaaaaactgatgagaacttctactccaccccccgcctctgttatcaacaatatgctcgcagagattttctgtcagaccggtggtgtggaggaccaagaggaatggcacgcgcaggtggtggaagaactaagtaatttcaagagccaaaaggtgttgggtctgaacgaagaccccctgaaatggtggtctgatcggctagccttattccccctattaccaaaggtcctccagaagtactggtgtgtgactgctacgagggttgcaccagagaggctatttggctccgccgccaacgtggtatccgctaaaagaaaccggctggcccccgcgcatgtagacgagcaagttttcctgtacgaaaatgcacgttcaggggcagaggctgaacctgaggaccaagatgagggcgaatggggcctcgatcaggaacaggtgttctctctgggagacggcgtctccgggggcttctttgggatcagggattcctcctttctttag

SEQ ID NO: 212497 - DNA, 2085 bp, Artificial Sequence
  Description of Artificial Sequence: Synthetic coding sequence
atggagaacaagagcctggagagcagccagaccgacctgaagctggtggcccatccccgggcgaaatccaaagtatggaagtattttggcttcgatactaatgccgagggatgcatcctccagtggaagaagatttattgtcgaatatgtatggcccagattgcgtattctggcaatacctctaatctgagctaccacctcgaaaagaaccatcccgaagagttctgcgaattcgtcaaaagcaatactgagcagatgcgggaagctttcgctaccgcattctctaaactgaagccagagtcatctcagcagccaggacaggacgcgttggccgttaaagccggacatgggtatgactcgaaaaaacagcaggagctgacagcagcagtgctgggtctgatttgcgaaggtctgtaccctgccagcatcgtggacgagcctacctttaaggtactgttgaagacagcggacccacggtatgagctcccctctcgtaagtatatttcaactaaagcaataccagagaaatatggagctgtccgtgaggtgatcttgaaggaactcgctgaggcaacatggtgtgggatctcaactgatatgtggcgctccgagaaccagaatcgagcctacgttaccctcgctgcgcactttctgggcttgggcgccccaaattgcctgagtatgggttcgagatgcctaaagactttcgaagtgcctgaagaaaacaccgccgaaactattaccagggtactgtacgaggtgtttatcgagtggggaatcagcgcaaaggtattcggagcaaccaccaactacggcaaggacattgtaaaggcctgttcactgctggatgtagccgttcacatgccttgcctcgggcacaccttcaatgctgggatccagcaggcctttcagttgcccaagcttggggccctcctgtcaaggtgcaggaaactggttgagtacttccagcaatctgctgtggcgatgtatatgctttacgagaaacagaagcagcagaacgttgcccactgcatgcttgtgagcaatagagttagctggtggggatctactctcgctatgttgcagcggcttaaggagcagcagttcgtgatcgccggcgtcctggtcgaagattccaacaaccaccacctgatgctcgaggcttccgagtgggcaactatcgaagggctggtggaactactccagccgtttaagcaggttgcagagatgctgagcgcctctagatacccaaccatttccatggtgaagcccctgcttcatatgttgctgaataccaccttgaatataaaggagaccgattcgaaagagttaagtatggcgaaagaagtgatcgctaaagagctatctaagacttaccaggaaactcctgaaatagatatgttcctgaatgttgctacgttcttagatccgcggtacaagaggttgccatttctgagcgctttcgagaggcagcaggtcgagaaccgggtggtggaggaggcgaaaggactacttgataaagtaaaagacggtgggtaccgcccggccgaggataaaatttttccggtgcctgaggagcccccagtcaaaaaattaatgagaacatctacgcccccacccgcaagcgttatcaataacatgcttgccgagatattttgtcaaacaggcggcgtggaagaccaggaagagtggcatgcccaagtagtggaagagctaagcaacttcaagtcccagaaagtgctgggcctgaatgaagatcccctgaagtggtggtcagatcggctcgcacttttcccacttctgccgaaagtgctgcagaagtattggtgcgtgactgcaacaagggtcgcacccgagcgattgttcggctcagctgccaatgtggtgtctgctaaaaggaatcggctggccccagcccacgtcgacgagcaggtctttctctacgaaaacgcaaggagcggggccgaggctgaacctgaagaccaggatgaaggcgaatgggggcttgaccaggagcaggttttttccctcggggacggtgtctctggggggttctttggcatccgagactccagttttctgtag

SEQ ID NO: 212498 - DNA, 2085 bp, Artificial Sequence
  Description of Artificial Sequence: Synthetic coding sequence
atggagaacaagagcctggagagcagccagaccgacctgaagctggtggcccatccacgggccaaaagcaaggtctggaagtactttggattcgataccaacgccgagggttgtatactacaatggaagaagatctactgtagaatctgtatggctcagatagcttatagcggaaacaccagcaatctgtcttaccatttggagaagaatcaccctgaggagttttgtgaattcgtcaagtccaacaccgagcagatgcgggaagcctttgccacggctttctcgaagttgaagcctgagagttctcagcagcctggccaggacgctctcgccgtcaaagctggccacggctacgactctaagaagcagcaggagttaacagctgccgttctcggactcatttgcgagggcctctaccccgccagcatagtggacgagcccacattcaaagtgctcctcaagacggccgatccgagatatgagctgccatcaagaaagtatattagcaccaaagccattccggaaaagtacggcgccgttagggaagtgattctgaaggaacttgctgaagccacgtggtgcggcatctccactgacatgtggcggagtgaaaaccagaatcgagcatacgtgacactggctgcccatttcctggggctaggagcccccaattgcctctccatgggtagcagatgcctcaagaccttcgaggtcccagaagaaaacacagctgagactattaccagggtgctgtatgaggtattcattgaatggggaatcagtgccaaggtctttggcgctaccactaattacggcaaggacattgtgaaggcctgctcactcttggacgtggctgtgcatatgccttgtttaggccatactttcaatgctggaattcaacaggccttccagctacccaaactcggagctttgcttagccggtgtagaaagcttgtcgagtatttccagcagagtgcagtcgccatgtacatgctgtacgagaaacagaaacaacagaatgtggcacactgcatgttggtctcaaacagagtgtcatggtggggaagtacgctcgctatgctgcaacgccttaaagagcagcagttcgtaatagccggcgtactggttgaggactcgaacaaccaccatctcatgctggaggcttccgagtgggctactatagagggactggtggaactcctgcaaccttttaaacaggttgctgaaatgctcagcgcctcaagataccccacaatatctatggtgaaaccattgttacacatgctgctgaacaccaccctgaacattaaagaaacagactccaaagagctatccatggccaaagaagttatagctaaagaattaagcaagacgtaccaggagaccccagagattgatatgttcctaaatgtggcaacctttttagatccgaggtataaaaggcttccttttctgagtgcttttgagcggcagcaggtagagaatcgtgtcgttgaggaagccaaaggcctcctagacaaggtaaaggacggaggataccggcctgccgaggataagatctttcctgtgcctgaagagcccccagttaaaaaactgatgcgaactagcacccccccccccgcctctgtgattaacaatatgctggctgagatcttctgccagaccggcggtgtagaggatcaggaagaatggcatgcccaggtggtggaggagctgtcaaatttcaagagccagaaagtcctagggctgaacgaggacccccttaagtggtggagcgatcggcttgcactgtttcccctcttaccaaaagttcttcagaagtactggtgcgtaaccgctacccgtgtggctcctgagcgactgtttgggagcgccgccaacgtagtttccgctaagaggaacaggctagcccccgcacatgtggatgagcaggtgtttctatacgaaaacgctcggtccggagctgaagctgaaccagaggatcaggatgagggggagtggggccttgatcaggaacaggtgttctctttgggagatggcgtaagtggggggttctttggcattagagacagctcctttctctag

SEQ ID NO: 212499 - DNA, 819 bp, Artificial Sequence
  Description of Artificial Sequence: Synthetic coding sequence
atggagaacaagagcctggagagcagccagaccgacctgaagctggttgctcacccgcgggcgaagtccaaggtctggaagtactttggattcgatacaaacgcagaggggtgtatcctgcagtggaagaagatttattgccggatttgcatggcgcagatagcgtacagcgggaacacatcaaatctgtcatatcatctggagaaaaatcatccagaagaattctgtgagttcgtcaagtcaaacacagagcagatgcgtgaggctttcgcaactgccttcagcaaattaaaacctgagagcagtcagcagccgggccaggatgcattggcagtgaaagcaggtcatggttatgactccaagaagcagcaagagctgaccgcagcagtgttgggactgatctgtgagggactttatcctgcctcgattgtggatgagcctactttcaaggtgcttctcaagactgcagatccaagatacgagctgcctagtcggaaatatatttcaaccaaagcaataccagagaagtacggcgccgtccgggaggtaatactgaaggaacttgccgaggccacttggtgcgggatctccaccgatatgtggcgcagcgagaatcaaaacagagcttatgtgactctggctgcacatttcctggggctgggggcccccaactgtctttctatggggagcaggtgcttgaagacattcgaggtgcctgaagagaataccgcagaaacaataactcgggtcttgtacgaagttttcattgagtggggcatttctgcgaaggtcttcggggctactacgaattatggctag

SEQ ID NO: 212500 - DNA, 3177 bp, Artificial Sequence
  Description of Artificial Sequence: Synthetic coding sequence
atgcggcggaagggccggtgccaccggggcagcgccgcccggcacccatcgtctccgtgcagtgtgaagcacagtcccacccgggagactctgacgtatgcgcaggctcaacgaatggtggagattgagatcgaaggcagactgcatcgcatttcaatattcgatccattggagattattctggaggacgatctcacagcccaggaaatgtctgaatgcaactctaataaagagaacagcgaacgtcctcccgtgtgcttgcggaccaaacggcataagaacaatagggtcaagaaaaagaacgaagctttgccgtccgcccacggtactccagcaagcgcaagcgccctgcccgaacctaaggtaaggatcgtggaatattctccaccttcagcccccagacggccgcccgtctactacaaattcatcgagaagtccgcagaagagctggacaatgaggtggagtacgatatggatgaggaagactatgcctggctcgaaatcgtcaatgaaaagagaaagggagattgcgtacctgcggtctcccagtctatgtttgagtttctgatggacagatttgaaaaggagtcacactgcgagaaccagaagcagggcgagcagcaaagtctgattgacgaggacgcagtgtgctgcatctgcatggacggagagtgccaaaatagtaatgtaatcctgttttgtgacatgtgtaacctggctgtgcaccaggagtgctatggcgttccttacataccagaggggcaatggctttgtaggcactgtctacagtcccgggcacggcctgctgactgcgttctgtgtcctaataaaggcggggcattcaaaaagactgacgacgataggtgggggcatgtggtctgtgccctgtggattccagaggttggtttcgccaacacagtgttcattgaaccaatcgacggcgtgaggaatattcctccagccagatggaaactgacctgctacctttgtaaacagaagggggtgggcgcttgcattcagtgccacaaggccaactgttataccgccttccacgttacgtgtgcccagaaagcgggtctgtacatgaaaatggagcccgtcaaagagctcacaggcggaggtaccacgttttcagtgagaaaaacagcctactgtgacgtgcatacacctcccggatgtaccagacgccccctaaacatctatggggacgtcgaaatgaagaacggggtatgccgaaaggagtctagcgtaaagaccgtgaggtcaacttctaaagtgaggaaaaaagcgaagaaggcgaagaaagctctcgctgagccctgcgcggtcctacccaccgtgtgcgccccctatattccaccccagcgcctgaatagaatcgctaatcaggtggcaatacaacggaagaagcagttcgtggaaagagcacacagctactggctcctgaagaggctatctcgaaatggggcgcctttgctcaggcggttacagtcgagtctgcaaagtcagagaagtagccagcagcgcgaaaatgatgaagagatgaaagcggctaaagagaaactcaagtattggcagcggctgagacatgacctggagcgggcccgactgctgatcgagttgctgcggaaaagagaaaaactaaagcgagaacaggttaaggttgaacaagttgctatggaactgcggctgactcccctcaccgtcttgctgagaagcgtattagaccaactccaagataaagatcccgctcgcatcttcgcccagccagtaagcctcaaagaagtgccagattaccttgatcacattaaacacccaatggattttgctactatgaggaagcgcttggaagcgcaaggctataagaacctgcacgagtttgaggaggactttgacttgatcattgataattgtatgaagtataacgcacgcgacactgtcttctatagggccgctgttcgcctacgagaccagggaggcgtagtgctgcgacaggccaggagggaggtggacagcatcggactggaggaagctagtggtatgcacctccccgaacgccccgcagccgcccctcgtaggcctttcagttgggaggacgttgacagactcctagatcccgctaaccgggctcacctgggcttggaggaacagctaagggaactcttggatatgttagacctgacatgcgcgatgaaaagttccggatccaggtcaaaacgcgccaagctgctcaaaaaagagatcgcgctgctgcgcaacaagctgagccagcagcacagtcagccacttccaactggacccggtctggagggcttcgaggaggatggcgcagcactaggtccagaagccggcgaagaagtcctgccgcggctagagacgttgctgcagcccaggaagagaagtcggagcacctgtggggactcggaagtagaggaagagtccccagggaaacgcttggatgcgggcctgactaacggcttcgggggggcccggtccgaacaggagccgggaggcggcttgggccgaaaggccacgccaaggcgccggtgcgctagcgagagcagtattagctccagtaactccccgctgtgtgactcctcattcaatgcgcccaagtgtggaaggggtaagcctgctctcgtgagacggcataccctggaggacaggtctgaattgatttcttgcatcgagaacggtaattatgctaaggccgcccgtatcgcagctgaggtggggcagtcatccatgtggatcagcactgatgctgcggcaagcgttctcgaaccactcaaggtggtttgggctaagtgctcaggataccctagctatcccgctctgatcatcgatcctaagatgccgagggtgcctggccatcacaacggagtcactatccccgctcccccgctagatgtcttgaagatcggggaacatatgcagactaaaagcgacgagaagctgtttctcgtgttgttttttgacaacaaaagatcttggcaatggctaccaaagagtaagatggttccactcggcattgatgagaccatagacaagcttaaaatgatggagggcaggaactcctctattaggaaagccgtgcggatagccttcgacagagccatgaaccacctctcccgggtacacggagagcccacctccgatctgagcgacattgactag

SEQ ID NO: 212501 - DNA, 2940 bp, Artificial Sequence
  Description of Artificial Sequence: Synthetic coding sequence
atgagcgtgtgcaccctgagcgtgcccgtgagcagcctgagccccggccgacggtgtaacactttctctgacagcggtattctcgggtgtgtgcccattaatagtaataccgacgaggaggacgttgtggaggaaaaaatggtcgcagagggggttaataaagaggcaaagcagccagcaaagaaaaaacgtaaaaaaggattaaggataaagggtaaacgccggaggaaaaaactcattctggccaagaaattcagcaaggacctgggttctggcagacccgtggcagacgcccccgccctgctagctagcaacgaccctgagcaggacgaagagtcacttttcgagtccaatatagaaaaacaaatttatttgccttctacccgtgcaaaaacgagcatcgtatggcacttctttcatgtggacccccagtacacatggcgcgcgatttgtaatttgtgcgagaagagtgtttcccgaggcaaaccaggatctcacctgggtactagcacattacagcgccatctgcaagcccgtcactctcctcattggacaagggccaacaagttcggcgtggcctcgggtgaagaagattttacactcgatgtctcactgtctccctctagtggctccaatggcagcttcgagtatatccccaccgatccccttgatgacaaccggatgggcaaaaagcatgacaagagcgcatcagacgccctccgcgcagaaaggggtcgatttctcattaagtccaacatcgtgaagcatgcactgattcccggcacccgcgccaagacaagcgcggtgtggaatttcttctatacagacccacaacacatctccagagccgtgtgcaatatatgcaaaaggtcagtgtctcgcggaaggcccggctcgcatctcgggacaagcacactgcagcggcatctgcaggcaacccaccccatccattgggctgtggccaataaagattctggtgccgtagccaacggtctggacgaggcagagaccgagcgatccgacttgcttagcgatacactgcatggtgagaagtcaaccggtagccaggacctgaccgccgaagacctctctgattccgactctgacgagccaatgttagaggtcgagaaccgatctgaaagccccattccagtcgccgagcagggcacattaatgcgggcccaggagcgagagaccacctgttgcggaaatcccgtgagcagtcacatatctcaggccatcatacagatgattgtggaggacatgcacccctacaactatttcagtacccccgccttccagagatttatgcagatcgtcgcaccagactaccgtttgccatcagaaacctacttcttcactaaggccgtgccacagctgtacgactgcgtcagggaaaaaatcttcctgaccctggagaacgttcagagtcaaaaaatccatctgacagtggacatttggacccacgatccatccaccgactatttcatcgtaacggtgcactgggtctcgctagagactgcatcgtttctgaacaacggcaggataccggattttagaaagtgggcagtcctctgtgtgacaggcctagcaaaggattgcctgattacaaatatcctgcaggaactcaatgaccagatcggcttgtggctctctccaaacttcttgattcctagctttattgtgagcgacaacagctcgaatgtggtgcatgcaataaaggacggaggctttacccatgttccctgcttcttacactgtttgaacatggtgatccaggactttttctgcgaacacaagtcaatagagaatatgctggtggcagcaagaaagacatgccaccacttttctcactcggttaaagcccggcagatccttcaagaattccagaatgatcaccagctgccctggaaaaatcttaaacaggatgaaaccggacattggatctctaccttctacatgcttaagtggctgctcgaacactgttacagtgtgcaccatagcctgggccgcgcctctggtgtggtgcttacatctctccaatggactctcatgacctacgtttgtgatatcctgaagccctttgaagaagcaacccagaaggtgtcggtgaagacggccggcttgaaccaggttttgccgctcatccaccacctgttgttaagcctgcagaagctgcgggaagattttcaggtgaggggaataactcaggcgctgaatcttgttgatagcctgtcccttaaactcgagacagatacacttctgagcgctatgttgaagtctaagccctgtattttagctacattgctggatccctgttttaaaaatagtctggaagacttctttccccaaggagctgatttagagacctataaacagtttctggctgaggaagtttgtaactatatggagagcagccctgaaatctgccagatccccacctccgaagcttcttgcccttccgtaacggttggtgctgacagctttactagctccctgaaagagggcaccagctcgtcaggctccgtcgattctagtgctgtggacaatgttgcgctggggagtaaaagttttatgttccctagcgcagttgccgttgtggacgaatactttaaggaaaagtacagcgagttctcaggtggcgacgacccattgatctactggcagaggaagatcagcatctggccagccttaactcaggtcgctatccagtatctatcatgtcctatgtgctcttggcagtctgaatgtatctttactaagaactcccacttccatccaaaacagattatgtcactcgatttcgataacatcgaacagttgatgttcttaaaaatgaatctcaaaaacgtgaattacgactacagtacactggtcctctcatgggatccagagcagaacgaggtggtccaaagcagcgagaaagaaatccttccatag

SEQ ID NO: 212502 - DNA, 4938 bp, Artificial Sequence
  Description of Artificial Sequence: Synthetic coding sequence
atggaggagagcaagaccctgaagagcgagaaccacgagcccaagaagaatgtcatctgcgaagagtcaaaggccgtgcaagtgataggtaaccagaccttgaaggcgcgtaacgacaagagcgtgaaagaaatcgagaactcaagccctaataggaatagcagtaagaagaacaagcagaacgacatatgtatagaaaagactgaagtgaagagttgcaaggtgaacgcagcaaatcttcctggacccaaagacctgggcctggttctgcgggaccagtcccattgtaaagccaagaaatttccaaacagcccagtcaaggctgaaaaagcgacaattagccaagcaaaatcagaaaaagccacgtctctgcaggccaaagctgagaagagccccaagtctcctaattccgtaaaggccgagaaagccagcagctaccagatgaaatccgagaaagttccaagctccccggcggaggcagagaagggaccttcgctgctactcaaggatatgcgccagaaaaccgaactgcagcagatcggaaaaaagataccctcaagctttacatctgttgataaggttaacatcgaagccgtcggcggggaaaaatgcgcactgcaaaattcaccccgcagccagaagcagcaaacctgcactgataatactggggacagcgacgattctgctagcgggattgaagatgtttccgacgacttgtctaagatgaagaacgacgagagtaataaggaaaattccagtgaaatggattacctggagaacgcaacagtaattgacgaatcagccctcactcctgagcagcgactggggttgaagcaggcagaagagagactcgaaagggaccacatatttcgcctcgagaagaggtcaccagagtacacaaactgtcgctatctctgcaaattatgcctcatacacatagagaacatacaaggtgcacacaagcacatcaaagaaaaacgacacaaaaagaacattttagagaagcaggaagagtctgagctgcggtccctccctcctccctcacctgcgcacttagctgcattatctgtcgccgtcatcgaattggcaaaggagcacggcattacggacgacgatttgcgtgtgcggcaggagatcgttgaagagatgtccaaggtcattactacattccttcctgaatgctccctgagactgtatgggtctagtctgactaggtttgctctgaagtcttccgatgttaacatcgacatcaagttccctccaaaaatgaatcacccagatttgctgattaaggtgctgggcattctgaaaaaaaatgtactgtacgtcgatgtagagtctgacttccacgccaaggtgccggttgtggtctgtcgagatcgtaagtccggactgctatgcagagttagcgctggcaatgatatggcctgcttaactacagacctgctcactgcccttggcaagattgagccggtgttcatccccctggttctggccttcagatactgggcaaaactctgctacattgactctcagaccgacggtggcataccaagctactgcttcgcgctgatggtgatgttctttctgcagcagcggaagcccccgctacttccttgtctgctggggtcctggatcgaaggatttgacccgaagcggatggatgattttcagctgaaggggatcgttgaagagaagtttgtcaagtgggagtgtaatagttcttctgcgacagagaagaattccatcgccgaggagaataaagctaaagccgaccagcctaaagatgacaccaagaagaccgagacagataaccaatccaatgctatgaaagaaaagcacggcaagagccccctggccctcgagacgcccaaccgcgtctccctgggccagttatggctggaactgctgaagttttacactctcgacttcgcccttgaggagtatgttatctgtgtgcgcatccaggatattttaacacgtgaaaataagaactggccaaaacgccgcatcgctatagaagatcccttttctgtgaagaggaacgtagctcgcagcctgaatagccagctggtgtacgagtacgtggtggaaaggtttagggcggcttatagatacttcgcttgcccccaaactaagggaggaaataagtctacagttgatttcaagaagcgagagaagggcaaaattagtaataaaaagcccgtgaagtctaacaacatggctaccaatggttgcattctcctaggcgaaacgactgagaaaattaatgcagaacgggaacagccagtccagtgtgacgagatggactgcacatcgcagaggtgcatcatcgacaacaataacctgcttgtcaatgagctcgatttcgctgaccatgggcaggatagctccagcttgagcaccagcaagtcgtccgaaatcgagccgaaactggataaaaagcaggacgaccttgccccctcagagacttgcctaaaaaaggagctctcccagtgtaattgtattgatttatccaaatctcctgaccctgacaaaagtaccggaactgactgtcgttccaatctggagactgagtctagtcaccaatctgtctgcacagatacctcagcaacatcctgcaactgtaaggctactgaagacgcctccgatctgaatgatgatgacaacctgcctacccaagagctctactatgtctttgacaaattcattctaacttccgggaaaccaccgacaatcgtgtgcagcatctgcaaaaaagacgggcattcaaagaatgattgtcctgaagatttccggaaaatcgatttgaagcccctgcctccaatgactaataggtttagggaaatcctcgacctggtatgtaaacgatgcttcgacgagctctcacctccttgcagcgagcaacacaatcgggagcagattctgatcgggctggagaagttcatccagaaagaatacgatgaaaaggcacgtctctgcctttttgggagctccaagaacgggtttggtttcagggattcagatcttgatatctgcatgactctggaggggcatgaaaatgctgaaaagctgaactgtaaggaaatcattgagaatcttgccaagatccttaaacgccatccaggacttcgaaatatcctgccaatcacaacagctaaggtgcctattgtaaaattcgaacatcggcgatctggcctcgaaggcgacatatcattatataacacactggcccagcacaacacccggatgctggcaacgtacgcagcgattgaccctagagtgcagtatctgggatataccatgaaggtcttcgcgaagcggtgcgatatcggtgacgcctcgcggggcagtcttagcagctatgcatatatcctgatggtgctctattttctccaacaacgcaagcctcctgtaatacctgtgctgcaggaaatattcgatgggaaacaaatcccgcagcgcatggtggacgggtggaacgccttcttctttgataagacagaagaactcaagaagaggctgccctcactgggaaaaaacacggagtctttaggagagttgtggcttggtctgctgcgcttctatactgaggagttcgatttcaaggagtacgtcatctcaatccgacagaaaaagcttttgacaacatttgagaagcagtggacctcaaagtgcattgccattgaggacccatttgacctgaatcataacttaggcgcgggcgtctcaagaaagatgactaattttattatgaaggcattcataaatggacgcaagctgtttggaactcccttctatccactcatcggtagggaagctgaatactttttcgattcccgggtcctaactgacggggagctggcaccaaacgacaggtgttgtcgggtttgcggtaagattggccattacatgaaagattgcccaaaacggaaatcctctttgctgtttagactgaagaaaaaagatagcgaagaagaaaaggaaggcaacgaggaagaaaaggattctcgggacgttttggacccgcgggacctgcacgacaccagagattttcgcgatcctagagatttgagatgctttatctgcggagacgccgggcacgtacggcgcgaatgtccggaagtgaaactggccagacagcggaactcctccgtggccgccgcgcagcttgtccgcaacctggtgaatgcccagcaagtagctgggagcgcacaacagcagggggaccagtccatcaggacaaggcaatccagcgaatgctctgagtctccctcgtacagtccgcagcctcagcccttcccacaaaatagctcccagtctgccgctatcacacaaccgtcgtcacagcccgggtctcagcccaaactggggcccccccagcagggcgcacagccccctcaccaggttcagatgccactatacaatttcccgcagtcaccgccggctcagtatagcccgatgcataacatgggcctgttgccgatgcacccgcttcagatacccgccccaagctggccaatacatggccctgttatccactccgctccaggcagtgcgcccagtaacattgggttaaacgaccccagcattatctttgcccagcccgccgcccgtcccgttgccatccccaacacatcccacgacggccactggccgcggacagtggcacccaatagcctggtgaactcgggggctgtaggtaattcagagcccggattccgagggctgacaccccccatcccgtgggagcatgctccgaggccccattttcctctggtcccggcctcatggccctacggcctgcaccagaattttatgcatcaggggaacgcaaggtttcagcccaacaagccattctacacgcaggataggtgcgccacaagacggtgccgggagcgctgcccacacccgccgcggggcaacgtgtctgagtag

SEQ ID NO: 212503 - DNA, 4935 bp, Artificial Sequence
  Description of Artificial Sequence: Synthetic coding sequence
atggaggagagcaagaccctgaagagcgagaaccacgagcccaagaaaaatgtgatatgcgaagagtctaaagccgtccaagttatcggcaatcagaccttgaaggccaggaacgataagtccgtgaaggagatcgagaactcctccccgaatcgtaatagctctaagaagaataaacagaatgatatttgtatcgaaaagaccgaagtgaaatcatgcaaagtgaacgccgcaaacctgcctgggccaaaagacctagggctggtgctgcgcgaccagtctcactgtaaggccaaaaagtttccaaattcccctgttaaggcagagaaggctaccatttctcaagccaagagcgagaaggctacgagcttgcaggctaaggccgagaagagtccaaaaagcccaaacagcgtcaaagccgagaaagcgtcttcttaccagatgaaaagcgaaaaggtgcctagctctcctgccgaagctgagaaagggccctctctgttactgaaagacatgcggcagaagacagagctccagcaaatcggtaagaaaataccgtcttccttcacttctgtggataaagtgaacatcgaggcagtggggggcgagaagtgcgccctgcagaactctcctcgctcccaaaagcagcagacctgtacagataacacgggggatagtgatgattctgccagtggaatcgaggatgtgtcagatgacctgagcaagatgaaaaatgatgagtctaataaggagaattcatcggagatggactacctcgagaatgctaccgtaatcgacgagtcagctctaactccagagcagaggctgggccttaaacaggctgaggagcggctggaacgcgaccacattttccggctggaaaagcgatctccggaatacactaattgccgttatctctgtaaactctgcttgattcatatagaaaacatacagggcgcccacaaacatatcaaagagaaacgccataaaaagaatatcttggagaagcaagaagaatcggagctccggagcctgcctcctccatctcctgcacacctggccgcactgagcgttgcagtgatcgagctggccaaagagcacggcataaccgacgatgatctaagagtgagacaggagattgtggaggagatgtctaaggttatcactacgtttctccctgaatgctctctgagattatacggtagttcactgacaaggttcgcactaaagagcagcgatgtgaacatcgacattaaattccctccgaagatgaaccaccctgacctcctcatcaaggtgctcggtattctgaagaagaacgtcctgtatgtagacgtcgagtctgacttccacgcgaaggtgccagtagttgtgtgtagagatagaaagtcaggactcctatgcagagtctccgccggtaacgatatggcctgccttaccacagacctcctgactgctctgggaaagatcgagcctgtgtttatccctcttgtgcttgcattccgctattgggccaaactgtgttacatagacagccagacagacggtgggatccccagctattgcttcgcccttatggtgatgttcttcctccagcagagaaaaccacctttgttgccgtgcctacttggaagttggatcgaagggttcgaccctaagcggatggacgactttcagctgaagggtatcgtggaagagaaatttgtaaagtgggagtgcaacagttcgtctgctaccgaaaaaaacagcatcgccgaggaaaacaaagcaaaggcagaccagcctaaggacgatactaagaaaacagagacagacaatcaatccaacgctatgaaagagaaacacggaaaaagccccctcgccctcgagacccccaatcgcgtatctttgggacagctttggttggagctgctgaagttctatacccttgattttgccctcgaggaatatgttatctgcgtgcgaatccaggacattttgacccgcgaaaacaagaattggcctaaacggaggatcgccatcgaagatccatttagcgtgaaacgaaacgtcgccaggtcactgaactcccagctggtctatgagtatgtggtggaacgctttcgggccgcttatcggtactttgcttgcccccaaacaaagggcggaaataagtcaacagtggacttcaaaaagcgtgagaagggcaagatttctaataagaagcctgttaaatcaaacaatatggctactaacggctgtatattactgggtgaaactactgaaaaaattaacgcagagcgggaacagccggttcagtgtgacgaaatggactgcactagccagaggtgtatcattgataacaataacctcttggtgaatgagctggatttcgccgatcacggacaagattcctcttcactctcgacaagtaaatccagtgaaatcgaacccaaactcgataaaaaacaggacgacctggccccgagtgaaacgtgtctcaagaaagagctaagccagtgtaactgcatcgacttgtccaagtcacccgaccccgataagtccacgggcactgactgtagaagcaatttggagacagaatcaagccatcaaagcgtgtgtaccgacacctctgccacatcttgcaactgtaaagcaacggaggacgcctcggatctgaatgacgacgataatcttcccacgcaggaactgtactatgttttcgataaattcatcctcacatcagggaagcccccaactatcgtgtgttccatctgcaagaaggacggacacagtaagaacgactgtcctgaagatttccggaagatcgacctaaaacctctgccccccatgactaaccggttccgagaaattttggacttggtgtgcaagcggtgtttcgacgagctgagccctccttgcagtgagcagcataatagagagcaaattctgatcggcctggagaagttcatccagaaagaatatgacgaaaaagcgagactgtgcttatttgggtcttctaagaacgggttcgggtttcgagattctgaccttgacatctgcatgacgctcgaaggacatgagaatgctgaaaaattgaactgcaaagagatcatagagaacctcgccaagatcctgaagcggcacccaggcctgcgaaatattctacccattacaaccgctaaggtgcctatcgttaagtttgagcataggcgctccgggcttgaaggcgacatttcgttgtacaacaccctagctcagcacaatacaagaatgctggccacatacgccgccattgaccccagggtgcagtacttagggtacacaatgaaagtatttgccaagaggtgtgatatcggtgacgcttccaggggatccttaagtagttacgcctatattcttatggtgctctattttctgcaacagcgaaaaccaccggtgatccccgtgctgcaagagatcttcgacgggaaacaaatacctcagagaatggtggacggctggaacgccttcttctttgacaaaaccgaggaactgaaaaaaaggctaccgtccctcgggaaaaatacggagagcttgggagagctgtggctcggactgctgcgcttctatacagaagaattcgatttcaaggagtacgttattagtatcagacagaagaagctgctgaccacctttgaaaaacagtggacatctaagtgcattgccattgaggacccattcgatctaaaccataacttgggggctggagtgtccagaaaaatgactaattttataatgaaagcttttattaatggcagaaagctcttcggtacccccttttaccccctcatcggacgggaggccgaatatttctttgactctagggttctgaccgacggagaactggctccaaatgacagatgttgcagagtgtgcgggaagatcggccattacatgaaggactgccctaagcggaaatctctgttatttaggctgaagaagaaagactcggaagaagaaaaggaaggcaacgaggaagaaaaagacagccgcgacgtgctggacccacgtgatctacatgacactagggattttagagatcctcgagatttgcgctgttttatctgcggtgatgctggacatgtccgccgggagtgtcccgaggtgaagctcgccaggcagcggaactcatccgttgctgccgcccaactggtaaggaacctggtcaatgcacagcaagtcgcagggagcgcgcagcagcagggcgatcagagcatccggactcgccagtcctccgagtgcagtgaatcacctagttactctccacagccacagcccttcccccagaatagtagccagtccgcggctataacccaaccttctagtcagccgggatcccagcctaagctggggcccccccaacaaggggctcaaccaccacaccaagtgcagatgccactgtacaatttcccccagagcccgccagcccagtatagtcctatgcataacatggggctcttgccaatgcacccgctacagattccggcgccatcctggcctatccatgggcctgtaatacactctgcccccggctcagccccttctaatatagggctgaacgatccctccatcatcttcgcacagccggccgcgcgtccagttgctataccaaacacaagccatgacggccattggccaagaactgtcgctccaaactcgcttgtgaactcaggggcagtgggtaactccgagcccggtttcagaggtctaacaccaccaataccgtgggagcacgcaccaaggcctcactttcccctcgtccccgctagctggccatacgggctacaccaaaacttcatgcaccagggcaacgcccgattccagcccaacaaacctttctatacccaagatcgctgcgccacaagacgttgtcgagagaggtgtcctcaccccccacgcggcaacgtgtcggaatag

SEQ ID NO: 212504 - DNA, 264 bp, Artificial Sequence
  Description of Artificial Sequence: Synthetic coding sequence
atggaggagagcaagaccctgaagagcgagaaccacgagcccaagaaaaacgtgatctgcgaagaaagtaaggcagtccaggttattgggaatcaaacgttgaaagccagaaacgataagtctgtcaaggagatcgagaatagcagtcccaataggaacagttccaagaaaaacaaacagaacgatatatgcatcgagaagacagaggtcaagtcctgtaaggtaaatgccgctaatcttcctggacctaaagaccttgggtag

SEQ ID NO: 212505 - DNA, 234 bp, Artificial Sequence
  Description of Artificial Sequence: Synthetic coding sequence
atggaggagagcaagaccctgaagagcgagaaccacgagcccaagaaaaatgtaatttgtgaggagagcaaggcggttcaggtgatcgggaaccagacgctgaaagcacgtaacgataagtcggtgaaggagattgagaactcaagccccaacagaaatagctcgaagaaaaataagcaaaacgacatttgcatagagaaaactgaggtgaaaagttgcaaagtgaacgcatag

SEQ ID NO: 212506 - DNA, 1209 bp, Artificial Sequence
  Description of Artificial Sequence: Synthetic coding sequence
atggccagcatcatcgcccgggtgggcaacagccggcggctgaacgccccgctgccgccttgggctcatagtatgctgagaagtcttggaagaagtcttgggcctatcatggcatctatggcggaccgaaacatgaaactttttagcggtagggtcgtgcccgctcagggagaggagaccttcgaaaattggctcacccaggtgaatggggtactgccagactggaatatgtctgaggaggagaaactcaagaggctgatgaagacactgcgtggtccggcacgagaagttatgagagtcctgcaggcgactaaccccaacctgagtgtcgcggatttcctgcgggctatgaaactggtgttcggagaatcggagagctccgtgactgcccacgggaagttcttcaatactcttcaggcgcagggagaaaaagcttctctgtacgtgatcaggctggaggtacaactgcagaatgccatccaggctgggatcatcgctgaaaaggatgcgaacagaacaagactgcaacaactgctcctcggcggcgagttgtcgcgggacctcaggttgagactgaaggactttctccgcatgtatgccaatgagcaggaaagattaccaaacttcctcgaactgattcgaatggtccgggaggaggaggactgggatgacgccttcatcaaaaggaagcggccaaagcggtcagaaagcatggtggagagggctgttagcccggtcgcatttcaggggtcaccaccaatcgtaattgggagcgccgattgcaatgtaatcgaaattgacgatacgctcgacgactctgatgaagatgtcatcctagtggaaagtcaggatccaccactgccatcttggggtgcccccccgctgagggatagagcccggccacaggacgaggtgcttgtcatcgactctccgcataactctcgagctcagttcccatccacttctggcggatcaggctataagaacaacggcccaggtgagatgaggagagcacgcaaacgcaagcatactatacggtgttcctactgcggagaagagggacacagtaaggagacatgtgacaatgagtctgacaaagcccaagtgttcgagaatctcatcatcacactacaggaactgactcacacagagatggaaaggagtagggtggccccgggagaatataatgactttagcgagccactgtag

SEQ ID NO: 212507 - DNA, 1542 bp, Artificial Sequence
  Description of Artificial Sequence: Synthetic coding sequence
atggccgccagccggaacggcttcgaggccgtggaggccgagggcagcgccggctgcagggggtctagtggaatggaggtcgtgttaccactggacccagccgtgcctgcacccctgtgcccacacggcccgacattgctattcgtgaaagttacccagggaaaagaggagacgcggaggttctacgcgtgcagtgcctgccgggacaggaaagactgtaacttcttccagtgggaggatgaaaagttatccggagcccggttggcagctcgagaggcccacaatcggcgttgtcaaccaccgctgtcccgcacccagtgcgtggagcgttatctgaagttcatcgagctgcccctgactcagcggaagttttgccaaacgtgtcagcagctcctgcttcccgatgattggggacagcactccgagcatcaggtgctcggcaatgtgtcaattacccagctgcgcaggccttcacagctgctttacccactagagaacaaaaaaacaaatgcccagtatctgttcgccgatcggtcttgtcaatttttggtggacctcctttctgccctgggattcagacgggttctttgtgtgggcacacctcgattgcacgagctcatcaaattaacagcatccggcgataagaagtcgaacattaagtctttactccttgacatagacttcagatattcccagttttatatggaagattctttttgccactacaatatgttcaatcatcatttttttgacggtaagaccgctttggaagtttgcagggcattcttgcaggaggacaagggggagggaatcattatggtgactgatccacccttcgggggccttgtggaaccgctggcaattacattcaaaaagcttattgccatgtggaaagagggacagtcccaagacgacagccacaaggaacttcccattttttggatcttcccctacttctttgaatcacgcatctgtcagttcttcccaagcttccagatgctggactaccaggtggattatgacaaccacgccctatataagcacggaaagaccggacgcaaacagagcccagtgcgtattttcactaatatccctcctaataaaatcattctgcctaccgaggaggggtacaggttctgtagtccctgccagcgatatgtctcactggaaaaccaacactgcgagctgtgcaattcatgcacctcaaaggacggaagaaagtggaaccactgctttctgtgcaaaaaatgcgtgaaaccgtcatggattcattgctctatttgtaatcactgcgccgtcccagaccacagctgcgaaggccctaagcacggttgcttcatttgtggcgaactagaccataaacgttctacttgtcccaacatagcaaccagtaagcgcgcaaataaagccgtgcgcaaacagaaacagcgaaaatctaataagatgaaaatggagacaactaaaggtcagagtatgaaccatacatctgcgactagacggaagaaacggagagaaagggcacaccagtacctgggatcttag

SEQ ID NO: 212508 - DNA, 384 bp, Artificial Sequence
  Description of Artificial Sequence: Synthetic coding sequence
atggaggtggtgctgcccctggaccccgccgtgcccgcccccctgtgtccccatgggcctactctgctgtttgtaaaggtcacacaaggcaaagaagagacacggagattctacgcctgctcagcttgcagggatcgcaaagattgcaacttcttccagtgggaggatgaaaaactgtctggagctaggctggcagcgagggaagcgcacaatcggcgatgccagcctccgctgtccagaacccaatgcgggaggtacctgaagttcatcgagctgcctctgacccagagaaagttctgccagacctgtcaacagctgctcttgccagacgattggggacagcatagtgagcaccaattttgggtgtgtgttattacttcctag

SEQ ID NO: 212509 - DNA, 1479 bp, Artificial Sequence
  Description of Artificial Sequence: Synthetic coding sequence
atggtgatcctgctgctgcagcacggcgccgaccccaccctgatcgatggtgaaggattctccagcatccatcttgccgtacttttccaacatatgcctattatcgcttacctcattagcaaagggcagtcagtgaacatgactgatgtaaatggacaaactccactgatgctcagtgctcacaaggtgatcggccccgagcccacgggattcctccttaagtttaacccctcactgaacgtagtagacaagattcatcaaaacacccccctgcattgggcagttgcagcaggcaatgtcaatgcggtcgacaaactgttggaagcagggagcagtctggacatccaaaatgtaaagggcgaaacgcctttagacatggctctgcaaaataaaaatcagcttatcatacacatgctgaaaacggaggctaagatgcgggctaatcagaaatttagattatggagatggctgcaaaaatgcgagctgtttctcctgctgatgttgagcgtgatcacaatgtgggcaataggctacatactagatttcaactctgatagctggcttttaaaggggtgtctcctcgtcaccctgttcttccttacatctctatttcccaggttccttgtgggctacaagaacctggtatatctccccaccgctttcctgttaagcagcgtgttttggatatttatgacctggttcattctgttcttcccggatctggcaggcgctccgttctacttctcatttatatttagcatcgtagccttcctgtattttttctacaagacatgggccacagaccccggtttcactaaggcgagtgaagaagagaaaaaagtcaacatcattacgctagcggaaaccggctctctggacttccggaccttctgtacctcctgcttgatacgtaaaccactgaggtccctgcattgccacgtctgcaactgctgtgtcgctaggtatgaccagcattgcctctggacaggcaggtgcataggtttcggtaatcatcactattacatttttttccttttttttctatcaatggtttgcggctggattatttatggaagtttcatctacctgtccagccattgcgcaactacctttaaggaagatggactgtggacttacttgaatcagattgttgcttgtagcccctgggtgctctatatactgatgctggccactttccatttctcctggagtacatttctcctactcaatcagctattccaaatcgctttcctgggattaacttcacacgaacgaattagtctgcagaagcagtctaaacacatgaaacagacgctctctctccggaagaccccatataatctgggtttcatgcagaatctggcggactttttccagtgtggatgcttcggactcgtcaagccttgtgtggtggactggaccagccagtacacaatggttttccaccctgcccgggaaaaagtcttgaggtcagtatag

SEQ ID NO: 212510 - DNA, 1869 bp, Artificial Sequence
  Description of Artificial Sequence: Synthetic coding sequence
atggagggccccggcctgggcagccagtgccggaaccacagccacggcccacatccgcctggctttgggcggtacgggatttgtgcacatgaaaataaggagttagccaacgcaagggaagctctaccactcattgaagattcatcgaactgcgacattgtgaaggccacacagtacgggattttcgaaagatgcaaagaactggtcgaggctggctacgacgtgcggcaacccgataaagagaacgtaagcctgctgcactgggcagccattaataatagactggacctcgtgaagttctacatctccaaaggcgcagtggtggaccagctcggaggggatctgaattctacacccctgcactgggccattcgtcaggggcatctaccaatggtgattttgctattacagcatggggccgaccctactctgattgacggtgaaggcttcagctcaatccacttagcagtgctgttccagcacatgcccattatcgcctaccttatcagtaagggccagtcggttaacatgactgatgtgaatggccagacgccacttatgctgagtgcacataaggtgattggaccggagcctactggttttctgctgaagtttaatccttccctcaacgtggttgataaaattcaccaaaacacccctctgcactgggctgttgcagccggcaatgtgaatgccgtggataaactgctggaggctgggtcctctttggacattcaaaatgtgaagggcgagacccctctggatatggcccttcagaataaaaatcagcttatcatccatatgctgaaaacagaggcaaagatgagagctaaccagaagttccgcctgtggcgttggctgcaaaagtgtgaattgttcctattgctgatgctgtccgtaatcaccatgtgggccattggatatatccttgacttcaacagtgactcctggttgctgaaaggatgcctcctcgtgaccctgttctttctcacatcattatttccccggttcctggtgggctacaagaacttagtgtacctgccgactgcattcctcctctcatcagtcttttggatcttcatgacttggttcattctgtttttcccggacctcgctggtgcacctttctactttagtttcatcttcagcatagtcgccttcctgtatttcttttataagacctgggcaacggatccaggattcactaaggcatcggaggaggaaaaaaaggtaaacatcatcaccctggccgagacaggtagcctggactttcgcaccttttgtacaagctgcttaatacgtaagccattgagatctctccactgtcatgtgtgtaactgctgcgttgcccgatacgatcagcactgcctgtggacaggcaggtgtataggtttcggaaaccaccactattatattttcttcttgttcttcctgtctatggtctgcggctggattatatacggctcctttatctacttgtcttcccactgtgctaccacctttaaagaggacggcctctggacttacctgaaccagattgtcgcctgttcaccgtgggtgctgtacatattaatgctggcaacattccactttagttggtctacattcctcctgctgaatcagctgttccagatagcctttctcggcttgactagccacgagagaattagtttgcaaaaacaaagcaaacacatgaaacagacactctcactccgcaagaccccgtacaaccttgggttcatgcagaatctggctgatttttttcagtgcgggtgttttggactggtgaaaccctgcgtggtggattggacaagccaatatacaatggtctttcaccctgccagagaaaaggtgcttcgcagcgtttag

SEQ ID NO: 212511 - DNA, 564 bp, Artificial Sequence
  Description of Artificial Sequence: Synthetic coding sequence
atgcggcggggctggaagatggccctgagcggcggcctgcggtgctgcaggagagttctgtcgtgggtgcctgttctcgtcattgtcctggtggtcctgtggagctattatgcctacgtctttgagctttgtctggtgacagtgctctctcctgccgaaaaggttatttatctgattctatatcatgcaatttttgtttttttcacatggacctattggaaatcaatatttactcttccacagcagccaaaccagaaatttcacctgtcatatacagacaaggaaaggtacgaaaacgaggagagaccagaagtccagaaacagatgttggtggacatggccaaaaaactaccggtgtataccagaactgggagcggtgccgtacgtttttgcgacagatgccatctcattaagcccgacaggtgtcaccattgttcagtgtgcgcgatgtgcgtgctgaagatggatcatcactgcccctggggaaattaccccgtgtttgctttatcctctatgtccttcttcttcagcctttggccggcgtgcttcctctctgcgctttag

SEQ ID NO: 212512 - DNA, 1014 bp, Artificial Sequence
  Description of Artificial Sequence: Synthetic coding sequence
atgcggcggggctggaagatggccctgagcggcggcctgcggtgctgcagacgcgttctcagctgggtgcctgttctcgtaatagtgctggtggtcctatggtcttactatgcctacgttttcgagctctgcctggtgaccgtcctgtcccctgccgagaaagtgatctatctaatcctctaccatgcaatctttgtgttctttacatggacctattggaaaagtattttcacgctcccgcagcagccaaaccagaagttccacctctcctacaccgacaaggaaagatacgaaaacgaggagaggccagaagtgcagaagcagatgctcgtcgacatggcaaagaagctgcccgtctacacgagaactggatccggcgctgttagattctgcgataggtgccacctgatcaaaccagacagatgccatcattgtagtgtgtgcgcgatgtgtgtgctgaaaatggaccaccattgtccatgggtgaataattgcatcggcttttcaaactataaatttttcctccagtttctggcatattcagtcctttattgcctgtatattgcaacaactgttttctcttacttcatcaaatactggcgaggcgagctccctagcgtcaggtctaagttccacgttctttttctgttattcgtggcttgcatgttcttcgtctcactagtgattcttttcgggtatcactgctggctggtgagccggaataagaccacattggaggctttctgcacacccgtattcactagtggacctgaaaagaacgggttcaatctcggattcatcaaaaatatccaacaggtcttcggagataaaaaaaagttctggttgatcccaattggctccagccctggagatgggcacagctttcctatgaggtcaatgaacgagtcccagaaccctctgttagctaacgaggagacttgggaggacaatgaggacgataatcaggactatcctgagggctcttcttccctggctgtggaaaccgaaacatag

SEQ ID NO: 212513 - DNA, 987 bp, Artificial Sequence
  Description of Artificial Sequence: Synthetic coding sequence
atgcggcggggctggaagatggccctgagcggcggcctgcggtgctgcagaagggttctctcctgggttccagtgttggtgatagtgctcgttgttttgtggtcttattatgcttatgtttttgaactgtgtcttgtcatctatctgattctttatcatgctatttttgtatttttcacttggacgtattggaaatcaatctttacactgcctcaacagccaaaccagaaattccatctgtcgtatacagacaaggagcggtatgaaaacgaggaacgacccgaggtccagaaacagatgctggtggacatggctaagaagctgcctgtgtataccagaacaggttccggcgccgtccgcttttgtgaccggtgccatctgatcaagcccgatcgttgccatcactgttcagtttgcgccatgtgcgtgttgaagatggatcatcattgcccctgggtaaacaactgtatcgggttctccaattataaattcttcttacaattcttggcttacagcgtcctgtactgcctctacattgctaccacagtctttagctatttcattaaatactggagaggggagcttccttccgtgcggtctaagttccatgtactttttcttcttttcgtagcctgcatgttttttgtcagcctggtgattttgtttggttaccattgttggctggtttcgcgcaataagaccaccctggaggccttctgcacccctgtgtttacttccgggcccgaaaaaaacggatttaatctaggctttataaagaatatccagcaggtgtttggcgacaagaagaagttttggctgatcccaattggctcctccccaggtgacggacattccttccccatgaggagcatgaacgaatcacagaatccactactggccaatgaggaaacatgggaagataatgaagacgataatcaagactatcccgagggcagttcatcactggcagtggaaactgagacttag

SEQ ID NO: 212514 - DNA, 2022 bp, Artificial Sequence
  Description of Artificial Sequence: Synthetic coding sequence
atgccccggagccccggcacccggctgaagcccgccaagtacatcccagtcgcgactgccgccgcattgctggtgggttcgtcgaccctcttctttgtatttacttgtccctggctgactcgagccgtcagtccagctgtgccggtgtacaacggcattatatttctgttcgtcttggcaaacttttccatggcaacatttatggacccaggagtgtttcctagggctgacgaagacgaggacaaggaggatgactttagagctcccctgtacaagaacgtggatgtgcggggcatacaagtgagaatgaagtggtgcgcgacctgccacttttaccgtcccccaagatgttcacactgttccgtctgtgacaactgtgtagaagttactggcaaattccgggggggtgtcaacccatttactcgcggctgttgtgggaacgttgagcatgtgttgtgctcacccctggcccctcggtatgtggttgagcctccccgactgcctcttgccgtttctttgaaaccgccatttctgcgcccagaactgctggatagggcagctcccctaaaggtgaaactctctgataacggattgaaggctggactgggccgcagcaagtcaaaaggttctctggatagactcgacgagaagcctctggacctcggcccacctctgccacccaagatagaggccggcactttttccagtgacttgcagacacctcgacctgggtcggctgagagcgcactctccgtgcaaagaacaagtcctcccacaccagccatgtataaattccgcccagctttccccaccggacccaaggtgcccttctgcggtcccggagagcaggtccccggtccagacagtctgacgcttggcgatgactcaattcggagcctggacttcgtgtccgaaccttctctggatctcccagattatggcccaggaggcctccacgcagcatatccaccatctccaccactttcagcgtctgatgcattctctggcgcactaaggtctctcagccttaaggcatcatcgagaaggggcggagatcatgtcgcactccagcccttgagatccgaaggggggccgcctaccccccaccgcagtatcttcgcgccacacgccctaccaaatagaaatggcagcctgtcctatgattccttgcttaatcccggatcaccgggtggccatgcgtgccccgcccaccctgccgtgggtgtggcaggctatcactccccttaccttcatccaggagctactggagaccccccacgaccgttgccccgaagctttagtcccgttttagggccccgcccccgggaaccatcccccgtcagatatgataatttgtctcggacgatcatggcatctatccaggagcggaaagaccgcgaggagagggagcgtctgctgcggtcccaggccgactcacttttcggcgacagtggcgtctacgatgctcccagttcctactccctccagcaggccagcgtattgtccgagggcccccgaggtcctgctcttaggtacgggtcacgcgatgacctggttgctggacccggattcgggggtgccaggaatccggcactccaaacaagtctctcatccctgagctcaagcgtttcccgagctccccgtacctcttcgagctctctgcaggccgaccaggcttcatctaacgctcctggcccgcgccccagctctgggagccaccgatcgccagccaggcagggtctcccaagtcctcccggtactccccactcacctagctacgccgggcctaaggccgtcgcctttattcacactgacctgccggaaccacctcccagcctgactgtgcagcgcgaccatcctcagctgaaaacaccgccatccaaactcaatggtcaatctccaggccttgcaaggctgggcccagctaccggcccaccagggcccagtgcatctccaactagacacaccctggttaaaaaagtgagcggcgtgggcggaaccacttacgagatcagcgtttag

SEQ ID NO: 212515 - DNA, 2298 bp, Artificial Sequence
  Description of Artificial Sequence: Synthetic coding sequence
atgccccggagccccggcacccggctgaagcccgccaagtacatccctgtcgccaccgcagccgccctgctggttggctcatcaacccttttcttcgtgtttacatgcccttggttaacccgagccgtatctccagctgtgcccgtgtacaacgggattatcttccttttcgtactcgctaacttctcaatggccaccttcatggatccgggagtgtttccacgagccgatgaggacgaggacaaagaagatgacttcagggcgcctttatacaaaaacgttgatgtcagaggcatacaggtgaggatgaaatggtgcgcaacatgccacttctaccgccctcctagatgtagtcactgctctgtgtgcgataattgcgtggaggactttgaccaccattgtccttgggtgaacaactgtattgggcgtagaaactacagatatttctttttattccttctttccctcagtgctcacatggtcggagtggtggcgttcggccttgtgtacgtccttaaccatgccgaaggcctgggggctgcccacacaacaatcactatggcggtgatgtgtgtcgccggcttgtttttcatccccgtaattggattgaccggcttccatgtagtgctcgtaactaggggtagaaccacaaatgagcaagtcaccggtaagtttcgcggcggagtgaatccctttaccaggggctgctgcggcaacgtcgagcatgtgttgtgctccccgctggcaccaagatacgttgttgaacccccacgcctcccactcgcagtctcattaaaacccccttttctccgcccagagcttcttgacagagccgcacccctcaaagtgaaactcagtgataatggactgaaagcagggctgggtcgctccaaatcaaaaggttctctggatcgactggacgagaaaccacttgatctggggccacctttgcctccaaaaatagaggcagggacattttcttctgatctccagaccccacgtcccggatcagccgaaagtgcccttagtgtgcagcgcactagtccccctacacccgcaatgtacaagttccggcctgcctttccaaccggcccaaaagtgccattttgtggccccggcgagcaagtacccggcccagactctctgaccctaggagacgacagcattagaagcctggacttcgtcagcgagccttcccttgacctcccggattacgggccaggcggcctgcacgctgcttaccctccaagcccccctctgtcagcctcagatgccttttccggagcactacgctccttgagcctcaaagcttcttcccgccgcggcggtgatcatgttgccttacagcctctgcggtctgagggtggacctcccacaccacaccggtcaattttcgcgcctcacgctctgccgaatagaaatgggtcactatcctacgatagccttctgaacccaggaagcccgggaggtcacgcttgcccagctcacccagcagtgggcgtagctggataccattcgccttacttgcacccaggagctacaggcgatccacctcgacccctaccccggtcttttagccctgttctgggaccccgtccgcgcgaacctagtccggtgcggtacgataatctatcacgaacaatcatggcctccatccaggagcgaaaggatcgggaagaacgggaacgccttctgaggtctcaggccgacagccttttcggagactctggagtatatgatgccccaagttcttactccctgcagcaagccagtgtgctctcagaggggccccgggggcccgccctccgctatggcagtcgggacgacctggtggccggacccgggtttggcggggcccgcaatccagcattgcagacttccttaagttctctctcaagttctgtatcgcgcgcgccgcgcacgtcctcttctagcctgcaggcagatcaggcctcttctaacgctcccgggcctagaccatctagtggctcgcatcggagccctgctcggcaaggattgccctccccacctggcacacctcattccccctcatacgctgggcccaaggcagtggcattcatccatacagacttacccgagcccccgccatctctcaccgtgcagcgggatcaccctcagctcaaaacacccccctcgaaactaaacggtcagtcacctgggttggctagactgggccccgctacggggccacccggacctagcgcctctccgacccgacacacccttgtgaagaaggtgtctggggtgggaggaactacatacgaaatctcagtgtag

SEQ ID NO: 212516 - DNA, 2337 bp, Artificial Sequence
  Description of Artificial Sequence: Synthetic coding sequence
atgccccggagccccggcacccggctgaagcccgccaagtacatcccggtcgccacagcagccgcactattagtcggtagttcgaccctcttctttgtcttcacgtgcccatggctgactcgagccgtgagcccggccgtacctgtttataatggcattatttttctgttcgtgctggccaacttttctatggctacttttatggaccccggcgtctttccaagagcggatgaggacgaagacaaggaggatgatttcagagcaccactatataaaaatgtggatgtgaggggcatccaagtccgcatgaagtggtgtgccacctgtcatttttatcgacccccaaggtgtagtcactgctccgtttgtgataattgtgtagaagacttcgaccaccactgcccctgggtcaacaattgcattggccgtagaaattaccgttacttttttttattcctgctatctctttccgctcatatggttggggtggtggcgtttggattagtgtacgttttgaatcacgcagagggcctgggggccgctcatacaactattacaatggcagtgatgtgcgtggctggactcttctttatcccagtgatcggactgacaggttttcacgtagtgctcgtaaccagaggtcgcaccacgaatgagcaggtcactggtaagtttaggggaggtgtgaacccctttactagaggctgttgcggcaatgtggagcacgtgctctgcagcccgctagcacctagatacgtggttgaacccccaaggctgccgttagccgttagcttaaagcctcccttcttgaggccagaactcttggacagggctgctccccttaaggtcaaactgtccgacaacggccttaaggccggacttggcaggagtaaatctaaagggtccctagataggctcgatgagaagcctcttgaccttggtccaccgctaccccccaagatcgaagctggtaccttttctagcgatctgcagacccctaggcctggttcagctgagtccgctctgtcagtgcaaagaacatcaccacctacacccgcaatgtataaatttcgtcctgcctttcctacaggcccaaaggtgcctttctgtggtccgggcgagcaggtccctggaccggactcccttaccctgggagatgattctataaggtcgttggactttgtcagcgaaccatccctggacctgccagactatggccccggcggattgcacgcagcctaccctccatcccctcctctgtccgcctctgacgcattttctggagccttgaggtcgctttcactcaaggcctctagcaggcgagggggggaccatgttgctctgcaacccctcagatcagagggagggcctccaacacctcatcgatctatatttgcaccccacgccttaccaaataggaacgggtcactctcatacgattccctgcttaacccaggctcacctggtggacatgcatgtccggcccaccccgcagtgggcgtggccgggtaccattcaccctatcttcacccaggagcgaccggcgatcctccccgacccctgccccgaagtttctcccccgttctgggtcctcggccgagggagccaagccccgtcaggtatgataatctctcacgcacaatcatggcttcaatccaggaacgcaaggaccgcgaggaacgtgagcgcttacttaggtcacaggcagacagcctctttggcgactccggggtgtatgacgctcccagcagttactctctgcagcaggcgtctgtcctgtcagaagggcctaggggacccgccctgaggtacggaagtagggacgacctggtggcaggccctggatttggaggggcacgaaaccccgcgcttcagaccagcctctcttctctctccagcagcgtctccagagccccccggacgagttcatctagcctccaggcggatcaggccagttccaatgcccccggcccaagacctagttccggttctcaccggtccccagctcggcagggcttgccctctcctccagggaccccacactcacccagctacgcgggtcccaaagcggtagcattcattcacaccgaccttcctgagccgcccccatccttaacagtccagcggggcaggattggaacttgtacaaggggatggggcagacggggacaaccttgggtaccgcctggtctgcacctgtgccatctcgggcgtcctgaagatcgcccgccacttcgcgccccttggtctcaagcagctggggcccctccaaggggggctatgtgtcggctgcaccttgcggcaagctctctgttcccctctctgtccggtccttag

SEQ ID NO: 212517 - DNA, 1095 bp, Artificial Sequence
  Description of Artificial Sequence: Synthetic coding sequence
atgagcgtgatggtggtgcggaagaaggtgacccggaagtgggagaagctccccggaagaaacacattctgctgcgatggccgcgtgatgatggcgcgacagaaaggtattttctatttaacactctttctaattctcgggacgtgcactctattctttgcatttgaatgccggtaccttgccgtgcaactttctccagcaatccccgtgttcgcagcgatgttattcctcttctcaatggcgaccctgttgcggaccagcttttcagaccccggggttatacctcgggcacttcctgatgaggcggcttttattgaaatggagattgaagccacaaacggcgcggtcccacaaggacagcgccccccacctcgcattaagaactttcagattaataatcaaattgtaaagctaaaatattgttacacttgcaagattttcagaccaccgcgggcatcccattgctctatttgcgataactgcgtggaacgctttgatcaccattgcccctgggtggggaactgtgtgggaaaaagaaactatagatacttctatctgttcatcctctcactgagcttgctgactatatacgttttcgccttcaatattgtctacgtcgctttaaagagcctgaagatagggtttctggagaccctgaaggagaccccagggacagtgctggaggtgcttatatgtttctttacattatggtcagtagttggtctgacggggttccatacatttcttgtagcactgaatcagaccacaaacgaagacatcaaggggagctggaccggcaagaaccgtgtccagaatccatacagtcatggaaacatcgtgaaaaattgctgcgaggtattgtgtggacccttaccaccgagcgtccttgatcgccgtggtatcctgcccctcgaagagtcgggaagcaggccaccctctacgcaggagacatcaagttcacttttgcctcagagtcccgctcccactgagcaccttaactcaaacgagatgccagaggattcctctacaccggaagagatgccacctcctgaacctccagaaccccctcaggaagctgccgaggccgaaaaatag

SEQ ID NO: 212518 - DNA, 1095 bp, Artificial Sequence
  Description of Artificial Sequence: Synthetic coding sequence
atgagcgtgatggtggtgcggaagaaggtgacccggaagtgggagaagcttcccggccggaatactttctgctgcgacggacgcgtaatgatggcacggcaaaagggaattttttacttgacacttttcttgattctgggaacttgcacactgtttttcgccttcgaatgtcgatatctggcagtgcaattgtcccccgccatccctgtgtttgcggcgatgctgtttctgttttctatggctacactgctccggacatccttctctgatccaggggtgattccacgagccctgcctgacgaagctgcatttatcgaaatggagatcgaagcaacaaatggcgcagtaccacaaggccagcggccacccccgaggataaagaatttccagattaataatcagatcgttaagcttaagtactgttacacatgcaaaatctttagacccccccgcgcctcgcattgttcgatctgtgataattgcgtggaaaggtttgaccaccattgcccatgggtgggaaactgcgtgggaaagaggaactatcggtatttctatttgttcattctgagcctgtccctgctaacaatttacgtttttgcgtttaacatagtatacgtggcactcaaatcacttaaaattggctttctcgagacgctgaaagagacgcctggaaccgtactggaggttcttatctgtttcttcacgctgtggtcagttgtgggactaacagggtttcataccttcctggtggctctgaaccagacaaccaatgaagacataaaaggctcttggaccggcaaaaatcgcgtgcaaaacccttacagccatggaaacattgtcaagaactgttgcgaagtgctctgcggccctctgccaccctctgtgctggaccggcgtggaattctgcctctggaagagtccggtagtagacctcctagcactcaggaaaccagctccagcctgctgccacagagcccagcacctacagagcacttaaattcaaacgaaatgcccgaagactctagcacaccagaagagatgcccccaccagagcctcctgagcctccgcaagaggcggcagaggctgaaaagtag

SEQ ID NO: 212519 - DNA, 513 bp, Artificial Sequence
  Description of Artificial Sequence: Synthetic coding sequence
atgagcgtgatggtggtgcggaagaaggtgacccggaagtgggagaagttgccagggagaaataccttctgctgtgacggacgagtgatgatggcaaggcaaaaaggtattttttatctgaccctgtttctcattctgggaacttgcacactattttttgccttcgagtgtaggtacctggccgtccaattgtctcccgctatccctgtgttcgccgccatgctttttttgttttctatggctactttattgcggacctcattctccgaccccggtgtcatccctagagctctgccagatgaggctgcgttcatcgaaatggaaatcgaagctacaaacggagcagtcccacagggccagcgcccacccccccggatcaagaatttccagattaacaatcagattgtcaaactgaaatactgctatacgtgcaagatcttccgacctcctagggctagtcactgttccatttgcgataattgtgttgagcggttcgaccaccattgtccgtag

SEQ ID NO: 212520 - DNA, 585 bp, Artificial Sequence
  Description of Artificial Sequence: Synthetic coding sequence
tgactgttcctgatcctgggcacctgcaccctgttcttcgccttcgaatgtcgatacctcgctgtgcagttgagccccgccatcccagtgtttgctgccatgctgttcctattttctatggccacactgctccgaacttcattcagcgatccaggcgttatcccaagggctctgccagatgaggccgcttttattgagatggagattgaggccaccaatggggctgtccctcagggccaaaggccaccccctcggattaagaatttccagattaacaaccaaatcgtgaagctgaagtactgttatacatgtaaaatcttccgccccccccgtgctagtcattgtagcatttgtgacaactgtgtagaatcactgaaaattgggttcctggaaactctcaaagagacacctgggacagttttggaagtactgatctgcttctttacactttggtccgtcgttggcctaacggggtttcacacgtttcttgttgctctcaatcagactaccaatgaagacatcaaagggagctggactgggaagaacagggtgcagaacccttatagccatggtaatattgtctag

SEQ ID NO: 212521 - DNA, 897 bp, Artificial Sequence
  Description of Artificial Sequence: Synthetic coding sequence
atggagcggggcatcagcgacgtgaccgaccggaagctgaccatggaggaggaagaggccaaacgtatcgctgagatgggcaagcctgtgctgggggaacacccaaagctggaggtaattatcgaagagtcgtacgagttcaagactaccgtagataagctcattaaaaaaaccaatctcgctctggtggtgggcacgcattcctggagggaccagtttatggaagctataacagtctccgccgccggagacgaggacgaagatgagtcaggtgaggaaaggttacccagctgcttcgattatgtgatgcacttcctgacggttttttggaaggtgcttttcgcttgcgtgccccccacagagtattgtcacggctgggcctgctttgctgtatcaattctcatcatcggcatgttaacagctatcattggagacttagcctcacactttgggtgtacaattgggctgaaggactctgttaccgcggtggttttcgtggcatttggcacctccgttcccgacacattcgccagtaaggctgctgccctgcaagatgtgtatgcagatgcatctattggcaatgtgacagggtctaacgccgtcaacgtctttctcgggattggactggcctggtctgttgcagcaatttactgggccttgcaaggccaagagttccacgtctctgccgggacattggctttttctgtcaccctattcacaatcttcgcatttgtctgcatctccgtccttctgtacaggcggcgccctcacttgggcggtgagctcggaggaccacggggctgcaaactcgccaccacctggctcttcgtgtctctgtggctgctctatatcctcttcgctacactcgaggcctattgctatatcaaaggtttctag

SEQ ID NO: 212522 - DNA, 705 bp, Artificial Sequence
  Description of Artificial Sequence: Synthetic coding sequence
atgagcagcgaggtgagcgcccggcgggacgccaagaagctggtgcgcagtcccagcggtctccggatggttcccgagcaccgtgccttcggaagtcccttcggtcttgaggagccccagtgggttcccgacaaggaatgtcgcaggtgcatgcagtgtgatgcaaagttcgactttctaacacggaaacaccactgcaggagatgtgggaagtgtttctgcgatcgctgctgttcgcagaaggtgcccctgcgaagaatgtgtttcgtggacccagtacggcagtgcgccgaatgcgccctcgtttcgctgaaagaggcagagttttacgacaagcaattaaaggtgctcctatcgggagcaacctttctggtaactttcggcaacagtgagaaaccagagacgatgacctgcaggctgtctaacaaccagaggtacctgtttctggacggcgactcgcactacgaaattgaaatcgtacacatctctacagtgcaaatcctgactgagggtttccctccaggaggcgggaatgcccgggcaactgggatgttcctgcagtacacagtgcccgggactgaaggcgttacacagctgaaactaactgttgtggaagacgtaacagtgggtcgcagacaggcagtagcctggctggtggctatgcacaaagcagccaagctcctttacgaatctcgagatcaatag

SEQ ID NO: 212523 - DNA, 7620 bp, Artificial Sequence
  Description of Artificial Sequence: Synthetic coding sequence
atgaaccaccccttcggcaaggaggaggccgccagccagaagcagctgttcggtttcttttgcgaatgtcttaggcggggcgagtgggaactggctcaggcctgtgtcccccagctgcaggagggtcagggagacataccaaagagagttgaagacatcctgcaggctctcgtcgtatgtccaaatctcctgagatgcggtcaggatataaacccacagcgagttgcctgggtctggctcctggtcctcgaaaagtggctggcccgggaaaaaaagttgttaccagtcgtctttcggagaaaattggagtttttgctgctctctgaggatctgcaaggtgatatcccggagaacattctggaagagctgtacgagactcttactcaaggggctgtcggtcacgtgccagacggtaacccaaggcgggaatcctggacaccaaggctgtcttctgaggccgtgtccgtactctgggaccttctgcgccagagtccacagcccgcacaggctctcctggaactactgctcgaagaggacgatggtactggcctgtgccactggccattgcagaatgctctcgtagacctgattcggaaagccctgcgcgccctacagggaccagattcagtacccccgggcgttgttgatgctatctacggcgctctcaggacacttcgttgccctgctgagccactcggggtagaactgcatctgctttgcgaggagcttctcgaggcttgtagaacagagggtagtccccttagagaagagcgactgctctcttgcctgcttcataaagcttcacggggactgctgtccttgtatggacacacttatgcagaaaaagtgaccgagaagccgccccgcgcgaccgcctctggcaaagtaagtcccgatcacttggatcccgagagggctatgttagctctgttcagcaaccctaatcccgcggaggcatggaaagttgcatacttttattgtttaagcaataacaagcacttcttggagcagattctggttaccgcactcactctgctcaaagaggaagatttcccaaatctaggatgtttgttagaccgcgaattccggccactgtcgtgcctgctggtactgctcggatggactcattgccagtcactggaatccgctaaacgactactccagaccctgcatagaacccagggtcccgggtgtgacgagctgctaagagacgcctgcgatgggctgtgggcacacttggaggtccttgaatggtgcattcagcagtcttccaatcccatcccaaagagggatttactgtatcacctgcacggaggagactcacattctgtgctgtataccctccatcatctcactaacttacctgctttacgagaggaggacgtgctgaagctgttgcagaaagtgcccgccaaggacccgcagcaggagccagatgccgtggatgcgcccgtcccagagcaccttagccagtgtcagaacctcacactttatcagggattttgtgcgatgaagtatgcgatttacgcgttgtgtgtaaatagccatcagcactcacagtgtcaagactgtaaagactcactgagcgaggatctggcctccgccaccgagccggcaaatgattctttaagctctccaggcgccgcaaacctcttctcaacctacctggcaaggtgtcaacagtacctctgctctatccctgactccctgtgtttagagctgttggagaacattttcagtctcttactcattacaagtgcggacttacatcccgagccccatctgcccgaagactatgccgaggatgatgacatagaaggtaagagtccgtccgggttaagatcccctagcgaaagcccccagcacatcgctcacccagagcggaaatccgagcgggggagtttgggggtaccaaaaaccctagcctatacaatgcccagccacgtgaaggccgaaccaaaagattcttaccctgggccccataggcacagcttcctggaccttaaacactttacgagcggcatctccggattcttggccgatgagttcgcaataggtgcgttcctgcgattgcttcaagagcagcttgatgagatcagctctcgctcccccccagagaagccgaagcaggaatcacagagttgtagtggatcccgggatggcctacagtcacgtctccaccgcctctccaaggtcgtgtccgaggcccagtggcgccataaggtggtgacgagtaatcatcggagcgaggaacaaccaagcaggagataccagccagccacccgccacccctcgttgcggagaggcaggagaaccagacggagccaggctgacgggcgcgaccgcggatctaaccccagtctcgaatcaacctcatcggagctcagcactagtacttcagaggggtcattgagcgccatgtctgggcggaacgaacttcactctagacttcacccacacccacaatcttccctgatccccatgatgttttctccacctgagagcctactcgctagttgcatactgaggggaaacttcgcggaggcccatcaggtgttgttcacctttaacttaaagtcaagcccttcaagtggcgagctcatgttcatggaacggtaccaggaggtgatccaagaattagcccaggtagagcataaaattgagaatcagaatagcgatgcagggtcttccaccatcagacgtactggctccgggaggtcaaccttgcaagcaatcggcagcgccgccgctgcgggcatggtgttctactcaatatctgatgtcacagataaactgctcaacacttccggcgacccaattccgatgctccaggaggatttctggatatcgacagccctggtggaacccactgctcccctgcgggaggtgctggaggatctcagcccacctgccatggcagcattcgacctagcttgcagtcagtgccagttatggaaaacatgtaagcaattacttgagaccgccgagcggcgactgaattcatcactggagaggcgtggtagacgaattgatcatgtgctgcttaatgcagacggtatccgaggctttcctgtggtactgcagcaaatcagcaaaagcctgaactatctcctgatgtctgcctcccagacaaaatcagagtctgtggaggagaagggggggggaccgcctaggtgtagtatcacagaattgcttcagatgtgctggcctagtctctccgaggattgcgtggcgtctcacactacgttatcccaacaacttgatcaggtgctccaaagcctgcgggaagctctggaactaccagagccccggacacctccgctgagcagcctggtggagcaggccgcccaaaaggctccagaggcagaggcccaccctgtgcagatccagactcaactgctgcagaaaaacctgggtaagcagacacctagcggcagccgtcaaatggattatttgggcaccttcttttcttactgctccaccttggcagcagtgctacttcaaagcctctcgagtgagcccgatcacgttgaagtaaaagtgggtaatcccttcgtgctcttgcagcagtcttcgtcacagctcgtttcccatctgttgttcgagagacaggtgcctccagaaaggctggctgcactgctcgcacaggaaaatctatccctttccgtgccccaagtgattgtgagctgctgctgcgagcccttagctctttgtagctcaagacagtcgcagcaaacatctagcctactgacccggctcgggacacttgcccagctccacgcctctcactgcctcgatgatctgcccctgagcaccccaagcagtccgaggaccacagagaatcccactttggaaagaaaaccatattcttctccaagagatagttctctaccagccctgaccagctcagcactggcctttctgaagtcacggagtaagttgctggccactgttgcatgtctgggagcaagcccccgcttaaaagtttccaaaccttcactgagctggaaagagctgcgcgggcgccgggaggtgccccttgccgccgagcaggtggcccgagaatgcgaaagactcctggagcagtttccactctttgaggcatttctcctcgccgcctgggaaccactgcggggttcccttcagcagggtcaatctctcgcggtgaacctgtgtggatgggcctccttatcaacagtgctgctggggctgcattctccaatcgcgctggacgtgctttcggaggcgttcgaggaatctctcgtggctcgcgactggagccgcgcacttcagttgaccgaggtgtatggacgagatgtggacgacttgtcaagtattaaggacgcggtattgagctgcgcagtggcttgtgataaagaagggtggcagtatttgttccctgtgaaagacgcatctctcaggagcaggctggctctccagtttgtcgaccggtggcccctagaatcctgtctggaaattctcgcttactgtatctcagacacagcggtgcaagaggggttaaaatgcgagctacaaaggaagcttgccgagctgcaggtatatcaaaagatcctgggattacagagccccccagtgtggtgtgactggcaaaccctcagatcctgctgtgtcgaagaccccagcaccgtgatgaatatgatccttgaggctcaggaatacgagttatgtgaagagtggggctgtttatatcctatccccagggaacatctcatatcattgcatcagaagcacctgcttcacttactggaacgcagagatcacgataaagcattgcagttgctgcgcagaatacccgacccaacaatgtgtcttgaggtcactgagcaatcactcgatcagcatacctctttggccacctcgcacttcctcgccaactacttaacaactcacttttacgggcagcttactgcagtgaggcaccgcgaaattcaggcactgtacgtgggttcgaagatcctgcttactctgcccgaacagcatcgagcatcctactctcatctatcgtctaacccactgttcatgctcgagcagctgctgatgaacatgaaagtggactgggcaaccgtcgctgtgcagactcttcagcaactgctcgtggggcaagagatcggattcacgatggacgaagtcgatagtctactgtctagatacgcagaaaaagctctggacttcccctaccctcagagggagaaaagaagtgatagcgtgattcacctccaggagattgtgcaccaagcggcagaccccgagacccttccgaggtctccctccgctgaattcagtcccgcggcaccacccggcatctcctccatccatagcccttccctgagagagaggtcttttcctcccacacagccgagccaggaattcgtccctcccgccacaccacctgccagacaccagtgggtccccgatgagaccgagtcgatctgcatggtttgttgtcgggagcacttcaccatgtttaacaggaggcatcactgcagacgatgcggccgcctagtttgctcaagctgttcgacgaaaaaaatggtagtagagggctgccgggagaacccagcccgcgtgtgcgatcagtgctattcttactgcaacaaagacgttcctgaagaaccaagcgaaaagcccgaggctcttgattccagtaaaaatgagtctcccccatatagttttgtcgtcagagtgcccaaggcggacgaagttgagtggatacttgatcttaaggaggaagagaacgaattggtgcgcagtgagttctattacgaacaagctcccagcgcctccctctgtattgccattttgaatctccatcgggatagcattgcatgtggccaccaattgatcgaacattgctgcagattgtcaaagggcctgaccaatcctgaggtggacgccggcctgctgacagacattatgaagcagttactattttcagctaaaatgatgttcgttaaggccggccagagccaagacttggcgctttgcgacagctacatctccaaagtcgacgtactcaacattttggtagctgcagcgtataggcacgtcccctcattggatcagatcctgcaacccgccgccgtgaccaggcttaggaaccagcttctggaagccgagtattatcagctaggagtcgaggtttctaccaaaactggtctcgatacgaccggagcatggcatgcttggggaatggcctgtctaaaggctggcaatcttacagctgcacgggaaaagttttcccgctgtctgaaacctccatttgatctaaatcagctgaaccacggttcgagacttgtccaggacgtagttgaatacctagaatcaacagtccggcccttcgtcagtctgcaggatgatgactacttcgctactctgagagagctcgaagccactttaaggacccagagtctgagcctagctgtcattcccgagggaaagattatgaataacacttactatcaagaatgtctattctatctgcataactattctaccaacctggcgataatctccttttacgtccggcactcctgccttcgcgaagccctgcttcacctgttgaacaaagagtctcctcccgaggtgttcattgaaggcatctttcagcccagttataagtccggcaagctccacaccctggagaacctgttagagagtatcgatcccacccttgagtcctggggtaagtacttaatagcagcctgccagcacttacagaaaaagaactactaccatatactgtatgagctgcaacagtttatgaaggaccaagtgagagctgcgatgacctgtatcaggttcttctcccacaaagccaagtcatatacagagctgggagagaaactcagctggctgctaaaagcgaaggatcacctaaaaatttatctgcaggaaacctcccggtctagcgggaggaaaaagactacctttttcaggaaaaaaatgactgccgctgatgtctcaagacacatgaatactctgcagttgcagatggaggtgaccaggttcctgcacagatgcgaatctgctggaacgagccagattaccacccttcctttaccaaccctgtttggaaataaccacatgaagatggatgtggcttgtaaagtaatgctcggcggtaaaaatgttgaggatggatttgggatagcctttcgcgtgctccaagatttccagctggatgctgcaatgacttattgtagggccgcaagacagctggttgagaaggaaaagtacagtgagattcaacaattgttgaaatgtgtgtctgagtcgggtatggccgcgaagtccgacggcgacacaattctcctgaattgcctggaagcattcaagcgcataccaccacaggagttagagggtctcattcaagcaattcataatgacgataacaaagtgagagcctacctgatctgctgcaaactgaggtctgcctatctgatcgcagtgaagcaggaacacagccgagccacagctctggtgcaacaagtgcagcaagctgccaagagtagcggcgacgcggtagtccaagacatttgtgctcaatggctcttaacttcacatccgagaggagctcatgggccaggtagcagaaagtag

SEQ ID NO: 212524 - DNA, 7557 bp, Artificial Sequence
  Description of Artificial Sequence: Synthetic coding sequence
atgaaccaccccttcggcaaggaggaggccgccagccagaagcagctctttggttttttctgcgaatgcttgagacgcggcgagtgggagctagcacaggcatgcgtacctcagctgcaggaggggcagggtgacattcccaagcgcgtggaagacatcctccaagccctcgttgtatgccctaatcttctgcggtgtgggcaggacatcaatccccagcgcgtcgcctgggtgtggctcctggtcctcgagaagtggctggctagggagaagaaactattaccggtcgttttcaggagaaagttggagtttttgctgctcagtgaagacctgcagggcgatatccctgagaacatcttggaagagctatacgagactctgacacagggcgcagtgggccatgttccagatggcaatccccgtagagagagctggaccccacggttgtctagcgaggccgttagcgtgctttgggacctgctgagacagagtccacagccggcacaagccctgcttgagctcttattggaggaagacgatggaaccgggctatgccactggccactgcagaacgccctcgtcgatctgatcaggaaagccctgcgcactctgcgttgccccgccgagccccttggcgtcgaactgcacttactctgcgaggagttgcttgaggcctgtaggactgagggcagtccgctgagggaggagcggttgctttcgtgcctgcttcataaagcctcacggggactcctcagcttgtatggacacacgtacgctgagaaggttactgagaagcctccaagggccactgcctctggcaaagtaagtcctgatcacctggatcctgagagagctatgttggctctgttcagcaatcctaacccagccgaggcatggaaggtggcttacttttattgtctgtcaaacaacaaacactttttagaacagattctggtgacagcactgaccctcctaaaagaggaggacttcccaaaccttggctgcctgcttgaccgggagttccggccactgagttgcctgctcgtgctgctgggatggacccactgccagtccttggagtccgccaagcggcttctccagactctgcacaggactcagggcccagggtgtgacgagctgctgagggatgcgtgcgatggcctctgggcccacttggaggtgctggagtggtgcatccagcagagttccaaccccatcccaaagagggatctcctgtaccatctgcatggcggagattcccactcagtgctatatacattgcatcatctcaccaacctgcccgcactacgcgaagaagatgtcttgaagttattacagaaggtacctgcgaaagaccctcagcaggaaccggacgctgtggacgctcccgttccagagcacctttcccagtgccagaatctgaccctgtatcaaggtttttgcgctatgaaatatgctatttatgcactgtgcgtgaattcccatcagcacagtcagtgtcaggactgtaaggacagcttaagcgaggacttggcgtccgcgacagagcctgctaacgactcgctatcctccccaggcgcggcaaacctgttttccacctacttggcaagatgtcagcagtacctgtgttcaatccccgattcactctgtttggagctgttagagaatattttttctctgctccttatcacttctgcagatctgcatccggaaccacatcttcccgaagattacgccgaggacgatgacatagaaggcaagtcgccttcgggactcaggtccccttcggaatcaccacagcacatcgcacatcctgaacgcaaatcagaaagaggatctctcggcgtgccaaagacgcttgcttatactatgcctagccacgttaaagccgagccaaaagacagctacccaggccctcacagacacagcttccttgacctgaaacatttcactagtggcatctctggatttctggctgacgaatttgcgatcggcgccttcctccgcctgttgcaagagcagttagatgagattagctccagaagccctcctgagaagcctaaacaggagagccaatcctgctccggcagtcgagatggcctgcaaagtcgactgcacaggctgtctaaggtggtctctgaggctcaatggagacacaaggtggtgacatccaatcatcggtctgaggaacaaccttctaggcgataccagccagctactcgtcacccatctcttcggcgagggagacgcacgcggcgatctcaggctgatgggagggatagggggtccaaccccagcctagagtcaacatcatctgagctgagcacatctacctctgagggctcgctgagcgctatgtctggcaggaacgagcttcactcccgcctgcatccccatcctcaaagctctctcataccaatgatgttcagtcccccggagagtctgctggcctcttgcattctgcgagggaactttgcagaggcccatcaggtgctgttcaccttcaacctcaagagtagtccctcatccggagagttaatgtttatggagcggtaccaggaggtgatccaagagctggcacaggttgagcacaagatcgaaaaccagaatagtgacgccggatccagcaccattagaagaaccggttcaggacggagcactctccaggcgattggatcagcggcagctgctgggatggtgttctatagtatatctgacgtgacagacaagttgctgaatacgtcaggagaccccattcctatgctgcaggaggatttttggataagcaccgctttggtggagcctaccgcgccactgagagaagtcctggaggatctgtccccacctgccatggcagcctttgatcttgcttgcagtcaatgccagctgtggaagacctgcaagcagctgctcgagacagccgagcgaaggctgaatagctctctcgagcggagaggaagaagaatagaccacgtactgctaaatgctgatgggatacggggcttccctgtggtgttgcaacagattagtaagtccctgaattatctcttaatgagtgcctcccagacaaagagcgaatcagtcgaggagaaagggggtggaccccccagatgtagtattacagaactgttgcagatgtgctggccctccctctccgaggattgtgtagcaagccataccacccttagccagcaactggaccaggtgctacaaagcttgagggaggcattggaactgcctgagcctagaacccctcctctgtcctctctggtggagcaggccgcccagaaggccccagaggccgaagctcaccccgtgcagatccaaacccagttgttgcagaagaacctaggaaagcaaaccccgtccggatcgaggcagatggattacctggggaccttctttagttactgctcaacgctggccgcagtactactccaatctttgtcatccgaaccggaccacgtcgaagtcaaagttggcaaccccttcgttctcttgcaacagtcatcttcacagctcgtgagccacctgctgtttgaaaggcaggttccccctgaaaggctcgccgccctgttggcacaggagaacctgagcttatctgttccacaggtcatcgtgagctgttgttgtgaacccttggctctctgttcgtctcgtcaaagccagcaaacatctagtctgctcacaagacttgggactctggctcagcttcatgcttctcattgccttgatgacctgccactttccacaccatccagtccaagaactacagagaatccaactttagagcgaaagccttactctagccccagagatagctccctgccagcgctgacctctagcgccctcgccttcttgaagtcacgctccaagttgctcgctaccgtggcatgtctcggggctagtcccagattgaaagtgtcaaaacctagcctatcatggaaagaactgcgcggccgcagggaagtccccctcgctgctgagcaggtggctagagaatgtgagaggctgcttgaacagtttcccctgtttgaggccttcttgctggccgcctgggagccccttaggggaagtttgcagcagggacagagccttgctgtgaacctgtgtggttgggcttcactctctacagtgctgttgggactccactcccctattgccctagacgtgcttagcgaagccttcgaagagagcctagttgcgagggattggtccagggcactgcagctcacggaagtgtacggacgagacgtagacgatctctcaagcatcaaggatgccgtgctgagttgtgccgtggcttgcgataaggagggatggcagtatctgtttcctgtaaaagatgcatctctcaggagccgtctcgctctgcaattcgtagaccgatggccgctggagagttgcctcgagatactggcttattgcatctccgataccgctgtgcaggaggggctgaagtgcgagctgcaaagaaagctggcggaactgcaagtctatcagaagattctcggtctccaatctcctcccgtttggtgcgactggcaaaccctccgctcttgttgcgtggaggatccctctaccgtcatgaacatgattcttgaggctcaggaatatgagctttgcgaagagtggggctgcctttatccaataccacgggaacatctcattagcctgcaccagaaacatcttctgcacctccttgagcgtagagaccacgataaggcactccaattgttacggcggataccagatcccacaatgtgtcttgaggtgaccgagcaaagcttggaccagcacactagtctagcgacttcacacttcttggcgaattatctgaccacccatttctacggtcagctcaccgccgtacgtcatcgggagatacaggcgctgtatgtgggctctaagatcctgctgaccctgccagaacagcaccgcgcctcatacagtcacctaagcagcaaccccctcttcatgttagagcagctgctgatgaatatgaaggtggattgggcgactgtcgctgtgcagacccttcagcagcttcttgttggccaagaaatcggctttactatggatgaagtggactcattacttagccgatatgctgagaaggctctcgattttccctacccccagcgggaaaaacgctccgactcagtgatccatctgcaggaaatagtgcaccaggcagccgacccagaaactctacccaggagcccctcagcagagttctctcccgcagcccctccagggatcagcagcatccacagcccctccctccgggagaggtcttttccacctacacaaccaagccaagaatttgtgcctccagccacgccgcccgcccgacatcagtgggtccctgacgaaaccgagtctatatgtatggtctgctgccgtgagcattttaccatgttcaatcgaagacaccactgtagacggtgcggccgcctcgtctgcagctcatgttctaccaagaagatggtggtcgagggctgccgcgaaaaccccgcacgcgtatgcgaccagtgctatagctactgcaacaaggatgttcctgaggaaccttccgagaaacctgaggcactcgactcatctaagaatgaatctcccccctattctttcgtggtgagggtgcctaaggccgacgaggttgagtggatcttggacttgaaggaggaggaaaatgaactggtaaggtccgagttctactatgaacaggctccttcggcctctctttgtatcgcgatacttaacctgcatcgggacagcatcgcctgcggccaccagctcatcgaacattgttgtaggctaagtaaagggctgactaaccccgaagtggatgctggtctccttaccgacattatgaagcagctgttgttttcagccaaaatgatgtttgtgaaggctgggcagtctcaggatctggccctctgcgattcctacatcagcaaagtggacgtgctgaacatcctcgtcgctgcggcctatcggcacgtgccctcccttgaccagattttacagcccgctgctgtcactagattgcgtaatcagcttttggaagccgaatattaccagctgggggttgaggtgtctaccaaaaccggcctggataccactggcgcttggcatgcctgggggatggcatgcctgaaggcaggaaatctgacagccgccagagaaaagttcagccgatgtctgaagcctcccttcgatctgaatcaattaaatcacgggagccggctggtgcaagacgtagtggagtacttggagtcaacggtcagacccttcgtttctctgcaggatgatgattatttcgccaccctaagggagctggaagcaactctcagaactcaaagtctatccctagctgtgatccctgaaggtaagattatgaacaatacgtattatcaggagtgcctgttctatctccacaactacagtaccaaccttgcaatcatttctttttacgtgcggcacagttgcttgagggaggccctactgcacttgctgaataaggagtcaccacctgaagtattcattgagggcatatttcaaccttcctacaaaagtggcaagttacatacacttgagaaccttctagagagtatcgaccctaccctggagagctggggaaagtatctcatcgcagcttgccagcatctccagaagaagaactattatcatatcctgtatgagcttcaacagttcatgaaagaccaggtccgcgccgccatgacatgtatcaggttcttttcgcacaaggcaaagagctacactgaattgggcgaaaagctgagttggctattgaaagcaaaggatcacttgaaaatatatttacaggagaccagccgatccagtggaagaaaaaaaaccacattcttccggaagaaaatgacagccgcagatgtctcacggcacatgaacacccttcagttacagatggaggttacccgtttcttgcaccgatgcgagtctgctggcacatcacagataaccaccctgccactccctacacttttcggaaacaaccacatgaagatggacgtggcgtgtaaagtcatgctaggcggaaaaaacgtagaggatgggtttggtatcgctttccgagtgctgcaggacttccaactcgacgctgctatgacatactgtagagctgcaaggcagctggtggagaaggagaagtattcagaaatccagcagcttctgaagtgcgtctcagaaagtgggatggccgccaaatctgacggcgacacaattttattaaactgcctcgaggcgttcaagcgaattccacctcaggagctcgagggtctaattcaggccattcataacgacgacaacaaagtgagggcttatctgatatgctgtaaactgagatccgcatacttgatcgccgtgaaacaggaacacagtagagccaccgcccttgttcagcaagtgcagcaggcagccaagtcgtctggtgacgccgtggtgcaagacatctgcgcccaatggctgcttactagtcatcctagaggcgcacatggtccaggcagtcgaaagtag

SEQ ID NO: 212525 - DNA, 1119 bp, Artificial Sequence
  Description of Artificial Sequence: Synthetic coding sequence
atgcagaccagcgagcgggagggcagcggccccgagctgagcccctcagtgatgccagaagccccactggagagtcccccattccctaccaagtctcctgcctttgatctcttcaatctggttctgagctacaagcgcttagagatatatctggagcctctgaaagacgccggtgcctggtatagcgtaggcgcactgatgatcagcgtccccgccctgttaggctaccttcaggaagtatgcagagctaggctgccagattccgagcttatgcggaggaaatatcattctgtgaggcaggaagacctccaacgagggagactatctcgcccagaggctgtggcggaagtcaaaagctttctcattcagctggaggcttttttgtctcggctgtgttgtacgtgtgaggcggcctaccgtgtcttgcactgggaaaatccagtggtgtcgtcacagttctacggagccttactgggaacagtatgcatgctttacttactgccactgtgttgggtgctgacactgttgaacagcacactcttcctcggcaacgtggagtttttcagagtggtgtcggagtacagggcctcattgcaacagcgcatgaaccctaagcaggaagagcacgccttcgagagtccgccacccccagacgtgggcgggaaggatggcctgatggactctaccccagctcttaccccaacagaggacctgactccgggtagtgtggaggaagctgaagaagccgagccagacgaggagttcaaggatgcgatcgaagaggatgacgaaggtgcgccttgcccagcagaagacgaactggctttacaggacaacggctttctctcaaagaatgaggtcctgcgtagcaaagtcagccggttgacagaacgactcagaaaacggtaccctacaaataactttggtaactgcactgggtgtagcgcgacatttagcgtactgaaaaaaagaagaagctgctctaactgtggaaactctttctgctcacgatgctgttccttcaaagtgccgaagagttcaatgggggcaacagcccccgaggcccagagagagacagttttcgtgtgcgcctcctgcaatcagacattatctaagtag

SEQ ID NO: 212526 - DNA, 1251 bp, Artificial Sequence
  Description of Artificial Sequence: Synthetic coding sequence
atgcagaccagcgagcgggagggcagcggccccgagctgagcccctcagtcatgcccgaagctccccttgagagcccccctttccctacaaagagtccggctttcgacctgttcaatttggtccttagctataagagactggagatctacctggagcccctgaaagacgcaggcgatggggtgagatacctgctccgctggcagatgccactttgttctctactgacttgcttggggctgaacgttctcttcctgaccctgaacgaaggagcgtggtatagcgtcggcgcactgatgatctccgtcccagctcttctcggctacttacaggaggtgtgccgcgcaagactgccagatagcgaattaatgcggaggaaataccattctgtgaggcaagaggacctgcaaaggggccgtttgtcccggcccgaggccgtcgccgaggtgaaatctttcctgatccaacttgaggcattcttaagccggttgtgttgtacatgcgaggccgcctacagagtcctccattgggaaaatccggttgtcagtagccagttttacggagccctcctgggtactgtttgcatgttatacctgctcccgctctgttgggtcctaacattgctgaacagcactctcttcctcggaaatgttgagtttttcagggttgtgtctgaatatagggccagtctgcagcagagaatgaacccaaagcaggaggagcacgcctttgagagtccccctcccccagatgtgggcgggaaggatggtctcatggacagcactcctgctctgacccccaccgaaagcctgtccagtcaagacttgactcccgggtccgtggaggaagcagaagaggcagagcctgacgaggagttcaaagacgcaatcgaggagactcatctcgtcgtgctcgaggacgacgaaggcgctccttgcccagcagaggacgaattagcgttgcaggataacggcttcctgtctaaaaacgaggtcctgcggtctaaagtctccagactgacggagcggctcagaaaacgctacccaacaaacaacttcgggaactgcacagggtgttctgccactttctccgtgttgaaaaaacgaaggtcgtgttcaaactgtggaaactcgttctgctcccgatgctgcagctttaaggttcctaaatcctctatgggcgctacagcacccgaggcgcagagggagacagtgtttgtgtgcgcatcctgcaaccaaactctgtcaaaatag

SEQ ID NO: 212527 - DNA, 957 bp, Artificial Sequence
  Description of Artificial Sequence: Synthetic coding sequence
atgcagaccagcgagcgggagggcagcggccccgagctgagccccagtgtgatgcctgaggcccccctcgaatcgccaccgtttcccaccaagtctccggccttcgatctgttcaatctagtcctctcatacaagagacttgaaatctatctggagccactcaaagacgccggagacggcgttcgttatctgttgtcgctcatccaactagaagcattcctgagcaggttgtgctgcacttgcgaagccgcttaccgggtgctccactgggaaaatcccgtggtgagttcccagttttacggcgccttgctgggaacagtgtgtatgctgtaccttctccccctgtgctgggtcctgacgcttctgaacagcactctcttcctcggtaatgttgagttctttcgggtggtgtccgagtaccgggcatctttgcagcagagaatgaatcccaagcaagaagagcacgctttcgaaagtccaccacccccggacgtcggcggtaaggatggcctgatggatagcacgccagctctcacacctacagaggacctcactcccggttccgttgaggaggcagaagaagccgagcctgatgaggaattcaaggacgccattgaggaggatgacgagggggcgccctgcccagctgaggacgagttagctctacaagataatggttttctttcgaaaaacgaggtactgcggtctaaagtctcccgtctaaccgagaggctaagaaagagatatccaacaaataacttcggtaactgcacgggctgtagcgcaaccttttctgtgcttaagaagcgcagaagctgcagcaactgcggtaatagcttttgtagcaggtgctgtagcttcaaagtccctaagagttctatgggcgcaacagctcctgaagcccagcgggagactgtcttcgtatgtgcttcttgcaatcagaccctaagcaaatag

SEQ ID NO: 212528 - DNA, 1215 bp, Artificial Sequence
  Description of Artificial Sequence: Synthetic coding sequence
atgcagaccagcgagcgggagggcagcggccccgagctgagccccagtgtgatgcccgaagcccccctcgagagtcccccttttcctacaaagtccccagcatttgacctgttcaacctggttttgtcatacaaacgcctggaaatataccttgagccgctgaaagatgctggagacggtgtgcgttatttgctgagatggcagatgcctctttgcagccttctaacttgcctgggactcaatgtcctgtttctcacactgaacgaaggcgcatggtactccgtcggagctctgatgatctccgttcccgccctgctgggctatctgcaggaagtgtgccgggccaggttgcccgactcggagctcatgagacgaaagtaccattcagttcggcaggaagacctgcagaggggccgactgtcacgccctgaggccgtcgccgaggtgaagtcatttctcatccagctggaagcctttctctccagactgtgctgtacatgtgaagccgcctacagggttctgcactgggagaatcccgttgtgagctctcagttttacggagcgttactgggcactgtgtgtatgctgtacctactccctctgtgttgggttctcacactgctcaactctacattgtttctgggcaatgtggagttttttcgtgtggtgtcagagtacagggcttccctgcagcagaggatgaatcccaaacaggaggagcatgctttcgagtcaccgcctcctccagacgtcggcgggaaggatgggctcatggattccacgccagcccttactccaaccgaagacctcactcctggcagcgtggaggaagccgaggaggccgagcctgatgaggagtttaaagatgctatcgaggaagatgacgaaggagccccgtgcccagcagaggatgagcttgccttacaggacaatggattcttaagcaaaaatgaagtgcttagatcaaaggtgagcagactcacagaacgcttgcggaaacggtaccccaccaacaacttcggaaattgtactggatgttcagcaactttcagcgtgcttaaaaaacgaagatcctgttccaactgtggcaactctttctgttccaggtgctgctctttcaaggtaccaaagagttcgatgggggctaccgcacctgaagcccaacgggagactgttttcgtttgcgcttcatgtaaccagacactttctaagtag

SEQ ID NO: 212529 - DNA, 936 bp, Artificial Sequence
  Description of Artificial Sequence: Synthetic coding sequence
atgatcagcgtgcccgccctgctgggctacctgcaggaggtgtgcagagcacggctccccgactccgaattgatgcgccggaaatatcatagtgtccggcaggaggatctgcagcgtggacgactgagtcgaccggaggcagtagccgaggtgaagagttttctgattcagctcgaggcatttctgtcaagattgtgctgcacctgtgaggccgcatatcgtgttctgcattgggaaaacccggtggtctcttctcaattttacggagccctcctggggaccgtatgcatgctttacttactgcccctctgctgggttctgacactcctgaattctaccttattccttggcaatgtcgaatttttcagggtggtatccgagtatcgggccagccttcaacagagaatgaatcctaagcaggaagaacacgcctttgaatccccgcctccccccgatgtgggagggaaggacggcctgatggattcaactcccgccctcaccccgaccgaatcgctatcctcccaagacctgactcctggatctgtggaggaggccgaagaggcagaacctgacgaagaattcaaggacgccatagaggaggacgatgaaggcgctccctgcccagctgaagatgagctggcacttcaagataacggatttctgtcaaaaaatgaggtgctccgaagtaaggtctcacggttgacggagaggctacgcaaaaggtacccaaccaataattttggtaactgtactggctgcagtgccacatttagtgttctgaagaaacgccggtcatgcagtaattgcggaaattccttctgtagccggtgctgcagtttcaaagtacctaagagtagcatgggcgcaaccgcgccagaagcccagagggagacagtgtttgtgtgcgcaagctgtaatcagacgctgtctaaatag

SEQ ID NO: 212530 - DNA, 861 bp, Artificial Sequence
  Description of Artificial Sequence: Synthetic coding sequence
atgcagaccagcgagcgggagggcagcggccccgagctgagccccagtgtaatgcccgaagcccccctggagagtcctccatttcctaccaaatcaccagcattcgatctttttaacctggtcctgtcctacaaacggctcgaaatttatctggagccactaaaggacgccggcgatggtgtcagatacttactgaggttctatggagcgcttctaggtacagtttgtatgctttatcttctcccgctgtgctgggtgttgaccttgttgaattccaccttgttcctgggcaacgtagagttctttcgagtggtgtcggaataccgcgccagtttgcaacaaagaatgaacccaaaacaggaagagcacgcattcgaatcccccccccctcctgacgttggcggtaaagacggcctgatggattctacacctgcactaactcctaccgaagacctgacgcccggcagcgttgaagaggccgaggaagccgaacctgacgaagaattcaaagacgccatagaagaggacgatgagggtgctccatgccccgcagaagacgagctcgcgctccaagataatggcttcctgagcaagaatgaagtgttacgcagtaaggtgtctcgtctgactgaacgtcttagaaaacggtacccaacaaataactttggcaattgtactgggtgcagtgcaacgttttcagtgctaaagaagagaaggtcttgttctaattgcggcaattccttctgttcccggtgttgtagcttcaaagtccccaaaagctctatgggtgctactgccccagaggcacaaagagagaccgtgttcgtgtgcgcttcttgcaaccagacactgagcaaatag

SEQ ID NO: 212531 - DNA, 1236 bp, Artificial Sequence
  Description of Artificial Sequence: Synthetic coding sequence
atgcagaccagcgagcgggagggcagcggccccgagctgagccccagcgtaatgcctgaggccccgctggagtcccctcctttcccaactaagagccccgcatttgacctctttaacttggtgctctcttacaagagactcgagatctacttagagccactcaaagatgcaggcgacggcgtgcgctaccttcttcggtggcaaatgcctctctgctcacttctaacttgcctcggtctcaatgtcctgttcttaacgctgaatgagggcgcatggtatagtgtaggggctctgatgatttctgtccccgccttgctgggatatctccaggaggtatgtagggcgagactccctgatagcgagttaatgcgtcggaagtatcacagcgtgaggcaggaagatctgcaaagaggaagactcagtcggcctgaggctgtcgcggaggtcaaaagcttcctgattcagttagaggcattcctctcacgtctgtgctgcacttgcgaagccgcttacagggttctgcactgggagaacccagtggtgagcagccagttttacggcgcattgttggggactgtatgcatgctatacctccttcctctctgctgggtgctgaccctgttaaacagcaccttgtttttgggaaacgtagagttcttccgggttgtttccgagtatcgggcaagcctgcaacagcggatgaacccaaagcaggaagagcatgcctttgagtccccaccgccaccagacgtgggaggaaaggacggactgatggactcaacaccggcccttacacctacagaagacttgacaccaggctcagtcgaagaggcagaagaagcagagcccgatgaggaatttaaggacgcaatcgaagaaacgcatctggtagtgctggaagatgacgaaggcgctccctgccccgccgaggacgagctcgcacttcaagacaatggcttcctatccaagaatgaggtgctgaggtcaaaagtgtcccggcttacagagcgtttaagaaagcgttaccctacgaacaacttcggtaattgcaccggctgttctgctacttttagtgtgctgaagaagaggagaagttgctcaaactgcggaaatagcttttgttcccgatgttgttccttcaaggtgcccaaaagttccatgggagccacggctccagaagcccagagagagacagtgtttgtgtgcgccagctgcaatcaaaccttgtcaaagtag

SEQ ID NO: 212532 - DNA, 1185 bp, Artificial Sequence
  Description of Artificial Sequence: Synthetic coding sequence
ctggagagcccccccttccccaccaagagccccgccttcgacctgttcaatcttgttctgagctataaaagactcgaaatttatctggagcctctgaaggacgcaggagatggagttcgctatctattgaggtggcaaatgccgctttgctcattactgacgtgcctcggcctgaatgtgttgttcttgaccctgaatgagggggcttggtactccgtgggcgccttgatgattagcgttccagcactgctcggctatctgcaagaagtgtgccgtgccaggttgcccgattccgaactcatgcgcagaaagtatcactccgtccggcaagaagatcttcagagaggtcgactttctagaccagaggcggtggcagaggtaaaatctttcttaatccaactggaagctttcttaagtagactgtgctgtacctgcgaagcagcttaccgagtcctgcactgggagaatcccgttgtaagcagtcagttctacggggccctactgggtaccgtgtgtatgctctacctcctgcctctttgctgggttttaaccctactgaattcgactcttttcctaggcaatgtggagttctttagagttgtctccgagtatagggcttctttacaacagcgaatgaaccctaaacaggaagaacacgcttttgagagcccacctcccccggacgtcggcggaaaggacggtctgatggattccacgcccgcactgacacctaccgagtcactctctagtcaagacctcactcccggctcggtggaagaagctgaggaagccgagccagatgaagagttcaaggacgccattgaggaaacccacctggttgtgctggaggatgacgagggcgctccctgccccgccgaagacgagctggcgctgcaggacaatgggttcctttccaagaacgaggtgttgcgctcaaaagtcagtcggctgactgaaaggttacgtaagcggtaccctacaaacaatttcggtaattgtacaggttgttctgctaccttctcagtgctgaagaaaaggagaagttgctccaactgcggtaatagtttctgtagccgatgctgttcatttaaagtacctaagtcctcaatgggcgccacggcccccgaagcccagcgtgagacggtatttgtgtgtgcgtcttgcaaccaaaccctctccaagtag

SEQ ID NO: 212533 - DNA, 1047 bp, Artificial Sequence
  Description of Artificial Sequence: Synthetic coding sequence
atgcagaccagcgagcgggagggcagcggccccgagctgagcccctcagtgatgcctgaggctccactcgaaagtcccccctttcctactaagtcccccgcatttgacttgtttaatctggtcctgtcctacaagagactggagatctacctggagccccttaaagatgccggcgatggagtgaggtacctgttgcgatggcagatgcccctttgctcgcttctcacctgcctgggcctgaacgtgcttttccttacattgaacgagggcgcatggtattccgtcggcgcgctcatgatctccgttcccgccctgcttgggtacctgcaagaggtatgtagagcccgcttaccagactccgaactgatgaggagaaagtatcatagcgtgcgtcaggaagatctgcagagaggtcggctgtcaagacctgaggccgtcgcagaagtgaaatcctttcttatccagttggaggctttcctcagcaggttatgctgcacctgcgaggcagcctacagagtgctacactgggagaaccccgtggtgtcaagccagttctatggtgcactgttaggtactgtgtgcatgctatatctgctaccgctttgttgggtcctcactctgctgaatagtacgctctttcttggcaacgtggagttctttagagttgtcagcgaataccgcgcaagcctgcagcagagaatgaatcccaagcaggaggagcatgcattcgagagcccccctccgccggacgtgggcggcaaggatggcttgatggactccaccccagcactgacacctaccgaagatcttacccctggcagcgtagaggaagcggaggaggcagagccagacgaggagttcaaagatgccattgaggaggacgacgagggggctccctgtcccgcggaagacgaattggctctacaggataacggatttctgtctaagaacgaagtgctgcggtccaaggtctctcggctaacagagcgcctgagaaagcgttatccgacaaataattttggtgttactggggcgggctcgtcgtag

SEQ ID NO: 212534 - DNA, 2664 bp, Artificial Sequence
  Description of Artificial Sequence: Synthetic coding sequence
atgatgaaccggttccggaagtggctgtacaagcccaagcggagcgatcctcagctgcttgccaggttctattacgccgatgaggagctgaatcaggtcgctgcagagctcgattcgcttgatgggcgaaaggacccccagagatgcaccctgctggtttcccagtttcgatcttgtcaggataatgtacttaacattatcaatcagattatggatgaatgtatcccgcaagatagagctccgcgtgacttctgcgtgaagtttcccgaagagatacggcacgataacctggccggccagctgtggttcggagctgagtgtcttgcggctgggagcatcatcatgaacagagagttggaatctatggcgatgcgccctttggcaaaagagctcacccgcagtctggaggacgttagaggggctcttcgggaccaggccttgcgtgatcttaatacatatactgagaagatgagagaggcgctccggcattttgacgtactcttcgctgagtttgaattgtcttacgtaagcgccatggtgcccgtgaagagccctcgagaatactacgtccagcaggaggtgatcgtgctgttctgcgagactgtggaacgagcactggattttggctacctcacccaggacatgatcgatgattatgagccagcccttatgttttctatcccacgactagcaattgtctgtggactcgtggtctacgcagatggccctctcaacctcgatcggaaggttgaggacatgagcgaactgtttcgaccttttcataccctgctcaggaagatacgagacttgttgcagacactgactgaggaggagctacacactctggagagaaacctgtgtatctcgcaggacgttgagttcccaatccgtgccgatgtgcagggccctgccgccctcgcacctgctttgagtgcccctttgccgccagagggaccgttatctgccaaagccaaggatccagatgctgagctagcgtgctctatgcagtacgatgaccaggagctggaacaactgagtcgcatggtgcaccgggctggagacgagatgtccagccttctttcaccacctattgcatgccagtcacccgctcatcggcccggggctgagggcagccctggcggagaggcttctcctggccgccccaggttacgttctgggtccgacgaagaggaaagagtgttctttatggacgatgtggaaggtacggcagaagctttggccaggcccgagtcccctgccgggccgtttggctgggcagggtcaacctgggcagacccgcaggagaagggacagggaggccccggtggagcagccggaatatctctgcccgccagtgagaaggaggaagacctctctaacaataatctggaggctgagggtaccgatggggcatccctggctgggacctctagttgtagctgtctcgacagccggctgcacctggatggatgggaagtcggcgccgacgatgcggagacagccgaaatgatcgctcaccgcaccggtggcatgaagctctccgctaccgttatcttcaacccaaagagtcctacttccctggatagcgccgtagccacccaagaggcagcctctgaacccgtggcagaaggtatggatggggggccgcataaattgtcaactggtgcaactaattgcctcctgcattcgtgcgtgtgttgcggttcctgtggcgacagcagagaggatgttgtcgagcggctcagggaaaagtgctcccccgggggtgttattggcgcttcctacgccgctggcctcgccaaggccagcgatagggcacctgagcgccaggaggaagccccacccccttctgaggatgcatctaacggacgtgaacccaaggcacccacctcagacaaatgtctcccgcataccagcggcagccaggtggatacagcctctggattgcagggcgaggctggtgtggccggacaacaggagcccgaggcccgcgagcttcacgctggctctccatcagctcacgaggctcctcaggctttatctggcagctcaagctccacagcggggtcttgtagtagcgataagatgggccccgaagccgcccccgccgctactcacgcagctccacaagctactagagagaagatcagaagtcgattccatggcagtcatgatttgattcaccggctttttgtgtgtatatctggggtcgctgatcagttacagactaattacgcctctgatctgcgaagcatcttgaagactctcttcgaggtaatggccacgaaaccagaaacagatgacaaagagaagctcagaaaggttactcagaccttgaggagtgccgctctggaggactgtgccctgtgtcaggaaaccctcagtagctctgaactggcagcaaaaacgagagacggggacttcgaggatcccccagaatgggtacctgatgaggcctgcgggttctgcaccgcctgcaaggcccccttcacagtgatacggagaaagcaccattgcagatcttgcggcaagatcttttgctcccggtgcagtagtcatagtgcacctcttccgcgttatgggcaggtcaaacccgtgcgtgtttgcactcactgttatatgttccatgtgacacctttctactcagacaaggccggactgtag

SEQ ID NO: 212535 - DNA, 2574 bp, Artificial Sequence
  Description of Artificial Sequence: Synthetic coding sequence
atgatgaaccggttccggaagtggctgtacaagcccaagcggagcgacccccaattgctagcacgcttctactatgcagatgaggaacttaatcaggtagccgctgaattggattctcttgatggccgtaaagaccctcaaaggtgtactctactggtctcgcagtttagaagctgtcaggataatgtgctcaacatcatcaaccaaattatggacgagtgtatcccccaggatcgggcccctcgggacttctgcgtaaagtttcctgaagaaattcggcacgataacttggccggacagctgtggttcggggcggagtgcctggcggctggatctatcatcatgaatagagaactggagagtatggcaatgcgacccttggccaaggagctcacaagaagtcttgaggatgttagaggagctctaagagatcaagcgctacgagatcttaacacctacacagagaaaatgagggaggccctgaggcattttgacgtgttgttcgcggagttcgaattgagttacgttagcgcaatggttcctgtcaagtctcctagggagtactacgtccagcaggaagtgatcgtgttattttgcgagaccgtcgagagtgggctcgttgtgtacgctgatgggcctctgaatctggacaggaaggttgaggacatgagtgagttatttagacctttccatacactactgaggaagattagggatctcctgcaaacactcactgaggaagagttgcacacactagagaggaacctctgtatcagccaggacgttgagtttccaatccgagccgacgttcaggggcccgccgcattagctcctgcattgtctgccccacttccgccagaagggcccctgagcgcaaaggccaaggatcccgacgctgagctcgcatgttctatgcagtacgacgaccaggagctcgaacaattgtcccgcatggtgcatcgagccggcgatgagatgtccagcctgctcagtcctcctatagcctgtcaatcacccgctcacagacccggcgccgaaggatcgccagggggcgaagcaagccctggccgacccaggttgcgcagtggctccgatgaggaggagagagtattctttatggatgatgtcgagggtacagcggaggctttggctaggccagaatctcccgcagggccatttggttgggcgggttcaacttgggccgacccacaagagaaaggtcagggggggcccgggggtgccgccggaatctcgcttccagccagtgagaaggaggaggacctctcaaataataacctggaggcggaaggtaccgatggtgcgagccttgcaggcactagctcctgttcttgtctcgactccaggctccatctcgacggctgggaagtgggcgccgacgacgcagagacagcagagatgattgcccacaggacaggtgggatgaaactctccgccaccgtcatttttaaccctaaatccccgacctcactcgattcagccgtggcgactcaggaggccgcctcagagccagtagcagagggtatggacggaggcccccacaagctgtcgacgggggcaaccaactgcctactccattcatgcgtgtgctgtggtagctgtggcgatagtagggaggacgtagtggaaaggttgcgggaaaagtgctcaccggggggagtgatcggggccagctatgctgctggcttagctaaggcttcggaccgcgcacctgaacggcaagaggaggctccccctccaagtgaagatgcctcaaatggcagggaaccgaaggccccgacaagtgacaagtgtctgcctcataccagcgggtcacaagtggacactgcctcaggtctgcaaggagaggctggggtcgctggtcaacaggaaccagaagcccgagaactacatgctgggagtcccagcgcgcatgaggcccctcaagccctgagtggatcgagttcttctactgcagggtcctgctctagtgacaaaatgggaccagaggctgcacctgctgccacgcacgctgctccacaggcaaccagagaaaaaattaggtcgcgcttccatgggtcccacgacctgatccaccggttattcgtatgtatttccggtgtggccgatcagctgcagaccaattatgcttccgacctcaggtccatcctgaagacgctgtttgaggttatggccaccaagcccgagacagacgacaaggaaaagttacgtaaggttacacagaccttacggtctgctgctctcgaggactgtgcgttatgtcaggaaacactgtcttcttccgagcttgccgcgaaaacccgggacggcgatttcgaagatccacctgagtgggtgcctgatgaggcctgtggattctgtacagcctgtaaggcaccattcaccgtgatccggcggaaacaccactgccggtcctgtggaaagatcttttgctcccgttgcagttcccatagtgctcctcttccccgatatggtcaagtaaagccagtcagggtatgcacccactgttacatgtttcatgttacacctttttattcggacaaggcgggcctctag

SEQ ID NO: 212536 - DNA, 2454 bp, Artificial Sequence
  Description of Artificial Sequence: Synthetic coding sequence
atggacgagtgcatcccccaggaccgggccccccgggacttctgcgttaagttcccagaggaaattcggcatgataaccttgcgggacagttgtggtttggagccgagtgcttggccgcgggcagtattatcatgaatagggaacttgagagcatggccatgcgcccactggccaaagagctcacacggagcctggaagatgtcaggggggctcttcgcgaccaagccttacgggacctcaacacctataccgagaaaatgagagaagcacttcggcattttgacgtgctgttcgccgaattcgagctgtcttatgtgtcagcgatggtacccgtcaaaagccctagagaatattacgtccagcaggaagtcatcgttctcttttgcgagacggtggagcgagcgctggactttgggtacctgacacaggacatgattgatgattacgaacccgccttaatgttcagtatccccaggctcgccatcgtgtgtggactggtggtctacgcagacggccctctgaatctggacaggaaagtggaagatatgtctgaactctttagaccgttccatacactgcttaggaagatccgcgacctgctgcagacccttacagaagaggaattacataccttggagcggaacttatgtatctcacaggacgtggaattccccattagggccgatgttcagggtcctgccgcgctagcccctgctctctccgcccccttgccacctgaaggaccgttatcagccaaagccaaggaccccgacgccgagctggcctgttccatgcagtatgatgaccaggagcttgaacagttgtccaggatggtccatagagctggggacgagatgtctagtttgctgtccccaccaatcgcctgccaatcaccagcccacagaccgggagccgaagggtcacccggcggtgaagcttccccaggacgcccccggttgcgctcaggctccgacgaggaggaacgggtattcttcatggatgacgttgagggtacagctgaggctctcgcccgccctgaatcaccagctggtcccttcggctgggcggggtctacgtgggccgacccccaggagaagggacagggaggccccggcggagctgctggtatctccctgcccgcgagcgaaaaggaagaggacctgtcaaacaataacctcgaggccgaggggacagatggagcgagcctggccgggacttcgagttgtagttgtttggacagccgcttgcacctggatgggtgggaagtgggagctgacgatgctgagactgcggaaatgattgcgcatcggacaggtgggatgaagctgtctgctacagtgatttttaaccccaagagtcccacttcactggattccgccgtggccacacaggaggccgcaagtgagccagttgctgaggggatggatggcgggcctcataaactgtctactggggcaacaaactgcctgctgcactcctgtgtctgctgcggatcctgcggcgatagccgagaggacgtcgtggagcgtttgagagaaaaatgttcccctggtggcgttattggggcctcctacgccgctggtctcgctaaggcgtcggatagagctcctgaaagacaggaggaagctccccctcctagcgaagacgcctccaacggcagagagccaaaagcgccgacaagtgataaatgcctgccccacacctccggctcacaagtggataccgcaagcgggcttcagggggaggccggtgtcgccgggcagcaagaacctgaggctagagagctgcatgctggatctcccagtgcccatgaagctccgcaggcactgtcgggatcctctagcagcacagccgggtcctgtagcagtgacaaaatgggccccgaggctgcccctgccgctacccacgcggctccccaggcaacccgagaaaagatccgctcccgattccacggcagccatgacctgattcaccgcttgtttgtatgcattagcggggtggccgatcagctgcagacaaactacgcatcagacttaaggtccatccttaagacactcttcgaggtgatggcaactaaacccgaaactgacgacaaagagaaactgcggaaggtgacacagaccctacgctctgccgcgctagaagattgcgcactatgtcaagagacactgtcgtcttccgagctggcagctaagacaagggacggagatttcgaggatccgcccgagtgggtcccagacgaagcctgtggtttttgcaccgcatgtaaagcacctttcaccgtgattcgacgaaaacatcactgccgatcctgtgggaagatattctgcagccgctgcagcagccacagcgccccgctcccccgctatgggcaggttaagccagtgcgggtttgcacacactgctatatgtttcatgtgaccccattctatagcgataaagctggtctgtag

SEQ ID NO: 212537 - DNA, 1212 bp, Artificial Sequence
  Description of Artificial Sequence: Synthetic coding sequence
atggagcccgccggcccctgcggcttctgccccgccggcgaggtgcagcctgctcggtatacctgtcctcggtgcaatgccccctattgctcattacgatgttatcgcactcacggaacctgcgctgagaacttctatagagatcaggtgcttggggagctgcggggctgttcagcacctccgtctagattagccagcgcccttagaagattaagacagcagcgggagaccgaagatgagcctggcgaggctggtctgagttcaggtccggctccagggggactatccgggctgtgggaaaggcttgctccaggggagaaagcggctttcgagcggctgctgagccggggggaggccggtcggctgctgccaccatggaggccgtggtggtggaacagaggcgcggggcctcagttgctggaagagcttgacaatgccccggggtccgatgcagccgagctggagttggcccccgctagaacgcctcctgattcagtcaaggacgccagcgcagccgaacctgcggccgctgagcgtgttctgggggatgtgcctggcgcctgtacccctgtggtcccgacaaggattcctgccatcgtctccctgagccggggacctgtgtcgcctctggtgaggtttcagctgccaaacgtgttgttcgcctacgcccacacgttggcactgtatcacggcggcgatgacgccctcctttctgatttttgcgccaccctcctgggagtaagtggcgccttgggagcccagcaagtgttcgcctctgcagaggaagccttacaggccgcggctcacgttctagaggccggtgagcacccaccaggtccattgggcacaagaggcgctatgcatgaggtggccagaatcctgctgggggaggggccaacaaaccagaaaggatatacgttggccgctctcggggatctcgcacaaaccctgggccgtgcgcgcaagcaggctgtcgctcgcgaggagagggatcacttgtatcgggccaggaagaagtgccagttcctactggcatggaccaacgagaacgaggctgcgctgacaccactcgctctagactgcgctcgggcccaccaagcacatgcagtggtcgctgaagaagttgccgccctaaccggcgaactcgaacggctgtggggaggcccggttcctcctgcccctcggactctaatagaggagctgccctcctag

SEQ ID NO: 212538 - DNA, 1683 bp, Artificial Sequence
  Description of Artificial Sequence: Synthetic coding sequence
atggccggcccccagcccctggccctgcagctggagcagctgctgaaccctaggccctctgaggccgaccccgaggctgacccagaggaggcgaccgcagctcgcgtgatcgatagatttgatgagggtgaggatggcgaaggggacttcctggtcgtagggagcatccggaagctcgctagcgcatcattgctcgacacagacaaacggtattgcggtaaaacaacatctcgtaaggcatggaacgaagaccactgggaacagaccctaccagggtcatcagacgaggagatcagcgatgaagaaggtagcggtgacgaggactctgagggcttgggactggaggagtacgatgaagatgatctcggagcggcggaagaacaggagtgcggtgatcaccgagagtcaaagaagtcccggtcacacagcgctaaaacaccgggcttcagtgtgcagagtatcagtgactttgaaaagttcacaaaaggcatggatgatctggggagctcggaggaagaagaggatgaggagtcaggcatggaagaaggagatgacgccgaagatagccagggcgagagtgaggaggaccgggccggcgacaggaatagtgaggacgatggggtggttatgacattttcatcagtcaaagtgtcagaggaggtcgagaaggggcgggccgtaaagaaccagatagccctctgggatcagctgctggagggcagaattaagctccagaaagccttgctgaccacaaaccagctgccccagccagatgtattcccgcttttcaaagacaagggcggccctgaattctcgtccgcccttaagaactcgcataaggcactgaaggctttattgaggtccctcgtcggactgcaggaagagctactgttccagtaccccgacaccaggtatctcgtggacggtacaaagccgaacgcaggaagcgaagagatatctagcgaggacgacgaactcgtcgaggagaagaagcaacagcggaggcgcgtgcctgcgaagcgtaaattggaaatggaggactacccatcatttatggcaaagcgattcgctgattttaccgtgtacagaaatagaactttacagaaatggcacgataaaacgaagctggcctcaggaaagctgggcaagggcttcggcgccttcgaaagatccattctaacacaaatagaccacatcctaatggataaggagagacttctgagaagaactcagaccaagcgctctgtttaccgggttttagggaagccagaacccgcagcgcagcctgttccagagagtctgcccggggaaccagagattctcccacaagcacccgcaaacgcccacctgaaagatttagacgaagaaatctttgatgatgacgatttctaccaccaattgctccgagaactcattgagaggaagacctccagtctagacccgaacgaccaagtggctatgggaaggcagtggctggccatccagaagctaagatccaaaatacacaagaaggttgacaggaaagccagtaagggccgtaaattaagatttcatgtcttatctaagctgctctcatttatggctcccatcgaccacacaacaatgaatgatgatgcgaggacagaattgtataggtccttgtttggacaacttcaccctcctgacgaaggccacggtgactag

SEQ ID NO: 212539 - DNA, 4134 bp, Artificial Sequence
  Description of Artificial Sequence: Synthetic coding sequence
atggacaccagcagcgtgggcggcctggagctgaccgaccagacccccgtccttttggggagcactgctatggccacgtccttgactaacgtggggaattcctttagcggtccggcaaatccacttgtaagccgatccaacaaattccagaactcttcagttgaagatgacgacgatgtggtctttattgagccagtgcagccaccccctccatcagtcccagtggtcgcagatcagcgaaccattaccttcacatccagtaaaaatgaagaactgcagggtaacgacagtaaaattacaccgtcgtcaaaagagctggcatcgcagaaagggtccgtcagcgaaactattgtgatcgacgacgaagaggacatggagacgaatcaggggcaggagaagaattcctctaatttcatcgaacggagaccgcccgaaaccaagaataggaccaatgacgtggactttagtacttcctcgttcagtcggtcgaaggtgaacgctggcatggggaattctgggatcaccaccgagcctgattccgaaattcagattgcgaatgtgactactctagagactggcgtcagtagcgtgaatgatgggcagttggagaacacagatggaagagatatgaatcttatgattacgcacgtcacctccttgcagaatacaaatctcggtgatgtgtcaaacggactgcagtccagcaacttcggtgtgaacattcaaacctataccccaagccttactagccagactaagaccggcgttggacctttcaatcccggccgcatgaacgtggctggcgacgtgttccagaacggggagtctgcgacgcatcacaaccctgactcttggataagtcagagcgctagtttcccaaggaatcagaaacagcccggtgtggatagcttgtccccagtggcaagtctgccgaaacaaatattccagccttctgtccagcaacaacccacaaaaccagtcaaagtaacctgcgccaactgcaaaaaaccactccagaagggtcaaaccgcctaccagaggaagggttcagcccacttgttttgctctaccacatgtctgagctcatttagtcacaaacccgcccccaaaaagctatgtgtgatgtgcaagaaggacattacaacaatgaaggggactatcgtagcccaggtggatagttcagaatcctttcaggagttctgcagcacctcctgtcttagtctgtacgaagacaagcaaaatccaaccaaaggggctttgaacaagagtaggtgcactatatgtgggaagttgactgagatcaggcatgaggtgtcattcaaaaacatgactcataaactgtgctctgaccattgtttcaaccggtataggatggccaatggcctaattatgaactgctgtgagcagtgcggagaatacctgccctccaaaggtgccggtaacaatgtgttggtaatcgacggccagcagaagcggttctgttgccagtcatgcgtctctgaatataaacaggtaggatcccatccttcattcttgaaagaggtgcgtgatcatatgcaggatagcttcctcatgcaaccagagaagtatggaaagctgaccacttgcacaggctgcaggacgcaatgcaggttttttgacatgacccagtgtatcgggcccaacggatatatggagccctattgctccacagcctgtatgaactctcacaaaacaaagtacgccaaatcccagtccttgggcataatctgccacttctgcaagcgcaatagcttgccacagtaccaggcgacaatgcccgacgggaagctctataatttttgcaattcctcctgtgttgctaaatttcaggccttgtccatgcagagtagccccaacggccaatttgtggctccaagtgacattcagctgaaatgcaactactgcaagaatagtttttgcagtaagccggagatcctagagtgggaaaacaaagtacaccaattttgtagtaagacgtgctctgacgactacaagaagctgcattgtatcgtgacttactgcgagtactgccaggaggaaaagaccctacatgagacggtcaacttctctggcgtgaaacgacccttctgtagtgagggctgtaaattgctgtacaagcaagattttgcgcgccgcttaggcctgagatgcgtgacttgtaactactgttcccagctttgcaagaaaggtgccacgaaagagcttgatggtgtggtgagggatttttgttcagaggactgttgcaagaagtttcaggattggtactacaaggctgcccgctgcgattgctgcaagagtcagggtactttgaaggagcgggtccagtggagaggggagatgaaacacttctgtgaccaacactgtctgttgaggttctattgtcagcaaaacgagcctaatatgaccactcagaagggaccggagaacttgcattatgaccagggctgtcagaccagtaggacgaaaatgactgggtcggccccacctccctcgcctactcccaataaggagatgaagaacaaggcagttctgtgtaagcctttaactatgacaaaggcgacttattgtaagccacacatgcaaactaagagttgtcagactgatgacacgtggcgaaccgaatatgtgccggtccccattcccgtgccagtgtacataccagtgcccatgcacatgtacagccaaaatattcccgtcccaactacagtgccagtcccagtgccggtccccgtgttccttccagcccctctggactcaagcgagaagattcctgccgccattgaggagctgaagtctaaagtctcttccgacgccctggatacagagctccttaccatgacagacatgatgagcgaggacgaaggtaagacagaaaccacaaatattaattccgtcataatcgagactgatatcatcggcagtgatctgcttaaaaactctgaccccgagacccaatcaagcatgcctgacgtgccgtacgaaccagatcttgatatcgagatcgactttcccagggccgccgaggagctggacatggaaaacgaattcctcctgcctcccgtctttggtgaggaatatgaggaacagccacgaccccgaagtaagaaaaaaggtgctaagcggaaagcagtcagcggctaccagagccatgatgactcttccgataacagcgagtgttcttttccttttaaatatacatacggggtcaacgcttggaaacactgggtcaaaacacggcagctcgatgaagatttgctggtgctggacgagttaaaaagttccaagtcggtgaagctgaaagaggacctgctttctcataccaccgcagagctcaactatggtctggctcatttcgtcaacgaaattcgacgccctaatggagaaaactatgcccccgactccatatactatctttgtcttggaatccaggaatatttatgtggcagtaatcgtaaagataacatcttcattgatcccggctatcagaccttcgagcaggaactgaataaaattctccggtcatggcagcctagcatactgcctgacggtagtatattcagccgagtggaagaagactatctgtggcgaataaagcagctggggtcccactcccccgtcgcgctgcttaacactctgttctattttaacactaagtacttcgggctgaaaactgttgagcagcatctgcgactctcctttggcacagttttccggcactggaagaaaaatccactgaccatggaaaataaggcttgcctcagatatcaggtgagtagcttgtgcggcacggacaacgaagataagattactacgggtaagcgaaaacatgaagatgacgagcctgtctttgaacaaatcgaaaacacggctaatccgtccaggtgcccggtcaaaatgttcgaatgttacttgtcaaaatccccgcagaatctgaaccagcgaatggacgttttctacctgcaaccggagtgtagttccagcacagacagtcccgtctggtacacctccacttcactcgataggaacaccctcgaaaacatgctcgtacgtgtgctcctggtcaaagacatatatgacaaagacaattacgagctcgatgaggacaccgactag

SEQ ID NO: 212540 - DNA, 4128 bp, Artificial Sequence
  Description of Artificial Sequence: Synthetic coding sequence
atggacaccagcagcgtgggcggcctggagctgaccgaccagacccccgtcctcctgggatccacagctatggcaacttcactcactaacgtgggtaatagtttcagtggaccagcaaaccccctggtctctagatcgaacaagtttcagaattctagcgtcgaagatgatgatgacgtagtcttcattgaacctgtgcagcctccccccccgagcgtcccggtagtcgcagatcagagaacaatcactttcacttcttccaagaatgaagagttgcagggcaacgactctaaaataactccttcatctaaggaactggcgtcacaaaaagggagcgtcagcgagactatagtcatcgatgacgaggaagacatggaaactaatcagggtcaagagaaaaattctagcaatttcatcgaaaggcggccgcccgagacaaagaatcgcacaaatgatgttgatttttcaactagcagtttcagcagaagcaaggtgaatgcaggaatgggaaattccggtatcactactgagccagattcggagattcagattgccaacgtcaccactctggaaaccggtgtgagcagcgtgaacgacgggcagctggaaaacacggatgggcgggatatgaatttaatgataacgcatgttacgtcactgcagaacacaaacctgggggatgttagcaatggactgcagagttccaatttcggcgtgaacatccagacatatacaccctctttgacaagtcagaccaaaaccggcgtgggtccttttaatcctggtcgcatgaacgtggctggagatgttttccagaacggagagagcgcaacacaccacaatcctgatagttggatctcacagtcagcctcctttccaagaaaccagaaacaaccaggcgtcgattcactgtccccggtcgcctctctccctaagcagatcttccagccatcagtgcaacaacaacccacaaagcctgttaaagtaacatgcgccaactgtaagaaacccctccagaaaggtcaaacagcctatcagcgaaaaggtagcgcacatcttttttgcagcaccacttgcttatccagcttttctcacaaacctgcacccaagaagttatgcgtcatgtgcaagaaagacattacaacaatgaaaggcactattgtggcccaggtggacagtagcgagtccttccaggagttttgctcaacatcctgcctgtccttatatgaagacaagcaaaacccaacaaaaggagcacttaacaaaagtcggtgtactatttgcggtaagttaaccgagatccggcacgaggtatcttttaagaatatgacccataagctgtgctcagatcactgttttaacaggtataggatggcaaacggcctgataatgaactgttgcgaacagtgcggtgaatatcttccttcgaaaggcgccggaaacaatgttctggttattgatggacagcagaagcgattctgctgccagtcctgcgtatctgaatacaagcaggtggggagtcacccctcctttctgaaggaagtacgtgaccatatgcaggatagctttttaatgcagcctgaaaaatacggaaagctcactacctgcactggctgtagaacacagtgccgcttctttgacatgacccagtgcatcggacccaacgggtatatggaaccttactgttctacggcctgcatgaacagccacaagactaagtatgctaaatcacagagcctgggaatcatctgtcacttttgtaaaaggaactctctcccgcaataccaggccacaatgccagacgggaagctgtacaatttctgtaactcctcctgcgttgccaagttccaggctttgtctatgcaatccagcccaaacggacagttcgtggcaccttctgatatacaactcaagtgcaattattgcaagaattcattctgttctaagccggagattttagaatgggaagcttcactgcatcaattttgctctaagacttgctccgacgattataaaaaactccactgcatcgttacatattgcgaatattgccaggaggaaaagaccctacatgagacggtgaacttttccggagtcaaacgaccattttgtagcgaaggatgtaaattactttacaagcaggactttgcaaggcgcctcgggctgcggtgcgtaacgtgtaactactgttcacagctgtgcaagaaaggtgccactaaggagctggacggggtggtccgcgatttctgttctgaagactgctgcaagaagttccaggactggtattacaaagcctgcgactgctgtaaaagccagggcaccctgaaagagagagttcaatggcggggggagatgaagcatttctgcgatcagcactgccttttacgcttttactgccagcaaaacgagcccaatatgactacacagaaggggccagagaatttgcactatgatcagggatgccaaacctcccggacgaaaatgaccgggtctgctccgcccccaagccccacaccaaataaagagatgaaaaataaagccgtgctatgcaagcccttaacaatgaccaaagccacatactgcaaaccccacatgcagaccaagtcttgtcagacagatgatacttggagaactgagtacgttcccgtccccattccagtgcctgtttacataccagtgcctatgcacatgtattctcagaacatcccagtacccactacagtgcccgtaccagtgcccgtgccagtgttcctgcctgcccccctagacagcagcgagaagattcccgctgccatcgaggagctcaagtctaaggttagcagcgatgcacttgacaccgagttgttaaccatgacagacatgatgagcgaagatgagggaaaaacagagacaacgaacatcaatagtgtgataatcgaaaccgatatcatcggttccgatttattgaagaattctgaccccgaaacccagtcaagcatgccggatgtgccttacgagccagatcttgacatcgagatcgactttcctcgtgctgccgaggagcttgatatggaaaacgaattcctcctgccgcctgtgttcggagaggagtacgaagaacagcctaggcctaggagcaagaagaagggtgctaagcggaaagcggtttctggctatcagtcacacgatgactcatctgacaatagcgagtgttctttccctttcaagtatacctacggtgtgaacgcttggaagcactgggtgaaaacacggcaactggacgaggatctcctggtcctggatgaactgaagtctagcaaatcggtgaagctgaaagaagacctgctcagtcatacaacagcggagctaaattatggactcgcccatttcgtgaatgagatcagacgcccaaacggcgagaactatgccccagactcaatttattatctgtgtctgggcatccaggagtacctctgtggctccaaccggaaagataacatctttatagaccctgggtatcagacatttgagcaggagctaaataagatccttagatcctggcaaccttccatccttccagatggctcaattttctcccgggtggaggaagactatctgtggcgaataaaacaactcggcagtcacagtcctgtggctttgctaaatacacttttttatttcaacacgaagtacttcggactcaaaacggtggagcagcatttgcgcctttcctttggcaccgttttccgacactggaaaaagaatccactgaccatggagaataaggcttgcctgaggtaccaggtttccagtttgtgtgggactgataacgaggacaaaattacgaccggaaagcgcaaacatgaggacgacgaacctgtgtttgagcaaatcgagaatactgccaacccatctcgttgtcctgtgaagatgtttgaatgctatttatccaagtcaccccagaatctgaatcagagaatggatgtgttctacctgcagcccgaatgctcgtcgtccaccgattcgcccgtatggtatacctcaactagtctcgaccggaacactctggaaaatatgttagtccgggtgttactcgtcaaggacatttatgataaggacaactacgagttggatgaagatacagactag

SEQ ID NO: 212541 - DNA, 4128 bp, Artificial Sequence
  Description of Artificial Sequence: Synthetic coding sequence
atggacaccagcagcgtgggcggcctggagctgaccgaccagaccccagtgctgctcggcagtactgccatggccaccagcctcaccaacgtagggaactcttttagtggaccagccaatcctctggttagtcggagcaataagttccagaacagcagcgtcgaggatgatgacgatgtggtttttatagaaccagtccaaccgccccctcccagcgtgcccgtggtagctgaccagaggacaattaccttcactagtagtaaaaacgaggaactgcagggtaatgactccaaaatcactccttcctcaaaagagttggcatcacagaaaggcagtgtgagtgagactatcgtcattgacgacgaagaggatatggagaccaaccagggccaggaaaagaactcctcaaacttcattgagaggcgtccccccgaaacaaagaatcgtacaaacgacgtggatttctccacctctagcttttccaggtcaaaggtaaatgcaggaatgggcaacagtggcataactactgagccagatagtgaaatccagatcgccaacgtgaccactctcgaaacaggggtgagcagcgtgaatgacggtcagctggaaaacaccgatggaagagatatgaacctgatgatcactcacgtgaccagtcttcaaaatacaaacttgggcgatgtgtccaacggcctgcagtctagcaactttggggtgaacattcagacatatacaccctccctaacctctcagaccaagacaggcgttggcccattcaatcccggacgcatgaatgtggccggggacgtctttcagaacggggaaagtgccacacaccataatccagattcttggattagccagagcgcttcatttcccaggaaccagaaacaacctggagtcgacagtttgtcccccgtggcctctctccccaagcagattttccagccgagcgtgcaacagcaaccaactaaaccagttaaggtgacctgcgcaaattgtaaaaaacccctccagaagggccagacagcctaccagagaaaggggtctgcccatctgttttgtagcactacatgcctgtcttccttcagccacaagccggctcctaaaaaactgtgtgtcatgtgtaaaaaagacattaccaccatgaaaggcacaattgtggcccaggtggattcttctgagagctttcaagaattttgtagcacatcatgcctgagcctgtatgaagacaaacagaatcctaccaagggggctctgaacaaatccaggtgcactatctgtggtaagctgaccgaaatccgacatgaggtgagttttaagaacatgacgcacaaactgtgttccgatcactgcttcaaccgatacagaatggcaaatggattgattatgaactgctgcgagcaatgcggggaatacctccctagcaaaggggccggaaataatgttctggtgattgatggtcagcaaaagcgcttttgttgccagtcatgcgtcagcgagtataaacaggtgggcagtcatccatcattcctcaaggaagtccgggatcacatgcaggactctttcctgatgcagcctgagaagtacggaaagctgacaacatgtacaggatgtcgtacacagtgccgcttcttcgatatgacccagtgtataggccccaatgggtatatggagccctactgctctacagcttgtatgaactctcataaaaccaagtacgcaaaaagccaatcccttggaataatttgccacttttgcaagaggaatagccttccacagtatcaggccacgatgcctgacggcaaactgtataatttttgtaattcatcgtgtgtagctaagtttcaagctctttcaatgcagtcttcgcccaacgggcagtttgtggccccttccgacattcagctgaagtgtaattattgtaaaaattccttctgtagtaagcccgagattctcgaatgggaggccagcctccaccagttttgcagcaaaacctgctccgatgactataagaaattgcactgcatagtcacctactgcgagtactgccaggaagagaaaaccctccatgagacagtgaatttttctggggtcaaacggcccttttgcagcgaaggatgtaagctgctgtacaaacaggatttcgccagacgcctgggtctccgttgcgtgacatgcaattactgctcacagctctgcaagaagggggctacaaaggagctggacggagtcgtgcgagacttctgttcagaagactgctgtaaaaagtttcaggactggtattacaaagcgtgtgactgctgcaagtcccaggggacccttaaagagcgggtgcagtggcgaggagagatgaagcatttctgcgatcagcattgcctgctcagattttactgtcaacagaatgaacctaatatgacgacgcaaaaaggccccgagaatctccactatgatcagggctgccagacatctcgaactaagatgacgggcagcgcacccccgccgtccccaacaccaaacaaagagatgaaaaacaaggccgtgctgtgtaaacctttaaccatgacgaaagctacatattgcaaacctcatatgcagaccaagtcatgtcagactgatgacacctggaggaccgagtacgttcccgtaccaattccagtgcccgtgtacattcctgtgcctatgcatatgtatagccagaacattcctgtcccaaccaccgtgccagttccggtgcccgttcccgtatttctgccagcacccctggactcttcagagaaaatccctgctgcaatcgaggagctgaagtccaaggtgtcgtcagacgcgctggatacagaactacttacaatgaccgacatgatgagcgaggatgaagggaagacagaaactaccaatattaactcagtgattatagagaccgacatcatcggatccgatttactgaaaaactccgaccccgaaacacagagctcaatgccggacgtcccctatgaacctgacctcgatattgagatagacttcccaagggctgccgaggaactggacatggaaaacgaattcctgctgccaccagtctttggtgaagagtatgaggagcaaccacgccctaggtctaagaaaaaaggcgcaaagaggaaagctgtgtctggataccagtctcatgacgatagctccgataactctgaatgtagtttcccattcaagtacacttacggcgttaacgcctggaaacattgggtaaagaccagacagctagacgaggaccttctcgtgctggacgagttgaagtccagtaagtctgtgaaattgaaagaagatctgctaagtcacaccacagccgagctcaactacggactagctcatttcgttaacgaaattcggcggcctaacggtgaaaactacgcccctgattccatatactatctgtgtcttggaatacaggagtatctttgcgggtctaatcggaaagacaacatttttatcgatcccggataccagacattcgagcaggagcttaataaaatcctgcgttcatggcagccctccattttgcccgacggttctatcttctcccgcgtggaggaagactatctgtggcgtattaagcagctaggatctcactcccccgtggccctcctcaatactctcttttattttaacacaaagtacttcggcctcaaaaccgtggagcagcacctgagactaagcttcggcaccgtgttccgccactggaagaagaatccattaacaatggaaaacaaggcttgcttacggtaccaggtgagttctttgtgtggcacagataacgaggacaaaatcacaaccggaaagcgcaaacacgaggacgacgagccagtgtttgagcagattgagaatacggctaacccaagtcgctgtccggtgaagatgtttgagtgctatcttagcaagtctccccagaatttgaatcaaaggatggacgttttctacctgcaacctgagtgttcctctagcaccgacagccctgtttggtatacttcaaccagcctggacagaaatacgctcgagaatatgctggtgagggtgttgctggttaaggatatttatgacaaagataactacgaactggatgaagacacagactag

SEQ ID NO: 212542 - DNA, 1134 bp, Artificial Sequence
  Description of Artificial Sequence: Synthetic coding sequence
atgcaggacagcttcctgatgcagcccgagaagtacggcaagctgacaacatgtactggctgccgcactcaatgcaggttcttcgacatgacccagtgtattggccctaatggttacatggagccttattgcagcacagcctgcatgaacagccacaagacaaaatatgctaaatctcagtcgcttgggattatttgtcacttctgtaaacggaactccttgccacagtatcaggccacaatgccggatggaaaactgtacaacttttgcaattcctcctgtgtggccaaatttcaggctttaagcatgcagtcttcgcctaacggtcagttcgtggccccttccgatatacagctgaagtgtaactactgtaaaaattcattctgtagcaaaccagaaatattggaatgggagaataaagtgcatcagttttgttctaagacatgtagcgacgattacaagaaactgcattgcattgttacatattgcgagtattgccaagaggagaaaacgctgcacgaaactgtcaatttctctggggtgaaacgccccttctgctctgagggatgcaagctgctttacaagcaagatttcgcaagaaggctcggtctgcgctgtgtgacatgcaactactgctcccagctttgtaagaaaggagccacaaaggagctggatggcgtggtgcgggatttctgcagcgaggattgctgtaaaaagttccaggattggtattacaaggcagctcgttgcgactgctgcaagagtcaaggcactttgaaggaacgcgtgcagtggcgtggcgagatgaaacatttctgtgaccagcactgtctcttgagattttactgtcaacagaacgagcccaacatgacgacccaaaaggggcctgaaaacctgcactacgatcagggctgtcagactagtcgaacaaaaatgacagggtctgctcccccccccagccccacaccaaacaaagagatgaagaataaggccgtgttatgtaagcctctcacaatgactaaggcaacatactgcaaacctcatatgcagactaaaagctgccaaactgatataacatggaggatacagcacttgattctgaatcattacgaccagagcctgataaaggcctag

SEQ ID NO: 212543 - DNA, 4134 bp, Artificial Sequence
  Description of Artificial Sequence: Synthetic coding sequence
atggacaccagcagcgtgggcggcctggagctgaccgaccagaccccggtgctgctgggaagtaccgcaatggctacctctctgactaacgtgggcaactcctttagtggccccgcaaaccccctggtgtcccgttctaataagtttcagaactcgtctgtggaggacgacgatgacgttgtgttcatcgagccagtgcagccacccccaccctctgtcccagtggtcgccgatcagcggactataacttttacctcctctaaaaatgaagaattacaaggaaatgatagcaagatcacgcccagcagtaaggagttggccagccaaaaagggagcgtcagtgagaccattgtgatagacgacgaagaagacatggagactaaccagggccaggagaaaaactcctctaatttcatcgagaggcggccccctgaaaccaaaaacaggaccaatgatgtggactttagtacatcttcatttagcaggtcaaaggtaaatgccggcatgggtaacagcggtatcactacagagccagattcagagatccaaattgcgaatgtcacaactcttgaaaccggtgttagttcagtgaacgacggccagctcgagaataccgacggccgggacatgaacttgatgattactcatgtgacctctctacaaaacactaatctcggagacgtgtccaatggcctccagagctccaatttcggcgtgaatatccaaacatacaccccctcgcttacctcacaaaccaaaaccggcgtgggcccctttaatcccggcagaatgaatgtggctggcgacgtattccaaaacggcgagagcgcaacacatcacaacccagattcatggatctctcagagcgcaagctttccacgtaatcagaagcaacctggagtggactccctgtctcctgttgcctccttaccaaagcagattttccagccctcggtgcagcagcagcccaccaaacccgtgaaagtgacttgtgctaattgtaaaaagcccctgcagaaagggcagacagcgtaccagcgaaagggatccgcccatctgttctgcagtaccacttgtttaagctccttttctcacaaacccgcgcctaaaaagttgtgcgtcatgtgcaagaaggatattaccaccatgaaagggacaattgtggcccaagtagacagcagcgagtcttttcaggagttctgttccaccagctgcttgtctctgtatgaggacaagcagaatcctactaagggagctctgaacaagtctagatgcacaatttgcgggaagttgacagagatacggcacgaggtgtccttcaaaaacatgacccataaattatgctccgaccattgctttaatcgttaccgtatggccaacggcctcatcatgaattgctgcgaacagtgcggcgaatacttgccctccaagggggctggcaataatgtactcgttatcgacggccagcaaaaacggttctgctgtcagagttgtgtttctgagtacaaacaagtcggtagtcatccatcattcctcaaggaggttagggaccatatgcaggattctttcctgatgcagcccgaaaaatacggcaaactgacaacctgtacagggtgcagaactcaatgcagattcttcgacatgacccagtgcatcggaccgaacggatacatggagccctactgtagtaccgcctgcatgaattctcataaaacaaaatatgccaaatcccagagcttaggcatcatatgccacttttgcaaacgaaattctctcccccagtaccaggccacgatgcccgatgggaagctctataatttttgtaacagttcatgcgttgccaagttccaggcactgtcaatgcagagcagccccaacgggcagtttgtggccccatctgacatccagctgaagtgcaactattgcaagaactccttttgtagtaaaccagagattttagaatgggagaacaaagtccaccagttttgttcaaaaacttgctccgatgactataagaagctgcattgtattgtgacctactgcgagtactgccaagaggagaaaacactgcatgagactgtaaacttctccggggttaaaaggcccttctgtagtgaagggtgcaagctattgtacaagcaggatttcgcccggcgactcggtctgcggtgtgtcacctgtaactattgttcccagctgtgcaaaaagggggccacaaaggaactggatggggtcgttagggacttctgttccgaggactgctgcaagaagttccaggattggtactacaaagcagccaggtgcgactgttgcaagagccaaggtacccttaaagagcgggtacagtggcgaggagagatgaagcacttctgtgaccagcactgcctgctgcggttttattgccagcagaacgaaccaaatatgacaactcagaaagggccagaaaacctgcactacgatcaaggttgtcagacatcaaggacaaagatgacgggctccgccccaccccccagccctactcctaataaagagatgaagaacaaggctgtcctctgtaaaccgctgactatgacaaaggcaacatactgtaaaccgcatatgcaaacaaagtcttgccaaactgacgacacctggcgcactgaatacgtgcccgttccaattcccgttccagtgtatattccagttccgatgcatatgtatagtcagaatattccggttcccacaacggttcccgttccagtgcccgtgcccgtgtttctgcccgctcctttggatagctccgagaaaataccagccgcaattgaggaactgaaatctaaagtgtcctccgatgctttggataccgagcttctgaccatgactgatatgatgagcgaagacgaaggaaaaaccgaaactactaatattaacagtgtcattatcgaaactgacatcatcggttcagatctcctgaaaaactctgatcctgaaacacaatcctctatgcctgacgtgccttatgaacctgatcttgatattgagatcgacttcccacgggcggccgaggaactggatatggagaacgagtttctgcttccgccagtttttggagaggagtacgaggagcagccccgccctcgctcaaagaagaagggcgctaagcgaaaggcagtaagtggatatcaaagccatgatgattcttcagacaattcagagtgctcttttccatttaaatatacatatggtgtgaatgcctggaaacactgggtgaagaccaggcaactggacgaagacttgctggtgctagacgagctgaagtcatccaagtcagtgaaacttaaggaggacctgctttcgcacacgaccgctgaactgaactacgggctcgcacacttcgtaaacgagatccgcagacccaatggagagaactacgctcctgacagcatctactacttgtgcctcggtatccaggagtatttgtgtggatccaataggaaggacaatatcttcatagacccaggctaccagacctttgagcaggaactcaacaaaattctgagatcctggcagcccagcattctgccggacggctccatcttctcacgggtggaggaggattatttgtggcgcattaagcagttaggcagtcacagccctgtggcactgttgaacactctgttctattttaatactaagtattttgggctcaaaactgtagagcagcacctgcggctctctttcggcactgtctttcgccattggaagaaaaaccctctaaccatggagaataaagcttgcttgcgttaccaagtgtcatctctgtgcggaaccgacaacgaagacaagattactaccggcaagaggaagcatgaggacgatgaacctgtctttgaacagatcgagaatacggccaacccaagtcgctgtcctgtcaaaatgttcgaatgctatctatctaagagcccccagaatctcaaccagcgcatggacgtgttttatctccagccggaatgctcaagttctaccgatagtccggtgtggtataccagcacttcacttgacagaaatactttagagaatatgctggttagggtgctcctggtgaaggacatatacgacaaggacaactacgagctcgatgaagacaccgactag

SEQ ID NO: 212544 - DNA, 4113 bp, Artificial Sequence
  Description of Artificial Sequence: Synthetic coding sequence
atggaccccagcgacttccccagccccttcgaccccctgaccctgcccgaaaagccccttgccggagatctgccagttgatatggagtttggcgaagatttgttggagtcccagaccgcacccacacggggctgggcccctcccgggccttcccctagtagcggggctttagatcttcttgatacccccgccggcttagagaaagaccccggcgtcttggacggggccacagagctcctgggtttggggggcctgctatataaagctcctagtccaccagaggtggatcatggtccagagggcaccctggcatgggacgccggtgaccagactttggagccaggtcccggggggcaaactcctgaagttgtgccaccagaccctggggccggagccaacagctgttctcctgaaggacttctggagcctctggctcccgatagtcctatcacactgcagagtccacatatcgaagaggaggagaccacttccatcgctaccgcccgacgcggctctcctggccaggaagaggagttaccccagggacaaccacagagccccaacgctccgcctagtcctagtgtgggggaaaccctcggggatggaataaacagctcacagaccaaacctgggggcagttcacctcccgcacacccatcactgccgggagatgggctgacggcgaaggcaagcgagaagcccccagagagaaaaaggtctgaaagggtgcgacgagccgaaccgcctaagcccgaagtggtcgattcgactgaatcaattccagttagtgatgaggattcagatgcgatggtggatgatcccaatgacgaggacttcgtgccattcagacctaggcgcagcccccgcatgagtcttagatcttcggtgagccagcgggcaggccgtagtgctgtgggtaccaaaatgacatgcgctcattgcaggactccgttgcagaaggggcagaccgcataccagagaaaaggcttgccgcagttgttctgttcgtccagctgtctgacgacattctccaagaagccttccggcaaaaagacatgcaccttttgcaagaaggagatatggaacacaaaggattcggtggttgcacagacaggctcaggagggagctttcacgagttctgtacctcagtttgcctgagcctttacgaagcccagcagcagcgaccgattccacaatctggggaccctgccgacgctactcggtgctcgatatgccagaagacaggcgaggtgttgcacgaagtcagtaatgggtcagtggtacataggctgtgctcagacagctgtttcagtaagttccgagcaaataaaggtcttaaaacaaattgctgcgaccagtgcggtgcatacatctataccaaaacaggctcccccggtccagaactgttgtttcacgaaggccaacagaagcggttctgcaataccacctgcctaggtgcgtataagaagaagaacacccgcgtgtacccatgcgtttggtgtaagactttgtgcaagaatttcgaaatgctttcccatgttgacagaaacggaaagacttccttgttctgttctctgtgctgcaccaccagctataaagtcaaacaggctggcctgactggacctccccggccttgtagtttctgccggcgatccctgagtgacccgtgctattacaacaaggtggacaggactgtctaccagttctgttcaccgagctgctggacaaagttccagcgaacctccccagagggaggcatccaccttagctgccactattgccatagtttgttcagcggaaagcctgaggtcctagactggcaggaccaggtctttcagttctgctgtagagattgttgtgaggattttaaaagactgcggggcgttgtgagccagtgtgagcactgcagacaggagaagctgttgcacgaaaaactgcgtttcagcggagtagagaaaagcttctgttctgagggatgcgttctcctatacaaacaggatttcaccaaaaagttgggactgtgctgcatcacctgcacctattgcagccagacctgtcagagaggagttaccgaacagctggatggcagcacctgggacttttgcagtgaggattgtaagagtaagtatctactgtggtactgtaaagcagcgcggtgccacgcgtgtaagcgccaaggcaagctgttggaaaccattcactggcgcgggcagatccggcacttttgtaaccagcagtgtctgctgcggttttactctcaacagaaccagcccaatctcgacactcagtccgggcccgaatccctgctcaattcacagagccctgagagcaagccccagacaccgagtcaaactaaggtggaaaactctaacaccgtgaggaccccggaagagaacgggaatctcgggaaaatccctgtaaaaacccgctccgcccctactgcacccacccctcctcctccacccccgcctgctactccccgcaaaaataaggcggctatgtgcaagcctttgatgcaaaataggggagtcagctgcaaggtggaaatgaagtctaaagggtcgcagacggaagagtggaagccacaggtgatcgtactgccaattcccgtgcctatttttgtccccgtgcccatgcacctctattgccagaaggtccctgtgcccttttctatgcctatccccgtgcccgttcctatgttcctcccaacaacattggagtcgaccgacaagatcgtggagactatagaggagctgaaagtaaaaatcccttcgaatccactagaagctgatattctggctatggccgagatgattgcagaggctgaggagctagacaaggccagttcagatctgtgcgacctggtctcaaaccagtcggccgaggggctcttagaggactgcgacctgttcggccctgcacgagatgatgtgctggctatggctgtgaagatggctaatgttctggatgagcctggtcaagacctagaggctgattttcccaagaatccattggacattaaccccagcgtcgactttctgttcgactgtggactggttggtcccgaggacgtttccactgagcaagatcttccacgaacaatgcgcaagggtcagaagaggctggtgctatccgaaagctgctctcgggattcaatgagcagtcagccgagttgtacaggccttaactattcatatggagtgaacgcttggaagtgttgggtacaatccaaatatgccaatggcgaaaccagtaagggcgacgagctacgttttggtcctaaacctatgcggatcaaggaagacatacttgcctgctcagcagctgaactgaattacggccttgcacagttcgtacgggaaataacccgacctaacggagaaagatatgaacccgacagtatctactacctgtgtttaggaattcagcagtatctcctcgaaaataaccggatggtgaatatcttcactgatctgtattacctcacattcgttcaggagttaaacaagagcctgtcaacctggcagcccaccctcctgccaaataatactgttttttctcgggtggaggaggaacacctctgggagtgcaagcagcttggggtctacagtccttttgtgctgctcaacacacttatgtttttcaataccaagttcttcggcctgcagacagctgaggaacatatgcagttgtcttttacgaatgttgtcagacagtctcggaagtgtactacccccagaggcacaacgaaggtggtctccattaggtattacgccccggtgcgccaacgtaaagggcgagataccggtcccggcaaaagaaagagagaagacgaagccccgatactggagcaaagggagaacagaatgaatcccctgcgttgcccagtcaaattttatgaattttatctaagcaagtgccctgaaagcctgcgaactcggaacgatgttttctacctgcagccagagcgatcttgtatcgctgaatcccccctctggtattcggtgattcccatggaccgatccatgctggagagcatgttaaaccgaatcctggccgtgcgggaaatctacgaggaactgggccgaccgggcgaggaagatttggactag

SEQ ID NO: 212545 - DNA, 4113 bp, Artificial Sequence
  Description of Artificial Sequence: Synthetic coding sequence
atggaccccagcgacttccccagccccttcgaccccctgaccctgcccgaaaaaccactcgcaggagacctgccggttgatatggagtttggtgaggatctcctggaaagccagacagctccaaccagaggatgggccccccccggccccagtccgtccagcggggccttggacttgctggacacacccgccggactcgaaaaggaccccggcgttttagatggggccacagagctactaggactgggcggtctattatacaaagccccttcccctccagaggtggatcacggccccgagggaacactggcctgggatgccggtgaccagacacttgagccaggcccgggcggacagacccctgaagtggtcccacctgacccgggcgccggtgccaactcatgtagcccagaaggattgctggaacccctggcccccgatagccccattaccctgcagagccctcacatcgaagaagaggagacaaccagcatcgccacagccaggcgtgggtccccggggcaggaggaggagctgccccagggacaaccacagtctcctaacgcccctccgtctcccagtgtgggggagaccctcggggacggaattaactcaagtcaaaccaagccgggcggtagtagccccccagcccaccctagcttaccaggcgacgggctgactgcaaaagcatcggagaaaccacctgagagaaaaagatccgagagggtgaggcgtgcggagccaccaaaacctgaggtggtggacagcaccgaaagtattccagtgagcgacgaggatagcgacgccatggttgatgaccccaatgacgaggatttcgtgccctttcgaccaagaagatcacctcgaatgagcctgcgaagctctgtgagccagcgtgctggccgatctgccgtaggcacgaagatgacttgcgcgcattgtcgcacccccctgcagaaggggcagactgcctaccaacggaaagggttgccgcagctcttttgctcaagtagctgtcttacaaccttctccaagaagccctctggcaaaaaaacttgcacattctgcaagaaggaaatttggaatacaaaagactcagtggtcgctcagaccggctccggcggaagcttccatgagttctgtacatctgtgtgcctgagcctgtatgaagctcagcagcagcgccctatcccccagtccggggacccagccgatgccaccagatgttcaatctgtcagaaaaccggcgaggtgctgcacgaggttagtaacggatcagtggtccaccggctctgctctgattcttgcttttcgaaattccgggcgaacaagggcctgaagactaactgttgtgatcagtgtggggcctatatatatacgaagactggaagccctgggccagaactgttgttccacgagggccagcagaaacggttctgtaacacaacttgcctgggagcctataaaaagaagaacacgagggtgtacccatgcgtgtggtgtaaaactctgtgcaagaatttcgaaatgctctcccatgtagatagaaacggcaagactagcctgttctgctccctttgttgcactacttcttacaaagtgaaacaagcaggcttaactggcccaccacggccctgtagcttttgtagacggtctctgtccgacccctgctattacaacaaggtggaccgtacagtgtaccaattttgctccccttcctgctggaccaagttccagaggacaagtcccgagggagggatccacctctcatgccattactgccactccttgttcagtggtaaacccgaggtacttgattggcaggaccaggtgtttcagttctgttgcagggactgctgtgaggactttaaaagactgcgtggcgtagtctctcagtgtgagcattgtagacaggaaaagctgcttcatgagaagttgaggttctcaggagtcgaaaaatcattctgctctgaaggatgtgtgctgctgtacaagcaggatttcaccaaaaagctaggcctgtgctgtatcacatgtacctattgcagccagacatgccaaagaggcgtgactgagcagctggatgggtcaacttgggatttttgttctgaggactgcaaatctaagtaccttctttggtactgcaaggctgccagatgccacgcctgtaaacggcagggcaagttgctcgaaactatccactggagagggcagatcaggcatttctgtaatcaacagtgcctgcttagattttattcccagcaaaatcagcccaatctggacacacagagtgggcccgaaagtttgctgaactctcagagccccgagagtaagcctcagaccccgtctcaaacaaaggttgaaaattctaacaccgtccggaccccagaggagaacggaaacctgggcaagatccccgtgaagacacgctctgctcccacagcccccactcctccgccgcctccaccacctgctactccacgtaaaaacaaggccgctatgtgcaagcccctcatgcagaacaggggtgtcagctgcaaagtggaaatgaaatcgaagggttcccagactgaagagtggaaacctcaggtgatcgttttgcctatccccgtcccgatatttgtgccagtgcccatgcatctttactgtcagaaagtaccagtcccattctccatgcccattcccgtgcctgtccctatgtttctccccacaacgttggagtcgaccgacaagattgtggagacaatcgaggaactcaaggtgaagatcccatctaatcctctcgaggccgatatcttggcgatggctgaaatgatcgccgaagccgaggagctggataaagcaagttctgatctctgtgacctcgtttcaaatcaaagtgccgaaggcttgctggaagattgtgatttatttgggccagcccgtgacgacgttctagccatggcggtgaaaatggctaacgttctggacgagcccggacaagacctcgaagcagatttccctaagaatcccttagatattaaccctagtgttgacttcctcttcgactgtgggctcgttgggccagaagatgtgtccaccgagcaagacttgcccagaaccatgcggaagggacaaaagcgcctggtgcttagtgagtcctgttcgagggacagcatgagttcacagcccagttgcacaggcctgaattactcttacggggttaacgcctggaaatgttgggtgcagtccaaatatgcgaatggcgaaactagcaagggagatgagttaagattcggacccaaaccgatgagaattaaggaggatatccttgcgtgtagcgccgccgaactcaactacggattggcacagtttgttagggaaattactagaccaaacggtgagagatatgaacctgattccatctattacctgtgccttggtattcagcagtatttgctggaaaacaaccggatggtgaatatattcacggacctgtattaccttaccttcgttcaagaactcaataagtccctatccacttggcagcctaccctcctaccaaacaacaccgtgtttagccgtgtggaggaagaacatctgtgggagtgcaagcagctgggtgtgtacagtccattcgtattgctgaatacactcatgttttttaatactaaattctttgggttgcagaccgccgaagaacatatgcaactctcgtttactaatgtcgttcgccaaagtaggaaatgcacaactccccggggcacaaccaaagtggtctctatcaggtactatgccccagtgagacagagaaaaggccgggacaccggtcccggcaaaagaaagagggaggacgaagctcctatcctggagcagagggagaataggatgaatccactacgatgccccgtgaaattttatgaattctatctgtccaaatgtcccgagagtctgagaactcgcaatgacgtgttctatctgcaaccagagcgctcctgtattgctgagtctcccctttggtactcagtgatccctatggacagatcgatgttggagtctatgctgaaccgaattctcgccgtgcgggaaatctacgaagaactgggcaggcccggagaggaggatctggactag

SEQ ID NO: 212546 - DNA, 1050 bp, Artificial Sequence
  Description of Artificial Sequence: Synthetic coding sequence
atggaccccagcgacttccccagccccttcgaccccctgaccctgcccgaaaaacccctggcgggtgatctgccagtcgatatggaatttggcgaagacttgttggagtcccagacggcccccacacggggctgggcccctcccggcccctcacctagcagcggcgccctggatctattagatacacccgcaggactagaaaaggaccctggggtgctggacggcgcaacagagctactcggtctcggaggactactgtacaaggcccccagccctccagaagtggaccacggtcccgagggcaccttagcttgggacgctggagaccagaccctcgagccaggacctgggggccagactcctgaggtagttccccccgaccccggagccggggccaactcttgtagccccgagggtctcctcgagcccttagcccccgacagtccaatcaccctccaatctccccacatcgaagaggaggaaactacgtcaatcgctaccgctagacggggtagccccggtcaagaagaagagctcccgcaagggcagccccagtctcccaacgccccacctagcccctcggtcggcgaaacactgggggatggcataaatagctcccagactaagccaggaggatcgtctccccctgcgcatccctccctcccaggagacggactgaccgccaaggcttccgaaaagccaccagaaagggtgcagaagcgctccgagcgggttagacgagcggagccgcctaagcccgaggttgttgattccactgaatcacgaagatctggcacgccccgtacaaggttatggagacgcctcgtccttgaggcgccaagtatgtcctcagcccatccgtctgtgagtccctgcatgcggccgtctagcagcgcgaggagccccagcctgggcataccacccaccttgttggcggcagcttacgcccgcagacttgaaagatcctgcacgagatccgctatggcggcctggtatactgggagtgcagctatcctcgcttcaccaaattcagggccaacccgggactag

SEQ ID NO: 212547 - DNA, 1488 bp, Artificial Sequence
  Description of Artificial Sequence: Synthetic coding sequence
atggaccccagcgacttccccagccccttcgaccccctgaccctgcccgagaaacccttagctggcgaccttccagtggatatggaattcggcgaggatttgctcgagtcccagacggcccctactagaggctgggccccacctggtccttccccctcttctggggctctggatcttctggacacacctgccgggctggaaaaagacccaggagtgctcgacggggccactgagttactaggtctaggcggcttgctgtacaaggcgccatccccaccagaggtcgatcatggtccagaggggacccttgcttgggacgccggcgaccaaaccttggaaccaggacccggcggacagaccccagaagtcgtgcccccggatccaggcgcaggcgccaatagctgttctcctgaaggattgttggagcctctggcgcccgattccccaatcactttgcaatccccccatatagaagaagaggagaccacttccatagcaacagcccgccggggttcaccaggacaggaggaggaattgcctcaggggcagccgcaaagccccaacgcaccgcccagcccatctgtcggagagaccctcggagacgggataaattcatctcagacaaagccaggaggctcttccccccctgcccatccatcactgcctggtgacgggctcaccgcgaaggcctcagagaagccccccgagcggaaacgctctgagcgcgtgagacgggccgagcccccaaaacccgaggtcgtcgacagtaccgaaagcatcccggtgtccgacgaagactccgatgccatggtggatgatcccaacgatgaggacttcgtgccatttcgccctaggcggtccccccgcatgtctctgcggagtagcgtgtcccagagggctggacgctcggccgtgggcacaaagatgacctgcgctcattgcaggacacctcttcagaagggccaaaccgcctatcagcggaaaggtctgccgcagctgttctgcagttcttcctgtctcaccacgtttagcaagaagcccagtgggaagaaaacttgtaccttttgtaaaaaggaaatctggaacacgaaggatagtgtagttgcacaaacagggagtggtggaagcttccatgaattctgtaccagcgtgtgcctgagtctgtacgaagcccagcagcagcgaccaatcccccagtcaggtgacccagccgacgcgacgaggtgcagcatctgtcagaaaacaggagaagtactccacgaagtgtccaacggtagcgttgtgcaccgcctgtgttctgacagctgcttctctaagttcagggcaaacaaaggactgaagacgaactgctgcgaccagtgcggggcgtacatctacacaaagacaggatctcccggtccagagctgcttttccacgaaggccagcagaagaggttctgcaatactacctgtctgggcgcctataaaaaggtcgggccacgagaatag

SEQ ID NO: 212548 - DNA, 1494 bp, Artificial Sequence
  Description of Artificial Sequence: Synthetic coding sequence
atggaccccagcgacttccccagccccttcgaccccctgaccctgccagagaagccactcgccggtgacctgcccgttgacatggaattcggcgaagacctattggagtctcaaaccgcccccacaagaggatgggcccccccagggccctccccgtcttccggcgctctggacctgctcgatacaccagccgggctcgagaaggacccgggcgttctggacggcgccactgaactccttggactggggggcttgctctataaagccccttccccacctgaagtcgaccacggaccagaaggcacactggcatgggacgctggagatcagaccctggaacccggccctggtggccaaacccccgaagttgtgccgcccgaccccggagctggagcaaattcctgtagcccagaaggcctgctcgaacctctagctccagatagtccgatcactctacagagcccgcacattgaggaggaggaaaccacaagcattgcaaccgccagacggggcagccctggtcaggaagaagaacttcctcagggacagcctcagagccccaatgcccctcccagtccaagcgtgggcgagactttgggcgacggtattaattcctctcagactaaacctgggggctcgagtccccccgcgcatccatcgcttccaggcgacggattgacagctaaggctagtgaaaaaccgcctgagcgggtgcagaagcggtctgagcgggtgagaagagcggagcctcctaaaccagaggtggtggacagcacagagtccattcccgtctccgatgaggatagcgatgccatggttgacgaccctaatgacgaggactttgttcctttccggccaaggcgcagcccgcgcatgtcactccggtcgagcgtgtcccaacgagccggccggtccgcagtgggcacaaagatgacgtgcgcccactgtcgtacccctctccagaagggacagaccgcctaccagaggaaaggtctccctcagctgttctgcagcagttcatgtctgactaccttctcgaagaaaccttcaggaaagaaaacttgtacattttgcaagaaagaaatatggaacacgaaagattcagtggtggctcagaccggaagcggtggcagctttcacgaattttgcaccagcgtgtgtctctctctgtacgaggcacagcagcaaaggcctattcctcaatccggggatcctgctgacgccacccgatgctctatctgccagaaaaccggcgaggtgctgcatgaggtatctaatggatcagtcgttcaccgactttgttccgatagctgcttttctaaatttcgagcaaacaagggccttaagactaattgctgcgatcagtgcggagcttatatctatacaaaaacagggtccccgggtccagagctgttgtttcacgaggggcagcagaaacgattttgtaacaccacctgtcttggcgcttacaaaaaggtggggcctagggagtag

SEQ ID NO: 212549 - DNA, 3843 bp, Artificial Sequence
  Description of Artificial Sequence: Synthetic coding sequence
atggaccccagcgacttccccagccccttcgaccccctgaccctgcccgagaagccattggcgggggatctgccagtagatatggagtttggggaggatctgctggaatctcaaactgctcctacgaggggatgggcccctcctggaccttcaccttcaagcggggctctggacctcctggatacacctgccgggctcgagaaggatcctggagtattagatggagctactgagctgttgggcctgggcgggctgctctacaaagcccccagcccacccgaggttgaccacggtcctgaagggactttggcgtgggacgccggcgaccaaaccctcgaacccggcccaggggggcaaacacccgaggtggtgcctcctgatcccggtgctggggctaatagctgttctcctgagggccttctagaacctctagccccagactcgcctatcaccctgcagtcgccgcatattgaggaagaagaaacgacttcgatcgccaccgcccggagaggttcaccagggcaagaggaagagttgcctcaggggcagcctcagtcccccaacgctcctccaagtcctagcgtgggggagacactcggcgatgggattaattcatcccagacaaagcccggagggagctctcctccagcacatccttcattgcccggcgacggactgaccgccaaagcgagtgaaaagccccctgaaagggtgcagaagcggtcagaaagagttcgccgagccgaacctccgaagccagaagtggtggactccactgaatccatccctgtgtccgatgaagattcagatgccatggttgatgaccccaacgatgaggacttcgtccccttccgaccgcgccgcagtcctagaatgtcccttaggagctccgtgtcccagcgcgctgggcggagtgccgtgggtactaaaatgacatgtgcccattgtcgcacacctctgcaaaagggacagaccgcttaccagaggaaggggctgcctcagctgttctgctccagtagttgtctgaccacattcagtaagaaaccctcaggaaaaaaaacctgcaccttttgtaagaaagagatttggaataccaaggattccgtcgtggcccagactggttcgggcggaagctttcacgaattctgcaccagcgtgtgtctttcattgtatgaagctcaacagcagcgtccaattcctcagtcaggtgatcccgcggatgctacacgttgcagcatctgccagaagaccggtgaagtgcttcatgaagtatccaacggctccgtggttcatagactgtgctcagactcctgtttcagcaagttccgcgcgaataagggcctgaaaaccaactgctgtgatcagtgcggcgcttacatttacaccaagaccgggagcccaggcccagagctactgtttcatgaaggtcagcagaaacgcttttgcaacactacctgtcttggtgcttataaaaaaaagaacacaagggtgtacccctgtgtgtggtgcaagaccctctgcaaaaatttcgaaatgctttcccacgtcgacaggaacggaaaaacgagcctattctgctcactgtgttgcaccacctcttacaaggtgaaacaggcgggcctcactggaccaccacgaccatgcagtttttgtcgaagaagccttagcgacccgtgctactataacaaggtagatagaaccgtctaccaattctgctctccatcctgctggacaaagttccaaagaacaagccctgaaggcggaatacatctgtcttgccactattgccactctctattctcaggcaagcctgaagtgctcgattggcaggatcaggttttccagttttgctgtcgcgactgttgtgaggacttcaagcggctcaggggcgttgtgagtcagtgcgagcattgccgccaggaaaagctgttgcacgagaagcttcggtttagcggcgttgagaagtcattttgctcagagggatgtgttctactatataagcaggactttacaaaaaagctgggcttgtgctgcatcacgtgcacatactgtagccagacctgccaaagaggggttaccgaacagctcgacggatccacttgggatttctgctccgaagattgtaagtccaagtatttactttggtactgtaaggctgccagatgccatgcttgcaagagacaggggaagctcctcgaaaccattcattggaggggccagatcagacacttttgcaaccaacagtgtctcctgcggttttatagtcaacagaatcagcccaacctggatactcagtcaggacctgagtcactcctcaactcccagagcccagagtcaaagcctcagactccatcgcagaccaaggtggagaatagcaacacagtcagaactcccgaagaaaatggtaatctcgggaaaataccagtgaagacacgctctgctcctactgctcctacgcctccccccccgcccccccccgccacacctcggaaaaacaaggcggccatgtgcaagcctctcatgcagaatcgcggcgtgagctgcaaagtagagatgaaatctaagggctctcagaccgaggagtggaagccgcaggtaatagtactgccaatccctgtgcctattttcgtcccagtgccaatgcacctgtactgccagaaggttccagtgcccttttctatgccgattccggtacccgttcccatgttcctgcctactactctggagagcaccgacaaaattgttgagacgatcgaagagttgaaagttaaaatccccagcaatcccttagaagctgacattttagcgatggctgaaatgattgcggaggccgaagagttagataaggcatcctcagacctgtgtgatcttgtatccaaccagtcagccgaaggtctgctggaggactgtgaccttttcggacccgccagagacgacgtcctggctatggctgttaaaatggctaacgtcctcgatgagccggggcaggatcttgaggcggactttccaaagaacccgttggatattaaccctagtgtggacttcctgtttgactgtggtctcgtgggcccggaagacgtgagcacagagcaggatctccccagaactatgcgcaaaggtcagaagcgacttgttctgtccgaatcatgcagccgcgactctatgtcgtctcagccctcatgtaccggactgaactacagttacggggtcaacgcctggaaatgctgggtgcaatctaagtacgcaaatggggagacctctaaagcaaaacctatgcgtatcaaggaagatatactggcttgctccgcggcagaactgaattacgggctcgcccaatttgtacgggagattacgagacccaatggggaacggtatgagccggattccatctactacctgtgtctgggcattcagcaatacctgctggagaataatcgcatggtaaatatcttcaccgatttgtattacttaactttcgttcaggaactgaataaaagcctgtcaacatggcaaccaaccctgctgccgaacaacaccggacctggcaagcggaagagagaggatgaggcccccatcctggagcagcgggagaaccggatgaaccccttgcgttgcccagtgaaattttatgaattttacctgtccaaatgccccgagtcactaaggactaggaatgacgttttctacctgcagcccgagcgatcttgtattgctgagtcaccactttggtatagcgtaatcccgatggacagatctatgttggagtctatgctcaatagaatcctggccgtgagagaaatttacgaagaactgggtaggccgggcgaggaagatctggattag

SEQ ID NO: 212550 - DNA, 4119 bp, Artificial Sequence
  Description of Artificial Sequence: Synthetic coding sequence
atggaccccagcgacttccccagccccttcgaccccctgaccctgcctgaaaaaccgctcgctggggatctgccagtggatatggaattcggcgaagatttattagagtctcagaccgctccgacccgaggatgggctcccccggggccctccccgagtagcggtgccttggacctgttagacacgcccgctgggctcgaaaaggaccctggcgtcctggatggggccaccgaactcctgggtctaggcggtcttctatacaaagctccctcaccccccgaggtggaccatggtccagaggggacactggcttgggatgcaggagaccagaccttggaacctggtccaggcggacagacccccgaagtcgtccccccggatccgggcgcaggggcgaattcctgctcccccgagggtctgctcgagccccttgctcctgacagcccgatcactcttcaatctcctcatatcgaagaggaagagaccaccagtatcgcaacagccagacgcgggagccccgggcaggaagaagagctcccacaggggcagccccaaagccctaacgctcctccttctccctcagtcggagaaaccctgggggatggtattaacagttcacagactaaacctggcggcagtagcccaccagcccacccttccctgcctggagacgggcttacggctaaggcttcggagaagccccctgaacgcgtccagaagcgaagcgagagggtgcggcgtgccgaaccacctaaacccgaagtggtggattcaacggaatccattccagtcagcgatgaggacagtgatgccatggtggacgatcctaatgacgaggacttcgtgccgttccggcccaggaggtctccccgcatgagcctgcgctcaagcgtgagccagcgggccgggcgatcggccgtgggtaccaaaatgacttgtgcccactgccgcacccccttgcagaaagggcaaaccgcttatcagaggaagggtctcccacaactgttctgtagctccagctgcctgactacatttagcaaaaaaccaagcggaaagaaaacttgcactttttgtaagaaagagatctggaataccaaggattctgtggtcgcacagactgggtcgggcggctcctttcatgagttctgcacaagtgtgtgcctgtcgttgtacgaagcccagcagcagagaccaattcctcaaagtggcgatcccgccgatgctacccgttgttcaatatgccagaagaccggcgaggtgctacacgaggtctccaacggatctgtggtgcatcggttatgttcagattcttgtttcagcaagttccgagcaaacaagggactgaagaccaattgttgcgatcaatgcggtgcatatatctataccaagaccggtagtccagggcccgagcttctgttccacgaaggccagcagaagaggttctgcaatactacgtgccttggtgcatataaaaagaagaatacccgggtctacccctgtgtgtggtgcaagacattgtgcaaaaactttgagatgctgtcacacgtggatagaaacgggaaaacttctctgttctgctccctgtgctgcacgacaagttataaggtgaagcaagcaggcctgaccggccctccccggccatgttctttttgtcgtagaagtctctcggacccctgctactataataaagtggatcggactgtatatcagttttgtagcccatcatgttggacaaaattccagagaacatctccagagggcggtatccacttgagctgccactattgtcactcactgtttagtgggaaacccgaagtgctcgactggcaagaccaggtctttcagttttgctgtcgcgactgctgtgaggatttcaagcgcctgagaggggtcgtgtcccagtgcgagcattgccggcaagaaaagctcctgcacgaaaaactgaggttcagcggagtagaaaagagcttctgctccgaaggatgcgtgctgctgtataagcaggactttacgaagaagttgggcttgtgctgcatcacatgtacttactgttcccaaacatgccaacgtggcgtaactgagcagcttgatgggtccacctgggacttctgtagtgaggattgcaaatccaagtaccttctgtggtattgtaaggctgcccgttgtcacgcctgcaagcgccagggaaagttgttagagacgattcattggcgaggccagatcaggcatttttgcaatcagcagtgtcttctgagattctatagtcaacaaaaccagcccaacctggatacacagagcggccccgaaagccttttgaatagtcagagcccagaaagcaagccacaaacaccatctcagaccaaagtagaaaatagtaacacggtgaggacaccggaggagaacgggaacctaggcaaaatcccagtaaagacacgttcggcccccactgctcctacccccccgccccctcccccacctgcaactcctcgaaagaataaagccgcgatgtgcaagcctctgatgcaaaataggggagtcagctgtaaggtggaaatgaagtctaaaggaagccagaccgaggaatggaaaccacaggtgatagtcctaccaatccccgtgccaatatttgttcccgttcccatgcacctgtactgccagaaagttccagtccccttctccatgccgattcccgtgcctgtgcctatgtttctgcctactacccttgagagcacggacaaaattgtggaaacaatcgaagaactgaaagtaaaaataccaagcaacccgctggaagcagacatcctcgcgatggcagagatgatcgctgaggctgaggagctagataaagcgtctagcgatctgtgcgatctcgtgtcaaaccagtccgcagaaggcctgctcgaggactgtgatctttttggccccgccagggacgacgttctggctatggcagtcaagatggcgaacgtcctggatgaacccggacaggatttggaagccgacttccctaagaatccattagatataaatccatctgtggattttctcttcgactgcggcctagtaggccccgaagatgtctctacagagcaggatctaccaaggacgatgcggaagggccagaaacggttggtgctgtccgagagctgtagcagagactctatgagcagccaacctagctgcaccggtctaaactactcatatggggtgaacgcttggaagtgctgggtgcagtcaaagtatgcaaacggcgaaactagtaagggtgacgagcttcgctttggacctaagccaatgaggatcaaagaggatatactggcctgctccgccgccgagctgaattacggcctagcacagtttgtgagagagattacccgcccaaatggagagagatacgagccggactccatctactacctgtgccttggcatacaacagtacctcctggaaaacaaccgtatggtgaacattttcaccgacctgtactatctgacatttgtacaggagttgaacaaaagtctgagcacgtggcagccaaccctgttacccaacaatactgtgttttctcgggtcgaggaggagcatttatgggagtgtaaacagttgggggtgtacagtccctttgtccttcttaacactttgatgttctttaacacgaaattctttggactgcagacagccgaagagcatatgcaattgagttttaccaacgtagtgaggcaaagtcggaagtgcacaactccgagaggcacgacaaaggtggtgtccatccggtattatgcaccagtgcgccaaagaaaaggcagggataccggcccaggcaagcggaagagggaagacgaggcccccatcctggaacagagggagaacagaatgaaccccctgaggtgtcctgtgaaattctacgagttctatctgagtaaatgccctgaaagccttcggacccgaaatgatgtcttctatctgcagcctgaacgaagctgtattgctgagagcccactgtggtatagcgtaatccctatggaccgctcaatgctcgaaagcatgctgaacaggatcttggcggtgcgcgagatctatgaagagctggggagaccaggcgaagaggatctggactag

SEQ ID NO: 212551 - DNA, 4077 bp, Artificial Sequence
  Description of Artificial Sequence: Synthetic coding sequence
atggaccccagcgacttccccagccccttcgaccccctgaccctgcctgagaagcctctcgccggggacctgcctgtggatatggagtttggtgaagacctcctggagagccagacggcgcctaccagaggctgggcccctcctgggccctctcctagttctggagccctggatttgcttgatactcctgcagggctggagaaggatccgggagtgctcgacggagcaacggagttactggggctggggggactgctctataaggctcccagcccgccggaagtcgatcacggcccagagggaacgttggcgtgggacgccggagaccagaccctggagccaggcccaggcgggcagacaccagaggtcgtcccgcctgacccgggcgccggtgccaatagctgctcacctgagggactactggagcccctggccccggactctccaataacactgcagtcccctcatattgaggaagaagagacaactagcatcgccacagcccgtcgcggaagtcccggtcaggaagaggagctaccacagggtcagccccagtcccccaatgccccgcccagccctagcgtcggtgagacgctgggcgatgggatcaacagtagccaaactaaacccggcggatcctctcctcccgcgcatccctctctgccaggtgacggcctgactgctaaagcctcagagaaaccacctgagcgaaaaaggagcgagagggtgcgcagagcagagccccctaagcctgaggtagttgatagcacagagtcaattcccgtgtctgatgaagactccgatgctatggtggatgacccaaacgatgaagatttcgtgcccttcaggcctcgcaggtctcctaggatgtcactccgcagtagtgtgtcccagcgcgccggtaggagcgctgtaggaaccaagatgacttgcgcacactgtagaactcctctccaaaaaggacagactgcctatcagaggaagggcctcccacagctattctgttcgtcaagttgtctcacaacattctccaagaaacctagcggcaagaaaacctgcaccttctgtaagaaagagatctggaatactaaggatagtgtggtggctcaaacagggtccggcgggtccttccacgagttctgcacgtcggtatgtctgagtctgtacgaggcgcaacagcagagaccaattccccagtccggagatccagcggacgccactcggtgcagtatctgtcagaagacaggcgaggttttgcacgaggttagcaatggttccgtcgtgcaccgcctctgctccgacagctgcttctcaaagtttcgagcgaacaaggggctcaagacaaattgctgcgaccaatgcggtgcatacatctacactaagaccggtagccccgggcccgagctcctcttccatgaaggccaacaaaaaaggttttgcaacaccacatgtcttggagcttataaaaaaaaaaacactcgtgtctatccatgcgtgtggtgcaaaacattatgcaaaaattttgagatgctgagccatgtggaccgcaacgggaagacctccctgttctgctccctatgttgtacgacatcctacaaggtgaaacaagccgggctgacagggcccccccgcccgtgctccttttgccggaggtctttatccgacccttgctattacaacaaggtggatagaacagtgtatcaattctgcagcccgtcttgttggactaagttccagcgcacttcaccggagggcgggatccacctgtcttgccactattgccattctttgttcagtggcaagcctgaggtactcgattggcaagatcaggtgtttcagttttgctgccgggattgctgcgaggacttcaaaaggctgaggggcgtggtcagccaatgtgagcattgcagacaggagaagttactgcacgagaagctcagattctcaggagtcgaaaagagcttctgcagcgaaggctgtgtgctgttgtataagcaggatttcacgaaaaaactgggattatgctgtatcacatgcacttattgctcacaaacgtgccagcggggcgttaccgaacagcttgacggctccacgtgggatttttgttctgaagactgcaagagtaaatacctcctgtggtattgcaaagccgccagatgccacgcctgtaaacggcaaggcaaattgcttgaaactatacattggaggggccagatcagacacttctgcaaccagcagtgcctcctgcgcttttactcgcagcaaaaccagccaaatctggatacacagtcagggcccgaaagtcttctcaacagccaaagcccagagtctaagccccagactccatcccagacaaaggtggaaaattctaatacgatccccgtgaagacaagatcagcccccacagcccctactccgcctcctccaccacctcctgccacaccgcgcaaaaataaggccgccatgtgtaaaccacttatgcaaaatagaggggtttcctgcaaagttgagatgaagagtaagggatcacaaaccgaggagtggaagccacaggtgatcgtactacccattcctgtcccgatttttgtacctgtacccatgcatctgtactgccaaaaggtgcccgtccctttcagcatgcctatcccggtcccagtgccaatgttcctccccacgactcttgaaagcactgacaagattgtggagactatcgaagaattgaaggtcaagatccccagtaatcctcttgaagcagacattctagccatggccgagatgatcgccgaagccgaagaacttgacaaggccagcagcgatctgtgcgatctggtctctaaccagtccgctgagggcctcctagaagattgtgatctcttcggtcctgcacgtgatgacgttttagcgatggcggtgaaaatggccaatgtgctggacgaaccaggacaggacctggaggctgactttccgaagaacccccttgatattaatccctccgtcgacttcctatttgactgcggtttagtagggcccgaggacgtgagcacggagcaggatctcccacgaacaatgcggaaaggccagaaacgactggtgctttctgagtcttgctcacgcgattccatgtcaagccagcctagttgtacaggcctgaactactcctatggcgtgaatgcgtggaagtgttgggtacagagcaaatacgctaatggggaaacttcaaagggcgacgagctacgcttcggccccaaaccaatgagaattaaagaagatattctggcctgcagtgccgccgagctgaactacggattggctcaatttgtacgcgagattactcgtcctaacggtgagagatacgagccagactcaatttattacctgtgcctcgggattcagcaatatttactagaaaataatcgtatggtaaatatatttacggatctgtattatttgacatttgttcaagaactgaacaaatcactgtctacatggcagccaaccctacttccaaacaacacagtgttttctcgagtggaggaagaacacctctgggagtgcaaacagctgggagtgtatagccccttcgtccttcttaacacattgatgttttttaacacaaaattttttgggctgcagactgctgaggaacacatgcaattgagctttactaacgttgtcaggcagtcacgaaagtgtactacacctaggggtaccactaaggtggtctccatacgatattatgctccggtccgccaaaggaaagggagggatactggcccaggcaaacggaagcgagaagacgaggcccctatcttggaacagcgagagaatcgtatgaatccgctgcggtgtcccgtcaagttctatgagttttacctatcaaagtgcccagaaagcctcaggacgcgtaacgacgtgttctacctgcagccagagcggagctgcatcgcagaatccccgctgtggtatagcgttattcctatggaccggtctatgctggagagcatgttgaaccggattcttgccgttagggagatttacgaagaactggggcggcctggcgaggaggacctagactag

SEQ ID NO: 212552 - DNA, 2112 bp, Artificial Sequence
  Description of Artificial Sequence: Synthetic coding sequence
atggagttcgtgagcggctaccgggacgagttcctggacttcaccgctctgcttttcggttggttcaggaaatttgtagccgaaaggggggccgtcggaacatcattagaggggcggtgccgtcagcttgaggcacagattagacggcttccccaagacccagccctgtgggtcctccatgttctgccaaaccactccgtaggcatctcactgggacagggagccgagccgggcccaggaccaggcctagggacagcttggctactaggtgataatcctccccttcacttaagagatctgagtccttacataagcttcgtctccctagaggacggcgaggagggggaagaggaggaagaagaggacgaggaagaggagaagagagaagatggcggggccggctctacagaaaaggtagaacccgaggaggaccgggagcttgcgccgacatcaagggagtcaccacaagagacaaaccccccaggcgagtccgaagaagcagcccgcgaggctggaggcgggaaagatggttgccgcgaagaccgcgtcgagaatgagaccagaccacagaagaggaaaggtcagcgttccgaagcggcacctctgcatgtctcatgcctgctccttgttacagatgaacacggcactatactcgggatcgacctgctcgtggacggcgcccagggtactgcaagctggggcagtggaacaaaggacctagccccatgggcatacgcactgctgtgtcacagcatggcgtgtcctatgggctcaggcgaccctcgtaagccgcggcagcttaccgttggggatgcacggctacaccgcgaactggaaagtctcgtgccaagactgggggtaaagctggctaagactccaatgcgcacctggggccctcgacctgggttcacctttgctagcctgcgcgcgcggacgtgtcatgtgtgtcaccgccacagctttgaggcgaaacttaccccatgccctcaatgttcagcagtgctgtattgcggagaggcgtgtctcagggccgactggcagagatgtccagacgatgtaagccataggttctggtgcccaagactcgctgcctttatggaacgggctggcgaactagcaacattacccttcacctacaccgccgaggtgaccagcgaaaccttcaataaagaggccttcctcgcttccagaggtttgacccgtgggtattggacccagctgtccatgctgatacccgggcccgggttttcacgccacccccggggcaatactccatccctgagcctgctacgtggtggcgacccttaccaactcctgcagggcgatggcactgcgctaatgcctcccgtaccaccgcatcctccgcggggagttttcgtgcctgagctcaatattcagaacaaacagagtctcaaaatacacgtagtggaagccggaaaagaattcgatcttgtgatggtcttctgggaactgttggtgttgctgccccatgtggccctggaactccaatttgtcggggatggactgcctccggaatccgatgagcagcactttacacttcagcgtgactctctagaagtttccgtgagaccgggttctggaatctcagctcgcccctcgagcggcacgaaggagaaaggaggcaggcgtgacctgcagattaaggtgtccgccagaccctatcatctgttccagggccctaagcctgatcttgtgattggattcaactccggctttgccctcaaagacacttggctacgctctttgcccaggcttcagagcctgcgcgtgcccgcattttttaccgaaagcagcgagtactcgtgcgtgatggatggccagaccatggccgtggccaccggtggaggtaccagcccacctcagcctaacccgtttcgatcacccttcaggctccgcgcggcagataattgtatgagttggtactgtaacgcattcatcttccatctggtgtataagcccgcgcagggttccggggcccggcccgccccaggacctcctccaccttcacccacgccctctgctccgccagctcctacccgtcggcgcaggggggagaagaagcccgggaggggcgccaggagaagaaaatag

SEQ ID NO: 212553 - DNA, 2229 bp, Artificial Sequence
  Description of Artificial Sequence: Synthetic coding sequence
atggagttcgtgagcggctaccgggacgagttcctggacttcaccgctctgctgttcggctggtttcgtaaattcgtggctgagcggggcgctgtgggaactagtctggagggacgatgtagacagttggaggctcaaatccggcgtctcccacaagatccggccttgtgggtcctacatgtgctgcccaatcattctgtgggcataagcctcggccagggcgctgagcccggcccaggacccggcctcggtacagcttggttgcttggggacaacccaccactgcatttgcgggacctctccccctatatatctttcgtaagtctcgaggacggggaggaaggtgaagaagaggaggaggaggacgaggaagaggaaaaacgtgaggacggcggagcagggagcactgagaaagtagagcccgaggaggacagagaactcgcccctacgtctagagaatcaccacaggagacaaatcccccaggtgaatctgaagaagcagcccgcgaggcaggtggtggcaaggatggatgcagagaagatcgggtcgagaacgagacccgccctcaaaagaggaaggggcagcgaagcgaagctgcccctctgcacgtctcttgtctacttttggtgaccgacgaacatggcaccattctggggatcgatcttctggttgatggcgcccaaggtactgcttcttggggatcagggacaaaggacctcgcaccttgggcctacgcactgttgtgtcatagcatggcctgccctatgggctctggcgacccacgtaagcctcgacaactgaccgtaggggatgctaggttgcaccgtgagttggagtctctcgtcccgaggcttggcgtcaaacttgcgaagacgccaatgcggacttgggggccccggccaggattcacttttgcgtcattgagagcccgaacatgccacgtgtgtcataggcactctttcgaagccaagctcaccccatgtcctcagtgcagtgctgtattatattgcggagaggcatgcctgcgcgccgactggcagagatgtcccgatgatgtgagccacagattttggtgccctaggttggcagcgtttatggaaagggcgggcgagctggccactcttccgttcacttacactgcggaagtgacaagtgagacctttaacaaggaggctttcctggcctcgcggggcctgacccggggctattggacacagctgagcatgctgatccccggacccggctttagtcggcatccgcggggcaataccccttccttgtccctgctgaggggaggagacccatatcagctgctgcagggggacggaactgcactcatgccccctgtccctcctcacccccctagaggcgtctttgggagctggcaggactattacacttggcggggactgagcctagactccccaatcgctgtactgctgacatatccccttacagtgtactatgtcatcacacatttagtccctcagtcatttccggagttaaatatccagaataagcagagtctgaaaatccacgttgttgaagccggcaaggagtttgatctcgtgatggtgttttgggaactgttggtgttactacctcacgtcgcccttgagttgcagttcgtcggcgatggcttacccccagagtctgatgagcagcatttcactctgcaacgtgacagccttgaggtttctgtgagacctggttctggaattagcgccaggccaagcagtgggactaaggagaaaggggggaggcgcgacctccagatcaaggtctcagctagaccttaccacctttttcaaggccccaagcctgatctggtcataggcttcaatagcggtttcgccttaaaagacacgtggctgagatcccttcccaggctccagtctcttcgagttccggccttcttcaccgagagtagcgaatacagttgcgtgatggatggccaaacaatggcagtggcgacagggggcggaacgagcccaccgcagcccaatccttttaggtctccctttcgcctgcgggccgcggataattgcatgagctggtactgcaatgctttcattttccacctagtgtataaacctgctcagggctctggcgcaaggcccgcaccggggccacctcccccttccccgacccccagtgctccacctgccccgaccaggcgccgacggggtgaaaagaagcccggccgcggggcccggcgccgaaagtag

SEQ ID NO: 212554 - DNA, 684 bp, Artificial Sequence
  Description of Artificial Sequence: Synthetic coding sequence
atgaccgacttcaagctgggcatcgtgcggctgggccgggtggccggcaagacaaagtatacgttgatcgatgagcaagacattccgctggttgaaagttattccttcgaagctagaatggaggtggacgcagacgggaacggtgccaaaatctttgcatacgccttcgacaaaaacagagggcgaggcagtggtaggctgctgcacgagctcctgtgggagcggcacagaggcggagtcgctcccggatttcaggtggtgcacctcaacgctgtgactgtggataaccgtctcgataatttacagctggtcccgtggggttggcgcccaaaggccgaggagacctccagcaagcaaagggagcagagtctctattggctcgctattcagcagttgccaaccgaccccatagaagagcagtttcccgtgctcaacgttacgaggtactacaatgcaaatggagacgtggtggaagaagaagagaattcctgtacctattacgagtgccactatcccccctgtacagtgatcgaaaaacaattgcgcgagtttaacatatgtggacgttgccaggtggctcgctactgcggatcacagtgccagcagaaggactggccagcacacaaaaagcactgccgggagagaaaaagaccttttcagcacgagctcgagcccgagcggtag

SEQ ID NO: 212555 - DNA, 2127 bp, Artificial Sequence
  Description of Artificial Sequence: Synthetic coding sequence
atgagcgagcggggcatcaagtgggcctgcgagtactgcacctacgagaactggccgagtgccataaagtgcactatgtgccgtgctcagcgtccttcaggtacaattatcacagaggatccttttaagagcggcagcagcgatgtgggacgagactgggatccgtcctccaccgagggcgggtcatcccccctgatctgccctgattcgtcggctcggccgcgcgtgaaaagttcgtactccatggagaacgccaacaagtggtcctgccacatgtgtacttacctgaattggcctcgggcaattcgctgcacacagtgcttgagccagcgccgtacaagatctcccacagagagtccccagagctctgggtctggctcgagacctgttgccttctccgtggatccctgcgaagaatataatgatcgcaacaagctgaacaccagaactcagcactggacttgttccgtctgtacatacgagaactgggctaaagctaagcgctgtgtagtgtgtgaccatcccaggcctaacaatattgaggcaatagaactcgcagaaactgaagaggcctcgagtatcattaacgaacaagatagggctagatggagaggttcttgctcgagcgggaatagtcagaggcgaagcccacctgctacaaaaagggactccgaagtaaagatggatttccagagaatagaattggctggtgccgttggcagcaaggaggaattagaagttgatttcaaaaaactgaaacagattaaaaatagaatgaaaaagacagattggttgttcctgaacgcatgcgtgggagtggtcgaaggtgacctggccgctatagaagcatacaaatctagtgggggagatatagctagacagctgacagcagatgaggtgagactgttgaatagaccgagcgcattcgacgtcggctacacgctcgtgcacctagccatacgtttccaacggcaggatatgttggccattcttttgaccgaggtgtcacagcaggctgccaaatgcatccctgccatggtctgcccagaactgacagagcagattagaagagaaatagcggcctcgctgcaccagcgcaagggagatttcgcctgttacttcctgacagacttggtgacattcacacttccagccgacatcgaagacttgcccccaactgttcaagaaaagctgttcgatgaagttctggatcgggatgtccagaaagagctggaggaagaaagccctatcattaactggagtttggagcttgccaccaggttggacagccgcctctatgcactgtggaaccggacagctggcgattgtctcctggacagcgtcctccaggcaacttgggggatttacgacaaagatagcgtccttaggaaggccttacatgattcactccacgattgctcccactggttttacactaggtggaaagactgggaaagttggtattctcaatctttcggtctgcacttctctctgcgtgaggagcaatggcaggaggactgggccttcatcctaagcctcgcctcccaaccaggcgcttcacttgagcaaacccacatctttgtcttagcacacatcctacgcagaccaataatcgtgtatggcgtgaagtactacaaatcctttcgcggagagacgctaggctacactcgcttccagggagtttacctcccccttctgtgggaacagagcttctgctggaaatctccgatagccctgggctacaccagaggccacttctccgctctggttgccatggagaatgatggctacggaaatcgcggtgctggagccaacctcaatacggacgatgacgtcaccattaccttcttacctctagttgatagcgagcggaagctgcttcacgtacactttctaagcgcccaggaactcgggaacgaagagcagcaggagaaattgctgagagaatggcttgattgttgcgtgactgagggcggtgttctcgtcgcaatgcagaagtcctccaggcgccgcaaccaccccctggtgacacaaatggtggagaaatggcttgacagatatcgtcagatcagaccctgtacttccctgagcgatggagaggaggacgaggatgatgaggatgaatag

SEQ ID NO: 212556 - DNA, 2400 bp, Artificial Sequence
  Description of Artificial Sequence: Synthetic coding sequence
atggagatccccaagctgctgcccgcccggggcaccctgcagggcggcggcggcgggggtattcccgccggtggggggcgagtgcaccgcggaccagattctcccgctggacaggtgccaacgcgcaggctgctgttgccccgtgggcctcaggacggagggcctggaagacgcagggaagaggcctcaactgccagccgcggccctggtccctccctgtttgcgccccgacctcaccagccctccggcggcggggacgactttttcttagtgctcctcgatcccgtggggggtgatgttgaaactgcaggaagcggccaggcggcaggtccagttctgcgagaggaggcaaaggctggtcccggcctccagggggatgagtcaggtgcgaatccagccggctgctccgcgcagggtcctcactgcctgtccgcagtccctacaccggcccccatatccgcccccgggcccgcagcagcatttgctgggaccgtaacaattcacaaccaggatctgctgctccgatttgaaaatggagtacttaccctcgccacacctccgccccacgcctgggagcccggtgcagcaccagcccaacagccacggtgtttaatagcaccccaggcagggttccctcaggctgcacatccaggcgactgtcccgagctgagatcagatctcttattggcagagcccgcggagcctgcgcctgcccctgccccccaggaggaagccgagggcctagcggccgctctagggcctcggggactccttggctcagggcccggggtcgtgctctacctctgccctgaggcactgtgcgggcagacattcgcaaagaagcaccagcttaagatgcatttgctcacccatagctcatcacagggacaaaggccatttaaatgtccgctgggaggctgcggctggacattcaccacatcttataagttgaaacggcatctgcagtcccatgacaagctgagaccattcgggtgtccagccgaaggttgcggaaaatcatttaccacagtctacaatcttaaggcccacatgaaaggacatgagcaggagaactctttcaaatgcgaggtctgtgaggaaagtttccctacacaagccaagttgggcgcacaccagaggagccatttcgagcccgagaggccctaccaatgtgctttttccggatgtaagaagacctttattacagtttcagcgctgttctctcacaaccgtgctcatttcagagagcaagagctgtttagttgttcctttcctggctgtagcaagcaatatgacaaggcttgccgacttaaaatccaccttcgaagtcacaccggcgaaagaccattcctctgcgacttcgatgggtgtgggtggaactttacatcaatgtctaaactgctgcgtcacaaacgtaagcacgacgatgaccgccgcttcatgtgtcctgtggaaggatgcggaaagtcatttacccgggcggagcacctgaaagggcactccataactcatctggggaccaaaccattcgtgtgccccgttgccggctgctgcgcgagattctcagcgaggagttctctctacatacattccaaaaagcatctccaggacgtggatacatggaaaagtagatgtccgatcagcagttgcaacaaacttttcacgtctaagcattccatgaagactcacatggtcaagagacataaagtaggccaggatttgctcgcccagctcgaagcagccaattctttgaccccatcaagcgagctaactagccagcgtcagaacgaccttagcgatgctgaaatcgtcagcctgtttagcgacgttccagactctacctcagccgcccttctcgacacggccttagtgaactctggcatccttacaatcgatgtcgcctccgtaagtagcaccttggccggccacctcccagcaaataacaacaactccgtgggacaggcagttgatccaccaagcctgatggcaaccagtgatcctccacagtcactggacacttccctgttctttggcacagctgctacgggttttcagcagtcctcactcaacatggatgaagtgtcttccgtatcggttggtcctctgggctcccttgattctctggctatgaagaactcaagcccggagccccaggcactaacgccatcttcaaagctcactgtagacactgatacactaacaccatcctctacactctgtgaaaactcagtctccgagctgctaacacctgccaaagccgaatggagcgtgcaccccaactccgacttttttggccaggagggggagactcagttcggcttcccaaatgccgctggcaatcatggcagccagaaagagcgcaatttaataaccgtgaccggaagcagtttcctggtttag

SEQ ID NO: 212557 - DNA, 2412 bp, Artificial Sequence
  Description of Artificial Sequence: Synthetic coding sequence
atggagatccccaagctgctgcccgcccggggcaccctgcagggcggagggggtggtggcatcccagcgggcggaggacgagtccaccgcggacccgattcccctgcagggcaggtacctaccaggcgactgctccttctcagaggaccccaggatgggggaccaggtagacgccgagaagaagctagtactgccagccgggggccaggaccttccttgctggcccctaggacagaccaacccagcggaggcggtgggggcggcggcgatgacttctttctggttcttctcgacccggtcggaggggatgtcgagactgccgggtctggtcaggcggctggaccggtcttaagggaagaagccgaggaggggccaggactccagggcggcgagtctggggccaaccccgctggacccaccgccctcggccctcggtgcctttcagccgtgcccacgcctgcgcccatttctgcaccaggaccagccgccgctttcgccggcactgtcacaatccacaaccaggatttgttacttcgattcgagaatggagtgctgacattagccacccctcccccccacgcttgggaacccggagctgccccagctcagcagcctgggtgcctcattgcaccgcaggcaggatttcctcacgccgcacacccaggggattgtccagaattaccacccgacctgctgctcgcagaacctgccgagcccgccccagcccctgcaccagaagaggaggcagagggccccgccgcggccctgggcccacgtggcccgttgggaagcgggccaggcgtggtactgtacttgtgtccagaggcccagtgtgggcagacttttgcgaaaaaacatcagcttaaagtgcacctgctgactcattcctcctcacaaggccagaggccattcaagtgtcctctcggggggtgcggatggacatttaccacaagctacaaactgaaaaggcatctgcagtcgcatgataagctgcgtccttttggctgccctgccgagggttgcgggaaaagctttaccactgtttacaatcttaaggcccatatgaagggacatgagcaggaaaactcttttaaatgtgaagtgtgtgaggaatctttcccaacccaggccaagctctcggcgcatcagcgctcacacttcgaacccgaaagaccataccagtgcgcgttctccggctgtaaaaagacgttcatcacagtctccgcgctcttctctcacaaccgggcccattttcgagaacaggaactcttctcctgctctttcccaggctgctccaagcaatatgacaaggcatgtcgtctgaagatccatctgcggtcgcataccggcgaaaggccattcctgtgtgactttgatggatgcggatggaattttacaagcatgtccaaattgctccggcacaaacgaaaacacgacgacgacaggagatttatgtgtccggttgaagggtgtggcaaatcatttactagggctgagcatttaaaggggcatagtataactcatctcggcaccaagccatttgtctgcccagtcgcggggtgctgcgcccggttcagcgcccgatcttctttgtatatccactcgaaaaagcatctgcaggatgttgatacgtggaagtcgcgctgccccattagctcgtgtaataagttgtttaccagtaagcattcaatgaaaacacacatggtgaaaaggcacaaggtcggccaggatctcctggcccagttggaggcagctaactctcttacacccagcagcgagctcacctctcagcggcaaaacgacctgtctgacgccgaaattgtcagtctcttcagtgacgtgccggacagtacttctgctgctctgttagataccgcactggttaacagtggaattcttactattgacgtggcctccgtgtcctccactctcgctggtcacctccccgcaaataacaacaactctgtaggtcaggctgtcgacccgcctagtcttatggcgaccagcgatcctccccaatccctcgacacaagtctgttcttcggaacagcagcgaccgggtttcaacaaagctctctgaatatggacgaggtcagctcagtcagcgttggcccgcttggcagcctcgactcactggctatgaagaactcatcccctgaaccacaggctctcacaccctcttctaagttgaccgtcgacacagacgctctgacaccgtcaagtaccttgtgcgaaaactccgtgtctgagctgctgacacctacaaaagctgaatggaacgttcaccccgatagtgacttttttggccaggaaggagaaacccaattcgggttccctaacgccgccggaaatcatggcagccaaaaggaaaccgatctgattacagttacgggctcttctttcctcgtctag

SEQ ID NO: 212558 - DNA, 2622 bp, Artificial Sequence
  Description of Artificial Sequence: Synthetic coding sequence
atggccagccggcggaagagcaccaccccctgcatggtgctggccagtgagcaggatccagatttagagctgatatccgatctagacgaggggcctcctgttctgactccagttgagaacacccgggcagaatcaatctcttccgacgaggaggtgcacgagagcgtggattctgacaatcaacagaataaaaaggtagagggagggtacgaatgcaaatactgcacatttcaaacccccgatctgaatatgttcacctttcacgtagacagcgagcatcctaatgtagtattaaactcgagctatgtgtgtgttgagtgcaactttttgactaagagatatgatgccctttctgaacacaacctaaaataccacccgggtgaagagaattttaaactgactatggtcaagcgcaataatcagacaattttcgaacaaaccattaacgaccttaccttcgatggttctttcgtgaaagaggaaaatgctgaacaggcagaatctaccgaggtgtcaagtagcgggatatctataagcaagacacccataatgaaaatgatgaagaataaggtggagaacaagaggatcgccgttcaccataacagtgtagaagatgtgcccgaggagaaggagaacgagatcaaaccagaccgggaggagatcgtggaaaatccatcgtcttcggcatctgaatcaaacacaagcacatccattgtcaataggattcacccatctacggcttcaaccgttgtgacccctgccgccgtgctgcccggactggcacaagtgatcactgccgtttctgctcaacaaaacagtaatctcattccgaaagtgctcattcctgtcaacagcatcccaacatacaatgctgcactcgacaataaccccctcttgcttaacacctacaataaatttccataccctacgatgagcgagatcaccgtgctgagcgcacaggcaaagtacaccgaggagcagattaagatctggttctccgctcagcggctgaagcacggagtgagttggacacccgaggaagtggaggaggctcggagaaagcaatttaacgggaccgttcacacggtgcctcaaaccatcaccgtgattcctacccatattagcacaggctctaacgggctaccttctatcctgcaaacatgccaaatagttgggcaacccggactggtgcttacacaagtcgccggtaccaacacactgcctgtgacagctcccatcgcattaacggtcgccggcgtgccaagccagaacaatattcagaaatcccaagtgcctgctgcccaaccaaccgctgagactaaacccgcaacagctgccgtgcctacttcccagagcgtgaaacacgaaacagccctcgtgaaccccgactcctttggaatccgagctaagaagaccaaagaacaattggctgaactcaaagtgtcatacctgaagaatcagtttcctcacgacagcgaaattatcaggctgatgaaaataacaggccttacgaaaggagagatcaagaagtggtttagcgataccaggtacaatcaacgaaattccaagtctaatcaatgtctgcatctcaacaacgacagcagtaccaccataattattgatagcagcgatgaaaccacggaaagcccgaccgtgggcaccgctcaacctaaacagagctggaacccctttcccgactttacgcctcagaagttcaaggaaaagaccgccgagcaattgagggttcttcaggcgagctttttgaactcaagcgttctgactgacgaagagttaaaccgcctacgcgcgcagaccaagcttacccgaagggagattgatgcatggttcaccgagaagaaaaagagtaaggcactcaaggaagaaaagatggagatcgacgaaagcaacgcagggtccagcaaggaggaagccggtgagaccagcccagcagatgaaagcggcgctcccaagagtggcagcactgggaagatttgtaagaaaaccccggagcagttgcatatgctgaaaagtgcctttgtccgcacacagtggccttctcccgaggaatatgacaagctcgccaaggaaagcggcctggctcgcactgatatcgtgagctggttcggcgatacgcggtacgcgtggaaaaacggcaaccttaaatggtactactattatcagagtgctaactcatctagcatgaacgggttgtctagcctgagaaagagaggacggggccggccaaaaggtcgagggcgtgggaggccccgggggcgtccaagaggatccaaacgaatcaacaactgggataggggtccttccctgattaaatttaaaaccggaacagccatactcaaggattactacctgaaacacaaattcctcaatgaacaggacctagatgagctggtgaacaagtcccacatgggctatgaacaggtgagggagtggtttgcagagcggcagcgccggagcgaactgggcatagagctcttcgaggagaacgaagaagaggacgaagttattgacgaccaggaggaggatgaggaagaaaccgatgatagcgacacctgggaaccccctcgccatgtgaaaagaaagctgtccaaatctgacgattag

SEQ ID NO: 212559 - DNA, 2622 bp, Artificial Sequence
  Description of Artificial Sequence: Synthetic coding sequence
atggccagccggcggaagagcaccaccccctgcatggtgctggcctccgagcaggaccccgacctcgagctcattagtgatttagacgagggcccccccgtgctgaccccagtcgaaaacacccgcgcagaaagtatcagtagtgacgaggaggtgcacgagtccgtcgattctgataaccagcagaataaaaaggtggaggggggctacgagtgcaagtattgcacttttcagacccctgacctgaatatgttcacatttcatgtggactccgagcatcccaatgtggtgctgaattcttcctatgtgtgcgttgaatgtaacttcctcacgaagcggtacgacgctctgagtgagcacaatctcaagtatcacccgggcgaagagaactttaaattgactatggttaagcgaaacaaccagaccatctttgagcaaacaatcaacgacctgaccttcgatgggagcttcgttaaggaggagaatgctgagcaggctgagagcacggaggtgtcctcatcgggaatcagcatcagtaagacccccattatgaaaatgatgaagaataaggttgagaacaagcgcattgcggtccaccataattccgttgaggatgttccagaggagaaagaaaacgagataaaaccggaccgagaggagatcgtggaaaacccatcaagctcagcctctgagtctaatacctccaccagcatcgtaaaccgcatccacccttcaaccgcatccaccgtggtgacgcccgctgccgtactgccgggcctcgcccaagttattacggccgtctctgctcagcagaattccaatctgatccccaaagtgctgatccccgtaaatagcatacctacttataatgcagctctggacaacaatccgctcctcctgaatacctacaataagtttccctatcccaccatgtccgaaatcacggtcctcagcgcccaggccaagtatactgaagagcagattaagatctggtttagcgcgcagcggttgaaacatggcgtgagttggactcctgaagaggtggaggaggcacggcgcaaacagttcaacggcacagttcataccgtgcctcagactatcaccgtgattcctacacacatatccaccggctccaacggcctgccctcaatcctgcagacctgtcagatcgttggccagccagggctggtcttgacacaagtggctgggacgaatacgctaccagttactgctcccattgccctaacagttgcaggggtgccatcccagaataacatccagaaatctcaagtccctgctgcccagcccacagctgaaacgaaaccggccacggcagcagtgccgacaagccaatccgtgaaacatgagactgccttggtaaatccggatagtttcggaatcagggctaaaaagaccaaagagcagctggccgagttaaaggtgagctatctgaagaaccagttcccacacgactctgaaataatccgattgatgaagatcactggcctcactaaaggtgagataaagaaatggtttagcgataccagatataatcagaggaattccaagagcaaccagtgccttcacctaaacaacgatagctctactaccatcatcatcgacagctccgacgagaccactgagagtccaaccgtggggaccgcccagccgaaacagtcgtggaacccattccccgatttcaccccacagaagtttaaagagaaaacagcagaacagctgcgagtgttacaggcatcgttcttgaattcttccgtcctgactgatgaggaattaaatagactcagagcccagaccaaactgaccagaagagaaatcgatgcatggtttaccgagaagaaaaagtccaaagcccttaaggaggagaagatggaaattgacgagtccaacgccgggagttctaaagaggaggctggcgagacctccccagctgacgagagcggcgcaccaaagtctggttctactggcaaaatatgcaagaaaactcctgagcagttgcatatgctgaagtcggcctttgtgcggacccagtggccgtctcctgaggagtatgacaaactggctaaggaaagcgggctcgctagaactgacatcgtctcttggtttggagataccaggtacgcgtggaagaatggcaatctcaaatggtactattattaccagtcagccaattctagttcaatgaacggtttatcctcccttcggaagcgaggaagaggccgaccaaaggggaggggcaggggcagacctaggggaaggccccgggggtcaaagcgcataaataattgggatcgcggtccatctttgatcaagttcaagacaggcacggctatcctgaaagactattacctgaaacacaagtttctgaatgaacaggatctagacgagctggtgaacaagtcacatatgggctacgaacaggttcgcgaatggtttgctgaacgtcagcgccgctcagaactcggaatcgaattatttgaggagaatgaagaagaggacgaagtgatcgatgatcaggaagaggacgaggaggagaccgacgattcagacacgtgggagccaccaagacatgttaagaggaagctcagtaaatccgatgattag

SEQ ID NO: 212560 - DNA, 2622 bp, Artificial Sequence
  Description of Artificial Sequence: Synthetic coding sequence
atggccagccggcggaagagcaccaccccctgcatggtgctggccagcgaacaggaccccgacctcgagctgatttcagatctggatgagggtcctcccgtattaacccctgtggagaacacacgggccgaatccatttcgtctgacgaagaagtccatgaatctgtggattctgataaccaacagaataagaaggttgagggtgggtacgagtgtaaatactgtacatttcagacaccagacctcaatatgtttacctttcacgtggacagcgagcaccccaacgtagtgcttaactcctcttatgtgtgtgtagaatgtaatttccttacaaagagatatgatgccctgagcgaacacaacctgaaataccaccccggcgaggaaaacttcaagcttactatggtcaaacgaaacaatcaaaccattttcgaacaaactatcaacgacctgacctttgacgggtcgtttgttaaggaggagaatgccgaacaagcagagtcaacagaagtaagcagcagtggcatttctatatccaagactcccattatgaagatgatgaaaaataaggtggagaataaacgcatagctgtccatcataattccgttgaggacgtgccagaagagaaggagaacgagattaagcctgacagagaggaaattgtggagaatccgagctcgagcgccagtgaatcaaacaccagcaccagtatagtcaaccggatacatccgtccactgctagtacagtggtgacaccagcagccgttcttcccgggctcgcccaggtgataacagccgtgtcggcccagcaaaatagtaaccttataccaaaagtactgattcccgtgaacagcataccaacttataatgccgctctggataataatcccctcctgcttaatacgtataacaagttcccatatccaacaatgtctgagatcaccgtcttgtcagcacaagccaagtacacagaggagcaaataaagatttggttctccgctcagagactcaagcatggcgtcagctggacacctgaggaggttgaagaagcccggcgcaagcagttcaacggaactgtgcacaccgtgccccagaccatcacagtaataccaacccacatatcaactgggtctaatgggttgcctagtattctccagacatgccaaatagtgggccaacctggtctcgttctgacgcaggttgctggtacgaatacactgccagtcaccgctccgatcgccctgaccgttgccggagtgccctcacaaaataacatccagaaatctcaggtcccagcagctcagcccaccgcggagaccaagcccgccactgcggctgttccaaccagccaaagtgtaaaacacgaaaccgcgctggtaaatccggactctttcgggattcgcgctaaaaaaacaaaggagcagctggcggagctgaaggtctcgtatttgaagaaccagttcccccatgactctgaaataatcaggctgatgaagattacgggacttacgaaaggcgaaatcaaaaaatggttctctgacacccggtataatcagcgcaatagtaagtccaatcaatgcttacatctgaacaacgattccagtacaacaatcattatcgacagctccgacgagaccacagagtcaccgacagtgggaaccgctcaacccaagcagtcatggaatcccttcccagacttcacgccccagaagtttaaagagaagacggcagagcagctgagggtgttacaggctagcttcctgaacagcagcgtgcttacagatgaggagttaaaccgcctccgagcccagaccaagttgacccgccgagaaatcgatgcttggtttaccgaaaagaagaagagcaaggccctcaaggaagaaaaaatggagattgacgaatctaacgctggctcttcaaaagaggaagcgggggagacctcccccgccgacgagtcaggggcacccaagtctggaagcacaggaaagatttgtaagaaaacacctgaacagttgcacatgctcaagagtgcatttgttaggacacagtggccctccccagaagagtacgacaagctggcaaaggagagcgggctggcaagaacagacatcgtatcctggttcggcgacacaaggtacgcctggaagaatggaaaccttaaatggtactactactatcaatccgcaaactccagtagcatgaatgggctgagctccctgcgcaagcgtgggagagggcgtcccaaaggacgcgggcgcggacgccctcgggggaggcctcgcgggtcaaagaggattaataattgggaccgtggtcccagcctaattaaatttaagaccggcaccgcgattctcaaggactattatctcaagcataagttcctgaacgaacaagatctcgatgagttggtgaacaagagccacatgggctacgagcaggtgcgcgaatggttcgcagaacgacaacgtcgaagcgaactgggaattgaactgttcgaggagaacgaagaggaggatgaggttatcgacgaccaggaagaggacgaagaagagaccgatgattccgacacttgggagcccccacgccatgtgaaacgcaagctctcgaaatcagacgactag

SEQ ID NO: 212561 - DNA, 1497 bp, Artificial Sequence
  Description of Artificial Sequence: Synthetic coding sequence
atggccagcaagcggaagagcaccaccccctgcatgatccccgtgaaaaccgtggttctgcaggacgctagtatggaggcccagcctgccgagaccctaccagaaggcccacagcaggaccttccccccgaagctagtgcggctagctccgaggccgcccagaatccttccagcaccgatggaagcacactggccaacggccacagaagcactttggatggttacctgtacagctgtaagtattgtgattttaggtcacacgacatgacccagttcgtgggccacatgaattctgagcacaccgactttaataaagatccaacatttgtgtgttccggctgctcgttccttgcgaagaccccggaggggctgagcctgcacaacgccacatgccattcaggcgaggcttccttcgtgtggaacgtagcaaagcccgataatcacgtcgtggttgagcagtccatcccagaaagtacctctacccccgacctagctggagagccatccgctgagggtgctgacgggcaggctgagataataatcactaagacacccattatgaagataatgaagggtaaggctgaagcaaaaaagatacatacacttaaggaaaacgtaccatcgcagcccgtgggcgaagctctaccgaagctcagtactggggagatggaagtgcgtgagggagaccactcctttattaacggagccgtccctgtttcacaggcctcggcctcttctgcgaagaacccacacgcggccaacggcccgttaatcggaacagtacctgtcctgcctgcggggatcgcccagttcctctcacttcaacaacagcctccagtgcacgcacaacatcatgtgcatcagccgctacccacagccaaagctctcccaaaggtgatgattcctttgtcgtcaatacccacttataatgcagccatggattctaactcttttctaaagaatagttttcataaatttccttaccctaccaaagctgagctttgttatttgacggtcgtgactaagtaccccgaagaacagctgaaaatttggtttacagcacaaaggctcaaacaggggattagttggagcccagaagagatcgaggacgctagaaaaaaaatgttcaacaccgtcatccagtccgtgcctcaacccacaatcacagtacttaatactcccctcgtggcctcagccggaaacgtgcaacacctcatacaggcggcactgccaggacacgttgtgggtcagcctgagggcaccgggggcggactgcttgtgacacaacccttgatggctaacggcctccaggccacgagctccccactacccctgacagttacatccgtcccaaaacagcccggcgttgctcccattaacacggtgtgttccaatacaactagcgctgtcaaagttgtgaacgctgcccagtccctcctgaccgcctgccctagtattacatcgcaagcttttttggacgcaagtatctacaagtag

SEQ ID NO: 212562 - DNA, 291 bp, Artificial Sequence
  Description of Artificial Sequence: Synthetic coding sequence
atggccagcaagcggaagagcaccaccccctgcatgatccccgtgaaaactgttgtgctacaagacgcctccatggaggcccagcccgccgagaccctgcctgaaggcccccaacaggacctcccacctgaggctagtgccgcctcctcagaagcagcccagaatccaagctcaacagacggaagcacacttgcaaatggacacagaagcaccctggacggctacctctatagctgtaagtattgtgactttcggtcccatgatatgacgcagttcgtcggtcacatgtag

SEQ ID NO: 212563 - DNA, 2244 bp, Artificial Sequence
  Description of Artificial Sequence: Synthetic coding sequence
atggaggtgcgggagggcgaccacagcttcatcaacggcgccgtgcccgttagtcaggctagtgccagctctgccaaaaacccacatgctgctaacggaccgctcatcggtacggtgcccgttctgcctgctggaatcgctcagtttcttagcctgcagcagcaacccccggtgcacgcccagcaccacgtacaccaaccactgccaaccgccaaagcacttccaaaggtgatgatccctctcagtagtatcccaacctacaatgctgcgatggacagcaacagttttctgaaaaactcctttcataaattcccgtatcccaccaaggctgagctatgctacctaacggttgtgacaaagtatcctgaagagcagctgaaaatctggtttaccgctcaacgactgaagcagggaatatcctggagtcctgaagaaatagaagacgctcggaagaagatgtttaacactgtgattcaatccgtcccccaacctaccattaccgtgttaaacacacctctggtggcctctgccgggaacgttcagcacctgattcaggcagctctcccaggccatgtggtaggccagcctgaaggaacaggcggtgggcttctagtcacgcagccgctgatggcaaatggtctgcaggcaacctcctctccgttgcccctgactgtcacctctgtcccaaaacagccaggggttgcccctattaacacagtttgcagcaacactacttccgccgtgaaagtcgtaaatgcagcacagtccctgctgactgcatgcccaagcatcacaagccaggcttttctggacgcctctatctacaagaacaagaaatcgcacgaacagctctctgcgctcaagggaagtttttgtaggaaccagtttcccggacagtctgaagtggagcaccttactaaagtgacagggctgagcacccgggaagtgcgaaagtggttctctgatcgccgataccattgtaggaatttgaagggctcccgagcgatgatccccggagatcactcatccatcatcatcgatagtgttccagaggtcagcttctcccccagctccaaggtgcccgaagtcacttgcattccgacaaccgctacactagcgacacacccaagtgcaaagcggcaatcatggcaccagactcctgactttacgcccacaaaatataaggagagagcacctgagcagctgagagcattagagagtagcttcgctcagaatcccttgccacttgacgaggagctcgataggttgcgatcggaaaccaagatgaccaggcgtgagatagatagttggttcagcgaaaggaggaaaaaggtgaatgccgaggaaacaaagaaagctgaagaaaatgccagccaagaggaagaggaagccgcagaagacgagggtggcgaagaagacctggcttctgaattgcgcgtgtctggagagaatggcagtctggagatgccgtcctcacacatccttgcggagcgcaaggtcagcccaataaagattaatctcaagaatttgcgggtcacagaagcgaacggccgcaacgaaatccccggcctcggcgcttgtgatccagaagacgacgagtctaacaagctggccgaacagttaccggggaaggtgtcatgcaaaaaaaccgctcaacagaggcacctcctgagacaactgtttgtgcagacgcagtggccatcaaatcaggactatgactccattatggcccagaccggtttacctcggccggaagtcgtccgctggtttggggatagtagatatgcgctgaaaaatggacagttgaagtggtacgaagactacaagcgcgggaactttcctcctggcctgttggttatcgcacctggaaatagagagctcctgcaggactattacatgactcataagatgctatatgaagaggatctccagaatttatgtgataaaacccagatgtctagtcagcaggtgaaacagtggttcgcagagaagatgggagaggaaaccagagccgtggctgacaccggaagcgaggaccagggacccggcacgggtgaactcaccgccgtgcataagggtatgggggatacctatagtgaagtgagtgaaaattcagaaagctgggagcccagggtcccagaagccagtagtgagccctttgacacgtcaagtcctcaggccggaagacaactgggctcttggtccctgtcctctcagcctctccctagcttactgactctgtag

SEQ ID NO: 212564 - DNA, 2871 bp, Artificial Sequence
  Description of Artificial Sequence: Synthetic coding sequence
atggccagcaagcggaagagcaccaccccctgcatgatccccgtgaagacagttgttcttcaagatgccagcatggaagctcaacccgctgagacactgcccgagggaccccagcaggacttaccaccagaagccagcgcggcctcctctgaggcagctcaaaatccttcatccacagatggcagcacacttgcgaacggacaccgctcaaccctggacgggtatctctattcttgtaaatactgcgatttccggagccatgatatgacccagtttgttggccatatgaattcggaacacacagattttaataaagacccaacttttgtgtgtagcggatgttctttcttggccaaaaccccagagggcctgtctctgcacaatgccacctgtcattcaggcgaagccagcttcgtgtggaatgtggccaagccagataatcatgtggtggtggagcagagcattcctgagagtactagcacccctgacctggcaggcgaaccgtccgccgaaggagcagatggccaggctgagataattattactaaaacgccaattatgaagatcatgaagggaaaggccgaagccaagaagatacatacactgaaagagaatgtgccctcccagcccgtgggcgaagccctgcccaagctctcaactggcgaaatggaggtccgagagggagaccactctttcatcaatggggcagtgcctgtctcccaggcctctgcctccagtgcgaagaatccccacgccgccaacggcccattaatcgggaccgtgccggtgctcccggctggaatcgcacaattcctaagcctccagcaacaacctccagtccatgctcaacatcacgtgcatcagccgctgcctactgccaaggcactcccgaaggttatgatcccactcagttccatccctacatataacgccgcgatggatagcaactcctttttaaagaactcctttcacaagtttccttacccaacaaaagctgaactgtgttacctgaccgtcgtcactaagtacccagaagaacagctcaaaatctggttcacagcccagaggctgaagcaggggatcagttggtcacctgaggagatcgaggacgccaggaaaaaaatgtttaatacggtgatacagagcgtcccacagccgaccatcaccgtgctgaacactccactggtggctagtgccggcaatgtccagcatttgattcaggcagccctccccggccatgtagtgggccagcctgagggaacaggtgggggactgctggtcacccagcctcttatggcaaacggcctgcaggctacatcctcacctctccctctgacagtgacgtcagtgcctaagcagccaggtgtggcccccataaataccgtttgctctaacacaacatcagcagtgaaggtggtcaacgccgcacagtctctcctgactgcctgtccctctatcacctcacaggcctttctcgatgcatctatttataagaataagaagagtcatgaacagctgagtgctcttaaaggaagtttctgtaggaaccaatttccaggacagtccgaggtggaacacctgaccaaggtaacaggactctctaccagggaggtgagaaaatggttcagcgataggcgctatcattgccgcaacctgaagggatcgagggctatgattccgggagaccactcatctataatcatcgactccgtcccagaggtgtcattcagcccatcttcaaaagtcccagaagtaacctgtattccaacaaccgctacattggccactcatccttccgccaaaagacagtcctggcaccaaacgcccgatttcactcctacaaaatataaagaacgggctccggagcagctgcgtgcattggaatcatccttcgcacaaaacccgttacctctggacgaagagctcgacagactgagaagcgagactaaaatgactaggagggagatcgattcttggttttcagagaggaggaaaaaggttaacgctgaggagaccaagaaggccgaggagaatgcctcacaagaagaggaggaggcagccgaagatgagggcggcgaggaggatctcgcctcagagcttcgcgtttccggagagaatgggtccttagaaatgccctcatctcacatactggctgaacgcaaggtgagtccaatcaaaataaaccttaagaacctcagggtcactgaagcaaacggtcgtaatgagatccccgggctaggcgcctgtgaccccgaggacgacgaatccaacaagctggccgaacagctcccaggcaaggtatcctgtaagaagacagcccagcagagacacctgctcagacaactttttgtgcaaacgcaatggccttcaaatcaagactacgactcgattatggcacagacagggctgcctcgccctgaggtggtgcgctggttcggggattcgcgctacgccctcaaaaacggtcagcttaagtggtatgaagactacaaacgtggcaacttcccgcccggattgttagtgattgcccccggtaacagggagctgctgcaggactattatatgacacacaagatgctgtacgaggaagacctgcagaatctatgcgacaagacccagatgtcctcccaacaggtaaaacagtggtttgctgaaaaaatgggagaagagacaagggcagtggccgacaccggcagtgaagatcagggccctgggacgggcgaacttacagctgtacataagggcatgggggacacatactccgaggtcagcgagaacagcgagagctgggaaccaagagtacctgaagcatctagtgaaccatttgataccagttctcctcaggccggacggcaactggaaaccgattag

SEQ ID NO: 212565 - DNA, 141 bp, Artificial Sequence
  Description of Artificial Sequence: Synthetic coding sequence
atggccagcaagcggaagagcaccaccccctgcatgatccccgtgaagactgtggtcttacaggacgcatccatggaggcccagccagctgagacgttaccagaaggccctcagcaggatctcccccccgaggcctcttag

SEQ ID NO: 212566 - DNA, 1497 bp, Artificial Sequence
  Description of Artificial Sequence: Synthetic coding sequence
atggccagcaagcggaagagcaccaccccctgcatgatccccgtgaagacagtggtcctgcaggacgcttctatggaggcccagcccgccgagacactgcctgagggcccccagcaggatttgcccccggaagcgagtgctgctagttcagaggccgcccaaaacccatcctctactgatggctctacactggcgaatgggcatcgctctaccctggacgggtatctgtattcttgcaagtattgtgacttccgctcacatgatatgacacagttcgtcggccatatgaattctgagcatacagactttaataaggatccaacattcgtttgctccggctgctcatttctggctaagactcccgagggactgagcctgcataatgcgacatgccactccggagaagcttctttcgtgtggaacgtggccaaacccgataaccatgtcgtggtagaacagagtatccccgaatccacttccacgcctgatctggccggcgagcccagcgctgaaggggcagatggacaggctgagataatcatcaccaagacaccgataatgaaaatcatgaagggcaaagcagaggctaagaagatccacacactgaaagagaatgtgccttctcagcctgtcggtgaggccctacccaagctgtcaactggcgagatggaagtgcgggaaggagatcactcctttatcaacggggcggtccccgtgagtcaggcaagtgccagttctgctaaaaacccacatgctgcaaatggtcctcttattgggaccgtgcctgtgctccccgctggaattgcacagtttctgtctttgcagcagcagcccccagttcacgctcagcatcacgtgcatcagcctctgccaactgctaaagccctacctaaagtgatgattcccctgtcgagcatacctacctacaacgctgcaatggattcaaactcttttctgaagaatagttttcacaagtttccttacccaacaaaagcagaattgtgctacttgacggtagtgacaaagtaccctgaggagcagttaaaaatttggttcacggcacagcgcctaaaacaaggcatctcatggtcacccgaggaaattgaggatgcccggaaaaagatgtttaataccgtcattcaatccgtgccacagcctacaattacggtcttaaatacccctctagtcgcctctgccggcaacgttcaacatctgatccaggctgctctgccagggcacgtggtgggccaaccggaaggtactggcggcggcctgctggtcacacagcccctgatggcaaacggtctgcaggcaacctctagtcccctcccactgacagtgacctcggtacccaagcagcctggggtcgcccctatcaacaccgtatgtagtaacacaacatctgctgtaaaagtggtaaacgcagctcagagtctcttaacggcctgcccgagtattaccagccaggcattcctggatgcaagcatctataagtag

SEQ ID NO: 212567 - DNA, 147 bp, Artificial Sequence
  Description of Artificial Sequence: Synthetic coding sequence
atggccagcaagcggaagagcaccaccccctgcatgatccccgtgaagacagttgtgttgcaagacgcatcgatggaagctcaacctgccgaaactttacctgagggcccacaacaggatcttcctccagaagccagcgcagcttag

SEQ ID NO: 212568 - DNA, 273 bp, Artificial Sequence
  Description of Artificial Sequence: Synthetic coding sequence
atggccagcaagcggaagagcaccaccccctgcatgatccccgtgaaaaccgtggtcttgcaggatgcgagcatggaagcccagcccgcggagactttacccgaaggacctcagcaggacttgccccctgaagcatctgctgcaagcagtgaagctgcgcagaatcccagtagcacagatgggagcacgctggctaatgggcaccgtagcacactcgatgggtatctgtactcttgcaagtactgcgactttcgcagtcacgatatgacatag

SEQ ID NO: 212569 - DNA, 357 bp, Artificial Sequence
  Description of Artificial Sequence: Synthetic coding sequence
atggccagcaagcggaagagcaccaccccctgcatgatccccgtgaaaacagtggtgctgcaggatgccagcatggaggcgcagcccgccgaaacactgccagaagggccacagcaggacctgccacccgaggcatcagccgcgtcctcagaggcagctcagaatccctcttccaccgatggcagtacgctagccaatggacatcgcagtacattggacggctacctatacagttgtaaatactgtgacttccgatcccatgacatgacacagtttgtcggtcacatgaatagcgaacacaccgacttcaataaagatcccacatttgtatgtagtgggtgttcattcctcgcatag

SEQ ID NO: 212570 - DNA, 2871 bp, Artificial Sequence
  Description of Artificial Sequence: Synthetic coding sequence
atggccagcaagcggaagagcaccaccccctgcatgatccccgtgaagacggttgtacttcaagatgcatctatggaagcccaacccgctgagactttgccagaagggcctcagcaggatcttccgccagaggcatctgcagcctcaagcgaagccgcacaaaacccatccagcacagatggtagtactctagccaacggacaccgaagcaccctggatggatatctgtattcctgtaaatactgcgacttccgctcccatgacatgacacaatttgtaggacacatgaactccgagcatactgattttaacaaagatcccactttcgtttgcagcggttgttcctttctggccaagacccctgagggactgtcgctacataatgctacttgccattcaggggaggcgagtttcgtgtggaatgttgcgaaacctgacaatcatgtcgtggttgagcagtccatcccggagtcaacaagtactcctgacctggctggcgagcctagcgccgagggagctgacggccaggccgaaatcataataaccaagaccccgatcatgaagatcatgaagggaaaagctgaagcaaagaaaatacacaccctgaaggaaaatgtgcctagccaacctgttggcgaggcccttcccaagctctctacaggcgaaatggaagttcgcgagggtgatcatagcttcatcaatggggctgtccctgtatcacaagcctccgctagttcagccaagaaccctcatgccgccaatggacccttgattgggacagtgcccgtgctgcccgcaggcattgctcaattcctatcccttcaacagcaaccccccgttcatgcccagcaccacgtgcatcaaccactccccacggccaaggccctgcccaaagttatgatacccttatcctccattccaacctataacgcggctatggattccaactcatttttaaagaattcttttcataagttcccctatcctaccaaggcagagctttgttacctgaccgttgtgacaaaatatcctgaggagcagctgaagatctggtttaccgcccagcgcctgaagcagggaatttcctggagtccagaggagatcgaagatgcccgaaagaaaatgttcaataccgtgatccagagcgttccacagcctaccattaccgtactgaatactccactcgtggcttccgcggggaacgtacaacacctcatccaggcggcactgcccgggcacgtcgttggccaaccagagggcaccggcggaggcctgctggtgacccagccactcatggccaacggtctacaggctactagcagcccacttccactgaccgttacctccgttcccaagcagcccggagtggcgccgattaacaccgtgtgcagtaacaccacaagtgcagttaaggtagtcaatgctgcccaaagcttgcttacagcctgtccttccattacttcccaagcatttttggatgcaagtatatataaaaacaagaagagccacgaacagctgtcagcactgaagggcagcttctgccggaatcagttccctggtcaatctgaggtagagcatctcacaaaggtcacgggactcagcaccagagaagttcggaagtggttctcagatcgtagataccactgccgcaatctgaaaggatctagagcaatgattcccggcgatcactcctcgataattatagattctgtacccgaggtgtcgttctctccaagctccaaagtgcctgaggtgacatgcatccctactactgcaaccctcgccactcacccctctgccaagcgccagagttggcatcagaccccagacttcacgcccacaaagtataaagaaagagcgcccgaacagctgcgcgcccttgagtcaagtttcgctcagaaccccctgcccctggacgaggagcttgatagacttagaagcgagacgaaaatgaccaggagagaaatcgactcttggttcagtgagcgccggaaaaaggtaaatgcggaggaaaccaaaaaagccgaggagaacgcatctcaggaggaagaggaggccgcagaggacgagggcggggaagaggacctcgccagtgagctcagagtgtcaggcgaaaatgggtcactggagatgcccagttctcacattctggccgagcgaaaggtcagcccaattaagatcaatctgaagaaccttagggtgaccgaagcaaacggccgaaatgaaatccccggcttgggtgcctgcgaccctgaggacgatgagagtaataaactggccgaacagctgccaggcaaggtttcttgtaagaagactgctcagcaaagacacttgctgaggcaactgttcgtgcagacccagtggccaagtaaccaggactatgatagcattatggcacagacagggttgccccggcctgaagtggtccggtggttcggcgattcaaggtatgcgctcaaaaatggacaactgaaatggtacgaagactacaaaagaggtaactttccccccggcctgctggttatcgcacccggcaatagagagttactgcaggattactacatgacccataagatgctctacgaagaggacctgcagaacttatgtgataaaacccaaatgtcctctcagcaggtgaagcagtggtttgcagagaagatgggtgaagagactcgggccgtggcagatactgggtctgaggaccagggacccggaacaggagagcttaccgccgtccacaaaggtatgggagatacttacagcgaagttagtgagaactcagagtcgtgggagccacgtgtccccgaggcgtcaagcgaacctttcgatacctcttctcctcaagccgggcgacagctggaaacagactag

SEQ ID NO: 212571 - DNA, 2910 bp, Artificial Sequence
  Description of Artificial Sequence: Synthetic coding sequence
atggccagcaagcggaagagcaccaccccctgcatgatccccgtgaagacagtcgtcttacaggatgcatccatggaggcccagccggccgaaactttacctgagggaccccagcaagacctgccgcctgaagcttcagctgcaagcagtgaggccgcacagaatccatcgagcaccgacggaagcaccttggcaaatggtcacaggagcaccctcgatggttatttatacagttgtaaatactgtgattttcgaagtcatgacatgacacagttcgtgggccacatgaactctgaacacaccgattttaacaaagacccgacttttgtgtgtagcggctgttctttcctggcaaagacccccgaagggttgagtctgcacaacgccacctgccacagcggggaagcaagttttgtttggaatgttgctaaacccgacaatcatgtggttgttgagcagtctatccctgagagcacaagcactccagatctggcgggagaacccagtgccgaaggggccgatggtcaggcggagataattattactaagactcccatcatgaaaattatgaaggggaaggcagaggctaagaagattcataccttaaaggagaacgtcccctcacagcccgtgggcgaagctctccccaagcttagtactggcgagatggaggtgcgggagggtgatcatagtttcatcaatggagccgtgcccgtaagtcaggcgtccgccagcagtgcaaagaatccacacgccgcgaatggccccttaatcggaactgtgcccgtccttcctgccggaatcgcacagtttttgagtcttcagcagcagcccccagtgcacgctcaacaccacgtgcatcagccattgccaacagccaaagctctgcccaaggtaatgattcctctatcctctatcccgacctacaatgccgccatggattcaaacagcttcctgaagaattcgtttcataagttcccctaccccaccaaggcagagctgtgctatttaactgtagttaccaagtaccccgaggaacagctaaagatctggtttactgcccagcggctgaagcaggggatttcctggagccccgaggaaatcgaggacgcacgcaagaagatgtttaataccgtaattcagagcgtgccacagcctacgatcaccgtcttgaacaccccactcgtcgcatccgctggcaacgtacagcatctgatccaggccgctcttcccggacacgtagtcggacaacccgaggggaccggggggggtctgctcgtgacacagcctctcatggccaacgggttgcaggctacctcaagtcctctccccctcactgtcacttccgtcccgaaacaaccaggcgttgccccaatcaataccgtgtgctccaacacgaccagcgccgtgaaggtcgtgaacgctgcacaatccctcctgacggcctgcccctccatcacaagccaagcgtttcttgatgcgagtatatataagaataagaagtcccatgaacagctgtccgcactgaagggaagcttttgtcgaaaccaattccctggtcagagtgaggttgaacacctgaccaaggtgacaggcctctccacaagagaggtacgaaagtggttcagcgacaggcggtaccattgtagaaaccttaaggggtccagagcgatgatccctggagaccattcttccatcattattgatagtgtaccggaggtgtccttcagtccttcttcaaaagtccccgaagtcacctgcatcccgaccacagccactctcgctacacacccgtctgccaaaaggcaatcatggcaccagacccctgattttaccccaaccaagtacaaggagagggcccccgaacagttaagggccctggaaagttcgttcgcgcagaacccattgcctctggacgaggaactggacaggctgcgtagcgagacaaaaatgacgcgacgggaaatcgacagctggttttctgagaggaggaaaaaagtaaatgccgaggagacaaaaaaagccgaggagaacgcttcccaggaggaagaagaagccgccgaggacgaggggggtgaggaggaccttgcctccgagctccgcgtgagtggcgaaaatggaagtttggaaatgcctagttcacacatcctagcagagagaaaggtcagcccgatcaagattaacctgaagaacctgagggttacagaagccaatggccgcaatgagatcccgggtctgggggcatgtgaccctgaggacgacgaatcaaataagctcgccgaacagcttcccgggaaggtgagttgtaagaagacagcccagcagaggcatctgctccggcagctttttgtgcagacgcagtggccaagcaaccaggactacgacagcatcatggcccagaccggattaccccgcccagaagtggtgcggtggtttggagactccagatatgccctgaagaatgggcaactcaagtggtacgaagactataagaggggcaacttcccacccggcctgcttgtgatcgctcctggcaaccgggagctgctgcaagattactatatgacccacaagatgctgtacgaggaagatctccagaatttgtgtgacaagacccagatgagttctcagcagaagcagacagagttcgatctcattaatgtgaaagactggccagtatgggagactgcctgccacgtggaagaacccaatccgaccctgtgctgtcatatgccattcccctgtccagccgctggtcacctgggcgagcttcccgaatcatcccaaaccgcccagtcgcttccactgcccagcgcatgtcctcctccttcaaagcagcaggcccggtggggatcccaccagtttttcctgcctcagtgccgaacttttcctctacccagtaatggttag

SEQ ID NO: 212572 - DNA, 948 bp, Artificial Sequence
  Description of Artificial Sequence: Synthetic coding sequence
atggccagcaagcggaagagcaccaccccctgcatgatccccgtgaaaaccgtggtgcttcaagacgcttccatggaggctcagccggccgaaacactccccgaagggccacagcaggatttaccgcctgaagcaagcgccgccagctcagaagccgctcagaacccatccagcactgacggaagtaccctcgcgaacggtcatcggtccacgctggatggatatctttacagttgcaaatactgcgactttagaagccacgacatgacacaatttgttgggcacatgaattctgaacacacagacttcaataaggaccctacatttgtatgttcaggatgttccttcttagccaagaccccagagggcctgagcctgcataatgctacctgccacagcggggaggcctcttttgtgtggaacgtggccaaacctgataaccatgtggtagtcgagcagtcaatccctgaatcgaccagcaccccagacttggcgggtgagccgagcgccgagggcgccgatggtcaggccgagataattattacaaagacccccattatgaaaatcatgaagggcaaggcagaggccaaaaaaatacatacccttaaggagaatgtacccagccagcccgtcggggaagctttgcccaagcttagcactggcgagatggagaagcaaaccgaatttgaccttatcaatgttaaggactggccagtgtgggagactgcctgtcatgtcgaggagcccaaccccaccctctgctgtcatatgccgttcccttgccccgccgccgggcatctgggggaacttcccgaatcatcccagacggcccagtcccttcctctaccttccgcttgtcctccgccgagcaagcagcaagcaaggtggggaagccatcagttttttctcccacagtgccgaaccttccctctgccttcaaacggttag

SEQ ID NO: 212573 - DNA, 501 bp, Artificial Sequence
  Description of Artificial Sequence: Synthetic coding sequence
atggccagcaagcggaagagcaccaccccctgcatgatccccgtgaaaacggttgtcctgcaggatgcgtcaatggaagcccagcccgcagaaacactgcccgagggcccccagcaggatttaccacccgaggcttctgccgcatcaagcgaggctgcccagaacccttccagtacagatggttccacactcgccaacggccatagatcaacgcttgatggttacctgtactcttgtaagtattgcgatttccgctcgcatgatatgactcagtttgtgggacacatgaactccgaacataccgacttcaacaaggaccctacattcgtttgttcgggttgctcctttctggccaagactccggaaggactgtctctgcataacgccacctgtcatagcggggaggcatcttttgtgtggaacgttgcgaagcctgataatcacgttgtggttgaacagagcatccccgaatccacctcgacccctgacctagctggctag

SEQ ID NO: 212574 - DNA, 2871 bp, Artificial Sequence
  Description of Artificial Sequence: Synthetic coding sequence
atggccagcaagcggaagagcaccaccccctgcatgatccccgtgaaaaccgtggttttgcaagacgccagcatggaagcccaaccagcagagaccttgccggagggcccacaacaggacttgcctcctgaggcctctgctgcgtccagcgaagcagcccagaatccgagctccaccgacgggagcacacttgccaacgggcacaggagtactctggacgggtacctctacagctgcaaatactgtgacttccgatctcacgatatgactcaattcgtgggccatatgaattcagaacacaccgatttcaacaaagatccaaccttcgtctgttcgggctgttctttcttagcaaagacaccagaaggcttatctctgcataacgcgacatgccactccggcgaggcttcttttgtatggaatgtggctaaaccggataaccatgtagttgtggaacagagtataccagagagtacatcaacaccagacttggccggagaaccaagcgccgagggggctgacgggcaagcagagatcattatcactaagacccccattatgaagatcatgaaaggcaaggcagaggccaagaagatccacacattaaaggagaatgtgccaagccagcccgttggcgaggctctacccaaactcagtacgggcgagatggaagtgagggaaggcgatcacagtttcatcaacggagccgtgcccgtctcccaggccagtgccagttcggccaagaatcctcacgccgcaaacgggcctctcataggaacagtgcccgtcctgccagccgggattgcacagtttctgtccctgcaacaacagccacccgtccacgcccagcatcacgtgcaccagccccttcctactgccaaagccctacccaaggtcatgatccctttgtcctccatccctacttacaatgccgccatggattcgaatagcttccttaaaaactcttttcataagttcccttaccccactaaggccgaattatgttatcttacagtcgttactaaataccctgaggaacagctcaagatttggttcaccgcccagagactcaagcagggaatcagttggtcccccgaggagatcgaggacgctcggaaaaaaatgttcaacacagtgatccagagcgtgccacagcccacgattacagttcttaacacaccactggttgcatcggccggcaacgtgcagcacctgatccaagctgctctgccaggacatgtggtgggtcagccagaagggacgggtgggggtctcctggtgacccagcccctgatggcgaacggattgcaagctaccagcagccctctgcccttaaccgtaactagtgtccctaaacagccaggcgtggctcctatcaacacagtctgctctaatacaacgagcgctgtgaaggttgtcaacgctgcacaaagcttgttgactgcctgccccagcataacttctcaggccttcttagatgcttcgatttacaagaacaagaaatcccacgagcagttaagcgctctgaagggatcattttgcagaaatcagttcccagggcaaagcgaagtggaacacctgacgaaggtcactgggctctcaaccagagaggtccgcaagtggttcagcgatcggcgctatcattgcaggaatctcaaaggcagccgagctatgatcccaggcgaccattcgagcattatcatagactctgtacctgaagtctcctttagcccctcatccaaagtgccagaggtaacctgtatccccaccaccgcgaccctcgcaacacacccttcagccaagcgccagtcttggcatcagacacctgactttacaccgacgaaatataaagaaagggccccagagcagctgagagctcttgagagtagcttcgcccagaatcctctaccactggacgaagagctggatcgtctcagaagtgagaccaagatgacccggcgggagatcgactcctggttctccgagcgacggaagaaggtaaacgctgaagaaactaagaaagccgaggagaatgccagccaggaggaggaggaggctgcggaagatgagggaggggaagaggaccttgcgagcgagcttagggtgagcggcgaaaatggatcactcgaaatgccctcaagtcatatcctggctgagcgtaaagtcagcccgataaagattaatcttaagaacctaagagttactgaggccaacggtagaaatgagattcctggccttggcgcctgcgatccagaagacgacgaaagcaacaaactggctgagcagttgcccggtaaggtctcttgtaagaaaactgctcagcagcgccacctgctgcgacagctgtttgtgcagacccaatggccctccaaccaggattacgattctatcatggctcaaaccgggctgccacggcctgaagtcgtccgctggttcggtgattctagatatgcccttaagaatgggcagttgaaatggtacgaagactacaagaggggcaactttcctcccggtcttttagtgatcgctcctggtaatcgcgagctgctccaggactattacatgactcacaagatgctctacgaagaagacctccagaatctatgcgacaaaacccaaatgtcgagccagcaagtcaaacagtggtttgccgagaagatgggcgaagaaactcgagcggttgctgacacgggatccgaggatcaaggccctggtacaggggagctcactgcagtgcacaagggtatgggcgacacctactctgaggtgtcggaaaacagtgagtcctgggaaccaagggtcccagaggcgagttccgagcccttcgatacaagttccccgcaggccgggcggcagctggaaaccgattag

SEQ ID NO: 212575 - DNA, 2871 bp, Artificial Sequence
  Description of Artificial Sequence: Synthetic coding sequence
atggccagcaagcggaagagcaccaccccctgcatgatccccgtgaaaaccgtggttctgcaagatgctagtatggaagcccagcctgctgagacccttccagagggcccgcaacaggatcttcctcctgaggctagtgccgcgagtagcgaagcagcccagaacccaagctccactgacggctctacactcgcgaatggacacaggtctacccttgacggctacttgtattcatgtaaatattgcgacttcaggtctcatgacatgacacagttcgtgggtcacatgaattctgaacatacggatttcaacaaagacccaacgttcgtgtgcagcggctgctcctttttggcgaaaacacctgagggtcttagtcttcataacgcaacttgccactcgggagaagcgagcttcgtgtggaacgtcgctaagccagacaaccatgtagtggtcgagcagtccattcctgagtcaacaagcacacccgacctggccggagaaccatccgccgagggggcagatggacaggctgaaatcattatcacaaagacacctataatgaagattatgaagggcaaggcagaggccaaaaaaatccacaccttaaaagagaatgttcctagccagcccgtcggagaggctttgcccaagttatctactggcgagatggaggtcagggaaggcgaccattccttcataaatggcgccgtaccagtgtcacaggcctccgcatcctcagccaagaacccacacgctgctaatggaccacttatcgggacagtgcctgtgctgcccgccggtatagcgcagttcctatcactgcagcaacagccaccggtacacgctcagcaccacgtgcatcagcctctccctacggctaaggcattgccaaaggtgatgattccccttagtagcatcccaacttataacgcagccatggactcgaactcgttcctcaagaacagctttcacaaatttccctaccctactaaggctgaactgtgctatcttacagtagttaccaagtatcctgaagagcagcttaagatctggttcaccgcccagagactcaagcagggtataagttggagtcctgaagagattgaggatgcccgaaaaaaaatgtttaatacggtgatccagagtgtcccacaacctacaattactgtactgaataccccgctcgtcgcctctgcaggaaatgtgcaacaccttatccaggctgcgctgcctggtcatgtggtaggtcagcccgaaggcacaggaggtgggctgctcgtcacacagccgctcatggctaacgggttgcaagctaccagcagtcccctccctctaacagtaactagtgtgccaaaacagccgggcgtagctcccattaatacagtgtgtagtaatacgacatcggcggtgaaggtggtgaatgcggctcagtccctcctgacagcctgtccctccattactagtcaggcgtttctggatgcatctatttataagaacaagaagagtcacgaacagctctcagccctcaaggggtcattctgccggaaccagttccccggacaatccgaagttgagcaccttacaaaggtaactgggctgtcaactagagaagtaagaaaatggttcagtgatcggcgctatcattgtcgcaaccttaaggggagccgggccatgatccctggcgatcattcgtccattattattgattctgtgccggaggtttcgttttccccaagtagtaaggttcccgaagtgacctgtatccccacaactgctactctggccactcaccctagcgctaaaaggcaatcatggcaccagacacccgactttactcctactaagtataaggagcgtgcccccgaacaactccgggctctagagagttcgttcgctcagaatccattgccgctcgatgaggagctggatcgcttgagatccgagaccaaaatgactcggcgtgagatagacagttggtttagtgagaggcgcaaaaaagtcaacgccgaggaaaccaaaaaagcagaagagaatgccagtcaggaggaggaagaggctgctgaggatgaagggggagaggaagatttggcatcagagctgcgggtgtcgggtgaaaacgggagcctggagatgccatcctcacacattctcgcagagcggaaggtcagtccaattaagattaacctgaaaaacctgagagtgaccgaagccaacgggcgtaacgaaattccgggcttgggagcctgtgaccccgaggatgatgaatccaataaactggccgaacagttacctggtaaggttagttgtaagaaaactgcgcaacagcgtcacttactgagacagctgttcgtgcagactcagtggcctagtaatcaggactacgacagcattatggcccagacgggattgcctcggcccgaggtggtccgctggttcggagactctcgttacgctctgaaaaacggtcaactgaagtggtatgaagattacaaaagaggtaattttcctcccgggctattggttatcgcacccgggaatagagaactgttacaagactactatatgacacataaaatgttgtacgaagaagacctccagaacctgtgtgataaaacccagatgagtagtcaacaggtcaaacagtggtttgcggaaaaaatgggggaagagacccgcgctgttgcggatactggctccgaagatcagggcccgggcacaggagagcttacagccgtgcataaaggaatgggtgacacctattctgaagtgtctgaaaacagtgaatcatgggaacctcgagtccccgaagcatcttccgagccattcgatacatcttcccctcaagctggtagacagctagaaaccgattag

SEQ ID NO: 212576 - DNA, 501 bp, Artificial Sequence
  Description of Artificial Sequence: Synthetic coding sequence
atggccagcaagcggaagagcaccaccccctgcatgatccccgtgaagaccgtggtccttcaggacgccagcatggaagctcaacccgcagaaaccttacccgaggggcctcagcaggatctcccgcccgaggcctctgctgcaagttccgaggcggcgcagaatcctagctccactgatgggagtacattggcaaacgggcatcgctcaacccttgatggctatctgtatagctgtaagtattgcgatttccgatcccacgatatgacccaatttgtgggacatatgaattcagaacatactgacttcaacaaggacccaactttcgtatgctcaggttgttcctttctggccaaaactcccgagggcctctcactgcacaacgccacctgccattcgggtgaggccagcttcgtgtggaatgtcgccaagcccgataatcatgtagtcgtcgagcagtcaattccagaatcgaccagcacgccggatctggcgggttag

SEQ ID NO: 212577 - DNA, 1428 bp, Artificial Sequence
  Description of Artificial Sequence: Synthetic coding sequence
atgggcatgtgggccagcctggacgccctgtgggagatgcccgccgagaaaagaatttttggtgctgtgttgcttttttcctggacggtgtatctgtgggaaacattcttggctcaacgccaacggcggatctacaaaacaacaactcacgtgccccctgagctgggacagataatggactcagagactttcgaaaaaagccgactgtatcagctcgataaaagcacattttccttttggtccggtttgtatagcgagactgaagggactttaatcctcctctttgggggcatcccctacctgtggcggttaagcgggagattctgcgggtacgccggtttcgggccagaatacgaaattacccagagtctcgtgtttctgctcctggctacactcttcagtgccctcaccggcctgccatggtctctctataacaccttcgtgatagaagagaaacacggatttaatcagcagaccctggggttcttcatgaaagatgccatcaaaaagtttgtcgtgactcagtgcatcttgctaccagtgagctctctgctgctctatattatcaaaataggcggagattacttctttatatatgcgtggttatttaccctggtggtgagcctggttctggtgaccatctacgccgattacatagcccctctgtttgacaagtttactcctctgccggaaggtaaactgaaggaggaaatcgaagtgatggcaaagagcatcgacttcccccttaccaaggtgtacgtggtggagggttctaaaaggagttcccacagtaacgcatacttttacggctttttcaagaataagcggattgtcttgtttgatacactgctagaagagtacagtgtgctaaacaaggacatccaagaggacagcggcatggagccgcggaacgaggaagagggtaacagcgaggaaattaaggccaaggtgaaaaataaaaagcagggatgcaagaacgaggaagtgcttgctgtactgggccacgaactcggccactggaagctcgggcacacggtcaaaaacatcatcattagccagatgaacagcttcttatgctttttcttgtttgccgtgctgatagggcgaaaggagcttttcgcagctttcgggttctacgattcacagcccacccttattggcctgctgatcatctttcaatttattttttcaccatataatgaggtactgtcgttctgcctgaccgtgctcagccgccgctttgagttccaggccgacgcttttgcaaaaaaactggggaaggccaaagacctctattccgctctaatcaaacttaacaaggacaacctcggattccctgtttccgattggttgttttccatgtggcattatagccacccgcccctgctggaacgactgcaggctctgaaaacaatgaaacagcattag

SEQ ID NO: 212578 - DNA, 1017 bp, Artificial Sequence
  Description of Artificial Sequence: Synthetic coding sequence
atgatgcggacctgcgtgctgctgagcgccgtgctgtggtgcctgactggcgtgcagtgcccgcgctttaccttattcaataagaaaggtttcatctatggcaagaccgggcagccagacaaaatctatgtggagctacatcaaaacagcccagtgttgatctgtatggactttaaattatcgaagaaagaaatcgtggatccgacttatctgtggatcggccctaacgagaagaccctcactggcaacaaccgcattaacattactgagacaggccagttgatggtcaaagattttctcgagcctctgtcagggctgtacacctgtaccctgtcctataagacggtaaaggcagagacccaagaggagaagacagtcaaaaaacgctatgacttcatggtcttcgcttatcgggaacccgattattcttatcagatggctgtgcgattcactacacgatcttgcattggtaggtataacgacgtatttttccgtgtgctcaagaagattctggacagtcttatatcggacctgagctgccatgtgattgagccgagttacaagtgccattccgttgaaattcccgaacacggcctgatacatgagctgtttattgcctttcaggtaaaccctttcgcacccggctggaagggagcgtgcaatggtagcgtggactgcgaggatacaaccaatcataacatcctacaggcgcgggaccgaattgaggacttttttagaagccaggcctacatcttctatcataactttaacaaaaccctcccagcaatgcactttgtcgaccatagcctgcaggtcgtcagactggacagctgtagacctggatttggcaaaaatgagagactccattccaactgtgcaagttgctgtgtagtttgttctcccgctacttttagccccgacgtgaatgttacatgtcaaacatgtgtcagcgtattgacgtacggcgccaagtcatgtccccagacttccaacaaaaaccaacagtatgaggattag

SEQ ID NO: 212579 - DNA, 951 bp, Artificial Sequence
  Description of Artificial Sequence: Synthetic coding sequence
atgatgcggacctgcgtgctgctgagcgccgtgctgtggtgcctgaccggtgataaaatatatgtggagctccaccagaactctccagtcttgatttgtatggattttaagctctctaaaaaggaaattgtggatcccacctatctgtggatcggcccgaacgaaaagacactgacagggaataacagaatcaacataactgaaacaggacagctgatggtcaaagactttctcgagccactgtcgggtctctacacatgcaccctatcttataagactgtcaaggcggaaactcaggaggaaaaaactgtgaagaaaaggtacgactttatggttttcgcatatagagaacctgattattcgtaccagatggccgtaagattcaccacaaggagttgtattgggcgctataatgatgtgtttttccgtgttttaaagaaaatcttagattctttaattagcgatctttcatgtcacgtcatcgaaccgtcctacaagtgccactccgttgagattccagagcacggacttattcatgaattgtttatcgcttttcaagtgaacccattcgcccctggctggaaaggagcgtgtaacgggtccgtcgattgtgaggataccacaaaccacaatatccttcaggcccgtgatcgcatcgaggacttctttcgctctcaagcctacatcttctaccacaattttaataaaactcttcctgcaatgcacttcgtggatcacagtttgcaggtggtccggctggactcatgtcggccaggattcggcaaaaacgagcgccttcactcaaactgtgcaagttgttgcgttgtgtgctcacctgccacattctctcctgacgtgaacgtgacttgtcaaacctgcgtctcagttttaacctacggtgcaaagagctgcccgcagacgtctaacaaaaatcagcaatacgaggactag

SEQ ID NO: 212580 - DNA, 1917 bp, Artificial Sequence
  Description of Artificial Sequence: Synthetic coding sequence
atggccggcggcagcgccaccacctggggctaccccgtggccctgctcctgcttgttgctacattaggcctcggacggtggttacagcccgaccctggcttgcccggtcttcgccactcatatgactgtggaatcaaaggtatgcagttactggtgtttccaaggcctggtcagacgctgcgcttcaaggtggtggacgagtttggaaatcggttcgacgtgaacaactgcagtatctgttaccactgggtaacttcgcgccctcaggagccagccgtattttcagcagattacaggggatgtcacgtgcttgagaaggatggccgcttccacttgagggttttcatggaggcagtgctgcccaacggtagagtagatgtggcacaggatgctactcttatctgcccaaagcctgacccttcccgcaccctcgattcacagctcgctcctcccgccatgttcagcgttagcacccctcagaccctatcgttcttaccaacttcggggcacacaagtcagggctctggccatgcctttccatctcccctcgaccctgggcatagctctgtgcaccctacacccgcgctgccttctcctggacctggccccactcttgcgacattggcccagccacattggggaacccttgaacattgggacgtgaacaagagggattacatcggcacccacctgtcccaagaacaatgtcaggtcgcgtctgggcacctgccgtgcatagtgaggaggactagcaaggaggcctgtcagcaggctggatgctgctatgataatactagagaggtaccgtgctactacggaaatacagcaactgtgcagtgtttccgcgacggctatttcgtgctggtggtttcgcaggagatggccctgacccacagaataaccctcgccaacattcatctcgcttacgcacccacgtcatgctctccgacgcaacacacagaggctttcgtcgtcttttactttcccttaacgcactgtgggaccaccatgcaagtggcgggagaccaactgatttacgaaaactggcttgtgtccggcatccacattcagaaaggaccacaagggtcaattacgcgcgacagcacttttcaactgcacgtgcggtgtgtgtttaatgcgagcgactttcttccaatccaggccagcatttttccacctccgtctcctgctcccatgacccagccgggccccctgcgtttggaactacgaatcgctaaggatgagaccttctctagctactacggagaggacgattatcctattgttagactgttgcgagaacccgtgcatgtcgaggtcagactgctgcagaggacagaccctaacctggtgctattgctccaccagtgctggggcgccccatcagccaaccctttccaacagcctcagtggcccatactaagtgatggatgccccttcaaaggtgactcctatagaacacaaatggtggccttggacggcgccaccccatttcaaagtcactatcaaagattcactgtggcaacattcgcactactggactccggcagccagcgcgccctaaggggtctggtttatttattctgctctactagcgcatgccacacatctggcctggaaacatgcagcactgcatgcagcaccggtactaccagacagagaagaagcagcgggcaccggaatgatacagcccgtccacaggacattgtctcgtcgccaggccctgttggcttcgaagactcttacggccaggaacccactttggggcctacggatagcaacggcaactcctccctgaggcctctgctttgggcagttctgctccttcccgctgtggccctggttctgggctttggcgtgtttgtaggcctatctcaaacttgggcccagaagctgtgggaatcaaataggcaatag

SEQ ID NO: 212581 - DNA, 993 bp, Artificial Sequence
  Description of Artificial Sequence: Synthetic coding sequence
atggccctgacccaccggatcaccctggccaacatccacctggcctacgccccaacatcatgcagtccaacacagcatactgaagcctttgtcgttttctattttcctctgacacactgtgggacaactatgcaggttgctggagaccagctcatatacgaaaattggttggtgagcggtatacacatccagaaaggcccacagggctctattactcgagacagcacattccagctccatgtcagatgtgtatttaacgcgtcggattttctaccaattcaagcgagcatttttccaccaccttcccccgcccctatgactcaaccgggcccattgcggctggaactgagaattgccaaagacgagactttttctagctattatggcgaggacgactaccctattgttcggctgctccgtgagcccgtgcacgtagaggtcagacttcttcagcggacagatcctaatctagtgctgttgctgcatcaatgctggggtgctccaagcgctaatccatttcagcagcctcaatggcctattttgtcggatggatgccccttcaagggagactcttatagaacgcagatggtagccctggacggggccacccccttccagtctcactatcaacggttcaccgtcgccaccttcgcactgttggacagcggcagccaacgggcactacgggggctcgtgtacctgttctgctctacatcagcctgccatactagtggcctggagacgtgctccacagcttgctcaaccgggacaacgagacagagacggtcttctggccataggaacgataccgctcggcctcaagatattgtttcatcccctgggccagtaggctttgaagattcctacgggcaggagccgactcttggccccacggattcaaatgggaactcctcactgaggcctcttctctgggctgttctcttgctgcctgctgtggctctggtgctgggattcggcgtattcgtcgcatag

SEQ ID NO: 212582 - DNA, 1317 bp, Artificial Sequence
  Description of Artificial Sequence: Synthetic coding sequence
atgggccgggtggaggacggcggcaccaccgaggagctggaggactgggatccaggcacttccgcgctgcctgctccaggaattaaacagggccctagggagcagacaggtactgggccactcagtcaaaagtgttgggaaccggagcccgatgccccttctcagcctggccctgccttgtggagcagaggacgagctcgtacgcaagctctcgctggggggagctccctgcagcagttggatcccgaaaacaccggtttcataggtgcagacacctttacaggcctcgtgcactcacacgagctgcctctggatccagcaaagctagacatgttagtggctttggctcaaagcaatgagcaggggcaggtgtgttatcaggagctggtggacctcatctcttccaagaggagctccagcttcaagcgcgcaatcgctaatgggcaacgagcactaccgcgggacgggcctctggatgaacccggcctgggtgtttataaacggtttgtgcgctacgttgcctatgaaattctaccttgtgaagtggatcggaggtggtacttttacagacaccggtcgtgtccgccccctgttttcatggcctcagttaccctggcccaaattatcgtttttttatgctacggcgcccggctgaataagtgggttctgcagacctaccatccagagtatatgaagtcccccctggtgtaccacccaggccaccgggcgcgagcttggagatttcttacctatatgtttatgcacgtgggtcttgagcagctcggatttaatgccttgctccaactgatgattggcgtacctctggaaatggttcacggacttctgagaatcagcttgttataccttgccggagtcctggccgggtccttaactgtgtctattacggacatgcgagcccccgtcgtggggggctccggtggcgtatatgcgctctgctccgcccacttggccaacgtagttatgaactgggccggtatgcgttgcccatataagctgttgagaatggtgctggctttggtttgtatgtcctccgaggtgggacgggctgtctggctcaggtttagccctcccctgccagcatcaggtccacagccttcattcatggcccacctggcaggggcagtggtgggtgtgtcaatgggcttgaccatcttgaggtcatacgaggagcgtctcagagatcagtgtgggtggtgggtcgtactgttagcctacgggacattcctcctgttcgccgtgttctggaatgttttcgcctacgatctactgggcgctcacatccccccaccaccctag

SEQ ID NO: 212583 - DNA, 1122 bp, Artificial Sequence
  Description of Artificial Sequence: Synthetic coding sequence
atggtgatggtgagcaaggacctgttcggcaccggcaagctgatcagagcagccgatctgacactcggcccagaagcttgcgaaccgcttgtgagcatggatacagaagatgtcgtccgctttgaagtgggcttgcacgagtgcgggaactcaatgcaggtcaccgacgatgcacttgtgtattcaacattcctgcttcatgaccctcggccagtgggcaatctgtctatcgttaggacaaatagggccgagatacctattgagtgcaggtacccaaggcagggaaatgtatccagccaggcaattcttcccacatggctgcccttccgaaccacggtctttagtgaggagaaactgacattctccctgagactgatggaggaaaactggaatgctgagaaacggagtccaacattccatcttggcgatgcggcacatctccaggctgagattcatactggcagtcatgtgccgcttaggctttttgtggaccactgcgtcgctacccccactcccgaccaaaacgcttctccataccatacaatcgtggattttcacggctgcctcgtagacggtctcacagacgcatcatctgcattcaaggtgccgcgaccaggacctgacaccctgcagttcacggttgacgtctttcatttcgcgaatgatagcagaaatatgatctacataacatgtcatctgaaagttacgctggcagagcaggatccagatgaactgaataaagcctgttcctttagtaaaccttccaactcttggttccccgtcgaggggagtgctgacatctgtcagtgttgtaacaaaggggattgcggcactccctcacatagccgacgccagcctcacgttatgagtcagtggagtcgctccgctagccgcaatagacgccatgtcacggaggaagctgacgtgactgtcggccctttgatcttcctggatcgacgcggagaccatgaagtcgagcaatgggctttaccatccgacacaagtgtcgtcctgctcggcgtagggcttgccgtggtcgtatctctgaccctgactgctgttattctggtcctgacccggaggtgccgtactgccagtcatcccgtgtcagcctcagagtag

SEQ ID NO: 212584 - DNA, 1275 bp, Artificial Sequence
  Description of Artificial Sequence: Synthetic coding sequence
atggagctgagctaccggctgttcatctgcctgctgctgtggggctccaccgagttgtgttaccctcaacccctatggctcctgcagggaggcgcttcccaccccgagacctcagtgcagcctgtgctcgtggaatgtcaagaggccacgctcatggttatggtgagcaaggaccttttcggcaccgggaagctcatcagggccgcagacctaaccttagggccagaggcctgtgaacctctagtttctatggataccgaggacgttgtgcgattcgaggtggggctccatgaatgcggcaactccatgcaggtgactgatgatgctctggtgtatagtacttttctgctgcacgacccccgcccagtgggaaatctctccatcgtcaggactaatcgggccgaaatacctatcgagtgccggtatccaagacagggaaacgtatcatcacaggcaatcctccctacctggttaccatttaggactaccgtgtttagcgaggaaaagctcaccttcagtctgaggctcatggaggagaactggaacgccgagaaacggtcacctactttccacctgggcgatgctgctcacctccaggctgaaattcacacaggatctcatgtgcctctgaggctttttgttgaccactgcgtcgccacacctactccagatcaaaatgcttccccttatcacaccattgtggatttccacggatgtttagtggacggcttgacggacgcctctagcgctttcaaagtgcctaggcccggccctgataccctgcagtttactgtggatgtgttccactttgccaacgactcacgcaacatgatatatattacctgtcatcttaaagtgactcttgctgaacaggacccggatgaactcaacaaggcgtgtagtttctccaagccctctaacagttggttccctgttgagggctctgctgatatatgtcagtgctgcaacaagggggactgcgggactccttctcatagtcggcggcagccacacgttatgtcgcagtggtccaggagcgcctcaaggaatcgcagacacgtaaccgaggaggccgacgtcacagtggggcccttgatttttctcgacagaagaggggatcatgaagttgaacagtgggcgctgccgtcggacacttccgtggtgctgctgggggtgggactggccgttgtcgtgtccttgacgctcaccgcagtcattcttgtgctgactcgccgatgtcggactgcaagccatcctgtgtctgcaagcgagtag

SEQ ID NO: 212585 - DNA, 1116 bp, Artificial Sequence
  Description of Artificial Sequence: Synthetic coding sequence
atggagctgagctaccggctgttcatctgcctgctgctgtggggcagtaccgagctgtgctacccacagccgctgtggctcttgcaggggggggcctctcacccagaaacatccgtgcagcctgtgctcgtggaatgccaggaggccactctgatggtgatggtgtccaaggatttgttcggcaccgggaagctcattcgtgccgccgacctcaccttagggcccgaggcctgtgagccattggtctctatggataccgaggacgttgtacgatttgaggtcgggctgcatgaatgcgggaatagtatgcaagtgactgatgacgctctggtgtatagtacttttctgctccacgacccacggccggtaggcaatttgagcatagtcaggacgaaccgggccgagataccgatcgagtgtagatacccacgacagggtaacgtgtctagccaggccatcctccctacatggctgccattccggacaaccgtgttctctgaagagaagctgacattcagtctcaggttgatggaagagaattggaatgccgagaagcgcagtccaacctttcacctgggggatgctgcccacctgcaggccgagatacacacaggctcacacgtgcccttgagactcttcgtggaccactgtgtggccacccccactcctgaccagaatgcctctccgtatcatactatcgtggatttccacggatgcctggtggacgggttaaccgatgcgagtagtgctttcaaggtgcctagacctggccccgacacactccaattcacggtagatgtgttccattttgcaaatgatagccggaatatgatttacataacatgccacttgaaggtgacacttgcagagcaggatcccgatgagctaaacaaggcctgttccttctcaaaaccatctaactcttggttcccagttgaaggctcggcagatatctgtcagtgctgcaacaagggagactgcggcacgccgagtcactccaggcggcagccacacgtgatgagccagtggtccaggtctgcatcgaggaaccgcagacacgtaactgaagaggccgatgtcacagttgggaccgacctgccgggacaggagggatag

SEQ ID NO: 212586 - DNA, 1623 bp, Artificial Sequence
  Description of Artificial Sequence: Synthetic coding sequence
atgtggctgctgcggtgcgtgctgctgtgcgtgagcctgagcctggcggtcagcggacagcacaaaccggaggcccccgattattccagtgtgctgcactgcggcccttggagctttcagtttgctgtgaacctcaaccaggaggccactagtcctcctgtactcattgcctgggacaatcagggactattgcacgagctgcaaaacgattccgactgcggtacctggatcaggaagggccctggcagctctgttgttctggaggcaacttattcttcatgctatgttactgaatgggacagccactatatcatgcctgtgggcgtcgagggcgctggagccgcagagcacaaggtggtaaccgagcgcaagctcctgaagtgcccaatggatctactagcccgcgacgcaccggacacggactggtgtgattcgattcccgctcgcgataggctaccatgtgccccatctcccatctctaggggcgactgcgagggccttggttgctgttatagctccgaggaagtgaattcctgttattatggcaacacggtaacgctgcattgcaccagagagggacatttctctatcgctgtctcgagaaatgtcacaagccctcccctcttgctggacagcgttcgacttgctctccggaatgactctgcttgcaacccagtgatggcgacgcaggctttcgttctcttccaatttcctttcactagctgcggcacaacccgccagattaccggagacagagctgtttacgaaaacgagctggtggccactcgagacgtcaaaaatggttcacggggtagtgtcacccgcgactccatattcagactgcatgtgagttgttcctattccgtaagcagcaattctttgccgatcaatgttcaggtgtttaccctgcctccaccattcccagaaacacagcccggaccactaactctcgaacttcagattgccaaagacaaaaattacggctcatactatggggtaggggattaccccgttgtgaagttgctgcgggatccgatttacgtggaggtctctatcctccataggactgacccctacttgggcttgttgctacagcagtgctgggctactcctagcacagacccactgagtcagccacagtggccaatactggtgaagggatgtccttacattggcgataactatcaaacacagttaataccggttcagaaagcccttgatctcccattcccctcccatcaccagcgcttctctatatttactttctcttttgtcaatccaaccgtcgaaaaacaagccctgcgtgggccggttcaccttcattgctccgtttcagtttgccagccagccgaaacacccagctgtgtagtcacatgccctgacctttcaaggagacggaattttgacaatagtagtcaaaatactactgcatcagtctcctcgaaggggcccatgatcttgctccaggctactaaggatcctccagaaaagctgagagtccctgtggattctaaggtgttatgggttgcaggcctgagcggcacccttatccttggggctttgctcgtgtcgtatttggctgtaaagaagcaaaaaagttgtcctgaccaaatgtgccagtag

SEQ ID NO: 212587 - DNA, 2340 bp, Artificial Sequence
  Description of Artificial Sequence: Synthetic coding sequence
atggccagcttcgtgaccgaggtgctggcccacagcggccggctggagaaggaggacttgggtacaagaatcagcaggctgaccaggagggtggaggaaatcaagggggaggtctgtaacatgatctccaagaaatactccgagtttttacccagtatgcaatcggcccagggactgattactcaagtagacaagctgagcgaggatattgacctgctgaagtcaaggatcgaatcagaggtgcgaagagatctccacgttagcaccggggagtttaccgatttaaagcagcagctggaacgcgactcggtcgtcctaagcctgctcaagcagttacaggagtttagcactgcaatcgaggaatacaattgtgcactgaccgaaaagaaatacgtgactggggctcaaagattagaggaggcccagaaatgtttgaagctgttgaaatctcgaaagtgttttgacctcaaaatcctgaaaagtttatcaatggagcttaccatacagaagcagaacatcctttaccatctcggtgaagagtggcagaaattgattgtttggaaatttcctccatcgaaggacacgagttcactggagtcctacctgcagacagagctccatctgtacactgaacagtcacacaaggaggaaaaaaccccaatgcctccgattagttctgttttactggcctttagcgtgctcggagagctgcactcaaaactgaagagcttcggccagatgcttctaaagtacatactgcggcccctggccagttgtcccagtctgcacgctgtcattgagtcacagcctaatatcgtgatcattcgtttcgaaagtatcatgaccaatctggaatatccatccccgagcgaggtgtttactaagatccggctggtcctggaggtgttacagaaacaattgctggatctgccattagatactgacttagagaatgagaaaacttcaaccgtgcctctggctgaaatgctgggcgacatgatctgggaggatctgtcggaatgcctgattaaaaactgcctcgtctacagcattccaaccaatagcagcaaactgcagcagtacgaagagatcattcagtccacagaggagttcgagaatgcgctgaaggaaatgaggttcctgaaaggggatactaccgatctgctgaaatacgctcgcaatattaacagccatttcgccaacaaaaagtgtcaggatgtgatcgtcgctgctaggaacctgatgactagtgaaatccacaacactgtgaagatcattcccgatagtaagatcaatgtgccagagctgcctactcccgatgaggataataagcttgaagtccagaaagtgagcaacactcagtaccatgaagtaatgaacctggagccagagaatactttggaccaacattctttttcccttcccacatgcaggatctccgagtctgttaagaaacttatggagctggcttaccaaaccctactcgaagcaaccacttcttccgaccagtgcgcggttcagctgttttacagcgtgcgaaatatcttccatctgtttcacgacgtggttccaacttatcacaaagagaatctgcaaaaactacctcagctcgctgccatccatcataataactgtatgtatattgcccaccatctccttacgttgggccaccagtttcgactgcggctagcacctatcttgtgcgacggaaccgccacgttcgttgatctggttcctgggttcagacgcctggggactgaatgtttcctggcccagatgagagctcagaaaggcgaactgctagagcgcctgtcaagcgcgcggaatttctcaaacatggacgatgaggagaattactcagctgctagcaaagcggttcgacaagtgctgcaccagctcaagcgtctgggcattgtgtggcaggatgtgttgcctgtaaatatatactgtaaagccatgggcactctccttaacacagccatttccgaagttatcggcaaaatcacggcactcgaggacatatcgaccgaggacggcgatcgactgtattctctgtgcaaaaccgttatggacgaaggacctcaagtatttgctcccctgagcgaggagtcaaaaaacaagaagtatcaggaggaggttcccgtatatgtacccaaatggatgccctttaaggagcttatgatgatgctgcaagcctctctgcaggagattggtgataggtgggccgacggcaagggacccctcgccgccgcattcagctcctccgaagtaaaggctctgatccgggcactcttccagaatacagagcgcagggctgcagcactggcaaagattaaatag

SEQ ID NO: 212588 - DNA, 2019 bp, Artificial Sequence
  Description of Artificial Sequence: Synthetic coding sequence
atggccagcttcgtgaccgaggtgctggcccacagcggccggctggaaaaggaggatctcggcaccagaattagccgattgacacgcagggtggaggagattaaaggcgaagtctgtaacatgatctctaagaaatactctgaattcctgccctccatgcagtccgcccagggattaatcacacaggtagacaagctgtcagaggacattgatctcttaaaatcccgcatcgaatctgaagtgcggagagatttgcacgtgtccacgggagagttcaccgatttgaaacagcagctcgagcgcgatagtgtggtgcttagcttactgaagcagctgcaggagtttagtacagccatcgaggagtataattgcgccctgactgagaaaaagtatgtgactggggctcaacggttagaggaagcccagaaatgcctcaaattgctgaagtctcgaaagtgttttgatcttaaaatcctgaagtctcttagcatggaactcactatccagaaacagaatatcctatatcatttaggcgaggagtggcagaagctgatcgtgtggaagtttccccctagcaaagatactagtagcctcgagtcttatctgcagaccgaactccacctctataccgaacaatctcataaggaggaaaaaaccccgatgccccctatttcgtcagtgttgctggcattcagcgttttgggcgaactgcactccaaactgaagagcttcggtcagatgctcctaaaatacatccttcggcctttggccagctgcccatcactgcacgccgtcatcgaatcgcaaccaaacatcgtgattattaggtttgaatcaatcatgacaaacttagaatatccgtctccttccgaagtctttacgaaaattcggctggtcctggaagtactgcaaaagcagctgctcgacttacctctggatactgatttagagaatgagaagacaagtactgtgcctctggcggaaatgctcggtgacatgatctgggaggacctaagtgagtgtctcattaagaattgcctcgtctactctattcccactaattcctccaagttgcaacagtacgaggaaatcattcagtctactgaggagttcgaaaatgccttgaaggaaatgagattccttaaaggagacacaaccgacctgctcaaatacgcgcgaaatattaattcgcactttgctaataagaaatgtcaggacgtcattgtggctgcacggaacctgatgaccagtgaaatccacaatactgtgaagataattcccgattccaagattaatgtgcctgagttgcccaccccggatgaggacaacaaactggaggtacaaaaggtgtcgaacactcaatatcatgaggtgatgaaccttgaaccggaaaacaccctcgaccaacatagctttagtctgcccacctgcagaatctcagagtcagtaaagaagttaatggagctagcctaccagactctgctggaggcaaccacatcatccgaccaatgcgccgtccagctgttctattctgtgaggaatattttccatctctttcatgacgtggtgccgacataccacaaagaaaatctccagaaattgccccaactcgccgccatccatcacaacaattgcatgtatattgcccatcatctgctgaccctgggccaccaattcaggctacggttggcgcctattctttgtgatggcaccgccaccttcgtggacctcgtgcctggatttagaagactgggcaccgaatgcttcctcgcccagatgcgggcacaaaagggcgagctgctggaaagactttcatctgctagaaacttttcaaacatggacgatgaggaaaactactcggcagccagtaaggccgtgcggcaggtactccatcaacttaaaagattaggcatagtctggcaggacgttctgccagtgaatatctactgtaaggctatgggcacactcctgaacaccgcaatctctgaggtgattggcaagataaccgcactggaatag

SEQ ID NO: 212589 - DNA, 1776 bp, Artificial Sequence
  Description of Artificial Sequence: Synthetic coding sequence
atgtgggagcggctgaactgcgccgccgaggacttctacagccggcttttgcagaagtttaatgaagagaaaaagggcattcgtaaagatccgtttctgtacgaggcagacgttcaagtgcagcttatctcaaaggggcagcctaatcctctgaaaaatatcttgaatgaaaacgacattgtctttattgtagagaaggtcccattagaaaaagaggaaacctctcacattgaagaactgcaaagcgaagagactgctattagcgattttagcactggagagaacgtgggccctctggctcttcccgtaggtaaagcacggcagcttatcgggctgtacacaatggcacataatcctaatatgacacacctcaagatcaaccttcctgtaactgcgcttccaccgctgtgggttcggtgtgattcctcagatccggagggtacttgctggctgggcgcggagctaatcactactaacaactctataactggcattgttctttatgtcgtctcttgtaaggctgataaaaattacagcgttaatctcgaaaatttgaagaacctacacaaaaagcggcaccatctgagtaccgttactagtaaaggctttgctcagtatgaactcttcaagtcctccgcgctcgatgatacgatcacagcctcacaaaccgccattgccctagatataagttggtcgcccgttgacgagattctgcagatcccgccactctctagcaccgcaactctaaacataaaggttgagtcaggggagccacggggacccctaaaccacctgtacagagaacttaagtttctcctcgtactggctgatggtctcagaactggggtcacagaatggcttgaacctctggaggctaagtctgcagtggaacttgttcaggaattcctgaatgatctgaacaagttggacggtttcggagactctacaaaaaaagacacagaggttgaaacccttaaacatgatacagcagctgttgatagatcagtgaagagactattcaaggtgcgttctgacctcgacttcgccgaacagctctggtgtaaaatgtcaagcagcgttatatcttaccaggacttagtcaagtgttttaccctgatcatccaaagtctgcaaagaggagatatccagccgtggttgcactcaggttctaacagtttgctgtcaaaactcatccaccaatcataccacgggaccatggatacagtgtcactgtcaggcaccatccccgtccaaatgctactggagatcggcctggataaacttaagaaagattatatatcattctttatcggacaggagcttgcctcccttaaccaccttgaatacttcatagcaccttctgtagatattcaggaacaggtctatcgagtgcagaagctgcaccatatccttgaaattctggtgagttgtatgccgtttattaaatctcaacacgaactgctgttttcactgactcagatttgcataaaatactacaaacagaaccccctcgatgaacagcatatcttccagctacccgtccgccccacagccgtgaagaacctataccagtcggaaaagcctcaaaaatggagggtcgagatttatagcggtcaaaagaagatcaagaccgtttggcagctgagcgatagtagccctattgaccacctcaatttccataaacccgatttctcagagctcaccttgaatgggtccttggaggaacgtattttctttaccaacatggtgacttgttctcaggtgcactttaagtag

SEQ ID NO: 212590 - DNA, 1434 bp, Artificial Sequence
  Description of Artificial Sequence: Synthetic coding sequence
atggcccacaaccccaacatgacccacctgaagatcaacctgcccgtcacagccctcccgcctttatgggtgcgttgcgactcgtcagacccggaggggacatgctggctgggagctgagctgatcaccacaaacaactccatcacagggattgtgctgtacgtggtgagctgtaaagctgacaagaattattccgtcaatctagaaaatctcaaaaatctgcataagaagaggcaccacttatccaccgtaacaagcaaaggctttgcccagtacgagctgtttaagagctccgccctggacgacacaatcacggcctcacagacagcaatcgccctggacatcagttggtcccccgtcgacgaaatactccagattccccctctgtcctctaccgcaacgctgaacatcaaggtagagtccggggaaccgagaggacctctcaatcacctttacagagagctcaaattccttctggtgctagcagatggcctcagaaccggtgttacagaatggcttgaacccttagaggccaagagcgcagtagagctggtgcaggagtttttgaacgatctgaataaactggatgggtttggagattctaccaagaaagatactgaagttgagacactcaagcacgatacggccgcagtggatcggagtgttaagcggctctttaaagtgagaagcgatctggactttgctgaacagctgtggtgcaaaatgtcatcctctgtcattagttatcaggatctggtgaaatgcttcacgctcatcatccagtccctccagcgcggcgacatacaaccctggctacattctggctccaactctttactctctaaactaatccaccagtcttaccacgggaccatggacactgtcagcctcagcgggactatcccagtccagatgcttcttgagattggattggataaactgaagaaggattacatcagcttctttataggacaagagctggcttccctaaaccacctggaatattttatcgccccttccgtggacattcaggagcaggtataccgcgtccagaaactgcatcacatcctggagattctcgtgtcttgtatgcccttcattaaatcccaacacgaactgctcttttctttaacccagatttgcatcaaatactataaacaaaatcctctagatgaacagcatatcttccagctcccggtgagaccgaccgccgtcaagaatctttatcagtctgagaaaccacaaaaatggcgggtggagatctactctggccagaagaaaatcaaaacagtgtggcagttatcggattcatcacctatagaccacctcaacttccacaagcctgatttttccgagctcactcttaatggatctcttgaagaaagaattttctttactaacatggtgacctgctcgcaggttcactttaaatag

SEQ ID NO: 212591 - DNA, 1434 bp, Artificial Sequence
  Description of Artificial Sequence: Synthetic coding sequence
atggcccacaaccccaacatgacccacctgaagatcaacctgcccgtcacggctctaccgccactatgggtccggtgcgactcatccgatcccgaaggcacatgctggctgggagcagagttaatcacaaccaacaattcaattaccggaatcgtgctgtatgtggtaagctgcaaggctgacaaaaactattcagtgaatcttgaaaacttaaagaatctgcataaaaagaggcaccacctgagcacagtgacatcgaagggtttcgctcagtacgaactgtttaaaagtagcgcattggacgacactataaccgcatcccagacggcgatcgcactggacatctcctggtctcccgtggacgagattctgcagatcccacccctgtcttctaccgctaccctgaatatcaaggtggaatctggggaacctcggggaccactgaaccatctgtaccgggaacttaagtttctattggtgctcgctgatggtctccgaacaggcgtcaccgagtggctcgaaccgctggaggccaagtccgcagttgagctggtgcaggagttccttaatgatctgaacaagctcgatgggttcggtgacagcaccaagaaggacacagaagtggaaactttgaaacacgatacagcagctgttgatcgctccgtgaagcggttgttcaaggtacgaagcgacttagactttgccgaacagttgtggtgtaagatgtcttcctctgtcatttcttaccaagatctcgtgaaatgctttacgctgatcattcagagccttcagcgcggggatatccaaccgtggctgcatagtggaagtaactcattactgagcaaacttatccaccagtcttatcatggcacgatggacacggtgagcttatccgggactatccctgttcaaatgcttctggaaatcggactcgataaattaaagaaggactatatctccttttttatcggtcaggagctggcctctctgaatcacctcgagtatttcattgcgccatccgtggacatccaggagcaggtttatcgggtgcagaagctgcatcatatactggagatcctggtgagttgcatgccttttataaaaagccagcatgaactgttgttttctctgacacagatttgcattaaatactacaagcaaaatccactggacgaacaacacatcttccagctgcctgtgaggccaacagcggtcaagaacttgtaccagtcagagaaaccccaaaagtggcgcgttgaaatctacagcgggcagaagaagattaagacagtctggcaacttagcgattccagccccatagaccacctcaatttccacaagcccgactttagcgaactaacactcaacgggtcgctggaagagagaattttctttacaaatatggtgacgtgctcacaggtccatttcaagtag

SEQ ID NO: 212592 - DNA, 1275 bp, Artificial Sequence
  Description of Artificial Sequence: Synthetic coding sequence
atggccgccctgggcgacgaggtgctggacggctacgtgttccccgcgtgcccgccttgttcataccgatacccctatcccgcagcaaccaagggcaagggagccgcaggaggttcatggcagcagcggggacgtgggtgtctacctgcttcatccccctgttccgccggggcggccagcctatcatttccagggtgtggtcgattaaccgccgccgaatacttcgacagctaccaaagggaacgcctgatggccctgctggcccaagtgggcccaggactagggcctcgagctcggcgagccggctcctgcgacgttgctgtccaagtatcccctaggattgacgctgccgtgcagtgttccctgggaagaaggaccttacagcgacgagcgagagatccagaatctcctgccggtccaggagccgaaggcacaacgggtggcgggtctttctcacagcagccgtccagacgtgggctcgagcagggttcacctcagaatggtgcccctaggcccatgcgctttccccgcaccgtagcagtttattcacccttagcactccggaggctgaccgcctttctggagggccccggaccagcggctggagagcagcggtccggagctagcgatggtgagcggggcccccctcctgctcgcctccaggggccagaggagggggaagtctggactaagaaagcccctcggaggcctcagagtgacgatgacggggaggcacaggccgctgttagggcttcatgggaacagcctgctgacggaccggaactgcctcctcgggaggcgcaggaaggtgaagccgccccacggagcgctctgcggtctccagggcaacctccctctgcggggcgcgccagagacggtggcgacggtcgggaagctgcagtagccggagagggccccagcccaagaagtccggaactcggaaaggagaggctgcggttccagtttctcgagcaaaaatatggctactaccactgcaaagattgcaatatcagatgggaatccgcctacgtctggtgtgtccaggggacaaacaaggtctacttcaagcagttttgccggacctgtcagaagtcatacaacccttaccgtgtggaggatatcacctgccaaagttgcaaacagactaggtgtagttgccctgtgaagctgagacatgtggacccaaagcgccctcacaggcaggatctgtgtggtaggtgcaaaggtaagcggttatcttgcgattccaccttctcattcaagtacatcatctag

SEQ ID NO: 212593 - DNA, 1719 bp, Artificial Sequence
  Description of Artificial Sequence: Synthetic coding sequence
atggccgccccccggcccagccccgccatcagcgtgagcgtgagcgcaccagccttttatgctccacaaaagaaatttggaccagtggtagctccgaaaccaaaggtcaatccttttcgtccaggcgattctgagccccctcccgcccctggagctcaacgagctcaaatgggcagagtgggcgaaataccccctcctccgcccgaagactttcccttaccacccccccccctggcaggagacggtgatgacgcagagggcgcactgggcggggcgttccccccacctcctccacctatcgaggaatccttcccacctgctccattggaggaggaaatattccctagtcctccaccgccacctgaggaggagggaggcccagaagctcctatacccccacctccccagccacgcgagaaggtttcttctatcgacctggaaatagactctttgagctctttgctcgatgatatgactaaaaatgaccccttcaaagccagggtcagcagcggctacgtccccccacccgtcgctacaccattctcttctaagtctagtacaaagcctgccgcgggggggactgcccccttgccaccctggaagtccccaagctcatctcaaccattgcctcaggtccctgctcccgcccagagccagacgcagtttcatgttcagccacaacctcaacccaaaccccaagtccagctgcatgtccagagccagacgcaacctgtgtctctggctaacacacagccacgaggtccacctgccagtagccctgcccccgcccccaagttctctcccgtgactccaaagtttacgccggtggcatcaaagttctcaccaggcgctcctggcggctctggcagccagcccaaccagaagttgggacatcccgaggcactgtccgctggaacgggctccccccagccaccctccttcacatacgctcagcaacgtgaaaaaccccgggtgcaggaaaaacagcatccagtgcctcctcctgcccagaaccagaaccaggtgcgcagtccaggtgcccccggtcccctaaccctgaaggaggtagaggaactggaacagctaacccagcaattaatgcaggacatggagcatccacagagacagaacgtggccgtgaacgagctttgtgggcgctgtcaccagccgctcgcccgggctcagccagcggtgcgggcactcggccaactgttccacattgcctgcttcacatgtcaccagtgcgcccagcagctccaaggacagcagttttattctctcgagggcgctccctattgtgaaggctgttacaccgatacccttgagaaatgtaatacttgtggggaaccaatcacagaccggatgctgcgggcaaccggtaaggcttatcatccccactgtttcacctgcgtagtgtgcgcccgcccactggaagggacgagctttatcgtggaccaggctaacaggccccactgtgtcccagattatcataaacagtacgctccacgttgcagtgtctgtagcgaacccattatgccggaacctgggcgggacgaaaccgtgagagtcgtcgcattggataagaactttcatatgaagtgctacaaatgtgaagactgtggcaagccgctgtcaattgaggcggacgacaatggttgctttccgctggacggacacgtcctatgtcggaaatgccacactgcacgggcccagacgtag

SEQ ID NO: 212594 - DNA, 1623 bp, Artificial Sequence
  Description of Artificial Sequence: Synthetic coding sequence
gccgccccccggcccagccccgccatcagcgtgagcgtgagcgccccagcgttttacgcaccacagaagaagtttggaccggttgtggctcctaagccaaaagtgaatcccttcagacccggtgacagcgaaccaccccccgcaccgggagctcagcgggcccagatggggcgggtcggagagattccacctccaccacccgaagacttccctttaccccctcctccgctggctggcgacggcgacgatgccgagggagccctgggcggggccttcccccccccacctccacccattgaagaaagtttcccccccgcacccctggaagaagagattttcccaagtccacctcccccacccgaggaggagggaggacccgaggccccaattcctcctcccccgcaagtttcaagcggttacgtacctccacccgtcgccaccccattctcgtcgaaatcgtctacgaagcccgccgctggcgggaccgcccccctgccgccgtggaagtctccctcctcatcacagcctctgccccaggtccctgctcctgcccagtcccagacgcagtttcacgtgcagccccaacctcaaccaaagccgcaagtccagctccacgttcaaagtcagactcagcccgtatccctcgccaacacgcagccccgtggtccaccagcctctagtccagctcctgcacccaagttctcccccgttactccgaagtttacccctgttgccagcaaatttagccctggggcccccgggggcagcgggagccaaccgaatcagaaattgggccaccccgaagcgctaagcgccggaaccggctcaccccagcctccctctttcacctacgcccagcagcgggagaagccacgggtacaggaaaaacagcatcctgtgcccccacccgcccagaaccagaatcaagttcgtagccctggagcaccagggcctctaaccttgaaggaggtcgaggaactggaacagctcacacagcagttgatgcaggatatggagcaccctcagcggcagaatgtagcagtgaacgagctgtgcggtcgttgtcatcagcccctggctcgcgcacagcctgcagtgcgagccctgggacaacttttccacatcgcatgctttacatgtcatcagtgcgcgcagcagctgcaaggtcagcagttttacagcctcgaaggcgccccatattgtgagggctgctacaccgacacgctggaaaaatgtaacacatgcggggagcctataacagaccgcatgctgagggcaacaggtaaggcttaccatcctcattgctttacgtgcgttgtgtgcgcccggcccctggaagggacaagctttatcgtggaccaggccaaccggccccactgtgtacctgattatcacaagcagtatgccccacggtgcagtgtctgcagtgaacctataatgccggagccaggtcgagacgagaccgttagggtggtcgccctggacaagaatttccatatgaagtgctataaatgcgaagattgtggaaagcccttatcaatagaggcagacgataacggctgcttccccctcgacgggcacgtcttgtgtcgcaaatgccacactgccagggcgcagacatag

SEQ ID NO: 212595 - DNA, 1248 bp, Artificial Sequence
  Description of Artificial Sequence: Synthetic coding sequence
atgaccaagaacgaccccttcaaggcccgggtgagcagcggctacgtccctccaccagtggcgacaccgttcagcagcaaatcaagtaccaagccggcagccggcggaactgccccgttaccaccctggaagagccccagtagctcgcagccactgccccaggttcccgcaccggcacagtcacaaacacagttccatgtgcaaccacagccacagcccaagccgcaggttcagttgcatgtgcagtcccagacacagccggtctctctggctaacacccagccaagaggccctccagcgtcgagcccagcacctgctcctaagttttcaccagttactccaaagtttacccccgtcgcctccaagttcagccccggagctcctgggggcagtggtagtcagcccaatcaaaaactgggtcatcctgaagcactgtccgccgggacgggtagtccccagcccccctccttcacctatgcccagcaacgggaaaagcctcgcgtacaggaaaaacagcatcctgtgcccccacctgcccaaaaccaaaaccaggtccgatcaccaggcgcccccggcccccttaccttgaaggaagttgaagaactggaacagctgacccagcagttgatgcaagacatggagcacccccagagacaaaacgtggccgtgaacgagctgtgtgggcgttgccatcagccactggctcgggcacagccagccgttcgtgctttgggacagttattccatatagcctgcttcacctgtcatcagtgcgcccagcagctccaaggtcagcagttctacagcctcgagggggctccatactgcgaagggtgttacactgacacactggaaaaatgcaatacatgcggcgagcctattactgaccgcatgctccgggcgactgggaaagcctatcatccccattgttttacttgtgttgtttgtgcacgtcccctggaggggacaagcttcatcgtcgatcaagccaatagaccacattgcgtccctgattatcacaagcagtacgccccccgctgctctgtttgcagcgagccaatcatgcctgaaccgggcagggatgagacagttagagtagtggcgttggacaaaaacttccatatgaagtgctataaatgtgaagattgtggtaagccactttcaattgaggccgatgacaacggctgcttccccctggatgggcatgtcctgtgccgtaaatgtcacactgccagggcccagacatag

SEQ ID NO: 212596 - DNA, 1458 bp, Artificial Sequence
  Description of Artificial Sequence: Synthetic coding sequence
atgggccgggtgggcgagatccccccccccccccccgaggacttcccactcccgcccccccccttagccggcgacggagacgatgctgaaggcgctttgggtggcgcattcccccctcctccaccgcctattgaagagtcatttccaccggctcctttggaggaagagatcttcccaagcccccctcctccacccgaggaagagggggggccagaagcacccatcccacccccaccgcaggtcagttcaggatacgtaccaccaccagtggctacgcccttcagttctaagtcatctaccaaaccagcagctggcggcacagctccactccccccctggaagtctccttccagtagtcagccgctgccacaggtgccagccccggcccaatcccaaacccagttccatgttcagccccagccgcaacctaagcctcaggtccaactacacgtgcagtcacaaacccagccagtgtccttggccaacactcagcctcgtggccctcctgcatcttctcccgccccggctccgaagtttagcccggtgacgcccaaatttactcctgtggcctccaagttcagccccggggcaccggggggttccggaagtcagccaaaccagaagcttggtcatcctgaggccctttcagcgggcaccggctccccacagcctcctagttttacctacgcccaacagcgcgagaaacccagggtgcaggaaaagcagcacccagtgccgccacctgcccagaatcagaatcaggtgcgttcgcctggtgccccaggccctttaacattgaaggaggttgaagaactggagcagctcacccagcaactgatgcaggacatggagcacccacagcggcagaacgttgcagtgaacgagctgtgtggtcggtgccatcagccactggctagagcacaacctgccgtgcgcgccctgggccagttgttccacatagcctgttttacatgtcatcagtgcgcccagcagcttcaaggtcagcaattctactcgctcgaaggcgcgccctattgtgagggatgttacactgataccttggagaagtgcaatacttgtggcgaaccaatcacagatcgaatgctacgggccacaggaaaggcttaccatcctcactgtttcacatgtgtcgtgtgcgccagaccactggaaggcacatctttcatcgtcgaccaggcgaacaggccgcactgcgtccccgattatcacaaacaatatgcaccgagatgttcagtctgctccgagcctattatgccagagccaggaagagacgaaaccgtaagagtggtcgccttggataagaatttccacatgaagtgttacaagtgtgaggattgtggcaagcctctgtctattgaggctgatgacaacggatgctttcccttggacgggcatgttctctgccgtaaatgccacacagcccgggctcaaacatag

SEQ ID NO: 212597 - DNA, 495 bp, Artificial Sequence
  Description of Artificial Sequence: Synthetic coding sequence
atggccgccccccggcccagccccgccatcagcgtgagcgtgagcgcccctgcgttctatgccccccagaagaaatttggtcctgttgtggcccccaagcctaaagttaatccatttcgccctggggattccgaacctccgccggcgcccggagcacagcgggcgcaaatgggaagggtgggagaaatacccccccctcccccagaggacttccctctgccccccccaccacttgcaggggatggagatgatgctgagggtgcactaggcggggccttccctcctcctccccccccaattgaggagagcttcccccccgcccctctggaagaagaaatctttccctcaccccctcccccgcctgaggaggaaggcggccccgaagcacccattcctcccccccctcagcctagagagaaggtgtcgagcattgaccttgagatcgacagcctgagctccttactcgatgatatgactaagaacgatcctttttag

SEQ ID NO: 212598 - DNA, 852 bp, Artificial Sequence
  Description of Artificial Sequence: Synthetic coding sequence
atggatctgtggcccggtgcgtggatgttgctattactcctgttcttacttctattattcctgctgcccacgctgtggttttgctcgcctagcgccaagtacttttttaaaatggctttctacaacggatggatcctatttctagcagtactggccattcctgtttgtgccgtccggggacgcaacgtagaaaatatgaaaattctgcgcctgatgctgctccacatcaaatacctgtacggtattagggtagaagtccggggagctcatcattttccgccatcccagccctatgtggtcgtgagtaatcaccagtcatccctggatttgctcggtatgatggaggtgttgccaggcagatgtgtgcccattgccaagagagagctgttgtgggcgggtagcgctgggcttgcatgctggttggcaggcgtgatttttatagataggaagagaacaggggatgctattagcgttatgagcgaggtggcccagaccctgttgactcaggacgtgcgcgtctgggtgtttcctgaaggaacacgtaaccataacggcagcatgcttccgttcaagagaggcgctttccacctcgccgtgcaagcacaggtgccaatagtcccaatagttatgtcctcataccaggatttttactgtaaaaaggaacgcagattcacttccggtcagtgtcaggtgagggtgctcccgccagtgcctactgaggggctgacacctgacgacgtccccgcactggccgatagagttagacactcaatgcttactgtgttccgggaaataagtacggacgggcgaggaggtggagactacttgaaaaagcctggcggtggaggctag

SEQ ID NO: 212599 - DNA, 852 bp, Artificial Sequence
  Description of Artificial Sequence: Synthetic coding sequence
atggatctgtggcccggtgcgtggatgctgctcttactgttatttctgctgctgctgtttcttcttcccaccttatggttctgctccccgagcgctaaatattttttcaagatggccttctataatggatggatattgttcctggcagtgctcgctattcccgtttgtgcagtgagaggcagaaatgtcgagaatatgaagattctccggcttatgctgctgcacattaaatatctatacggaataagggttgaggtgagaggggcacaccactttcccccatcacagccttatgtcgtcgttagtaaccaccagtcgtccctggacttactgggaatgatggaggtcctgccaggacgctgtgtgcccatagccaaaagggaactgctctgggccggatccgctggcctggcttgttggcttgccggagtgatcttcatcgaccggaaacggacaggtgatgccatcagcgtcatgtctgaggttgctcagaccctgctgacacaggatgtccgagtgtgggttttccccgaagggacacgaaatcataatggcagcatgcttccctttaaacgtggggcatttcaccttgccgtccaggcccaagttcccattgttcctattgttatgagcagttaccaagatttctattgcaagaaagagaggcgattcacctctggtcagtgccaggtcagagtcctgccaccggttccaacagagggactgacgcctgacgatgttccagccctcgccgacagagtgaggcatagcatgctgactgtctttagagaaatttcaaccgatgggagagggggaggcgactatctgaagaagccgggaggaggtggctag

SEQ ID NO: 212600 - DNA, 852 bp, Artificial Sequence
  Description of Artificial Sequence: Synthetic coding sequence
atggacttgtggcctggagcatggatgcttttactgcttctctttctgcttcttctattcctgctccccaccctgtggttctgctcccccagcgctaaatacttctttaaaatggctttttataacgggtggatccttttcctcgctgttttggccataccagtctgcgccgtgagagggaggaatgtagaaaatatgaagatacttaggttgatgttgttacatatcaagtatctgtatggcatccgtgtcgaagtacgaggcgcacatcatttcccaccctcacagccctacgtcgttgtttccaaccatcagagtagcctagatctgctcggtatgatggaggtgctcccgggtcggtgtgtacctattgccaagcgggagctcttatgggcaggaagcgccggtctggcatgctggctagcaggtgtgatcttcattgacagaaaacgtacaggcgatgcaatatccgtcatgtcagaggtcgcccagaccctgctcacacaagatgtaagggtatgggtgtttcccgagggcacgcgcaaccataacggaagcatgctcccttttaaaaggggcgctttccacctagcggtccaggcccaggtccccatagtgcccatcgtcatgagttcctaccaggatttttactgcaagaaagagcgcagatttacctccggccagtgtcaggtccgagtgctcccacctgtgcctacagaaggactgacccccgacgatgtacctgcgttggccgatcgagtgcggcattcaatgctcaccgtcttccgagagatctcaactgacggacggggtggaggcgattacctgaaaaaacctggtggtggcggatag

SEQ ID NO: 212601 - DNA, 852 bp, Artificial Sequence
  Description of Artificial Sequence: Synthetic coding sequence
atggatctttggcctggcgcttggatgttgcttctgctcttgtttctgctgctgctgtttctattgccgaccctgtggttctgcagccccagcgctaagtatttttttaaaatggccttctataatggatggatactctttttagcagttctggccatccccgtgtgtgctgtccggggtaggaacgtggagaatatgaaaattctccgccttatgttgttacatattaagtatctctacggcatccgggtagaagtacggggagcacaccacttcccaccaagtcagccttatgtggttgtctcaaaccaccagtcatccctcgatctgctgggaatgatggaggttctgcctggtagatgcgtgcctattgcgaagagagagctgttgtgggcagggagtgccggtcttgcctgctggctagcaggagtcatatttattgataggaagcgtacgggtgacgcaatctctgttatgtcggaagttgctcagaccctgctgacccaggatgtgagggtgtgggtgttccccgagggcacaagaaatcacaacggcagcatgctcccattcaaaaggggagcattccatcttgctgttcaggctcaagttcccatcgttcccatcgtgatgagcagctaccaagacttctactgtaaaaaggagaggaggttcacgtcgggacagtgccaggttagagtgctgcctccagtgccaacggaggggctgacacccgacgatgtgcctgcgcttgccgaccgagtgcgccattctatgctgaccgtctttcgagagatatctaccgatggccgaggcggtggcgactacctgaaaaaaccagggggtgggggttag

SEQ ID NO: 212602 - DNA, 852 bp, Artificial Sequence
  Description of Artificial Sequence: Synthetic coding sequence
atggatttgtggcctggcgcatggatgctgctactcctcctatttctgctgctgctgtttctcctgccgactctctggttttgttctccctctgccaaatacttcttcaagatggccttctacaatgggtggattctgttcctggcggtcctggccataccggtgtgcgccgttagaggccgtaacgtcgagaatatgaagattttgcgcctgatgctactgcacattaaatatttgtacggaattcgagtagaggtgcgcggagctcatcacttcccccctagccagccgtacgtagtggttagcaatcatcagtccagcctcgatctgctggggatgatggaagtactgcccggtcggtgcgtaccgatagcgaagcgcgaactgttatgggcgggaagcgcgggtttggcctgctggctggcgggagtgatctttattgatcgcaagagaactggcgacgcaatatcggtcatgagcgaggtcgctcaaaccctgttaacccaggatgtgagagtgtgggtattcccggaaggaacaaggaatcataacggctccatgctgccttttaaacggggagccttccacttagctgtgcaggcccaggttccaattgtgcctatcgtgatgtcgtcctaccaagacttttactgcaaaaaagaaaggcgatttacttccgggcagtgccaggtccgcgtgttgcctcccgtgcccacggagggattaacccccgacgacgtgcccgctcttgccgacagggtgaggcactctatgctcacagtgttcagagaaatttcaacggatggacgcggaggcggagattacctgaaaaaacccggagggggtggctag

SEQ ID NO: 212603 - DNA, 852 bp, Artificial Sequence
  Description of Artificial Sequence: Synthetic coding sequence
atggacctatggccaggtgcctggatgttacttcttcttttattcctgcttttgctgtttctgttgccaaccctttggttttgcagcccctccgcaaagtacttctttaaaatggctttttacaacgggtggattctgttcttggcagtgctggcaataccggtgtgcgccgtcagagggaggaacgtggagaacatgaaaatattgcgtctgatgttgcttcacatcaagtatctgtatggtatccgcgtcgaagtgcgcggagcccatcattttcccccatcccagccttacgtagtggtatcgaaccaccagtcaagcttagacttgctcggtatgatggaagttctgcccggacgatgtgtccccatagccaagcgcgaactcctgtgggctggctcagcgggtttagcttgctggctagccggagttatcttcatagataggaaacggaccggggacgccattagcgtaatgagcgaggtggcccagaccctgttaactcaagacgtgcgagtttgggtatttcctgagggcacacgtaatcacaatggttcaatgctgcctttcaaacgtggcgctttccatctggctgtgcaggctcaggtgccaatcgtccccattgtgatgtcctcttatcaggacttctactgcaagaaagaacgcagatttacgtccggccagtgtcaggtgcgggttctgccgccagtccctactgaaggcttaacgccagatgatgttccagcccttgcagatcgcgtacgacattctatgctgacagtgtttagggaaattagtacagacgggagaggcggaggcgattatttaaagaaacccggaggaggaggttag

SEQ ID NO: 212604 - DNA, 852 bp, Artificial Sequence
  Description of Artificial Sequence: Synthetic coding sequence
atggacctatggccgggtgcttggatgctcctgctattgctgttccttctgttactatttctgctacccactctatggttttgttccccctccgcaaagtatttttttaaaatggccttttacaacggatggatactgtttctcgctgttctcgccattccagtgtgtgcagtccggggacgaaatgttgagaatatgaagattctgcgactgatgctccttcacataaagtacttgtatgggatcagagttgaagtcagaggtgctcaccatttccccccaagccagccgtacgtggtcgtgagtaatcatcagtcatccctggacctgctgggaatgatggaggtgctgcccggaagatgtgtgcctatagcaaaacgggaacttctttgggcaggttctgctggactggcttgctggctcgccggtgtcatattcatcgatcggaagagaaccggtgacgcgatcagtgttatgtccgaggtcgcgcagactctgttaacacaggatgttagagtgtgggtgttcccagaaggaacgcgaaaccataatgggtctatgctgccatttaagcgtggcgcatttcatcttgcagtccaggcccaggtacctatcgtgcccatagtgatgagtagctaccaggatttttactgcaagaaagagcgacgattcacgtcgggtcagtgccaggtgcgggtactccctcctgtccccactgagggccttacacctgacgatgtgcctgcgctggccgaccgcgtccgccattcaatgctgacggtgttcagagagattagcacagacgggagaggcggaggcgactatctgaagaaacccggtggaggaggctag

SEQ ID NO: 212605 - DNA, 852 bp, Artificial Sequence
  Description of Artificial Sequence: Synthetic coding sequence
atggatctgtggccaggtgcttggatgctgttgctgctgctgttcctcctccttcttttcctgctgccaacactttggttttgtagcccatcggctaagtactttttcaagatggctttctataatggctggatcctctttctggcagtgctggccattcctgtttgcgctgtgagggggagaaatgttgaaaatatgaagattcttagacttatgctcctgcacattaagtacttatatggaattcgagtcgaggtgcgtggagcccatcactttcctcctagtcagccctacgtggtggtgtccaaccatcaatcttccctggatttgttgggcatgatggaagtgctgccaggacgatgtgtaccaattgccaagagggaattgttgtgggcgggttcagcaggcctggcttgctggctggctggggtgatatttatagataggaagcgcaccggtgatgccatatctgtgatgtcagaagtagcacaaaccttgctgacccaagacgtgagggtgtgggtttttcccgaaggaacaaggaaccataatggcagcatgttgccctttaagcgcggagccttccatcttgccgttcaggcacaggtcccaattgtcccaatagtgatgagcagctaccaggacttctactgcaaaaaagagcgtagattcacctctggccagtgtcaggtgcgcgtcctgccccctgtgcctaccgaaggccttactccggatgacgtcccggcactcgcggaccgcgtcagacatagcatgcttacagtttttcgggaaatttcaacagacggccgtgggggaggtgattacttaaagaagccaggagggggagggtag

SEQ ID NO: 212606 - DNA, 852 bp, Artificial Sequence
  Description of Artificial Sequence: Synthetic coding sequence
atggatttatggccaggagcctggatgctccttctgctgctgtttttgctgctgctctttctgcttcctaccctctggttttgctctccgagcgccaaatattttttcaaaatggctttttataatggctggattctcttcctggctgtgcttgctatcccggtatgcgctgtccggggaaggaacgttgagaacatgaagatacttcgcttgatgctcttgcatattaaatacctttatggcattcgtgtggaagttcgaggagcccaccatttccccccatctcagccctatgtagtggtgtccaatcaccagtcttctctggacctcctgggcatgatggaggtgcttcccggtagatgtgtgcctatagccaaaagggaattgctgtgggccggttcagctgggttggcctgctggctagcgggtgtgattttcatcgacagaaaacgaactggcgacgcaatcagcgtcatgtctgaggtggcacaaactctgctgacacaggatgttcgcgtctgggttttccccgagggtactaggaatcacaatggatcaatgctgccctttaaacggggtgcatttcacctggcggttcaggcccaggtgccgatcgtgccaatcgtgatgagcagttaccaggatttctactgcaagaaagaacgccgattcacatcaggtcaatgtcaggtcagggtcctgcctcctgtgccaacagagggacttactccggatgatgtccctgctttggctgacagggtgcggcatagtatgttgactgtctttagagagatttcgaccgatgggaggggcggaggagactaccttaagaaaccagggggtggcggatag

SEQ ID NO: 212607 - DNA, 852 bp, Artificial Sequence
  Description of Artificial Sequence: Synthetic coding sequence
atggacctgtggcccggtgcatggatgctcctactgctgctgtttctcctcttgttatttctgcttcctaccttgtggttctgttctccatctgctaagtacttcttcaaaatggctttctacaatgggtggatcctgtttttagctgtattggctattccggtctgtgctgtccgtgggaggaacgtggagaatatgaagattctgcgcctgatgctactgcatatcaaatatttgtacgggattagagtggaagtccgcggagcccaccacttcccaccatctcagccctatgtcgtggtgagtaatcaccaaagtagtttagatttactcggaatgatggaggtgctccccggtcgctgtgtacccattgccaagcgagaactattatgggcaggctcagccggtctcgcgtgctggttggcgggtgtaattttcattgaccgaaaaaggaccggggatgctatcagcgtcatgagcgaggtcgcacagacgttactcacacaggacgttcgtgtttgggtctttccagaggggacccggaaccataatgggagtatgttgccatttaagaggggtgcatttcatctagccgtgcaggcacaagtgccaattgttcctattgtcatgagcagctatcaggacttttattgcaaaaaggaacggcgattcacgtccgggcagtgccaggtgagagtgctaccccctgtcccgactgaaggtctcacgccagacgatgtgcccgcactcgctgaccgggtcagacatagtatgctgaccgtctttagggaaatcagtaccgacggcagggggggaggggactaccttaaaaagcctggcggtggcggttag

SEQ ID NO: 212608 - DNA, 852 bp, Artificial Sequence
  Description of Artificial Sequence: Synthetic coding sequence
atggacctgtggcccggagcctggatgctgcttctgctactcttcctcctgctcctgttcctacttcccaccctgtggttttgctctcctagcgccaaatacttcttcaagatggcgttctataacgggtggatcctgtttcttgcggtcctagccatacctgtgtgcgcagttagaggacgcaatgtcgagaacatgaagatcctacggcttatgctgctacacattaagtacttgtacgggattcgcgtggaagtacggggtgctcaccatttcccaccaagccagccctatgtcgtggtctctaaccatcagtcctccctggacttgttaggaatgatggaggtcctcccagggcgttgtgtccccatcgccaaacgcgaactcttgtgggctggctcggccggacttgcctgttggctggctggagtgatttttatcgacaggaagcgaacgggggatgccatctccgttatgtcagaggtagcccagaccctgcttacacaagatgtgagagtgtgggtcttccccgaagggacccggaaccataatggatccatgctacccttcaagcggggtgcttttcatctcgcagtgcaggcccaggtaccgatcgttcccattgtcatgagttcctaccaggacttttactgtaagaaagagagaaggttcacctcgggccagtgccaggtgcgcgtgctgcctcccgtgcctacagagggactgacgcctgacgatgtacccgctctagccgaccgagtccgtcattcaatgttgactgtgtttagggagatatccacagatgggcgtggaggcggtgattacctcaaaaagcctggcggtggaggctag

SEQ ID NO: 212609 - DNA, 852 bp, Artificial Sequence
  Description of Artificial Sequence: Synthetic coding sequence
atggatctatggccaggggcttggatgttgctactgctgttatttctacttctgctgttcctgctccccaccctgtggttttgtagcccatctgcgaaatatttttttaagatggctttttataatggctggatcctctttctggccgtgctggcaatccccgtgtgcgccgtccgagggaggaacgtcgaaaatatgaagattctccgcctgatgttgctgcacatcaaatacctgtatggcatcagggttgaggtacggggtgcccaccatttcccaccatcacagccttatgttgtggtgtcgaatcaccaatcctcgttggacctgctggggatgatggaggtcttgcccggacggtgtgtcccaatcgccaagagagaactgctttgggcaggctccgctggtcttgcatgctggttagctggggtgatattcatagatagaaagaggacgggcgacgctatctccgtgatgtcagaagtggcacagaccttgctaactcaagatgtcagggtctgggtgttcccagagggaacccggaatcacaacggatctatgctgccttttaaacgcggtgcttttcaccttgccgtccaggctcaggtaccaattgtcccgattgtgatgtcgagctaccaagatttctactgtaaaaaggagagaaggttcacaagtggccagtgtcaagtcagagtgctccctccagtgcccacagagggcctgacccctgacgacgtgcctgccctcgccgatcgggtacggcactctatgctgaccgtgtttagagagataagtaccgatggacggggtgggggagattacctcaaaaagccgggtggtgggggatag

SEQ ID NO: 212610 - DNA, 516 bp, Artificial Sequence
  Description of Artificial Sequence: Synthetic coding sequence
atgatggaggtgttgcccggacgctgcgtgcccatagccaagagagagctactgtgggccggttctgcaggattagcttgttggctggcaggcgtgattttcatcgacagaaagcggacaggagacgccatttcagtgatgagtgaggttgcccaaactctgttaacacaagatgttcgtgtgtgggtgtttccagaggggacccggaaccacaacggttcaatgcttccattcaagaggggggcatttcacctggccgtacaagcacaggtgccaattgtcccaatagtaatgtcctcctaccaggatttctattgcaagaaagagaggcggtttacctccgggcagtgccaggtccgtgtgctgccccctgtgccaactgagggactcacgcccgacgatgtccctgccctggccgacagagtgcggcacagcatgctcacagtctttagggaaatcagcaccgacggccgtggtgggggagactacctgaagaagcccggtggcggaggctag

SEQ ID NO: 212611 - DNA, 852 bp, Artificial Sequence
  Description of Artificial Sequence: Synthetic coding sequence
atggatctctggcccggtgcttggatgcttttgctattgttatttcttctattgcttttcctgttgcccaccctgtggttctgcagcccgtctgctaagtatttcttcaagatggccttctacaacgggtggattctctttttggctgttcttgcaatcccggtgtgcgcggtaaggggccgtaacgttgagaatatgaagatcctgcggttaatgctgcttcatatcaagtatttatacggcatccgcgtagaggttaggggagctcatcacttccctccgtctcagccctacgtggtcgtgagcaaccaccagagcagtctcgatctattgggcatgatggaggtgctgccgggtaggtgtgtgcctatcgctaaacgggaactgctgtgggccggaagtgccggacttgcctgttggttggccggagtgatttttatcgatcgcaagagaacaggcgatgctattagcgtcatgagcgaggtcgcccaaaccctgctaacacaagatgtccgagtgtgggtatttccagaaggtacacggaatcataatggctcaatgctgcctttcaagcggggtgccttccatctggcagtccaggcccaggttcctattgtccctatcgttatgagctcatatcaggacttttactgcaaaaaggaacggcgtttcaccagcggacagtgtcaagtccgcgtgctccctccggtgcctacagagggcctgacccccgatgacgtgcctgccctggcggatagagtgaggcattccatgttaacggtgttcagagaaatttctaccgatggcaggggagggggagattaccttaagaagcccggtggcggtggctag

SEQ ID NO: 212612 - DNA, 852 bp, Artificial Sequence
  Description of Artificial Sequence: Synthetic coding sequence
atggacctatggccgggtgcctggatgctgttgctcctgctctttctattattactgtttctgttgcctactctatggttctgttcgccctctgctaaatacttcttcaaaatggctttctacaatgggtggattctgtttctggcggttctcgctatacccgtgtgtgcagtgcgcggacggaatgtggaaaatatgaaaattcttaggttgatgctcctgcacatcaagtacctttacggaatccgagtggaagtgaggggcgcacaccattttcctccgtctcaaccctatgttgtggtctccaaccaccagtcaagcctagaccttctcggaatgatggaagtgttgcccggtcgctgcgtccctattgctaagagagagctactgtgggccggatcagccggattagcatgttggctagctggcgttatcttcatagacagaaaaagaaccggagacgctatcagtgtgatgtcagaggtggcacagaccctgttaactcaggatgtgcgggtgtgggttttcccggaaggtacaaggaatcacaatggctctatgctccccttcaagagaggagccttccaccttgccgtccaggcccaggttcccatcgttccaatcgtaatgtcatcttatcaggatttttattgcaaaaaagaacgtcgatttacatccgggcagtgtcaggtccgcgtcctccctcccgtgcccactgaaggactaactccagacgatgtccccgctctggcggatcgggtccgccattccatgctcacagtgttcagggaaatcagcaccgacggacggggaggaggcgactacctcaaaaagcccggtgggggtggctag

SEQ ID NO: 212613 - DNA, 852 bp, Artificial Sequence
  Description of Artificial Sequence: Synthetic coding sequence
atggatctgtggcctggagcctggatgcttctcctcctgctgttcctcctcttactctttctgttgcctactttgtggttttgttccccgagcgccaaatactttttcaagatggccttctataacgggtggattctgttccttgccgtacttgcaattcccgtgtgtgcagtgagagggaggaatgtggaaaatatgaagatcctcaggctgatgctccttcatattaagtatctgtacggaatccgggtggaggtaaggggtgcccaccactttcccccaagtcagccttatgtggtggtgagcaatcatcagagctccctggacctcttgggcatgatggaggtgctaccaggacgttgcgtgccaattgcaaaacgagaactgctgtgggcaggaagtgcaggactggcttgctggctggcgggtgttatttttatcgaccgcaagaggactggcgacgctatctctgtgatgtcagaggtagcccagacccttttgacacaagacgttcgcgtgtgggttttccccgaaggaactagaaatcataacggaagcatgctgcccttcaagagaggggcattccacctggctgtgcaagcacaggtgcccatagtgccaatcgtgatgagttcctatcaggatttctactgcaagaaggagagacgatttacatccggccagtgccaggtccgcgtgttaccccctgtgcctaccgaagggttaaccccagacgacgtacccgctctggccgaccgggtgcgccacagtatgctcacggtttttagagagatctctacagatggcagagggggaggtgattatctcaagaaaccagggggaggaggctag

SEQ ID NO: 212614 - DNA, 852 bp, Artificial Sequence
  Description of Artificial Sequence: Synthetic coding sequence
atggatctgtggcctggagcctggatgctgctgctcctgctcttcctgttacttctgtttctcttgcccactctgtggttttgtagtccatccgctaaatatttctttaaaatggcgttttacaacggctggatcctgttcttggctgtgcttgcgatcccagtatgcgctgtgagagggaggaatgtggagaacatgaaaatcttgcggcttatgttactgcatattaaatatctttacggcattagggtggaggtccggggagcccatcacttccctccttcccaaccttacgtcgtggtgagcaaccaccagtccagtttggacctgttggggatgatggaggtcttgcccggacggtgtgtgccaattgccaagcgtgaactcctttgggccggatctgcagggctggcatgttggctggccggagtgatttttatcgatcgcaagcggaccggcgatgcgatttcagtcatgagcgaagttgcacagacactgctgacacaggatgtgcgggtttgggtgttcccagaagggactcgcaatcacaacggctcaatgttgcctttcaagcgcggagctttccacctcgcagtgcaggctcaggtgcctatcgtgcccattgttatgtcgagctaccaggatttctattgtaagaaggagcgccgattcacatccggacaatgtcaagtacgtgtcctgccccctgtgccaactgagggcctgacaccagatgacgtgcctgccctggcagacagagtacgtcactcaatgctgaccgtgttccgtgagatctccaccgatggacgcggtggtggcgactatctgaagaagccaggcggtggtgggtag

SEQ ID NO: 212615 - DNA, 852 bp, Artificial Sequence
  Description of Artificial Sequence: Synthetic coding sequence
atggacttgtggcccggagcttggatgcttcttctcctgttattcctcctgctgctttttctgctgcctacactgtggttctgctcaccctccgccaaatatttcttcaagatggctttctacaatggatggatcctgttcctggccgtgctcgccatacctgtctgcgccgtgcggggacggaatgttgagaacatgaagatcctgcggttaatgctcctgcacattaagtacctgtacggaattcgagtggaagttcgcggtgcccatcatttcccaccaagccaaccatacgtagtcgtctctaatcatcaaagcagccttgacctcttggggatgatggaagttctgccagggagatgcgtgcctatagccaagagggaactcttatgggcagggagcgcagggctggcctgttggctcgcaggggtgatatttatcgatagaaaacgcactggggacgccatctcagtgatgagcgaagttgcgcagacgctgcttactcaggacgtccgggtctgggtctttcctgaaggcacacgaaaccacaatgggtctatgttgccattcaagcgaggtgcttttcacctggcggtgcaagctcaagtgccgatcgtgcctatcgtgatgtctagctatcaggatttttactgcaaaaaggaacgtcgatttacaagcggccagtgccaggtcagagtgcttcccccagtgccaaccgagggactaacacccgacgacgtccctgctctcgcagatcgggtgaggcatagtatgcttaccgtcttcagggagatttccactgacggaagaggcggtggcgattatctcaaaaagcccggaggcggaggctag

SEQ ID NO: 212616 - DNA, 852 bp, Artificial Sequence
  Description of Artificial Sequence: Synthetic coding sequence
atggatctctggcctggcgcatggatgctattgttgcttctctttcttctacttctttttctgctcccgaccttatggttttgctctccttcagcgaagtacttcttcaaaatggctttctacaacgggtggatcttattcctcgctgttctggccatcccagtgtgcgccgtgcgcggtcgtaacgtggaaaatatgaaaattttgaggctgatgttgctgcacataaaatatctgtacggcatccgcgtggaagtgcggggagcacatcactttcccccttcccaaccctacgtggtagtttccaaccatcagagctcactagatcttttgggaatgatggaagtgctcccgggaaggtgtgtgccaatagcaaaaagggaactcctgtgggctggatctgcagggctggcctgttggcttgccggagtgatatttatcgatcgcaagcgcacaggagacgccattagcgtaatgtcagaggttgcacagaccctgctgacccaggatgttcgcgtgtgggtgtttcctgaaggtacacgaaaccacaacggatccatgctccccttcaaaaggggtgcctttcatctcgccgtccaagctcaagtccctatcgttcccatagtgatgtccagttatcaggacttctattgcaagaaagaaaggaggttcacgtcaggacaatgtcaagtccgcgttctgccgccagtcccaacagaaggccttaccccagacgatgtgccagcgctcgcagaccgtgtccggcacagtatgctgacagtgttccgggagatttcaacggatgggaggggtggaggcgactatctgaaaaaacccggaggaggcggatag

SEQ ID NO: 212617 - DNA, 852 bp, Artificial Sequence
  Description of Artificial Sequence: Synthetic coding sequence
atggacctgtggccaggtgcatggatgctgttgctgctgcttttccttttgctcctgtttctgctgcctacactctggttttgtagcccctccgccaaatacttctttaagatggccttctataatggttggattctctttttggcagtgcttgcaatacccgtatgcgccgttaggggacgcaacgtggaaaatatgaagatcctccgtctaatgcttttgcacatcaaatacctctatgggattagggtggaagtgcgaggcgctcatcacttccccccatctcaaccctacgtagtagtatctaaccatcaaagctctttagacctactgggtatgatggaggttcttcccggaagatgtgtgcccatagccaaacgagaacttttgtgggcagggagtgctgggctggcttgttggcttgcgggagtgatatttattgatcggaagaggacgggggatgccatttcagtcatgtccgaggtcgcgcagactcttttaactcaggatgtgagagtatgggtttttccagagggcacaagaaatcataacggaagcatgcttccttttaaacgcggagcttttcaccttgccgtgcaggcccaggttcctattgtgcccatcgtgatgtccagctatcaagacttttactgcaagaaggagagaaggttcacaagtgggcagtgccaggtccgtgtgctccccccagtgcccacggagggattgacccctgacgacgtgccggcactggcggaccgggtgcggcactcaatgctgaccgtatttcgagagatctcgacagacggaaggggcggaggcgattatctgaagaagccagggggaggcggatag

SEQ ID NO: 212618 - DNA, 852 bp, Artificial Sequence
  Description of Artificial Sequence: Synthetic coding sequence
atggacctgtggcctggagcatggatgttgctacttctgttgttcctgcttttactctttctgctgccaacactatggttctgctcaccctctgcgaagtattttttcaaaatggcgttctacaacggctggattctgtttctcgccgtcttagccattccagtgtgtgccgtgcgaggccgaaatgtagaaaatatgaagatccttagattaatgctgctccatatcaagtacctatatggaatccgcgtggaagtgcgcggagcgcaccactttccgccttctcagccctatgtggtggtttcaaaccatcagtctagcctggacctactgggtatgatggaagttctcccagggagatgcgttccaattgctaagcgcgagctcctgtgggcaggatctgcagggctggcctgctggcttgccggagtcatctttattgacaggaagagaacaggggatgccatcagcgtgatgagtgaagtagcccagacactgcttacgcaggatgtccgggtctgggtgtttcctgagggaacacgcaatcacaatggatcaatgctccccttcaagaggggagccttccacctggctgtgcaggctcaggtcccaattgttcccatcgttatgagcagctaccaggacttttactgcaaaaaggagagaagatttaccagtgggcaatgtcaagtacgtgttctcccacctgtaccaaccgaggggcttacccctgacgacgttcccgcacttgccgatcgcgttcggcattccatgcttacggtgttccgcgagatcagcacagacggaagggggggtggagattacctcaagaagcccggaggcggtggttag

SEQ ID NO: 212619 - DNA, 852 bp, Artificial Sequence
  Description of Artificial Sequence: Synthetic coding sequence
atggatctgtggcccggtgcttggatgctgctgttacttctattcctgctgctcctgtttctgttacccactctgtggttctgttctccatccgcgaaatatttctttaagatggccttctataacggatggatcttatttctcgccgtactcgcgattcccgtgtgcgcagtgcgcggtagaaacgtggagaatatgaaaatcctacgccttatgcttctccatatcaaatacctttatggcatcagggttgaagttagaggcgcacatcatttccccccaagtcagccttatgtggtcgtgtcaaaccatcagtcttctctggatctcttgggcatgatggaagtgttacccggaaggtgcgtacctatagcgaagcgggaattactgtgggccggatcagccggtttggcctgttggctcgcaggagtcattttcattgaccgaaagcggacaggagacgctataagcgtgatgagcgaggtggcgcagactttactgactcaggacgtcagggtgtgggtgttcccagagggaactcgcaaccacaatggttctatgctccccttcaagcgcggagctttccaccttgccgtgcaagcccaagtccccattgtgcctattgtcatgagtagctaccaggacttctattgcaaaaaagaacggaggtttacctccggacagtgtcaagtgcgcgtgctccctcccgtccctactgaagggctgacacctgatgacgtcccagctctggcagatcgagtgagacatagcatgctgaccgtgtttagggagataagcaccgatggaagaggtgggggagactatctgaagaaacctggagggggaggctag

SEQ ID NO: 212620 - DNA, 852 bp, Artificial Sequence
  Description of Artificial Sequence: Synthetic coding sequence
atggatctatggcctggagcctggatgctgttgctgctcctgttcctactgttgctattcctccttcctacactgtggttctgctcccccagtgcaaaatacttctttaaaatggcattctacaacggatggatcttgttcttggctgtgctggccattcctgtgtgtgcagtaagaggacggaatgtggagaacatgaaaattctaaggcttatgctgctccatatcaaatacctgtatgggatccgcgtggaggtaagaggcgctcatcacttcccgccttctcagccgtatgtggtcgtgagcaaccatcagtcctccttggatctcttgggaatgatggaggtgcttccaggcaggtgtgtgcctatagccaagcgggagctgctgtgggctggaagcgcgggactggcatgttggcttgctggtgtgatatttattgatagaaaaagaacgggcgatgctattagtgtaatgtcagaagtggcgcagacactactgactcaagatgtcagggtgtgggtgttccccgagggtactagaaaccacaatggctctatgctacccttcaagcggggagcttttcatctggccgtgcaggctcaagtccccatcgtgccaattgtaatgagttcgtatcaggacttctactgcaaaaaagagaggcgcttcaccagtgggcagtgccaggtgcgggtgctcccgccagtgcccaccgagggtctgaccccggatgatgtgccggcactggcagatcgagttaggcacagcatgttgacagtcttccgggaaatctcaaccgatggacgtgggggtggcgactatcttaagaagcctggagggggaggttag

SEQ ID NO: 212621 - DNA, 852 bp, Artificial Sequence
  Description of Artificial Sequence: Synthetic coding sequence
atggacctgtggccaggtgcctggatgctcctcctgctgctatttctactgctgctgttcttattgcccaccctgtggttttgttcaccatccgccaaatacttctttaaaatggcgttctacaatggatggattttatttcttgccgtattagctatccccgtatgtgccgttaggggacgcaacgtcgaaaatatgaaaatcctgaggttgatgctgctgcatatcaagtatctgtacggcatccgagtggaagtgcgtggggcacaccatttccccccaagtcagccctacgtcgtggttagcaaccaccaaagcagcttagatctgttgggcatgatggaggtgctgcccggacggtgcgttccgatagctaaacgggaactgttgtgggccggatctgcaggtctagcttgttggctcgcaggggtgatttttatcgacaggaaaaggactggagacgccatatctgtgatgtctgaagtcgcccagacactgcttacccaggacgtgagggtatgggtatttccggaagggactagaaaccacaacggctccatgctgccctttaaacgaggtgcttttcacctcgcggttcaagcccaagtgccaattgtacctattgtaatgagcagttaccaggatttctattgcaaaaaggagcgcaggttcacaagtgggcagtgccaggttagggtgttaccgcctgttcccaccgaggggctgacccctgacgacgtgcctgccctggcggaccgcgtcagacattccatgcttacagtatttagagaaatctccaccgacggccgtggagggggagattacttgaaaaagccaggaggagggggttag

SEQ ID NO: 212622 - DNA, 852 bp, Artificial Sequence
  Description of Artificial Sequence: Synthetic coding sequence
atggatctgtggcccggagcctggatgttgttgctgctgctctttctgctcctgctgtttctgctgccgactctgtggttctgttcgccttcagccaagtacttttttaaaatggcgttttacaatgggtggatcctctttcttgcagtacttgcaatcccggtttgcgccgtgcgtgggagaaatgttgagaatatgaaaatcctccggctcatgcttctccacatcaaatatttatatggcattcgcgttgaggtgaggggcgctcatcacttccctccttcccagccctatgtggtcgtgagcaaccatcagtctagtctggatctgctcggcatgatggaagtgctgcctggaaggtgtgtgcctattgccaagagggaactgctctgggcagggtctgccggactggcctgctggctggcaggagtaatttttatcgatcggaaaagaactggggacgctatctctgtgatgtctgaggtggcacagaccctgctgacccaagatgtgagagtctgggtcttcccggaggggactagaaaccacaatgggtccatgctaccgtttaagcgcggagccttccatctggcagttcaggcacaggtgcctatcgtaccaattgtcatgagctcttaccaagacttctattgtaagaaggaaaggaggtttacctccggacagtgtcaggtgcgagttctcccccctgtacctacagagggcttgacaccggacgatgttccagcactggctgatcgggtgaggcattcaatgctgacagtctttcgcgaaatatcaactgacgggaggggaggtggagattacctgaagaagcctggaggcggtggatag

SEQ ID NO: 212623 - DNA, 852 bp, Artificial Sequence
  Description of Artificial Sequence: Synthetic coding sequence
atggatctgtggccaggcgcatggatgctcctcctgcttctcttcttgctgctccttttcctccttcctaccctctggttctgcagcccttccgccaagtattttttcaagatggccttctacaacggctggattctattcctggccgtcctcgccattcctgtctgcgcagtgagaggaagaaatgtggagaatatgaaaatcttacgactgatgctgctgcacattaagtatctttatggcattagggtggaggtgaggggcgcacaccatttcccaccttcccagccttatgtcgtagtatcaaatcatcagtctagcctggatctgttggggatgatggaggtgcttcccggtcgctgcgtgccaatcgcaaagagagagctgttgtgggcagggtctgccggtctagcttgttggttagccggagttatctttattgaccggaagcggaccggagatgctatctccgtaatgagtgaggttgcacagacattgctaactcaggatgttagggtgtgggtgtttcctgaaggtaccaggaaccataacggttccatgttgccttttaaacgcggtgcttttcatctcgcggtgcaggcccaggtgccaatcgtgcccatagtgatgtcctcctaccaggacttttactgtaagaaagagcgaagatttacgtccggacagtgtcaagtcagagtattgccccctgttccgaccgagggactcactcccgacgatgtgcctgcattagctgatcgtgtgagacattccatgctcactgtgttcagagaaataagcacagacgggagaggcggaggtgattacctgaagaagccaggcggtgggggttag

SEQ ID NO: 212624 - DNA, 852 bp, Artificial Sequence
  Description of Artificial Sequence: Synthetic coding sequence
atggacctgtggcccggagcctggatgctgttgctcctcctttttcttctgctgctctttctgctgcccacactgtggttctgctccccctcagctaagtatttttttaaaatggctttctacaatgggtggatcctcttccttgcagtcctggccatccccgtgtgcgccgtcaggggcaggaacgtggagaacatgaaaatacttcgtctcatgctcttgcatattaagtacctatacgggatccgtgtcgaagtgagaggtgcacatcactttccgcctagtcagccttatgtggtcgtctccaatcaccagtcttcactggacttactgggtatgatggaagtgctacccggacgatgcgtgcccatcgctaagcgagaattgttgtgggctggctccgccggattggcctgctggctggctggggtaatcttcatcgatcgaaagaggaccggggacgcgatctcagtaatgtctgaagttgcgcagaccttgctgacccaagacgtgagggtctgggtgttccctgaggggactagaaaccacaacggcagtatgcttccatttaagcggggagcattccatttggcggtccaagctcaggtgcccatagtccctatcgttatgagttcataccaggacttttactgtaagaaagagcgcagattcaccagtggacagtgccaagtcagagtactccccccagtgcccaccgaagggcttactccagacgacgtgcctgccctggctgatagggtacggcactctatgctcaccgtctttcgtgaaattagcaccgacggcaggggagggggtgattatctgaaaaagcctggaggaggcggatag

SEQ ID NO: 212625 - DNA, 852 bp, Artificial Sequence
  Description of Artificial Sequence: Synthetic coding sequence
atggatctgtggcccggagcatggatgctcctccttcttttgttcctcctgcttttattcctcctgccaacactatggttctgcagtccaagtgcaaagtactttttcaagatggctttttacaatgggtggattctgtttctggcagtgcttgcaattcccgtatgtgccgtgcggggaagaaatgtggagaatatgaaaatcttgcgtctcatgctgctgcacatcaagtacctgtacggcatcagggtcgaggtacggggagcccaccactttcctccctcacagccatatgtagtggtctcaaatcatcagtcctcattagacctcctggggatgatggaagtgctgcctggcagatgcgttccgattgctaaacgagaactgctttgggctgggagtgccggtctggcctgctggctcgccggagtgatattcatcgacaggaagcgaaccggtgatgccatcagtgttatgtcggaagttgcccagactctccttactcaggacgtccgcgtgtgggtcttccctgaaggtacaaggaatcacaacggcagcatgcttcccttcaaaagaggagcgttccatttagcagtccaggcgcaggttcccattgtaccgatagtgatgagctcatatcaagatttttactgcaaaaaagagcggagatttacatctggccagtgtcaggttcgggttcttccaccagtgccaactgaaggcctgactcctgacgatgtgccagccctggctgatagagtacggcactccatgcttaccgtgttccgtgagatctcgactgatggtagaggcggaggggattacctcaagaagccaggcggtggcggttag

SEQ ID NO: 212626 - DNA, 852 bp, Artificial Sequence
  Description of Artificial Sequence: Synthetic coding sequence
atggacttatggcctggagcatggatgctgctcctattgctgttcttgctgctattgttcttgctccccaccctctggttctgttcacccagtgccaagtatttctttaagatggccttctacaatggatggattctttttctggctgtgctggccatccctgtgtgtgccgtcaggggcaggaacgtggaaaatatgaagatccttcgactcatgttactccacatcaaatatttatatggcattcgtgtagaagtgcggggtgcccaccactttcccccttcccaaccatatgtggtggtgtctaatcaccaaagttccctggatctcctcggaatgatggaggtcctgcctggcaggtgtgtgcctatcgccaaacgcgagctcctgtgggcaggcagtgcgggtcttgcgtgctggctcgcaggcgtgatttttatcgaccggaagagaactggagacgcaataagcgtgatgtctgaggtcgctcagacccttctaacccaggatgtgcgagtgtgggtcttcccagagggaacacgcaatcacaacgggagtatgctcccttttaaacgaggagcgtttcacctggccgtacaggctcaggtccctattgtccccattgtgatgagcagctaccaagatttctactgtaagaaagagcgacgctttactagtggacagtgccaggtgcgagttcttccaccagttccaaccgaggggcttacccctgacgacgtcccagctttggcagaccgtgttaggcatagcatgctaaccgtcttccgggagatttccactgacggccgaggcggaggtgactacttgaagaaaccaggaggcggtggttag

SEQ ID NO: 212627 - DNA, 852 bp, Artificial Sequence
  Description of Artificial Sequence: Synthetic coding sequence
atggacttgtggcccggtgcatggatgctgctgctgctcctgtttttgctcttgctatttctactccccaccctctggttttgctcccctagcgccaaatatttcttcaaaatggccttctacaacggatggatcctctttctggctgtgttagccatacctgtgtgtgcagtgcgcggtagaaacgtagagaacatgaaaatcctaaggcttatgcttttacacataaagtacttgtacgggattcgagtggaggtacggggtgctcatcattttccaccctctcaaccatatgtggtcgtctctaaccaccaaagttctttggacttactcggcatgatggaggtgctaccgggaaggtgtgtgccaattgccaagagagagctcctgtgggctgggagcgccggactcgcttgctggctggcgggagtgatttttatagaccgcaagcgtacaggtgatgctatctcagtcatgagcgaggtggcccagactctgctgacccaggatgtgcgggtgtgggtatttccagagggaacccggaaccataacggcagcatgcttccgttcaagcgaggggcatttcaccttgccgtgcaggctcaggtgcctatcgtgccaatagttatgtcgagttatcaagatttttactgcaagaaagaaaggcgattcacaagcgggcaatgtcaggtacgagttctaccccctgtgcccactgagggcctcacccccgacgacgtaccagcccttgcagacagggtgaggcactccatgctgaccgtgttcagagaaatttctacagacgggaggggtggaggcgactatctgaagaagcctggaggtggcggatag

SEQ ID NO: 212628 - DNA, 852 bp, Artificial Sequence
  Description of Artificial Sequence: Synthetic coding sequence
atggacctgtggccaggcgcatggatgttgctcctattactgttcctcctactgctctttttactacctaccctgtggttctgctcaccttccgcaaagtatttcttcaagatggccttctacaacgggtggattttatttttggccgtcctggccatcccagtatgtgctgtgagaggaagaaacgtcgaaaatatgaagattcttaggttgatgctgctgcatatcaaatacctgtatgggattagggtggaagtaagaggagctcaccacttcccgccttcacagccttacgtggtggtgagcaatcatcagtcaagtctggatctactcggaatgatggaagtgctccccggaagatgcgtacccattgcgaaaagggaattgctgtgggccggatcagcgggattagcatgttggctggcaggggtcattttcatcgacagaaagcgcacaggcgacgccattagtgtgatgagcgaggttgctcagactctgttgacgcaggacgtccgagtttgggtctttcctgagggcaccaggaatcacaacgggtcgatgttgccatttaaacggggagccttccacttggctgtgcaggctcaggtgcctattgtcccaattgtgatgtcgagctaccaagacttttattgcaagaaagaaaggagattcacgagtgggcaatgccaagtacgagtgctgcccccagttccgacagaaggactcacaccagacgatgtgcccgctctggccgacagagttagacacagtatgctcactgtattccgggagataagcaccgatggcaggggtggcggagattacctcaagaaacccggtggcggaggctag

SEQ ID NO: 212629 - DNA, 852 bp, Artificial Sequence
  Description of Artificial Sequence: Synthetic coding sequence
atggatctttggcccggagcctggatgctcctgcttttactttttctactgctgctgttcctcctgccaaccctgtggttctgttctccttctgctaagtattttttcaaaatggcgttctataatggctggatactctttttggccgtgctcgcaattccagtgtgtgccgtcagaggtcgtaatgttgagaatatgaagatcttgagattgatgctattgcatatcaaatatctgtacggaataagagtggaagtgcggggtgctcatcacttccccccatctcagccctatgttgtggtatctaaccatcaatctagtctagacctgctgggcatgatggaagtgctgcccggaagatgtgtgccaatcgccaagagggaattgttatgggcaggatctgccggactcgcatgctggctggccggagtgatattcatcgaccgtaaacgcacgggcgacgcaatatcggttatgtcagaggtcgcacagactctgctgacacaggacgtcagggtgtgggttttcccagagggtactcgtaatcacaacgggtcgatgcttccattcaagcgcggagcattccatctggcagtgcaggcgcaggtgcccatagtcccaattgtgatgagcagctaccaggatttctattgcaaaaaggagagaagattcacgagtgggcagtgtcaggtgcgcgtgttacctccagtccctaccgagggattgactcctgacgatgtgccagccctggcggatcgcgtgcgtcattccatgttaactgtgttccgcgagataagcacggatgggaggggcggaggagactacctgaagaaaccaggcggtggaggatag

SEQ ID NO: 212630 - DNA, 852 bp, Artificial Sequence
  Description of Artificial Sequence: Synthetic coding sequence
atggacctctggcccggagcatggatgttgctgctcctactctttctactactactatttttgctccctacgctgtggttttgctctcccagcgctaaatacttcttcaaaatggcattttataacggctggatactattcctggccgttctggccatacctgtgtgcgcagtgagaggcaggaacgtggaaaacatgaaaattctgagactaatgttgctgcacatcaaatacctttacggcatcagggtggaggtgcgaggcgctcaccatttcccgccaagccagccctacgtggtggttagtaaccaccagtcatccttagacttactgggcatgatggaagtgctcccaggtagatgcgtccccatcgccaaaagggaactcttatgggctggttcggccggactcgcctgctggcttgcaggggtgatctttatcgataggaagcgcactggagatgccatttctgtaatgagcgaggtggcccaaactctgttgacccaggacgtccgcgtgtgggtgttcccagaaggcacccgcaaccataacggatccatgctacctttcaagcgtggagcatttcatctggccgtgcaagcccaagtgcccattgtgccaatcgtgatgtctagctaccaggacttttactgcaagaaggaaagacgtttcactagcggtcagtgccaggtgcgcgtcctgcctccagtgcccaccgaaggacttacgcctgatgatgttccagccctagcggaccgggtgcggcattctatgttgactgtattcagagagatctccacagacggacggggaggtggtgattatctgaagaagccaggcggaggcggatag

SEQ ID NO: 212631 - DNA, 852 bp, Artificial Sequence
  Description of Artificial Sequence: Synthetic coding sequence
atggacctttggccaggcgcatggatgctgttactgctgcttttccttctgcttttgtttctgctgccaaccctctggttctgcagccctagcgccaaatactttttcaagatggccttctacaatggttggatcctctttctcgccgtcttggcaattcctgtgtgtgccgtgcggggtcgtaacgtggagaacatgaaaattctgaggttaatgcttctgcatatcaagtacttatatggcatccgagtcgaggtcagaggcgctcatcatttcccgccatcccagccttatgtggtcgtgagcaatcatcagagcagcctcgaccttttgggaatgatggaggtgctccccggacgctgtgtgccaattgccaagcgcgaactgctatgggccggatccgccggtcttgcttgctggcttgccggagtgattttcattgatcgcaagcgcacaggagacgccatctcagtgatgagtgaggttgctcagaccttactaacacaggatgttagagtttgggtgtttcctgagggaacccgcaaccataatgggagcatgttacctttcaagaggggagcttttcacttggctgtccaggcacaggtacctattgtgcccattgtaatgtccagctatcaagacttctactgtaagaaagagcgtaggtttacatccggccagtgccaggtaagggtgcttccaccagtgccaacagaaggcctaacccctgacgacgtccccgctctcgcagatagggttagacattctatgttaactgtgttcagagaaatcagcacagatggacgcggaggaggcgattacctgaaaaaacctggaggaggaggctag

SEQ ID NO: 212632 - DNA, 852 bp, Artificial Sequence
  Description of Artificial Sequence: Synthetic coding sequence
atggatctgtggcctggcgcatggatgttattgctgctgctttttttgctgcttctcttcctcctacccaccctgtggttttgctctccttctgccaagtattttttcaagatggcattctacaacggatggattctattcctcgccgtcctggccattcctgtctgcgctgtgagaggaaggaatgtcgaaaacatgaaaatcctcagacttatgctgttgcacatcaaatatctgtacggcattcgtgtcgaggtcagaggtgcccaccacttcccaccctctcagccttacgttgttgtctctaatcaccagagttcccttgatctgctcggaatgatggaggtcctccccggtcgctgcgtgcctatcgctaaacgcgagctgctctgggcaggctccgcaggcttagcatgctggcttgccggagtaatattcatcgaccgcaaacggacgggtgacgccatcagtgtcatgtcagaggtagcccagaccctccttacccaggacgtgagggtgtgggtgtttcccgaggggacccgaaaccacaatgggtccatgctcccctttaaaagaggagcatttcacctggcagtccaggcacaggtacccatcgttccaatcgttatgtcctcatatcaggacttttattgtaaaaaagaacggcgattcaccagcggacagtgtcaggtgagagttttaccacctgtcccaactgaaggactgactccggacgatgtgcctgctctagccgatcgggtccgccactctatgttgactgtatttcgggagatttcgactgatgggagggggggaggagattacttaaagaagccagggggaggcggatag

SEQ ID NO: 212633 - DNA, 852 bp, Artificial Sequence
  Description of Artificial Sequence: Synthetic coding sequence
atggatctgtggcctggagcctggatgctgctccttttactgtttctcctgctgttgtttctcttgccaacgctctggttctgctctccaagtgccaagtacttctttaagatggccttctataatggctggatactcttcttagcagttctcgccatccctgtgtgcgccgtcagaggtcgtaatgtcgaaaatatgaagattctcagactcatgctgctccacataaagtacctctatggaataagagtggaagtaaggggcgcacaccacttccccccaagccagccatacgtagttgtgtccaatcaccaaagctcactggatttgctggggatgatggaggtactacccggacggtgtgtcccaatcgccaagcgggaattgctgtgggcgggatccgcagggttggcatgttggctggcaggcgtgattttcatagatagaaaacggactggggatgctataagtgttatgagcgaagtagcgcaaactctgctgacgcaagacgtgagggtgtgggtcttccctgaagggacgcgaaatcacaatggaagcatgctgccattcaagagaggagcctttcacctcgcggtgcaggcccaagtccctatcgtccctatagttatgtcctcatatcaggatttctattgcaagaaagaacgcaggtttacgagcgggcagtgccaggtcagagtgctcccgccagtccccactgaaggcctaacccccgacgacgtgcctgccctcgcggatagagtccgccattcgatgcttacagtgtttagagaaatttccacggacggaaggggcggaggcgattacttgaagaaaccgggtggagggggatag

SEQ ID NO: 212634 - DNA, 852 bp, Artificial Sequence
  Description of Artificial Sequence: Synthetic coding sequence
atggatctgtggccaggggcttggatgctgctcctcctgctttttctactgctcctctttctcctccccaccctttggttctgcagtccttcagctaagtatttttttaagatggccttttataacggatggatattatttctggccgtgctggctatcccagtttgtgcagttaggggaaggaacgtggagaatatgaagattctgcggctgatgctgcttcacatcaaatacctctacggcattcgcgtcgaagtcagaggagcccaccacttccctccaagccagccatatgtggttgtttcaaaccaccaaagctccctggatctcctcggcatgatggaggttctaccaggacggtgcgtgccgatcgccaaaagagagttgctgtgggcgggaagcgccggactcgcctgttggctggccggtgtgattttcatcgatcggaagagaacaggagacgcgattagcgtgatgagtgaagtcgcccaaaccctgttgactcaagatgtcagggtctgggtcttcccggagggcacccgcaaccacaacggatctatgttgccgttcaagcgcggtgccttccaccttgctgtgcaagcacaggtgcctatcgttcccatcgtgatgtctagctatcaggatttttattgtaaaaaagagagaaggttcacctctggacagtgtcaggtgcgggtgttaccccctgttcccacagagggcctcactcctgacgatgtgcccgcactcgcagacagggtgaggcacagtatgctgacagtcttcagagagatcagcacagacggacgtggaggcggagactacctcaagaagccaggcggaggcggatag

SEQ ID NO: 212635 - DNA, 852 bp, Artificial Sequence
  Description of Artificial Sequence: Synthetic coding sequence
atggacctgtggcctggggcatggatgcttttattgctcctctttctactgctcttatttctcttgcccacattatggttttgtagtccctcggctaagtacttttttaaaatggctttctacaatgggtggatcctgttcctggctgtcctcgcaatccctgtgtgtgcggtgagaggtcgcaacgtcgagaacatgaagattttgagattaatgctgctgcacattaaatatctgtacggcatcagagtggaggtccggggtgcgcaccattttcccccttcccagccttatgtcgtcgtgagcaatcatcaatcttctctggatctgctgggcatgatggaagtactacctgggagatgtgtgcctatcgctaaaagagaactgctttgggcaggctccgccggtctcgcctgctggctggccggagtcatcttcatcgaccgcaagcgaacaggagacgcaatcagcgtgatgtcagaggtggcccagaccctgctgactcaagacgtgcgcgtgtgggtgttccctgagggaaccaggaatcacaacgggtccatgctgcctttcaagcgcggtgcgttccacctagcagttcaggcccaggtacccattgttcctattgtgatgtcctcctaccaagatttttattgcaaaaaagaacggaggttcaccagcggacagtgccaggtccgagtgcttccccctgtcccaaccgagggtctgactcctgatgacgtccccgctttggccgatagagttcgtcattccatgctcaccgtgttccgcgaaatcagtaccgatggcagggggggaggcgactatttaaagaaacctggaggaggaggttag

SEQ ID NO: 212636 - DNA, 852 bp, Artificial Sequence
  Description of Artificial Sequence: Synthetic coding sequence
atggatctgtggcctggagcctggatgcttctgctgctcctgttcttactgctcctgttcttactccccactctctggttctgctcaccctctgccaagtacttctttaagatggctttttataacgggtggattctgtttcttgccgtgctggcaatcccggtgtgtgccgtgagaggccgaaatgttgaaaacatgaagattcttcgccttatgctcctgcacattaagtacctgtacggcattagagtggaagtgagaggcgctcaccactttcccccttctcaaccgtatgttgtcgtgagcaaccaccagtcttctttagatttgttaggcatgatggaggtcttgcccggtcgttgcgtgccgatcgcaaaaagggaactcctatgggccggatctgccggtcttgcttgctggctcgctggggttatattcattgaccgaaagcggaccggagatgcgattagcgtcatgtccgaggtggcccagaccctgctaacccaggacgttagagtctgggtttttcctgaagggacaaggaaccataatggctccatgttgccttttaagcgcggtgccttccacctggcagtgcaggcacaggtacctattgtacccattgtgatgagcagctaccaggacttttattgcaagaaggagaggcggttcacatctggccagtgtcaggttagggttctgccaccagtgcccaccgagggcctcactccagacgacgtcccggctctcgccgatagagtgaggcactcaatgctgaccgtgttccgggagatttcaacagacgggaggggcggaggagattacctgaaaaagccgggtggcggaggatag

SEQ ID NO: 212637 - DNA, 852 bp, Artificial Sequence
  Description of Artificial Sequence: Synthetic coding sequence
atggatctctggcccggtgcatggatgttgctgctgttattgttcctgctcctcctttttttgctgcctacattatggttttgctctccaagcgcaaaatattttttcaagatggctttctataacggatggatcctatttctggccgtcctcgcaataccagtctgtgctgtgcgtggtagaaacgtggaaaacatgaaaatcctgagattaatgctcctccacatcaaatatctctatgggattcgtgtggaagttaggggtgcccaccactttcccccaagccagccatacgtggtcgtgagcaaccatcagagctctctggacttactcgggatgatggaagtcctgccgggacgctgcgtgccaatcgctaagcgcgagctgctttgggctggaagcgcgggactcgcatgttggctggccggagtcattttcatcgacagaaaaagaactggcgacgccattagtgtcatgtccgaagtcgcccagaccctgctaacacaggacgtgcgggtgtgggtgttcccagaggggacacgcaaccacaatggctccatgttgcctttcaagcgcggagcgttccacttagcagtgcaggcccaagtgcccattgtccccatcgtgatgagctcttatcaagatttctattgtaaaaaagaacgaagattcacatccggccagtgccaggttcgagtcttgcctcctgtccctactgagggcctcacaccggatgatgttccagccctcgcggaccgagtgcgacacagcatgctgacagtgttccgcgagatcagcaccgacggccgaggcggaggagattatctcaaaaagccaggtggcggaggttag

SEQ ID NO: 212638 - DNA, 852 bp, Artificial Sequence
  Description of Artificial Sequence: Synthetic coding sequence
atggatctatggcccggagcctggatgctgctcctgctgctgttcctgctcctcctatttcttctgcccaccctctggttttgttcccccagtgcaaagtacttcttcaagatggccttttataatggttggatcctgttcctggcggtcctggcaattcctgtgtgcgctgtgcggggacgtaatgtcgagaacatgaagatccttcgcctgatgctactccacatcaaatacctgtatggcattcgagtagaagtacggggtgcccaccactttcccccatctcagccttatgtggtggtgagcaaccatcaatcatctcttgatctcctgggcatgatggaggtgctgcctgggagatgtgtgccgattgcgaaacgtgagttactctgggctggaagcgcgggtctggcctgttggttggccggagtcatcttcatcgataggaagcgtaccggcgatgcaatttcagtcatgtcggaggtggcgcagacattattaacccaggacgtaagggtgtgggtcttcccagagggcacccgcaaccataacgggagcatgctcccattcaaacggggtgcatttcacctggccgttcaagctcaggtcccgatcgtgccaatagtgatgagctcttaccaggacttctactgcaaaaaggagcgccgattcacatcaggacagtgccaggtcagagtactcccacctgttcctaccgaggggctgacccctgacgatgttcctgctctggccgatagagtccgccatagcatgctgaccgtctttagggagattagtaccgatggtcggggaggaggagactatctgaaaaagcctggtgggggtggatag

SEQ ID NO: 212639 - DNA, 852 bp, Artificial Sequence
  Description of Artificial Sequence: Synthetic coding sequence
atggacttgtggcccggagcatggatgttacttctcctgctcttcctcctgctgctctttcttctcccaaccctttggttctgttctccatccgccaaatatttttttaaaatggcgttttataatgggtggatcttattcctcgctgtcctggccatacccgtgtgcgctgtgcgaggcagaaatgtcgagaatatgaagatacttcgcctgatgctgcttcatattaagtatctgtatggcatacgcgtggaggtccgcggtgctcaccatttcccgccttcgcagccatacgtggtggtatccaaccatcagagctctctcgatttgctcggaatgatggaggtcctaccaggcaggtgcgtgcctatcgcgaagcgtgaactgttgtgggctggaagcgcgggactggcttgctggctcgcaggcgtgattttcatcgatcgaaagcgtactggggatgctatttccgtcatgtccgaggtggcccagaccctcctcacgcaggacgtgcgtgtgtgggtattccccgaaggaactcgcaaccacaacggttcaatgctgcctttcaagagaggagcatttcacctggccgtccaggcacaagtgcctattgttcccatagttatgagctcgtaccaggacttttactgtaaaaaagagaggcggttcacctcaggtcaatgccaggttcgggtgctcccccctgtgccaacagaaggcctcaccccggacgacgtgccagcgttagctgatcgtgtgcgccactccatgctgactgttttcagagagattagcaccgatggcagaggagggggagactatctgaaaaagccgggtggcggaggttag

SEQ ID NO: 212640 - DNA, 852 bp, Artificial Sequence
  Description of Artificial Sequence: Synthetic coding sequence
atggatttatggcctggcgcatggatgttactgctccttctattcctattgttgctgttcttgttacccacactttggttttgctctccaagcgccaaatacttttttaaaatggccttttataatggctggatcctgttcctcgcagttctggctattccagtgtgtgcagtgcgaggcaggaatgtcgaaaatatgaagattctgcggcttatgctattacatatcaagtacctgtacggtatacgagttgaggttcgcggtgctcaccactttcccccttctcagccttacgtcgtcgttagcaaccaccagagctcattagatttgttgggaatgatggaagtgctgccaggtaggtgtgtcccaatcgccaaaagagagttgttgtgggctggcagtgccggactcgcctgctggcttgcgggagtcattttcattgaccgaaagcgtacaggcgacgccatcagcgtcatgtccgaggttgcccaaacgctcctgactcaggacgtgcgtgtttgggtattccctgagggaacacgaaaccataacggttctatgttgccatttaagcggggtgccttccacctggcagtgcaggctcaggtgcctatagtacccatagtcatgtcgagttaccaggacttctactgcaagaaggagaggcgcttcacctcaggtcaatgccaggtgcgcgttctgcctcccgtacctaccgagggcctgacacccgatgatgtgcccgctctggccgatagagtgaggcacagtatgctgaccgtattccgggagatatccaccgacggtcggggagggggtgactacctgaaaaagccaggtggaggaggctag

SEQ ID NO: 212641 - DNA, 276 bp, Artificial Sequence
  Description of Artificial Sequence: Synthetic coding sequence
cacagcgcatcaacccccattttaactcacagtcatccggctcagggaatgatggaggtgctgcccggacggtgcgtccctatcgctaaacgagagctgctatgggccggttccgccggtctcgcctgctggctggccggtgtcattttcatagacaggaaaagaactggcgatgcaatctctgtcatgagcgaagtggctcagaccctgctcacgcaagacgttagccatcccggacttctactacaggagggcgcttctctgcacctcgggtag

SEQ ID NO: 212642 - DNA, 276 bp, Artificial Sequence
  Description of Artificial Sequence: Synthetic coding sequence
cattctgcaagcacacctattttgacccactctcaccctgcacagggcatgatggaagtccttccaggtcgatgtgtgcctatcgccaagcgcgagctgctatgggcaggcagcgccggactggcctgctggctcgctggagtgatctttatcgatcggaaacgtactggcgacgcaatttccgtaatgtccgaggtcgctcagaccctgctcacccaagacgtgagccatcctggacttctcctgcaggaaggggcaagcttgcacctgggatag

SEQ ID NO: 212643 - DNA, 276 bp, Artificial Sequence
  Description of Artificial Sequence: Synthetic coding sequence
cacagtgcctccacccccatcctaacccactcgcatccggcacaaggaatgatggaagtacttccaggcaggtgcgttccaattgccaagcgggaattgctctgggcaggttctgctgggctagcctgctggttggcgggtgtgatttttattgaccgaaaacgcaccggagacgccattagcgtgatgtcagaagtggcgcaaactctcctaacgcaggatgtgtcacaccccggtctgctcctgcaagaaggagcaagtttgcatcttggctag

SEQ ID NO: 212644 - DNA, 516 bp, Artificial Sequence
  Description of Artificial Sequence: Synthetic coding sequence
atgatggaggtgttaccaggacgctgtgtgccaatagccaaacgtgaattactgtgggctggcagcgctgggctggcttgttggctggcaggggtgatcttcatcgacaggaagaggaccggagacgccatcagcgtgatgtccgaagtcgctcagacattgctgacccaagacgtgagagtctgggtctttccagaggggacacgcaaccacaacggcagtatgttgccattcaagagaggagcatttcatcttgccgtgcaggcacaagtgccaatcgtgcccattgtgatgagctcctaccaagacttttactgtaagaaggaacggagattcaccagcggccagtgccaagtgcgcgtgctccctccagtccctaccgaggggttaacacctgacgacgtgcccgctctagccgaccgggtgcgccactctatgctcaccgtttttagggaaatctctacagatggacgcggtgggggagattacctgaagaaacctggcggtgggggatag

SEQ ID NO: 212645 - DNA, 516 bp, Artificial Sequence
  Description of Artificial Sequence: Synthetic coding sequence
atgatggaggtcttgcccggtcgctgtgttccaattgcgaagagagagctcctttgggctggctcggccggactggcctgctggctggccggagtgattttcatcgataggaagaggactggcgatgctattagtgtgatgagcgaagtggctcagaccctactaacccaggacgtgcgagtgtgggtattcccagaaggcacccgcaaccacaacggtagcatgctgcctttcaaaaggggcgcattccacctcgcggttcaggcccaggttccgatcgtcccaattgtgatgtccagttatcaagacttttactgcaaaaaagagcggagatttacatccgggcaatgtcaagtgcgcgtgctccccccagtgcccacagaagggctaacacctgatgatgtgcccgctctcgctgatagagtacgtcactctatgttgaccgtgttcagggagatctctaccgatggccgtgggggaggcgactacctgaagaaacccggtggtggtggatag

SEQ ID NO: 212646 - DNA, 276 bp, Artificial Sequence
  Description of Artificial Sequence: Synthetic coding sequence
catagcgcaagcactccaattttaacccactcccatcccgctcagggtatgatggaggtgctgcccggacggtgtgttccaatcgcaaaacgggaactgttgtgggcgggtagcgccggactggcctgctggttagcaggagtcatctttatcgatcgcaagagaacaggggacgcaattagtgtgatgagcgaagttgcccagaccttactgactcaggatgtaagtcaccctggcctgctcctccaggagggagcctccctccacttgggatag

SEQ ID NO: 212647 - DNA, 276 bp, Artificial Sequence
  Description of Artificial Sequence: Synthetic coding sequence
cacagcgcgtccacgcctatattgacccacagccaccctgcgcaaggtatgatggaggtgcttcccggacgatgcgtccctatcgctaagcgcgagcttttatgggcagggtccgccggtctcgcttgttggctggcaggtgtcatcttcattgatcggaagagaaccggcgatgcaatttccgtcatgtcagaggttgcacaaactttacttacccaggacgtaagtcaccctggtctgctcctgcaggaaggagcctccctgcacctgggctag

SEQ ID NO: 212648 - DNA, 276 bp, Artificial Sequence
  Description of Artificial Sequence: Synthetic coding sequence
cacagcgcgtccaccccaattctcacccacagtcatcccgctcaagggatgatggaggtgttaccgggacgctgcgtgccaattgctaagagagagctcctgtgggcaggtagcgcagggctggcatgttggcttgccggagttatctttatcgaccgtaagcgaaccggagacgccatcagcgtaatgtccgaagtagcccagactctgttgacccaggacgtgagtcacccgggactgctgctgcaggaaggcgcttctcttcacctgggttag

SEQ ID NO: 212649 - DNA, 516 bp, Artificial Sequence
  Description of Artificial Sequence: Synthetic coding sequence
atgatggaggtactcccagggaggtgtgtgccgattgcaaagcgagagctgttatgggcagggtctgctggattggcttgctggctggctggggtgattttcatcgatagaaaacgcaccggcgacgcgatatccgtcatgtctgaggtggcccagacgctgttgactcaggacgtgagggtctgggttttccctgaagggacacgaaatcacaacggctctatgctgccatttaagagaggcgctttccacctcgctgtgcaggcgcaggtcccaatcgtgcctatcgttatgagcagttaccaagacttttattgcaaaaaggagcgaagatttaccagcggacagtgccaggtgcgggttcttccccctgtgcccacagagggactgacccccgacgacgtaccagctctggcggacagagtccgccactcaatgcttaccgtcttccgggagataagcaccgacgggaggggagggggagattatttaaagaaaccgggtggaggcggttag

SEQ ID NO: 212650 - DNA, 516 bp, Artificial Sequence
  Description of Artificial Sequence: Synthetic coding sequence
atgatggaggtcttgcccggacgatgcgtgcccatcgccaaacgcgaactgttatgggcagggtccgccggactggcttgctggctagcaggcgttatctttatcgaccgaaagcgcacaggtgacgcaatttctgtgatgtccgaggttgctcagaccctgctgacacaggacgtaagagtgtgggtcttcccggaaggaacgcgaaaccacaatggctcaatgctccccttcaaacggggagctttccacctcgccgttcaggctcaggtcccaattgtgcccatagttatgtcctcctatcaggatttttactgtaaaaaagaacgcaggttcacttccggccagtgtcaggtgagagtgctgcccccagtgcccactgagggccttacccctgatgatgtgcctgccctcgctgatagggtgaggcattccatgttgactgtctttagggagatctcaacagacggccgagggggaggggactatttaaaaaaacccggtggagggggttag

SEQ ID NO: 212651 - DNA, 276 bp, Artificial Sequence
  Description of Artificial Sequence: Synthetic coding sequence
catagtgctagcaccccaattcttactcactcacatccggctcagggaatgatggaagtgctgccaggcagatgtgttccaatcgccaaacgcgaattgctgtgggcgggtagcgctgggctcgcgtgttggctcgccggagttatatttattgatcgcaagagaactggcgacgctatcagtgtcatgagcgaggtggcccagactctacttacccaggatgtatcacatcctggtcttttgctacaagagggagcctctctgcacctggggtag

SEQ ID NO: 212652 - DNA, 516 bp, Artificial Sequence
  Description of Artificial Sequence: Synthetic coding sequence
atgatggaggttctgcctggacgctgtgtgccgattgccaaaagggaactgctctgggctggctcggccggactggcgtgctggttggcgggtgtgattttcatcgacaggaagcggacaggagatgctatatccgtgatgtccgaggtcgcccagactcttttgactcaagacgttcgtgtttgggtgtttcccgaagggacccgaaaccacaacggcagtatgttgccattcaagaggggggcatttcatctggccgtgcaggcacaggtccccatcgtgcccatcgtaatgtctagttatcaggatttctattgtaaaaaagagcgacggttcacttctgggcagtgccaggtgcgagtgctgcctcccgtgccgaccgagggtctgaccccagacgatgtgcctgccctcgctgatcgtgtccggcatagtatgctgacagtgttcagagagatttctacggacggcagggggggtggcgactacctgaaaaagcctggtggcggaggctag

SEQ ID NO: 212653 - DNA, 516 bp, Artificial Sequence
  Description of Artificial Sequence: Synthetic coding sequence
atgatggaggtgctgcccggacgatgtgtgcctatcgccaaaagagagctgctgtgggccggatccgcaggacttgcctgttggctggcgggagtgatcttcattgaccggaagagaacaggcgatgctatttcagtaatgagcgaggtggcccagacactactgacgcaagatgtgagagtttgggtgtttcccgagggaacaaggaaccacaacggcagcatgctccccttcaagcggggtgccttccacctcgctgtccaagcccaagtgcccatagttcccattgtgatgtccagctaccaggacttttattgtaaaaaagaaaggcggtttactagcggccaatgccaggtccgcgtgctgccgcctgtccctacagaagggctcaccccagacgacgttcctgcgcttgcagatcgagtgaggcactctatgctgacagtgtttcgggaaatttcaacagatggcagggggggtggagactaccttaaaaagccaggcggaggtgggtag

SEQ ID NO: 212654 - DNA, 741 bp, Artificial Sequence
  Description of Artificial Sequence: Synthetic coding sequence
atggagctgtggccgtgtctcgccgcagccctgctgttactcttgctcctcgttcagctctcacgtgctgcagaattttatgccaaagttgccctttattgcgcgttatgctttacagtttccgccgtagcatcactggtatgcttgttgaggcacggtggcaggacggttgagaatatgagcatcatcggatggttcgttagatcttttaagtacttctatggtctacgcttcgaagtgcgggacccacgacgactgcaggaagctagaccatgtgttatcgtttctaatcaccaatctatattggacatgatgggcttgatggaggtattgccagaacgctgcgtccagattgccaagcgggaacttctcttcctaggacccgtgggtctcattatgtatttgggcggtgtcttctttatcaataggcagcggtcttcaaccgccatgacagtcatggctgatctaggggaacggatggtgcgtgaaaacgtgccaatcgtgcctgtcgtttatagttcctttagctccttctacaataccaagaaaaagttttttacatccggtaccgtcacagtgcaagtgctggaggcaatacctacttcaggactgaccgctgccgacgtacccgctctggtggatacctgtcatagggccatgcgcacaacgttcctccatatcagtaaaactccccaagaaaatggcgctaccgctggtagcggagtgcagccggctcaatag

SEQ ID NO: 212655 - DNA, 837 bp, Artificial Sequence
  Description of Artificial Sequence: Synthetic coding sequence
atggaattatggccctgtctggcggcagccctgctgttgctgctgctccttgtccagctctctcgtgccgctgaattttacgctaaagttgcgctttattgcgccttgtgttttactgtgagcgctgtcgcctccttggtgtgccttttgcgacatgggggtcggactgtggagaatatgtccataattggatggtttgtccgaagcttcaagtatttttacggcctcagattcgaagtgcgggaccctcgccgacttcaggaagcaaggccatgcgtgatcgtctctaatcatcagtctatcttagatatgatggggctcatggaagtgttaccagaaagatgtgtccaaattgcaaagagggagctgctattcctcgggccagttggactgattatgtatttaggaggagtgtttttcataaatcgacagagatctagcaccgcaatgaccgtgatggctgatttgggcgagagaatggtgagagagaatcttaaggtgtggatatacccagaggggacaagaaatgataacggggacttactacccttcaaaaagggtgccttctaccttgcagtgcaggctcaggtccccattgtacctgtggtttatagctctttctcttcattctacaatactaaaaaaaaatttttcacgagcggaacagttacagttcaggtgttggaagcaatcccaacgtcgggcctgaccgccgcagacgtgccagcattggtcgatacctgtcatagggccatgcgaactacgttcctgcatatctccaaaacccctcaggagaacggggctacagctggatctggagtgcagccagctcagtag

SEQ ID NO: 212656 - DNA, 837 bp, Artificial Sequence
  Description of Artificial Sequence: Synthetic coding sequence
atggaactgtggccttgcctagccgcagccctgctgctgcttctgctgctggtccagctgagccgcgcagctgagttctacgcaaaagtcgccctatattgcgcactatgttttacagtaagtgctgtggcctcattagtatgcctgctgagacacggcggacgcaccgttgagaacatgtcaattatcgggtggtttgtgcgttctttcaaatacttctacgggctgcgttttgaggtcagagacccaagacgactgcaggaagcaaggccatgtgttatagtgtcgaaccatcagtccatactagatatgatggggcttatggaagtgctccctgaaaggtgcgttcagatagcaaaacgagagctgctctttcttgggccagtaggactgatcatgtatttgggcggtgtgttttttatcaaccgtcagagaagctcaacagccatgacagtgatggccgacttaggcgaacggatggttcgggagaatctgaaggtgtggatctaccccgaaggaactagaaatgataacggcgacctcttgcccttcaaaaagggggctttctacctggccgttcaagctcaggtccccatcgtgcccgtggtctactcctctttctcctccttttacaatactaaaaagaagttctttacaagcggtaccgtcactgtgcaggtgctggaggccatcccgacctcaggactgactgccgctgatgtccccgcactggtggatacttgccaccgggctatgaggactactttcctacatattagcaagactccacaggagaacggagccacagcaggctccggtgtccagcctgcacaatag

SEQ ID NO: 212657 - DNA, 1371 bp, Artificial Sequence
  Description of Artificial Sequence: Synthetic coding sequence
atgtttctgctgcttccattcgactccctgatcgttaatctgttaggaatcagtctgacggtcctgttcacactactccttgtgttcatcatcgtgcccgcaatctttggggtctcctttggtattcgcaaactgtatatgaagagcctccttaagatcttcgcctgggccaccctgcgcatggagcgaggagcaaaggaaaagaaccatcagctctataagccgtatactaacggcatcattgccaaagacccaacaagtttggaggaggagattaaagagataaggaggtctgggtctagtaaggcattggacaatacacctgaatttgaactttccgacatattctacttctgccgcaagggtatggaaaccatcatggacgatgaagttacaaagaggttcagcgccgaggaactggaatcttggaatctattgtctcgcacaaactacaactttcagtatatcagtcttcgtctaaccgtcctctggggcttgggtgtgctgattcggtactgcttcctcctccctctcaggatcgcgctagctttcacaggcataagtctgctagtcgtgggcaccacagtggttggatatttacctaacggccgtttcaaggagtttatgtcgaaacatgtgcatctgatgtgttacaggatctgtgtgcgggcacttacagctataattacttaccacgatcgagaaaaccgaccccgaaacggtgggatatgcgtcgcaaaccatacgtctccgatcgacgtgatcatcctcgcttccgacggttattacgctatggtgggccaggtgcacgggggattaatgggtgtgattcagcgagctatggttaaggcatgcccgcacgtgtggttcgagcgctccgaagtgaaggacagacacctggttgcaaagaggctgacagagcacgtacaagataaaagtaaattaccgatcctgatctttcctgagggaacatgtatcaacaacacatccgtgatgatgttcaaaaaagggtctttcgagatcggcgcaaccgtctaccctgtcgctattaagtacgacccacaatttggagatgccttctggaatagctccaagtacgggatggtgacctacctactacggatgatgacctcttgggccatcgtctgcagtgtgtggtatcttccgccaatgactagagaggcggacgaggatgctgtccagtttgctaatagggtgaaatctgcgattgcccgacaggggggattggtggacttgttatgggacgggggtctaaaacgtgaaaaggtcaaagacacattcaaggaggagcaacaaaaactttattctaagatgattgtcggtaatcataaagaccgatctagatcgtag

SEQ ID NO: 212658 - DNA, 1305 bp, Artificial Sequence
  Description of Artificial Sequence: Synthetic coding sequence
atggagggtgccgaactcgctggcaaaatcctatcaacatggcttacactggtcctgggatttattctcctcccctccgttttcggagtctcattgggcatcagcgaaatctatatgaagatcctggtcaaaaccctggagtgggcaaccattcggatagagaaagggacccctaaagaaagcattctgaagaactctgctagcgttggaataatacagcgcgacgaaagtcctatggagaaagggttgtctggtttgaggggacgagattttgagctcagcgacgtattctactttagcaagaaaggactagaggcaatcgttgaagatgaagtgacccaacgcttttcaagcgaggaattggtatcttggaacctcctcaccagaaccaacgtgaacttccagtacatttcgttacgcctcaccatggtgtgggttctaggtgtgattgttcggtattgcgtgttacttccacttagagttaccctggcattcatcgggatcagccttctggtaattggaaccaccctcgtcggccagcttccagacagctctcttaagaattggcttagcgagctcgtgcacttgacctgttgtcgaatttgcgtgagagctctttcaggaacgatccattaccacaataagcagtacaggcctcagaaagggggaatttgtgtcgcgaatcacacttcaccaatagacgtcctcatcctgacgaccgacgggtgttacgcgatggtgggacaggtccatggcggactgatggggatcatccaacgtgctatggtgaaagcctgtccacatgtgtggtttgaacgttcagagatgaaagaccggcacctggtaaccaaacgactgaaggaacacatcgctgacaagaagaagcttcccatactgatctttccagagggcacgtgcataaacaatacgtccgtaatgatgtttaagaagggctcttttgaaatcgggggtacaattcatcctgtagctatcaagtacaaccctcagtttggcgacgcattttggaactcatccaaatacaacatggtcagctaccttctgcgaatgatgacaagttgggcaatcgtgtgtgacgtctggtacatgccccctatgacacgagaggagggcgaagacgcggttcagttcgccaatagggtcaaaagcgcgatcgccatccagggcggactgacagaactgccatgggacggtggcctgaaaagagctaaggtcaaggacatatttaaagaggagcagcagaagaactatagcaagatgatcgtgggcaatgggtctctaagctag

SEQ ID NO: 212659 - DNA, 1305 bp, Artificial Sequence
  Description of Artificial Sequence: Synthetic coding sequence
atggagggggctgagcttgccggaaaaattctgtctacctggcttacccttgtgttaggctttattctgctgccctccgtgttcggtgtgtctcttggtattagtgagatttacatgaaaatactggtgaagacgctggagtgggctactattcgcatcgagaaaggaacccccaaggaaagtattctgaagaatagcgcctcggtgggtataatccagcgtgatgagtccccaatggaaaaggggctgagcggcttgcgtgggagagacttcgagttgagcgatgtgttttatttttcgaagaaagggcttgaagctattgtagaagacgaggttacccaacgcttctcttcagaggaattggtatcttggaacctgctgacgcggacaaatgttaattttcaatacatatcacttcggctcactatggtttgggtactcggcgtgatcgttcgatattgtgtcttgctgcccctgagagtgacgctagctttcatcgggatctctttattagtgattgggactacgctcgtgggacagctgccagactcatctttaaaaaattggctgtctgagcttgtgcatctcacatgctgcagaatttgcgtaagggcattaagcgggaccattcactatcacaacaagcagtacagaccccagaaaggcggtatttgtgtggctaatcacacttcgcccatagacgtgctgattttaactactgatggttgctacgctatggtcggacaagtccatggcggactgatgggcataattcaacgcgctatggtgaaggcctgcccgcacgtgtggttcgaacggtctgagatgaaagatcggcacctggtgactaagcgcctgaaagaacatatagccgataaaaagaagctgccaattctgatttttccagaaggtacctgtatcaataatactagcgtcatgatgtttaagaaagggagcttcgagatcggcggaacaattcacccggtcgcaataaagtacaacccccagtttggcgacgcattctggaattcctccaaatataacatggttagttatctgctccgcatgatgacaagctgggcaatcgtctgcgacgtctggtacatgcccccaatgacccgggaggagggagaggacgccgtgcaatttgcaaatcgggttaagtctgctatcgccatccagggcggactgaccgaactcccttgggatgggggtctcaaaagagctaaagtgaaggatattttcaaggaagaacagcagaagaactacagcaagatgatcgtggggaatgggagcttgagttag

SEQ ID NO: 212660 - DNA, 1506 bp, Artificial Sequence
  Description of Artificial Sequence: Synthetic coding sequence
atgttcacactcccacagaaagattttcgggctcccactacttgcctggggcctacctgtatgcaggacttgggaagttcacatggcgaggacctcgagggcgaatgtagtagaaagctagaccagaaactgcccgagctccggggtgtcggtgaccccgcaatgatcagctcagacacgagttatttgtcctctagagggagaatgattaaatggttctgggactctgcggaggagggttaccggacttaccacatggatgagtacgacgaagacaaaaatccgtcaggcatcattaaccttggcacatcagaaaataagctatgcttcgacttattgtcttggcgcctctcccagagagatatgcaacgcgtggaacccagcctcctgcagtatgcagattggagggggcatctgttccttcgggaggaagtggcgaagtttctgtcattctactgcaagtcgccagtccccttacggcctgaaaacgtggtggttctgaatggcggagcctcgctgttcagtgcactggccacagtgctgtgtgaagcaggagaggcattcctgataccgactccctattacggcgctattacacagcatgtatgtttgtacggaaacattagattggcgtatgtctacctggatagcgaagtaacaggtctggatacacgccctttccagctgactgtcgagaagctggagatggcactgcgcgaggcacatagtgaaggcgttaaggtgaagggccttatcctgatttcgccccaaaacccactcggtgacgtgtacagtccagaagagctgcaggaatacttggtgttcgccaagcggcacagattgcacgtgattgtcgacgaggtgtacatgctgagcgtgttcgagaagagcgtggggtatagaagtgtgctctcgttggaaaggttgccagacccccagaggacccacgtcatgtgggcaacctccaaggattttggtatgtctggtctgaggtttggaacactttacactgagaatcaggatgtggccaccgccgtagcctctctgtgccgctatcacggactgagcgggctggtccagtaccagatggctcagctgctgcgggaccgggactggattaatcaggtatatcttcctgagaatcacgccagattaaaagcagcccacacctatgtttccgaggaactccgcgcattaggtattccatttctgtctcgcggagctggcttcttcatctgggtagacctgcgaaaatacctccctaaaggtacgttcgaagaagaaatgctgctgtggagaagatttctcgacaacaaggtactgctgtccttcggcaaagctttcgagtgtaaagagccagggtggttccgcttcgtgttcagcgaccaagtccaccggctgtgcctcggaatgcaacgcgtccagcaggtgcttgctggtaaatctcaggtggccgaggatccccgtcccagtcaaagtcaggagccctctgaccagcgcagatag

SEQ ID NO: 212661 - DNA, 477 bp, Artificial Sequence
  Description of Artificial Sequence: Synthetic coding sequence
atgttcacactccctcagaaggattttcgcgcaccgaccacctgtctgggccctacatgtatgcaggatcttggctcaagccacggcgaggatctggagggcgagtgcagcagaaaactggaccagaagctcccagagctcagaggggtcggcgaccccgcaatgatcagttcagatacctcatacctcagcagcaggggacgaatgatcaaatggttctgggactcagcggaagaaggttaccgcacctatcacatggacgaatacgatgaggacaaaaatcccagtgggataatcaaccttggcacttccgaaaataagctgtgctttgacctgttgtcctggaggcctcccggagggtcaggccaagtgcccgtcttcctccttcaggagccctctacaccgcagacacgcgaatgcgggtgtccagagtggtggtgtctggcacttctgtgctctggacacggtgccgtctag

SEQ ID NO: 212662 - DNA, 420 bp, Artificial Sequence
  Description of Artificial Sequence: Synthetic coding sequence
atgtttacactccctcagaaagattttcgggctccgactacatgtctcggtcctacgtgcatgcaagatttggggtcaagtcacggcgaggaccttgaaggggagtgcagcaggaaactcgatcaaaaactgcctgagttgaggggtgtgggcgaccctgcaatgatctcatcagatacaagttatctgtcaagccggggtaggatgatcaagtggttttgggactctgctgaggagggctataggacctaccacatggacgaatatgatgaggacaagaatccaagcgggatcatcaacctcgggaccagcgaaaacaaactgtgttttgacctcctctcctggcgcctgtcacaaagggatatgcagcgggttgaaccctctctactgcaatatgccgattggagaggacacttgtag

SEQ ID NO: 212663 - DNA, 234 bp, Artificial Sequence
  Description of Artificial Sequence: Synthetic coding sequence
atgtttacgctaccccagaaagatttcagagcccctaccacgtgtctcggtcccacatgtatgcaagacttgggctctagccacggtgaggatctggagggggagtgcagcagaaagctggatcagaaactgccggagctaaggggggttggcgatccagcgatgatctcatccgatacttcctacctgtcttccagaggaaggatgattaagtggttctgggactccgcatag

SEQ ID NO: 212664 - DNA, 780 bp, Artificial Sequence
  Description of Artificial Sequence: Synthetic coding sequence
atgtccaagtataaactcattatgctgaggcacggcgagggagcttggaacaaggaaaacagattctgctcatgggtcgatcagaaactcaatagcgagggtatggaagaagcccgaaattgcgggaagcagctcaaggccttaaacttcgagttcgatcttgtgttcacctcagtgttaaacaggtcaatacatacggcatggctgattttggaggaactgggccaggagtgggtccccgtagagtcttcctggagactcaatgagcgccactacggcgcactcattggactcaaccgcgaacagatggcccttaatcatggcgaggaacaggtgcggctctggcgccgatcatacaatgtgacgccacccccaatagaggagtcacatccatattatcaggaaatctacaatgatcggagatacaaagtgtgcgacgttccccttgaccagctaccaagaagcgaatccctgaaagatgtgctggaacgtctgctgccttactggaacgaacgcatagcacccgaagtgctccggggtaagaccatactgatttctgcacacgggaacagcagtcgtgctcttttaaagcaccttgaggggatatcagacgaagacatcattaatatcacgcttccaactggtgtccctattcttctggaattggacgaaaaccttcgcgctgtgggccctcatcaatttctcggcgatcaggaggcgattcaggccgcaattaagaaggtggaggaccaggggaaagtaaaacaagcaaaaaaatag

SEQ ID NO: 212665 - DNA, 780 bp, Artificial Sequence
  Description of Artificial Sequence: Synthetic coding sequence
atgagtaagtacaaactaatcatgctgaggcacggcgagggcgcttggaataaggagaatcgtttctgcagctgggttgatcagaagctcaacagtgaaggtatggaagaggcccgtaactgcggaaagcaacttaaggcgttaaatttcgaatttgatctggttttcaccagtgtcctcaatcggtccattcacactgcatggttgatcttagaagaacttggacaggagtgggtacccgttgaaagttcgtggagactgaatgagagacactacggcgcacttattggactgaacagagaacaaatggccttgaatcacggggaagagcaagtcaggctgtggcggagaagctataatgtgacgccacctccaatcgaagaaagtcatccatactaccaggaaatctacaacgaccggagatataaggtgtgcgatgtcccccttgatcaactgcccaggagcgagagcctgaaagatgtgttggaacggcttctgccctactggaatgagcggatcgcacccgaggtccttcgaggtaagactatcctgatttcggcgcatggtaattcatccagagctctcttgaagcacctcgaagggatctccgacgaggacatcatcaatataacactccctaccggagtgcctattttgctggagttggatgagaacttgcgagccgttgggcctcatcagtttcttggggaccaagaggcaatacaggcagcaatcaaaaaggtggaggaccaaggaaaagtgaagcaggccaaaaagtag

SEQ ID NO: 212666 - DNA, 780 bp, Artificial Sequence
  Description of Artificial Sequence: Synthetic coding sequence
atgtcgaagtacaagcttattatgttgcgccacggggagggcgcatggaacaaagagaatcgcttctgctcctgggtagaccagaagctgaacagcgagggcatggaggaagcacgcaactgcgggaagcagctcaaagccctgaacttcgaattcgacttagtgttcacgagcgtcctgaacagatctattcatacggcatggttgatactcgaagagctggggcaggagtgggtcccagttgaaagttcttggcgcctgaacgaacggcattatggcgcattgatcggtcttaacagagagcagatggctttgaaccatggtgaggaacaggtcagattatggcggagaagttacaatgtcacccccccaccaatcgaagaatcacacccttattatcaggagatatataatgataggaggtataaagtatgcgacgtgcccctggaccagctgcctcgcagtgagtcactcaaggatgttctggagaggctactgccatactggaatgaaagaatcgcccctgaagtgttgagaggtaaaacaatccttattagcgcccacggtaattccagtagggccctgctgaagcatcttgaaggtatcagcgatgaagacattattaacatcaccctccctacaggggtgcccattttgctagaactggacgaaaatttgagggctgtgggcccacatcaattcctgggggatcaagaagccatccaagcagcaataaaaaaggtcgaagaccagggaaaggtcaagcaggccaagaaatag

SEQ ID NO: 212667 - DNA, 237 bp, Artificial Sequence
  Description of Artificial Sequence: Synthetic coding sequence
atgagcaagtataaactcatcatgctgagacacggggaaggagcctggaacaaagagaaccgcttttgttcctgggttgatcagaagctgaatagcgaaggcatggaggaagctaggaattgcggcaagcagctgaaggctctcaactttgagttcgacctagtattcacctcagtcctgaaccgctcgatccataccgcttggctcatcctagaggagctgggccaggagtggtag

SEQ ID NO: 212668 - DNA, 894 bp, Artificial Sequence
  Description of Artificial Sequence: Synthetic coding sequence
atgaatcgaggattcagcaggaaatctcacacgtttttaccaaaaatttttttcaggaagatgtcctcatccggagccaaagacaagcctgagttgcagttccctttcctgcaggatgaagacaccgttgcaacactgctggaatgcaaaacactgtttattctccgtggactgcccggtagtggaaaaagcaccctggccagggtaattgttgataagtaccgtgatgggaccaagatggtgagcgccgatgcctacaagattacacccggtgccagaggtgccctgaaggaactgcgacaatttgtacccggagatgagccacgggaaaaaatggacttggttacatacttcggcaagcgcccaccgggagtgctgcactgcaccactaaattctgcgactatggaaaagcccctggagcagaggagtacgcccagcaggacgttctcaagaagtcatatagtaaagctttcaccctcacaatttctgccctgttcgtaaccccgaaaacaactggcgctcgggtcgaactttccgaacaacagctccagctgtggcccagcgacgtcgacaagctgagtccaaccgacaatctcccacggggatctcgcgcacacattactctcggatgcgcagctgatgtggaagccgtacagaccggcctggatcttctcgagattttacgtcaggagaagggcggtagccggggagaggaagtgggagagctgagtcggggtaagttgtactcactcggtaacggtagatggatgctgacactggccaagaatatggaagtgcgtgccattttcacaggctactacggcaaaggaaaaccggttccaacccagggatctagaaagggaggcgcactccagagctgtaccatcatttag

SEQ ID NO: 212669 - DNA, 1206 bp, Artificial Sequence
  Description of Artificial Sequence: Synthetic coding sequence
atgtccagcagtggggctaaggacaagcctgaactccaatttccatttctgcaggatgaggacacagtggctactctcctcgagtgcaaaaccctttttatcctgagaggcctccctggatccggaaaaagtaccctcgccagggtgatcgtcgacaaatacagagacggaacgaagatggtctctgccgatgcttataaaattacacctggagcaagaggcgcttttagcgaggagtataaaagactcgatgaggacttagcagcctactgtagacggagggacatccgaatactggtgctggatgacacaaatcacgagcgggagcgtctggagcaactctttgaaatggctgaccagtaccagtaccaagtcgtattggtagagcctaagaccgcctggcggctcgactgcgcccaactcaaagaaaaaaatcaatggcagttgtctgcggacgatctgaagaagctgaagcccggactcgaaaaggacttcttgccactttattttggatggttcctgacaaagaaatctagtgaaactctgcggaaggccggtcaggtgttcttggaagagctgggtaatcacaaggcatttaagaaggaactcagacagttcgtccccggagacgaaccgcgagaaaagatggatctggtgacctattttggtaaacgacctcccggagtgttgcactgcacgactaaattctgcgactatgggaaagcacccggagccgaggaatacgctcagcaggatgtactcaagaagtcctactcgaaggcattcacactgacaataagcgctctgttcgtcactccaaagacaaccggtgcaagagtggagttgagcgaacagcagttgcaactgtggccatccgacgtggacaaattgtctccgaccgacaatcttcctcggggttcccgcgctcacataacgctaggttgtgccgctgacgtcgaagcagttcagacaggcttagacttgctggagattttgaggcaggaaaaaggcggatctagaggagaggaagtgggagagctgtctaggggcaagctgtactctctcggtaacggccgatggatgctcacactagcaaaaaacatggaggtgcgagctatctttaccggttattacgggaaagggaagcccgtgccaacacaggggtcaaggaaggggggtgctctgcagagctgtaccataatctag

SEQ ID NO: 212670 - DNA, 1266 bp, Artificial Sequence
  Description of Artificial Sequence: Synthetic coding sequence
atgaaccgaggtttttcacggaaatcccatacttttcttcccaaaatcttctttcgcaaaatgtcatcctcgggagcgaaggacaaaccggaactgcaattcccgtttctgcaggacgaagacaccgttgctacactgcttgagtgtaaaaccctctttatacttagaggcctgcccggtagtggtaagtcaacattggccagggtgatcgtagataaatacagagacggcactaagatggtgtccgccgacgcctacaagatcactcctggagcacgaggggcttttagtgaagaatacaagcgccttgatgaggacctagccgcatactgtagaagaagggatattagaatacttgtgcttgatgacacgaaccacgagcgggagcgattagagcagctattcgagatggctgatcagtaccaataccaggtcgtcctggttgagccgaagacagcttggcggctggattgtgctcagttaaaggaaaagaaccagtggcagttaagcgccgacgacttgaaaaagttgaagcccggactggaaaaagacttcctgccgctgtacttcggctggtttctcacaaaaaagtcttccgagactctgcggaaagcgggacaggtgtttttggaagaactgggtaaccacaaagcctttaagaaggagctgcgtcagtttgttcctggtgatgagcctagggaaaagatggacctagtgacgtattttgggaaacggcctcccggagtcctgcattgtaccaccaaattttgtgattatgggaaggcacctggcgcagaggaatatgcccagcaggacgttctgaaaaagtcctactccaaggctttcaccctcacgatctctgctctttttgtaactccaaaaacaaccggggcacgcgttgagctgagcgaacagcagctgcagttgtggcctagcgacgtggataagctgtcccccaccgataatctcccgcgtggctctagggcccatattaccctcggctgtgcagctgacgtggaggcagtgcagactggcctcgacctgctggagatcttaagacaggaaaagggcggaagccgaggtgaggaggtgggagaactcagcaggggcaagttatactcactggggaatggtcgctggatgctcaccctagcaaagaacatggaagttcgggctatctttaccgggtattacggcaagggaaaacccgtgcccacacagggctcccgaaagggaggggctctgcaatcttgcacgattatttag

SEQ ID NO: 212671 - DNA, 174 bp, Artificial Sequence
  Description of Artificial Sequence: Synthetic coding sequence
atgtctagttccggcgcaaaagacaaacccgagctccagttcccctttttgcaggacgaggataccgttgcaacactgcttgaatgcaaaacgctgtttatcttgcgcggacttccagggtctggcaagagcaccctcgcacgcgtgatagtggataagtaccgcgacggctag

SEQ ID NO: 212672 - DNA, 1419 bp, Artificial Sequence
  Description of Artificial Sequence: Synthetic coding sequence
atgaagtttctcatctttgcgttctttggcggtgtccatctactcagcctgtgctctggaaaagccatctgcaaaaacggcatatcaaagagaacattcgaagaaattaaagaggaaattgcttcatgtggggacgttgcgaaagcgatcatcaatctcgccgtgtatggaaaagctcagaataggagctacgagcgcctcgccctactggtcgacaccgttgggcctcgtttaagcggctccaaaaacctagagaaggccatccagatcatgtaccagaacctccagcaggatggcttggaaaaagtacaccttgaaccggtcagaataccccattgggaaaggggcgaagagagtgcagttatgctggagcctcgaatacacaaaattgccatccttggcttgggtagctccataggtaccccaccggaaggcataaccgcggaagttctggtagtgaccagctttgatgagcttcagcgtagggcctcagaggcgagaggcaagatcgttgtctataaccagccgtacattaattatagcagaacagtccagtacaggacccaaggtgctgtggaggcagccaaggtgggagcactggcctctttaatcaggtctgtggcctctttcagtatttattcgccacacaccggcatccaggaatatcaggatggtgtgccaaaaattcctaccgcgtgtatcaccgtggaggacgccgagatgatgtcaagaatggcctctcacggaatcaagatcgtaattcaactgaaaatgggcgctaaaacatatcctgacaccgactcttttaacacggtggctgaaataacaggtagcaagtatccggaacaggtggtgctagtgtctggccaccttgactcctgggacgtgggccaaggagcgatggacgacggtgggggagcgttcatctcgtgggaggcgttatcactgattaaggatctgggcctgagaccgaaaagaacgttaaggctcgtcctatggaccgccgaggagcaaggcggagttggggcatttcagtactaccagctgcacaaagtaaatatttctaattactctctggtgatggaatcggatgcgggtacatttttgcctaccggactgcagttcaccggatcggaaaaggcccgagcaatcatggaagaagttatgtcgctattgcaaccactcaatatcacacaagttttgtcccatggagaaggcaccgacataaatttttggatccaggccggtgtcccgggagcctcactgctcgatgacctgtataaatacttctttttccaccattcccatggcgataccatgacagtcatggatcctaaacagatgaatgtggcggctgccgtctgggcagtcgtgtcctacgtcgtagcagacatggaagagatgcttccacggagttag

SEQ ID NO: 212673 - DNA, 981 bp, Artificial Sequence
  Description of Artificial Sequence: Synthetic coding sequence
atgtccgggcttggtaaaaagcacctgctgctcatgggtgagtttttttcatacggcactaaaattctgtatcaaaacactgaggctctccagtctaagtttttcagccccctccagaaagccatgttgcctccgaatagctttcagggaaaggtggcattcattacgggtggcggaacaggactgggaaaagggatgactaccttgctgtcgtccctcggagcacagtgcgtgatcgccagcagaaaaatggatgtgctcaaagccaccgcagaacaaatcagctcacagacgggcaacaaagtgcatgccatccagtgcgacgtaagagatccagatatggtgcagaacacagtctccgagctcatcaaggttgcgggacatcccaacatcgtaatcaacaacgctgcaggcaatttcatttcgcctacagaaagactttccccaaatgcgtggaagaccatcaccgacatagtgctaaatggcaccgcattcgtcacgctcgaaattggcaaacaactgatcaaagcccaaaaaggcgcagcgtttttgtccatcaccacaatttacgctgagactggttcggggttcgttgtcccatccgcttcggcgaaagccggtgtggaagcaatgtctaaaagcctggccgcagagtggggcaagtatggcatgcgtttcaatgtcattcagcccggtccaatcaaaacgaagggcgcttttagtcgactcgacccaacaggaacctttgaaaaggaaatgatcgggcgtatcccctgcggacggctcgggacagtcgaggagctggccaatttagcggcttttctctgtagcgattatgcctcatggattaatggcgctgtgattaagttcgacggcggagaagaagttttgattagtggagagtttaatgacctgaggaaagtgacaaaggagcagtgggatacaattgaagaactcatccggaagacaaagggctcatag

SEQ ID NO: 212674 - DNA, 1551 bp, Artificial Sequence
  Description of Artificial Sequence: Synthetic coding sequence
atggagcctgcggtgagcttggctgtttgcgcgctcttgttcctgctttgggtgcgtctcaaaggtctggaattcgttttgattcaccaacgatgggtgttcgtatgcctgtttctgttgcctttgtcgttaatcttcgatatttactactatgtgcgggcatgggtagtctttaaactgagcagtgccccacgactgcacgaacagcgggtccgggatatacagaaacaagttagggagtggaaagaacaggggtcaaaaacatttatgtgtaccggaagacccggatggctgacagtgagtctgcgggttggtaagtataagaagacgcacaaaaacataatgataaacttgatggatatcctggaggtggatactaagaagcaaattgtgagagtggagccacttgtcaccatgggtcaggtcacagctctgctcacgtccatcggatggacactgcccgtgctgcccgaattagacgatctgacggttggcggtctaataatgggaacagggatagaatccagcagccataaatacggtctttttcagcacatttgcactgcgtacgagttagtgctcgctgacgggtccttcgtacggtgcactccaagcgagaattctgatcttttttatgctgtgccttggtcctgcggaacactgggcttcctggtcgctgctgagattagaatcatccctgctaaaaaatacgtgaaactgcgctttgagcccgttcggggactggaggcaatatgtgctaaatttacacatgagtctcagagacaggagaaccactttgtggaggggttgctgtattcactggacgaggcagtgatcatgacaggagtgatgacagatgaagcagagcctagcaaactgaattctatcggcaactactataagccatggttcttcaagcatgtggaaaactacctgaagactaatcgcgaaggactggagtacattcctttgaggcattattatcatcgacatacccggtctattttttgggagctgcaagacataatcccattcggtaacaatccgatcttccggtatctgtttggctggatggtgcccccaaaaatatccctattgaaactcacccagggagagacactgagaaaactgtacgagcaacaccacgttgttcaggatatgctcgtgcccatgaagtgtctccagcaagccctgcataccttccagaatgacattcacgtgtaccctatctggttgtgtccatttatactgccctcacagcccggtctggtgcatcctaaaggtaacgaagctgagttatacattgacattggagcttatggggagcctcgcgtgaaacactttgaagcgcgatcctgcatgagacagctcgagaaatttgtgcgcagtgtacacgggtttcagatgctttacgcagactgttacatgaatagggaagagttctgggagatgttcgacggttccctgtatcacaagctgcgcgagaaactgggttgtcaggatgctttcccagaggtgtatgataaaatttgcaaagcggcaagacactag

SEQ ID NO: 212675 - DNA, 465 bp, Artificial Sequence
  Description of Artificial Sequence: Synthetic coding sequence
tgatccctgctgaaactgacccagggggagaccttacggaagctatatgagcaacatcatgttgtgcaggacatgttggtgcctatgaaatgcttacagcaggccctgcatacgtttcaaaacgacatccatgtctatcccatatggctgtgtccatttatcctgccctcacagcctgggctggtacacccgaaaggcaatgaggctgaattatacatcgatatcggagcctatggggagcctagagttaagcattttgaagccagatcttgcatgcgacagctggaaaagttcgtgcggtctgtgcacggcttccaaatgctgtacgctgactgttacatgaacagagaggagttctgggagatgtttgatgggtcgttgtaccataagctccgggaaaaactgggctgccaggatgcgtttccggaggtgtatgataaaatatgcaaggccgcaagacactag

SEQ ID NO: 212676 - DNA, 1428 bp, Artificial Sequence
  Description of Artificial Sequence: Synthetic coding sequence
atgggtgcaggtgaacagaataggcagagcgcacactgcgttcagggcatctgtggctacctggaaggggacgaagaaggggaggaaggtgaagtgcgaagcacacaagtccgggaatggaaggagcaaggatcaaagacgttcatgtgcaccggcagacccggatggctcaccgtctccctgcgggttggcaagtataaaaaaacccacaaaaatattatgatcaacttgatggacatcctggaggtggacacgaaaaagcagatcgttagagtcgagccgttggtgactatgggacaggtgacggctctccttacatctatcggctggacactgcccgtgctgccagagctggatgacctgacagtcggcggtctgatcatgggaacaggtatagagtcgagttcccataagtatggactttttcagcatatctgtaccgcctatgagctggtgctcgccgatggatcatttgttcggtgtacccccagcgaaaacagcgatctgttttatgccgtaccatggtcatgcggaacactcggcttcttggtcgcggcagagatacgcattataccagctaaaaaatatgtgaaactccggtttgagccggtccgcggtctcgaggcaatctgcgcgaagtttacgcatgagtctcagcggcaggaaaatcattttgttgaagggctgctctatagcctcgatgaagctgtcatcatgactggagtaatgactgacgaagcggagccaagtaaacttaattccataggcaattactataaaccttggtttttcaagcatgtggagaattatttaaaaacgaaccgggagggtctggagtacatccccctgcggcattattaccaccgccatacacggagcatattctgggagcttcaagatataattccattcggcaacaatcctatttttcgttatctctttggctggatggttcctcctaagataagtctgctgaaactgacacaaggcgagacactgaggaagctctacgagcaacatcacgtggtccaggatatgctcgtgcccatgaagtgtctccaacaggcgctgcacacattccagaacgacattcacgtctaccccatttggctttgtcccttcatacttccctcacagccgggactcgtgcaccctaaaggcaatgaggccgaactgtacatcgacattggggcttacggcgaaccgagagtcaagcattttgaggctcgttcctgtatgcgacagttagaaaaatttgtgcgcagcgtgcacggttttcagatgctctacgcagactgttacatgaaccgtgaggaattttgggaaatgttcgatggatccttataccacaaactgcgcgaaaagctgggttgtcaagacgcttttcccgaagtgtatgacaagatctgtaaggccgctaggcactag

SEQ ID NO: 212677 - DNA, 903 bp, Artificial Sequence
  Description of Artificial Sequence: Synthetic coding sequence
atgggaactggaatcgaaagcagctcccacaaatacggactctttcaacacatttgcaccgcttacgagctggtgctcgctgacgggagcttcgtgagatgcacgccatctgagaactctgacctcttttatgctgttccatggtcctgcggaactctcggattcttagtagcagctgaaatcagaattattccagcgaagaaatacgtaaagttgagatttgagcccgtcaggggcctggaggccatctgtgctaaattcacccatgagtcccagagacaagaaaatcatttcgtggagggtctgctttattctcttgacgaggccgttattatgaccggagtgatgaccgacgaagccgagccaagcaaagacatcataccattcggcaataacccaatcttccgctacctatttggctggatggtgcctccaaaaatatcgttactgaagctgacacaaggtgagacgctcagaaagctatacgagcaacaccacgtggtccaagatatgcttgtgcccatgaagtgccttcagcaggcactccacacttttcaaaacgacatacacgtatatccaatatggttgtgcccgtttatattgccctcacaaccaggcctggtgcacccaaagggcaatgaggcagagctctacatcgacataggggcttacggagaacctagggtgaaacactttgaggcccgaagctgtatgaggcagctggagaagtttgtacgtagcgttcacggattccagatgctgtatgccgattgctatatgaatcgggaggagttctgggagatgtttgatggctctctgtatcacaagttgcgcgaaaaactgggttgccaggacgcctttcccgaggtgtacgataagatttgtaaggctgcgcgacactag

SEQ ID NO: 212678 - DNA, 729 bp, Artificial Sequence
  Description of Artificial Sequence: Synthetic coding sequence
atggaacccgctgtatccctggcagtctgtgcccttctttttctcctgtgggtgaggctgaagggactcgagttcgtccttatacatcagcggtgggtctttgtttgtttattcctcctccctctgagcctgattttcgacatctactattacgtgagagcctgggtcgtttttaaactgtccagtgctcctagactccacgagcagcgggtgagagacatccagaagcaggttagagagtggaaagagcagggctctaaaaccttcatgtgtacgggtaggcctggctggctcacagtgtctctgagggtcggcaagtataagaaaactcataagaatatcatgattaatctgatggatattctggaggtggatactttccaaaacgacattcacgtatatcccatttggttatgtccttttatcctccctagtcagccagggctagttcaccccaaagggaatgaagcagagctttacattgacataggcgcatatggcgagcccagagtgaagcacttcgaggctaggtcatgtatgcgccagttggaaaagtttgtgcggtccgtccacggctttcagatgctgtacgccgattgctacatgaatagagaggagttctgggagatgttcgatggttccctgtaccataagctgcgagaaaaacttggttgtcaagatgcgtttccagaggtatacgacaaaatctgtaaagcagcccgacactag

SEQ ID NO: 212679 - DNA, 1203 bp, Artificial Sequence
  Description of Artificial Sequence: Synthetic coding sequence
atgatggatctccggaatacacctgccaaatcactggataagttcattgaagactacctcctccctgatacgtgcttccgcatgcagatcaaccatgctattgatataatttgtggctttctcaaagagcgttgctttcggggatcctcataccccgtttgtgttagtaaggttgtaaaggggggaagctctggcaaaggcactacactgcgaggccgttcagatgccgacctcgtggtcttcctctcacccttgacgacattccaagatcaactgaacagacggggagagtttatacaggagatccgccgacagcttgaggcctgccaacgagagagagctttctcggtcaaattcgaggtgcaggccccacgctggggcaacccacgagcgctgagcttcgtgctgagtagcctgcaacttggggagggggtggaattcgatgttctcccagccttcgacgcactgggccaattaactggcggatacaaacctaatccccagatctatgttaagctgattgaggagtgcactgatcttcaaaaggaaggcgagttcagcacgtgcttcacagagctgcaaagagacttccttaaacagcgtccaacaaagctgaaaagcctgatccggctcgtcaagcactggtaccagaactgcaagaagaagctgggcaaactccccccacaatacgcgctggagttgctaactgtttacgcctgggaacgtggctcgatgaagacccacttcaacactgcccagggatttaggactgttctcgagctggttataaattaccagcagctctgcatctattggactaagtattacgatttcaaaaaccctattattgagaagtacctccgaaggcagctgacaaagccccgaccggtaattctggatcctgccgaccctacggggaatctgggaggtggtgatcctaagggttggcgccagttagcgcaggaagcggaggcctggctgaattacccttgtttcaaaaattgggacggaagccccgtcagtagctggatcctgctggctgaatcaaactcagccgacgacgagacagatgatccgaggaggtatcagaaatatgggtacatcggcacccacgaatatccccacttcagccaccggccttcgaccttgcaggcggcaagcacgccgcaggccgaagaagactggacctgcactatattatag

SEQ ID NO: 212680 - DNA, 1146 bp, Artificial Sequence
  Description of Artificial Sequence: Synthetic coding sequence
atgatggacctgaggaatacacccgctaaatccctcgataaatttatcgaggactacctactcccagacacatgtttcaggatgcagatcaatcacgccatcgacatcatctgtggcttcctgaaagaaagatgtttcaggggttcttcttaccccgtgtgcgtgtcaaaggtagttaagggaggatctagcgggaaaggcacaacactacgcggtcgaagtgatgccgacttagtagtctttctgtcccctctgaccacttttcaggatcagttgaatagacgcggagagtttatccaagagatccgcagacagttagaagcctgccagagagaaagagcatttagcgtgaaattcgaagttcaggcaccgcgttggggaaaccctcgcgcattgtcctttgtgctgtcatcattgcagcttggggagggcgtagaattcgatgtcctgcccgcttttgacgccctgggacagctgaccggcggttataagccaaaccctcaaatttacgtgaaacttatcgaagaatgtactgacttgcaaaaggagggcgagttcagcacctgtttcactgagctccagcgagatttcctcaaacagaggcctaccaagctcaaatcactaatccgcctggtgaagcattggtaccagaattgcaagaagaagcttgggaagctccccccacaatatgcactggagctcctcacagtgtatgcttgggagcggggtagtatgaaaactcactttaacacagctcagggcttcagaacggtcctggaactcgtaataaattaccaacagctctgtatctactggaccaagtactatgatttcaagaatccgattatagaaaagtacctcagacgtcaactaacaaagccgagaccagtgatcctggatcccgctgaccccacagggaacctgggaggaggtgaccccaagggttggcggcagctggctcaggaagcagaagcctggcttaattacccgtgttttaaaaactgggacggatctccggtgtctagttggatccttttagtgaatcttactttggtcgggagacgaaactatataatcagtgagcatgcagtcaacctgcagcaaacaaggggcgcttctctgtcttatagctttcaggtcgcatag

SEQ ID NO: 212681 - DNA, 1245 bp, Artificial Sequence
  Description of Artificial Sequence: Synthetic coding sequence
atgatggacctgaggaataccccggcaaagtccttggacaagtttatcgaggattatttgctcccagatacatgttttaggatgcagattaatcatgccatcgacattatttgcgggtttctgaaagaacgctgtttcagaggatcttcctacccagtgtgtgtcagcaaggttgtaaagggtggctccagtggcaaagggactaccctgagaggccgaagcgacgccgatttggtggtgtttctgtccccactcactactttccaggaccaattaaatagaaggggggagttcatacaagagatacgcaggcaattggaagcctgccagcgagagcgcgctttttcagtcaagtttgaggtccaggcacctcgctgggggaaccctagagccctgagcttcgtcctctcttcacttcagctgggagagggggtcgaattcgacgtactgcctgctttcgacgcgctggggcaattaactgggggatataaacctaaccctcagatctatgttaagctgatcgaagagtgcaccgatttgcagaaagaaggggagttcagcacctgttttacagagctccaaagggacttcctaaaacagcgcccaacaaagcttaaatctctcatccggctcgtcaaacactggtatcaaaactgtaaaaaaaaattaggcaagctcccccctcagtacgcactcgagctgctgaccgtttacgcatgggagaggggaagtatgaagacccatttcaataccgcccagggattccgcaccgtgctggagttggttatcaattatcagcagctctgcatttactggaccaaatattacgatttcaagaaccctataattgaaaagtatttgcgccgacagctcactaaacccagaccagtgatactcgacccagcagatcccacggggaacttaggtggtggagatccgaagggctggaggcaactcgctcaggaggctgaagcctggttaaattacccttgttttaagaactgggatgggagcccggtgtctagctggatcctattgacccagcacactccaggtagcatccacccaactggcaggcgtggccttgacctgcaccacccactcaatgctagtgcaagctggggcaaaggactgcagtgctacctggaccagtttctccacttccaggtcggactgctcatccaacgcggtcagtccagtagcgtatcctggtgcattatccaggatagaactcaggtctcttag

SEQ ID NO: 212682 - DNA, 1095 bp, Artificial Sequence
  Description of Artificial Sequence: Synthetic coding sequence
atgatggacctcaggaatacccctgccaaatccctcgataagtttatcgaggactaccttctgcctgacacctgcttcaggatgcagattaatcatgccatcgacatcatctgcggttttttgaaagagcgctgcttccgagggtcgtcctaccccgtgtgtgttagcaaagttgtgaagggcggatcatccggaaaaggtacaactcttaggggcagatcagacgctgatctagtggtttttttatcaccactcacaacatttcaagaccagctgaatcgtcggggtgagtttattcaggagattagacggcagctggaagcctgtcaacgcgaaagggcttttagtgtcaagtttgaagtccaggcaccccgttggggcaatcctagggctctgagtttcgtgttatcaagccttcaactgggagaaggtgtcgagtttgatgtgctccctgcctttgacgcactgggtcagttgactggtggctataaaccaaaccctcagatatatgtgaagctgatagaggagtgcacagatctccagaaagagggagaatttagcacctgctttaccgaactacagagagactttctaaagcaaagaccaacaaagttgaaatctctgatccgcctggtcaagcactggtaccagaattgcaaaaagaagctggggaagttgccgcctcagtacgccctcgaattattaacagtctacgcctgggagcgcggtagcatgaaaactcattttaacaccgctcagggatttcggaccgtgctggagttagtcatcaattaccagcagctgtgtatttactggacgaagtattacgatttcaaaaaccctatcattgagaaatatttacgcaggcagctgacaaaaccgcgaccagttatccttgacccagccgatccgacaggaaaccttggtggaggcgatcccaaaggatggcgccagttggcccaggaagccgaggcctggctcaactatccttgctttaaaaattgggacggctcccccgtcagctcgtggattcttttggtgaggccaccagcgtcatcgctgccctttattccagcgccactacatgaggcctag

SEQ ID NO: 212683 - DNA, 2160 bp, Artificial Sequence
  Description of Artificial Sequence: Synthetic coding sequence
atgggcaatggcgagtctcagctctcatctgtgcccgctcagaagttgggctggtttattcaggagtaccttaaaccgtacgaagagtgccaaaccctgatcgatgaaatggtgaataccatctgcgatgtgttgcaggaaccagagcagttccctctggtccaaggagtggccattgggggttcatacggcagaaagacagtactgcgcggaaattcagacggcactctcgtgctattcttttctgatctcaagcaatttcaggatcaaaagcgttctcaacgggatatcctcgataaaacaggagataaacttaaattttgcttgtttacgaagtggttgaaaaacaactttgagattcagaagtcactggatggatttacaatccaggtgttcaccaaaaaccagcgaatttccttcgaagtgctggctgcctttaacgctcttagtcttaatgataatcccagcccatggatctatagagaactgaagaggagcctggataagaccaacgcaagcccaggtgaattcgccgtctgtttcactgaactccagcaaaaattctttgacaacagacctgggaagctcaaggatcttatcctgctaatcaagcattggcatcagcagtgccagaaaaagatcaaggatttgccatcactgtccccatatgcactggagctactgacagtgtatgcttgggaacaaggatgtcgtaaagataacttcgacatcgctgaaggtgttcggaccgtcttagagttaataaaatgtcaggaaaaactgtgtatatattggatggtgaactataactttgaggacgagaccatccgcaacatcctcttacatcagctgcagagcgctagaccagttatacttgaccctgtcgatcctaccaacaacgtaagtggcgataaaatctgctggcaatggctcaagaaagaggcccagacctggttgactagcccaaatctcgacaatgaactgcctgcaccttcatggaatgtattacctgcacctctatttactacacccggacacctgcttgacaagtttatcaaggagtttctccaacccaataaatgctttctggagcagatagattctgcggtgaacatcatccgtaccttcctcaaggaaaactgctttaggcagtccaccgccaagatccagattgtgcgcggtggctccaccgcgaaggggacggcacttaaaacaggatccgatgctgacctggtggttttccataatagtctaaagtcgtatactagtcagaagaatgagcgccataagatcgtgaaggagatacatgagcagctgaaggccttttggagggagaaggaagaagagctggaggtcagcttcgagcccccaaagtggaaggcaccacgcgttcttagctttagtctcaaatccaaggttctcaacgaatcagtttcttttgacgtgctgccggcattcaacgcattggggcagctgagttcagggagcaccccctcacccgaagtctacgcaggactgatcgacctctataagtcttccgatctccctggtggggagttcagtacctgtttcacagtcctgcagagaaactttatacggtctcgccctacaaaactgaaagatttaattcgactcgtaaaacactggtataaagagtgtgagcggaagttaaagcctaagggcagcttgccccctaagtacgccctggagctactcaccatctacgcgtgggagcaaggtagcggcgtgccagattttgacactgcagagggcttccgcacagtgctcgaactcgtgacacagtaccagcagttgtgcatcttttggaaagtgaattacaatttcgaagatgaaacagtgcgaaaattcctcctttctcagctccaaaagactcgacccgtgatcctggatccggcagagccaaccggtgatgtcggaggcggagatcgttggtgctggcatctattggctaaggaggctaaagaatggctgagcagtccatgtttcaaagacggcaccgggaatccgattcctccatggaaggtcccaactatgcagacccccggtagttgcggagccaggatccatccaatcgtaaacgaaatgttctctagtagatcccacaggatcctcaacaataactctaaaaggaatttttag

SEQ ID NO: 212684 - DNA, 2064 bp, Artificial Sequence
  Description of Artificial Sequence: Synthetic coding sequence
atggggaacggtgagagccagctgagtagcgtgcctgctcaaaaacttggctggtttatccaagagtacctcaaaccttacgaagagtgccagacacttattgatgagatggtgaacactatctgcgacgtccttcaggagccagagcagttccctttggtccagggcgtggctatcggcggaagctacggacgaaagaccgtccttcgcggaaattccgatggaactctcgtcttgttttttagcgacttgaagcagttccaggatcagaagaggtctcagagggatattttggataaaactggggataagctgaaattctgcctgttcacaaaatggctgaagaacaattttgagattcagaagtccctggatggctttacgattcaggtctttaccaagaaccagaggattagcttcgaggtgctggccgcattcaatgccctctctcttaatgataatccttccccatggatctaccgcgagctcaaaagatccctcgataagacaaacgctagtcctggagagttcgccgtgtgctttacagagctgcagcagaagttcttcgacaatcggcctggcaagcttaaagacttaatcttgcttataaagcactggcatcagcagtgtcaaaaaaagattaaggatcttccatccctgagcccttatgctcttgagcttctgaccgtgtatgcttgggagcaaggttgtcggaaggacaatttcgacatagctgagggagtgaggactgttcttgaactaatcaagtgccaggaaaagctctgcatttactggatggtaaactataactttgaggacgaaactatccgaaatatcctcctgcaccagctgcaaagtgccaggcctgtcattctggacccagtggacccgacaaacaatgtgtccggtgataaaatctgctggcagtggttaaagaaagaagctcaaacctggctcacgtctcctaacctggacaatgagctgcctgctcctagttggaacgtgctgcccgcaccccttttcaccaccccaggccacctcctggacaagttcattaaggaatttcttcagcccaacaaatgtttcctggagcagatcgatagcgccgtcaacatcattcgcacttttctaaaggagaattgttttaggcagagcaccgctaaaattcagatcgtgcgtggtggtagcaccgctaaggggaccgctctgaagacgggatcagatgccgacctcgtggttttccataatagtctgaagtcttatacctcacagaaaaacgagagacacaaaatcgtcaaagaaatccatgagcaattgaaggcattctggcgtgaaaaagaggaagaactagaagtctcattcgagccaccaaagtggaaagcccctagagtgttgagcttcagcttaaaatcaaaagtgttgaatgagtccgtctccttcgatgtgctgccggcttttaatgctcttggccagctgagctctggaagtaccccctcacctgaggtttatgccggactcattgatctttataaatctagcgaccttccaggtggagaattttctacatgcttcacagtgctgcagcgcaattttatcagatccagaccgacaaaactgaaagatctaatcaggctcgtgaagcattggtataaagaatgcgaacgtaaattgaagcctaagggatcattgccccctaagtacgccttggaattattaacaatttacgcttgggagcaagggtcgggtgttcccgatttcgatactgctgaaggtttccgtactgttctggaactcgtgacacagtatcagcaactgtgtatcttctggaaggtcaattacaatttcgaggatgagaccgtgaggaaatttttactgtcccaactgcaaaagactcgcccagttattctagatcctgctgagcctactggtgacgtaggtgggggagaccgttggtgctggcacctgttggccaaggaggccaaggaatggctgagcagcccatgtttcaaagacggaacagggaatccaattccgccatggaaggtccctgtaaaggttatttag

SEQ ID NO: 212685 - DNA, 519 bp, Artificial Sequence
  Description of Artificial Sequence: Synthetic coding sequence
atgggcaacggagaatctcagcttagtagcgtgccagcccagaagttgggttggtttatccaggaatatctgaagccttatgaagagtgccagacccttattgatgagatggttaataccatatgtgacgtactccaggagccagagcagttcccactcgtccaaggcgttgccatcggaggctcttacgggaggaagacagtgctccgagggaacagcgacggcaccctagtgctgtttttctctgacctgaaacagttccaggaccaaaaaagatcacaacgggacatactggataagacgggagacaagcttaagttttgcctgtttacgaaatggctgaagaacaacttcgagattcaaaagagcctggatggcttcacaatccaggtctttaccaagaaccagaggatctcctttgaggtgcttgccgcatttaacgcattgtccaaacattgctgggtctcgggcgagaaatcacagcgctcaggatgtcagaccgcgttatgcaatctttag

SEQ ID NO: 212686 - DNA, 1053 bp, Artificial Sequence
  Description of Artificial Sequence: Synthetic coding sequence
atggccaccgttggggctcctaggcacttttgcagatgcgcctgtttctgcacggacaatctgtacgtggcccgatatggcctgcatgtgagattcagaggggagcagcaactgagaagagattacggaccaattctgcgatcccggggttgtgtttcagctaaagatttccagcaacttttggcagagctggagcaggaggtcgaaagacggcaacgcttggggcaggagtccgccgctaggaaggctcttattgcttcctcataccaccccgctcggcctgaggtgtacgacagccttcaggatgcagctctggcaccagaattcttggcagtgaccgagtactcggtctctcccgatgccgacctgaaaggcctcttgcaacgcctggaaactgtgagtgaagaaaagagaatctacagagtacctgtgttcacggcccctttctgccaggccctacttgaagagcttgagcatttcgaacagagtgatatgcccaaggggaggcccaacaccatgaacaattacggcgtactgctccatgagctcgggttagacgagcccttaatgacccctctccgtgaacggttcctccaacctctcatggcactgctctacccagactgtggtggtggcagattggactctcatcgagcctttgtcgtaaagtatgctcccggtcaggatttagaactaggttgtcactatgataacgctgagttgacgctcaacgtggctcttggtaaggtgttcactggtggcgcactctatttcgggggtttatttcaggccccaaccgccctcactgagccattggaagttgagcatgtggttgggcaaggtgtcttgcaccggggaggccagctccacggtgccaggccactcggcacaggggagaggtggaatttagttgtgtggctgagagccagcgctgtgcggaacagcctgtgtcctatgtgctgcagagaaccagatctggtggacgacgaaggattcggcgacggctttaccagagaggagcccgcaaccgtcgacgtatgcgctctgacttag

SEQ ID NO: 212687 - DNA, 3261 bp, Artificial Sequence
  Description of Artificial Sequence: Synthetic coding sequence
atggatttgtacagtacgcctgcagcagcactcgacaggtttgtggctaggaggctgcagcccagaaaagagttcgtcgagaaagcacgtcgtgccctcggcgctctggccgcagcactgcgtgaacgcggaggcaggttaggcgctgctgcccctcgcgtgctaaaaactgtcaaaggcggatcttccgggagaggtacggcgctcaaggggggatgtgactccgaacttgtaatttttttggattgttttaaaagctacgtagatcagcgcgctcgacgcgcagagatactgtccgagatgcgagccagtctggaatcctggtggcagaatccggtgcctgggctccgccttacatttcccgagcaatctgtccccggtgccctgcagttccgcctgacatccgtggacttggaggattggatggacgtgtccctggtgccggcttttaatgttctgggtcaagctggcagtggtgtaaagccaaagccccaagtatactccactctgcttaattccggatgtcagggcggagaacatgcagcctgcttcactgaactgagacggaattttgtcaatattcgccctgccaagctgaagaatctaatcctattggtgaaacattggtatcaccaggtgtgcctgcagggcctgtggaaggaaacacttcctccggtgtacgccttggagctgcttaccatctttgcctgggagcagggttgcaagaaggacgctttcagcttagccgagggactgcggactgttcttggtctgattcagcagcatcagcatttgtgtgttttctggactgtgaactatggctttgaggaccccgcagtgggccagtttctgcagagacagttaaaacgccctagaccagtgattctggaccccgcagaccctacatgggacctcggcaatggtgccgcttggcattgggacctgctcgcgcaggaggccgcaagctgttacgatcacccatgtttcttgagaggtatgggtgacccggtgcagtcttggaagggacctggcctgccccgtgctggctgttctggccttggtcaccccatacagctggacccaaaccagaagactccagaaaactccaaatctctgaatgccgtgtaccccagagccggtagcaagccaccatcttgcccggcacctgggccaacgggccaacctgcctcgagcagtgttccgggtatggccttagacctgagccagattcccaccaaggagttggatcggttcatacaggatcaccttaagccctctccccaattccaggaacaggtgaagaaggcgatagacatcatcctccggtgtcttcatgaaaattgcgtgcataaagcctcacgggtgtccaaggggggttcctttggccgagggactgacctgcgagacggttgtgacgtggagctcattatatttctgaactgcttcaccgattataaggaccagggtccaagacgagcagaaatcctggacgagatgcgagcccaactcgaatcgtggtggcaggaccaagtgccctctctttccctccagttcccagagcagaacgtgcctgaggccctgcaatttcagctggtgtccactgcccttaaatcatggaccgacgtatctctgctccctgcttttgatgcggtgggacagctgtcaagcggaactaaacccaacccacaggtgtactcccgcctgctgaccagcggttgtcaggagggggagcacaaggcctgtttcgccgaacttagacgaaactttatgaacattaggcccgtgaagctaaaaaatttgatcttactagtcaagcactggtataggcaggtcgcagcccagaataagggaaaaggtccagccccagcgagccttcctccagcctacgccctagagttgctgactatattcgcctgggagcagggctgtcgccaggactgttttaatatggcccagggattccggacagtgttaggcctcgtccagcagcatcagcagttatgtgtgtactggaccgtaaactacagcacggaggatcctgcgatgcgtatgcatttactcggccagctgaggaagcctcgacctcttgtattggatcctgctgaccctacgtggaacgtgggtcacggttcatgggagctgctggctcaagaagccgctgccctcggcatgcaagcctgcttcctgtcacgggacggaactagcgtccagccctgggacgtcatgccagccctgctgtaccagacacctgctggcgatctcgacaagttcatttctgagtttctgcagcctaataggcagttcctggcacaggtgaataaggcggtggacacaatctgcagcttcctgaaagaaaactgttttcgtaattcgcctattaaggtgatcaaggtagttaagggaggcagctccgcaaaaggcactgcgctcagaggacggtcagacgccgatttggttgttttcctgagttgcttttcacagtttacggagcagggtaataagcgcgcagaaattattagcgaaattcgagcccagttagaggcgtgtcagcaggagcgacagtttgaggttaagttcgaagtgtctaagtgggaaaatcctagagtcttatcattcagtctaacctctcagacaatgttggatcaatccgtcgattttgacgtactccccgctttcgacgcgctgggtcagttggtttccggttcaagaccgagctcccaggtttacgtggatttgattcattcctattccaatgcgggagaatactctacttgcttcaccgaacttcagagagattttatcatctcacgaccaacaaagctgaaaagcctgatcaggctggtgaagcactggtaccaacaatgtacaaaaatttctaagggcaggggctcgctacctccacagcatggtctcgagctgcttaccgtttatgcttgggagcaaggaggaaaggactcacagtttaacatggccgaaggcttccggactgttctggagttagttacgcagtatcgacagctctgtatctactggactattaattataacgcaaaagataagaccgtcggggattttctgaagcagcaactgcagaaacctcgtcctatcattctggatcccgctgatccaaccgggaatctgggccataatgcgcgatgggatttgctggctaaggaggctgccgcttgcacatcagctctgtgctgtatgggtcgaaatggaatccccatccagccctggcccgtcaaagccgctgtgtag

SEQ ID NO: 212688 - DNA, 1545 bp, Artificial Sequence
  Description of Artificial Sequence: Synthetic coding sequence
atggcattgatgcaggaactctattcaactccagccagccgcctggactcatttgtggcacaatggttacagccccacagggaatggaaagaggaggtgcttgacgccgtccggacagttgaagaattcctacgacaggaacacttccaggggaagaggggcctcgaccaagatgtccgagtgttgaaagttgtgaaggtgggctcgttcggcaatggaactgtactgagaagtactcgggaggtggagctcgtagcattcctaagttgtttccattccttccaagaagccgcaaaacaccacaaagacgtcctccgcctcatctggaagaccatgtggcagtcgcaggatctgttggacttgggcctagaggacctgcgcatggaacaacgggtccccgatgccttggtctttaccatccaaacacgagggaccgcagaaccgatcaccgtaactatcgtgcccgcttacagggcactgggcccttcactgcctaatagtcagcccccacccgaggtgtacgtgtctctgatcaaagcctgcggtggccctgggaatttctgcccttctttctctgagctccagaggaatttcgtgaagcacagaccaaccaagctgaagtcactgttaaggctcgttaaacattggtatcagcagtatgtaaaagcacggagtccgcgagcaaatctgccaccattgtatgcgttggaattgttaacgatctatgcctgggagatgggtacggaggaggatgagaacttcatgctggatgagggctttaccacagtgatggatttgcttctggaatatgaggttatttgcatttactggacaaagtattatactctccacaatgcaataatcgaggattgcgtgagaaaacagcttaagaaagagagacccattattcttgatccagccgacccaactttgaacgttgcggaaggttatagatgggacatcgtggctcagcgggcatcacagtgtttaaagcaggattgttgctacgacaaccgagaaaatcccatcagctcttggaacgtcaagcgagcacgggatattcacctcacagtggagcagagagggtatccagacttcaatctgatcgttaatccgtacgagccgatccggaaggtgaaagagaaaatcagaaggacccgcggatacagcgggctgcaaaggctttcatttcaggtgcccggatccgaaaggcagctcctcagcagcagatgcagtcttgcgaagtatggcattttctcacacactcatatttatctgctggaaacaatccccagcgaaattcaggtgttcgtaaagaatccagatggcggttcctatgcatacgccattaacccaaacagttttatcttaggactgaaacagcagatagaagaccagcaggggctcccaaagaaacagcaacagttagagtttcagggccaggtactgcaggactggctgggcctaggtatttacgggattcaggatagcgacacgctaattctctcaaaaaagaaaggagaggctctttttcccgctagctag

SEQ ID NO: 212689 - DNA, 768 bp, Artificial Sequence
  Description of Artificial Sequence: Synthetic coding sequence
atggctctgatgcaggagctgtactccacccctgcctcccgacttgatagtttcgtggcccaatggttgcaaccgcacagagaatggaaggaagaagttttggatgccgttcggaccgtggaagagttcttgagacaagagcattttcaggggaagcgaggactggaccaggatgtgagggtactgaaggttgtgaaggtagggagttttggaaatggtacagtgcttcgtagtaccagggaggtggagctggtagccttcctatcctgcttccactcctttcaagaggctgccaagcaccataaagacgtccttagactgatttggaagacaatgtggcagtcacaggacctacttgaccttgggctggaagacctgaggatggagcagagagtgcccgacgccctggtttttaccatccagacaagagggacagctgaaccaataaccgtgaccatcgtgcccgcatacagagctcttggccctagcttaccaaattcacagccgcctcctgaagtatatgtctctctgatcaaggcttgtggcggacccggaaacttctgtcccagcttttctgagttgcagcggaactttgtgaagcaccgtcctaccaaacttaaaagcctgctgagactcgtaaaacactggtaccagcaggctcaccatcctggatcgggtcgcccacatcctcagagggggagaagggtccaaatgggacatcgctgttccgaaggactgcccgtgccagagacgggcctgcttctgtag

SEQ ID NO: 212690 - DNA, 1737 bp, Artificial Sequence
  Description of Artificial Sequence: Synthetic coding sequence
atgcctgacagcaactttgcggaaagatccgaggaacaggtgtcaggggcaaaggtgattgcacaggcgctgaagacccaggacgtggaatatattttcggaatcgtcggtatcccagttacagagatcgccatagctgcgcagcaacttggcattaaatacatcggcatgcgcaacgagcaggcagcttgttatgcagctagcgccatcggctacctgacttccagacccggagtctgtctggtggtatccggacccggtctgattcacgcactgggcggaatggcgaatgctaatatgaattgttggcctttgctcgtaatcggagggtccagcgagagaaatcaagaaacaatgggagccttccaggagtttccccaagtggaagcttgccgcctgtacactaaattttcagcaaggccctcatcgatcgaggctataccctttgtgatcgaaaaggccgtacgctccagcatttacggtagacccggtgcctgttatgtcgacattcccgcagacttcgttaacttacaagttaatgtcaacagtataaagtatatggagcgctgcatgtcacccccaatctccatggcagagaccagtgctgtatgtacagccgctagcgtcattagaaacgcaaagcagcctcttctgattatcggcaagggggcagcttatgctcatgctgaggaatcgatcaagaaactggtggaacagtataaactgccttttcttcccactcccatgggaaagggcgtggtacccgataatcatccctactgcgtgggtgccgctcgatcaagggcgttgcagttcgcagacgtgatcgtgttgttcggagccaggctcaattggattctgcacttcggactgcctcctaggtatcaacctgacgtgaagtttattcaggtggatatatgtgcagaggagctgggaaataatgtgaagcccgctgttactctcctgggcaacatccatgcagtcactaaacagctcctggaagaactcgacaagactccttggcagtatcctcctgaatcaaaatggtggaagacgctacgggaaaaaatgaaatccaatgaagctgcttcaaaagagcttgccagtaaaaagtcgctgcccatgaactattacaccgtgttctaccacgtccaagagcagctgcctcgcgactgcttcgtcgtttctgagggggctaataccatggatattggccgtacggtgctgcagaattacctccctcggcatcgattagacgccggtacctttgggacaatgggggtgggcctgggttttgccatcgctgcggctgtggtggctaaagacaggtcccctgggcagtggattatctgcgtggagggcgacagtgccttcggcttttcaggcatggaagtcgagaccatctgccgatataatctacctatcatcctgctagttgttaacaataatggtatataccagggcttcgacacggatacttggaaagagatgctgaaatttcaggacgccacggccgtggttcctccgatgtgcctgctgccaaacagccattacgagcaggtgatgactgccttcgggggtaagggatactttgttcagacgcccgaggagctccagaagtctctgcggcagagcttagccgatacaacaaagcccagtttaataaatatcatgattgaacctcaggcaacccggaaagcacaagactttcactggctgacacgttctaacatgtag

SEQ ID NO: 212691 - DNA, 1563 bp, Artificial Sequence
  Description of Artificial Sequence: Synthetic coding sequence
atgcctggatctttgccactaaatgctgaagcctgctggcctaaggacgtcggaattgtcgccctagaaatttacttcccctcacagtacgttgatcaggcggagctggaaaagtacgacggtgtagacgccggtaagtacacaatcggactcggccaggcaaagatgggattttgcactgacagagaagacataaattctctgtgtatgacggtggtgcagaatttgatggaaaggaataatttaagttatgattgcatcgggagactggaagtgggaacagagacaatcattgacaaatccaaaagcgtgaaaacaaatttaatgcaactgtttgaagagtcaggaaatacggacatcgaggggatagatacgacaaacgcgtgctacggcggtacagcagccgtgttcaacgccgtgaattggatcgagagtagctcttgggacggccgatacgctttggtggttgctggggatatcgcagtctatgctactggtaatgccagaccaacaggtggcgtgggcgcagtggcactattgatcggacctaatgctccattaattttcgagcgcggtctccggggaactcatatgcagcatgcctacgatttttataagcccgatatgctctcagagtatccgatcgtagacgggaagctgtctattcaatgctacctctctgccttggatcgatgttacagtgtttattgtaaaaagattcacgctcagtggcagaaggaaggcaatgacaaggacttcacacttaatgacttcgggttcatgatcttccactccccttattgcaagctggtacagaagtctttagcaaggatgctgctcaatgatttcttgaatgaccagaacagagataagaactcaatctatagcggtctggaggcgttcggcgatgtcaagcttgaggatacttatttcgacagggacgtcgagaaggcattcatgaaagctagctccgagttgttctcccagaaaacgaaagcttcacttctggtgtctaaccagaacggaaacatgtacacgagctcagtctacggttccttggcttctgtgcttgctcagtacagtccacagcagcttgctggtaagcggataggtgtgttctcgtacggaagcgggcttgcagctaccctctactctttaaaggtcacacaggacgccactcccggtagtgcattagacaaaattactgcctccctttgtgatctgaagtctcggttggatagcagaaccggagtcgcgccagatgtgtttgctgagaacatgaaactgcgggaagacacacatcaccttgtgaattatatcccacaagggtcaatcgatagtctattcgaggggacttggtatttagtaagagttgatgagaaacacaggcgaacatacgccaggcgacctacacctaacgatgacacacttgacgagggcgtcggcctggtgcattcaaatatcgccacagagcacatacccagtcctgctaagaaggtcccgaggctccctgccaccgccgctgagccggaggctgctgtaatttccaatggagaacactag

SEQ ID NO: 212692 - DNA, 1563 bp, Artificial Sequence
  Description of Artificial Sequence: Synthetic coding sequence
atgcctggatcactgcctctcaacgccgaggcgtgttggccgaaagatgtgggaattgtggcgctcgaaatttacttcccttcccaatacgtggatcaagccgagttagaaaagtatgatggcgtggatgcaggtaagtacaccattggactcggccaggctaagatgggtttctgtactgatcgcgaagatatcaactcattgtgcatgaccgtggtgcagaatctgatggagcgaaataacctgagctacgattgtattgggaggcttgaagtaggaactgagactatcattgacaaatcaaagagtgtcaaaacaaatttgatgcagttatttgaggaaagcggaaacactgatatcgagggcattgacaccacgaacgcatgttatggcggaactgcagcagtgtttaacgctgtcaactggattgagtcgagtagctgggacggaagatacgcactagtcgtcgccggtgatatcgctgtgtacgccacaggtaacgctcggccaacaggcggagtcggagccgtggcgctgctgattggacctaacgctccgttgattttcgagcggggactcaggggaactcacatgcagcacgcctatgatttctataaacctgacatgctgtccgagtatcccattgtggacggcaaactttccatccaatgttacctgtcggcactggaccgttgttacagcgtttactgtaagaaaattcacgcgcaatggcagaaagaaggtaacgacaaggacttcaccctgaatgactttggatttatgatttttcactcaccgtactgtaaacttgtgcaaaagagtctggccaggatgctgttgaacgattttctcaatgatcagaaccgggacaaaaactcgatctacagtggcctggaagcttttggcgacgttaagctagaggatacctatttcgacagggatgtggagaaagccttcatgaaggcctcatcagagttgttctcccaaaagaccaaggcgtctcttttggtctcaaaccagaatggcaacatgtatacttccagcgtctatgggtcactcgccagtgttctggctcagtactcaccccagcagttggctggcaaaaggatcggcgtgtttagttatggaagcgggctcgcggcaactctgtactctctcaaggttacacaggacgcaacaccgggaagtgctctcgacaagatcaccgcctctctttgtgacctaaagtcgaggcttgattcccgaactggtgtcgctccggacgtgtttgccgaaaatatgaaactgcgagaggacacccaccatttggtgaactacatacctcaaggaagcatcgattctcttttcgagggaacctggtatctggtgcgggtggacgaaaagcacagaagaacgtacgctcggaggccaacccccaacgacgatacacttgatgaaggcgtggggttagtacactctaacattgccaccgaacatattccctcaccagctaagaaagtccctcggctgcccgcaactgctgcagaaccggaggctgcagtcatctctaatggcgagcactag

SEQ ID NO: 212693 - DNA, 291 bp, Artificial Sequence
  Description of Artificial Sequence: Synthetic coding sequence
atgcccggaagcctgcccttaaatgccgaggcatgctggcctaaggacgtcggtattgtcgcgcttgagatttattttcccagtcagtacgtcgatcaggccgaactggagaagtatgacggggttgacgccggaaagtacacgatcggcctgggccaagcgaaaatgggtttctgtactgaccgagaagatataaacagcctgtgcatgacagtggtccaaaatctgatggaacgaaacaaccttagttatgactgtattgggagactggaggtgggtacagagacttag

SEQ ID NO: 212694 - DNA, 1530 bp, Artificial Sequence
  Description of Artificial Sequence: Synthetic coding sequence
atgccaggaagcctgccactgaacgcagaagcttgttggccgaaggatgtcggcattgtcgctctggagatctacttcccatcacagtatgtcgatcaggcagagctcgagaagtacgacggcgtggacgccggaaagtataccattgggctgggccaggcaaaaatgggcttctgcactgacagagaagatattaacagtctgtgcatgaccgtcgtccagaacttgatggaacggaataatctgtcgtacgactgcattggcaggctcgaggttggaacagagacaatcatagataagtctaaatctgtcaagactaatcttatgcaactgttcgaggagtcgggcaacacagacatcgaggggattgacactactaacgccgttaactggatcgaaagcagcagctgggatggacgctatgctctcgttgtggcgggtgacatcgccgtgtacgccactggaaatgccaggcccaccggcggtgtgggagccgtggccctactgataggaccaaatgcacctcttatcttcgaaagggggctgcggggtactcacatgcagcacgcttatgacttttataaacccgatatgttgtccgaataccctattgtcgatgggaagttgtcgatccaatgttatctgtccgctctggacagatgctacagtgtgtactgtaagaaaatccatgcccagtggcagaaagaggggaacgataaggactttacactgaatgatttcggattcatgatttttcattcgccttattgtaaactggtgcagaagtccctggctcggatgttattgaacgattttctgaacgatcaaaaccgcgataagaacagtatatacagcggactggaggcttttggggacgtgaagcttgaagacacctacttcgatcgggatgtggagaaggcctttatgaaggcttctagtgaattattcagccagaagaccaaggcatccctgctggtaagcaaccaaaacggtaatatgtacacctccagcgtctacggctcgcttgcctctgtgttggcacagtattctccccaacagctggcagggaagagaattggtgtttttagctacggatccggccttgctgcaactctgtatagtctgaaggtcacgcaggatgctacgccaggaagcgcgctcgacaagattacggcgagcctctgcgatcttaaaagcagactcgactctcgcaccggcgtggcacctgatgtgttcgctgagaacatgaagctccgcgaggacactcaccaccttgttaactacattcctcaggggtctattgatagtctgtttgaggggacctggtacctggttcgcgtggacgagaaacatcgcagaacctatgccaggcggccaaccccgaacgatgacacattagacgaaggagtgggtctggtgcacagcaacattgccacagagcatatcccatctcccgcaaagaaggtaccgaggctaccggctacggcagccgaacccgaagccgcagtaataagcaacggcgaacattag

SEQ ID NO: 212695 - DNA, 1527 bp, Artificial Sequence
  Description of Artificial Sequence: Synthetic coding sequence
atgcagcggctgcttacgcccgtgaagcggattttgcagctgaccagagccgtgcaggaaacctcacttacacccgcaaggcttcttcccgtggcgcaccagcgttttagcactgctagcgccgtgcctcttgccaagacagatacctggcccaaggacgtcggtatcctcgctctcgaagtgtacttcccggctcaatacgtggaccagacagacttggagaaatacaacaatgttgaagcaggaaagtatacggtcggcctaggccagacgagaatgggcttttgctctgtgcaggaggatatcaattccttgtgcctgacagtggtccaacgcctcatggaacgtatccagctgccctgggacagcgtcgggagactggaagtcggcaccgagacgattatcgacaaaagcaaggcagtaaaaactgtactcatggaactgtttcaagattccggtaatactgacatcgagggcattgatactactaatgcatgctacggcggaactgcttcactcttcaacgctgctaattggatggagtcgagctcatgggacggacgttacgccatggttgtgtgcggcgacattgctgtttacccctcaggaaatgcccgtcctaccggaggagcaggagccgtggccatgctcatcggaccaaaggctccactggccctggagcggggtttgcgcggtacccatatggagaatgtgtatgatttctacaagcccaacttggcctcggagtaccccattgtcgacgggaagctttcaattcagtgttatttaagggcgctggatcgctgttatacaagctatagaaagaaaattcaaaaccaatggaaacaggcgggttccgataggcccttcacccttgacgatctgcagtacatgatcttccacacacctttctgtaagatggtgcagaagagcctggcccgactcatgttcaacgacttcctgagtgccagctccgatacgcagaccagcttgtataagggtctggaagcattcgggggactaaagcttgaggatacctacaccaacaaggacctggacaaagcattgttaaaggcgtctcaggatatgtttgacaaaaaaactaaggcctccctgtatctctctactcacaacgggaacatgtacacctcttctctctacggttgtctcgcttctctgctttcccaccatagtgcccaggagctagccggatcccgcatcggggctttctcatacgggtctggcttggcggcttcctttttctcctttcgcgtgtctcaagatgcggctccgggtagtcctttggataaattggtgagtagcacctctgacctgcccaagaggctcgctagccggaagtgcgtgagcccggaggagtttacggaaattatgaatcagcgcgaacagttctatcacaaagtgaacttctcacctcccggagatacgaattctctgtttcccggtacgtggtatctagagagagtggatgagcaacataggagaaagtatgcacgcaggcccgtgtag

SEQ ID NO: 212696 - DNA, 1401 bp, Artificial Sequence
  Description of Artificial Sequence: Synthetic coding sequence
atgcagcggttattgactcccgtgaagcgcattctgcagctaacccgagctgtgcaggagacgtctctgacgcctgcacggctgctgcccgtggcccaccaaagatttagcacggccagcgcagttcctttggcgaagacagatacctggcccaaggacgtcggcatcctggctcttgaagtgtatttccctgcgcagtacgtggatcaaacggacctggagaaatacaacaatgtggaagctggcaaatatactgtcgggctggggcagactcggatggggttttgtagtgtgcaggaggatattaactccttatgtttaacagtcgtacagaggctcatggagcgtatccagttaccttgggacagcgtaggtcgccttgaagtggggactgagacgatcattgacaagtcaaaggcagtaaaaacggtgcttatggagcttttccaggattccgggaacactgatatagaagggatagacactaccaatgcgtgttatgggggaacagcctccctgtttaacgctgccaattggatggagtcctcctcctgggacgggctgagaggtactcatatggagaacgtctatgacttctataagcctaatctggcctcagagtacccaatagtggatggcaagctctccatccaatgctatctgcgggcactcgatcgctgttacacatcctacagaaaaaaaatacagaatcagtggaagcaggctggcagtgaccgaccttttacactggatgaccttcagtatatgatctttcacactccgttttgtaaaatggtgcagaagtctcttgcacgactaatgttcaatgacttcttatccgcctcttcagacacccagacctcattgtacaagggcttagaggcttttggcggtttaaagctagaggatacatacacaaataaggatcttgacaaagccctgctgaaggctagtcaggacatgttcgataagaaaactaaggcctcactctatctgagcacccataatggcaacatgtacacctccagcttatatggctgtttagcttctcttttgagccaccacagcgctcaggagctggcgggaagcagaatcggcgcttttagttatggatctggtctggccgcaagcttcttcagctttcgggtgagccaagatgctgcacctggctcccccctggataaattagtgtcaagcacctcagatctccccaagagattggctagtaggaaatgtgtctcaccagaggagttcacggagatcatgaatcagcgtgagcaattttaccataaagtgaacttctctcctccaggggacactaatagtttattccctgggacttggtacttggaacgagttgacgagcagcatcgacggaaatacgcgaggcggccagtttag

SEQ ID NO: 212697 - DNA, 1161 bp, Artificial Sequence
  Description of Artificial Sequence: Synthetic coding sequence
atggggcagagagagatgtggagactgatgtcaagatttaatgctttcaagagaacaaataccatcctgcaccacctgcggatgagcaaacacaccgacgccgctgaagaggtgttgcttgagaaaaaagggtgtactggagttatcacgctaaacagacccaagttccttaatgctctgaccctgaacatgataaggcagatttatccacaactgaagaagtgggaacaagaccctgaaacctttttgatcattataaagggggcagggggaaaagccttctgcgcaggcggtgatatccgggtaatctctgaggcggaaaaggccaagcagaagattgcccctgtcttttttagagaagagtatatgttaaataatgcagttgggtcatgccagaaaccctatgtggcacttattcatggtatcaccatgggcggtggtgtgggcctcagcgtgcacggccaattccgagtcgcgacggagaagtgcctgttcgccatgcccgaaaccgccatcggtttgtttcccgacgttggcggaggatactttttaccaaggctgcaagggaaactgggctattttttggccctcaccggcttcagactgaaaggtagggatgtgtatagagcaggtatcgccactcactttgtagatagcgaaaaattagccatgcttgaagaggatttgctggcgcttaagagccctagcaaagaaaacatcgctagtgtcctcgagaactatcatacggagagcaagatagatagagacaagagctttatacttgaagagcatatggacaagatcaacagctgtttctctgccaataccgtggaggagatcattgaaaatcttcagcaggacggatcttcatttgctttggagcagctcaaggtgatcaataaaatgtcacctaccagccttaagatcaccctccgccagctgatggaaggttcatctaagactctccaagaggtgctgactatggaatatcgtctgagccaggcatgtatgagaggacatgacttccatgagggtgtgagggccgtcctgatcgacaaagaccaatctccaaaatggaaaccagccgacttgaaagaggtgacggaagaagacttgaacaaccactttaagagcctgggatcgtccgacctgaagttctag

SEQ ID NO: 212698 - DNA, 1017 bp, Artificial Sequence
  Description of Artificial Sequence: Synthetic coding sequence
atgggccagcgcgagatgtggcgcttaatgtcaaggtttaacgccttcaagaggaccaacaccatcctgcaccatctgcgcatgagcaagcacactgatgccgctgaggaggtgctactcgaaaaaaaaggctgtacgggggtgattacgctaaatcgtcccaagtttcttaatgctcttaccctgaacatgattcggcagatctatccgcaattgaagaaatgggagcaagacccagagacttttcttattatcataaagggcgctggcggtaaggctttctgcgcaggcggtgatataagagtgatttccgaagcagagaaagctaagcagaaaatcgcccctgtgtttttccgagaggagtatatgttgaacaatgccgtgggctcatgccagaaaccgtatgttgctctcatccacggcattactatgggaggcggagtgggcctgtcagttcacggccagttccgcgtcgcgacagagaagtgtttgttcgccatgccagagaccgcaattggactttttcccgatgtcggcggtggttattttctgccccgtctgcaaggcaagctaggctactttctggcactcaccggtttcaggctgaaagggagagacgtttaccgtgcaggaatcgccactcatttcgtcgacagcgaaaagttggccatgctggaggaggatctgcttgccctgaagagtcctagtaaggaaaacatcgcttccgtcttagaaaactaccacaccgagtcaaagatagacagggataagtccttcatcctggaggagcatatggataaaatcaattcctgcttctccgccaacaccgtggaggaaatcatcgaaaacctgcaacaggacggatcttcatttgccctggaacagctcaaagttatcaataagatgagccctacatccctgaagatcactctacggcaacttatggaaggctcttccaaaactctgcaggaggttttaactatggaatatcgcctgtcacaagcttgcatgttttag

SEQ ID NO: 212699 - DNA, 117 bp, Artificial Sequence
  Description of Artificial Sequence: Synthetic coding sequence
tagctgatcgataaggaccagagccctaagtggaagcccgctgatctgaaagaggtgacagaagaggatctcaataatcactttaagagcctagggagtagcgacctgaagttttag

SEQ ID NO: 212700 - DNA, 903 bp, Artificial Sequence
  Description of Artificial Sequence: Synthetic coding sequence
atgggaactttgcccaaaagggtcaagattgtcgaggttggtccgcgagatggcctacagaacgagaaaaatatagtgtccacccctgtaaaaattaaactgattgacatgctcagcgaggctggcctgagtgttattgagacaactagctttgtaagtccaaagtgggtcccccaaatgggtgaccataccgaggtcctgaaaggaattcaaaagtttcccggaatcaactatccagtgctgacccctaacttgaagggatttgaggccgcagtggctgctggggctaaagaagttgtcatcttcggagctgctagtgagctgtttacaaaaaagaacatcaattgcagcatagaagagtcctttcagaggttcgacgcaatactcaaagcggcacaatcagcaaacataagtgtgagggggtacgtatcttgtgctcttggctgtccgtatgagggcaagatttcccccgctaaagtcgccgaggtgacgaaaaagttttatagcatgggctgctacgagatctctctgggcgacaccatcggcgtgggaacacctggcattatgaaagatatgttaagtgcggtaatgcaggaggtgcctctggccgctttggccgtgcattgtcatgacacctacgggcaggccctggccaacacactcatggctctgcagatgggggtgagtgtggtggatagcagcgtggctggcctcggaggttgcccatacgcccaaggtgcaagtgggaatctggcaacagaggatctggtgtatatgctggagggtctcggcatccataccggcgtgaacttacaaaagttgcttgaagctggtaacttcatttgccaggcactgaacagaaaaacgtcctcgaaggtagcacaggccacctgtaaactatag

SEQ ID NO: 212701 - DNA, 978 bp, Artificial Sequence
  Description of Artificial Sequence: Synthetic coding sequence
atggctgcgatgcgcaaagcgctaccccgtcgcctggtagggctggcatctttacgagcagtttccacttcatctatggggacattgcctaagagagtgaaaattgtggaagttggaccacgggacggcttacagaacgagaagaacatcgtgagcacacccgttaagattaagctcattgatatgctctcggaggccggactgtcagtgatcgagaccacttctttcgtcagtcccaaatgggtgcctcagatgggggaccacaccgaggtgttgaagggcattcaaaaattcccaggcatcaattaccctgtcctgacaccaaatctgaaaggctttgaagccgctgtggcagcaggcgcaaaagaagtagtgatctttggtgccgcaagcgaactcttcacaaaaaaaaatataaattgttctattgaagaatcctttcagagattcgatgccatacttaaagcagcgcaaagtgcgaatatcagcgttcggggatacgtgtcatgcgcattgggctgtccatatgaaggaaagatttcgccggcaaaggtggcagaggtgaccaaaaaattctatagtatgggctgctacgaaatttctctgggggacactatcggggtgggcaccccagggatcatgaaggacatgcttagcgccgtaatgcaggaagtgcccctggcagccttggctgtccactgccatgacacatacggccaggctctagcaaacaccctcatggccctccaaatgggagtgtcagttgttgatagctctgttgctggcctcggtggctgtccatatgcacaaggcgcatccggcaatcttgcaaccgaggacttggtgtacatgctggaaggactgggaatccacaccggggttaacctccaaaagcttctggaggccggtaactttatctgtcaggcactaaaccgcaagacttctagtaaggttgcgcaagccacctgtaaattgtag

SEQ ID NO: 212702 - DNA, 765 bp, Artificial Sequence
  Description of Artificial Sequence: Synthetic coding sequence
atggccgctatgcggaaggcactacctcggaggctagttggtctggcctcactgagggcagtgtcgacttctagcatgggcactttgccaaagcgcgtgaaaatcgtggaggtgggccctcgcgatggactccagaacgaaaaaaacattgtcagcactccggttaaaattaagctgatagacatgctcagcgaggccggactgagcgtcattgagaccacctcattcgtgagccctaaatgggtgccacaaatgggtgatcacaccgaggttctgaagggtattcaaaagtttccgggaattaattatcccgtcctcactcccaaccttaaggggttcgaggctgctgtcaccaagaagttctactccatgggttgttatgaaattagcttaggggataccattggcgtaggaaccccgggaatcatgaaagacatgctgagtgccgtgatgcaagaggtgcccctcgcggctctggccgttcactgccacgacacctatggacaggcattggccaacaccttgatggccctgcagatgggagtgagcgtggtcgactcatcagtagctggcctgggcggttgcccatatgcccagggagcctccggaaatctagccacagaggatctggtgtacatgctggaaggtctgggaatccatacaggggtaaatctccaaaagctgttggaggctggaaatttcatctgtcaagccttaaatcgcaagacctccagcaaagttgctcaggccacctgtaagttatag

SEQ ID NO: 212703 - DNA, 501 bp, Artificial Sequence
  Description of Artificial Sequence: Synthetic coding sequence
atggggacactaccaaaaagggtgaaaatagtggaagtaggtcctcgcgacggacttcagaacgagaaaaatatcgtgagcactcctgttaagatcaagctcattgacatgctgtcggaggcgggtctcagcgtgattgagacaacgagtttcgtctctccgaaatgggttccgcagatgggtgaccacacagaggtgctgaaaggcatccaaaagtttccgggaataaattaccccgttctcactcccaatctgaaggggttcgaggcagccatgggggtctctgtggtagacagttctgtcgccggactgggcggatgcccctatgcacagggagcaagtggcaatttggccactgaggatcttgtctatatgctggaaggtcttggcatccacacaggcgtgaacctgcaaaaactgttggaagccggaaactttatctgccaagccctgaaccgcaaaacttccagcaaggtggcgcaggcaacctgtaaactgtag

SEQ ID NO: 212704 - DNA, 1563 bp, Artificial Sequence
  Description of Artificial Sequence: Synthetic coding sequence
atggcagccctgaaactcctttcttcaggcctcagactgtgtgcaagtgcaagaggttctggcgctacctggtataaaggctgcgtctgcagctttagcacatccgctcacagacacactaaattctatactgatcccgttgaagccgtgaaggatatcccagatggtgccacggtgctggtgggagggttcggcttatgcggaattcctgagaatcttatagatgctctgcttaaaaccggcgtcaaaggtctgactgccgtgagtaataacgcaggagtcgataactttggcctggggctcctgctgcgttctaagcaaataaagaggatggttagtagctacgttggcgaaaacgctgaatttgagaggcagtacttgagcggtgagcttgaggtggagttaacaccgcaggggacattagccgagcgcattagagctggcggagcaggggttcctgccttttatacccctaccggttatgggacgttggtccaagagggaggatctcccatcaaatataataaggacggcagcgttgctattgccagcaaaccaagagaagtcagggagtttaacgggcaacattttatactggaggaggccataacaggtgactttgcactggtaaaggcatggaaagccgacagagccggaaatgtcatcttccggaaatctgcaaggaatttcaatcttcctatgtgcaaagctgccgaaactactgtagtcgaggtggaagaaatcgtagacatcggggcttttgctcccgaggacatccatattccacagatttatgttcaccggctgatcaaaggagaaaagtatgaaaagcgaatcgagaggctgagcattcgcaaggaaggcgatggagaggccaagagcgccaagccgggagatgacgtgagagagcggataatcaaaagagcagctcttgagtttgaggatggcatgtacgctaatttagggatcggcattccattgctggcttccaactttatttcccccaacatcacggtgcacctgcagagcgagaacggggtcttgggactgggaccatacccaagacagcacgaagctgatgcagacttgattaacgccggtaaagagacagtgaccatacttcctggcgcaagtttcttcagcagcgacgaatctttcgccatgattcggggaggccatgtggacctgacaatgttgggtgcgatgcaggttagcaagtatggcgaccttgcgaactggatgatccctggtaagatggtaaagggcatgggcggtgccatggatctagtatccagtgccaagacgaaagtggtggtgacaatggaacacagtgctaaaggcaatgctcacaaaatcatggagaagtgtaccctgcccctgaccggcaaacagtgtgttaacaggattattacggagaaggctgtgtttgatgtggacaaaaagaaaggcctcacgctcatcgagctctgggagggtttgactgtcgatgatgtgcagaaatccactggttgcgactttgctgtcagccctaagctcatgcccatgcaacagattgctaactag

SEQ ID NO: 212705 - DNA, 1005 bp, Artificial Sequence
  Description of Artificial Sequence: Synthetic coding sequence
atgatggttcgagagttcaacggccaacattttatcctggaggaggctatcaccggcgactttgctctagtgaaggcctggaaggccgatcgggctgggaacgttatattccgtaagtctgccagaaatttcaatctgcctatgtgtaaagctgcagaaacaacagtcgtcgaggttgaagagatagtcgatatcggagcctttgccccagaggacatccacatcccacagatatatgtacaccgattgataaagggcgaaaaatatgagaagcggatcgaaagactgagtatccgtaaagagggggatggggaagccaaatcggccaagcccggtgacgatgttcgggagagaattattaaacgcgctgccctcgaatttgaggatggcatgtatgctaacctggggatcggaataccgctgctcgcatcaaacttcatctcccccaatatcactgtacacttgcagtctgagaacggggtcctagggttgggaccttaccctagacaacacgaggccgacgctgatctgatcaacgccggtaaagaaacggttaccatcctcccaggggctagcttcttctcctcagatgaaagttttgccatgattcgtggcggtcacgtggacttgaccatgttgggagctatgcaagtgtctaagtatggagatctagctaattggatgatacctggaaagatggtcaagggcatgggcggagctatggatctcgtgagctccgcgaagacgaaagtggtagtcacaatggagcatagcgcaaagggcaacgcacacaaaattatggaaaagtgtaccctgcctctcacagggaaacagtgcgtcaaccgcattattacagaaaaagccgtgtttgatgtggacaagaagaaaggcctgactctcatagagctttgggaagggctgacggttgatgatgtccagaagagcacaggatgcgactttgcggtttccccgaaactaatgcctatgcagcagattgcaaattag

SEQ ID NO: 212706 - DNA, 372 bp, Artificial Sequence
  Description of Artificial Sequence: Synthetic coding sequence
atgctgggtgcgatgcaagtgtccaagtacggtgacctggccaactggatgattcctggaaagatggtaaaaggtatgggtggcgctatggacctcgttagcagcgcaaaaacaaaggttgtggtcactatggaacattcagctaaaggcaacgcacacaaaataatggagaagtgtaccctgcccctcacaggaaaacagtgcgttaacaggatcatcacagagaaggctgttttcgatgtagacaagaagaaaggcttgactttaattgagctgtgggagggactcaccgtcgatgacgtccagaaatccactggttgcgacttcgctgtgtctcctaagctcatgcccatgcagcaaatagcaaactag

SEQ ID NO: 212707 - DNA, 372 bp, Artificial Sequence
  Description of Artificial Sequence: Synthetic coding sequence
atgctgggcgcaatgcaagtgtccaagtatggcgatctggcaaactggatgatccccggtaagatggtcaagggaatgggcggtgctatggatttagtgagctccgccaaaactaaggtggtggtgacgatggaacattccgccaaaggtaacgcccacaaaatcatggaaaaatgcaccctccctctgactgggaaacaatgtgtgaacaggataattacggagaaggcggtgtttgacgtcgataagaaaaaagggcttaccctcatcgagctctgggaggggttgacagtcgacgatgtccaaaaaagcacaggctgcgatttcgcagtcagtcctaagctcatgcctatgcagcagattgccaactag

SEQ ID NO: 212708 - DNA, 453 bp, Artificial Sequence
  Description of Artificial Sequence: Synthetic coding sequence
tctaacgcgtacaaagtcgacaactttggcctggggctacttctcaggtccaaacagatcaaaaggatggtctccagttatgtgggagaaaatgcggaatttgaaaggcaatatctgtcaggggaacttgaggttgaattgacccctcagggaactttagcagagcgaatcagagcgggtggtgccggagtacccgcattttacaccccgaccggatacgggacattagtgcaagagggaggctctcccatcaagtataataaggatggttccgtggcgatcgcctctaagcccagagaggtgcgggaattcaacggtcagcactttatcctggaggaggccattacaggtgactttgctttggtcaaagcgtggaaagcagatagggcaggtaacgtcatctttcgcaaatccgcgaggaatttcaacttgccaatgtgtaaagcagcctag

SEQ ID NO: 212709 - DNA, 1131 bp, Artificial Sequence
  Description of Artificial Sequence: Synthetic coding sequence
atgtcgaattgtcttcagaacttcttgaaaatcactagcacaagacttttgtgttctcgcctgtgccaacaacttcggtccaagaggaaattctttggtactgtgcccattagccgcctgcaccgtagagtggtaattactggcataggactggtcaccccactgggcgtaggtactcacctagtgtgggacaggttgataggcggagaaagcggaatagtgagtttagtcggagaggaatataaatccatcccatgctccgtggccgcatatgtgcccagaggctccgatgaggggcagtttaacgagcagaacttcgtgtccaaaagtgatattaagtcaatgagctcaccaaccattatggccatcggagcagccgagcttgcgatgaaggattctgggtggcatcctcaaagcgaggctgaccaggtggctactggagtagcaatagggatgggaatgatacccctagaggtggttagcgagaccgctctgaacttccagactaagggatataacaaagtgtccccgttctttgtgccaaaaatactggtgaatatggccgcaggccaggtatcaattcggtataagctgaagggcccaaatcacgcagtctccactgcctgcaccacaggggctcacgcagtcggagactcatttcggtttattgcgcacggagatgcaggccacatcaccgcacccgatccggagggggaaggggctctgagatgcatggccgctgcattgaaagacgccggtgtgcagccggaggagatatcctatataaatgcccacgctacatccaccccccttggggacgccgcagagaacaaggctatcaaacacttgttcaaggatcacgcatacgctctggctgtgagtagtaccaagggggctactgggcacctgctaggtgccgcaggcgcagtggaggcagcttttaccaccttagcttgttattaccaaaaactgccgcctaccctgaatcttgattgcagtgagcctgagttcgatctgaactacgtacctttgaaagcccaagagtggaagaccgaaaaaaggttcataggcctgaccaacagctttggctttgggggtactaacgctaccctgtgtatcgccggtctctag

SEQ ID NO: 212710 - DNA, 1380 bp, Artificial Sequence
  Description of Artificial Sequence: Synthetic coding sequence
atgtccaactgcctacagaattttttaaaaattacatccacacggctcctctgttcacgcctgtgtcagcagctgcggagcaagcgcaaatttttcggaacggtgcccatatcccgtctgcatcgcagggtagtgattacgggcatcggcctggtgactcctctgggcgtgggtacccatttagtttgggataggttgatagggggagagagtggtatcgtaagcttagtcggcgaagagtataagtccataccctgttcggtggccgcttatgtgcctagaggcagcgatgaaggtcagtttaacgagcagaactttgtcagtaaatcagacattaagtctatgtccagccccaccataatggctataggcgcagccgagctcgctatgaaggattcagggtggcatccccagtccgaagcagaccaggtggccaccggggtcgccatcggcatggggatgatcccactcgaagtggtgtccgagacggccctgaatttccagaccaagggctacaacaaggtcagtccctttttcgtacctaaaatcctggtaaacatggctgctggccaggtttcaataaggtacaagttgaagggcccaaaccacgcagtgtcaaccgcgtgcaccaccggtgcacacgcagtcggcgacagcttccgctttatcgcccacggagatgcagacgttatggttgcaggtggcaccgacagctgcatcagtcctctaagtctggcgggtttctccagagcacgcgctctatcaaccaactccgaccctaaactggcctgccggcctttccaccccaaaagagatgggttcgtgatgggagagggcgcagccgtcttggtgctcgaagagtatgagcacgctgtgcagagaagagctaggatttacgcagaagtgttgggttatggattaagcggggatgccggtcacattacagccccagatcccgaaggggaaggagcactacggtgcatggccgcagcgctgaaggacgccggagtccagccggaagagatttcttacatcaacgcacatgccacttcaacaccattgggggacgctgccgagaataaagctatcaagcacctctttaaagatcatgcatacgccttggcagtctctagtactaaaggcgctacgggccacctgctcggggcagctggtgccgtcgaggctgcctttacgacactggcctgttactatcagaaattgccacccaccctcaaccttgactgcagtgaacctgaattcgatctgaactatgtgcccctcaaagcgcaggagtggaaaaccgagaagcggttcatcggactgacaaatagcttcggatttggaggcacgaacgctaccctttgcatcgctggtctttag

SEQ ID NO: 212711 - DNA, 696 bp, Artificial Sequence
  Description of Artificial Sequence: Synthetic coding sequence
atgtcgaactgtctccagaactttcttaagattacaagcacccgcctgctctgctcgcgtctttgccagcagcttcggagtaaaagaaagttcttcggaaccgtacctatctctagactgcatagacgcgtggttataacagggatcgggctcgtgaccccattgggcgttggcactcaccttgtttgggataggttaattggaggagaatctgggatagtctctctagtaggggaagagtataaaagcatcccttgctcagtggcagcgtacgtcccaagaggaagcgacgagggccaattcaacgagcagaactttgtgtcaaagtcggatataaagtctatgagtagcccaactataatggctatcggagccgcagaattggccatgaaggacagtggttggcacccacaatctgaggccgaccaggtggctaccggggtcgcgattgggatgggaatgatccctctggaggttgtatctgaaaccgctctcaatttccaaaccaaaggctataataaggtgagtccttttttcgtgccgaaaatcttagtgaacatggcagccggacaggtaagcattcggtataagttaaaaggacccaaccatgcagtgtctacagcatgtacaaccggcgctcacgcggtgggggattcattccgatttatagcccacggtgacgctgacgttatgtag

SEQ ID NO: 212712 - DNA, 663 bp, Artificial Sequence
  Description of Artificial Sequence: Synthetic coding sequence
atgtccaattgtcttcaaaatttcttgaagattacgtcaacaaggctgttatgctcacgcctttgccaacaactgcgatcgaagagaaagttttttggcacggtcccgatctcgcggctgcaccgtagagtagttattacgggcataggtctggtcaccccactcggtgtaggaacccatcttgtttgggacaggctcattgggggtgaatcagggattgtttcgttggtcggagaagagtacaagtccattccctgctccgtggccgcatacgtgccccgtggctcagacgagggccagttcaacgaacaaaacttcgtcagtaaaagtgacatcaaatcgatgagctctcctactataatggcaatcggtgccgctgagctcgcaatgaaagatagcgggtggcacccacagtctgaggcggatcaagtagccacaggggttgcaattggcatggggatgattcccttagaagtagtcagcgagacagcactgaacttccagaccaagggttacaacaaagtgtctccgttctttgttccaaagatcttagtgaacatggcagccggtcaagttagtatccgatataagctgaaggggccaaatcacgccgtatcaactgcctgcaccaccggcgcacacgccgtgggggatagtttttag

SEQ ID NO: 212713 - DNA, 1875 bp, Artificial Sequence
  Description of Artificial Sequence: Synthetic coding sequence
atggaaattccgggaagtttgtgtaagaaagtgaaattgagcaacaatgctcagaattggggcatgcagcgcgcaaccaacgtgacataccaggcgcatcacgtttcccggaataaaaggggtcaagttgttgggactcgcggtggttttaggggctgtacggtgtggcttacgggccttagcggagccggaaagactacagtgtcaatggctttggaagaataccttgtctgccacggcatcccctgctacacccttgatggagataacattaggcagggactgaacaagaatctgggcttttcaccagaggatcgggaagaaaacgtcaggaggatcgctgaagtggcaaagttgttcgccgacgctggcctggtttgtattacgagtttcatatccccttacacacaggatagaaataatgccaggcagatccatgagggagcctctctgcccttctttgaggttttcgttgatgcgccactgcacgtgtgtgagcagcgcgacgtgaaaggcctttacaaaaaagccagagcgggagagatcaaaggtttcaccggcatcgattccgagtacgaaaagcctgaggccccagagctagtcttgaaaacagactcttgcgacgttaatgattgcgttcagcaagttgttgagctgctccaggagagggacatcgtccccgtagacgcaagttatgaggtgaaagagctatacgtgcccgaaaataagctgcacttggccaagactgacgctgagaccctcccagctctaaaaatcaacaaagtcgatatgcagtgggtgcaggtactggcagagggctgggccacccccctgaatgggtttatgcgcgaaagagagtacttgcaatgtctgcacttcgactgtctgctggatgggggtgtgatcaatctcagtgtccctatagtcttgaccgccacgcacgaggataaggagaggctagatggatgtactgcttttgccctgatgtatgaaggacgtcgcgtagctatactgcggaatcccgagttcttcgagcatcgtaaggaggagcgctgcgccaggcagtggggcaccacttgtaaaaaccacccatatatcaaaatggtgatggaacagggagattggttaattggaggggaccttcaagtactggatcgggtctactggaacgacggtctcgatcagtatagactgacaccgacagagcttaaacagaagttcaaggacatgaatgctgatgctgtcttcgcgtttcagcttagaaacccagtgcataacgggcatgccctacttatgcaggatactcacaaacagttgttagagaggggctataggaggccagtgctgctcctgcatccgctgggaggatggaccaaagatgatgacgtcccgctgatgtggcggatgaagcagcacgcggctgtactggaagagggtgtgcttaatccagagacaactgtggtggcaatcttcccgtctccaatgatgtatgcaggcccaaccgaggtgcagtggcactgccgagctcggatggtagctggcgcaaatttctacatcgtgggaagagacccggctggcatgccccatccagaaaccggaaaggatctgtacgagccaagtcatggcgcaaaggtcctcaccatggctccagggttaatcaccctcgagatagtgccatttagagtggctgcttataataaaaaaaaaaagagaatggactattatgactcagagcaccacgaagactttgaattcatttcaggtactcgtatgaggaaactcgctagagagggccaaaaaccccctgaaggcttcatggcacctaaagcatggacggtacttacagagtattataaatctttagagaaagcgtag

SEQ ID NO: 212714 - DNA, 1845 bp, Artificial Sequence
  Description of Artificial Sequence: Synthetic coding sequence
atgtcaggcatcaaaaagcagaaaaccgaaaaccagcagaaatcaacaaacgttgtctatcaggcccaccatgtgtctcgtaacaaaagagggcaggttgttggaacaagaggcggatttcgtggatgcactgtctggctgaccggcctcagtggagcaggcaagaccactatatcctttgccctggaagaataccttgtctctcacgctatcccgtgctactcattggacggcgacaacgttagacatggcctgaaccgtaatctgggtttcagccctggcgacagagaggaaaacattagacgcatagcagaggttgcaaagctgtttgctgatgccggtctcgtgtgtattacgtcatttatcagccccttcgccaaggatagagagaatgctcgtaaaattcatgaaagcgcagggctgcctttttttgagatttttgtggacgctccactgaacatatgcgaatccagagatgtcaaaggtctgtacaagcgagcccgagccggagaaattaaggggtttacgggaatagactctgactatgaaaaacccgagaccccagaacgggttttaaaaaccaatctctccacggtgagcgactgcgtccatcaggttgtagagctcctgcaggagcaaaatatcgtgccctataccatcatcaaggatatccatgagctgtttgtcccagagaataagctcgatcatgtcagggcagaggccgagaccctgcccagcctgtccatcaccaaactggatctgcaatgggttcaggtcctctcagagggctgggccactccattgaaagggtttatgcgagagaaggagtatctgcaagtcatgcacttcgatacgctgctagatgatggggtgatcaatatgtccatccccatcgttctgcccgttagcgccgaagacaagacaagactcgaaggctgctccaagtttgtgttagcccacgggggaagaagagtggctatcctgagagatgctgaattctatgaacaccgcaaagaggagcgatgctctagggtgtgggggaccacatgcacaaagcacccgcacatcaaaatggtgatggaaagcggagactggcttgtgggaggtgatttacaagtgctcgagaagattaggtggaacgatggactggaccagtatcgccttacacctctggagcttaagcagaagtgcaaggagatgaatgccgacgccgtgtttgcctttcaactgcgaaacccagtccacaacgggcacgccttgctaatgcaagatacccggaggaggcttttagagaggggctacaagcatcctgttctattgctacatcctctgggaggatggaccaaggacgacgatgtcccgttagactggcgaatgaaacagcacgcagccgtgctggaggagggagttttggaccccaaatcgacgatcgtcgccatcttcccaagccccatgctgtacgcaggacccacagaggtgcagtggcactgtagatctaggatgatcgccggtgctaatttctatatcgttgggagggatccagctgggatgccccacccggagacaaaaaaagacctgtatgaaccaacccacggcggaaaggtgctgtctatggcgcctggtctcacttctgtcgaaatcataccctttagggtagcggcatataataaagctaaaaaggccatggacttctacgatccagctagacataatgagtttgacttcatttccggaacccgcatgcgaaaacttgctcgcgagggcgagaatcctcccgatggttttatggcaccgaaagcgtggaaggtcttgaccgattactatagatcactcgaaaagaactag

SEQ ID NO: 212715 - DNA, 1857 bp, Artificial Sequence
  Description of Artificial Sequence: Synthetic coding sequence
agcggcaaaaagcaggagaaagaggagaatcagcagaagtccaccaatgtggtgtatcaggctcaccacgtgtcccggaacaaacggggacaggtggtcgggacccgcggagggttccggggttgtacagtctggctgaccggcctcagcggggcaggaaaaactaccatctctttcgctttagaagagtacctggtgagccacgccatcccctgctactctcttgatggggacaacgtgaggcacgggcttaacaggaatctgggattctcccccggagatcgcgaagagaatatcaggcgtattgctgaggttgctaagctctttgccgacgcgggacttgtgtgcatcactagctttatttccccgttcgctaaggacagggaaaacgccaggaagattcacgaatctgctggtctgcctttctttgaaatttttgtcgatgctccacttaacatctgcgaaagtcgagacgttaaaggtctatacaaacgagccagagctggggaaattaagggcttcaccgggattgattccgactacgagaagcctgagacaccagaaagggtccttaagactaacttgtccacggtgtccgattgtgtccaccaggtcgtggagctcctccaggagcagaacattgtcccttacactatcattaaggacattcatgaactgttcgtacccgagaataagttagaccacgtgagagccgaagccgagaccttacctagtctctcaatcacaaagctggacttacagtgggtgcaggtactctctgagggatgggcaactcccctgaaagggtttatgagggaaaaagagtacttacaagtgatgcatttcgacaccctcctggacgggatgtttctgctcgatggtgttatcaatatgagtatccccatcgtgttaccagtttctgcggaggacaaaacccgactggaaggctgctcgaaattcgtcctggcacacggagggcgtcgtgtggcaatcttacgcgacgccgagttttacgagcaccgcaaagaggagcgctgcagccgcgtgtggggcaccacctgcacaaaacatccacacatcaagatggtgatggagagtggtgactggctggtgggcggagatcttcaggtcctcgagaagatacggtggaacgacgggctcgaccagtaccgcctaacccccttggagcttaagcagaaatgcaaagagatgaacgcagatgctgtctttgctttccagctgagaaaccccgtgcataatgggcatgccctgctcatgcaagacactcgcagacgactcctggaacgcggatataagcaccctgtgctcctacttcatcctttagggggatggacaaaggatgacgatgtccctttagactggagaatgaaacagcacgccgcagtcttagaggaaggtgtcctggatccaaagtccacgatcgtggccatatttccctctccaatgctgtatgccggtcccactgaagtgcagtggcattgtcgttcccggatgatcgcaggggctaatttctacattgtgggcagagatccagcaggcatgccgcacccagagactaaaaaggacttgtacgagccgactcacggaggaaaggtcctgtccatggcacccggtcttacgtctgtcgaaatcattccattcagagtggcagcttataacaaggccaagaaggcaatggacttttacgatccagctcgccacaatgagttcgacttcatcagtggcacacggatgaggaagctggctagggaaggggaaaacccccctgatggatttatggcacccaaggcatggaaggtcctgacagactactatcggtcacttgagaagaattag

SEQ ID NO: 212716 - DNA, 1857 bp, Artificial Sequence
  Description of Artificial Sequence: Synthetic coding sequence
atgatcgtgctagtgaccgagtgggtggatcttagtcttgagaatcagcagaaatccacaaacgtggtttatcaggcccaccacgtttctagaaataaacggggtcaggtggtcggcacaaggggaggtttccgtgggtgcaccgtgtggctcacaggcttgtcaggcgctggcaaaactaccatatccttcgcactcgaggaatacctggtcagccacgccattccctgttattccctcgacggagataacgtgcggcacgggctaaaccgaaacctggggtttagcccaggtgatcgggaggaaaatataaggcggatcgcagaagtggcaaagctcttcgccgatgccggattggtatgcattaccagctttatctctcccttcgccaaggacagagaaaacgccagaaagatccatgagagtgcaggtctgccattcttcgaaatattcgtagatgcaccgctgaacatttgtgaaagtcgtgatgtaaagggactgtataaaagggccagggccggagagataaaaggcttcactggaatagacagtgattacgaaaagcccgaaaccccagagagggtgcttaaaacgaatctgagtaccgtgagcgactgcgtgcatcaggtcgtcgaactgcttcaggagcagaatattgtgccttataccatcattaaagacattcatgagctctttgtccccgagaacaagctcgaccatgttcgggcagaggctgaaaccttaccctctttatccatcactaaactggacctacaatgggtgcaagtgctgagcgaggggtgggctacaccattgaagggtttcatgagggagaaggagtatctgcaggttatgcacttcgatactctgctcgacgatggggtgattaacatgtctatcccaatcgttcttcccgtgtctgcagaggacaaaacaagactagaaggctgctctaagttcgtgcttgcccatgggggaaggcgggtggctattctgagggacgccgagttttatgaacaccggaaagaggagaggtgtagccgcgtatggggcacaacctgcacgaaacatccacacatcaagatggtgatggaatccggcgattggctggtcggcggagatctgcaggtgctggaaaaaatccggtggaatgacggcttggatcagtataggctgactccacttgagctgaagcagaagtgcaaggagatgaatgctgatgctgtcttcgccttccagttgcggaaccctgtgcacaatggacacgccctcctgatgcaggacaccaggcgaaggcttttggagagggggtataaacaccctgtcctgttgctccaccctttaggaggctggactaaagatgacgatgtcccgctggattggaggatgaaacagcacgccgcagtgctcgaggaaggcgtactagatcctaagtctacgatagtggccatcttcccttctcccatgctgtacgccggacccaccgaggttcaatggcattgtcgaagtcgtatgattgccggtgccaatttctatatagttgggagggaccctgctggtatgcctcaccctgaaactaagaaggacctttacgaaccgacccacggcggaaaagtgctatccatggctcctggcttgacatcagtggaaataataccatttcgggtggcagcatataacaaagctaagaaggcaatggacttctatgaccctgcgagacacaacgagttcgatttcattagtgggaccagaatgagaaaactcgcacgtgagggggagaatcctccagacggatttatggcccctaaggcctggaaagtcctaacagactactacagaagcctcgagaagaattag

SEQ ID NO: 212717 - DNA, 1860 bp, Artificial Sequence
  Description of Artificial Sequence: Synthetic coding sequence
atgtcagggattaaaaagcaaaaaactgaaaaccagcaaaagagtaccaatgtggtataccaagcccaccacgtgagccgaaataaaagaggccaggtcgtgggaacccgcggaggctttagaggctgcaccgtctggcttacaggattgtctggtgccggtaaaacaaccattagttttgcactggaggagtatctcgtatctcacgccattccttgctacagcctggatggggacaacgttcggcatgggctcaatcgtaatctgggttttagccctggcgatcgagaagaaaacataagacgaatcgcggaagtcgctaaactgttcgcggatgcgggacttgtttgcattacatctttcattagcccatttgcgaaagacagagagaatgcacgcaaaatacacgaatcggccggactgcccttttttgagatcttcgtggacgcccctctcaatatctgtgagagccgcgatgtgaagggcctgtacaagagggctagggcgggagaaatcaagggcttcactggcatagatagcgattacgagaagcctgagaccccagaacgggtgctgaagaccaatctctcaactgtgtcggattgtgtgcaccaggtcgttgaactcctccaggagcagaacattgtcccctacactatcattaaggatatccacgagctgtttgtccctgaaaataagctcgatcacgtaagggccgaggccgagaccctgcccagtctctccatcacaaagcttgatctccaatgggtgcaggttctcagtgaaggatgggccacacccctgaagggtttcatgcgcgagaaggagtacttgcaagtgatgcactttgatacactgttagatggtatggcgctccccgatggcgtgatcaatatgtctatccctattgtgctccccgtgtccgccgaggacaaaacccgactggaaggctgctcaaagttcgttctggcccacggaggcaggcgtgtagctatactgagggacgccgagttttatgagcaccggaaggaggaaaggtgttcacgcgtgtgggggaccacctgcactaagcacccacacatcaaaatggtgatggagtccggggattggctggtaggaggagatctccaagtgctggaaaagatcagatggaatgacggcctcgaccaatatcgtctgactccacttgagctgaaacagaaatgtaaagaaatgaacgccgacgccgtattcgcattccagttacgcaatccggtgcataatgggcatgcgctgttaatgcaggacaccaggcgaaggctcctggagcgaggatacaaacatcccgtcttactgctgcacccgctcggcggttggaccaaagacgatgacgtacctttagactggaggatgaagcaacatgcagccgtgctggaggaaggggtgctggaccccaagagcacaatcgttgcaatatttcctagcccgatgctatacgctggccctacagaagtgcaatggcactgcaggtcccgaatgattgctggcgctaatttctacatagtggggcgtgacccggcaggcatgccccacccggaaaccaagaaggatctctacgagccgacccatggaggcaaagtgctgtccatggcccctggacttacaagtgtcgagatcatcccatttagagttgccgcttacaataaagccaagaaggctatggacttctacgaccctgcaagacacaacgagttcgactttatttccggcactcgcatgcggaaacttgcacgcgagggcgaaaatccacctgatggattcatggcccctaaggcgtggaaagtactgactgattactacagatctctggagaagaactag

SEQ ID NO: 212718 - DNA, 1503 bp, Artificial Sequence
  Description of Artificial Sequence: Synthetic coding sequence
atggctagtatgctgctggcccaaaggctggcctgttcctttcagcactcttaccgcttgctcgttcctggctcccggcatattagccaggcggctgcaaaggtggatgtggagtttgactacgacgggcctctgatgaagaccgaggtgcctgggccaaggagccaggaactgatgaaacagctcaatataatacagaacgccgaggcagtgcattttttctgcaactatgaagagagtcgcggtaattacctggtggacgtggatggcaatcgcatgctcgacctctattcccagatatcgtctgtgcccatcgggtacagccaccctgcattgctgaaacttatccagcaacctcaaaatgcctcaatgtttgtgaatcgacccgcactcggaattctccctccagagaactttgttgagaagctgcgacaatctctcttatctgtggctccaaagggaatgtctcagctcattacaatggcctgcggttcctgtagcaacgagaacgccctcaaaactatctttatgtggtatcgctcaaaagaacggggtcagcgcggattctctcaagaggagctagaaacgtgcatgatcaatcaagcacctgggtgtccagactacagcatcctgtcctttatgggcgcattccacgggcgaacaatgggatgtctggcaaccactcattcaaaggctatacacaagattgatataccctcctttgactggcctatcgctccttttcctcgtcttaaataccccctcgaagaattcgtgaaggagaatcaacaggaagaagctaggtgcctggaagaggttgaagacctcatcgtgaaatacagaaagaagaagaagaccgtggctggcattatagtcgagcctatccagtccgaggggggagacaatcatgcgagcgacgactttttcagaaaattacgggatatcgcccgaaagcacggatgtgcgtttctcgtagacgaggttcaaaccggtgggggttgcacagggaaattctgggcacacgagcattggggcctggatgacccggctgacgtgatgacctttagcaagaaaatgatgacgggagggttctttcacaaggaggaattcaggccaaacgccccttacaggatttttaacacttggctgggggaccctagcaagaacctgctcctggcagaggtgattaatattatcaagcgggaagaccttctcaacaacgcagcccatgcaggcaaagccctgttaaccgggctgcttgatcttcaagctaggtatccacagtttatttctcgggtcagaggtcgaggcacattctgtagtttcgatacacccgacgattcaataagaaacaagttaatccttatcgcgagaaataaaggagtggtcctcggcggttgcggcgataaaagcattcgcttccggcctaccttggtattccgagatcatcacgctcacctgttcctcaatatcttctctgacattctggctgactttaaatag

SEQ ID NO: 212719 - DNA, 1503 bp, Artificial Sequence
  Description of Artificial Sequence: Synthetic coding sequence
atggctagtatgcttctggctcagaggctggcatgttcttttcagcacagctatagactcctggtgccaggtagtaggcacatcagccaggcagctgccaaggtggatgtggagttcgactacgatggtccgctcatgaaaactgaggtgcctggtccaagaagccaggagttgatgaagcagctgaacattatacagaacgcagaggccgttcattttttttgtaactatgaggaatctcgcggtaactatctggtggatgttgatggcaatcgaatgctggatctgtatagtcaaattagtagcgtcccaataggatactctcaccccgctctgctcaagctgattcagcagccccagaacgcctcaatgttcgtcaacagacccgcactgggaattctgcctccggagaactttgttgaaaagttaagacagagcctgttaagcgtagccccaaaaggcatgagtcagctcataacgatggcatgcggctcctgctccaacgaaaatgccctcaaaacaatcttcatgtggtacaggtccaaagaaagaggtcagcgcggttttagccaggaagaattggaaacatgtatgatcaaccaggccccaggctgtcccgactatagcatattgagctttatgggcgcatttcatggtaggaccatgggttgcctcgccacaacgcattccaaggccattcataagatcgatatccccagttttgattggccaattgcaccattcccccgtttgaagtaccccctggaagaatttgtcaaagagaatcagcaggaagaggctagatgccttgaggaagttgaggatctgattgtgaaataccgaaaaaagaagaaaacagttgccggtattatcgtcgaacccatccaaagtgaaggaggggataatcacgcttccgatgatttcttccggaagcttagagacatcgcccgtaaacacggatgcgcgttcctggtcgacgaggtgcagacaggaggtggttgtactggcaaattctgggcgcatgaacattggggactcgacgatccagcagatgtgatgacatttagtaagaagatgatgactgggggtttttttcacaaggaggagtttcgtcccaatgcgccatatcgcatttttaacacttggctgggcgatccatccaagaatcttctgctggccgaagtgattaacataattaagcgcgaggacctcctcaacaatgccgcacacgctggaaaagcacttctgacgggcctcttggatctccaggcacgctatccacagtttatttcgcgggtgcgtggtcggggaacattttgctcgtttgatacccctgacgattcgatccggaataagctgatcttgattgctaggaataaaggtgttgttctgggcggatgtggagacaaatccatacggtttcgcccaacgcttgtctttcgtgaccaccatgcccatctgttccttaacatcttttctgacatcttagctgatttcaagtag

SEQ ID NO: 212720 - DNA, 1503 bp, Artificial Sequence
  Description of Artificial Sequence: Synthetic coding sequence
atggcctctatgctcttggctcaacgactggcttgtagtttccagcactcttatagacttctggtacctggcagccgtcacatctcccaagctgctgctaaggtggacgtggaattcgattatgacggcccactgatgaagaccgaggtgccgggtcctagatcacaagagcttatgaagcagttgaatattatacagaatgctgaagccgtgcattttttctgcaactatgaagagagcaggggaaattacttagtggatgtggacgggaaccgaatgttggatctgtattcgcagatcagctccgtgcccattgggtactctcaccccgcacttctcaagttaattcagcagcctcagaacgcttccatgttcgtgaacagaccagcacttgggatcttgccccctgaaaacttcgtagaaaagcttcggcagtcactgctgagtgtggctccgaagggaatgtcacagctcataaccatggcttgtggctcatgtagcaacgagaacgctttaaaaactatctttatgtggtatagatcaaaagagaggggacagcggggattttctcaggaggaactcgagacatgcatgataaatcaggcacccggttgccccgattattccatcttgagtttcatgggcgcttttcatggccgaactatgggttgcctggcgactacccattccaaggcaattcacaagatcgacattccttccttcgattggcctatagcgcctttcccaaggctaaagtacccattagaggagtttgtgaaagagaaccagcaggaagaagcaaggtgtctggaagaagtagaagacttgattgttaagtaccggaagaaaaaaaaaactgtcgcagggattattgtggaacctatccagagcgaagggggtgataatcatgcgtcggatgactttttccggaagcttagggatatcgcacgaaagcacgggtgcgcatttctggtggacgaggtgcagacgggcggtggctgcaccggcaaattctgggcccatgaacattggggactcgacgatccagctgatgtcatgactttctcgaagaagatgatgacaggcggatttttccacaaggaggagttcagaccaaacgcaccctatagaatatttaatacatggctgggcgacccatcaaagaacctactgctcgcagaggtgattaatatcataaaaagagaggatttgcttaacaatgccgctcacgctgggaaagccctcctgaccggcctgcttgatctacaggcacggtatccccaattcattagtcgcgtgagggggagagggaccttttgtagtttcgacacaccagatgattctatccgcaacaaactgatacttatcgcccgtaacaagggcgtggttctggggggatgcggcgataagagcattcgattccgtccaactttggtattcagggaccaccacgcacacctgtttcttaatattttctccgacattctggctgacttcaaatag

SEQ ID NO: 212721 - DNA, 462 bp, Artificial Sequence
  Description of Artificial Sequence: Synthetic coding sequence
gttgatatggacggggttctagccgacttcgaagctggcctgctccggggatttaggagacgcttccccgaagaacctcacgtcccactcgaacagcgcaggggcttcttggctagggagcagtatagagctctgaggcccgatttggctgacaaggttgcctctgtatacgaggctccagggttctttctggacctggaacccatccccggtgccctggacgctgtacgggaaatgaacgatctgcctgatacccaggtcttcatttgcaccagccctctacttaagtaccaccattgcgtgggtgagaaagaggagaccccttcctgggagcatatccttttcacttgttgccacaatcggcaccttgttctgcccccaacccgccgtcggctgctttcatggtccgacaattggagagaaatcttggattctaagaggggagccgctcagagggagtag

SEQ ID NO: 212722 - DNA, 606 bp, Artificial Sequence
  Description of Artificial Sequence: Synthetic coding sequence
atggccagaagtgtcagggtgctagtggatatggatggtgtactggccgacttcgaggcaggactgttaagaggttttaggcgcaggtttccagaggagcctcacgtgcctctggaacagaggaggggctttctggcccgagagcagtatagggctttgcgcccagatctggcagacaaggttgcctcagtgtacgaggctccaggtttcttcctggatctggagccaattcccggagcccttgacgcagttcgggagatgaatgaccttcccgatacacaagttttcatctgtacgagtccgctgttgaaatatcaccattgcgttggtgagaagtataggtgggtggagcaacacctgggacctcagttcgtggagcgtatcatcctgactcgcgacaagacagtagtgcttggcgacctcttgattgacgataaggataccgtcaggggtcaggaagaaacacctagttgggagcacattctctttacctgctgtcataatcgccacctcgtgctgcccccaacgaggaggcgactgctgtcctggtcagacaactggcgggagatcctggactccaaaagaggagcggctcagagggagtag

SEQ ID NO: 212723 - DNA, 687 bp, Artificial Sequence
  Description of Artificial Sequence: Synthetic coding sequence
atgatacggctgggagggtggtgcgcaaggcggttatgctccgccgctgtgccagccggacggagaggggctgcgggaggtttaggacttgctggaggtcgagcacttcgggtgctagtcgatatggacggcgtcctcgctgacttcgaaggaggttttctccgcaaattcagagcaagattccccgatcaacctttcatagcactggaggaccggcgtggcttttgggtgtccgagcagtacggcaggctgcggccagggttgtctgagaaagctatcagcatttgggagtcaaaaaattttttctttgaactggaaccactgccaggggctgttgaggcggtaaaggagatggctagcctgcagaatacagacgtgtttatatgcacatcccctataaagatgtttaaatactgtccatatgagaaatatgcctgggtcgagaaatactttggtccagatttcttagaacaaatcgtgctgacgcgtgacaagaccgtcgtgtctgcagacttgctcatagacgaccggcctgacattacaggggcagagccaacaccttcctgggagcacgtgctatttaccgcatgccacaatcagcacctgcagctgcaacccccaaggcggaggctgcacagctgggctgacgactggaaggctatactggatagcaaacgcccttgctag

SEQ ID NO: 212724 - DNA, 720 bp, Artificial Sequence
  Description of Artificial Sequence: Synthetic coding sequence
atgattcgcctcgggggttggtgtgcccgacgtttgtgcagtgctgccgtccctgcaggacgccgaggagccgctggaggattaggattggcagggggtagggccctgcgggtactcgtggatatggatggggtgctggctgactttgagggcggtttcttgagaaagtttcgtgccaggtttccagaccaaccattcattgcactggaggacaggaggggcttttgggtgagcgaacaatacggtagactacgtcctgggctgagtgaaaaggccatcagcatttgggaatccaagaattttttcttcgagcttgagccactgcctggagccgtagaagctgtaaaagaaatggcgagcctgcagaacaccgacgtgttcatttgcaccagccctattaagatgtttaagtactgcccttatgaaaagtatgcttgggtcgagaagtattttgggccagattttctagaacagatagtgctgacacgggataagaccgttgtgtctgctgatttgctgatcgatgatagacctgatataaccggtaaccaaccccctgctggctccatgagtagctctcctccagctaccaccagtacttgtagttgcagcccgccagccgctggctgcaccaggggccgtaccactggtaggccgttttggactgccagcggcccagccgagctggattgtgcaagcggctctagcgtcggtctgtag

SEQ ID NO: 212725 - DNA, 2853 bp, Artificial Sequence
  Description of Artificial Sequence: Synthetic coding sequence
atgggcgtcccagcatttttcaggtggcttagcagaaagtacccttcaatcatcgtgaactgcgtggaggaaaaaccgaaggaatgcaatggtgtgaaaatccctgtggacgcctcaaaacccaatcccaacgacgtggagtttgacaatctatacctagatatgaatggaattatccatccatgtacacaccctgaagataagccagctcccaagaacgaagatgaaatgatggtggccatttttgagtatatcgaccgcttgttcagcatcgttcgtccacgcagactgctctatatggcaattgatggcgtggcccctagagccaaaatgaatcagcaacggtctaggcgcttccgtgcttcaaaggaggggatggaggcagccgtggaaaagcagcgcgtgcgggaggagatactcgcgaaagggggttttctgccgcctgaggaaattaaagaacggtttgattccaactgtataacgcccggaacggaatttatggacaacttggccaagtgcctgcgttattatattgcagaccgccttaataatgatcccggatggaagaatcttacagtcatcttatccgacgctagcgctccaggggaaggggaacacaagatcatggactatatccgacgacagcgcgctcaacctaatcatgatcctaacactcaccattgcctttgcggtgcagatgcagacctgatcatgctggggctggccactcacgaacccaactttacgatcattagagaggaattcaaacccaataaacccaagccttgcggactgtgtaaccagttcggccatgaggtgaaggattgcgaggggctgcccagggaaaagaaagggaagcacgatgagctcgccgatagcctaccatgtgctgagggagagttcatcttcctgcggctgaacgtgctgagggaatacctggaacgggaactcactatggcctccctgcctttcacctttgatgtggagagaagtatcgacgactgggttttcatgtgctttttcgtgggaaacgatttcctgccccacctcccaagcttggaaatcagagaaaatgctatcgaccggctggtgaatatctacaagaacgtggtacataaaaccggcggatacctaactgagagcggctatgtcaatctccagcgagtgcaaatgatcatgttagccgtgggcgaagtggaggacagtatattcaaaaaacgtaaagacgatgaggacagtttccggcgaagacagaaggagaagcggaaaagaatgaaacgagatcagcccgcatttaccccatccgggatattaaccccgcacgccctgggctcaagaaactcacctggctctcaagttgccagtaatcctcggcaggctgcctatgagatgagaatgcagaacaattcatccccaagcatttcaccaaacacctccttcacctcggacggttccccctcccccctcggcggtattaagcggaaggctgaggactccgacagtgagccagagcctgaagacaacgtgcggctgtgggaggccggatggaaacaacgctactacaaaaacaaattcgacgtggatgctgctgacgagaaattccggaggaaagtggttcagagttatgtggaggggctctgttgggtcttgcgatactactatcagggctgtgcatcatggaagtggtattacccgtttcactatgctccattcgcttcagacttcgagggcattgccgacatgccctcagattttgaaaagggcacgaaaccatttaaaccactagagcagcttatgggtgtatttcccgctgcaagcggtaattttctgcctccgtcctggcggaagctgatgtcggaccccgacagctcaataattgatttctatccagaggactttgccatagacctgaacggcaaaaagtatgcctggcagggagtcgcattactcccattcgtggatgaaaggcggcttcgcgcagccctcgaggaagtttacccagacctgacccccgaggaaacacggcgtaattccctcgggggagatgtcctctttgtcgggaagcatcatcctctccacgactttattctggaactataccagaccggcagcactgaaccagttgaggtgcctcccgagctgtgccatggcattcagggaaagttcagtctggatgaagaggctattctgccagatcaaattgtctgtagccccgtgcccatgctgagagacctgacacagaacacagtggtgagtatcaatttcaaagatcctcagttcgccgaggactacatcttcaaagctgtcatgctgcctggtgctcggaaaccggctgcagtgctgaagccctctgattgggaaaaatcatcaaatggtagacagtggaagcctcagttgggatttaaccgcgatcgtaggcccgtacatttagaccaggctgcctttcgtacattgggacacgttatgcctaggggttctggaactgggatctacagtaacgctgctccaccacccgtcacctaccagggaaatctttaccggcctctgttacggggacaagctcaaatccctaagttaatgtcaaacatgcgtccgcaagattcttggagaggacctccacccttatttcagcaacagcggtttgaccgcggtgtcggggcagagcccctcctgccatggaaccgaatgctccagacccagaacgctgcttttcaacctaatcaatatcagatgctggctgggcctgggggttacccccctagacgtgatgaccgaggaggaaggcagggctaccccagagagggtaggaaataccccctgccccctcctagcgggaggtataattggaactag

SEQ ID NO: 212726 - DNA, 2625 bp, Artificial Sequence
  Description of Artificial Sequence: Synthetic coding sequence
atgatggtggctatcttcgaatatattgatcggctgttttccatagtcagaccaagaagactattgtacatggctatcgacggcgtcgcccctcgggctaagatgaaccaacagcggtctcggagatttagagcttcaaaagaagggatggaagctgccgtggaaaagcagagggtcagggaagagatactcgccaagggtgggtttctccctccagaagaaataaaggagaggttcgacagcaattgtatcaccccgggaacggagttcatggacaacctggccaagtgccttagatattatatcgctgatcggctcaataacgaccccggatggaagaacctcaccgtaattctgagcgacgccagtgctcctggagaaggggagcataagattatggattatatccggagacagagagcccaacctaatcacgatcccaacactcatcattgtctctgtggcgctgacgccgacctgatcatgctgggcctagccacacacgaaccgaacttcactattattcgtgaagagttcaagcctaataagcctaagccctgtggattgtgcaaccagtttgggcatgaggtgaaggactgtgaaggcctgcccagagagaaaaaagggaagcacgacgaattagccgactccttgccttgcgccgaaggtgaattcatattcctgcggctcaatgtcctgcgggaatatttagaaagagagctcaccatggcttctctacccttcacgtttgatgtggaaagaagcatcgacgactgggtgttcatgtgttttttcgtgggcaacgatttcctacctcacttgccatctcttgaaatcagggaaaacgcaatagatcgtctagtcaacatctacaaaaacgtcgttcacaagaccgggggatacctgaccgagtcaggctatgtgaacctccagagagtccagatgataatgctggccgtcggcgaggtcgaagactccatctttaaaaagaggaaagacgatgaagactccttcagaaggaggcagaaggaaaaacgcaagcggatgaaacgcgaccaacctgccttcactcctagcggcattctaaccccgcacgctctgggaagtaggaacagtcccggtagtcaggttgcaagtaatccgaggcaggctgcgtatgaaatgcggatgcagaacaattcctctccgagcatctcacccaacacttctttcacaagcgacggaagcccatcgccgctgggcggtatcaagaggaaggctgaggactccgactcagagcccgaaccagaggataatgtaagactctgggaagcaggatggaagcagcggtactacaaaaacaagttcgacgtggatgcagccgacgaaaagttccgtcgcaaagtggtccagagctatgtcgaaggattgtgctgggttttacgctattactaccaaggctgcgccagctggaagtggtattatcctttccattatgcccctttcgcctcagacttcgagggtatcgccgatatgccatctgattttgaaaaaggtacaaaacctttcaagcccctggaacaattgatgggggtatttccggctgcctccggcaatttcctcccacccagctggcggaagttaatgtctgaccccgatagttctatcattgacttttatcctgaggactttgcaatcgacctcaatggcaagaagtatgcgtggcagggcgtggctctgctgcctttcgttgacgaaagaagactacgcgcagcattagaagaagtgtatccagacttgacgcccgaagagacacgacggaactcactgggaggcgatgtcctgtttgtgggaaaacatcatcccttgcatgactttatcttggaactgtaccaaacaggcagcacagagcccgtcgaggtaccccctgagctctgccacggcatacagggcaaatttagtcttgacgaagaagctatattaccggaccaaattgtgtgctcacctgtgccaatgttgcgtgacctgactcaaaacactgtcgtgtccattaattttaaagatcctcaattcgccgaggattatatcttcaaagcggtgatgctgcctggagcaagaaagcccgctgctgtgcttaagccatctgattgggaaaaatcctccaacggacgccagtggaagccccagcttggcttcaaccgtgaccgtaggccggtgcacctggaccaggccgctttcagaactctcgggcacgttatgccaagaggctccgggacagggatttactcaaatgccgcaccaccacctgtcacttaccagggtaacctgtacagaccgcttctgcggggtcaagcacagatacctaagcttatgtcaaacatgagaccgcaggacagctggagggggccaccccctctgttccaacagcagcggtttgacaggggagtgggtgcagaacccctgcttccctggaatcgaatgctgcagactcaaaacgccgcattccagccaaaccagtaccagatgctcgccggaccaggcggatacccacctaggcgcgatgataggggaggccgacaagggtatcctagggagggacgaaaatatcctctccctcccccttccggccgatacaattggaattag

SEQ ID NO: 212727 - DNA, 2691 bp, Artificial Sequence
  Description of Artificial Sequence: Synthetic coding sequence
atgaacgggattatccatccatgcacacacccggaggacaaacccgctccaaagaatgaagacgagatgatggtcgcaatatttgagtatatcgatcgcctgttctctatcgtacgaccgcgacgcctgttgtatatggcaatcgacggggttgccccacgcgctaaaatgaaccagcagcggtcccgccgatttagagcctctaaggaaggcatggaggcagcggtcgagaaacagcgggtacgggaggagatcttagcaaagggcggtttcctgcctccggaagagatcaaagaacgtttcgactcaaattgcatcactccgggaacagaatttatggacaatctggcaaagtgcctgcgatactatatcgccgaccgactgaataatgatccaggctggaagaatctcacagtgatattgtctgacgcctcggcccctggcgagggggaacataagattatggattatatccgtaggcagcgagctcagcccaaccacgatcctaacacacatcactgcttatgcggtgccgacgcggaccttatcatgctggggctcgccacgcatgaaccaaacttcaccatcattagagaggagttcaagcccaataaacctaaaccctgcggcctgtgcaaccaatttggccacgaagtcaaagattgtgagggactaccacgggaaaaaaaagggaagcatgatgaacttgctgacagcctcccctgtgccgaaggggagttcatatttctgcgactgaatgttctgcgagagtacctggaacgggagctgacgatggctagcctccccttcacctttgatgtcgagcgcagcatcgacgactgggtctttatgtgtttttttgtcggcaatgacttcctcccgcatctaccatctctagagatccgagaaaacgctatcgatcgccttgtgaacatctataaaaatgtggttcacaagacaggtggttacctgacagaatctgggtacgttaatctccaaagggtgcagatgatcatgctggctgttggagaagtggaggacagcatcttcaagaagcgcaaggatgatgaggactcgtttaggaggcgtcagaaagaaaaacgcaaacgcatgaagcgcgaccaaccagctttcaccccatcagggatactgactccgcatgcgctgggctccaggaactctcctggatcgcaggttgccagcaacccacgtcaggccgcttatgagatgaggatgcaaaataatagctctccctccatctctccaaacacttcattcacaagcgacggctcgcctagccctttgggcggaatcaagcggaaggcagaggactccgactcggaacccgagccagaagacaatgttcgcctctgggaggccggttggaagcagagatattataaaaacaaatttgacgtggacgccgctgacgaaaagttccgcaggaaggttgtgcagagctatgtggaaggcctctgttgggtattgaggtactactatcagggatgtgcgagctggaagtggtattacccgtttcactatgctcctttcgcaagcgacttcgaaggaattgccgatatgcccagcgacttcgagaaagggaccaagccgtttaaacctctggaacagttgatgggtgtttttcctgcagcatcgggcaactttctcccaccttcttggaggaaacttatgtcagaccccgattcaagcatcatagatttttacccagaggactttgccattgatctaaacgggaagaagtatgcttggcagggcgtggctctcctgcccttcgtcgacgaacggagactccgggctgcactggaagaagtgtacccggatctcactccagaagagacaagacggaacagcctgggtggtgatgtgcttttcgtgggaaaacaccaccccctacatgattttatcctggaactgtatcaaacaggatcaactgagcccgtggaagtaccccctgagctgtgtcatgggatccaagggaagttttctttggacgaggaggccattctgcctgaccaaattgtgtgttcgccagtgccaatgttgagggatcttacacagaacaccgtggtctctatcaatttcaaggatccccagtttgccgaagattatatttttaaagctgtcatgctgcctggcgctcgcaaacccgcagctgttttaaaacccagcgattgggaaaagtcctccaacggaagacagtggaaacctcagttgggtttcaatagggaccgtaggcctgtacatttggatcaggccgcattccgcactcttgggcacgttatgccccgtggttctggcactggcatttacagcaacgcagcaccccctccagtaacctaccaagggaacctgtatagaccacttctaagggggcaagcccagatcccaaagctgatgtcaaacatgaggccgcaggactcctggcggggtcccccacctctgttccagcagcagaggttcgaccgaggagtgggagcagagccactgctgccctggaatcggatgttgcagacgcagaacgccgcttttcaacccaatcagtatcagatgctcgcaggtcctgggggatacccaccacggagagacgatcggggagggagacagggatacccgagggagggtagaaagtaccctctgcctcctccctcggggaggtacaactggaattag

SEQ ID NO: 212728 - DNA, 1779 bp, Artificial Sequence
  Description of Artificial Sequence: Synthetic coding sequence
atggcacctgggcagctggctctcttttctgtgagtgacaaaacaggcctcgtggagtttgcaaggaatctcaccgcactgggccttaatttggtcgcaagcggaggtaccgccaaagctttgagagatgccggtctggcagttcgggatgtgagcgagctgaccggtttccctgaaatgctggggggacgcgtgaagaccctgcaccccgctgtgcacgcaggcatattggctcggaatattccagaggacaatgcagatatggcacggctagattttaacttgatcagagtggtggcctgtaatctgtacccattcgtaaagacggtggcgagcccgggtgtgactgtggaggaagcagtggagcagatcgatatcggaggcgtcacgttactacgcgcagcagccaagaatcacgcccgtgtgacggtcgtttgcgaacccgaggattacgtcgtggtcagtactgaaatgcagagttccgagtccaaggacacttcactggagacccggaggcaactcgcgctcaaagcgttcacgcacaccgcccaatacgacgaagcaatttccgattacttccgaaagcagtactcaaagggcgtgtcccagatgcccctcaggtacggtatgaatccccatcagacgcctgcccaactgtatactctgcagcccaagcttcctatcactgtgctgaatggcgctccaggcttcattaatctgtgtgatgccctgaatgcctggcagctcgtgaaagagctcaaggaggctcttggtattcctgcagccgcatccttcaagcacgtctcccccgcaggggcagctgtgggtattccactatctgaggatgaggctaaggtgtgcatggtctacgacctttacaagacacttaccccaataagcgcagcatacgcgagggctaggggagctgaccgtatgtccagtttcggcgatttcgtggctttgtcagatgtgtgcgacgtgcctaccgcgaagataatatcccgggaagtcagcgatggtatcatcgcacccggttacgaggaggaagcactgaccatactgagcaagaagaaaaacggcaattactgtgtgctgcagatggaccagagctacaagccggacgaaaacgaggtccgcactctcttcgggttgcatctgagtcaaaagcggaataatggtgtcgtcgataagtccctgttttcaaacgtggtcaccaaaaacaaagatctccctgagtccgctttaagggacctgattgttgcaacaatagccgtaaagtatacacagtcgaattctgtctgctacgccaaaaatgggcaagtgatcggaattggcgctggccagcaaagtagaatccactgtactcggttggctggggacaaggccaattactggtggttacgccatcatccacaagtcttaagcatgaagtttaagactggtgtgaaacgggctgaaatttccaacgctattgatcagtatgtgaccgggaccatcggtgaagacgaagatctgatcaaatggaaagctctctttgaagaggtgcccgagctgttaactgaggccgaaaaaaaggagtgggtggaaaaacttaccgaggtctccatcagctctgacgcattttttcccttcagagacaacgtggatagagctaaaaggagcggggtagcctacatcgccgctccgtccggcagcgcggcagacaaagtcgtgatcgaggcctgcgacgagcttggcattattctggcacacaccaacctgcggctttttcaccactag

SEQ ID NO: 212729 - DNA, 1602 bp, Artificial Sequence
  Description of Artificial Sequence: Synthetic coding sequence
atgctgggcggtcgggtaaagaccctgcaccccgcagtccacgcagggatcctggcgaggaacatccctgaagacaacgccgatatggctagactggattttaaccttatcagggttgttgcatgtaacttgtacccattcgttaagaccgtcgcttctccaggtgtcaccgtcgaggaagcagtcgagcagatcgatattgggggagtaacccttctccgggcagccgcaaaaaatcatgcacgggtgactgtggtctgtgaaccagaggactacgttgtcgtctccactgagatgcagtcttccgaatctaaggacacaagcctcgaaactaggcgtcagttggcgctgaaagccttcacccacacagcccagtacgacgaggccattagcgactactttcgaaaacagtatagcaagggtgtgagccagatgccgctcagatatgggatgaacccacatcagacacctgcccagttgtacacgctgcaacctaagttaccaatcacagtgctgaatggcgcacccggttttattaacctgtgtgacgctctgaatgcttggcagttagttaaagagctgaaggaggctctgggcattcctgccgcagcatcctttaaacacgtgagtcccgctggagcggctgtgggaatacccctgtctgaggacgaggccaaggtgtgtatggtatatgatctgtacaaaactctaacaccaatatctgccgcttacgccagagctcgcggagccgacaggatgagttccttcggagacttcgtggccctgagtgacgtctgtgacgtacctaccgctaagattataagtagagaggttagcgacggaattatagcccctggctacgaggaggaggcgctcactatcctctccaaaaaaaagaacggaaactactgcgtgctccagatggaccaaagttataagccagacgagaatgaggtgcggaccctatttgggctgcacctgtctcagaaacgcaataacggagtagttgacaagagtctgtttagtaatgtagtcacaaaaaataaagacttgcccgaaagcgcgctgagagatctgattgtcgccactattgcagtgaaatatacccagagtaatagtgtgtgctacgctaaaaatggacaggtcatcggtattggggctgggcagcagagtcgtatccactgtacgcgcctggccggagataaggctaattattggtggctacgccatcaccctcaggttctaagcatgaagtttaaaaccggtgtgaaaagggccgagatttccaatgcaattgaccagtacgtaacaggaacaattggagaagacgaggatttgataaagtggaaggccctgtttgaggaagtgccagagctgctgaccgaagccgaaaagaaggaatgggttgagaagctgaccgaggtttccatatcttctgatgcgttttttccttttagagataacgtggacagagctaagcgcagtggcgtggcttatattgccgcaccgagcggatctgccgcagacaaggttgtgatcgaagcttgcgacgagcttggtatcattctcgcgcatacaaacctgcgcctgttccaccactag

SEQ ID NO: 212730 - DNA, 3252 bp, Artificial Sequence
  Description of Artificial Sequence: Synthetic coding sequence
atgaaaggcactagggcgattggttcggttcctgaacgctcaccagcaggggttgatttgtccctcacaggcctgccacctcctgtgtctagacgtcctggatctgcagccactacaaagccaattgtccggtccgtctccgtggtgacgggtagcgagcagaaacgcaaagttctcgaagcaaccggaccaggcggaagccaggccattaataacctaagacggtctaactccaccacacaggtatcccagccccgttccggatcccccaggcccacagagcccacagattttctgatgttatttgagggaagtccatccggcaagaagcgacccgcttcactaagcacagccccttccgagaaaggcgcaacttggaacgtgctggacgatcagccaagaggatttacattgccatcaaatgctagatccagctctgcattggacagccccgcaggacccaggaggaaggagtgtactgtcgccctggcgccaaattttacagccaataataggtctaataaaggcgctgtgggcaactgcgtcacgaccatggtacacaacaggtatactccgagcgagagagcacccccactgaagagttcaaaccagaccgcaccatctttaaataacattataaaggcggcaacttgtgagggctccgagagctctggtttcggaaaattgccaaaaaatgtaagctcggcaactcatagcgcaaggaataatactggaggatctaccggcttacctcgtaggaaagaggtgaccgaggaggaggcagagagatttattcaccaagtcaaccaggccacagtgaccatccagagatggtatcgccatcaggtccagaggagaggcgcaggagcagctcgactggagcatctgcttcaggccaagcgggaggaacaacgacaacgctccggagaaggcactctgctggatttgcatcagcagaaagaggctgcacgaaggaaagccagggaggagaaggcacgtcaggccaggcgggctgctatccaggaactgcagcaaaaacgggctctgcgtgcacagaaagcatccactgcagaacgcggaccccctgaaaatcccagggaaacccgagtgcccggtatgcggcaacccgctcaggaactgagtcccacgccaggagggaccgcccatcaggccctaaaagccaataacactggaggaggtctgcccgcagccggaccgggtgatcgttgcctgcctacgtctgactcgtcccccgagccccagcagcccccagaggaccggacgcaggatgtactcgctcaggacgccgctggtgacaatctggaaatgatggccccatctcggggatccgccaagtcgcggggtcccctggaggaattgctgcatacactccagttgctggaaaaggagccagacgtgctcccacggcctaggactcaccaccgcggtcgctatgcgtgggctagcgaagtgactacagaggatgatgcatcctcactcaccgctgacaatctggaaaaatttggcaaactctcagctttccctgaaccacccgaagatggaaccttactgagcgaggctaaattgcaaagcatcatgtcctttctcgatgaaatggagaagtcaggccaggaccagctagactcgcaacaggaagggtgggtgcccgaagccggacctggccctctggagctgggatcggaggtcagcactagtgttatgcggctaaagcttgaggtcgaggagaaaaaacaggccatgctgttgctccagcgcgctttagcgcagcagagggatctcaccgctcggagagtcaaagagaccgagaaggccctgtctagacagctacaacgtcagcgggaacattacgaggcaactatccaaaggcatttggcatttattgatcagcttatagaagacaagaaggtgcttagcgagaagtgtgaggcagttgtagcggagctgaaacaggaagatcaacggtgcactgaaagggtggctcaggcccaggcccagcatgagcttgaaatcaaaaagttaaaagaactcatgagtgccaccgagaaggcacgcagggagaaatggatcagcgagaagaccaaaaagatcaaggaggtaacggtgcggggacttgaaccggaaattcagaagctcatcgccaggcacaagcaggaggtccgtcgcctgaaaagcctccatgaggctgaactgcttcaaagcgatgaaagagcttctcaaagatgtctgaggcaggcagaggagttgagggaacagttagagcgggagaaagaggctctcggacagcaggagcgggaaagggcacggcagcgcttccagcaacacctcgaacaggagcagtgggcgctgcagcagcagcgccaaagactctacagcgaggtggcggaagaacgggagcgtcttggacaacaggcagcgagacaacgagctgagttggaggaactcagacagcaactggaggaaagctcctccgctcttacacgggcattaagagccgaattcgaaaaaggtcgagaggagcaggagcggaggcatcagatggaattgaatactctcaagcagcagctggaactggaaagacaggcgtgggaggcgggaagaacacgtaaggaagaagcttggctgctgaatagggagcaggagcttagagaggagatccggaaaggcagagacaaggagattgaactggtgattcaccgtctagaagctgacatggctctcgccaaggaagagtccgagaaagccgcagagtctaggatcaagcgtcttcgtgacaagtacgaggcagagctgtccgaacttgaacagagcgagcgtaaactacaggagagatgctctgagctgaaaggccagctgggtgaagcagaaggtgagaacttacgactacagggcttggtgcggcaaaaggaacgcgctctcgaggacgcccaggcagttaacgagcagttgtcttccgaacggtcaaacttagcccaagtaattaggcaagaattcgaggatcgcttagctgccagtgaagaagagactcgccaagccaaagcggagcttgctactctgcaagccagacaacagctagagctggaggaagtacaccggcgagtgaagacagctctagccaggaaggaggaggccgtgtcctcactgagaacgcaacatgaagccgctgttaagcgcgctgatcacctggaagaactgctggaacagcaccgcaggcccacaccttcaacaaagtag

SEQ ID NO: 212731 - DNA, 3135 bp, Artificial Sequence
  Description of Artificial Sequence: Synthetic coding sequence
atgaaaggtacaagagccatcggatccgttcccgaacggagccctgcaggcgtggacctgagtctgactggtctgccccctcctgttagccgtcgacccggttccgcagcgacaacgaagccaatcgttcgttccgtgagcgtggtgactggttctgagcagaaaagaaaagttctcgaggccaccgggccaggcggtagccaagccataaacaacctgagaaggtccaatagcacgacccaggtttctcaaccacgatcaggatctcctagacccaccgagccgacggattttctcatgttgtttgaagggtctccctcaggcaaaaaacggcctgccagcctttccacagctcccagcgagaaaggcgcaacctggaatgttttagatgaccagccacggggtttcaccctccctagcaacgccaggtcctcctctgcactagattctccagctggtcccagacgcaaggaatgtaccgtggccctggccccaaacttcaccgctaacaataggtcaaacaaaggagcggtcggcaactgcgtcacaacaatggtccacaatagatatacccccagcgagagggcccctcccctcaaatccagcaatcagaccgccccatcccttaataacattattaaagccgctacctgcgagggatccgagtccagcgggttcgggaagctccctaagaacgtcagctcagccacacattcagctcgtaacaatacaggcggttccactggcctacccagacgcaaggaggtgacagaagaagaagcagagcgttttatccaccaggttaaccaggccactgtgacgattcagcgctggtacagacatcaggtgcagaggagaggggcaggagccgctagactggagcacctcctacaggctaagcgggaagagcagagacagcggtccggggagggcactctgctggatctgcaccaacagaaggaagctgctagaaggaaggcccgtgaagagaaggctcgccaggctaggcgggcagcaatacaggaactgcagcaaaagagggccctaagagcccagaaagcctctaccgcagagagaggccctcctgaaaaccctcgggagacgcgggtgcctgggatgcgtcaacccgctcaagaattgagcccgacacccggagggaccgctcaccaggctctgaaggcgaataataccggcggtggtctgcccgctgcaggtcccggagaccgatgcctcccaacaagcgactcttctccagaaccccagcagccaccagaagaccggacccaggatgttttggcccaggacgctgcaggcgataatctcgagatgatggctccctcacggggttctgcaaagtctagaggcccactggaggaattgctccacacccttcaattactcgaaaaggagccagacgtgctaccaagacctcgcactcatcacagaggacggtacgcttgggccagcgaggaagacgatgcctctagccttacagccgacaacctggagaagttcggcaagctcagcgccttcccagagcctcctgaggatggaactctcctgtctgaagcgaaactccaaagcattatgtcatttctggatgagatggagaaatcaggtcaggatcagttagatagccagcaggaaggctgggtgcccgaggcaggacctggccctctggaactgggaagtgaggtcagcacttccgtgatgcgactgaagctggaggtcgaggaaaagaagcaggctatgctactcctgcagcgagctctggcccagcagcgcgacctcacggcgagaagagtgaaggaaacagaaaaagcacttagtcggcagctccagagacagagggagcactatgaggctactattcagagacatttagctttcatcgatcagttaatcgaggataagaaggtgttgtccgagaagtgcgaagcagtggtggcagagctgaagcaggaggaccagaggtgcacggaaagagtcgcacaagcccaggcccaacacgagctggagatcaagaagttaaaagaattaatgtctgcgactgaaaaggctagacgggagaagtggatcagcgagaagacaaagaagataaaggaagtgacagtaagggggctcgagccagaaatccagaaactgatcgcccgacataaacaagaggtgagaaggctgaaatcactgcatgaggccgagctgctgcagagcgatgaaagagccagtcagaggtgtctgagacaggctgaggagctaagggagcagctagagcgcgaaaaagaggctctgggacagcaagaaagagagcgcgctcggcaacgtcagagggcggaactggaagaactgcgtcagcagctcgaagagagcagttctgccctgacccgggctctgcgggctgaattcgagaaggggcgagaggaacaggagcgcaggcaccaaatggaattaaatacccttaagcagcagctggagttggagcgtcaggcttgggaggccggaaggacccgcaaggaagaggcttggctgcttaaccgggagcaggaattgagggaggagataagaaaaggtcgggataaggagatcgagctggtaatccacaggctggaggcagatatggctctagctaaggaagagagcgaaaaagccgctgagtcccggataaaacgattgcgtgacaagtacgaagcggagctctccgagctggagcaatcagagcgcaagctccaagagagatgttcagagctcaagggacaattgggggaggccgaaggtgagaatctacgcctccagggactggttaggcagaaggaacgcgcactggaggatgctcaggccgtgaatgaacagctctcaagcgaaaggagtaatcttgcccaagtgatcagacaagagtttgaagaccgtctcgcagcttctgaggaagagacacgccaggccaaagctgagttggcaacattacaagcccgacaacaactggaattggaggaagtgcatcggcgagtcaaaactgctcttgcaagaaaagaggaagcggtcagctctttaaggactcagcacgaagctgccgttaaacgtgctgaccatctggaagaactgctggaacagcaccgcagacctaccccatcaaccaaatag

SEQ ID NO: 212732 - DNA, 3243 bp, Artificial Sequence
  Description of Artificial Sequence: Synthetic coding sequence
atgaaagggacaagggcgattggaagtgtccctgaaaggagtcctgccggagttgatctctccctcactggattaccacctccagtgagtagaagaccaggctcagccgcaaccacaaaacctattgtccgcagcgtctccgttgtcacaggtagcgagcagaagagaaaggtcctggaggctaccggccctggaggatcccaggcaattaacaatctgagacggtctaattcaacaactcaagtctctcaacctcggtccggctcaccgcgacctactgaacctaccgattttcttatgctgtttgagggatcaccatcagggaagaagcggccagccagcctgagcaccgccccatcggagaaaggagccacctggaatgtgttagacgaccaacccaggggctttacattaccctcgaacgccagatcttcctctgccctcgattcaccggctggccctcgcaggaaggaatgtacagtggccctcgccccaaactttaccgcgaataatcgctcgaacaaaggggctgttgggaattgcgtcactactatggtgcataatagatacaccccaagcgaacgtgcaccccctctcaagtcttccaatcagactgctccctccttaaataatattatcaaagctgccacttgcgaggggagcgagagcagtggctttggaaaactgcccaagaatgtatcttcagccacacatagtgcccgtaataatacagggggatcaacaggtctgcccagacggaaggaggtgaccgaagaggaagcggaaaggttcatccatcaagtgaaccaagcgactgtaactattcagagatggtatcgacaccaggtgcagaggcgtggggcaggggctgcaagactggaacacctactgcaagctaagagagaagagcaaaggcagagaagtggggagggaacgctactcgatttgcaccagcagaaggaagctgcgcgtaggaaagcgagggaggagaaagctcgccaggcgcgtcgcgcagcaatacaagaattgcagcagaagcgcgcactccgggctcagaaagccagtacagcggaacgcggtccacctgagaaccccagggagactagggtccctggcatgcgccagcccgcacaggagctctccccaaccccaggaggcacagcgcaccaggcattgaaggccaacaatacgggtgggggtttgccagctgcaggccctggggatagatgcctgccaacctccgacagtagtcccgaaccacaacaaccacctgaagaccgaacccaggatgtcttggcacaagacgctgccggtgataatctggaaatgatggccccttcgaggggatccgccaagtcacggggaccgctggaagaactactccatacactacaactgttggaaaaggaaccggacgtattacccagaccacgcacgcatcaccgcggtcggtacgcctgggcatcagaggaagacgatgcctctagccttaccgccgacaacctcgagaaattcggcaagctttctgccttccctgaaccccctgaggatgggaccctcctttccgaggcgaagctgcaatccattatgtcttttctggacgagatggagaagagcggacaggatcagctagatagccaacaggagggctgggttcctgaagcagggcctggcccacttgagctgggatccgaagtttcaacatccgtcatgcggctgaaactagaagtggaggagaagaaacaggctatgcttctgcttcagagagcattggctcaacaaagggatcttactgccagacgcgtgaaagaaacagaaaaggctctctctcggcagctgcagagacagcgtgaacattacgaggctaccatacaacgacatttggcgttcattgaccagctgattgaagataagaaagtactttccgaaaagtgtgaggccgtcgtggcagaattgaagcaggaggaccagcgctgcacggaacgggtggcccaggctcaggcccagcacgagctggaaattaaaaagcttaaggaactcatgagtgctaccgagaaggctcggagagagaaatggatcagcgaaaagaccaagaaaattaaagaagttactgttagggggctggagcccgagatccagaagctgattgcaagacacaagcaagaagtcagaagactgaagagtctccacgaagccgagcttctgcagagcgacgaaagagccagtcagcgctgcctgcggcaggcggaggagctgagagagcagctcgaaagggagaaggaggcacttggacagcaggagagagaaagagctagacagcggttccagcagcatctggagcaggagcaatgggctctgcaacagcagagacagagactatatagcgaggtcgccgaagagagggaaaggcttggccagcaggctgcgcgacagcgcgctgagctggaagagctgcgccagcaattggaagaatcaagtagcgccctcacccgggcactgcgcgctgagttcgagaaaggcagggaggagcaggagaggcggcaccaaatggaactgaacacgctgaagcagcagctggaactggagcggcaagcctgggaagccggaaggaccaggaaggaagaggcctggctgctgaacagagagcaagaactgagggaagagattagaaaaggcagagataaggagatcgaactggttatccacaggctggaagcagacatggccttggccaaggaagagtcagagaaggctgcagaatctcgcattaagaggctacgggataagtacgaagctgagctgagcgagctcgagcagagtgaaaggaagttgcaagaacggtgttctgagctgaaaggacagctgggggaagcagaaggcgagaatctgcggttgcaaggcctggtcagacagaaagaaagggcgttggaggatgcccaggccgtcaatgaacagcttagcagcgagcgatccaatctggcccaggtcattcgacaggaatttgaagaccgcctcgccgcatctgaggaggaaacacggcaggcaaaggcggagctcgccacattacaggctcgccaacaactcgagctagaggaagttcaccgtcgggtgaagaccgctcttgcacggaaagaggaagcggtgtcatcccttcggacacagcatgaggcagccgtgaagcgggctgaccacttagaagagcttctagagcaacatcggagacctactcctagtacgaagtag

SEQ ID NO: 212733 - DNA, 699 bp, Artificial Sequence
  Description of Artificial Sequence: Synthetic coding sequence
atggatgcattggttgaggacgatatctgcatcctcaatcatgaaaaagcacataagagggacaccgtcacacctgtgagtatttattccggcgacgagtcagtcgcatctcattttgcgctggtgactgcatacgaggacatcaaaaagcgcctgaaggattccgaaaaagagaactcactcctgaaaaagcgcatccggtttctggaagagaagctgatcgcaaggtttgaggaggagactagttccgtgggacgcgaacaggtgaataaggcttatcatgcctatcgggaggtgtgtattgacagagataatctcaagagcaaactggacaagatgaataaggataactccgaaagtttaaaagtcttgaacgaacagcttcaatcaaaggaggtggagttgctgcagctgaggacggaggtcgagacacagcaggttatgagaaacttaaacccaccctcttccaattgggaagtggagaagctgagctgcgacctcaagatccatggactggagcaggagctcgagctcatgcggaaggagtgttccgaccttaaaatagaactccaaaaagcaaagcaaactgatccttaccaagaggacaatctcaaatctagggatttgcagaagctgtctatttcacgcgtaagcgtagcgcagccaggagtgcagtggcggaaccacggtatcgcatag

SEQ ID NO: 212734 - DNA, 648 bp, Artificial Sequence
  Description of Artificial Sequence: Synthetic coding sequence
atggacgcactggtggaggacgacatctgtatcctgaatcacgaaaaggcccataagagagatacagtgacccctgtgtctatttactccggtgacgaatctgtggcctcccacttcgccctcgtgactgcttatgaagatatcaaaaagcgactcaaagatagtgagaaagagaacagcctgctgaaaaagcgtattagattcctggaagagaagctcattgctagatttgaagaggaaacgtctagcgtaggccgagaacaggtgaacaaagcttaccacgcatatagggaggtgtgcatagatagggataatttgaagtctaagttagataaaatgaacaaggacaattcggaatctctgaaggtgcttaatgaacaactgcaaagcaaggaggtcgagcttctgcagctccggacagaggttgagacacaacaggtgatgagaaatttgaacccgccatcctcaaattgggaggtggaaaagttatcatgcgatctgaaaatccacggtttggaacaggagctcgagctgatgagaaaagaatgctctgacttaaaaattgagcttcagaaagctaagcagactgatccttaccaagaagataacttaaagtcgagagatctccagaaactgtccatctcttag

SEQ ID NO: 212735 - DNA, 288 bp, Artificial Sequence
  Description of Artificial Sequence: Synthetic coding sequence
atggatgccctggtcgaggacgacatctgcattcttaatcatgagaaagctcacaaacgggatacagtgacacccgtatctatatacagcggagatgagtctgttgcctcccatttcgcattagttaccgcttacgaggatattaaaaaacgcctcaaagacagcgagaaagagaattcccttttgaagaagcggattagattcctcgaggaaaaactcatcgccagatttgaggaggagacctctagtgtcggtagagagcaggtgaacaaggcttatcatgcttag

SEQ ID NO: 212736 - DNA, 732 bp, Artificial Sequence
  Description of Artificial Sequence: Synthetic coding sequence
atggatgccctggtagaggatgatatttgtattctcaatcacgagaaggcacacaagagggatactgttacacccgtgagcatatatagcggcgacgaatctgtggcctctcacttcgccctggtgaccgcgtatgaggatattaaaaaacgcctcaaggattcagagaaagagaactcgctgctcaaaaagagaatccgattcctggaggagaaactgattgctcggtttgaggaagagacttcaagtgtgggcagggagcaggtcaataaggcataccatgcgtatcgggaagtgtgtatcgaccgggacaacttaaaatcgaaactcgataagatgaacaaggacaatagcgagtctctgaaggtgctgaatgagcagctgcaaagtaaagaggtcgagctgctgcagctgcggaccgaggttgaaacacagcaggttatgcggaatttgaaccctccctcctctaattgggaagtagagaagctatcttgcgacttaaagattcatggcctagaacaggagctggaacttatgcggaaagaatgttccgatctgaagatcgagttacaaaaagcaaagcaaacagatccgtatcaggaggataacttgaagtctagggacctgcaaaagctgtctatctccagacagtcaatctgctccactgcctggtcagccgtcgcccagtcatgggacagcatgaacttcgaagactgttcgctgttcgcctag

SEQ ID NO: 212737 - DNA, 732 bp, Artificial Sequence
  Description of Artificial Sequence: Synthetic coding sequence
atggatgcattggtcgaagacgatatctgtattttgaaccatgagaaggcacacaaacgggacacggtcacaccagtctccatctactccggggatgagtcagtggcctcgcattttgccttggttactgcgtatgaggatattaagaagcgactcaaagacagcgagaaggaaaacagtttacttaaaaaaaggataagattcttggaggagaaactgattgctcggttcgaagaggagacttcgtccgtaggcagggagcaggtgaacaaagcttatcacgcctaccgcgaggtgtgtatagacagggataacctcaagtccaagctcgacaagatgaataaggataactccgagagcctgaaggtcttgaatgaacagctgcagagcaaagaggtcgagctcctccagttgaggactgaggtggagacgcagcaggttatgcgaaaccttaaccccccatcctctaactgggaggtcgagaagttaagttgtgacctcaaaatccatggcttggagcaagagctggagcttatgcggaaagaatgtagcgatttaaaaatcgaactccagaaagccaaacaaacagatccataccaagaagataatttaaaatctagggacctgcagaaactcagtattagtaggcagagtatatgttcaactgcctggtctgccgtggcccaatcctgggacagtatgaacttcgaagactgctccctatttgcatag

SEQ ID NO: 212738 - DNA, 1179 bp, Artificial Sequence
  Description of Artificial Sequence: Synthetic coding sequence
atggacgcactagttgaagacgatatctgcatactcaatcacgagaaggcgcacaagcgtgacaccgtgactcccgtgtccatctatagtggtgatgagtccgtggcaagccatttcgcactggtgacagcctatgaggacatcaagaagagattgaaggacagtgaaaaagagaattctttgttaaagaaacggatccggtttctggaggaaaagcttattgcaaggtttgaggaagagaccagtagcgtcggacgggaacaggtgaataaagcatatcatgcctatcgcgaagtctgtatagatcgggacaacctgaaatctaaactcgataagatgaacaaggacaattccgaatccttaaaggtgttaaacgaacagctacagtcaaaagaagtcgagttgctacaattgcgcactgaagtggaaacccaacaggtgatgcgaaatttaaacccaccttcaagcaattgggaagtagaaaaactctcatgcgatctcaaaatacatgggctcgagcaagaactagagttgatgagaaaggaatgctcggatttaaagatcgagctgcagaaagctaagcagactgacccctaccaggaggacaatcttaaaagccgggacttgcagaagttgtctataagctccgacaatatgcagcacgcctactgggaactgaagagagaaatgtcaaacctgcatttggtcacccaggtgcaggccgagttgctccgcaagctaaagacctctacagctatcaagaaggcatgcgcacccgtgggctgttcggaggatttaggacgggactcaacaaagcttcatcttatgaattttacggcaacttatacccgccaccctcctctcctgcccaacgggaaggccctgtgccacactacatcctctccgttgccaggggatgttaaagtgcttagcgaaaaggctattcttcagtcctggaccgataacgaaagaagcatccctaatgatggaacgtgcttccaggaacatagcagttatgggcgtaacagcctcgaggacaactcatgggtgttcccgtcaccgccaaagtccagcgagacggcttttggtgagacaaaaacgaagaccctgcccttacctaacctgcctcctcttcactacctagatcagcacaatcagaactgcctgtacaagaattag

SEQ ID NO: 212739 - DNA, 1269 bp, Artificial Sequence
  Description of Artificial Sequence: Synthetic coding sequence
atggatgtgttatccccgggacagggcaacaatacaactagccctccggcacctttcgaaacgggcggtaatacgacaggtatctctgacgtgactgtgagttaccaggttatcactagccttcttctcgggactttgatattctgtgccgtacttggcaacgcatgtgtcgttgcagccattgccctggaacgcagcctgcaaaacgttgccaattacctgattgggtcattggccgtaaccgacctcatggtgtctgttttggttctccctatggccgcattgtaccaggttctgaacaagtggacccttggccaggttacttgtgacctcttcatcgcgctggacgttttgtgttgcacatcatcaatactgcacctatgcgctattgcactggacagatattgggctattacagatcctatagattatgtcaacaagcgtacaccaagaagggccgctgccctgattagtttaacgtggctgattgggtttttgatcagcattccgcctatgttgggctggcgtactcctgaagaccggagcgaccctgacgcttgtaccattagcaaggatcacgggtatacaatctactccacatttggcgcattctacatccccctgctgttgatgttagtattatatggaagaatcttccgcgcagcaagattccgaattcgcaagaccgttaagaaggttgaaaagaccggggctgatacaaggcacggtgcctcccccgctccccagccaaagaaatccgtgaacggcgagtctggaagtagaaactggcgtctgggggtggagtccaaagccggaggtgccttgtgcgctaacggcgcagtgcgccaaggcgatgatggagccgctttagaggtgatagaggtccatagagtgggaaactctaaggaacacctgccactcccttccgaggcgggaccgacgccctgcgccccagcatcctttgagagaaaaaacgaaagaaacgccgaggctaagagaaagatggcacttgcgagggaacgcaaaaccgtgaaaacactgggtatcatcatggggacttttattctctgctggttgccatttttcattgtggcactggtcctgccgttttgcgaaagcagttgccacatgccaacgctgctcggagcgatcattaattggctgggatactcaaattccctcctgaatccagtcatctatgcctatttcaacaaagatttccagaacgcctttaaaaagatcatcaagtgtaagttctgccgccaatag

SEQ ID NO: 212740 - DNA, 129 bp, Artificial Sequence
  Description of Artificial Sequence: Synthetic coding sequence
atggacgttctgtccccaggccaaggcaataatacaacctctccccctgcaccattcgaaacaggcggaaacactaccgggattagtgacgtgactgtgagctaccaggttatcacttccttgctgtag

SEQ ID NO: 212741 - DNA, 1173 bp, Artificial Sequence
  Description of Artificial Sequence: Synthetic coding sequence
atggaggagcctggagcccaatgcgcgcctccacctcctgcaggctcagagacctgggtgcctcaggctaatttgtcatccgcacctagtcagaattgcagtgctaaagattacatttaccaggattctatctcactgccatggaaagtccttctggttatgctgctagcactcatcaccttggccacaactctcagtaacgcgttcgttatcgcgacagtgtatagaactcggaaactacacacccccgcaaattatctgatagcctccctggcagtgacagacctcctcgttagcatcctggtgatgccaatcagtaccatgtacactgtgactgggagatggacacttgggcaggtcgtgtgcgatttttggttgtcaagcgatataacctgttgtaccgcaagcattcttcacttgtgcgtaatcgccctcgaccgatactgggctatcactgacgccgtcgaatattcagccaagcgtacacctaagcgcgctgccgtgatgatagccttggtgtgggtgttcagtatttctatatcacttcccccattcttctggagacaagccaaggcagaagaggaagtgtctgagtgtgtggtgaatacagaccatatcctatataccgtttatagcaccgttggtgccttttacttcccaaccttgctgctgatcgccctctacggcagaatttacgtcgaagctcgaagccgtattctgaaacagacgcctaaccggacaggcaagagattaacccgggctcagttgattacggattctccgggttcaacctcaagcgtgacatcaattaactccagggtgcccgacgtaccctctgagtctggctctccggtctacgtcaatcaggtgaaagtgagggtgtcagatgccctgttagagaaaaaaaaattaatggcagcgagggagagaaaggccaccaagactttggggataatcctgggcgcatttattgtttgctggttacccttcttcataatttcactggttatgccgatctgcaaggatgcctgctggttccatctggccattttcgatttctttacttggctcggataccttaacagtcttatcaaccccattatttacacgatgtccaatgaagacttcaagcaggcctttcacaaattgatccggtttaaatgcacctcctag

SEQ ID NO: 212742 - DNA, 1134 bp, Artificial Sequence
  Description of Artificial Sequence: Synthetic coding sequence
atgagtccactgaaccaatcagcggagggcctcccccaggaggcaagcaaccggagccttaatgccaccgagaccagcgaggcctgggatccacgtactttacaggccctcaaaatctctctggctgtggtacttagcgtgattacactggccaccgtcctgtcaaatgccttcgtcctgacaaccatcctcctgacaagaaaactccacactcctgccaactacctgatcggctcactggctaccaccgacctgctcgtttcaatcctcgttatgcccatctctattgcctacaccataacccacacttggaattttggccagattctctgcgatatctggctgagcagtgacattacttgttgcactgccagcattctgcacctctgcgtcatcgcactcgatcgatactgggccattactgatgccctggagtattctaaacggagaacagctggacatgcagccaccatgattgctatcgtgtgggccatcagcatctgcatttctatccccccactcttttggagacaagcaaaggcgcaagaagaaatgagtgattgtttagtcaacacttctcagatcagttatactatctacagtacatgcggagctttttatataccatcagtgctcctgattatcctttacggcagaatctaccgtgcggctcgcaatcggattttgaacccgccatctctctatggtaagcgcttcacaacagctcacttaatcacaggaagcgctggaagctcgctttgtagtttaaatagcagcctgcatgaaggacatagtcattctgccggatcccctctctttttcaaccacgtgaagatcaagctcgctgacagtgccctggagagaaagcggatctcagctgcccgagaacgcaaagccacaaaaatcctcggcataatcttgggtgctttcataatatgttggctgcctttttttgttgtctcccttgtgctgccaatctgtagggattcctgttggattcacccagccttgttcgacttttttacctggctagggtacttgaactcgctgattaatcccatcatctacaccgtgtttaacgaagagtttcggcaggcctttcagaagattgtgcctttccggaaggcctcttag

SEQ ID NO: 212743 - DNA, 1134 bp, Artificial Sequence
  Description of Artificial Sequence: Synthetic coding sequence
atgagcccactcaaccagtcagctgaggggctgccgcaagaggcctctaataggtctctcaacgcaacagaaacgagtgaagcctgggatcctaggactctgcaggctttgaagatttcgttggccgtcgtgctgagcgtcataaccttggccaccgtgctcagcaacgcctttgtgctgaccacaatcctgcttactcgcaagttgcatactcctgccaactacctgatagggagtctggccacaacagacttgctcgtgtccatactcgtcatgccgattagtatcgcatataccataacacacacctggaacttcggccagatcctgtgcgacatttggctctcttcagatatcacgtgttgtactgcatcaattttgcacttatgtgttattgccttggatcgttattgggccatcacagacgcgcttgaatactctaagagaaggacagccggacatgctgctaccatgattgcaatagtgtgggccatcagcatctgcatttcaatccctccgctgttctggaggcaggcgaaagcacaggaagaaatgagcgactgcctggtgaacacctcacagatctcttacacgatttattccacctgcggtgcattttacattccctccgtactgcttattatcctttacggacggatttatagagctgcgaggaacagaattctcaatccaccttccctgtacggtaaacggtttacaaccgctcatctgattactggtagtgcaggcagcagcctgtgctctttaaatagttctttgcacgaaggccattcacattctgccggttccccactgttcttcaaccacgtaaagattaaactggcagactctgccctggagagaaaaaggatttccgctgccagggagcggaaggctacaaagatcctcgggatcatcctcggagcatttattatctgttggctgcccttttttgtggtatcccttgtgctcccaatctgcagagattcctgttggattcaccccgcactcttcgactttttcacttggctcgggtatctgaactcactaattaatcctattatctacacagtctttaatgaagagttccgccaggcctttcaaaaaatagttccattccggaaggcctcgtag

SEQ ID NO: 212744 - DNA, 1098 bp, Artificial Sequence
  Description of Artificial Sequence: Synthetic coding sequence
atgaacattacaaactgcacgacagaggccagcatggctatccggccaaagactatcacagagaaaatgcttatctgtatgacactggtcgtcatcaccaccctgaccacactattgaatcttgccgtgatcatggccatcggcaccacgaaaaagctgcatcagcccgcaaactaccttatttgctccctagctgtgacagacctcttggtggccgtgcttgttatgccactgtcaatcatctatattgtcatggacaggtggaagctggggtactttttatgtgaggtctggctgagtgtcgacatgacatgctgcacgtgctccattctccacctctgcgtgattgcactcgaccgctactgggcaattactaatgcaatcgaatacgccaggaagcgcacagctaaaagagctgctctgatgatactgactgtctggactatttccatttttattagtatgcctccactattctggcgtagtcacaggagactctcaccaccacccagccagtgcaccatccagcatgatcacgtgatctacacaatttactctactctaggggcattttacatcccactgacattaattctcattctgtattaccgcatctatcacgccgctaagagcctgtaccagaaacggggatcctctcggcatctgtccaacaggtcaacagactcgcaaaattcgttcgcaagctgcaagctcacacaaactttttgcgtcagcgatttctctacctccgatcccaccaccgagtttgaaaagtttcacgcctctatccggattcctccattcgacaatgatctcgatcaccccggagaaaggcagcagatctcgagtacgcgtgaaagaaaagcggctaggatcctcggcctgatccttggggcattcattctgtcttggttgcctttttttattaaagaactgatcgttggcctcagtatttatacagtgagtagtgaagtcgccgacttcctgacttggttgggctatgtgaactcactgatcaacccactactgtatactagcttcaatgaggacttcaaactagccttcaaaaagcttatccgctgtagggagcatacttag

SEQ ID NO: 212745 - DNA, 1098 bp, Artificial Sequence
  Description of Artificial Sequence: Synthetic coding sequence
atgaatattaccaattgcactacagaggcctccatggctattcgccctaaaactatcaccgagaagatgttgatctgcatgacactagttgtgataacgacactgaccactctgctgaacttggcggtgattatggccatcgggaccaccaagaaacttcaccagcccgcaaattacctgatttgcagcctcgcggtgactgacttgctggtagccgtgcttgtgatgccactgagcatcatttatatcgtgatggatcgttggaaactggggtactttctctgcgaggtatggctttctgtggatatgacatgctgtacctgctcaattctgcacctgtgtgttattgccctggatcggtactgggctattactaatgctattgagtatgcacggaaacgaaccgcaaaaagagctgctctgatgatcttaactgtgtggactatttctatattcatttccatgcctccactgttctggaggtctcatcgtcgactctcgcctcccccttcccagtgcaccatacagcacgaccatgtgatttatacaatctactccactctgggggcattctacatacccctgacgcttatcctgatcctgtactatagaatctatcatgccgctaagagtttgtatcagaaaagagggagctctcggcatcttagcaatcgcagtactgactcgcagaacagctttgcctcatgtaagttgacccagaccttttgtgtctcggactttagcacctccgatcccacaactgagttcgaaaaatttcatgctagtattagaattccccctttcgataacgatctggaccaccctggcgaacgtcagcagatatctagcacccgcgagcgaaaggccgcacgcatcctcggattgatactgggagccttcattctgagctggctcccattctttatcaaggagctgattgtgggtctatccatttacacagtaagctcagaagtggctgacttcctgacgtggctgggttacgtgaacagcctgattaatcctctgttatatacctcgtttaatgaggactttaaacttgcgtttaagaagttgattcgctgtagggagcacacctag

SEQ ID NO: 212746 - DNA, 1101 bp, Artificial Sequence
  Description of Artificial Sequence: Synthetic coding sequence
atggattttctgaacagcagcgatcaaaacctcacctccgaggagctgctcaatcgcatgccatccaagatccttgtctccttgactctctccggcctcgcccttatgactacgacaatcaactcactggtgatcgcagcgatcatagtgacccgtaaattgcatcaccctgccaactatctgatttgctctctcgccgtgaccgatttcctcgtggccgtccttgtgatgccgttttccatcgtttatattgtgcgggagtcctggataatggggcaggtagtatgtgatatttggctgagtgtcgacattacatgctgtacgtgctccattctgcatctgagcgctattgctctggaccgataccgtgcaattacagacgcagttgaatatgcccgaaaaaggacacccaagcatgctggcatcatgattaccatcgtatggataattagcgtgttcatcagcatgcccccactcttttggagacaccagggcacctcacgagatgacgagtgcatcatcaagcatgaccacattgtttctactatctacagcacctttggcgctttctatatccctttggccctcatcctgatcctttattataagatctatagggccgctaagacactttaccataagaggcaagccagccggatcgccaaggaggaagtgaacggccaggtgcttttagagtctggtgaaaagtccacaaagagcgtgagcacgtcctatgtgctggaaaaaagtctctcagacccttctactgacttcgacaagatccactctactgtgagatcacttcgatcagaattcaagcacgagaagtcatggaggcggcagaagatctccgggactcgtgagcggaaggcggctaccaccctaggccttattctgggggcttttgtcatttgttggcttcccttcttcgtgaaggagctggtcgttaacgtatgcgacaagtgcaagatttctgaagagatgtctaactttctggcatggttggggtaccttaatagcctgattaaccccctgatctacacaatcttcaacgaagacttcaagaaggcatttcaaaagcttgtgcgctgcagatgttag

SEQ ID NO: 212747 - DNA, 1416 bp, Artificial Sequence
  Description of Artificial Sequence: Synthetic coding sequence
atggacattctgtgtgaggaaaatacttctctgagttcaacaacgaattccctgatgcagctgaacgatgatacccgattgtatagcaacgactttaattccggcgaggccaatacctctgatgcctttaactggaccgtcgactctgaaaacagaaccaatctatcatgcgaaggctgtctttctccaagctgtctgagccttctgcacctgcaagagaagaactggtccgcgctgcttaccgctgtggtgatcattttgactatcgctggcaacatactggtaatcatggcagtgagtttggaaaagaagctgcaaaacgccacgaactacttcctgatgagtctagcgatcgccgacatgctgttaggctttctagttatgccggttagcatgctaacaattctttacggctacaggtggccgcttccgtccaaattatgcgcggtttggatttacttagatgttctattctcaacagccagcattatgcacctctgtgccattagccttgataggtacgtcgctattcaaaatccaatacaccacagtcgattcaacagccggactaaagcatttctaaagatcatagcggtgtggaccatttctgttggcatctctatgccaatccctgtgtttggattacaagatgacagtaaggtgtttaaagaaggcagctgcctcctcgctgatgacaactttgtgcttatcggatctttcgtctctttctttatcccattgactatcatggtgattacatatttcctgacaatcaagtccctgcaaaaagaggctacactgtgtgtgagcgaccttggcacccgtgctaagctggcatcctttagcttccttcctcagtctagtctgagctcagaaaagcttttccagagaagtatccatagagagcctgggagctatactggacgcaggacaatgcagagtatctccaatgagcaaaaggcctgcaaagtgctggggattgtgttctttctgtttgtggtaatgtggtgcccgttcttcattacgaacattatggccgtcatttgcaaggagtcttgcaacgaggatgtgatcggagctctgctgaacgtcttcgtatggattggatacttgtcctccgccgttaacccgctggtttataccttatttaacaagacgtaccgttcggcgttctcccgctatatccaatgtcagtataaagagaataaaaagcccctacagctgatactcgttaatacaatccccgctctggcctataagagtagtcagctacaaatgggccaaaaaaagaattccaaacaggatgctaaaacgacggacaacgactgtagcatggtagccctgggaaagcagcatagtgaagaggcctcaaaggataatagcgatggcgtgaacgagaaggtgtcttgcgtgtag

SEQ ID NO: 212748 - DNA, 1416 bp, Artificial Sequence
  Description of Artificial Sequence: Synthetic coding sequence
atggatattctgtgcgaggagaatacctcactgtcctccacaacaaacagtctgatgcaactgaacgacgacaccagactatattcaaatgattttaactctggcgaggccaacacctcggacgctttcaactggactgtggattctgaaaaccggacaaacctgtcctgcgaaggttgcttgtccccttcatgcctaagtcttctacaccttcaggagaagaattggtccgcgctgctcaccgctgtggttattattttaaccatcgctgggaatattctggttatcatggccgtcagcctagaaaagaagctccaaaatgccactaattatttcctcatgtcgttagccatagccgatatgctgctaggcttccttgttatgcctgtgtccatgctgactattttgtacggatacaggtggcctttacctagcaaactgtgtgccgtctggatctatttggatgttctttttagcactgcgagcataatgcacctatgcgcgatctcgctcgatcggtacgtcgccatacagaatcctatccaccattctcgttttaatagcaggactaaggcttttctcaaaattatagccgtttggaccatttctgtcggcatttccatgccaatcccggtgtttggtttacaggatgacagtaaggtattcaaggaggggtcatgcctgctcgccgatgacaattttgtgcttattggatcattcgtgtctttctttatccctcttaccatcatggtgattacgtactttctcacaattaagagcctgcagaaagaagccaccctgtgtgtgtcagatctgggaacacgagccaagcttgccagcttttccttcttgccacagtcatccctgtccagcgagaagctgtttcagagatccattcacagggagcctgggtcttatacagggaggcggacgatgcagtccatttctaatgagcagaaagcctgcaaagtcctaggtatcgtgttttttctgttcgtggtgatgtggtgccctttcttcattacaaatatcatggcagtgatttgcaaggaaagctgcaacgaggacgttatcggagcgctgctgaacgttttcgtgtggattggctacctatcctctgccgtgaacccccttgtgtataccctctttaataagacttatagatccgccttctctcgctatattcaatgccagtataaggagaataagaaacccttacagctgattctggtgaacaccattccagcgctcgcctataagtcaagtcagcttcagatgggacagaagaaaaactccaaacaggatgctaaaacaacagataacgattgtagcatggtggctttaggcaaacaacactcagaggaagcgagtaaggataacagcgacggtgttaacgagaaggtgagctgcgtctag

SEQ ID NO: 212749 - DNA, 1164 bp, Artificial Sequence
  Description of Artificial Sequence: Synthetic coding sequence
atgcagtttctcaagagtgccaagcagaagccgaactattaccacataatgctggtcgaggaccaagaggagggtacactccatcagtttaattattgcgagaggtgctcagagagccagaacaataagtgtatctcatgcgtggatcccgaggataaatggtaccgctggcctctgccctcgaaattgtgtgcggtgtggatttacctggacgtactgtttagcaccgcgagcatcatgcacctgtgcgcaatctccctggacaggtacgtggcgattcaaaacccgatccaccattcccggtttaactcccggactaaggctttcctgaaaatcatcgcagtatggactatttccgtcggaatatctatgcccatccctgtgtttgggttgcaggatgactcaaaagtgttcaaggagggctcctgtttgctggctgacgacaacttcgtcctcatagggtcctttgtctccttcttcatccctctaaccatcatggttatcacttacttcctcaccattaagagtttgcagaaagaggcgacactgtgcgtctccgatctgggaacacgcgcaaaactcgcgagtttttccttcctgccgcaatcctcgctcagcagcgagaaactgttccagcgttctatacatagagagcccggtagttataccggccgacggactatgcaatccatcagtaatgagcagaaggcctgtaaggtgctgggcatcgtgttctttctgtttgtggtaatgtggtgcccatttttcatcaccaacatcatggcggtgatatgcaaggaaagctgcaatgaggacgtgattggagccctgcttaacgtcttcgtctggattggctatctcagcagcgccgtcaacccactggtgtacactctatttaataagacatatcgcagcgccttttccaggtatatccagtgccagtacaaagaaaataaaaaacccctgcagctaatcttagtgaatactatccccgctttggcttacaagtcctcccaactccagatgggccagaagaagaattctaagcaggatgctaagaccaccgataatgactgttccatggtggcattgggcaaacagcattctgaggaggcctccaaggacaatagcgacggtgtgaatgaaaaagttagctgcgtgtag

SEQ ID NO: 212750 - DNA, 1446 bp, Artificial Sequence
  Description of Artificial Sequence: Synthetic coding sequence
atggccctcagttatagagtgtcggaattacagagcacaattcccgaacatattctgcaatccactttcgtccacgtaatcagcagtaattggagcggactacaaacagaaagcatcccagaggagatgaaacagattgtcgaggagcaaggaaacaaactgcactgggccgcactgctgattctgatggtaatcatccccacaatcggcggtaacacattagtgattctagctgtgtccttagagaagaaactccaatacgcaaccaattatttcctaatgtccctcgccgttgcggatttgctggttggactattcgtaatgccaattgctctgctgacaatcatgttcgaggccatgtggcccctgccgctggtgttgtgcccagcatggttgttcttagatgttttattcagcactgccagcataatgcacctttgtgccatcagcgtggaccgctacatcgcgattaagaagccaatccaggccaatcaatataacagccgggctacagcgtttattaagattaccgtggtgtggctcatatctattggaatcgccatccccgtgccaatcaagggcatagagacagatgtcgataatcccaataatatcacctgtgttttgacgaaggaaagattcggcgacttcatgctgttcggatctctggcggctttttttacccctctggcgatcatgatcgtgacctattttctcacaatccacgccctgcagaagaaggcctatcttgtgaagaataagccccctcaacgtcttacatggctgaccgtttccacggtgttccagagggatgagactccatgcagcagcccggaaaaggtggccatgctggacggctccagaaaggacaaagcgctgcccaattctggggacgaaactcttatgagaagaacttctacgataggcaagaaatccgttcagacaatctccaatgagcagcgggcttccaaagttttggggatcgtgttcttcctctttctgctgatgtggtgccctttctttatcaccaacatcacactggtactctgcgattcatgtaaccaaaccacattacagatgctgctggagattttcgtttggattggatacgtgagctcaggcgttaacccgctggtctatactcttttcaataaaacctttcgggacgcatttggcaggtacataacttgcaactatcgggcaactaagagcgttaaaactctcagaaagcgttcttctaaaatctactttcgcaatcccatggcagagaacagcaaattcttcaagaaacatgggatccgcaatggcatcaatccggcaatgtaccagagtcccatgaggctgcgctctagtacgattcagtccagtagcataatcctgctcgatacactgttgctcacggagaacgagggtgataagactgaagaacaagtgtcctatgtgtag

SEQ ID NO: 212751 - DNA, 195 bp, Artificial Sequence
  Description of Artificial Sequence: Synthetic coding sequence
atggtaattattcccacgattgggggaaataccctggtcatcctagctgtcagcctcgaaaagaagcttcagtacgctaccaattacttcctgatgtctctggccgtagctgacctcctcgttgggctcttcgtgatgcctatcgcactgctgaccattatgtttggaattgcaattcccgtgcctataaagtag

SEQ ID NO: 212752 - DNA, 1377 bp, Artificial Sequence
  Description of Artificial Sequence: Synthetic coding sequence
atggtgaatcttcgaaatgctgtgcacagcttcttggtgcaccttattggcctgctcgtttggcagtgcgatatctctgtgtcccctgttgccgcaattgtgaccgacattttcaatactagcgacgggggacggtttaaatttccggacggggtgcagaactggccagcactgagcatcgtgattatcatcatcatgactattggtggtaatatactggtgattatggctgtaagtatggagaaaaagttacacaatgcaaccaactactttttgatgtccctcgctattgccgacatgctggtaggcctcctcgtgatgcccctctccctgctagccatactttacgactacgtctggcccctgcccaggtatctgtgcccggtgtggattagtctagatgtgttgttcagcactgcatcaatcatgcatttgtgcgcgattagtctcgaccgctacgttgccatccgaaatcctattgaacactcaaggtttaatagtcggactaaagccattatgaaaatcgcaatagtctgggccatctctatcggggtgtcagtgccaatcccggtgattggccttagggacgaagaaaaggttttcgtcaacaataccacctgcgttcttaatgatcctaatttcgtgctgattggttcgttcgtcgcattctttatccccctgactattatggtgatcacctattgcctgactatctacgtgctaaggagacaggcgcttatgctgcttcacggacatacagaggagccccctgggctatccctggacttcctgaagtgctgcaagcggaataccgccgaagaagagaatagtgccaatccgaaccaggaccaaaacgcacggcgtaggaagaagaaagaacggagacctaggggcacaatgcaggctatcaacaacgaacgcaaggcaagtaaggtgctggggattgtattcttcgtttttctcataatgtggtgcccgttcttcattactaatattctatccgtgctttgcgagaagtcctgtaatcagaagcttatggagaagctgctcaacgtttttgtttggataggatatgtatgctccgggattaaccccctggtctacactctattcaacaaaatctatcgtcgcgctttcagcaactacctgcgttgcaactataaggtcgagaagaagccccctgtaagacagattcctcgcgtcgccgcaaccgccctaagtggccgagagcttaatgtgaacatttacaggcatacgaacgagcctgtgatcgagaaagcttctgataacgagcccggaatagaaatgcaagttgaaaacttagagctccctgtcaatcccagctcggtcgtgagcgaacgcattagcagtgtgtag

SEQ ID NO: 212753 - DNA, 747 bp, Artificial Sequence
  Description of Artificial Sequence: Synthetic coding sequence
atggttaaccttcgcaatgccgtgcattcattcctggtacatctgatagggttgctggtctggcagtgcgacatctccgtctctcccgttgccgcaatagtgactgacattttcaatacaagtgacggcggtcgttttaagtttcctgacggtgtgcaaaactggccagccctgagcattgtcatcattattatcatgaccataggaggtaacattcttgttatcatggcagtttctatggagaaaaaactccacaacgcaactaattacttccttatgtccctcgcgattgccgacatgcttgttggtctgcttgtgatgccactgtccctgttagcaatactgtacgactacgtgtggccactgccaaggtatctctgcccagtttggataagcctggacgtgctcttctccaccgcaagcattatgcatttgtgtgcgatttccctggatcgttgcattagctcgtatccatgtgattggactgagggcaggagaaagggagttagagaacagcacgacgtgagggcccagcgccctaaatttaggtcgtattgggtccttagatccttcctgcatacggcggacgactacggcgattacgtcctccctgaccacctgagaagcgctcctacttcatttgacgtgacagctcgtccccataggggtacagcatggaccaagagcgggttccctgaagtacttcaggaagaatatggaagaggacgagagctctgcaaaccctag

SEQ ID NO: 212754 - DNA, 1377 bp, Artificial Sequence
  Description of Artificial Sequence: Synthetic coding sequence
atggttaacctgaggaatgccgtgcattctttcctggtgcacctcatcggcctgttagtgtggcagtgcgatatcagtgtaagcccggtcgcagctattgtgacagacatcttcaacacctccgacgggggaaggtttaagtttcctgatggagtccagaattggcccgcactttcaatcgtgatcatcataatcatgactattggcggaaacatcttggtcataatggcggtgtctatggagaagaagctgcacaacgctactaactatttcctcatgtccctggccattgctgacatgctggtgggcctcctggtcatgcctctctcacttctggccatcctgtacgattacgtgtggcctttgcccaggtatttgtgccccgtgtggatatccctagacgtgcttttctcaacggctagcatcatgcacctttgcgccattagccttgaccgctacgtggcgatacgcaacccgatcgagcattcccgctttaactcacgcacgaaagcaatcatgaaaatcgccattgtatgggccatctccattggagtttctgtgccgataccagtgattggactgcgcgacgaggaaaaggtgttcgtcaacaataccacatgtgtgttgaatgatcccaatttcgtgctcattggaagctttgttgcctttttcattccactgaccattatggtgattacctactgtctgacaatctacgtcttgcggagacaggccctcatgctgttgcacggccacactgaagagccgcctggactgagtctggactttttgaagtgctgcaagagaaacaccgcagaggaagaaaactcagccaatccaaatcaagaccaaaacgccagacggcgtaagaaaaaagagcggaggcctagggggactatgcaggctataaataacgaaaggaaggcttcaaaggttctgggcatcgtcttttttgtgttcctgataatgtggtgcccattctttataaccaacatactgtcagtcctgtgtgaaaaaagttgtaatcagaagctcatggaaaaactgctcaatgtgtttgtttggatcggatacgtctgtagcggaatcaacccactcgtgtatacgctgttcaacaagatctacaggcgtgccttttccaattacctgcgttgcaactataaggtcgaaaaaaagccgcctgtccgacagattcctagggttgcagctaccgccctgagtggaagggaactcaacgttaatatatacagacacacgaatgaaccagtaatcgaaaaggcttccgacaacgaaccaggtatcgagatgcaggtggaaaacttggaactgcccgtcaaccctagctctgtggtttcggaaaggatctcctctgtgtag

SEQ ID NO: 212755 - DNA, 840 bp, Artificial Sequence
  Description of Artificial Sequence: Synthetic coding sequence
atggccagtatgagtattgtgaaagcaacctcgaacacaatctcccaatgcggatggagtgcttctgccaactggacgcccagcatttcaccaagcatggacaggggggaaaggagtccgagcgccctcagcccgacccaagtagcaattcgtcgcaggtgcaggccatccccctacgtggtgaactttctcgtgccaagcggcattcttattgccattgacgcactatccttctaccttcctctggagtccggtaattgtgctccctttaagatgacagtcttactgggatacagtgtgttccttctgatgatgaacgacctgctccctgccacatcgacatcatcccacgcgtctctcgtaagacctcatccctctcgagaccagaagaggggcgtctatttcgctctgtgtttgagcctaatggttgggtccctgctcgagaccattttcatcactcacttgctgcacgtcgccaccactcagcctttaccattacctcggtggctgcacagtctcttgctgcactgtacgggacagggaagatgttgtccaaccgcaccgcagaagggtaataaggggcctggcctgactccaacccacctcccgggtgtcaaagagcctgaagttagtgctggccagatgcccggaccaggcgaagcagagctgacaggtggctctgagtggacgagggctcagcgggaacacgaagcccagaagcagcattcggtggaactgtgggtgcagttcagccatgccatggacgccttgctgttccgcttgtatctcctgtttatggcatcgtccattattacagttatttgcttgtggaatacctag

SEQ ID NO: 212756 - DNA, 1365 bp, Artificial Sequence
  Description of Artificial Sequence: Synthetic coding sequence
atgcagaaacatagcccgggaccacccgctctcgctctgcttagtcagtcactcctgaccacaggcaatggggatactctcattatcaactgtcctgggttcggccagcatcgggtagacccggctgcattccaagccgtgtttgataggaaggcaataggcccagttacgaattatagtgtggctactcatgtgaacatctcattcactctgtccgcaatctggaattgttattcccgcatccacactttcaattgccatcatgcacgaccctggcacaaccaatttgtgcagtggaaccctgacgaatgcggtggcattaagaaatcgggaatggctacggagaatctttggctctcagacgtgtttatcgaggaatccgtcgaccagactccagctggcttaatggcttcaatgagcatagtaaaggctacttccaacacaatctcccagtgcggctggtccgctagcgccaattggaccccctctataagtccatccatggatcgggctcgagcctggcggaggatgtccaggtcgtttcagattcaccaccggacaagttttagaacgcgacgtgagtgggttctgctgggaattcaaaagcgtaccatcaaagtcacagtagcaacaaatcagtatgaacaggcgatctttcatgtcgccatacggaggagatgcagacctagcccttatgtggtgaactttctcgtgccttcagggatccttatcgctattgatgccctgagtttttatctgccattggaatctggtaattgcgccccattcaagatgaccgtgttactcggatattcagttttcttacttatgatgaacgacctcttaccagctacatcaacttcttctcacgcgtctttggtggcccctctggctcttatgcaaaccccactgcccgctggcgtgtattttgcactgtgccttagcctgatggtgggatccctcttagagaccatctttattactcatctgttgcacgtggcgactacccagcccctgccactgcccagatggctccacagcttgcttctgcactgcactgggcaggggaggtgctgtcccaccgctccgcagaaaggtaataaaggccctggactgacacccacacacttgcccggagtcaaggaacctgaggtaagtgctgggcagatgcctgggccaggggaggcggaattaaccgggggatcggagtggactcgtgctcagcgagaacatgaagcccaaaaacagcacagcgtcgagctatgggtacagtttagccacgccatggatgctttattgttccgtctttatctgctgttcatggcctcatcaattataacagtgatatgtctgtggaacacctag

SEQ ID NO: 212757 - DNA, 1215 bp, Artificial Sequence
  Description of Artificial Sequence: Synthetic coding sequence
atggagagaggctggtttcatggcaaaggctttttgctggggttcatccttcacctgctgcttcaggatagccacttgcagctagtgacaagctttctgtggctaaacatgtggaaccccgacgagtgcggaggcatcaagaaatccggcatggctactgagaatctttggttatccgacgttttcattgaagagagcgtggatcagacccccgctggtctgatggccagtatgtcaattgttaaggccacaagcaataccatatcccagtgcggctggtcggcatcagccaactggacaccctctatctctcctagcatggataggggtgaaagatctccctccgctctcagtccaacacaggttacacgcgcatggcgcaggatgtcgcgctcctttcagatccatcaccggacttcctttagaacccggagggaatgggtccttctgggtatccagaagaggaccatcaaggtcactgtggcaactaatcagtacgaacaggccattttccatgtagcaattcgcaggcgctgcaggcctagcccctatgtagtcaattttttagtcccgagcggaattctgattgcgattgatgccctgtctttttacctgccactggaatcggggaattgcgcacccttcaagatgacagttctcctgggctattctgtcttcctgttgatgatgaatgacctgcttccagcgacttcaacatcttctcacgcgtctctggttcggccacatcctagtcgggatcagaagcgcggagtttacttcgcattgtgcctctcactaatggtgggcagtctgctagaaactattttcatcacccacctgctgcatgttgccacaactcagccgctgcccctaccccgatggctccattcgcttttgttgcattgcacagggcaaggaagatgctgtcccactgctccgcagaagggtaacaagggcccaggactaacacctacccatctccccggagttaaagaacctgaggtttctgctggtcagatgccaggaccaggagaggccgaactcacaggtgggtctgaatggactcgagctcaaagggagcatgaggctcagaagcaacattcagtggagctttgggttcaatttagccacgctatggatgccctcctgttcagactctatctcctatttatggctagttcaataatcacagtcatatgtctctggaacacttag

SEQ ID NO: 212758 - DNA, 702 bp, Artificial Sequence
  Description of Artificial Sequence: Synthetic coding sequence
atggtggcaatccgacgtaggtgcaggccttctccatacgtggtgaactttttggtgccatctgggattctgatcgcaatagatgcactgagcttttatctgcccctcgaaagtggtaattgtgctcctttcaagatgaccgtgctgctgggttacagtgttttcctgctgatgatgaatgacttgctccccgcaacatccacatcctcccacgcctcattggttaggccgcacccgagccgggatcaaaaaagaggcgtgtacttcgccctctgcttatcactgatggtcggttcactgctggagacaatctttataactcacctcctgcacgtagcaaccacccagccacttccactgcctaggtggctgcactccctcctgctccactgcactggccagggaagatgctgtcctacagctccccagaaaggcaacaaaggtcctggattgacacctacgcacctccccggtgtgaaagaacctgaggtgagcgcaggccagatgcctggcccaggggaggctgagctcacaggaggaagcgagtggaccagggcccagcgtgagcatgaggcccaaaaacaacactcagtagagctctgggtgcagttcagtcacgcaatggatgccctactttttcggctgtatctcctttttatggcttcctccattattacagttatttgcctgtggaacacttag

SEQ ID NO: 212759 - DNA, 1344 bp, Artificial Sequence
  Description of Artificial Sequence: Synthetic coding sequence
atggaggggggttggcccgctcggcaatccgccctgctgtgcttgaccgtcagccttctcttgcaggggcgaggggacgctttcacgattaattgctcaggcttcgaccaacatggagtcgatcctgctgtctttcaggctgtatttgacagaaaggcttttcggcctttcacaaattactccattccgacccgggtgaacatttcatttacactatcggcaatactgggagtggacgcacaactacagctcttaaccagcttcttatggatggatctggtgtgggacaaccctttcatcaattggaacccaaaagaatgcgtgggcatcaataaactcacagtgctagccgagaatctctggctgccagatatcttcattgtggagagcatggatgtggatcagaccccctcagggctgacagcctatatttcttcggaaggaagaatcaagtatgacaagccaatgcgagttacatcaatctgcaacttagacatcttttattttccctttgaccagcagaattgtaccttcaccttcagcagcttcctctacactgtggactccatgctgttggggatggacaaggaggtgtgggaaattaccgacacttctcgcaaagtgattcagactcagggcgagtgggagttgttaggcattaacaaggcaactcccaaaatgtcaatgggaaacaatctgtatgatcagattatgttctacgtggcgatccggagacgtccatctttgtatataattaatctgcttgttccatcctcatttttggtggctatcgacgccctatctttttatctgcccgctgagtccgaaaatcgggctccgttcaaaatcacgctgttgctgggctacaatgtgtttctcctgatgatgaatgatttgctccccgcttccggaacacccctaattagcgtgtattttgcactctgtttgtcattgatggtggtttcactgttagagactgtgtttataacttacctgctgcacgtcgccaccacccagccaccccctatgccaaggtggttgcacagcttgctgctccattgtacctccccgggtaggtgttgtccaactgctcctcagaaggggaataaagggctgggtctaacgctgactcaccttccaggcccaaaggaacctggagaacttgctggcaagaaacttgggcctagggaaactgagcccgacggagggagcggctggaccaaaacccagctcatggagttatgggtgcagttctcccacgccatggacacgctgctgttccggctttatctcttgtttatggcctccagcatcctgactgtcatcgttctgtggaacacgtag

SEQ ID NO: 212760 - DNA, 1416 bp, Artificial Sequence
  Description of Artificial Sequence: Synthetic coding sequence
atgttagccttcatccttagtcgggctacacccaggcccgcactgggccctctgtcctatcgggaacacagagttgcgctcctgcacctgactcacagcatgtctacaactggtaggggtgtcactttcactataaactgcagcgggttcggacagcatggggctgacccaacggccttgaattcagtgttcaatagaaagccatttcgaccggtaacaaacatctccgtcccgacgcaagtgaatatttcttttgcaatgagtgccattctggatgttaatgagcagttgcacctcctcagcagctttctgtggcttgagatggtttgggacaaccccttcatatcatggaacccagaggagtgtgagggcatcacgaagatgagcatggctgcaaagaatctttggttgccggacatctttatcatagagctgatggacgtggataagacacctaagggattgacagcttatgtgtcaaacgagggacgcatccggtacaaaaagccgatgaaagtggactcaatttgcaacctagatatcttctattttccatttgatcagcagaactgcacattaaccttctccagcttcctgtacactgttgattccatgttgctggatatggaaaaggaggtgtgggagataacggatgcaagtagaaatattctgcaaacccatggagaatgggaactactgggtctcagcaaggccacagccaaactgtcccgaggcggtaacctgtacgatcagattgttttctacgtcgcgatcaggaggcgcccttcattgtacgtcatcaacctcctggtaccctcaggattcctggttgccatagatgctctttctttttacctgccggttaagtcagggaacagggtgccattcaagataaccttgttgctgggttataacgtgtttttattgatgatgtccgacctgcttcccacttccggaacccccctgattggagtgtacttcgccctatgcctgtctctcatggtgggatccctgctcgaaaccatcttcatcacccatctcttgcatgtggccactacccagcctccacctctcccaaggtggctgcactcattgttgttacattgcaactcacccggacgctgttgccccactgcacctcagaaagagaacaagggccctggcttaacacccacgcatctccccggagtcaaagagcctgaggttagcgctggtcagatgccagggcctgctgaagccgaactgaccgggggaagtgaatggacccgcgcacagcgcgagcacgaggcccagaagcagcatagtgtggaactgtggcttcagttttcacacgccatggacgcgatgctgttccgcctgtacctgctgttcatggctagcagcatcattaccgtgatatgcctgtggaatacctag

SEQ ID NO: 212761 - DNA, 1371 bp, Artificial Sequence
  Description of Artificial Sequence: Synthetic coding sequence
atggagggatcgtggtttcatcggaagcgattcagtttttatctgcttctgggatttttgttgcagggccgtggggtgactttcacaataaattgctccggtttcggccagcatggtgccgaccctactgctctcaattccgtgttcaatagaaagccattcaggcctgtgactaacatttcagttccaacacaggtaaatatatcctttgccatgtcagccatcttagatgtcaacgaacaacttcatctcctgtcatcctttctatggctggaaatggtctgggataacccattcatcagctggaaccccgaggaatgcgaaggcattaccaaaatgtctatggcagcgaagaacttgtggctgcctgacatctttatcatagaacttatggacgtggataagactcccaagggccttaccgcctacgtgagtaacgagggtcggatcaggtacaaaaaacctatgaaggtggattcgatctgtaatctcgatatcttctacttcccatttgaccagcaaaattgtaccctaaccttctcctccttcttatacaccgtcgacagcatgcttctggatatggagaaggaggtttgggaaatcactgacgcgtccaggaacattctgcagacgcatggagaatgggagctgctgggtttatccaaggccacggccaagctgtcccgcggaggcaatctctacgatcaaatcgtcttttatgtggcaattcggagaaggccctccctgtacgttattaatcttctggtgccctctgggtttctggtcgcgattgacgcattgtcattctatctgccagtcaagagcggtaaccgggtgccttttaagatcacattgctccttggatataacgtgtttctgcttatgatgtccgacctgctacctacatctggcacacctctaattggggtgtactttgccctgtgcctgtcgctaatggtaggaagcttgctcgagacgattttcattacccacctgcttcacgtggccactacacagccaccgcctctcccccgttggctgcactcgctgctgctacactgtaattccccaggacgttgttgcccaacggcaccccaaaaggaaaacaagggacctggcttgacgccgactcatctgcctggagtgaaggaacctgaggtgagcgccggacagatgccaggccctgcagaggctgaactgaccggaggttccgaatggaccagagcacagagagagcacgaagcccagaagcagcactccgtcgaactctggctccagttctctcacgccatggatgctatgctcttccgcttgtatttgttattcatggcctcctcaataatcacggttatttgtctgtggaatacttag

SEQ ID NO: 212762 - DNA, 1326 bp, Artificial Sequence
  Description of Artificial Sequence: Synthetic coding sequence
atggaggggtcttggtttcataggaagcggttttccttctacttactgctcggctttctgctgcaagggagaggcgtgacattcacgataaactgctcagggtttggccagcacggcgcagatccaacagctttgaactcagtttttaacagaaaaccgttccggccagtgacaaacatatctgtccctactcaagtgaacataagttttgctatgagtgctatactggatgtggtctgggacaatccattcatcagctggaacccagaagagtgcgaagggattacaaaaatgtccatggccgcaaagaacctctggcttcctgatatcttcattatcgaactcatggatgtggataagacccctaaagggttgaccgcctatgtgtccaatgaaggcagaattcggtacaagaagcccatgaaagttgacagcatatgtaacctcgacattttttattttccttttgaccagcagaattgcactttgaccttcagctctttcctctatacagtcgactctatgttgcttgacatggaaaaagaagtctgggaaattacggacgcctctcgcaatattttacaaacacacggcgagtgggaactgcttggcctgagtaaagccactgcaaagctcagtcggggaggaaacctatacgatcagattgttttttatgtcgctatacgccgacgtccctccctgtacgtgataaacttgctggtgccaagcggcttccttgtagcaatcgacgccttatcattctacctgcccgtgaaatccggaaacagagtcccctttaagattaccctcctgctgggctataatgtgtttctcctcatgatgtcagacctcctgcccacatcaggtactccactgattggtgtgtacttcgcactgtgcctgtccctcatggttggctccttactcgaaactatctttataactcatcttctccacgtagccaccacacagccacctcctctccccagatggctccactccctgctcctccactgcaactcacctggcaggtgttgccctacggcccctcaaaaagagaataaggggcctggcctgacccctacccatctgcccggagtcaaagagccggaggtgagtgctggccagatgcccggtccggcagaagcagaacttacaggaggctcagagtggacacgcgctcagagagagcacgaagcacagaagcagcattcagtcgagctctggctccagttttcacatgccatggacgccatgcttttccggctatacctcctctttatggcgtcctcaattataaccgtgatttgtctttggaatacatag

SEQ ID NO: 212763 - DNA, 1371 bp, Artificial Sequence
  Description of Artificial Sequence: Synthetic coding sequence
atgctagctttcatcctctctcgagccactcccagaccggctttggggcctctcagctaccgggagcatcgggtggcactccttcacctaacgcactctatgagtacaacaggaagaggcgtgaccttcacaataaattgttcaggcttcgggcagcacggcgcagacccgaccgccctgaactccgtctttaataggaagccttttcggcctgtgacaaacatctcggtcccaacgcaggtaaacattagtttcgctatgtccgctatattggacgttgtttgggacaacccattcataagctggaacccagaagagtgtgagggtatcacaaagatgtctatggcagcaaagaatttatggcttccagacattttcattatcgaattgatggatgtcgataagacgcccaaaggccttaccgcatacgtttcaaatgagggccgaataaggtataaaaaacctatgaaagttgattctatctgcaatttggacattttttactttcctttcgatcagcagaactgtaccctgactttctcgtcattcctttacacagtggatagcatgctgctggacatggagaaggaggtctgggaaattactgatgccagcaggaacatactgcagacacatggggaatgggaattgctggggctgtcgaaagccaccgccaagttgagtcgaggcggaaatctctacgaccagatagtgttctatgtggcgatccgacggcgtccctccctgtatgtgattaaccttctggtcccaagcggttttctggtcgccatagacgcacttagcttttacttacctgtcaagtccggtaaccgagttcctttcaagataaccctgctcctcggttacaacgtcttccttctcatgatgtcagatttgttgcccaccagcggtactcccttgattggcgtgtattttgccctttgccttagtttgatggtggggagccttctggaaacaatttttataactcacctccttcacgtggccaccacccagcccccaccactccctagatggctccacagccttcttttgcattgcaactctcccggacggtgctgcccgaccgctccccagaaggagaataaggggccagggctgactccaacgcatttaccaggagtgaaagagcctgaagtgtccgctgggcaaatgcctgggcctgctgaggcagaacttactggtggttctgagtggaccagagcccagcgggagcacgaggcccagaagcagcactcggtggagctttggctgcagttctcacatgctatggacgcaatgctgttccggctttatctgttgtttatggcctcttctatcatcaccgttatttgcctgtggaatacatag

SEQ ID NO: 212764 - DNA, 1326 bp, Artificial Sequence
  Description of Artificial Sequence: Synthetic coding sequence
atgctttcatctgtgatggccccactgtgggcctgcatcctggtagccgcaggcatcctggctacagacacgcatcatccacaggattcagccttatatcatttgagcaagcaactgttgcaaaagtatcacaaggaggtgagaccagtttacaattggacgaaggcaacaacggtgtatctcgatctgtttgtccacgccattctcgatgttgatgccgagaaccagattttaaagacttccgtttggtaccaggaggtgtggaacgacgaatttctgagctggaactcctccatgttcgatgaaatccgtgagatctcactccccttgagcgctatttgggctcctgatatcatcattaatgaattcgtagatattgaaagataccctgacttaccatatgtctatgttaacagttctggaacaatcgagaattacaagcctattcaggtcgtgtccgcatgctcactggaaacatacgccttccctttcgatgttcaaaattgcagcttgaccttcaaatctatcctgcatactgtcgaagacgtagacttggcctttctgcgtagtcctgaggatatccaacatgacaaaaaggccttcctcaatgactccgagtgggagttactgagcgttagcagcacgtactcaatcctgcagtcaagtgcaggcggatttgctcagattcagtttaatgtagtgatgcgaagacatccacttgtttacgttgttagcctgttgattcctagcatctttctcatgctggttgacctggggtccttttacctgcctccaaattgtcgtgctcgtattgtctttaagaccagcgtcctggtcggttataccgtgttccgggttaatatgtccaaccaggtccctcggtcagtgggttctactcccttgatcggtcactttttcacaatttgcatggctttccttgtgctttcgcttgcgaagtcaatcgttcttgtgaaattccttcacgatgaacaaaggggaggccaagagcaaccttttttatgtcttagaggagacacagacgcagaccgaccaagagttgaaccacgagcccagcgcgctgtggtgaccgagtctagcctttacggcgaacacttggcccagcccggaacattaaaagaggtctggtcccagctgcagagtatttccaactacctgcagactcaggaccagaccgaccagcaggaagcggagtggctggttctcctgagccgttttgacagattgctgttccagagctacctgttcatgcttggtatatacaccatcacactatgctcactttgggccctctgggggggtgtttag

SEQ ID NO: 212765 - DNA, 1293 bp, Artificial Sequence
  Description of Artificial Sequence: Synthetic coding sequence
atgatcgtgtactttcctggcatactcgcaaccgacactcaccaccctcaggactccgcactgtaccacctttccaagcagctgctgcaaaagtatcataaagaagttcgcccagtctataattggacgaaggccaccaccgtctacctggacctgttcgtgcacgcaatcctggatgtcgacgccgagaaccaaatcctgaagacgtccgtttggtaccaagaagtatggaatgatgaatttctcagttggaattcctcgatgttcgacgagattcgggaaatcagcctaccactgtcagctatctgggccccagatatcattattaacgagttcgtggatatcgagcggtatccagacctgccttatgtgtacgtgaatagctccgggacaatcgaaaactacaaacctatccaggtggtttccgcttgctccctcgagacatacgccttcccatttgatgtgcagaactgcagcctgacgttcaagtccattttgcataccgtcgaggatgtggatttggccttcctacggtctccagaggacatccagcacgataagaaagcctttctcaatgattctgaatgggaactgctttctgttagctcaacatatagcatcctccagagcagcgcgggtggcttcgcacaaattcagtttaatgtcgtcatgagacgccatcctcttgtctatgtcgttagtctgctcataccgtctatattcctgatgctcgtggaccttggctctttctatctcccgcctaattgccgggctcgcattgtgttcaagacctccgtgctggtaggctacaccgtatttagagtgaatatgagtaatcaggtgcctcgaagcgttggctctacgccattgattggacactttttcacaatctgcatggcattccttgtcctgtccttggcgaaaagcatcgtgcttgtcaagttcctgcatgatgaacagcggggtggtcaagagcagccgttcctgtgtctaaggggggataccgacgctgatcgccctagggtggagcctagggctcagagggctgttgtcacggaatcctccttatatggcgagcacctggcacaacctgggacactcaaggaggtgtggtcccagttacagtcgatctcaaactacctgcagacccaggatcagaccgatcagcaggaggccgagtggctcgtcttattatcacggttcgatagactcctcttccagagctatctctttatgctcggcatttatactattaccttgtgcagcctttgggctctgtggggcggagtttag

SEQ ID NO: 212766 - DNA, 528 bp, Artificial Sequence
  Description of Artificial Sequence: Synthetic coding sequence
tgagccgagaaccagatcttgaagactagcgtctggtatcaggaagtatggaacgacgaattcctgagttggaattcttctatgttcgacgaaataagggaaatctcactcccgctgagtgccatctgggccccagacattatcatcaacgagttcgtcgatattgagcggtaccccgatttaccctatgtgtatgtgaatagttcagggacaattgagaattacaagccaatccaggtcgtctccgcctgtagcctggagacctacgcattcccatttgacgtgcagaattgtagtctgacattcaagagcattctccacaccgtcgaagatgttgacctggcctttcttaggagccctgaggacatacagcacgacaaaaaagcttttctgaacgattctgagtgggagctgctcagcgtaagttcaacatatagtatcttacagtccagtgcagggggatttgctcagattcagttcaatggcactagtagtccttccgcctggccgtcttggttcagtgcttag

SEQ ID NO: 212767 - DNA, 1449 bp, Artificial Sequence
  Description of Artificial Sequence: Synthetic coding sequence
atgctggcatttatattatctagggccaccccacgccctgcgctcggcccactttcctatagggaacatcgtgtggctctactgcatctgacgcattccatgtctactaccggccgtggcgttacctttactattaattgtagtggctttgggcagcacggcgcagatcccactgctctgaacagtgtgtttaataggaagccatttcgccctgttactaacataagcgtgccaactcaggtgaacatatcgttcgccatgagcgccatcctggacgttgtctgggacaatccattcattagttggaaccccgaggaatgcgagggcataactaagatgtctatggcggcaaaaaacttatggctccccgatatctttatcatcgaactatgtgtgtctcgcgcaggccaacgggaagtgccgagtccagggagccatagggatcactccctgccactgggtcccttgatggacgtggacaaaacacccaaagggctcactgcttacgtcagcaatgaagggcgtatccgctataaaaaacccatgaaagtggattctatatgcaacctcgacatattttattttcccttcgatcagcaaaattgcacgctaacattctcgagttttttatataccgtcgattcaatgcttctcgatatggagaaagaggtttgggaaattactgatgcctcccggaatatcctgcaaacgcacggtgaatgggagctgctcggactgagtaaggctactgcaaaactgagtcggggaggtaacctctacgatcagattgtgttctatgtcgcaatccgacgacgccctagcctgtatgtaatcaatctgctggtgccaagtggtttccttgttgccattgacgcactcagcttttatcttcccgtcaaatccgggaaccgcgtcccattcaagataaccctgctccttggctacaacgtcttcctgctcatgatgtccgacctgcttcctacctcaggaacccctctgataggtgtgtatttcgcactttgcctgtccctgatggttggaagcctgctggagaccatcttcattacgcatctgctccacgtggcgactacccagcctcctcctctgccgcgttggcttcattcacttctccttcactgcaattcacctggtagatgttgccctactgccccacagaaggagaacaagggacctggtttgacgcccactcatctccctggcgtgaaggaacccgaagtttccgccggacaaatgcctgggccagctgaagctgagctgacaggcggatcggaatggacgcgcgctcagagggagcacgaggcacaaaaacaacatagtgtagagctgtggcttcaatttagtcatgccatggatgcaatgctcttccggctctacctgcttttcatggcttcctcaatcatcacggtcatctgcttgtggaacacctag

SEQ ID NO: 212768 - DNA, 1137 bp, Artificial Sequence
  Description of Artificial Sequence: Synthetic coding sequence
atggataagctcgacgccaacgtgtctagcgaagagggcttcggtagtgttgagaaagtggtactcctgactttcttatccacagtgattctaatggcaatcctgggaaacctcctcgtcatggtggcagtgtgctgggatcgccaacttaggaagataaaaaccaattatttcatcgtgtctctggcctttgcagacctcctggtatcggtgctcgtcatgcctttcggcgcaatcgaactggtccaggacatctggatctacggagaagtgttctgtcttgttagaacgagcctcgatgtcctgctgaccaccgcatccattttccacctctgctgcatctcccttgacaggtactacgctatttgctgccagccactggtgtataggaacaagatgacccctctgcgcatagcactgatgcttgggggatgctgggttatccccactttcatctcctttttaccaatcatgcaggggtggaataacatcggaataatcgacctcatagagaaacggaagttcaaccagaatagcaattctacctattgtgtgtttatggtgaataaaccgtatgctattacttgcagtgttgtcgcattttatatcccatttctgttgatggtgttagcctactacaggatttacgttacagcaaaggaacatgcacaccagatccagatgttgcaacgcgctggcgcttcctccgagtctcggcctcagagtgctgaccagcattcgactcatcggatgcgcaccgagaccaaggccgctaagacgctgtgcatcattatgggctgcttttgcctatgttgggcaccgtttttcgtgaccaacatagttgaccctttcattgattacacagttcccggtcaagtctggaccgcgttcctttggcttggctacatcaactctggcctcaatcctttcctgtacgcctttctcaacaagtcctttaggagggcgttcctcataatcctgtgttgcgacgatgagaggtatcgcaggccctccattctaggacagaccgtcccatgctccaccaccacaattaacggctcaactcatgtgctttccggatgcagccccgtctcatcatttcttctgttgttctgcaataggcccgtgcccgtgtag

SEQ ID NO: 212769 - DNA, 1164 bp, Artificial Sequence
  Description of Artificial Sequence: Synthetic coding sequence
atggacaagcttgatgcaaatgtctcctccgaggaagggttcggttccgttgagaaagtggtcctgttaacttttctcagcactgttattctgatggccattctgggaaacctgttggtaatggttgcggtgtgttgggaccgtcagcttcgaaagataaaaactaactactttatcgtgagtctggccttcgccgatctgttggtttccgtcctggtgatgccattcggggcaattgagctagttcaggatatttggatatacggcgaagtgttttgtcttgtgaggaccagcttagatgtgctacttacaaccgctagtatttttcatctctgctgtatttcccttgacagatattatgccatttgttgtcagcctttggtgtacagaaataagatgacccccctcagaatcgctctcatgcttggtgggtgttgggtgatacccaccttcatcagctttcttcccatcatgcagggttggaacaacataggcattatcgacttgattgagaagcgcaaatttaaccagaactctaacagcacctattgtgtgttcatggtaaataagccatacgcaattacatgtagcgtcgtggctttttacatcccatttttactcatggtactggcctactacaggatttacgtgacagccaaggagcacgcccaccaaatccagatgctgcaacgggctggcgcaagcagcgaatctcgaccgcagagcgctgaccagcatagcacccaccggatgcgcaccgagactaaggctgctaaaactctttgcattattatgggctgcttctgtctttgttgggcccctttctttgtaactaacatcgtggatcctttcatcgactatactgtcccaggacaagtgtggactgcattcttgtggttgggttatattaattcaggactcaatccatttttgtatgcgtttcttaacaaaagttttagaagagccttcctgatcatcttgtgctgcgatgacgagcgctatagacgtcccagcatcctcgggcagaccgtcccttgctccaccaccactatcaatgggtccactcacgtgctaagatacactgtgctacaccgcggacaccatcaggagctggagaagctacccatccacaatgatccagaatccctggaaagctgtttctag

SEQ ID NO: 212770 - DNA, 1287 bp, Artificial Sequence
  Description of Artificial Sequence: Synthetic coding sequence
atggataagttggatgcgaatgtttcgtccgaggagggattcgggagcgttgagaaggtcgtgttgctgacattcttaagcacggttatcctgatggcaattctggggaatcttctcgttatggtcgctgtctgctgggatagacagttgaggaagatcaagaccaattatttcattgtgtcgcttgctttcgcagatctcctcgtctccgtcctggtgatgccattcggagctattgaactcgtccaagacatctggatatacggggaagtcttttgcctcgtgaggaccagcctggatgtgcttttgacaaccgcctcaatcttccatctgtgctgtattagcctggaccgctattacgccatctgctgccagcctttagtttaccgcaataagatgacaccccttcgaatcgctcttatgctgggtggatgttgggtgatacctacattcatttccttcttgcccatcatgcagggatggaacaatatcggtattattgacctgatagaaaaacggaagtttaatcagaattccaatagtacgtattgcgtctttatggtgaataaaccgtacgcgattacttgtagcgtagtcgcgttctacattcccttcctgctaatggtcctggcttactatcgcatctatgtaacggcgaaggagcatgcccatcaaatccagatgctgcagcgtgcaggtgcttctagtgagtcgagacctcagtctgccgatcaacactctacccatcgaatgagaacggaaacaaaggccgctaaaacactgtgcatcattatggggtgtttctgtctgtgctgggccccatttttcgtgacaaatatcgtcgacccattcatcgattataccgtgccaggccaagtgtggacagccttcctctggctaggctacattaattccggccttaaccctttcctgtacgcgtttctgaacaagagctttcgcagggcttttctgatcatcctttgttgcgatgatgaaaggtaccgcaggccatcaattttgggccagaccgttccatgttcgactaccacaattaatggaagcacccacgtcctgcggactgattttctttttgacagggacatactagccagatactggacgaagcccgcacgtgccggaccattctccggcaccctgagcatcagatgcctcactgcgcgtaagcctgtcctcggcgatgccgtcgagtgtgggggacagtgggagagtcagtgccaccccccagctacttctccgctcgttgccgctcagccgtccgatacctag

SEQ ID NO: 212771 - DNA, 1209 bp, Artificial Sequence
  Description of Artificial Sequence: Synthetic coding sequence
atggacaagcttgacgccaacgtgagctcagaggaaggctttggaagtgtagaaaaagtagtgctcctcacgttcctgagtacagtgattctgatggcaatcctaggtaatctgctggtgatggtggccgtatgttgggacaggcagctcagaaaaatcaagacaaactatttcatcgtcagtcttgcctttgcagacctgcttgtgtccgtactggtcatgccctttggagccatcgagctagtacaagatatctggatctacggcgaagtgttctgtctggtgcgaacctcattggacgtcctcttgaccaccgcaagcattttccatctgtgttgtatcagcctcgaccggtactatgctatatgctgccagcctctcgtgtataggaataagatgactccgctgaggattgctctcatgctgggcggatgctgggtcattcccacttttatttcctttctccccattatgcaaggatggaataatattgggataatcgacctagagaggtctcttaaccagggtctggggcaagacttccacgccattgaaaaacgaaagttcaatcagaactccaatagtacctattgtgtgtttatggtaaataaaccctacgcgatcacctgttccgtcgttgctttctacatacccttcctgctgatggtgcttgcctattatcggatttatgtgactgcaaaggaacacgcccaccagatacagatgctgcaacgggctggcgcaagctccgagtctcgtccccagtccgccgaccaacattcaacgcatcggatgcggactgaaactaaagccgcaaagaccctgtgcattattatggggtgtttctgcctatgttgggcgccattcttcgttaccaatattgtggatccctttatcgattacaccgtacccggacaggtctggaccgcatttctctggctcgggtacatcaactcagggctgaatccatttctttacgcatttctgaacaagtcattcagacgagcttttctgataatcctgtgctgcgatgatgaacggtataggaggccttctatcctaggacagacagtaccttgttcaactacgaccatcaatggctcaacccacgtgctgagggacgctgttgaatgtggaggccagtgggaatcgcagtgccacccccctgccacgagccccctggtggctgcccagccttccgacacctag

SEQ ID NO: 212772 - DNA, 1167 bp, Artificial Sequence
  Description of Artificial Sequence: Synthetic coding sequence
atggacaagttggatgccaatgtgagctccgaggagggattcggctccgtggagaaggtggttctgctgactttcctcagtacagtcatcctgatggccatattgggtaatctcctggtgatggtagccgtttgttgggacaggcagctgagaaagatcaaaacgaattacttcattgtgtctctggcgttcgcggacttgctggtcagcgtgctggtgatgccatttggcgctatagagctcgttcaggacatttggatatacggtgaggtcttttgcttggttaggactagtctggatgtgctgttaaccacggcttcaattttccatttgtgctgcatctcactggatagatattacgcaatatgctgtcaacccctggtgtaccgcaacaaaatgacccccttgcggatagcgctgatgctcggaggttgttgggtgattccaacgttcatttcctttctgcctattatgcaaggctggaacaatattggaataatcgatctgatcgagaaaagaaagttcaatcaaaatagcaactcaacttattgtgtgtttatggttaacaaaccctacgccatcacgtgtagcgtcgtcgcattctacatcccctttttgctcatggtgctggcatactaccgaatctacgtaaccgctaaggaacacgcccaccagatccagatgctacaaagggcaggtgcttctagcgaatcacgccctcagagcgccgaccaacactctactcaccggatgcggaccgaaactaaagccgcaaaaacgttgtgtataattatgggttgtttttgtttgtgttgggccccattctttgtaaccaacattgtggatcctttcatagactacaccgtgcccggacaggtatggactgccttcttatggctggggtatatcaactctgggctaaacccctttctgtacgccttcctgaacaagtcctttcgacgagcatttctgatcatactgtgctgtgatgatgaaaggtaccgaaggccctctatccttgggcagaccgttccctgctctactactaccattaatggatccactcacgttctaagagatgctgtggagtgcgggggacagtgggagtcccaatgccatcccccagcgacttcaccactggtggccgcacagccctcagatacatag

SEQ ID NO: 212773 - DNA, 1083 bp, Artificial Sequence
  Description of Artificial Sequence: Synthetic coding sequence
atggacaagctggacgccaatgtgtcttccgaggagggctttggatctgtggagaaggttgtcctgctcaccttcctgagcaccgtcatcctgatggcaattttgggcaacctcctggtgatggtcgctgtgtgttgggataggcagctgcggaaaatcaaaacaaactacttcatcgtgagcctggcatttgccgacttgctggtgtcggtgttggtcatgcctttcggcgcaatcgagctcgttcaggacatttggatttacggagaagtattttgcctagtacgcacttcactcgacgtgttactgaccactgcctctatcttccatctgtgttgtattagcttagatagatattacgcaatttgttgtcagccgctggtgtacaggaataagatgaccccactgcggattgctctgatgttaggtggttgctgggtgatccctacttttatctcgttcctcccaatcatgcagggatggaataacatcggaatcattgatctgatagagaagaggaagtttaaccagaacagtaactccacctattgcgtttttatggtcaacaagccatatgctatcacttgctcagttgtggccttctacatcccattcctgctgatggtgctcgcttactatagaatctacgtgacagcgaaagaacacgcccatcagatccagatgctgcagcgggctggcgcatcaagcgaaagtcggccacaaagcgccgaccagcacagcacacacagaatgaggacagagactaaagctgcaaaaactctgtgcatcatcatggggtgcttctgcctatgctgggcccctttcttcgtgactaacattgtggatcctttcatcgattacaccgtgcccggtcaggtgtggacagcctttctctggctgggttatattaacagcggcctaaaccctttcctgtatgcattcctaaacaagagcttccgtcgcgctttcctgataattctatgctgtgacgacgagagataccgcagaccatctattctggggcagacagtgccatgctccactacaacaatcaacggctctacccacgtgctgcgcttctag

SEQ ID NO: 212774 - DNA, 1236 bp, Artificial Sequence
  Description of Artificial Sequence: Synthetic coding sequence
atggataagttggatgctaacgtgtcatcagaagaagggtttggctctgtggagaaggttgtgctgttaactttcttgagcaccgtgatcctgatggccatactgggtaacttactggtaatggtggccgtttgctgggaccggcagctgcgcaagattaaaacgaactatttcatagtgagcttagctttcgcggacttgttggtcagcgttctggtcatgccattcggcgctatcgagctggtgcaggatatttggatatatggggaggtattctgcctcgttcggacttccctggatgtgctgctaactaccgcctctattttccatctctgttgcatcagtttggacagatattatgccatctgctgtcagccactcgtttacagaaacaagatgaccccactcagaattgctctcatgttaggaggctgctgggtaatccccacctttatctcctttctgcctatcatgcagggctggaataatatcgggattattgacctcattgagaaaaggaagttcaatcaaaactcaaattcaacatattgcgtctttatggtgaataagccgtacgctattacgtgctcggttgtcgcattttacatcccatttctcctcatggtgctcgcatattaccgtatctatgtaaccgccaaagagcatgctcatcagatccagatgctacagagagccggagccagctccgagagccgcccacagtcagccgatcaacatagcacccatcgaatgcgcacagagaccaaagctgccaagaccctgtgcataattatggggtgcttctgcttgtgctgggctccctttttcgtaactaatattgttgatccttttatcgactatacggtgccaggtcaggtctggacggcttttctgtggctgggatacatcaattccgggctcaacccattcttgtatgctttccttaacaagagctttcggagggctttcctcattattctgtgttgcgatgatgaaaggtacaggcgcccatcaatcctgggccagactgtgccctgtagtacaactaccatcaacgggagcacccatgtactgagctcgggcaccgagactgacaggaaaaagttgtggaacaaagaggaaaagattgaccagaccattcagatgccaaagcgcaagaggaaaaaaaaagcctcccttagctatgaagacttaattctgctgggaaggaaatcctgctttcgagagggcaagtag

SEQ ID NO: 212775 - DNA, 1164 bp, Artificial Sequence
  Description of Artificial Sequence: Synthetic coding sequence
atggacaagttggatgccaacgtgtccagcgaagagggctttggttctgtagagaaagtggtgcttctgacctttctgagcacagtgattctcatggccatcctgggcaatttacttgtgatggtcgccgtgtgctgggacagacagctgagaaagatcaaaacaaactactttatagtgagtctggcctttgctgacttacttgtgagtgtgctagtgatgccctttggggctatcgagttggtccaggacatttggatctacggcgaagtattctgcctcgttaggacaagcctcgacgttctcctcaccaccgcctccatatttcacctgtgctgcatcagcctcgaccgatactacgcaatctgctgtcagccgttggtgtatcggaataagatgactccactgagaatcgccctgatgctcggcggttgttgggtcattcctactttcatttccttcctgcccatcatgcaggggtggaataacattgggataattgacctgatcgagaaaaggaaattcaatcagaattcgaacagtacatactgtgtttttatggtaaacaagccatatgccatcacttgttccgtagtagcgttttatattcctttcctcctgatggtgctcgcatactaccgcatctatgtgaccgcgaaggaacacgcgcaccagatccaaatgctccagcgagccggagcctcctctgagtcccggcctcagagtgccgaccagcatagcactcatcggatgagaacagagacaaaggccgcaaagacgctttgcattatcatgggatgtttctgtctgtgctgggcccctttctttgtgacaaacatcgtggatccatttattgattacacagtgcctggtcaagtgtggacagcattcttgtggctggggtacatcaacagcggtttgaatccattcctctatgccttcctgaataagtccttcagaagagcctttctgattattctttgctgtgacgatgagcggtatagaagacccagtattctgggacagacggtcccctgctccaccaccactatcaatgggtctactcacgtgcttcgttacactgtgctccataggggtcaccaccaagagctggagaagctcccgatccataacgatcccgagtcactggagtcttgtttctag

SEQ ID NO: 212776 - DNA, 1137 bp, Artificial Sequence
  Description of Artificial Sequence: Synthetic coding sequence
atggataaattggacgccaacgtgtcttcagaggaggggtttgggtccgtcgaaaaagtcgtcttattgacatttctctcaacggtaattctgatggccatcctcggtaatctcctggtgatggtcgccgtctgctgggatcgtcagctccggaaaattaagacgaattacttcatcgtttcactggcattcgctgacttactagtgtcagtgctagtaatgccattcggtgcaattgaattagtgcaagacatttggatttacggcgaagttttctgcttggtacgtacgtctctggacgtgcttctcactactgcctccatattccatctgtgctgcatctctctcgaccggtattacgccatctgttgccagcccctggtgtaccgtaataaaatgacccctctcagaatagctctgatgttgggagggtgctgggtgatccccacgttcattagtttcctgccaataatgcaggggtggaacaacataggtattatcgatctgatagagaagaggaaattcaaccagaattctaatagtacctactgcgttttcatggtgaacaaaccttatgcaataacatgctctgtcgtagccttttatatcccttttctcttgatggtcctggcttattaccggatttacgttacagctaaggaacatgcccaccagattcagatgcttcagcgagcaggggcttcttcagaatcaaggccccaaagcgccgaccagcatagcacccatcgtatgcgcacagagacaaaggcggcaaaaacactttgcatcattatgggctgcttttgcttgtgctgggctccattctttgtgaccaacattgtggatccatttattgactatactgttcctggtcaagtctggacggcttttctttggctcggctatattaacagcggtctgaacccatttttgtacgcttttctgaacaagagcttcaggcgtgccttcttgatcatcctgtgctgcgacgatgaacggtaccgccgtcctagtatcctgggccaaacagtaccttgctcaactactactatcaacggcagtacgcacgttctaagtggatgctctccagtcagctctttcttgctgctgttttgcaatcgccctgttcccgtctag

SEQ ID NO: 212777 - DNA, 1137 bp, Artificial Sequence
  Description of Artificial Sequence: Synthetic coding sequence
atggacaaactggacgctaacgtaagctctgaggaaggctttggctccgtggaaaaagtggtgcttctgacctttctcagcaccgtgatcctgatggcaatcctcggcaacctcctggtgatggtggcggtttgctgggaccgccagctccggaagatcaagaccaactatttcatcgtcagcctggctttcgccgatttgttggtgagcgtgctggtcatgcccttcggcgctatcgaactcgtgcaggatatctggatatatggggaggtcttctgtctggtgcgcacgtccctggatgtcctgctaaccactgcgagtattttccatctgtgttgcatcagtctcgatagatactacgcaatctgttgtcaacctctggtttataggaataaaatgaccccactgcggattgcactcatgttaggaggttgctgggtaatacctactttcatttcctttctgcctattatgcagggatggaacaatattgggataatcgatctcattgaaaagagaaagtttaatcagaatagtaacagtacttattgtgtcttcatggtgaacaaaccgtacgccattacctgttctgtggtggccttctatatcccatttcttctaatggtgctcgcgtactacaggatctatgtcacagcaaaagagcacgcccaccagattcaaatgttacagagagccggtgcatcatccgagtcgaggcctcagagtgccgatcagcattccacccacaggatgaggacggagactaaggctgctaaaaccctctgtatcatcatgggctgcttctgtctttgctgggcaccattttttgtaacaaatattgtagacccattcatcgattacacagtacctggccaggtgtggactgcattcctctggctggggtacattaactcgggcctgaacccattcctgtatgcttttctgaacaagtccttccgtcgggcatttctcatcatcttgtgttgtgacgatgagcgctatagacggccttctattctcggtcagactgtgccttgcagtaccactaccatcaacgggtccacacacgtactgtccggttgcagccccgtgagcagttttctgctgctcttctgcaacaggccagtacctgtctag

SEQ ID NO: 212778 - DNA, 1074 bp, Artificial Sequence
  Description of Artificial Sequence: Synthetic coding sequence
atggacctgccggtgaaccttacatcatttagcctctccacaccctcaccgcttgagactaaccatagccttgggaaggacgacctgcggccatcgagcccactgctatccgtctttggagtgcttatattgaccctgttagggttcctggttgccgctaccttcgcatggaaccttctggttctcgccacaatactcagagtacggacattccatcgggtgccacataatctcgtcgcctcgatggccgtatcagacgtcctggtcgcagcactcgtgatgcccctcagcctcgtccatgagctaagtggcaggagatggcagctcggcagacggctgtgtcaactgtggatcgcttgcgacgttctgtgctgtaccgcgtcaatttggaatgtgacagcaatagccctggaccgatactggtcaatcaccaggcacatggagtacaccttgcggacacgcaagtgcgtctctaacgtgatgattgcacttacatgggccctctccgctgtgatctctctcgcccctctgctgttcggttggggtgagacttactctgaagggagcgaagagtgtcaagtgtctcgggagccctcgtacgccgtgttcagcacagtgggcgcattttacctgcccctgtgtgtggtcctgtttgtgtattggaagatttacaaagcagccaaattccgagtgggcagccggaagacaaattcagtgtcacccatcagcgaagcagttgaggtgaaagactctgccaagcaaccgcagatggttttcacagttagacacgcgaccgttacctttcagcccgagggggacacctggcgcgaacagaaggaacaaagagcagccctcatggtggggattctcatcggagtctttgtactatgttggataccgttctttctaacagaactcatctcaccactgtgttcgtgcgacatcccagccatttggaagtccatcttcctgtggctgggctatagcaacagcttctttaatcctctgatctatactgcgttcaataagaactataacagtgcctttaagaactttttctccaggcagcactag

SEQ ID NO: 212779 - DNA, 1323 bp, Artificial Sequence
  Description of Artificial Sequence: Synthetic coding sequence
atggtcccggagcctggacctaccgccaatagcacaccggcttggggcgcagggcctccttccgccccaggaggtagcggatgggtggccgctgcactttgtgtcgtcatcgccctgactgccgcagcgaattctctactaatagcccttatctgtacccaacctgctctgaggaacacatctaatttttttctggtatcactgttcacctctgacctcatggtgggactcgttgttatgcctcccgctatgttgaacgctctgtatggaagatgggtcttagccagagggctgtgcctgctatggaccgcatttgacgtgatgtgctgctccgctagcatcctcaatttgtgtttgattagcttggaccgctacctccttatcctaagtcccctgcgttacaagctccgaatgacccctctgagagctctggcactcgtgctgggtgcctggtccctcgcggcactggcatccttcctgcctctgctgctaggatggcatgagctgggccacgccaggcccccagttcccggacagtgccgactgctagcctccctcccattcgtgctggtggcaagcggcctcacattctttctcccaagcggagccatctgcttcacctattgccgcatcctgctcgcagcccgtaagcaagcagttcaagtggctagtcttacgacagggatggccagtcaagctagcgagaccctccaggtgcctcgtacgcccagaccaggggtggaaagcgcagatagccgaagactcgctacgaaacattcaaggaaagcactcaaggcgtcactgaccctggggattttgttaggaatgttttttgtgacctggttaccattttttgtggccaacatcgtacaggctgtctgcgactgcatatcacctggcctattcgatgtgctcacttggctcggatattgtaacagcacaatgaatccaatcatataccccctgttcatgagggacttcaaacgggctttgggcaggttcttgccttgcccacgctgtcctagggagcggcaggcaagcttggccagccctagccttcgtacgagccacagcggtccacgtccagggctgtcattgcaacaggttctgcctttgcctctgcccccagacagtgatagcgatagtgacgctggctcggggggttcttcaggcttgcgcctgactgctcagctcctcctgcctggggaggccacccaggaccccccactgccaacacgggctgcagccgcagtgaacttttttaacatcgaccctgccgaacccgagcttaggccccatcccctgggaattcctactaactag

SEQ ID NO: 212780 - DNA, 1338 bp, Artificial Sequence
  Description of Artificial Sequence: Synthetic coding sequence
atgatggacgtgaattctagcggccgtccagatctgtacggacacctgcgctcctttttgttgcccgaagtcggtcggggactccctgaccttagtcccgacggaggcgctgaccctgtggctggatcctgggcaccccacctgctgagcgaggtcacggcgtcccccgctccaacgtgggatgctccaccagataacgcttccgggtgtggagaacagattaactatggtagagtcgaaaaggtggtgatagggtcaattcttacccttattactcttctgaccatagccggtaattgtttagtggtgatatcagtgtgctttgtgaagaaactgcgccaaccctccaattaccttattgtttccctggctctggcggatctgtccgtggcggtggcggttatgccgtttgtgtcagtgacagacctgatcgggggtaagtggatcttcggacattttttctgcaacgttttcatcgccatggacgtgatgtgttgcacagcttctatcatgactctgtgcgtaatttctatcgacagataccttggaattacacggcctctgacctatcctgtacggcagaacggaaaatgcatggctaaaatgatattgagtgtttggctgctgtcggcttcaatcacactgccccctctgtttggatgggcacagaatgtgaatgatgataaggtgtgcctgattagccaggactttgggtacaccatttatagcactgccgttgcattttatatccccatgtctgtcatgcttttcatgtactatcagatctataaagctgctagaaagtcggcggctaagcataaattccctgggttccccagggtcgagccggattcagtcattgcgctgaacggcatcgtcaaattgcagaaagaggttgaagagtgtgccaacctctctcgccttcttaaacatgaaagaaagaacatttctatctttaagagagagcagaaggccgcaaccacgctgggaatcattgtgggcgcatttactgtttgctggctgccttttttcctcttgtctaccgctcgaccatttatttgcggcacctcttgttcctgcatcccgttgtgggtcgaacgcacttttttatggttggggtacgcaaattctctgattaacccattcatatacgccttctttaaccgggacctgagaactacctatcgttccctcttgcaatgtcaatacaggaatattaaccggaagctttcagcagcagggatgcacgaggccctaaaactcgctgagcgcccagagaggcccgagttcgtgttacagaacgctgattactgtcgcaagaaagggcatgatagctag

SEQ ID NO: 212781 - DNA, 1440 bp, Artificial Sequence
  Description of Artificial Sequence: Synthetic coding sequence
atgatggacgtgaattccagcggtcgacctgatttgtacggccaccttaggagtttcttactccctgaggtaggcagagggctccctgacctgagtcctgacggaggcgctgatccagtggctgggtcatgggctcctcatttgctgtcggaagtgacagcaagtccagcgcctacatgggacgccccaccggataacgccagcggatgcggggaacagatcaattatggacgcgtcgagaaagtggtgatagggtcaatactgacactcattactctgctgaccattgctgggaattgtctggtggttatttcagtttgttttgtgaagaaattgaggcagccttctaactatctaatcgtaagccttgctctggccgacctttctgttgctgtggcagtcatgccctttgtgagcgtgaccgacctgatcggcggtaagtggatctttggtcactttttctgtaacgtgttcattgctatggacgttatgtgctgtactgcctccattatgaccctctgcgtgatatcaatcgatagatacctcggcatcactagaccactcacataccccgtgcgacagaacggtaagtgcatggctaagatgatattaagtgtctggcttctgtccgcgtctataacgttgccacccctgtttgggtgggcacagaacgtaaacgatgacaaggtatgcctgatcagccaggacttcggttataccatttatagcaccgccgttgccttctatatcccgatgagcgtgatgctcttcatgtattatcaaatttacaaagccgctcgaaaatccgcggcaaagcataaatttccgggtttcccccgagtagaaccggactccgtaattgccctgaacggcatcgtgaagctgcaaaaggaagtggaggaatgcgcaaatctatcaaggcttctcaaacacgagagaaaaaatatctccatcttcaagagagaacagaaggcagcgacgacactgggcattatcgtgggcgctttcaccgtgtgctggctcccgttctttctgttatctactgcacgacctttcatctgcggtacaagctgcagctgcatacctctgtgggttgagcggacttttttgtggttaggttatgctaatagtttgatcaatccttttatctacgcattcttcaatagagacctcagaactacatacagaagcctgctccagtgccagtatcgaaatattaacagaaaactgtctgcggcaggtatgcatgaggccctgaaactggctgaacggcctgaacggcctgaattcgtgcttcgcgcatgcacgcggagagtgcttctgcgaccggaaaaaagaccacccgtgtctgtttgggtgttgcagagccctgaccaccacaactggctggccgataagatgctgacaacagttgaaaagaaggtcatgattcatgattag

SEQ ID NO: 212782 - DNA, 1299 bp, Artificial Sequence
  Description of Artificial Sequence: Synthetic coding sequence
atgatggatgtgaattccagtgggagacctgatttatatggacacctgcgcagctttctacttcctgaagttggtcgtgggcttccagacttaagccctgatgggggagcagatcctgtcgcgggttcatgggccccacacctgttgtcggaggtgacagcaagtcctgctcccacttgggatgctcctcctgataatgccagcggatgcggggagcagatcaactatgggagagtagagaaggtggtcattggctccattcttacattaatcaccctcctgacaattgctggaaactgtttggtcgtcatctctgtctgtttcgtgaagaagttaagacaaccctccaattacctaattgtgagcctcgccctcgcggacctcagtgtcgctgttgccgtgatgccattcgtgtccgtgactgacttaataggtggtaagtggatcttcgggcattttttttgcaatgtgtttatcgcaatggatgtgatgtgctgtaccgcctccatcatgacactgtgtgtgattagcattgaccgctacttaggcattacacggccactgacgtaccctgtccgccagaatggcaaatgcatggccaaaatgatcctgtcagtctggctgctttccgcctccatcaccttacccccactgttcggttgggcacaaaatgttaatgacgacaaggtctgtctcatttcccaggattttggttatacgatctattcgacagcagttgccttctatattccaatgagtgttatgctgttcatgtattaccagatttataaggccgcaaggaagtccgctgctaaacacaagttccccggatttcctagggtcgaacccgattctgtgattgctcttaatggcatcgttaaactgcagaaagaggtggaggaatgtgccaacctatcgcgtcttctgaaacacgagcggaagaacatttccatctttaagcgtgagcaaaaagctgccactacactgggaatcatcgtgggcgctttcaccgtctgttggctgccattctttttgctgagcactgcacggcctttcatctgcggtacctcttgttcctgtataccactgtgggtagagaggacctttctgtggttggggtatgcaaactccctgatcaatcccttcatctacgctttcttcaatcgcgaccttaggacaacctacagatccctcctgcagtgccagtacagaaacatcaaccgaaagttgtcagccgcagggatgcatgaagcactgaaacttgccgaaagacccgagcgccctgagttcgtcctgtag

SEQ ID NO: 212783 - DNA, 1440 bp, Artificial Sequence
  Description of Artificial Sequence: Synthetic coding sequence
atgatggacgttaatagcagcggaaggcctgatctgtacggccacctgagaagtttccttctgccagaagtcggacggggactgcccgacctctcccccgatggaggtgccgatccagtggccggatcatgggcacctcaccttctgtctgaagtgaccgcctcaccagcaccgacttgggacgctcctcctgataatgcctccggctgtggagaacagattaattacgggcgagtggaaaaggtcgtgatcggatctatactaacactgatcactctgctgaccattgcaggtaattgcctagtggtgattagtgtgtgttttgtgaaaaaactccggcagccaagtaactatctgatagtgtctcttgctctggccgacctttctgtggccgtggccgtgatgcctttcgtcagcgtgacggatttgataggcggaaaatggatcttcgggcacttcttttgcaacgtgttcatcgctatggatgttatgtgctgcacagcctccattatgacgctgtgcgtgatatccattgacagatacctggggataactcggcctctgacctaccccgtgcggcagaacggtaagtgcatggcgaagatgatcctgagcgtgtggctgctcagcgcatccatcaccttgccacccctgttcggttgggctcaaaacgtaaacgatgataaagtgtgtctgatttcacaggacttcggctacacaatttacagtacagccgtggctttttacattccgatgagcgtcatgctgtttatgtattatcagatctataaggccgctcgcaagtcagccgcaaagcacaagttccctggcttcccaagagtcgagcccgactctgtcatagccctcaacggcatagtgaagttgcagaaggaggttgaggagtgcgccaatctgtcgaggttgcttaagcatgagagaaagaacattagcatctttaagagagaacagaaggctgcgaccactctcggtatcattgtgggggcttttaccgtctgctggctcccattcttcctcttgagtacagctaggccctttatctgtggaaccagttgttcctgtatcccactgtgggtcgaacggaccttcctgtggttgggatatgcaaacagtctcataaatccatttatatatgcttttttcaatagggatcttcggaccacctaccgcagcctcctgcagtgccaatacaggaatattaaccggaaactcagtgcagcgggtatgcatgaagcgctaaagctcgctgaacgaccagagcggccagagttcgtactgatcacccgcacatcaggtgtccatcaggcgctggagaacttcccttgggggaacgaagttaatcgttggcggaagtcttgtgagtatttctgtaccgataaaatgctgaccaccgtggaaaagaaggtcatgatacacgactag

SEQ ID NO: 212784 - DNA, 2460 bp, Artificial Sequence
  Description of Artificial Sequence: Synthetic coding sequence
gggatgctggatgggccaagcgccatgacccggttttgcaatttaattgcaagcgagcccgatatcgctaaggtcccactgtgcattgattcgtccaacttcgctgtgatagaggctgggctcaagtgctgccagggcaagtgcatcgtcaactctattagtcttaaggagggagaagctaccgagactgacaccaagattagagtctgcacacgcgcttatcaccttttagtgaaaaaactgggattcaaccccaacgatattatatttgatccaaacatactgacaatcgggactgggatggaggagcataatttatatgctataaattttatacatgcgacaaaagtgatcaaggagactctccccggtgctcgcatttcgggcggtctgtccaatttgtccttcagcttcagggggatggaggccatcagagaagccatgcacggcgtctttctctaccatgccattaaatctggcatggatatgggcatcgttaacgccggtaacctgccagtttatgacgatatccacaaagagctgctgcaactgtgcgaagatctgatctggaataaggatccggaggccacggagaagctcctccgatatgcccagactcagggaacagggggaaagaaggtgatccagacagatgaatggaggaacgggccagtagaggaacggctcgaatatgccctggtgaagggcattgagaagcatatcatcgaggacactgaggaagcacggctgaaccagaaaaaatatcctagacctctgaatatcatagagggacccctgatgaacggcatgaaaatcgtgggagacctgttcggcgctggcaagatgttcctcccccaggtcattaagtccgccagggtaatgaagaaagcagtaggtcacctgattccgttcatggagaaggagagagaagagaccagagtactcaatggcacggttgaagaggaagatccgtaccagggaacgattgtgctggctaccgttaaaggggatgttcatgatatcggtaaaaatattgtgggtgtcgtgctgggctgtaacaacttccgggtcattgacctgggagtgatgaccccttgtgacaagattctgaaagcagctctggaccacaaagctgatattataggtttgagtggcctgattacgccctccttggacgagatgattttcgtggctaaagaaatggagcgtttggccatccgcatccctttactgatagggggagcaactacctccaagacccacaccgccgtaaaaattgcgccacgatacagcgcgccagtgatccatgtgttggatgcatccaagagcgtggtggtttgttctcaactgctcgatgagaacttaaaagatgagtacttcgaggaaataatggaggagtatgaagatattcggcaagaccactatgagagtctgaaagaaaggcgatacctgccattgtctcaagcacgcaagtcaggcttccaaatggactggctctccgagccccaccccgtgaagcccacgtttatcggcacccaggtgtttgaagactatgacttgcaaaagctcgtagactatatcgactggaagcctttttttgacgtgtggcaactgagaggaaagtaccccaaccggggattcccgaagatttttaatgacaaaacagttggcggtgaggcccgaaaggtctatgacgacgcccacaatatgttgaacacactgatcagccagaaaaaacttagagcgaggggagttgtcggcttttggcctgcccagtcaatccaagatgacatacatctttacgccgaagccgctgttccgcaggccgcagagcctattgccactttctatggccttagacagcaagctgagaaagacagcgcaagtactgaaccttactattgccttagcgacttcatcgcccctctgcatagtggcattcgggattatctcgggctcttcgctgtggcttgcttcggggttgaggagctgtccaaggcttacgaagatgacggagatgactatagtagtatcatggtgaaagcactgggcgaccgactggcggaggctttcgccgaagagttgcatgaacgggtgcggcgtgaactgtgggcatactgcgggtccgaacagcttgacgttgcggatttgcgacgcctgcgctataaaggcataagaccagcgccagggtacccaagccaacctgaccataccgaaaagctgacaatgtggagacttgccgatatagagcagtcgaccggtatacggctgaccgagtccctagccatggcccctgcatctgccgtttccggtctatacttctccaacctgaagagtaaatattttgccgtaggcaagatcagcaaagatcaggtcgaggactacgcactgaggaaaaatatctccgttgccgaagtggagaagtggctggggcctattctaggctacgatacggattag

SEQ ID NO: 212785 - DNA, 3798 bp, Artificial Sequence
  Description of Artificial Sequence: Synthetic coding sequence
atgtctcctgctctgcaagacctgtcccagcccgaagggttgaagaaaacccttcgcgatgagataaacgccatcctccagaagcgaataatggtgctagatggaggcatgggaactatgatacagagagagaaacttaatgaggagcattttcgcggtcaggagtttaaggaccacgctagaccactgaaaggcaacaatgatatcctgtcgatcacacagccagacgtgatttaccagattcataaagagtaccttttggccggagccgacatcatagagactaataccttctcaagcaccagcatcgcccaagctgattatggactggaacacctcgcctatcgcatgaatatgtgctccgcgggtgtcgcccgaaaagcggctgaggaggtcacgttacagactggcattaaaaggttcgttgcaggagcactcgggcctaccaacaaaactctgtctgtgtctccttccgtggagcggccagactataggaacatcacctttgatgagctggtagaggcttaccaggaacaggccaaaggattactggatggaggcgttgacatcctgctgatcgagaccattttcgatacagccaatgccaaagcagccctgtttgcactgcagaacctgttcgaggaaaagtatgctcctcggccaatcttcatcagcgggacgattgtcgataaatccggccgtaccctgagcggccagacaggagagggctttgtgatcagcgtctctcatggcgagcctctatgtattgggctgaattgtgcgctaggcgcagctgagatgaggccttttattgagattatcgggaaatgtacaaccgcctacgtgctctgctaccctaatgccggattgcccaacaccttcggtgactatgacgagaccccaagcatgatggccaagcatctaaaggatttcgcaatggacggactggtcaatattgtcgggggatgctgcggcagcacgcctgaccacattcgggaaattgcggaggccgtgaaaaactgcaaacccagggttccccctgcaaccgccttcgaaggacacatgttgcttagcggtctggaaccctttaggattggtccctacaccaattttgtgaatatcggggagcgctgtaacgtggcagggagtagaaaatttgcaaaactgatcatggcgggaaactatgaagaagcactgtgcgtggccaaagtgcaggtggaaatgggcgcacaggtgcttgacgtcaacatggacgacgggatgctcgacgggccttccgcaatgactcgcttctgcaacctgatagcctccgagccagacatagcgaaagtgcccctctgtattgactccagtaatttcgccgtcatcgaagcagggcttaaatgttgccagggaaaatgtattgttaattccattagtttgaaagagggggaggacgacttcctcgaaaaagccaggaagatcaagaaatatggcgcagcgatggtagtaatggcatttgacgaagaaggccaggcaactgaaaccgacactaaaattcgcgtgtgcactagggcttatcatctgctggtcaagaaattagggttcaatccaaatgatattattttcgacccaaacatcctgactatcggcaccgggatggaagaacacaacctttatgcgatcaatttcatccatgcaacaaaagttatcaaggaaacgctgccgggagctaggatcagtggtggcctctccaaccttagcttttccttccggggaatggaggccataagagaggctatgcatggcgtcttcctttaccatgccatcaaaagcgggatggacatgggcatcgtcaacgcaggcaaccttcccgtgtatgacgacatccacaaggagctgctgcagctctgtgaggacctgatctggaacaaagatcccgaggctacagagaaactccttagatatgcgcaaacccaggggaccgggggtaagaaggtcatccagactgacgaatggcgcaacggccctgtggaggagcgattggagtacgctctcgtaaagggcatcgaaaaacacatcatagaggatactgaagaagctcgcctgaatcagaagaagtaccctcgaccactgaacattatcgaaggtccattgatgaatggcatgaagattgtaggtgatttgtttggggctggcaaaatgtttctcccccaggtcatcaagagcgcgagggtgatgaagaaggctgtgggccatctgatccctttcatggaaaaagagcgggaggagacccgcgtacttaacgggactgtcgaggaggaggacccgtatcaaggcaccatcgtgctggctacagtcaaaggagatgtgcatgatatcggaaaaaatatcgtcggtgtcgtgctaggatgtaataactttagggtcatcgatcttggagtgatgacaccgtgcgataaaatactcaaagcagcactagatcacaaggcagacattattggtctgtctggcctgattacgccttcactcgacgaaatgattttcgttgccaaagagatggagaggctggcaattcgcatcccactcttaataggcggtgctaccactagcaaaactcataccgccgttaaaattgctccacgttactccgcacccgtcatccatgtcctggatgccagcaagagcgtggtagtctgtagccagctcctggacgaaaaccttaaggacgagtatttcgaagaaataatggaggagtacgaggacattagacaggatcattacgagtccttgaaagaacgtagatatctaccgctcagccaggcccgtaagagcggcttccagatggattggctgtccgaacctcatcctgtcaagcctactttcattggaacccaagtcttcgaggattatgatcttcagaagctggtggactatatcgattggaagcctttctttgatgtgtggcagctcaggggaaagtaccctaaccgtgggtttccaaaaatcttcaatgacaagaccgttggcggagaagcccgtaaagtgtacgatgacgcacataatatgctgaatactctgatctcccagaagaaattgagggccagaggagttgtaggtttctggccagctcaatctatccaggacgacatccacctatacgccgaggccgctgtgcctcaagcagcagaacccattgctacgttttatggtctgcgccagcaggccgaaaaagactcagcttccactgagccctattactgcttgtctgacttcatcgctcccctccacagcggaataagagactaccttgggctgttcgctgtggcttgtttcggggttgaagaactctctaaagcatacgaggacgatggggatgattattcctccatcatggtgaaggcactgggagaccgcttagcggaagctttcgcagaggaactccacgagcgagtgaggcgagagctctgggcatattgtggctccgaacagctcgacgtagcggaccttcggagacttcgttacaaagggataagacccgctccgggatatcccagccagcccgatcatacagaaaagctaacaatgtggagactcgcagatatcgaacaatccacaggcatccgacttacagaatccctggccatggcccctgcttctgcggtgtccggcctctatttcagcaatttgaagtccaagtactttgccgtaggcaaaattagcaaggatcaggtggaggattacgccctgaggaagaatatcagcgtcgcagaggtagagaagtggttggggcctatactgggttacgacactgactag

SEQ ID NO: 212786 - DNA, 3357 bp, Artificial Sequence
  Description of Artificial Sequence: Synthetic coding sequence
atgtcaccagctctgcaggatctgtcacaacccgagggcctgaaaaagacactgagagatgagattaatgctatacttcagaagaggatcatggtgctcgacgggggaatggggacgatgattcagcgagagaagctaaatgaagaacacttccggggacaggagtttaaggaccacgcaagacctttaaagggaaataacgacatcttgtcaatcacacaacctgacgtcatctaccagatccacaaagagtatttgctagctggggcagatattattgagaccaacactttttcttcaactagcatagcccaggccgattacggacttgagcatttggcctacagaatgaatatgtgctctgcaggagtggccagaaaggccgcagaagaggtaacactgcagacaggaatcaaacgattcgtggccggagcccttggccctacaaataaaacgttgtctgtcagcccatcagtagagcggccagattaccggaacattactttcgatgagctagtcgaggcttatcaggagcaggccaaggggctgctagacggtggggtcgatatactacttatagaaactatttttgatacagcaaacgcaaaggccgcactcttcgcgctgcaaaacctctttgaagagaagtatgcacccagacctatcttcatcagcggcaccatcgtggacaaatcaggacggacactgagtggacagacaggagaaggctttgtgatttcagtgagtcacggcgaaccactttgtataggcctgaattgtgctctcggtgcagccgagatgcgccctttcatcgagattatcgggaagtgcacaaccgcatatgtcctatgctaccccaatgcgggattgcccaacacattcggcgactatgatgagacccctagcatgatggccaagcatttgaaagatttcgctatggatggtttggtgaacattgtcggtgggtgctgcggcagcacgcccgaccacatcagagagattgccgaggctgtaaaaaattgcaagccgcgagtaccacctgctaccgcctttgaaggacacatgttgctcagcggattagaaccgtttcgtatcggtccttacactaacttcgtgaatataggagagcggtgtaacgtcgccggatctcggaagtttgcaaagctcattatggctggcaactacgaggaggccctctgcgttgctaaggttcaggtggagatgggggcacaggttctagatgtcaacatggacgacggcatgttagatggcccatctgccatgactaggttttgcaatcttatcgcttctgagccggacatcgcaaaggtaccactatgcatcgactccagtaacttcgcagtgattgaagcagggctcaagtgttgtcaagggaagtgtatcgtcaactctatttccctcaaagaaggtgaggacgactttctggaaaaggctagaaagatcaaaaaatacggtgctgcaatggtggttatggcgttcgatgaggaaggacagacacagggtacaggagggaagaaggtgattcaaactgacgaatggcgaaatggacccgttgaggagcggttagagtacgccttggtgaagggcattgagaaacacattatcgaggacaccgaagaagccaggttgaatcagaagaaatatccgagaccactgaatattatcgaaggccctctaatgaacggaatgaaaattgtgggtgatctcttcggagctggtaaaatgtttctgccccaggtgattaagtccgcgagagtgatgaagaaagcagttgggcacctaatcccattcatggagaaggagagggaagagacaagggtgctcaatgggacagtcgaggaggaagatccctatcaggggaccatagtactcgccacagtaaaaggggatgtgcacgatattggaaagaacatcgttggcgtggtgctggggtgcaacaattttcgcgtgatagacctgggcgtgatgacaccttgtgataagatcctgaaggccgcattggatcataaggccgacataattggcctctctgggcttatcactccatccctggatgaaatgatctttgtggctaaggagatggaacggctggctatccgaatccccctactaattgggggagccacgacctctaagactcatacagccgtgaagattgcaccaagatattcagcccctgttatccatgttcttgacgccagcaagtctgtcgtggtgtgttctcagctacttgacgagaacctgaaagatgagtattttgaggagatcatggaggaatacgaggatattagacaggatcactacgagtcgctgaaggaaagaaggtatttaccactaagccaggccaggaaatcagggttccaaatggactggctgtctgaacctcatcctgtaaagccgacttttattggcacccaagtcttcgaggattacgatctacaaaagcttgttgactacatcgactggaagcctttctttgatgtctggcaactgagaggcaagtatccaaaccgcggttttcctaagatcttcaatgacaagacggtcggcggagaagctaggaaagtttacgatgatgcgcacaacatgctaaataccctaatctcccaaaagaagcttagggcacggggtgtcgtgggattttggcccgctcagagcatccaggacgatattcacctctacgccgaggccgctgtgccgcaggccgcagagcctatcgctacattctacggcctgagacagcaggccgaaaaggacagtgcaagcacagagccatactactgtctttcagatttcattgcgccactccacagcggaatccgcgattatctgggtctttttgctgtcgcctgtttcggagtggaggagctgagtaaagcctatgaagacgatggggatgattactcatcaatcatggtaaaggcactgggggatagactcgcggaagccttcgctgaggaactgcacgaacgagtgcggcgagagctctgggcgtactgcggctcagaacagctggatgtagccgatcttcgccgtctccgatataagggaattaggccagcaccaggttatcccagccagccggaccataccgagaaactgaccatgtggagattagccgatattgagcagtctactgggatcaggctcacggaatcactggccatggcccctgcctcggctgtgagcggcctgtactttagtaatcttaaatctaagtacttcgctgtgggtaaaatctctaaggatcaggtggaggattatgctctgcgtaagaatatctccgtggccgaggtcgagaaatgcatgagcgtgtaccgtaaaataggggagtag

SEQ ID NO: 212787 - DNA, 690 bp, Artificial Sequence
  Description of Artificial Sequence: Synthetic coding sequence
atgtcagccggtttgcgagctgggtgtcacgtggttctgttatgccgcttctccctcggctcattctcggttccaagtcgcgatagtgcttccggacgtgcttgtcttgcggcacgccctacccccagaactggaagggtacccggaaaaaaggccagggcccctgctgtggcggctccctcccccgagcggggtccacgcgcactgagagcattcggggtgcgctcccccccagcaacccgagctaacggcagaaggcagaaaaccagggccctgtgcggcaggttggcctggcgctggttggcctggcctttggcggtggtaacctgtggtgaacatgtgttcagcgcggctccttcagcccagggcggagactcgacaacatgtcatcctagaagtaaaacttgtagaaatccagagtatcttcttgcaggcgcagacatcatcgagaccaacaccttcagctccaccagcatagcccaagccgactacgggctggagcacctggcttacaggatgaacatgtgttccgctggggtagccagaaaagcagccgaggaggttacccttcaaacaggcatcaaacggtttgttgcaggcgctcttggcccaactaataagactttgtctgtgtccccatccgtggagagaccagattacaggaatatcaatctacccgtcggtagctag

SEQ ID NO: 212788 - DNA, 3645 bp, Artificial Sequence
  Description of Artificial Sequence: Synthetic coding sequence
atgtctcctgccctgcaggatcttagccagccggaaggtttgaaaaagaccctgcgtgatgaaatcaatgcaatccttcagaagcgcattatggttctggacggcggtatgggcacgatgatccagagggagaagttaaatgaagaacattttcgcggtcaggaattcaaagaccatgcccgacccctgaaaggcaacaacgatatcttgagcattacccagccagatgtcatatatcagattcacaaagaatacttgctagctggcgctgatattattgagacgaataccttttcaagcactagcattgcccaggccgattacggacttgagcaccttgcgtaccggatgaatatgtgctcggccggtgtggctaggaaagctgctgaagaggtgactctgcagactgggatcaagagattcgtggctggagctttagggccaactaataagactctgagcgtctctccctccgtggagcggccagactaccgcaatatcacctttgacgagcttgtcgaagcatatcaggagcaggccaaaggtctgcttgacggtggagtggacatactactgatcgaaacgatctttgacaccgccaatgccaaggctgccctcttcgccctacagaacctgttcgaggagaaatatgcgcctcgcccaattttcatctctggcacgattgtggataaatccggacggacactgtccgggcagaccggcgaggggtttgtcataagcgtgagccatggcgagcccctatgtattggccttaattgcgcgttgggcgcagcagaaatgcgcccttttattgaaatcataggaaagtgtacaacggcatacgtgctgtgttatcctaacgctgggctaccaaatactttcggcgattatgatgaaacaccctccatgatggcaaagcacctgaaagatttcgccatggatggacttgtcaatatcgtcggaggctgttgtggatcaacgccagaccatattcgagagatcgcagaggccgtgaaaaattgtaagcccagagtccccccagccaccgcctttgaaggacatatgcttttgtctggcttggagccctttcgtattggtccatacactaattttgtcaacattggcgagagatgtaatgtggcaggttcccggaaatttgccaaactgattatggccggaaactatgaggaagctttgtgcgtagccaaggtgcaagtggagatgggagcccaggtgttggacgttaatatggacgatggaatgctggatggaccctctgccatgacacgattttgtaacttgatagctagtgaacctgacatagctaaagtacctttatgcattgattccagcaatttcgcagtcatcgaggcagggttgaaatgctgtcagggaaaatgcatagtcaatagcatctccctgaaggagggggaggatgacttcctggaaaaggccaggaagatcaaaaaatacggcgctgcgatggtggtaatggccttcgatgaggagggccaggccaccgaaaccgatactaaaatacgagtgtgcacacgtgcttatcatctcctggtaaaaaagctcggattcaaccccaatgacatcatttttgaccccaacattttgaccatcggcaccgggatggaagagcacaatctttatgctattaatttcatccacgcgaccaaagttatcaaggaaactctgccaggggcaaggatcagcggcggactcagcaatttaagctttagtttccgcggaatggaggccattagggaggcaatgcacggggtatttttgtaccatgccattaagagcggaatggatatgggtattgtgaacgctggcaacttgcctgtgtacgacgatattcataaagagctcctgcaattatgcgaagatcttatttggaataaagacccagaggcaacagaaaaactcctcaggtacgcccagacccagggcaccgggggaaagaaagtgatacagactgacgagtggaggaacggtcctgtggaagaacgcctggaatacgccttggtaaaggtcataaagtctgcccgagtcatgaagaaagcagttgggcacctcatcccgtttatggagaaggaaagggaagaaacgcgcgtacttaatggaacagtggaagaagaagatccctaccagggcactattgtgctggccaccgttaaaggtgatgttcatgacattggaaagaatatcgttggtgtggtgctgggttgcaataacttcagagtaatcgatctaggagtcatgaccccctgcgataagattcttaaagctgccctggaccataaagccgacatcattgggttgtcaggcctcataactccatcgctggacgagatgatattcgtggcaaaggagatggaacgcctggctatccgtattcctctattgatcggtggggctacgactagcaagacgcacaccgcagtgaaaatcgcacctagatactccgcgcctgttatccatgtcctcgacgcttcgaagtccgtggtggtgtgtagccaactgctggacgagaatttaaaagatgaatacttcgaagagattatggaagaatatgaggacatacgacaggaccactacgagagtctgaaagagcgcaggtacctgccgctcagtcaggccaggaaatctggctttcagatggattggctcagtgaacctcatcctgtgaagcccacctttattggcacacaggtctttgaggattacgatcttcagaagttggtcgactacatcgattggaaacctttcttcgacgtgtggcagctgagaggaaagtatcccaacagaggcttccccaagatttttaatgataagactgtgggcggtgaagctcgcaaggtgtacgatgatgcacataacatgctgaacactctcatatctcagaagaaattacgggctcgcggagtggtgggtttctggcctgcgcagagcatacaggatgacatccatctttacgccgaagccgctgtccctcaggccgcagagcccatcgccaccttttatggactgcgccaacaggccgagaaggattcagcctccacagagccgtattactgcctttctgattttatcgcaccacttcactctggcatccgggactatttgggcctgttcgcagtggcctgctttggtgtcgaagaattgagtaaagcctacgaagatgacggggatgactatagttcaatcatggtgaaggctcttggagaccggctggccgaggctttcgcagaggagctccacgaacgcgtccgtcgggaactctgggcgtactgtgggagcgaacagctggacgtggctgaccttaggcgccttaggtataagggcattcgcccagctcctggctacccctcacagcctgaccacaccgaaaagctaacaatgtggcgcctcgcagacatcgagcagtctactgggatccgcttgacagaaagccttgctatggccccagcctccgcggtctcaggcctatattttagcaacctgaagagcaagtactttgccgtgggtaagatcagtaaggaccaggtggaagactacgccctcagaaagaacatctctgtggcagaagtagaaaagtggctgggtcccattctggggtacgacacagattag

SEQ ID NO: 212789 - DNA, 2178 bp, Artificial Sequence
  Description of Artificial Sequence: Synthetic coding sequence
atgggcgcagcatcagtccgggcaggagcgaggttagtcgaagtggcgttatgcagttttaccgtgacctgcctcgaggttatgagaaggtttctgctgctgtacgccacgcaacaaggccaggctaaagctatcgctgaggagatctgtgagcaggcagtcgtgcacgggttcagcgctgatctgcactgcattagtgagagtgacaagtatgatttaaaaacagaaaccgcaccacttgtggtggttgtctccacaaccggcactggcgatcccccagacactgctagaaaattcgtcaaggagattcagaaccaaactctgccagtcgatttcttcgcccacctccggtacgggctgttggggctgggcgattctgagtatacatacttctgtaacggtggcaaaattatcgacaagcggctccaggagctgggggcaaggcacttttatgatacgggccacgcagacgattgcgttggtctggagctggtggtagagccctggatcgcagggctttggcccgcactgagaaaacactttagatcatctcgcggacaggaggagattagcggggcacttcccgtcgcatccccagcctccagccgcaccgatctggtgaaatccgaacttctccatatagagtcccaggtggagctactcagattcgatgattctggtcgcaaggactcggaggtcctcaaacaaaacgcagttaactctaaccagtcaaatgtggttatcgaggatttcgagagctcgctgacacgtagcgttccccctctgtctcaggcatcactgaacatcccaggccttcctcccgagtatctccaggttcatctccaggaaagcctggggcaggaggagagtcaggtgtccgtaacttccgcagacccagtgttccaggtgcccattagcaaggctgtgcagctgactactaacgatgcaattaaaaccactttgctcgtggagcttgacataagcaacaccgactttagctaccagccaggggacgccttcagtgtgatttgcccaaactctgactcagaagtgcagagcttgctgcagaggcttcaactggaggataagcgagagcattgcgtgctgctgaagattaaggcagatacaaaaaaaaaaggagctactctgccccagcacatccccgctggctgtagcttacaatttatttttacctggtgtctcgaaatccgcgcaatcccgaaaaaggcgttcctccgggcactggtggactacacaagtgatagcgctgagaagcggaggctgcaggaattgtgttccaagcagggggcagccgattacagcaggttcgtccgcgatgcttgcgcgtgcttattagaccttttgctagccttcccgtcttgccagcctcccctatcgctcttattagagcacctacccaagctgcaacccagaccatacagctgcgcaagcagctccctgtttcatcctgggaagctccactttgtgtttaacattgtagagtttctatctactgcaacaaccgaggtgctccgcaaaggcgtttgtacaggttggctagcgctgcttgtggcctcggtccttcaacctaatattcatgcctcgcatgaagatagtgggaaagcgttggcaccaaagatctcgatctcacccaggacaactaacagtttccatctgcccgatgatcccagcattccaattatcatggtgggaccgggaactggtattgcacccttcattggctttttgcagcaccgggagaaattgcaggaacagcatcctgatggtaatttcggtgctatgtggctgttcttcggatgtcggcacaaagaccgggactacctgttccggaaggagctgaggcacttccttaagcacggaattttgacacacctcaaggtttccttctcccgagacgcccctgtgggagaagaggaggcacccgctaagtacgtgcaagataacatacagttgcacggccagcaagtggcacggatcttgctacaggagaacggacatatctatgtgtgcggtgatgccaagaacatggcaaaagacgttcacgatgctctggttcagatcatttccaaggaggtgggcgtggaaaaattggaagcaatgaaaaccctcgccactctgaaagaggagaaaagatacctgcaagatatttggtcttag

SEQ ID NO: 212790 - DNA, 177 bp, Artificial Sequence
  Description of Artificial Sequence: Synthetic coding sequence
atgaggcggttcctactgttgtatgccactcagcagggccaggctaaggccatcgctgaagaaatctgtgaacaggctgtagtccatggcttttccgccgatcttcactgcatctctgaaagcgataaggttagcgtgattcagaatacacctacattcgccatggggggaagatag

SEQ ID NO: 212791 - DNA, 2097 bp, Artificial Sequence
  Description of Artificial Sequence: Synthetic coding sequence
atgcgacgattcctgctgctgtacgcgacccagcagggacaggccaaagctatcgccgaggaaatatgtgagcaagctgtcgtccatgggttttcagcggacctgcactgcatctcagaatctgacaagtacgacctgaagaccgagaccgctcccctcgtggtggttgtatccactactgggacgggcgaccccccagacaccgctcgaaagtttgtgaaggagatccagaatcagacgctacccgtggatttctttgctcacctgcgatacggcctcctgggcttgggcgacagtgaatatacttatttctgtaacggagggaagatcatcgacaaacgtttgcaggagctgggggcaagacacttctacgacactggacatgccgacgactgcgtgggtctcgaactggtggtggagccatggattgccggattatggcccgcactcaggaaacacttccgttcgtcgcgtgggcaggaagagattagcggggctttacccgtcgcttccccggctagttcccgtacagatttagtgaagtcagagctcttgcatatcgaaagtcaagttgagctactgagatttgacgatagtggtcgaaaggactccgaagttctaaaacagaacgcagtgaactccaaccaaagtaatgtcgtgatcgaagacttcgagtcctcgcttactcgtagcgtgccacctctatcccaggcctccctgaatataccagggctgccacccgaatacctgcaggtccacttacaggaatctctgggacaagaagaatcccaagtatcggtgaccagcgcagaccctgtgtttcaggtgcccatttctaaggcagttcagctgacaaccaatgatgcgataaagaccacccttctcgtggaactcgacatctcgaatactgacttctcctatcagccaggtgacgctttctccgtgatctgccccaacagcgattcagaggtgcagagcctcctccagcgactgcagcttgaagataagcgcgagcactgcgtcctgctcaagattaaagccgataccaagaaaaaaggcgctacactgcctcagcatatccccgctggctgcagcctgcagtttatcttcacatggtgcttggaaatcagagccatccctaaaaaggcgtttctccgcgctttggtagattacacaagcgattctgcagagaaaaggaggctgcaggagctttgtagtaagcagggagctgccgactatagccgttttgtgcgggatgcttgcgcctgcctgctcgatctgctgcttgccttccccagttgtcagccaccgctgtctctgctcctcgagcatttgcctaagctccagcctcggccttacagctgcgcttcatccagtcttttccaccctgggaaactgcacttcgtcttcaacatcgtcgaatttctgtcaacagccaccactgaagtgctgcgtaagggagtgtgtaccgggtggctggcgttgctggttgcctcagtgctgcaacccaatatccatgcttcccatgaggacagcgggaaagctctcgctcctaagataagcattagccctagaaccacaaacagcttccacctacccgatgacccctccatcccaatcattatggttgggcctggaacagggattgctccctttattggctttctacagcacagagagaagcttcaggagcagcatcccgatggcaactttggtgccatgtggctgttcttcggctgtcgacataaagacagagattacctgtttaggaaggaactgaggcactttttgaaacacggaatactgactcaccttaaagttagcttttccagagatgctcctgtgggtgaggaagaggcgcctgcaaaatacgtgcaagataacatacagcttcacgggcagcaggtggccaggatcctgcttcaggaaaatggacatatctacgtgtgcggagatgcaaaaaatatggccaaagacgtgcatgacgccctggtccagattattagcaaagaagtcggcgtagagaaattagaagccatgaaaacccttgccacactgaaagaggaaaagcgctacttgcaggatatctggagctag

SEQ ID NO: 212792 - DNA, 471 bp, Artificial Sequence
  Description of Artificial Sequence: Synthetic coding sequence
atgaggaggtttttgcttctctatgccacccaacaggggcaggctaaagcgattgcagaggagatatgcgaacaggcagttgtgcacggcttctcagccgacctccactgtatttcagaatcggataagtacgatctgaagaccgaaaccgccccactggtggtcgtggtcagtacaaccggcacaggggaccctccggatacggctaggaagtttgtcaaagagattcagaatcagacactacccgtggacttttttgcgcacttgcgttacggtcttctggggttaggggattctgaatatacctacttctgcaatgggggaaagataattgacaagcggctgcaggaactgggagcccgacacttttatgacaccgggcacgcagacgattgcgtggggcttgagttggtggtggaaccatggatagccggtctgtggcctgcgctgcgaaaacactttcgatcttag

SEQ ID NO: 212793 - DNA, 126 bp, Artificial Sequence
  Description of Artificial Sequence: Synthetic coding sequence
atgcgcagattcctcttgctgtacgcgacgcagcaaggccaggcaaaggccattgcggaagaaatttgcgagcaagcggtggtccatggattctcagctgatctccattgcatcagcgagagctag

SEQ ID NO: 212794 - DNA, 339 bp, Artificial Sequence
  Description of Artificial Sequence: Synthetic coding sequence
atgcggaggttcctcctcctctacgccacacaacaggggcaggccaaggcgatcgccgaagaaatctgtgaacaggcagtcgtgcatggcttttcagcagaccttcactgcatctccgaatctgacaaatatgaccttaaaaccgagaccgcgcctctggtggtggtcgtcagtactacaggcacaggcgacccgcctgatacggcacgcaaattcgtcaaggagattcaaaaccagacactgcccgttgacttcttcgctcacctccggtatggtctccttggcctgggcgactccgaatatacgtacttctgcaatggtggcaagatcattgactag

SEQ ID NO: 212795 - DNA, 249 bp, Artificial Sequence
  Description of Artificial Sequence: Synthetic coding sequence
atgctttgggatcctgcgctcccgcgtctggcagtctacgctagctgcttgttctttagctgtctcgatgctcacgaggggcctgtccatggtcccaggggcagaggcgagggcggtcgcggtagtgaacgacagcgtgttagaccaggcggagggggtggcgctggatccgtgcacattcatctggaagaggaggacggtgccgaggatcaagaccaccgcgatgaagactggataactaaaaagtag

SEQ ID NO: 212796 - DNA, 1647 bp, Artificial Sequence
  Description of Artificial Sequence: Synthetic coding sequence
atgactatggccgctgccgcagtcgtagcgcgtggggcaggggctagggccgctactgctgcagcactcagagggggatgtggtacggcagcacggggtcgcccttgtgcagggccagccaggcctttgtgcactgccccagggacggcaccggacatgaagcgatacctctgggaaaggtatcgggaagcaaaaagaagtacggaagaattagtgccttcaatcatgtccaatttgctgaacccggatgctatatttagcaataatgagatgtcactttctgatatagaaatttacggattcgactatgactataccttagttttttactccaagcatttgcataccctgatctttaatgcggcacgagacctcctcatcaatgaacatagatacccagcggagatccgcaagtacgagtatgatcccaattttgccattcgaggcttgcactatgacgtgcagcgggctgtgctcatgaaaatcgacgcattccactacatacagctcggcaccgtgtacagggggctgtctgtcgttcccgacgaggaggtgatcgaaatgtacgaaggctcccacgtgcctctggaacaaatgagcgacttttatggaaagtcctcccacgggaataccatgaaacagttcatggacatattttcactgccagagatgaccctgttgagctgtgtaaacgagtacttcctgaaaaataatattgactacgaacctgtgcacttgtacaaggatgtgaaggactcaattcgcgatgtgcatattaaggggattatgtacagggcaatcgaagctgatatcgagaagtatatttgttatgcagagcagacccgggcagttttggccaaactcgccgatcacggcaagaaaatgtttctgatcaccaacagtcccagcagtttcgtggataaaggcatgtcatatatagttggtaaggattggagggacctctttgatgttgtgatcgtgcaggcagagaagcctaacttcttcaacgacaagcgacgaccatttcgcaagatgaacgagaagggagtgctgctgtgggacaaaatacataagctccagaaaggacaaatctataagcaggggaacctttacgagtttctgaagttaaccggctggaggggctctagggttctctattttggtgaccacatctactcggacctagctgatctgaccctgaaacacggctggaggactggcgcaataattcccgaactgcgctccgagcttaagattatgaacaccgagcagtatatccagactatgacttggctccagacgctgactggcttgttggagcagatgcaggtccacagagacgccgaatctcagctggtcctgcaggagtggaaaaaggaacgcaaggaaatgagggagatgacaaagtccttcttcaacgcacagttcggctccctgtttagaaccgatcaaaacccgacttacttcctccgtaggttgtctagattcgcagatatctacatggcctcgctgtcttgtctgctcaattatgacgtctcacatacgttctatccgagaaggacccccctccaacacgaactgccagcatggtctgagagaccacctacgtttggaaccccgctgctgcaagaagcccaggccaagtag

SEQ ID NO: 212797 - DNA, 1686 bp, Artificial Sequence
  Description of Artificial Sequence: Synthetic coding sequence
atgagcactagctggagcgaccggctgcagaacgctgctgatatgccagccaatatggacaagcacgcgcttaagaagtacagaagagaggcctatcatagggtgttcgtgaaccgctctcttgctatggaaaaaataaaatgcttcggcttcgatatggactacaccctggccgtgtacaagagccctgagtacgagtctctcggattcgagttgacagtagagagactcgtgtctataggttatcctcaagagttgctgtcattcgcctacgactccacctttccgactagaggactggtcttcgataccctgtatggaaatctgctcaaggtcgacgcctatggcaacctgctagtgtgcgcccacggatttaatttcatccgcggacctgagacccgtgagcagtacccaaacaagttcattcagcgagacgacacagagcgcttctatattctgaatactctgtttaacctcccagagacatacttattagcctgtttggtggactttttcacaaactgtccgagatacacaagctgtgaaaccgggttcaaggacggagatttgttcatgtcatacaggagcatgttccaggacgtaagggatgccgtagactgggtgcattataagggaagcctgaaagagaagaccgttgagaatctggaaaaatatgtcgtgaaggatggtaaattgcccctgctgctttccaggatgaaggaagtgggcaaagtgtttcttgcaaccaacagtgactacaaatacacagataagatcatgacctatctttttgactttccgcacggtcctaagccaggttcttcgcacagaccatggcagagctacttcgatcttatcctggtcgacgccagaaagcctctcttcttcggagagggaactgtgctaagacaggtggacacaaagacaggtaagctgaaaattggaacgtacaccggcccactgcagcacggcatcgtatattcggggggttcatccgacactatttgcgacctgctcggggctaagggcaaggacatcttgtacattggggatcacatcttcggagacatccttaagtccaaaaagaggcaggggtggagaacttttttagttattcctgaattggctcaagagcttcatgtgtggaccgataagtcctcattattcgaagaattacagtctttggacatattcctggccgaactctataaacatctggattcctctagcaacgagcgcccagatatctcatccatccaacgccgtatcaagaaggtgacgcatgacatggatatgtgttatggaatgatgggcagcctgttccgcagcggatcccggcagactttgtttgccagtcaggtgatgcgatacgcagacctgtatgccgcttcctttatcaacctcctctactaccctttcagttatcttttcagggccgctcatgtgcttatgccacacgagtccaccgtggaacacacacacgtggacatcaatgagatggaatccccactcgctaccagaaaccgcacatcagttgactttaaggatacagattacaagcgccatcagctcactagaagtatctctgagatcaagccccctaatctgttcccactggcaccccaggaaatcacgcactgccacgacgaagacgatgatgaagaagaggaagaggaggaggagtag

SEQ ID NO: 212798 - DNA, 600 bp, Artificial Sequence
  Description of Artificial Sequence: Synthetic coding sequence
atggattatactctggccgtgtacaaatcaccagagtacgaatctctggggttcgagctgacagtcgagcgtctggtttcaatcggttatccccaggagctactgtctttcgcctacgacagtacctttcccacccgaggcctagtgttcgatacgctgtacggcaatctcttgaaggtggatgcttatggcaatcttctggtctgtgcgcatggcttcaactttatccgcggttctcaggtggccgtgcagaaaagaccagaaactcgcgaacaatacccaaacaagtttatccaacgcgatgacacagagcgattttatatcctgaacacccttttcaatctcccagaaacgtatctgctggcctgcttagtggatttttttaccaactgcccccgttatacttcctgcgaaaccggattcaaggatggagatctgtttatgagctatcgaagcatgtttcaggatgtcagggacgctgttgactgggtgcactataaaggtagcctgaaagagaaaactgttgagaatctggagaagtacgtagttaaggattccaagtccagccggattcagtacttcctcaaagtgctctggtag

SEQ ID NO: 212799 - DNA, 1686 bp, Artificial Sequence
  Description of Artificial Sequence: Synthetic coding sequence
atgagcacatcttggagcgatcgcctgcagaacgcagccgacatgccggcaaatatggacaaacacgcattgaagaaatatcggagggaagcgtatcaccgggtctttgtaaacagaagcctggcaatggagaaaattaaatgtttcggcttcgacatggattatacactggccgtgtacaaaagtccagagtatgaatccctgggcttcgagcttactgtcgagcggttggtgtcaatcggttatcctcaggagctgctgagctttgcatatgattctaccttcccaactcgagggctggtttttgataccttgtacggcaacctgctcaaagtcgacgcctacggaaacttgctggtgtgcgcccacgggttcaattttatacggggacctgaaacgagggagcagtaccctaacaaatttattcagagggacgacacagaaaggttctacattttgaacacactctttaaccttcctgaaacctacctgctcgcctgcctggttgactttttcaccaattgccccagatatacctcatgcgagacgggctttaaggatggggacctgtttatgagctacaggagtatgttccaggacgtgagagacgccgtggactgggtccactacaaggggtcccttaaagagaaaacagtggaaaatctggagaagtatgtcgttaaggatggcaaactgcctctcctgctgtcccggatgaaagaggtggggaaggtctttctggccacgaatagcgactacaagtatacggataagatcatgacctatctcttcgacttcccacatggccctaagcctgggagctctcataggccctggcagagctactttgacctgatcttagtcgacgcgcgaaagccacttttttttggggaggggactgtgctccgacaagtagatactaagactggcaagcttaagataggtacatataccggccctctacaacatggaattgtgtactccggtggctcctccgacaccatctgcgacttgcttggagctaaaggaaaggatatattatatattggcgatcacatttttggtgatatcctaaagagtaaaaagagacaaggctggcggacctttctggtgatccctgagcttgctcaagaactgcatgtgtggaccgacaaatctagcttgttcgaggagcttcagtccctggacatcttcctagctgaactttataaacacctcgatagttcttctaatgaacgcccagatatctcttcaattcagcggaggatcaagaaagtgactcacgacatggacatgtgttacggcatgatgggcagcctgtttcggagtggcagccgacagacgcttttcgcaagccaggtgatgcgatatgccgacctttatgcagcgagcttcatcaatttgctgtactatccattctcatacttgttccgtgcggctcacgtgttgatgcctcacgaatctactgtggagcacacacacgtggacatcaatgaaatggaatcccctctggctacaaggaaccggacctctgtggactttaaggatacggattataagagacatcaactcacacgttccatctctgagatcaagccacctaacttgttcccactggccccacaggagattactcactgccacgatgaagatgatgatgaagaagaggaggaagaagaagagtag

SEQ ID NO: 212800 - DNA, 444 bp, Artificial Sequence
  Description of Artificial Sequence: Synthetic coding sequence
gtgctcaggcaggtcgatacaaagaccggaaagctcaaaatcggtacctacacaggtccactacagcacggaatcgtttacagcgggggttcttcagataccatatgtgacctgctgggcgcaaaaggaaaagatatactgtatatcggtgatcacatctttggtgatattctcaagtccaaaaagaggcaagggtggagaacttttttggtgatccctgaattggcacaggagctgcacgtctggaccgacaaatcatccctattcgaggaattgcagtcgttagatatttttttagctgaactttacaaacacctggatagttcttcaaacgaacggccagatatctcatccattcagaggcgcatcaaaatgccacatgagtctaccgttgaacatacacatgtcgacatcaatgaaatggagtcacctttggcgacatag

SEQ ID NO: 212801 - DNA, 1599 bp, Artificial Sequence
  Description of Artificial Sequence: Synthetic coding sequence
atgtccaaagagggagtcttcgtgaatagaagcctggccatggagaagattaagtgcttcggatttgatatggactacactctcgcagtttataaatcgcccgaatacgagtcactgggattcgaactaaccgtggagaggctggtgtccattggctatcctcaggagctgctgtcctttgcctatgatagcacatttcctacccgcggtctcgtatttgacacactctacgggaatctgcttaaagtcgacgcctatggcaaccttctggtgtgtgcccacgggtttaacttcatacggggacccgaaactcgagagcaataccctaacaaattcatccaacgcgacgatactgagcgcttctacatactcaacacgctgtttaatctgcctgaaacgtatctcctggcatgcctggtcgactttttcaccaactgccccagatatacatcgtgcgagactggcttcaaggatggtgatctgttcatgtcttacagatcaatgttccaggacgtacgggatgccgtcgactgggttcactataagggtagtcttaaggagaagaccgtggagaatctggagaaatacgtggtaaaggatgggaaattacctctgttacttagcagaatgaaagaggtcgggaaggtattcctcgctaccaactcagattacaaatacaccgataagatcatgacatatctattcgacttcccccatggcccaaagcccggatcatcccaccggccttggcagtcttattttgacctcatacttgtagacgcaaggaaacccctgtttttcggcgagggaacggtcctgcgccaggtcgacaccaagacagggaagctcaagatcggtacgtacaccgggccactgcagcacggaatcgtgtattcaggcggatctagcgacacaatctgcgacctcttgggtgcaaagggcaaagatattctctatattggagaccatatctttggtgatatcttaaagagcaaaaaacggcagggctggcgtactttcttggtgatccccgaattagctcaggagcttcacgtgtggactgacaagagttcgctttttgaagagctccagagcctggatatttttcttgcagaactttataaacatctggattcatcgagcaatgaaaggccagatatcagtagcatccaaaggcgcattaagaaggtgacacacgatatggacatgtgctacgggatgatggggtctctgtttaggtcaggatcccgccagaccttgtttgcctctcaggtgatgcgttacgccgatttatacgccgcatcttttatcaacttgctgtattatccgttcagctacctctttagggctgcccacgtgctgatgcctcacgagtcaaccgtggagcatacacacgtggatatcaacgaaatggaatctccgttggctacccgaaatcgcacttctgtggatttcaaggacacagattataagcgacaccaattaacaaggtccatttccgaaattaagcctcctaacctgttccctttggctccccaggaaattacacactgccatgatgaggatgatgatgaggaagaggaagaggaagaagagtag

SEQ ID NO: 212802 - DNA, 798 bp, Artificial Sequence
  Description of Artificial Sequence: Synthetic coding sequence
atgagtactagttggagcgaccggctacagaatgcggcagatatgccggctaacatggataaacatgccttgaaaaaatatagaagggaggcataccaccgcgtattcgttaatcggtctttagctatggagaagatcaagtgttttggattcgatatggattacaccctcgccgtttacaaatcgccagaatatgagagcctaggcttcgagttaacagtcgaaagactcgtgagtatcggctatccgcaagagttgctctcttttgcctatgactcaactttccctaccaggggcctcgtgtttgatacactttacgggaacttactgaaagttgacgcatacgggaatctgctagtatgtgcacatggcttcaactttataaggggcagccaggtggccgtacagaagcggcctgagactcgcgagcagtatcctaacaaatttattcaacgggacgacaccgaacggttttacatattgaacaccctgtttaacctgccggaaacttatcttctggcttgcctggttgatttcttcaccaactgcccccgatatacatcatgcgagaccggatttaaagatggggacctgttcatgtcatatcgatcaatgtttcaggacgtgcgggacgccgttgactgggtgcattacaaaggttccctgaaggagaaaaccgtggagaatctggagaagtacgtggtgaaggatggaaagctgcccctgttgttaagtagaatgaaagaggtgggaaaggtctttcttgcaacaaactccgactacaaatacacggactag

SEQ ID NO: 212803 - DNA, 525 bp, Artificial Sequence
  Description of Artificial Sequence: Synthetic coding sequence
gtgtcaataggctatccccaggagctgttgagttttgcctatgatagtacattccccactaggggcttggtctttgacaccctatacggaaacctcctgaaagtggatgcttatgggaatttgctcgtgtgtgctcatggatttaacttcatcagaggttcccaagttgctgtccaaaaacggcctgagacccgggagcaatatccgaacaaatttatccagcgagacgacactgaacggttctacatcctgaacactttatttaatctcccagaaacatacctgctcgcctgcctggttgattttttcaccaactgcccccgatatacttcctgtgaaacagggttcaaggacggtgatctattcatgtcttatcgatcgatgtttcaagacgtcagagacgcagtggattgggtgcattataagggctcactcaaggagaagactgtggaaaaccttgagaaatatgtggtcaaggattctaaaagttctcgtatccaatactttctgaaggttctgtggtag

SEQ ID NO: 212804 - DNA, 1011 bp, Artificial Sequence
  Description of Artificial Sequence: Synthetic coding sequence
atgagggctccatcaatggaccgcgctgctgttgccagggtgggcgctgtggcgtccgcctccgtatgtgcccttgtggctggagtcgtccttgctcagtacatcttcacactcaaacgtaagactgggagaaagacaaagatcattgagatgatgcccgaatttcagaaaagttccgtaaggattaaaaatccaacccgtgtggaagaaattatttgcggtctcatcaaaggaggggcagccaagctccaaatcattacggacttcgacatgactctgtcccggtttagctacaaggggaagaggtgccctacgtgtcataacattatcgataactgtaagctggttacagacgaatgcagaaaaaaacttctccaattaaaggaaaaatattatgctatagaagtcgacccagtgttgacagtggaagagaagtatccttacatggttgagtggtacacaaaatctcacggactgctggtgcagcaagcactgccaaaagccaaacttaaggagatagtagccgaatcagatgtgatgctgaaagaggggtacgagaacttcttcgacaagttacagcagcatagcattcctgtattcatcttttccgccggaattggagacgtgttggaggaagttatacgccaggctggcgtgtaccatcctaacgtgaaggttgtgagcaatttcatggacttcgatgagaccggcgtcctcaagggctttaagggagaactgatacatgtgttcaataaacacgacggagcactgaggaatacggaatacttcaaccagctcaaggacaactccaatataatcttgctcggcgacagccagggcgatctgcgtatggccgacggcgtggccaatgtagagcatattctcaagataggatatctgaacgaccgagttgatgagctactggaaaagtacatggatagctatgacattgtcctggttcaggacgagagcctagaagttgcaaattctattctgcaaaagatcttgtag

SEQ ID NO: 212805 - DNA, 858 bp, Artificial Sequence
  Description of Artificial Sequence: Synthetic coding sequence
atgccggagttccagaaatcctccgtacgcatcaaaaaccccaccagagttgaggaaattatatgcggcctcatcaaagggggagccgcaaagctccagatcattacagatttcgatatgacgctgtccagattttcttacaagggaaaacggtgtccaacatgccacaatattattgacaactgcaagttggtgactgatgaatgccggaaaaagctgctgcaactaaaggagaaatattacgcaatcgaggtagatcctgtcctgaccgttgaggagaagtatccttatatggtcgagtggtacacaaagtcccatgggctcctggtgcagcaggccttaccgaaagccaaactgaaagagattgttgcagagtcggacgtgatgctaaaggagggatatgagaatttttttgacaagcttcagcagcattccatcccagtcttcattttcagtgcaggtatcggtgatgtgctcgaggaggttattcggcaggccggagtctaccatcccaatgtgaaagtggtttccaacttcatggatttcgatgaaaccggcgttctcaaaggattcaaaggtgagctgatacacgttttcaacaagcacgatggtgcacttaggaatactgagtatttcaatcagttgaaagataatagcaacataatcctgctaggtgattctcagggcgatctgagaatggctgatggtgtggccaatgtggaacacatcctgaagatcggttatctgaacgaccgagtcgacgagcttcttgagaagtacatggactcctatgacatcgtcttagttcaggacgagtcgctggaggtggccaattcgattcttcaaaagatattgtag

SEQ ID NO: 212806 - DNA, 894 bp, Artificial Sequence
  Description of Artificial Sequence: Synthetic coding sequence
atgacaaaccaggagtctgccgtgcacgttaagatgatgccagagttccagaagagctctgtacgaatcaagaatcccaccagggtggaggagattatttgcgggctcatcaagggtggagccgctaagctccagataatcacggatttcgatatgactctgagtaggttcagctataagggaaaacggtgccccacttgccacaacattatcgacaactgcaaactagtgacagacgagtgcagaaagaagttactccagctaaaggagaagtactacgccatcgaggttgatccggtgctgaccgtggaagaaaagtacccctatatggtcgagtggtataccaagtctcacggcctgttggttcaacaagccctaccgaaggcaaagcttaaagagatcgtggcagagtcggacgttatgttgaaagaagggtatgaaaatttcttcgataaacttcaacagcatagcatacccgttttcattttcagcgccggaataggcgacgtgctggaggaggtcattcgacaggctggtgtgtaccatcctaacgttaaggtcgtgagcaattttatggactttgacgagacaggcgtactgaagggctttaaaggcgagcttattcatgtcttcaataaacatgatggcgctctgcgaaatacggaatactttaaccaattgaaagataatagcaatatcattctcctgggcgatagtcagggagatttgaggatggctgatggggtggccaatgtggagcacattctgaagattgggtatctgaatgaccgggttgacgagctcctagaaaagtatatggatagctacgacatcgtccttgtgcaagacgaatccctcgaggtggctaactcgatactccagaaaatcctttag

SEQ ID NO: 212807 - DNA, 894 bp, Artificial Sequence
  Description of Artificial Sequence: Synthetic coding sequence
atgacaaaccaggagagcgccgtccatgtcaagatgatgcccgaattccagaaatccagcgtgcgcatcaagaatccaacaagagtggaggagataatatgtggccttattaagggcggtgccgctaagctgcagatcataaccgattttgatatgacactgtcccgcttcagctacaagggaaaacggtgtccaacatgccataatatcattgacaattgtaaattggtgactgatgaatgccgcaagaaactcctgcagctcaaggagaagtattatgcaatcgaagtcgacccagtgctcacagtcgaagagaaatatccttacatggtcgagtggtacactaaatcccacgggttgcttgtacaacaggccttgcctaaagccaagcttaaggaaattgtggctgaaagtgatgttatgctaaaagagggttacgaaaatttctttgataagctacagcagcattccattccagtgtttatcttctcggctgggatcggggacgtgcttgaagaagtgataagacaagccggagtctaccacccaaacgtgaaggtagtgagtaactttatggacttcgatgagactggcgttctgaaaggctttaaaggggagctgattcacgtgttcaataagcatgatggggctctgcggaataccgagtacttcaatcaactgaaggataacagcaatatcatattactcggagatagtcagggtgacctgcgtatggccgacggtgtcgctaacgtcgagcatatactgaaaatcggatacctgaacgaccgagtagacgagttactcgaaaaatacatggactcctatgacatagtgttagtacaagacgagtccctggaagtggccaatagcattttgcagaaaatcttatag

SEQ ID NO: 212808 - DNA, 858 bp, Artificial Sequence
  Description of Artificial Sequence: Synthetic coding sequence
atgccagagttccagaaatcgagcgtcaggattaaaaatcccacacgcgtggaagaaataatctgcggacttatcaagggcggagctgcgaagctccaaatcatcaccgactttgacatgactcttagcaggttcagctacaagggcaagcgctgtcccacttgccacaacatcattgacaattgcaagctggtcacagacgaatgtaggaaaaagctccttcagttaaaggaaaaatactacgctattgaagttgatccagtgctcactgtggaggagaaatatccgtacatggtcgaatggtacacaaaatctcacggcctgcttgttcaacaggcgctgcctaaggccaaactaaaggaaatcgtggccgagtcagatgtgatgcttaaggaaggctacgagaacttctttgacaagcttcaacagcattccatccctgtctttattttctctgccggtatcggggacgtgctggaggaagttataagacaggcaggcgtgtatcatccaaatgtgaaggtcgtctctaatttcatggactttgacgagactggcgtactgaaaggctttaaaggggaacttatccacgtgttcaacaaacacgatggcgctctgaggaacaccgagtatttcaatcaactcaaggacaacagcaatatcatactgctcggagatagccagggcgacttaagaatggctgatggcgtggctaatgtggaacacatccttaagattggatacttgaacgatagggtggatgaactgctcgagaagtacatggattcctacgatattgtgctcgtccaggacgagtctcttgaagttgccaactcaatcctacagaaaattctgtag

SEQ ID NO: 212809 - DNA, 129 bp, Artificial Sequence
  Description of Artificial Sequence: Synthetic coding sequence
atgccagaatttcagaagtcctccgtgcgtatcaaaaaccccaccagagtggaggaaatcatttgtggtctgatcaaggggggagcagccaaacttcagatcataacagatttcgatatgactttgtag

SEQ ID NO: 212810 - DNA, 1725 bp, Artificial Sequence
  Description of Artificial Sequence: Synthetic coding sequence
atgtgcccacgggcagcccgtgcgccagctaccttgctgctcgccctcggcgctgtgctatggcccgctgccggagcttgggaattgacaatcctccacaccaacgatgtccattcccggcttgaacaaacctctgaggatagctctaagtgcgtgaacgccagtcgatgtatgggtggggtcgctcgcttgttcactaaggtccagcaaatcagaagggctgagcccaacgtgctgcttctcgacgctggagatcaatatcagggtaccatctggtttacagtttacaaaggggctgaagtagcgcatttcatgaatgcactgcgctacgatgctatggccctcgggaatcatgaatttgataacggcgttgagggccttatcgagccgctcctgaaagaagctaagtttccgattctctcagccaacattaaagccaagggacctttagcttcgcagatcagtggactctacctgccttacaaagtcctgccagtgggcgacgaggtggtggggatagtgggttacacaagtaaagagaccccctttttatcaaacccaggtacgaacctggtcttcgaggatgagatcactgctctccagcctgaagtagacaagctgaagaccttgaatgttaataaaataattgctttgggtcatagcgggtttgagatggacaaactgatcgcccagaaagttagaggagtggatgtggtggtgggagggcacagtaatacttttctctatactggaaacccaccctcaaaggaggtccccgctggcaagtatccattcattgttacgagcgacgacggtcgaaaagtacccgtggtgcaggcttacgcttttggaaagtatctcgggtacctgaagattgaattcgatgaacggggtaacgtaatctcaagtcacgggaatccaatcctgctgaactcctcaatacccgaagatcctagtataaaagccgatatcaataaatggagaatcaaactggataactatagtactcaggagctgggtaaaaccatcgtataccttgacggatccagtcaaagctgtagattcagggaatgtaacatgggaaatcttatttgcgatgcaatgattaataacaacttgcgacatacagacgagatgttctggaatcacgtgtccatgtgtatcttgaacggcggaggtattcgatcccctatcgatgagcgcaacaatggtactatcacatgggagaatttggctgcagtgctgcctttcggcggaacatttgatctggtccagctgaagggatccaccctaaagaaagcctttgaacattccgtgcaccggtatggccaatccactggcgaatttttacaggtcggcggaatccacgtggtatatgacctcagtaggaaaccaggcgaccgggtggtcaagctggatgtgctctgtacaaaatgccgcgtgccttcctacgacccattgaaaatggacgaggtctacaaggtgatcctgccaaatttcctggccaacggaggagacgggttccagatgatcaaggatgaactgctgcgacacgatagtggtgaccaggatatcaatgtggtgtccacgtacatatccaagatgaaagtaatatatcctgccgtggagggccgtatcaagttttctacagggtctcattgccacgggagtttttccctgattttcctatcgctgtgggcagttatattcgtgctctaccaatag

SEQ ID NO: 212811 - DNA, 795 bp, Artificial Sequence
  Description of Artificial Sequence: Synthetic coding sequence
atgtgtccacgggcagcaagagcgcctgccaccttgctactcgcattaggcgcagtgctgtggcccgcagccggagcttgggagctgaccattttacacacaaacgacgtacattccagattggaacagacatctgaggattccagcaagtgtgtcaatgcatctaggtgtatgggcggagtcgctaggctgtttaccaaggtgcagcagattaggcgcgcagaacccaacgtcctgctactggacgccggagaccagtatcagggcaccatctggttcacagtgtacaaaggggctgaggtggcacactttatgaatgcgctgcgctacgatgccatggctctgggtaatcatgagttcgacaacggcgtggaaggcctaatcgagcccctccttaaagaagcaaaatttcccattctgagtgctaatataaaggcgaaaggccctctggcttcccagatttcgggcctatacttaccgtacaaagtcctccctgtcggtgatgaggtcgtggggatagtcggctatactagcaaggagacaccgtttctgtccaaccccggaactaacctagtctttgaagacgaaatcaccgcactgcagcccgaggtcgataagttgaagactctgaacgtgaacaaaatcatagccctgggtcacagcggattcgaaatggacaaacttatagcgcagaaagtgcggggtgtcgacgtcgtggtcggtggccattcaaatacattcctttacaccggaaactgttttaagagaattgcttgggcacggatgtcccgctag

SEQ ID NO: 212812 - DNA, 780 bp, Artificial Sequence
  Description of Artificial Sequence: Synthetic coding sequence
atggacaaacttattgctcagaaagtgagaggagtcgatgtagtagtggggggacatagtaacacctttctctatacaggaaatccgccttcaaaagaggtccccgctgggaaatatccgtttatcgtcacaagcgatgacggaagaaaggttccggtcgtgcaggcttatgccttcggtaaatacctgggatatctaaagattgagtttgacgaacggggtaacgttatatcctcccatggcaatcccattttgctgaattcgtctattccagaggatccaagcatcaaggccgacatcaataaatggcggatcaaactcgacaactactcaactcaagagcttggcaaaaccatcgtttacctggatgggagctcacaatcctgccgttttcgcgagtgcaatatgggcaacctgatctgcgacgctatgataaataacaatctgagacacacggatgaaatgttttggaaccacgtcagtatgtgcattctgaacggcggtgggattcgttctccgatagatgaacgcaataatggaacgattacatgggagaacctggccgcagtcctgccattcgggggaacttttgatctggttcagctgaaggggagcacccttaaaaaggcgtttgagcactccgtgcaccggtacggtcaaagtaccggtgagttcttacaggtcggggatctgaaggagtgctgcccaatatgtatcaaccaagacgactcatggaaagagcagcctacagctcagacatacctaaacacgtggttctag

SEQ ID NO: 212813 - DNA, 1575 bp, Artificial Sequence
  Description of Artificial Sequence: Synthetic coding sequence
atgtgtcctcgtgcggctagagccccagctaccctgttgctggctctgggagcagtactttggccagctgcgggagcgtgggaactgacaattctccacaccaatgacgtgcactccagactggaacagacgtcagaagatagtagcaaatgcgttaacgcttccaggtgcatgggcggtgtagccagattattcaccaaggttcaacagatccggcgtgctgagcctaatgtgctcttattagacgctggcgaccagtatcagggaacaatctggttcaccgtctacaaaggagccgaggtggcccactttatgaatgcactgcggtatgacgccatggctctgggaaatcatgagttcgacaacggggtggagggcttaattgagcctctactgaaggaggctaagttcccaatcctctcggcaaatataaaggctaaaggacctctggcatcccagatcagtgggttgtacctgccatacaaggtgctcccagtcggcgacgaagtggtcggcatcgttgggtatactagtaaagaaactccgttcttatcaaatcctggtaccaatctggtctttgaggacgaaatcaccgctctgcagccggaagtggataaactgaagacattgaatgtgaataagattattgccctgggtcatagcggattcgaaatggataaattaatcgctcaaaaggtgaggggtgtcgacgttgtggtgggtggacattcaaacacgttcctgtatacagggaacccaccttccaaggaggtcccagcaggaaagtacccttttatcgtgacgagtgacgacgggaggaaggttcccgtagtgcaggcatatgcgtttggaaagtacctcggatatctcaaaatagaatttgacgagcggggtaatgtcatctcctctcacggaaaccctatcttgctgaacagctccatccctgaagacccctcaatcaaggccgacattaataaatggagaatcaaactcgacaattacagcactcaggagctgggaaaaaccattgtgtacttagatggcagtagccaaagctgccggtttcgagagtgcaatatgggaaatctcatctgcgatgctatgatcaataacaacctgcggcacacagatgagatgttctggaaccatgtctccatgtgcatcctgaacggtggtggcatccggtccccaattgacgagaggaacaacggtattcacgtggtatatgatctgtccagaaaaccgggagatagggtggtgaagttggatgtactatgcaccaaatgcagggttccctcttatgacccattgaagatggatgaagtgtataaggtgatcctgcccaactttctggctaacggcggtgacggattccagatgatcaaagacgaactgttacggcacgatagcggagatcaggacatcaacgtagtctccacatacatcagtaagatgaaggtgatctaccctgcagtggaaggccgtatcaaatttagtacaggatcacactgccacgggtcattctctttaatttttctgagtctgtgggctgtcatatttgtgctttaccagtag

SEQ ID NO: 212814 - DNA, 693 bp, Artificial Sequence
  Description of Artificial Sequence: Synthetic coding sequence
tgagacgtggttgtgggtgggcatagtaatacattcctttatacaggtaatcctccatccaaggaggtacccgctggcaagtacccatttatagtcacaagtgacgacggacgcaaggtgccagtcgtgcaggcatacgccttcggcaagtatctggggtaccttaaaatcgagtttgacgagcgcggtaacgtaatcagtagccatggaaatccaatcctgttaaactcaagcattcccgaagatccctccattaaagctgacatcaataagtggcgaatcaaactagataattacagtacacaggagctcggcaaaacaatagtttatctcgatgggagctcacagtcatgtcgattcagagagtgcaacatgggaaaccttatatgcgatgcaatgattaacaataacctgcggcatactgacgagatgttctggaatcatgtgagtatgtgtatcctgaacggagggggtatccgaagcccgatcgatgagaggaataatgggatacatgttgtgtacgacttgagccgcaaacctggtgaccgcgtggtgaaattggacgtgctttgtacaaagtgccgcgtgcccagttatgaccccttgaagatggacgaggtctacaaggtgatcctgcccaattttctggcaaacggcggagacggctttcaaatgatcaaagatgaattgtag

SEQ ID NO: 212815 - DNA, 540 bp, Artificial Sequence
  Description of Artificial Sequence: Synthetic coding sequence
tgaaaccccatccttctgaattcaagcatccctgaagaccccagcataaaggctgacataaataagtggcgcattaagctggataattacagtacgcaagaattaggtaaaaccatcgtgtacctggacggctcgagtcagtcctgccggttcagggagtgcaatatgggaaacttgatctgcgatgccatgataaacaacaatctgcgacataccgatgagatgttctggaaccacgtgagtatgtgcatactgaacggcggtggcattaggagcccaatcgatgaacgcaacaacggcactattacctgggaaaatctggcagctgtgctgcccttcggtgggacattcgacctagtccagctgaagggcagcacccttaagaaggcgttcgaacattcggtgcatcgatacgggcagagtacgggagagtttctgcaggtgggcgacctgaaggaatgctgcccaatttgcatcaaccaggatgatagctggaaggaacagcccactgcccagacttatctgaatacctggttctag

SEQ ID NO: 212816 - DNA, 687 bp, Artificial Sequence
  Description of Artificial Sequence: Synthetic coding sequence
atggtacgctatagtctggaccctgagaatcctactaagagttgtaaatcccggggttcgaatttgagggtgcactttaaaaacacccgtgagacagcccaggctatcaaaggaatgcatattagaaaggcgaccaaatatttgaaggacgtgaccctccagaaacagtgtgttccatttagaaggtacaatggtggcgtcggacgctgcgcccaagccaaacagtgggggtggactcagggcagatggccaaaaaagtccgccgaatttctgctgcacatgctgaaaaatgccgaatctaacgcagaacttaagggcctcgacgtggactctttggttattgagcacattcaggtcaacaaggccccaaaaatgagacgccgaacatacagggcacacgggagaattaacccctacatgtcctcaccctgtcatatcgagatgattttgacagagaaagagcagatagtgccaaagcccgaagaagaagtggctcaaaagaagaagcttcgcagttcctctcttgggaagtggtgtgcgttcctggtgtctagctttcagttttgttccggctccacaaaaaattcatggtcgcatatctataccctgtggtttccgccatccttggtggtgtatggcttacgcaaacagtacaagaaccccatgatccaaactaaggccaaatag

SEQ ID NO: 212817 - DNA, 816 bp, Artificial Sequence
  Description of Artificial Sequence: Synthetic coding sequence
atgtcaccagaaatgggggagctcacccagaccagactgcagaaaatttggatcccccattcctcaggaagtagcaggcttcagcgtagacgtggatcctcaataccccagtttacaaacagtccaactatggtgattatggtcggcttgcctgccagagggaagacttacatatcaaccaagttgacacggtatttaaattggattgggactcctaccaaagataatatggaggctctacaaatacggaaacagtgtgccctcgccgctcttaaggacgtgcataattatctctcacatgaagaaggtcacgtcgccgttttcgacgcaacaaacacaacacgggagcgacgttcattaatactgcagtttgccaaggaacacgggtataaaggggtgtgcgaagaaatgacctacgaagagattcaggaacattaccccgaggagtttgccctccgcgatcaggataagtaccgttacagatatccaaaaggggagtcctatgaggatttagtacagagattggaacccgtcatcatggagttagagagacaggagaatgtgctagtgatttgccaccaggcagtgatgcggtgtttgctggcttattttctggataaaagtagcgacgaactaccttatctgaagtgccccctacacacagtgttgaagttaacccccgtggcttacgggtgtaaggtcgagtcgatttacctcaacgttgaggccgtcaatacccatagagaaaagccagaaaacgtggacatcacgcgggagcccgaagaggcattagacactgtccccgctcattattag

SEQ ID NO: 212818 - DNA, 1416 bp, Artificial Sequence
  Description of Artificial Sequence: Synthetic coding sequence
atgtctccggagatgggagaactgactcagacccgtctacagaaaatctggatcccccacagtagcggcagctcacgcttacaaaggaggcgcggttccagtatcccgcagtttacaaactctccaactatggtaattatggtgggtctcccagccagaggtaaaacttatatttccacaaaacttactcggtatttgaactggattggaacacctacaaaagtttttaacctgggtcaatacaggagggaggccgtcagctacaagaattatgaattctttttgccagacaatatggaagccctgcaaataagaaagcagtgcgcgctggccgcattgaaggacgtgcacaattatttgagccatgaggaggggcatgtcgccgtattcgacgcaacaaacacgacgcgtgaaaggcgcagcttgattctgcaatttgccaaggaacatggctataaagtctttttcatcgagagcatttgcaatgaccctggcatcatcgctgagaatatccggcaggtgaaactgggatccccagattatattgactgtgaccgagaaaaagttctggaggatttcctgaaaagaattgaatgttacgaggtgaattaccagccactggacgaggagctcgatagtcacctctcctatatcaagatcttcgacgtaggtaccaggtacatggttaatcgcgtgcaagatcatatccagtccagaaccgtgtattaccttatgaacattcacgtgaccccccgttccatctacttgtgtaggcatggtgagtcagaactgaatatccgaggtagaatcggcggagatagcggtctgtcggtacgcggaaagcagtacgcctatgccctggcaaatttcattcagagtcaggggatatcgtcgctgaaagtatggacgtcccacatgaaaaggactatccagaccgcagaagcattaggcgttccctatgaacagtggaaggccctgaatgagattgacgccggagtttgtgaggagatgacatacgaggagattcaagaacattatcccgaagagttcgctctgcgcgaccaggataagtaccgctaccgttatccgaagggcgaatcctatgaagacctggtgcagcgtctggagccagtcatcatggagcttgaacgccaagagaatgtcctggtaatctgccatcaggctgtgatgaggtgcctgctcgcatactttctggataagtctagcgatgaactgccctatctgaagtgtcctttgcacacggtactcaagctgactcctgtcgcatatggctgcaaagtagaatcaatttatctgaatgtggaggcagtgaatactcacagagagaagcctgagaatgtagacatcacaagagaaccggaagaagctttagataccgtgcccgcacattactag

SEQ ID NO: 212819 - DNA, 1221 bp, Artificial Sequence
  Description of Artificial Sequence: Synthetic coding sequence
atggaggagaaaacgtcccggatcaaggtgttcaatcttgggcagtaccggcgtgaggccgtatcttacaaaaattatgagtttttcctgccagacaatatggaggcattgcaaatcaggaagcaatgcgccttagcagctctcaaagacgtgcacaactacctctcccacgaggaaggacacgtggccgtgttcgatgccactaacactaccagagaacgcaggagtctcatattgcagtttgcaaaggaacacggctacaaggtcttttttatagaaagcatctgcaatgatcccggaattattgccgagaatattagacaagtgaagttgggaagccccgactacatcgattgcgaccgcgagaaggttctggaagacttcttgaagcgtatcgagtgctatgaggttaactatcagcctctggacgaagaacttgactcgcacctcagctacattaagatctttgacgtcggcaccagatatatggttaaccgcgtgcaggatcacatccagtccagaaccgtgtactaccttatgaatattcacgtgactccacgatcgatctacctctgccgccatggagagtctgaactgaacatcaggggcaggattgggggagactctgggctctctgtgcgcggtaaacagtacgcttacgctttggctaatttcatccaaagtcagggcatatcatcactgaaggtttggacgtctcatatgaagcggaccatccagacagctgaggccctgggggtgccatatgagcagtggaaggccctcaacgagattgatgctggcgtatgcgaggagatgacatatgaggagatccaagagcactatcccgaagagttcgccctgagagatcaagacaaatatcggtaccgctacccaaagggtgagtcgtatgaggatctcgtgcagaggcttgagccagtcataatggagctggagaggcaggaaaacgtcttagtgatttgccatcaggccgtcatgagatgcttgctcgcatacttcctggacaagtcttccgacgagctgccctacttgaaatgcccacttcacaccgtgctgaagctcactcccgtggcttatggctgtaaggtcgaatctatctacctaaatgtggaggctgtaaacacacacagggaaaaacctgaaaatgtggacattactagagaaccagaggaagccctggatacagtgcccgcacactattag

SEQ ID NO: 212820 - DNA, 1416 bp, Artificial Sequence
  Description of Artificial Sequence: Synthetic coding sequence
atgagcggagcaagctcgagcgagcagaacaataacagctatgagacaaaaacccctaatctcaggatgtccgagaagaagtgctcctgggctagttatatgactaattccccaaccttgatcgtaatgattggcctcccagctagggggaagacttacgtgagcaaaaaactgacccgataccttaattggatcggtgtcccgacaaaggtgttcaacttgggagtataccggagggaggccgttaaatcctacaaatcctatgacttcttcagacacgataacgaggaggctatgaagatccgcaaacagtgcgcccttgtggcccttgaggacgtcaaggcatatctcacagaagagaatggacaaatcgccgtctttgacgcaaccaacactaccagggagcgcagagacatgattcttaacttcgcagaacagaatagtttcaaggtgttcttcgtcgagagcgtgtgcgacgacccagacgtgatcgcagcgaacatcctggaggtgaaggtgtcgagccctgactacccagaacggaatagggagaatgtgatggaggattttcttaaacgcatcgaatgctacaaggtgacttataggccactggacccggacaactatgacaaggacttatcttttattaaggtcatcaacgtaggtcagagattcctggtcaaccgtgtccaagactatatccagtccaagattgtgtactacctaatgaacattcatgtacagcccagaacaatttacctatgccggcacggggagagcgagttcaatctgctgggcaagataggcggagattccggcctaagcgtgaggggaaagcagttcgcacaagctctccggaagttccttgaggagcaggaaatcactgatctgaaagtttggactagccagctgaaaaggacgatccagacggccgaatccctcggtgttccctatgagcaatggaagatcctaaacgagatcgatgcaggagtgtgcgaagagatgacctatgcagagatcgaaaaaaggtaccccgaggagtttgcgcttagggaccaggaaaagtacctttacaggtaccccggtggcgagtcttaccaggatctggtccaaagactggagccggtaatcatggagctggagcgccaaggaaacgtgctcgttattagccaccaagcagtgatgcgctgtttacttgcctattttctggataagggcgctgatgagctgccttatctccgctgcccgctccacaccatttttaagcttacacctgtggcgtacgggtgtaaggttgagaccatcaagctgaatgttgaagccgttaacacccacagagacaagcctaccgccgctgagaccacactcgcggtgagacgaagaccaagcgcagcttccttaatgctgccttgctag

SEQ ID NO: 212821 - DNA, 1518 bp, Artificial Sequence
  Description of Artificial Sequence: Synthetic coding sequence
atgagcggcgctagttcatccgagcagaataataacagctatgaaacaaagacccccaacttgcggatgtcagagaagaagtgcagctgggcatcgtacatgacaaacagtccaaccctgattgtgatgatagggctcccagcaaggggcaaaacttatgtctccaaaaaactgactcgttatctgaactggattggcgtcccaacaaaagtatttaatctgggggtgtacagacgcgaagcggtcaagtcttacaagtcctacgacttttttaggcacgataatgaggaggcaatgaagatccggaaacagtgcgcgctggtggccttggaggacgtcaaagcgtatctcactgaagagaacggccagattgctgtctttgatgctaccaacactactcgggaacgccgtgacatgattttgaacttcgccgagcagaattcgttcaaagtgttcttcgttgaatcggtttgcgatgatcctgatgttatcgccgctaatatcctcgaagtaaaggtatcgtcaccggactatcctgagcggaacagggagaatgtcatggaagactttctaaaaaggatcgagtgttacaaagtcacgtaccggccactggaccccgataactatgacaaagacctctcattcattaaagtgataaacgtgggccaaagattcctcgtgaatcgagtgcaagactatatccagagcaaaatcgtgtactatctgatgaacatccatgtccaaccaagaacgatctatctatgccgtcatggcgaatcagagttcaatctgctgggaaagatcgggggagattcgggattatcagtgaggggtaagcaatttgcccaggccctgcggaaatttcttgaggaacaggagatcaccgatctcaaggtgtggacttcgcaacttaagaggacaatccaaactgccgaatccttgggagtcccatacgagcaatggaagatccttaacgagattgatgcaggagtgtgtgaggagatgacgtatgcagaaatcgagaagaggtaccccgaagaattcgctctgagagatcaagagaagtacctgtaccgctatcctggcggtgagtcttaccaggatctcgtccaacgattggagccagtgattatggagttggaacggcaggggaacgtgttggtcatttcccaccaagccgttatgaggtgtttgttggcctattttctggacaagggcgctgacgagctaccatacttgcgttgcccactgcatacgatcttcaagctcacgcctgtggcatatggatgcaaggttgagacaatcaaactgaacgtggaggcggtcaacacccacagagacaagcctaccaacaacttcccaaaaaaccagacccctgtgcgcatgagaagaaactcctttactcctctatcctcctcaaatacaattaggagacccaggaactacagtgtgggatctcggccactaaagcccttgtccccactgcgggcacaagatatgcaagagggtgccgactag

SEQ ID NO: 212822 - DNA, 1122 bp, Artificial Sequence
  Description of Artificial Sequence: Synthetic coding sequence
atgaagatacgcaaacagtgtgctctcgtggccctggaggacgtgaaagcttacctgaccgaggaaaacgggcagatcgccgtcttcgacgcgactaacactacacgggaaaggagagacatgatactaaattttgctgagcagaatagtttcaaggtgttctttgtggagagtgtttgcgatgatcccgacgtcatcgcggctaacatcctggaggttaaggtatcaagccccgactacccggagaggaaccgggaaaacgtcatggaagacttcctcaaacggattgaatgctataaggtgacctaccggcctctcgacccagataattacgacaaagacctgtctttcatcaaggtcattaacgtggggcagcgatttctagtgaatagagtccaggactacatccaaagtaagattgtttactatctgatgaacatccacgtacagccacgaaccatctacctgtgtcgccacggggagtcggaatttaacctgttgggaaagatcgggggagactctggactgtctgtgcgaggaaagcagtttgctcaggccctgcgcaaatttctggaggaacaagaaatcaccgacctgaaagtgtggacatctcagctgaagagaaccattcagacagccgagtcccttggggtgccctacgagcagtggaagattctgaacgagatcgatgctggggtgtgcgaggagatgacatatgccgaaattgagaaaagatatcccgaggaattcgcactgagagaccaggagaaatatttgtatcgctaccccggaggggagtcctaccaggaccttgtgcagagactggaacctgtgatcatggaattagagcgtcagggcaatgtacttgtgatttcccaccaggcggtgatgagatgcctactggcttactttctggacaagggagcagacgagttgccgtacctaaggtgtcctttgcataccatctttaaactgacccctgtcgcatacgggtgtaaggtggagacaattaaactgaacgtggaagccgtgaacacccacagagacaagccgacagccgcagagacgactctcgctgtcaggaggaggccctctgccgctagcctgatgttaccctgctag

SEQ ID NO: 212823 - DNA, 795 bp, Artificial Sequence
  Description of Artificial Sequence: Synthetic coding sequence
atggaggacttcttaaaacgcattgagtgctacaaggtgacctacaggcccttggatcccgacaactacgacaaagacctaagcttcataaaggttataaatgtcggccagagatttctcgtgaaccgcgtacaagactatatccagtcgaagatcgtgtactacctgatgaatatccatgttcaaccacggacaatttatctttgcagacacggggaaagcgagttcaacttgctcggcaagatcggtggagactccggactttccgtacgcggtaaacagttcgcgcaggccctgcggaagtttttagaggagcaagagattaccgacctgaaagtgtggacatcgcagttgaagagaactatacagactgcagagtccctgggtgttccgtatgagcagtggaaaatcctcaatgaaatcgatgcaggagtctgcgaagaaatgacgtacgcggaaatagaaaaacggtatcccgaggagtttgctttgcgagaccaggaaaaatatctttaccggtaccccggtggggagtcttaccaagatctggtgcagcgtttggaacccgtcatcatggaactggagcgccaggggaatgtactcgtgatctcacaccaggccgtgatgcgctgtctcctggcttacttcctggacaagggtgcaggctgtaaggtggagaccattaagctaaatgtcgaagctgtgaatacccatcgcgacaagccaaccgccgctgagaccacgctcgccgtgcgacggcgtccttctgccgcttcattaatgctgccatgttag

SEQ ID NO: 212824 - DNA, 1419 bp, Artificial Sequence
  Description of Artificial Sequence: Synthetic coding sequence
atgacaaattcccccaccttgatagttatgatcggcctgccagcacgagggaagacctacgtcagcaagaagttgacccgctacctcaactggattggcgtgcctacgaaagtcttcaaccttggggtatacaggagggaagcagttaagtcttataaatcgtatgacttctttaggcatgataatgaggaagccatgaagatcaggaagcagtgcgctcttgtcgctctggaggatgtcaaagcatacctcacagaggaaaacggccaaatcgccgtgtttgatgctacaaatactacccgagaacggagagacatgatcctaaacttcgccgagcagaacagctttaaggtttttttcgtggaaagtgtgtgtgacgatccagatgtgattgctgccaacattctggaagtcaaggtctccagtcctgattatcctgagaggaaccgggaaaacgtgatggaagacttcttgaagcggatcgagtgttataaggtgacctacaggcccttggaccccgacaattatgataaggacctcagttttatcaaagtcataaatgtcggtcagcggtttctcgtgaacagggtgcaggattacatccaaagcaaaatcgtgtactatctcatgaacatccacgtgcaacctaggacaatctacctgtgtagacacggcgagtcggagttcaacctcttaggtaagattggcggtgattccggactctctgttaggggaaaacagttcgctcaggcccttagaaagttcctggaggaacaggagattacagatctgaaggtgtggacaagtcagctaaaacgcaccattcagaccgccgaatccctgggggtgccatacgagcagtggaaaattctgaacgaaattgacgccggagtatgcgaagagatgacttatgctgagatcgagaagcgctatccggaagaatttgcattgcgagaccaggaaaaatacctgtaccgataccctggcggagagtcctatcaggatctcgtgcagaggctagaaccggtaatcatggaacttgagcgtcaggggaacgtgctggttatctcacaccaggccgttatgcgctgcttattggcttacttcttggacaagggcgctgacgaactgccttacctgagatgcccactccatacgatttttaaactgaccccggttgcgtacgggtgtaaggtggaaacaataaagctgaacgtcgaggccgtgaatacacaccgcgataagccaaccaataatttccctaaaaatcagacgcccgtcagaatgcgccgtaacagcttcactcctctctccagttcaaacaccattaggcggccacgtaactacagtgtggggtcccgccctcttaagcctttgagcccgttacgcgcacaggatatgcaagaaggcgctgactag

SEQ ID NO: 212825 - DNA, 1542 bp, Artificial Sequence
  Description of Artificial Sequence: Synthetic coding sequence
atgcctctggagttaacacagtcacgagttcagaagatttgggttcccgtggaccaccgccctagtctgcctcgctcctgcgggcctaaactgactaacagccctacggttatcgtcatggtgggactgccagctagaggaaaaacatacatctcgaaaaaactcacgcgttacctcaattggatcggcgtacccacaaaagtcttcaacgtaggggagtaccggcgtgaggctgtcaagcagtattcttcatacaacttttttagacccgataatgaagaagccatgaaagttcggaagcagtgtgccctcgcggctctcagggacgtgaaatcatacttggcaaaggaagggggtcaaattgccgtgttcgatgcgacaaacacaacacgcgagagaagacacatgatcctgcattttgcgaaagagaacgacttcaaagccttttttatcgagtctgtgtgcgatgaccccactgtcgttgctagcaatatcatggaggtcaaaatttccagtcccgactacaaggactgcaatagcgctgaggcgatggacgattttatgaagagaatctcctgctacgaagcttcttaccaacctcttgacccagataaatgtgacagggacctatccctaatcaaggtgatcgatgtgggtcgcaggtttctcgtcaacagggtgcaggaccacattcagagccggattgtgtactatcttatgaatatccatgttcagcctagaacaatatacctgtgtagacacggggaaaacgagcataatcttcagggtcggattggcggagattctggcctgtccagtcggggtaagaaattcgcctctgctctgtccaagtttgtcgaagaacagaacttgaaagacctgcgggtctggactagccagctcaagtccactatccagaccgccgaggccttgcgcctgccctacgaacagtggaaagccctgaacgaaatcgatgcaggcgtttgcgaggagctgacgtatgaggagattcgagacacctatcctgaggagtacgccctgcgggaacaggataaatattattacagataccctacgggggagtcttatcaggacctggtgcaacggttggagcctgtgatcatggaactagagagacaagagaacgtgctggtgatctgtcaccaggccgtccttaggtgtctcctggcttacttcctagataagtctgccgaggagatgccgtatctcaaatgtcccctgcacacggtgctgaaacttacccctgtggcctacgggtgtagagtagagagtatttacctcaacgtggaaagcgtttgcacacatagagagagaagtgaagacgccaaaaagggacccaatcccctgatgcgacggaactcagttacaccgctggcttcacccgagccaacaaaaaaacccagaatcaattctttcgaagaacatgttgcctccactagtgcagcgctgccgtcttgcctgccaccagaggttcctacccagttgcctggacagccactcctgggccaggcctgtctgtag

SEQ ID NO: 212826 - DNA, 1545 bp, Artificial Sequence
  Description of Artificial Sequence: Synthetic coding sequence
atgcctcttgagctgacacagagccgcgttcagaaaatctgggttcctgttgatcaccgtcccagtctccctagaagttgcggacccaagctgactaacagtcctaccgtcattgtcatggtgggtcttcctgctaggggaaagacgtacatctccaaaaagctgactcggtacttaaactggatcggagtgccgactaaggtcttcaacgttggggaataccggagggaagctgtcaaacagtactctagctataacttctttagaccagacaatgaggaggccatgaaggtccgcaagcagtgtgctctggccgcattgcgcgacgtcaaaagctatctcgccaaggaaggcggacagattgctgtgttcgatgccacgaacaccacgagagaacggagacatatgatcctgcacttcgcaaaggaaaatgattttaaggctttctttatagagtccgtgtgcgacgatcccactgtggtcgccagcaacattatggaagtcaagatttcgtcacccgactacaaggactgtaatagtgccgaagctatggatgacttcatgaagaggatcagctgttatgaagccagctatcagccattggaccctgacaagtgcgatcgcgatctgtccctgataaaggtgattgacgttgggaggcggtttcttgttaatcgggtgcaggaccatattcaaagccgtatcgtgtactacctgatgaacatccacgtgcagccaaggacaatatacttgtgtcggcacggggagaatgaacacaacctgcaagggcgaatcggcggagactctggcctctcttcccgaggtaagaagttcgcttccgccttaagcaaattcgtggaggaacaaaatctaaaggacctgagagtgtggacctcccaactgaagagtactatccagactgccgaagccctccgtttgccctacgagcagtggaaagccctcaacgaaattgacgcgggagtttgcgaggagctgacatacgaagagattcgcgatacttatcccgaagaatatgcattacgcgagcaggataaatactactaccgctacccaaccggcgaatcctaccaggacctggttcagaggctggaaccagtgataatggaattggagagacaggagaatgtgctggttatctgtcaccaggcagttctgcggtgtctgctggcatattttcttgataagtccgccgaggagatgccctatcttaaatgcccgctccacacagtcttgaagctgactccagtggcatatgggtgcagagttgaaagcatttatcttaatgtggaatccgtttgtactcacagagaacggtcggaggatgctaaaaaaggccctaatcccctgatgaggcggaacagcgtgaccccactcgccagcccagagcctaccaagaaacccaggataaatagcttcgaagagcacgttgcctcaacttccgctgcactgccctcgtgcctgcctccagaggtgccaacccagctccccggacagcctttgctcgggcaggcctgcctgacatag

SEQ ID NO: 212827 - DNA, 1545 bp, Artificial Sequence
  Description of Artificial Sequence: Synthetic coding sequence
atgccgctagaactcactcagtctcgcgtacagaagatctgggtccctgttgatcatcgaccctccctgccacgtagctgcggccctaagttgaccaacagccctacagtgatagttatggtcggcctgcctgctcggggaaagacatacatttcaaaaaagctcacaaggtacttgaactggattggcgtgcctacgaaggtcttcaacgtgggagagtacaggcgcgaagcggttaagcagtattcctcttataatttctttcggccagataatgaggaagcgatgaaagttaggaagcaatgcgcactagcggctttgagggatgtcaagtcatacttggcaaaagaaggcggacagatagcggtgttcgacgcaactaataccacccgcgagcgaagacacatgatccttcactttgcgaaggagaacgattttaaggcctttttcattgagtctgtctgcgatgatccaacagttgttgcttctaacattatggaggtgaaaatctcgagtccagactataaagattgtaactctgctgaagctatggatgatttcatgaagcggatctcctgttatgaagcttcctaccaacccctcgatcccgacaaatgcgacagggatctgtccctcatcaaagtgatcgatgttggtaggcggtttttagtcaacagagtgcaggatcacatccagtctaggatagtctattatcttatgaatatacacgtccagccacgaacgatctacttgtgccgccatggtgaaaatgagcataacctgcaaggtcgcattgggggagatagtggactttcttctaggggaaagaaattcgcctcagccctgagcaagttcgtcgaggagcagaatcttaaggatctgcgagtttggaccagtcaactgaaaagcactatccagacagccgaggcactgcgcctgccttacgaacagtggaaagccctgaacgaaatcgacgccggagtatgtgaggaattaacatacgaagaaatccgagacacctatccggaagaatatgcccttcgggaacaagataaatactattacaggtacccaacaggcgagtcataccaagatctggtgcaacggttagagcctgtgatcatggagttggaacggcaagaaaatgtgctggttatctgccaccaggccgtattgcgatgtctgctcgcctatttcctggataaatcggcagaagagatgccatacttaaaatgccctctgcacaccgtactgaagctgacacccgttgcgtacgggtgccgcgtggagagcatttaccttaatgtggagagtgtctgtacccaccgagagaggtctgaggacgctaaaaaagggccaaaccctttaatgaggagaaattccgtgactcctttagcctccccagagcctaccaaaaaacctaggatcaacagtttcgaagagcacgttgctagtacctcagcagccctcccttcttgcttaccacccgaagttccgacgcagctgcctgggcagccactgcttgggcaagcatgtttgacctag

SEQ ID NO: 212828 - DNA, 1563 bp, Artificial Sequence
  Description of Artificial Sequence: Synthetic coding sequence
atgcccctcgagctgacccagtcccgggtacagaaaatctgggtgcccgtggatcatagaccctccctccctcgctcttgtgggcctaaattaacaaatagccctacggtgattgtcatggtgggcttacccgctagaggtaaaacttacatcagtaagaagctgacgagatatctcaactggatcggcgtgcccaccaaggtttttaatgtcggcgagtacaggcgggaagctgttaaacagtatagctcatacaatttctttcggcctgataatgaagaagcgatgaaagtccggaagcagtgtgccctcgccgcactgagagacgttaaatcgtacctggcaaaggagggcggacagattgccgtgttcgacgcaaccaacaccacgagagaacgtcggcacatgatcctccatttcgctaaggagaacgatttcaaggctttttttattgagtcagtgtgcgatgaccctactgtagtggctagtaatattatggaagtgaagattagctctccggattacaaagattgcaatagtgctgaggcaatggacgattttatgaagaggataagttgctacgaagcgtcctaccagcctctggaccctgacaaatgtgacagagacctgtctttaatcaaggttatcgatgtagggaggaggttccttgtaaatagagtgcaggatcacattcaatctcggattgtctactacctaatgaatatccatgtgcaacccaggaccatttatctgtgtcgtcatggggaaaatgaacataacctgcagggacgtattgggggtgatagcgggctttcctcacggggaaagaagttcgcatcagccctgtctaaatttgtggaggagcagaacctgaaggatttgagggtgtggacgtcgcaacttaaatctaccatccagactgcggaagcgttgcggcttccttacgaacagtggaaagcactgaatgagatcgacgcaggcgtgtgcgaggagctcacgtacgaagagatcagggacacctaccctgaggaatacgctctgcgggagcaggataaatactactacagatatcccacgggcgagagctatcaggacttagtgcagagactagagcctgtgatcatggagcttgagaggcaggagaacgtactggtcatctgtcaccaggccgtcctgcggtgcctacttgcttatttcttggacaagtccgccgaggaaatgccttatctaaagtgtcctctccatacggtgctcaagctgacccccgtggcctatggttgccgagttgagtccatctacctcaatgtggaatccgtctgtactcaccgagagcgaagcgaagatgctaagaaaggacccaacccactaatgcggaggaattccgtgacgccgctcgcctcccccgaaccaacaaagaagcctcgcataaacagctttgaggagcatgtggccagcactagcgccgcactcccgtcatgtttacctccagaggtgcccacacagcttccaggccagaacatgaaaggaagcagaagctccgccgactcatcacggaaacactag

SEQ ID NO: 212829 - DNA, 354 bp, Artificial Sequence
  Description of Artificial Sequence: Synthetic coding sequence
atgccatacctcaaatgcccactgcatacggtcttaaagctgacacctgtcgcatatggttgcagggtggaatcaatctatctcaacgtagaaagcgtctgcactcacagggagaggagtgaagatgctaagaaggggcctaaccccttgatgagaaggaactcagtgaccccattggcatcccctgagccgacaaaaaaaccaaggataaattcattcgaagagcacgttgcctctacaagcgcagctttgccaagttgcctccctccggaagttcctacccaactccctgggcagcctcttttgggtcaggcctgccttaattggaaaggagtaatgcggaacgcggcatag

SEQ ID NO: 212830 - DNA, 1581 bp, Artificial Sequence
  Description of Artificial Sequence: Synthetic coding sequence
atgccattggagttaacacaaagcagggttcagaaaatctgggtgcctgtggaccatcgccctagcttaccaagaagttgtggtcccaagctaacaaactctcctacagtgatcgtgatggttggactgcctgccagaggcaagacttatatcagtaagaagttgactagatatctcaattggatcggggtacctaccaaggtgttcaacgtgggagagtaccggagggaggccgtgaagcaatacagctcgtacaactttttcaggccagacaatgaggaggcaatgaaagtgcggaagcagtgcgccttagccgctttaagggacgtgaagtcttatctggccaaagaagggggtcagattgccgtattcgatgccactaataccacacgtgaacgccgtcatatgatacttcactttgccaaagaaaacgactttaaggccttcttcatcgaaagcgtgtgcgacgacccgacagtggtcgcgagtaacattatggaggtaaagatatcttcccccgactacaaagactgtaacagcgccgaagcaatggatgactttatgaagcggatttcttgctatgaagctagctaccaaccactggacccagataaatgcgaccgggacctgtcgctgattaaagtcatcgacgtaggtcgcaggtttctggtgaatcgggtccaggaccacatccagagtagaattgtgtactacctcatgaacatccatgttcaacctagaactatctacctttgtcgccacggtgagaatgaacacaatctccaggggagaatcggcggtgatagcgggctgtcctccagaggcaaaaagttcgcctctgcgctgagtaagttcgtcgaggaacagaatctcaaagacctaagggtttggacttctcaattgaaatctacaatccagactgctgaggccctgagattgccctacgagcagtggaaagcactcaacgaaatcgacgctggagtttgtgaggagctgacctacgaggagattcgcgacacttacccagaggagtacgcacttcgggagcaggacaaatattactataggtatcccaccggtgagtcctaccaggatttagtgcagcgcttggaacccgtcattatggagctggaaaggcaggaaaatgtgctagtgatctgccatcaggccgttctgcgctgccttctcgcttacttcctagacaaaagtgcagaagagatgccgtacctgaagtgccctctgcacaccgtcctgaagctgactccggttgcgtacgggtgccgcgtggagtctatctacctgaatgtagaatcagtctgcacgcaccgggagcgctccgaggacgctaagaaggggcctaaccccctgatgaggagaaactctgtaacgcctctggcgtctcccgaacccaccaaaaaacccagaatcaacagtttcgaggagcatgtggcctctacctctgctgcattgcctagttgtctacctcccgaagtcccaacacagctgcccggtcagccactgctcggacaggcatgcctccgcaccgtctgtcacatttttagcaagttttcaccctattag

SEQ ID NO: 212831 - DNA, 567 bp, Artificial Sequence
  Description of Artificial Sequence: Synthetic coding sequence
atgaatattcacgtccagcccaggactatttacctgtgtagacatggcgagaatgaacacaacctgcagggacgcattggtggagactccggtctgtctagccgcggaaagaagttcgcctcagctctaagcaagttcgtggaagaacagaacctgaaggatctgcgtgtgtggacctcacagctcaagtctacgatacagactgccgaggcactgagactcccatacgaacagtggaaggccctgaacgagattgacgcaagttatcaagatttggtgcagagactcgagcctgttatcatggagctggagaggcaggagaacgtgcttgttatctgtcaccaggccgtgctgagatgcctgttagcttattttctcgacaagagcgctgaggaaatgccatatctaaagtgtcccctccacacggtcctgaaattgacacctgtcgcgtatgggtgccgggtcgagtctatctacctgaacgtagagagcgtctgcactcaccgcgaaaggtcagagaatatgaagggatctagaagctcagccgacagcagtcgaaaacattag

SEQ ID NO: 212832 - DNA, 1581 bp, Artificial Sequence
  Description of Artificial Sequence: Synthetic coding sequence
atgccacttgagctgactcagtcccgcgtgcaaaagatttgggtccctgtcgatcatcgacctagcttacctagaagttgtggcccaaagctgaccaatagccccacggtgattgtgatggttggactacccgctcgtgggaaaacttacatatctaaaaaactgaccagatacctgaactggattggtgtgcccacgaaagtgttcaacgtgggggaataccgcagggaggccgtcaaacagtatagttcctacaatttttttaggccagataacgaggaagctatgaaggttagaaagcaatgcgctctcgcagcactgagagatgtgaagagttatctggccaaagagggagggcagatcgctgttttcgacgccacaaacacaacgcgggaacggagacacatgatcctgcacttcgccaaagaaaacgactttaaagcattctttatagagtccgtctgcgacgatcccacagttgtggcctcaaatataatggaggtgaaaatttcaagtccagactacaaggattgtaactccgcagaagcaatggacgattttatgaaacgtattagctgctacgaagctagttaccaaccattggatccagacaagtgtgacagggacctgtccctgatcaaagtgatagacgtcgggagacgctttctcgtgaaccgggtacaagatcacatccagagcagaatagtttattatcttatgaatatccatgttcagcccaggacgatttacctgtgcaggcacggtgagaacgaacataatctccagggccgtatcggaggggactccggcctgagttctcgaggcaagaaattcgcatcagccctcagtaaattcgtggaggagcagaatctgaaagacctaagggtctggacatctcaactcaagagcaccatacaaaccgctgaggcattaagactaccttacgagcaatggaaggcactgaacgaaatcgatgcaggggtgtgcgaggagcttacttatgaggaaatccgtgacacatacccagaggagtatgcactgagagaacaggataaatactactatcgatatcctaccggagagagctatcaggatttggtgcagaggctcgagcccgtaataatggaattggaaagacaagagaacgtcctagtgatttgtcaccaggcggtacttcgatgtttgctagcatatttcctggataagagcgctgaagaaatgccatacctgaagtgtcccctgcacacagtgctcaaacttacacccgtggcctatggttgtcgcgtggagtctatttacctaaatgtggagtccgtctgtactcaccgggagaggagtgaagatgcgaaaaagggccctaaccccttgatgcggcgaaactcagtcacaccattggcgtctcccgaacccaccaagaagccacgcattaactcttttgaagagcacgtggcatcaacaagcgcggcactaccaagttgcctgccccctgaagtgcctacccagttgccaggacagcccctgctgggccaagcgtgtctccgaaccgtgtgccatatattctctaagttttccccatactag

SEQ ID NO: 212833 - DNA, 1503 bp, Artificial Sequence
  Description of Artificial Sequence: Synthetic coding sequence
atgcctttccgtaaagcctgcggcccaaaactgacgaattcccctacggtgatcgtaatggtaggtttacctgctcgcggaaaaacctacatttcaaaaaagctgacacgctacctcaattggatcggagttcccaccaaagtgttcaacgtaggggaataccgccgtgaggccgtcaagcagtacagcagttataacttcttcaggcccgataatgaagaagccatgaaggtgaggaagcagtgtgccttggccgcactgcgcgacgtcaagtcatatctggccaaggaggggggacagatagccgtgttcgacgccactaatactactcgcgaacgacgccacatgatcctgcatttcgcaaaagaaaacgattttaaagccttcttcatagagtcggtgtgcgatgaccccactgtggtggcctccaacatcatggaggtgaagatctcgtcgcctgactacaaggattgcaattccgccgaggctatggacgactttatgaaaagaattagttgctatgaggcctcctaccaaccactcgatcctgacaaatgtgatcgggacctctcgttgatcaaggtgattgatgtgggaaggcggtttctggtcaatcgcgtgcaggaccatattcaatcacgcattgtatactacctaatgaatatccacgtgcagcctagaactatctatctgtgcagacacggagagaacgaacacaatcttcagggccgtatcggaggggatagcgggctgtcaagtcgcggaaagaagtttgcaagtgccctgagtaaatttgtggaagagcagaatttgaaagatctgcgggtttggacctctcaattgaaaagcaccatccaaacagccgaagcgctccggctaccatatgagcagtggaaagccctgaacgaaatcgacgccggtgtgtgcgaagagctaacatatgaagagatcagagatacataccccgaagaatacgccctgcgcgaacaggacaaatattattaccgctaccccaccggtgaatcctatcaggacctggtccagcggctggagcccgtgatcatggagttggaaaggcaggagaatgtgctggtgatttgccaccaggccgtgttacgctgtcttctggcttatttcttagacaagtcagctgaagaaatgccttacctcaagtgcccgctgcacacagtgctgaagctgacccccgtggcctacgggtgtcgcgtggaatcaatctatttgaacgtagaatctgtgtgcacacaccgagaaagatccgaggatgctaagaaagggcctaacccgctgatgcgtaggaatagtgtaacgcctttagccagccctgagcctactaagaaacccaggatcaactcctttgaagagcacgtggcctcaacctcggctgccctgccatcctgcctacctccggaggtgcccactcagctgcccggacagaatatgaaaggttcccgttcctcagcggactcttctcgcaagcactag

SEQ ID NO: 212834 - DNA, 279 bp, Artificial Sequence
  Description of Artificial Sequence: Synthetic coding sequence
atatacctgaatgtggagagtgtttgcacccacagagagcggtcagaagatgccaagaagggaccaaatcccctgatgcgtcggaattccgtaactcccctcgccagccctgaacctacaaaaaaaccacggattaacagcttcgaagaacatgttgcctccacctctgccgctctgccctcctgcctcccaccagaggtacccactcagctgcctggacagcccctactcgggcaggcttgtcttaattggaagggtgtgatgagaaacgcggcttag

SEQ ID NO: 212835 - DNA, 96 bp, Artificial Sequence
  Description of Artificial Sequence: Synthetic coding sequence
atttatctcaacgtggaaagtgtgtgcactcatcgggaacgttccgagaacatgaagggcagtaggagttctgctgactcttctcggaagcattag

SEQ ID NO: 212836 - DNA, 261 bp, Artificial Sequence
  Description of Artificial Sequence: Synthetic coding sequence
atgccctacctcaaatgccccctccacacagtgctgaaattgactcccgtcgcgtatgggtgccgagtggagtctatttacctgaatgtagagagcgtctgcacccaccgcgagcgcagtgaaggacttagtctctttcctcggctggaatgtggcggagcagtgaccgcgcattgttcgctgaacttattaggttcgagcgatccccctgcctcagcctcacgtgtggccgaaacgactggatgtaaagagggcacgtag

SEQ ID NO: 212837 - DNA, 432 bp, Artificial Sequence
  Description of Artificial Sequence: Synthetic coding sequence
tgagtcgaggagcagaacttaaaggaccttagggtgtggacctcccagttaaagtccaccatccaaaccgcagaggctcttagactgccttacgagcagtggaaggccctcaacgaaattgacgccagttatcaggacctggttcagcgcctggaacctgtgattatggagctggaacggcaagagaacgtgctggtcatctgtcatcaggcggtgctccgctgccttcttgcctattttttagacaagagcgccgaggaaatgccttatctcaagtgccccctgcatactgtgctgaaactcacacctgttgcttatgggtgtagggtggagagtatctatctgaatgttgagtccgtgtgtacgcatcgggagaggtctgagaacatgaaaggatccagatcttcagctgatagttctcggaaacattag

SEQ ID NO: 212838 - DNA, 555 bp, Artificial Sequence
  Description of Artificial Sequence: Synthetic coding sequence
atgcccttccggaaggcgtgcgggccaaagctcacaaattctcccacagtcatcgtgatggtaggactgcccgctagaggtaaaacctacatttccaagaagctaacgcggtaccttaactggattggggtgcctacaaaggtctttaacgtgggcgagtatagaagggaggccgtgaaacagtactcatcctataacttcttccgccctgataacgaagaagccatgaaggtgcggaaacagtgcgcgctggcagccctcagggacgtgaagagctatctggccaaagaaggcggacagatcgctgtgtttgacgctactaacacaactagagaacgccgacatatgattcttcacttcgctaaggaaaatgattttaaagcattttttatagagagcgtctgtgacgacccgactgtggttgcatccaatataatgcagaaggcattccagcgcgatctgtcggcaactcccctttggtgctgtcggaaactgaagagtcctgcccgtatcaccaagacagctaccaggcagaagccctggactacaagttag

SEQ ID NO: 212839 - DNA, 1605 bp, Artificial Sequence
  Description of Artificial Sequence: Synthetic coding sequence
atgggcgaggggggtcaaaaagaaggggattcccagcaggccggtgctttgcccctgttgtgccaattggacacgtttagtcccaaagctaccgttttcggcgtttccattaacccggcatgcggtcccaaactgactaatagtccgacagtgattgtcatggtggggctgccggctcgcggaaagacgtacattagtaagaaactcacccgctacctaaactggataggggtgcccacaaaggtgtttaatgtcggcgaataccgcagagaggcagtgaaacagtactcctcatacaatttctttagaccggataatgaggaggccatgaaggtgagaaaacagtgtgcgttggcagccctccgtgatgtaaaatcttatctggctaaggaggggggacagatcgcagtgttcgacgctacgaatacaacacgcgaaaggcgacacatgattctgcacttcgccaaggagaacgactttaaagcctttttcatcgagtcagtgtgcgatgatccaaccgtcgtggcgtctaacatcatggaagtcaaaatctcgagtccagattataaagactgcaacagtgctgaagcaatggatgacttcatgaagcgaatctcctgttacgaggcctcttatcagcctctcgaccctgacaagtgcgaccgtgatctgagtctgatcaaggtcattgatgtcggtcgaaggttccttgtcaaccgggtccaggaccatatacagtcgagaatagtttattacctcatgaatatccacgttcagccccgtacaatctatttatgtcggcacggcgaaaatgaacacaaccttcagggacgcataggcggtgatagtggactctcctcacgtgggaaaaagtttgcatcagctctttccaagttcgtagaagaacagaaccttaaggacctgagggtgtggacgtcacagctgaagagcaccatccagactgctgaggctctgcgcctgccctacgagcagtggaaggcactcaatgagatcgatgccggtgtatgcgaagagctcacatacgaagagattcgggatacatatcctgaggagtatgcacttcgcgagcaggataaatactattaccgctaccctaccggtgaaagctaccaggaccttgtacagcgcctggagcctgtgattatggaactggaaaggcaagaaaatgtgctcgtcatctgccaccaggctgttctgaggtgtctcctggcatactttctggataagtccgctgaagagatgccttatctcaagtgccccctacatacagtgcttaagctgacgcctgtagcgtatggttgcagggtggaaagcatctacctgaatgtcgaatcggtgtgcacacacagagaacggagcgaagacgctaaaaaagggcctaatcctttaatgcgtcggaactctgtgacacccttggcctctccagaacctaccaagaagcccagaatcaactccttcgaggaacacgtggcctccacatctgccgcactcccatcctgtctgcctcctgaggtgcctacccaactcccgggtcaaaacatgaaaggaagtcgttcatccgctgactcttctcgtaagcactag

SEQ ID NO: 212840 - DNA, 594 bp, Artificial Sequence
  Description of Artificial Sequence: Synthetic coding sequence
atggaccctccagccggatttgtgcgagctggcaaccctgccgttgcggctccccagtcccctttatcccctgaaggcgctcacttccgtgccgctcaccaccctcggtccacgggttcacggtgtccgggaagcctgcagcccagccgcccattagtggctaactggctgcagtcccttcccgaaatgcccgttgattttaccggatattggaagatgctagtgaacgagaatttcgaggaatatctccgggcactggatgttaatgtggctttgagaaaaatagccaatttgctgaaacctgataaagaaatagtgcaagacggcgaccatatgatcatcagaactctttccacctttcgcaattacatcatggattttcaggttggaaaggaattcgaggaagacttaacaggcatagacgacaggaagtgtatgacaaccgtgagctgggatggtgacaagctgcaatgcgtacagaaaggtgaaaaagaaggccgagggtggacccagtggatagagggcgacgaactccacttggagatgagagtagaaggagtcgtctgtaagcaagtatttaaaaaagtgcagtag

SEQ ID NO: 212841 - DNA, 528 bp, Artificial Sequence
  Description of Artificial Sequence: Synthetic coding sequence
atgacaaactgccccacccttattgtcatggtgggcctgccagcacggggaaaaacctacatctcgaaaaaactgacccggtatctgaattggataggagttccgactagggagttcaacgtggggcagtaccggagggacgtagtgaaaacatacaagtccttcgaattcttcttgcccgacaacgaagaggggctaaagatccgcaagcagtgcgctctggccgcattgagagacgttcggcgattcctatctgaagaagggggtcacgtcgccgtgtttgatgccaccaacacaactagggagagaagggcaaccatctttaactttggagagcagaacggatataaaacgtttttcgtggaatctatttgcgttgaccctgaagttattgccgcaaacatcgtccaggtcaagctgggctctccggactatgttaaccgggattccgatgaggccactgaagacttcatgagaaggattgagtgctacgaaaactcttatgagtcactcgatgaagatttgtag

SEQ ID NO: 212842 - DNA, 1377 bp, Artificial Sequence
  Description of Artificial Sequence: Synthetic coding sequence
atggacaggggcagcctgggaggatccagcttgacagacctaggccctggatcttcaaggcgagtgtgtatgacaaactgtcccacattgatagttatggtgggtttacctgccagggggaagacttacatcagtaaaaagctcacgaggtatctgaattggattggcgtccccaccagagaattcaatgtgggccagtaccggagagatgtcgtgaaaacgtacaaatcattcgaattcttcctgccggataatgaggagggcctcaagattcgcaagcagtgtgcactagccgctttaagggacgtccgcagattcctaagtgaagagggaggacacgttgccgtttttgacgccacaaatacaacgcgagagaggagagctactatctttaactttggagagcagaatggttacaaaactttcttcgtggagtccatttgcgtggaccctgaagtaattgccgctaatatcgttcaggtgaagcttggctcccctgactacgtcaatcgggactctgacgaggccaccgaagacttcatgcgacgcatagaatgttatgaaaacagctacgaaagtttggacgaggatcttgacagggacttgtcatacattaaaataatggatgtcgggcagtcctacgttgtaaaccgggtggctgatcacatccaaagtcgcattgtctactacctcatgaatatacatgttaccccaaggtccatttatctgtgtagacatggcgaatcggagctcaatctcaagggtcgcatcggcggtgaccccggactttcacccagagggcgagaatttgccaaatcccttgctcagttcatcagcgaccagaatattaaagacctcaaagtgtggacctcacagatgaagaggaccattcagactgccgaagcgctgggggtcccctacgagcagtggaaggtactgaacgaaatcgatgctggggtgtgtgaagagatgacttacgaggaaatccaagacaattatcctctggagttcgcactcagagaccaggacaaataccgctatcggtatccgaagggagagagttatgaggacttggtgcagcggctggaacctgtcattatggaactggaaaggcaggagaacgtgttagtaatctgtcaccaggctgtaatgaggtgcctcctggcatattttctagacaaagcagcggagcagcttccctatctgaagtgtccgcttcacaccgtcttgaagctgacaccagtcgcctatggctgcaaagttgaaagcatattccttaatgtagccgcagtgaatacccatcgggacagaccacagaacgtggacatcagcagaccccctgaggaggccttggtgaccgtgcccgctcatcagtag

SEQ ID NO: 212843 - DNA, 1308 bp, Artificial Sequence
  Description of Artificial Sequence: Synthetic coding sequence
atgactaactgtcctacccttattgtcatggttggcttgcccgctcggggaaaaacttacatctccaaaaaattgacaaggtacctcaattggataggagtcccaactcgggaattcaatgtggggcagtatcggcgagatgttgtgaagacatacaaatccttcgagttttttctgcctgataacgaggaaggtctcaagatccgcaaacagtgcgccctagctgccctgcgggatgtaagacggttcctctcggaggaggggggtcatgtagcggtcttcgatgccactaacacaacccgagagcgcagggctacaatcttcaactttggagaacagaatggctataaaaccttttttgtagaaagcatctgcgtagacccagaggtgatcgcagctaatattgtgcaagtgaagctgggttctcccgattacgtaaaccgcgattctgacgaagccactgaagatttcatgaggcgtatcgaatgttacgaaaacagttacgagtctctggatgaagaccttgaccgagacctaagctacatcaagattatggacgtgggacagagctatgtggtgaacagagtcgcagaccatatccagtcaaggatcgtgtattatctcatgaatatccatgtgaccccacgctccatctatctctgtcgccacggggagtctgagctgaacctaaaggggcgtatcggcggtgaccccggtctctcaccgagaggccgagagttcgctaaatcacttgcacagtttataagcgaccagaatattaaagatctcaaagtgtggacgagccaaatgaagcggacgatccaaaccgctgaagcactgggcgttccctatgagcagtggaaggtcctcaacgagatcgatgccggagtctgcgaagagatgacttatgaagagatccaggacaactacccactagagttcgcattacgggatcaggataaataccgttatcggtaccccaagggcgaaagctatgaagacttagtgcagcgacttgagcccgttatcatggaattagagcggcaggagaacgtgctggtgatctgccatcaggcagtcatgagatgcctcttggcatacttcctggacaaagcagccgaacagttgccatacttaaagtgtcccttgcacactgtcctgaagctgaccccggtggcatatggctgcaaggtggaaagtatttttctgaacgtggctgctgttaacactcatcgggaccggccacagaacgtggatatcagtcgcccaccagaggaggcactggtgacggtgccagcccaccagtag

SEQ ID NO: 212844 - DNA, 429 bp, Artificial Sequence
  Description of Artificial Sequence: Synthetic coding sequence
atggcgagtcccagggaactaacccagaaccctctgaaaaagatctggatgccctactcaaatgggaggccagcactgcacgcatgccaacgaggggtttgtatgacgaactgtccaaccctcatcgtgatggttggtctcccagccaggggtaagacttatatttccaagaaactgacccgctatctgaactggatcggcgttccaacccgggaattcaatgtggggcaataccgacgtgacgtggttaagacctataagtcctttgaattcttcttaccagacaacgaagaaggcttgaaaattcggaagttcctgatgccccagaccccaccagaaaacggtgagcgcccttcgctaatccttgaaaataggatggccactcggccattccttagctcgccctctgtgtggatccttagatcttag

SEQ ID NO: 212845 - DNA, 777 bp, Artificial Sequence
  Description of Artificial Sequence: Synthetic coding sequence
atggccgctcccgctcctgggctgatcagcgtattcagttcgtctcaggagcttggtgcagcattggcccagctggttgcccagcgcgcagcttgctgcctggccggtgctcgggctagattcgcgttagggttatccggcggaagcctggtatccatgctagctcgcgaattgccagccgcagttgcccctgctggacccgctagcctggccagatggactcttggcttctgcgatgagaggctggtgccttttgatcacgcagaatccacctatggcctgtaccgaacccacctactaagccgcttgcccattcctgaaagtcaggtcattacgatcaaccctgaactgcctgtggaggaggcggcagaagattacgccaagaagctgaggcaagccttccaaggggacagtatccccgtgttcgatcttttaatattgggagttggccctgatgggcacacgtgcagcttgtttcccgaccacccactgttgcaggagcgggagaaaatcgtcgccccaattagcgatagccctaagccaccccctcagagggtaaccttaacccttcccgtcctgaacgcagcgagaactgtgatattcgttgcgactggggaaggtaaggctgccgtgcttaagaggatccttgaggaccaagaagaaaatcccctgccagccgcactcgtgcaaccgcatacgggaaaattgtgttggttccttgatgaggcagccgctaggctactgactgtgcccttcgagaaacactccactctctag

SEQ ID NO: 212846 - DNA, 1428 bp, Artificial Sequence
  Description of Artificial Sequence: Synthetic coding sequence
atggcagccaagtcccagccgaatatcccaaaggccaagagcttagatggggtcacaaacgaccggacagcctcacaggggcaatggggccgagcttgggaagtggattggttcagtttggctagcgtgattttcttgctgctgttcgcaccatttatcgtctactatttcatcatggcctgtgatcaatactcatgcgccctcactgggcctgtcgtggacattgttactgggcacgcccgtctgtccgatatatgggccaagactcctcccatcacgcgcaaggcggctcagctctatacgctctgggtcacctttcaggtcctgctctatactagtctgccggacttctgccacaaatttttacctggctatgtaggcggaatacaagaaggcgcagtaacacccgcaggggttgtgaataagtaccagatcaacggcctccaggcatggctcctcacacatctgctttggttcgctaatgcacacctcttatcgtggttctctcctactattattttcgataattggattcctttgctctggtgtgccaacatactgggatatgctgtgtccacattcgccatggtgaagggctatttcttccctaccagtgccagagattgtaagttcactggaaattttttctacaattacatgatggggatcgaatttaatcccaggatagggaaatggttcgattttaagctcttctttaatgggaggcctggcattgtggcatggacactgatcaatctgtcttttgcggctaagcagcgggaactgcactctcacgtcacaaacgcgatggtgctggtaaatgttttacaggccatttacgtgatagactttttttggaatgagacttggtatctgaagacaattgacatctgtcacgatcatttcgggtggtatctgggatggggcgattgcgtgtggctgccctacctgtatactcttcagggcctctatctcgtctaccaccctgtccagctgagcacccctcatgccgtgggcgtattactactgggcttggtgggctattacatttttagagtcgcgaatcatcaaaaggacctgtttagacgcacagatggaaggtgtctcatctggggcaggaaacccaaggtgatagagtgctcttacacctccgccgacggacagcggcaccatagtaagctactcgtgtctgggttctggggggttgccagacactttaactatgtgggagatctgatgggcagtctagcctattgtctggcctgcggcggaggacatcttttgccatacttttacatcatctacatggctattctgctcacgcaccgctgcctgcgggatgagcatcgctgtgcctccaagtatggaagagattgggagcgatacacggccgcagtcccgtataggctgctgccagggatattttag

SEQ ID NO: 212847 - DNA, 1428 bp, Artificial Sequence
  Description of Artificial Sequence: Synthetic coding sequence
atggcagctaaatcccaaccgaacatcccaaaggccaagtctctcgatggtgtcaccaatgatcgtaccgcgagccaggggcagtgggggcgtgcctgggaagtcgactggttttcattggcttctgttatctttctactgctgtttgccccatttatagtgtattacttcatcatggcgtgtgatcagtactcgtgcgccctaacaggcccagttgtggatattgtcaccgggcacgccagactcagcgatatatgggcaaagacgccgcctataacccgaaaggccgctcagctctatacactctgggtcacattccaggtccttctgtacacgtccctgcccgacttctgccacaaattcctaccaggctatgtgggcggtattcaggagggagcggtgaccccagccggagtggtcaacaagtaccagatcaatgggttgcaggcttggctcctcactcatctgctctggtttgccaacgctcacttactttcctggttttctcccacaatcatcttcgataactggattccgctactgtggtgtgccaatatactggggtacgctgtttccactttcgccatggtaaagggctactttttcccaacgagtgccagggactgcaagttcaccggcaattttttctataactacatgatgggtatcgaattcaatcctagaatcggcaagtggttcgatttcaagctattttttaacgggagaccaggaattgtcgcttggacgctgatcaatctttcgttcgccgcaaagcagagagaattgcatagtcacgtgacaaacgccatggtgctggtcaacgtgttgcaggccatctacgtcattgattttttttggaacgaaacgtggtacctgaaaacaatcgacatctgtcatgatcattttggatggtatcttgggtggggggactgcgtgtggttaccctacctgtatacgcttcaaggactttacttggtgtatcaccccgtgcaactgagcacgccacatgcagtaggcgtactcctcctgggacttgtaggctactacattttccgcgtcgcaaatcaccagaaagatctgttccgcaggaccgacggccgttgcctgatatggggtcgtaagcctaaagttattgaatgtagctacacatccgcggatgggcagcgtcaccacagcaaacttttagtctctggtttctggggcgttgccaggcattttaattatgtgggtgacttaatgggaagcttggcctattgcctcgcctgtggtggaggacatctgttaccatatttctatataatatatatggccatccttctgactcacagatgccttcgcgacgagcatcggtgtgcttccaaatacgggcgagattgggaaaggtatacggcggctgtaccttatcgcctccttcccggaatcttctag

SEQ ID NO: 212848 - DNA, 327 bp, Artificial Sequence
  Description of Artificial Sequence: Synthetic coding sequence
atggcagccaaaagtcagcccaacatccccaaagctaagtcattggatggcgtcactaacgacagaaccgcctctcaaggacagtggggaagagcctgggaggtcgactggttctcgctagctagtgtcattttcttgctcctctttgccccatttatcgtatactattttataatggcctgcgaccagtatagttgtgcccttaccgggccagtggtggatattgttacaggacacgctcggctcagtgatatatgggctaaaacccccccaatcacccgcaaggccgcacaactctatactctctgggtgactttccaggtctag

SEQ ID NO: 212849 - DNA, 495 bp, Artificial Sequence
  Description of Artificial Sequence: Synthetic coding sequence
atggctgcaaagagtcaaccaaacatcccaaaggctaagagcctcgatggagtgaccaacgaccggacagcttcccagggccagtggggtcgggcttgggaggtggattggttttccctggccagtgtaatcttcctgttgctgttcgcacccttcatcgtttattatttcatcatggcctgcgaccagtacagttgcgccttgactggccctgtggtggacatagtgaccggccatgctcggctgagcgatatttgggccaagacacctccaatcactcgcaaagccgctcagctgtatacattgtgggtgacttttcaggttctcttgtacacgtccctaccagacttctgtcataaattcctgcccggttatgtaggcggaatccaggaaggggcagtcactcctgctggagtagtcaataagtaccagattaacggactacaggcctggttgctaacacatctgctctggttcgcaaatgctcatttgtag

SEQ ID NO: 212850 - DNA, 276 bp, Artificial Sequence
  Description of Artificial Sequence: Synthetic coding sequence
atggcagccaaaagccagcccaatatcccaaaagcgaaaagtctggatggcgtaaccaatgaccggactgcatcccagggccagtgggggagagcctgggaagtggactggttttctctcgcttctgtaatatttctgttactgttcgcgccattcatcgtctactactttattatggcctgtgaccagtactcctgcgcgctgaccgggcctgttgtggacatcgtgacaggccacgccaggctctccgatatatgggccaaaacccctccttag

SEQ ID NO: 212851 - DNA, 318 bp, Artificial Sequence
  Description of Artificial Sequence: Synthetic coding sequence
atggccgcaaagagccaacccaacatcccgaaggcaaagtcactggacggggtaacgaacgacagaacagcctcccaaggtcagtgggggagggcttgggaggttgattggtttagcctggctagcgtaatttttctgctgctgttcgctccgttcattgtttactattttatcatggcatgcgaccagtactcatgtgccctcacaggacctgtcgtggacatcgtgaccggccacgctcggctatccgatatatgggccaagacccccccaatcacccggaaggccgcacaactttataccttgtgggtgacttag

SEQ ID NO: 212852 - DNA, 846 bp, Artificial Sequence
  Description of Artificial Sequence: Synthetic coding sequence
atggactcgtacagcacgtatctggccaccgtgaaggtaagcggaagctggctggaggagcaggacgaagatatctacgaagtagagtcccgcgttcccctgcctcacccctttcccctgtgcgaacacctggacgaaaacaacagcgtgatcgtaaatacctcaatattccacttcattcacaaacgaaatggtcatatcttaaagcttatctccaagatttcgctcccaacacccccatatagcttggagcacgccaaagtgacccaaaccgagctcatgagagagagctttagacagaagcaggaagctacggaatccctgaaatgtcaggaggagctgagggaaaggcttcatgaggagtcaagggctagggagcagctggctgttgaactgtctaaagctgaaggtgtaatcgacggatatgccgacgaaaaaaccctgttcgagcgtcaaatacaggagaaaacggacattatcgaccggctagaacaggaacttctttgcgccagtaacagattacaagagctggaagcagagcagcaacaaatccaggaggaacgagaacttcttagcagacagaaagaagctatgaaagccgaagccggacctgtggagcaacaactcctccaggagacggaaaaactgatgaaggagaaattggaggtccagtgccaggcagaaaaggttcgtgacgatctgcagaaacaagtaaaagcgttggaaatcgacgttgaggagcaagtgagtcggttcatcgaattagagcaggaaaaaaataccgaactgatggatctccggcagcagaatcaagcattggagaaacagctggagaagatgcgctag

SEQ ID NO: 212853 - DNA, 11724 bp, Artificial Sequence
  Description of Artificial Sequence: Synthetic coding sequence
atggaggacgaggaaagacaaaaaaagctggaggccggaaaagctaaactggcccagtttcggcaacgcaaggcacagtctgacggacagtctccctcaaagaaacaaaagaaaaagaggaagacatcatcatcaaaacacgatgtaagcgcacaccacgacctgaacatcgaccagtcacaatgcaacgagatgtacataaattctagccagagggtcgaaagcaccgttatcccggagtccacgatcatgcgtacactgcattcgggtgagattacaagccatgaacagggcttttccgtcgaactcgaatccgaaatcagcacaactgccgatgattgcagtagtgaagtcaacgggtgctcatttgtgatgagaaccgggaaacctactaatctcctgagagaggaggaatttggagtggatgactcgtattcggaacagggagcccaggacagccccacccatctggaaatgatggagtctgagcttgctggtaagcagcacgagattgaagaacttaatcgagaactggaggagatgcgtgtgacctacggtacagagggtctgcagcaactccaggaattcgaggcagcaattaagcagagagacggaataattactcaattgacagccaacctgcagcaggcacggcgagagaaggacgaaaccatgagggagttcttggagttgaccgagcaatcccagaaactgcagattcaatttcagcaactgcaggcatccgaaacgctgcgcaacagtacacactcttccaccgctgcggatttgctccaggccaaacagcagatactgacccaccagcaacaactggaggaacaggaccatcttttggaagactatcagaaaaagaaggaggacttcaccatgcagatctctttcctccaggaaaaaataaaggtgtacgagatggagcaagataagaaagtggagaacagcaataaggaggaaattcaggagaaggagacaatcattgaggagcttaatactaaaatcattgaggaagagaagaagacattggaactcaaggacaaactcactactgcagataagctcctcggcgagctccaggagcagatcgtgcaaaaaaatcaggagataaagaacatgaaactggaactgactaattccaaacagaaggaaagacagagcagtgaagagattaagcagctcatggggacggtcgaggaattgcaaaagcgcaaccacaaggactcacagttcgagacagacattgtacaaaggatggagcaggagacacagcgaaaactggagcagctcagggcagaactagacgaaatgtacggacaacagatagtccaaatgaagcaggagctgattcgacaacatatggcgcaaatggaggagatgaaaacccgccataagggtgaaatggagaatgcactgcgctcctactctaacataaccgtcaatgaggatcagatcaaactcatgaacgtcgcaattaatgaacttaatatcaaactccaggatactaattcacagaaagagaagctgaaagaggagcttggcctgatcctcgaggagaagtgtgcactccagagacagctagaagatctagtggaggagctgagcttctcccgcgagcagatccaacgcgctcgacagacaatagccgagcaagaaagtaaactgaatgaagctcacaaatctctcagcacagtagaggatttgaaggcagagattgtgagcgcctcggagagcagaaaagagctggagctgaaacacgaagccgaagtgacgaactataagataaaattggagatgctggaaaaagaaaaaaatgctgtgctggaccggatggctgagtcgcaggaggccgaactggagagactgcgtacacagctgctgtttagtcatgaggaagaactctcaaagctgaaagaggacctcgaaattgaacacaggattaacattgagaaattaaaggacaatttgggaatccattataaacaacagattgatggactgcaaaacgaaatgtcccagaagatcgaaaccatgcagtttgaaaaggacaacctcattactaagcaaaaccagctcattcttgagataagtaagcttaaagacctacagcagtctctggtgaactccaaaagcgaggagatgacactgcagatcaacgagctgcagaaggagattgagatcttgagacaagaagagaaggagaaaggcaccctcgaacaggaagtgcaggagcttcaactcaagaccgaactgctcgagaaacaaatgaaagagaaagagaacgatttgcaagaaaagttcgctcagcttgaagctgagaattcaattctgaaggatgaaaaaaaaacactcgaagatatgctcaagattcacacgccagtctcccaagaggagcgacttatttttctggattcgatcaagtctaagtccaaggattctgtctgggaaaaggagatcgagatcctgattgaagagaacgaagacctgaagcagcaatgcatccagttgaacgaggaaatcgaaaagcaaagaaatactttcagcttcgctgaaaagaatttcgaagtgaattaccaggaactccaggaggaatacgcttgtctcctgaaagttaaagacgatcttgaggactcaaagaataagcaggagctggaatataaatcaaaattgaaggctctgaatgaggaattgcacttacagagaattaacccaaccaccgtgaaaatgaaatcgtccgtgttcgacgaggacaagaccttcgtggccgagaccttggaaatgggggaagtcgtggagaaggataccacagagctcatggagaagttggaagtaactaagcgcgaaaagctggagcttagtcagaggcttagtgacttgagcgaacagctgaagcagaaacatggagaaatttcatttctgaatgaagaagtaaagtctctgaagcaagaaaaggagcaggtcagcctccgatgccgagagctcgaaatcattattaaccataacagagccgagaacgtgcaaagttgcgatactcaggtgtcatctcttctcgatggtgtagtgacaatgacttccaggggcgcagaaggttccgtgagcaaggtgaacaaaagcttcggcgaagaatccaagattatggtggaggataaagtatcctttgaaaatatgacagtcggtgaagagtcaaaacaagagcagctcatcctggaccacctgcccagcgtaacaaaagaatcgtctttgcgggcaactcagccttctgagaatgacaaactgcagaaagagctcaatgtcctgaaatctgaacagaatgatctacgtctccagatggaagcccaaaggatctgcctgagcttagtctactccacgcacgttgaccaggtgcgggagtacatggaaaatgaaaaagataaagccctttgttccctgaaagaagaactcatatttgcccaagaggagaaaataaaggaactccaaaagattcaccagctcgagcttcaaaccatgaagacccaggaaaccggggacgaaggaaagcctcttcatttgttaatcggtaagctccagaaagccgtgagtgaagagtgtagctactttctacaaacactatgcagcgtgctgggcgaatactacacgcctgccctgaaatgtgaggtcaacgcggaggacaaagagaatagtggagactacatcagtgaaaacgaagacccagagttacaagactataggtacgaagtgcaagattttcaggaaaatatgcacaccctcctaaataaagtcactgaagaatataataagctactagttttacagacaagactttccaaaatttggggccagcaaaccgatggtatgaaactagagtttggcgaggaaaacctgcccaaagaggaaaccgagtttttgtctatccattcccagatgacaaacttagaagatatcgatgtcaaccataagagcaaactatccagcctccaggacctggagaaaaccaaattagaggaacaggtgcaggagctggaaagtctcattagttcccttcagcagcagcttaaggaaactgagcagaattatgaggcagagatccactgtctgcagaaaagactacaggctgttagtgaatcaacagtgcccccttctcttcctgtggattctgtcgtgatcaccgaaagcgatgcacaacggaccatgtaccctgggtcttgtgtgaaaaaaaacatagatggaacgatcgaattttcaggcgaatttggcgtcaaggaggagaccaacattgtgaagcttctggagaaacaataccaggagcaactggaggaagaagttgcaaaggtgattgttagtatgtcgatcgctttcgctcagcagaccgagctatcccgcatctcaggtggcaaggagaacactgctagctccaagcaggcccacgccgtgtgtcaacaggagcaacactattttaacgagatgaagttaagtcaggaccagattggcttccagacatttgaaacagtggatgtgaaattcaaagaggaattcaaaccattgagcaaggagcttggcgagcacggtaaggaaattcttttatctaacagtgacccccacgacatcccggaaagcaaggattgtgtgctcaccatctccgaagaaatgttcagtaaggataagacttttattgtgaggcagtctatacacgacgagatatctgtgagcagcatggacgcctcccggcagttaatgctgaatgaggagcagctggaagacatgcggcaggagctcgtgcgccagtatcaagaacaccaacaggcaaccgagctgctgcggcaggcccacatgcggcagatggagcgccagcgggaagatcaggaacagcttcaggaagagattaaaagactcaatcgccagctcgcccagcgctctagcatcgataatgaaaacttggtgtcagaaagagagagggtcctgctggaggaacttgaggctctcaaacaactgtccctggcagggagggaaaagctgtgctgcgagctcagaaattcctccacccagactcagaacggcaacgaaaatcaaggtgaggtcgaggaacaaacatttaaggaaaaggaactcgatcgcaagccagaggacgttccccctgaaattctgtctaacgaacgctatgctttgcagaaggccaacaacagactgctgaaaatccttctcgaggtggtgaaaactaccgctgccgtcgaggaaaccatcgggaggcatgtcctgggtattttggacagatcttcaaagtcacagtccagtgcatcgctgatttggcggagcgaagcagaagcgtccgtcaagagctgcgtgcatgaagaacacacacgcgtcactgatgagtccatcccaagttactctgggtccgatatgcctcgtaatgacattaatatgtggagtaaggtcacggaagaaggtaccgagctgagccagaggttggtgaggtccggattcgccggtaccgagatcgaccccgagaatgaggaactgatgctcaatatatcttcacggctccaggccgctgtcgagaaactgctggaagccatctctgagacctcttcccagttagagcatgccaaggttacccaaactgaactgatgcgtgagtctttccgtcagaagcaggaagcaactgagagcctgaagtgccaagaggagctaagggaacggttgcacgaggagtcccgtgccagggagcagcttgctgttgagctctcaaaagccgagggtgttatcgatggctatgctgacgagaagactctgtttgagcggcaaatacaggagaaaactgacatcattgatcgcttagaacaggagctactttgcgcctctaatcgactgcaggaactcgaggctgagcagcagcagatacaagaagaacgcgagctcctgagtagacagaaggaagcgatgaaagcagaggcaggaccggttgagcagcagctgctgcaggagaccgaaaagctgatgaaagagaagttggaggtccagtgtcaggctgaaaaggtgagagacgatcttcagaagcaggttaaagctttggagatcgacgtggaggaacaggtaagtcgcttcattgaattagaacaggagaaaaacactgagctgatggaccttaggcagcagaatcaggcactcgagaaacagctggagaaaatgcgcaagttcctggacgaacaggctatcgatcgagagcacgaacgcgacgtgtttcagcaggagattcagaagctagaacagcaacttaaggtggtgccaagatttcagcccatctctgaacaccaaaccagagaggttgagcagttagcgaaccacctcaaagaaaagacggataagtgttccgagctcctgcttagtaaggagcagctgcaacgggatatacaagagcggaacgaagagatcgagaagttagagttccgggtgagagagctagagcaggcattgctggtttctgccgacaccttccaaaaagtggaggatagaaagcatttcggagccgtcgaggcgaaacctgagctttctcttgaggtgcagttacaagccgaacgggacgccatcgataggaaagaaaaggaaatcacgaacctcgaggagcagttggaacaatttagagaggaattggaaaacaaaaatgaagaggtgcagcagctgcacatgcagctcgaaattcagaagaaggagtctactactcggctgcaagaactcgaacaggaaaacaaactcttcaaggacgacatggagaaactgggattggccatcaaggagtcagacgctatgagcactcaggaccagcatgtgctgtttggcaagttcgcccagataatccaggaaaaggaggtcgagatcgatcaacttaacgaacaagtcaccaagctgcagcagcagttaaaaatcaccaccgacaacaaagtgatcgaagagaaaaacgagctgattagggatttggaaacacaaatcgaatgcctgatgtccgaccaagagtgtgtcaaacgcaatcgagaggaggaaatcgagcaattaaatgaagtcattgaaaaactgcagcaagaactcgcaaacattggtcagaaaacgtccatgaacgctcacagtctgagcgaagaggccgacagcctcaagcaccaattggatgtggtaattgccgagaagctcgcattggaacagcaagtcgaaacagcaaacgaagaaatgaccttcatgaagaacgtgctaaaagagaccaacttcaagatgaaccaactgactcaggagctattctcacttaaacgggaacgggagtcagtggaaaagatacagtccatccctgaaaactcagttaatgttgccatcgatcatctgtcgaaagataagcccgagctggaggtggtgctgaccgaggacgccctgaaaagtttggagaaccagacctatttcaagagctttgaggagaacggaaagggatcaatcatcaaccttgaaactcggctgctacagttggaatccactgtcagcgcaaaagatctggagcttacccagtgctataaacaaattaaggatatgcaagaacagggccagttcgagaccgaaatgcttcaaaaaaagatcgtgaatctgcagaagatcgtggaggagaaggtggcagccgctcttgtatcccagatccagctcgaagcagttcaggaatacgccaagttttgccaggacaatcaaacaattagttccgaaccagagcggaccaatatacagaatctgaatcagttgcgggaagacgaactaggaagtgacatttccgctctcacgttacgcatcagcgagctggaaagccaagtggtcgagatgcacactagcttaatcctcgagaaggagcaggttgagatcgccgaaaagaatgtgctggagaaagaaaaaaaactgttggagctgcagaagctgctcgagggcaatgaaaaaaaacagcgcgagaaggaaaagaaacggtctccccaggacgtggaggtgctgaagaccactacagagctgtttcacagtaatgaggagagcggcttttttaacgagcttgaggccttgagagcagagtcggtcgccactaaagccgagctggccagctacaaagagaaagcggagaaactgcaagaggaactcctggtgaaggaaactaacatgacctccctccagaaagacctgagccaggtgcgcgaccacctcgccgaggcgaaggaaaaactgtccatccttgagaaagaggatgagaccgaggttcaggaatcaaagaaagcttgcatgtttgaaccactgcctataaaactgtctaagtctatagcgagccagacggacggcactctcaagatctcatcttcgaatcagacgcctcagatcctggtaaagaatgcaggtattcagataaatctgcagagcgaatgttcatccgaggaggtaactgaaattattagccagtttacagagaagatcgagaagatgcaggaactgcacgcggctgagatcctcgatatggaatcgcgacatatttctgaaaccgaaactctaaaacgcgagcactacgtggccgtgcaactcctcaaggaagaatgtgggactctgaaggccgttatacagtgtctgaggtccaaggagggatcgagcatccccgaattggctcattcggacgcttaccagacaagggaaatatgctcatcagactcgggctcggattggggacagggaatctacttgacacatagccagggcttcgatattgcatctgaagggaggggcgaggagtccgagtccgccacagactcctttcctaagaagatcaagggactgttgcgagcagtgcataacgaggggatgcaggtgctttccctcacagaaagtccctattcagatggtgaggaccattccattcagcaggtgtcagaaccatggctcgaggaaaggaaggcttatataaacaccatatcaagcctgaaggacctgataacaaagatgcagctgcagcgagaggcagaggtttatgatagttcacagtctcacgagtctttctcggactggcgtggggagctgctactcgccttacagcaagtgttccttgaagaaagatccgtccttctggccgcattccgcacggagctgacagccctagggaccactgatgccgttgggcttctcaattgtctggaacaacggatccaagaacagggagtagagtaccaggctgccatggagtgtcttcagaaggccgatagaagatcactcctgagcgagattcaggccctccacgcccaaatgaacgggagaaaaatcaccttaaagcgggagcaggagtctgaaaagccaagtcaggagctactggaatataatatccagcagaagcagagtcagatgttggagatgcaggtggagttatcaagcatgaaggacagagcaactgagcttcaggaacaactctccagtgaaaaaatggttgttgcagaattaaagagcgagctggctcagacaaagttagagcttgaaacaactctaaaagctcagcacaagcatttaaaagaattagaagctttccgcctggaggtaaaggataagacggatgaggtgcaccttctcaacgacacactcgcttccgagcagaagaagtcccgcgagcttcagtgggccctcgagaaagagaaagctaaactgggcaggtcggaggaaagagataaagaagaattagaggacctgaaattttccctcgaatcacagaaacaacggaatcttcagcttaatcttcttcttgaacagcagaagcagctcctgaatgagtcccagcagaaaattgagtcccagcgcatgttatacgatgctcagctgtctgaagagcaaggcaggaacctggagctgcaggtcttgctcgaatctgaaaaggtgcgaattagggagatgagctccacactggacagagaaagggaactgcacgcccagcttcagtccagcgatgggaccggacaaagtcgacctccattgccctcggaggacctgctgaaggaacttcagaaacagctggaggaaaaacattcaaggatcgtggaactcctgaatgagaccgagaagtacaagctggacagcctgcaaacccgccaacaaatggagaaggaccgccaggtacaccgaaaaacccttcagacggagcaagaagctaatacggaaggccagaaaaagatgcacgagctgcagagtaaggtggaggacctccagcggcagctcgaagaaaagcggcagcaggtgtacaagctggatctggagggtcaaaggttacaggggattatgcaggaatttcagaaacaggagcttgaaagggaggaaaaaagagaaagtcggcgtattctgtatcagaacctgaatgagcccacgacctggtcattgacaagcgatagaacccggaactgggtcctgcagcagaaaatcgaaggtgaaaccaaagaaagtaactatgcaaaactgatcgagatgaacggtggcggtacaggttgcaaccacgaactggaaatgattcggcaaaaactgcaatgcgtggcctccaagctgcaggttctgccccagaaagcttctgaacgcctgcagtttgaaaccgcggacgatgaggatttcatatgggtccaagaaaatatcgacgaaattattcttcagttgcagaaactgactggacagcaaggcgaagaaccatccctcgtcagcccttccacctcctgcggatccctaaccgaaaggctgctgcgacaaaacgccgaactgaccggccacataagccagttgacggaagagaagaatgacttacgcaatatggtcatgaaactggaggaacagatcagatggtaccggcaaacaggagcgggtagagataacagctcaagatttagtctcaatggaggtgctaatatagaggccattatcgcctccgagaaagaggtgtggaaccgagagaaacttaccttgcagaaatcactgaaacgggctgaggcggaagtttacaagctgaaagcggagctcagaaacgacagtctgttgcagacactcagtccagactccgagcatgtcactttaaagaggatctatgggaaatatctccgtgccgaatcattcagaaaggccctcatttaccagaagaagtatctcctcctgctcctcgggggatttcaggagtgtgaggacgctacactcgcactgttagctcgcatgggtggccagccggcatttaccgacttggaagttataactaaccgtcctaaaggttttacaagattcagatcagctgtgcgtgtaagcatagcaattagccggatgaagtttctcgtgcggagatggcatagagtcactgggagcgttagcattaacattaatagagacggtttcggactgaatcaaggcgctgaaaaaacagactccttctaccacagttctggcggacttgagctttatggagagcccagacacactacctaccgatcaaggagcgacctggattatataagaagtccgctgccgtttcaaaatagatatcccggaacccctgctgacttcaatccagggtcactcgcttgcagccagctccagaattacgaccccgacagagcgctgactgactatatcacgaggttggaggctttgcagaggcgactcgggaccatccagagcgggtccactactcagtttcacgccggaatgcgcaggtac

SEQ ID NO: 212854 - DNA, 11574 bp, Artificial Sequence
  Description of Artificial Sequence: Synthetic coding sequence
atggaagatgaggagcggcaaaagaaactagaggccggtaaagcaaagattgaggaactgtcactcgccttcctggtcaggcagttggctcagttcaggcagaggaaagcgcagtctgatggacagtcaccttctaagaaacaaaagaaaaaacgtaagacatcttccagcaagcacgacgtttctgctcaccatgatttgaacatcgaccagtcccagtgcaacgagatgtacattaacagctcccagcgggtagaaagtactgttattcccgaatctactatcatgagaaccctgcactctggggaaattactagccacgagcagggcttctctgtggaattggaaagtgaaatttcgacaacggctgacgattgtagctctgaggtcaatgggtgcagctttgtgatgagaaccggcaagcccactaacttgctgcgggaagaagagttcggtgtggatgactcctactctgaacaaggcgcacaggactccccaacccacctggaaatgatggagtccgagctcgcgggaaagcagcatgagattgaggagcttaaccgggagttagaggagatgagggtgacctatggaactgaaggattacagcagctgcaggaattcgaggcggcaataaagcaacgcgatggcatcattactcaactcacagccaatctccagcaggctagaagagaaaaagacgaaaccatgcgcgagttcttggaactcaccgaacagtctcagaaactccaaatacagttccagcagctgcaggcgagcgaaaccctgagaaactcaactcacagtagtactgcggctgacttactgcaagccaagcagcagatattaacacaccagcagcagctggaggagcaggaccacctgttggaagactaccagaagaaaaaagaggactttaccatgcaaatttcgtttctgcaggaaaagatcaaggtctacgagatggagcaggataagaaagtggagaacagcaacaaagaagagatccaagagaaggagaccatcattgaagagctgaacactaagattatagaagaggagaaaaagaccctggagcttaaagacaagctgacaaccgccgataaactgctgggcgagctccaagagcagatcgtgcagaagaaccaggagattaagaatatgaagttggaattgactaactctaagcaaaaggagagacaatcctcggaggagatcaagcagctcatgggtacagtagaggaacttcaaaagaggaaccacaaagattcccaatttgagactgacatcgtgcagcgcatggaacaggaaacgcagaggaagctagagcagctgagagccgaattggacgaaatgtatgggcagcagatagtgcagatgaagcaggaactcatccggcagcacatggcacagatggaggagatgaagactagacataagggagagatggaaaacgccttgaggtcctacagcaatataaccgttaatgaggaccagattaagcttatgaatgtggcgatcaatgagttaaacatcaaactgcaggatacaaattctcagaaggaaaagctgaaggaagagctggggctgatcctcgaggagaaatgcgccctacagcgtcagctggaggaccttgttgaggagctgagtttcagcagggagcaaatacaacgggctaggcagaccattgcggagcaggagagcaagctcaacgaggctcacaagtcactaagtactgtagaggatctcaaagctgaaattgtatctgcatccgaatcacgaaaggagctagaattgaagcacgaagccgaagtgaccaattataagataaaattagaaatgcttgagaaggaaaagaacgccgtcttggatcgtatggccgagagtcaggaagccgaactcgagcgccttagaacccagcttctgttttcccatgaggaggagttgtctaaactgaaagaggacctagagattgagcataggattaacatcgaaaagctcaaggataatctggggattcattataaacagcagatcgatggcctgcagaacgaaatgagtcaaaagatcgagacaatgcagttcgagaaagacaacctgataaccaaacaaaaccagctgatcctcgaaatctcaaagctgaaggacctccagcagtcactagtgaactctaagagcgaagagatgaccctacaaattaatgagttacagaaggaaatagagatcttgcgccaggaggaaaaagagaaaggcacactcgagcaggaagttcaggagttacagctgaagactgagctcctcgagaaacaaatgaaggaaaaggagaatgatctgcaggagaaatttgcgcagctggaagctgagaattctatattaaaagacgagaagaaaaccttagaagatatgttaaagattcacaccccagtaagccaggaggagcggttgatctttctggacagcataaagtcgaagtctaaggacagtgtatgggagaaggaaatagagattcttattgaggaaaacgaagatctgaagcaacaatgcatccagctaaacgaagaaatagaaaaacaaaggaacaccttttcatttgctgaaaaaaatttcgaggttaactatcaagagctgcaggaagaatacgcatgtcttctaaaggtgaaagacgatctcgaggacagcaagaacaagcaggaactggagtacaaatcaaaactgaaggcactgaacgaggaactccacctgcaacgaattaatcctacgaccgtcaagatgaagagcagcgtgttcgacgaggacaagacgtttgtggccgaaactcttgagatgggcgaggtggtcgagaaggacacaaccgagttaatggagaagctggaggtcactaagcgagaaaaactggagctgtcgcagagactcagcgatttgtccgagcagttgaaacagaagcatggggaaatttcgttcctgaacgaagaggtgaagtccttaaagcaggaaaaggaacaggtgtctcttaggtgcagagagctcgagatcatcattaaccataatcgtgctgaaaatgtgcagtcctgtgacacccaagtgtccagcctcttggacggcgtggtgacaatgacaagccggggagcagagggttcagtgagcaaggtcaataaatcattcggcgaggagagtaaaataatggtagaagacaaggtgagctttgagaacatgacagtcggagaagaatccaaacaggaacagcttatcttagatcatctgcccagcgttaccaaagaatcatctcttcgggctacgcagccatccgaaaacgacaagctgcagaaggagttgaacgtcttgaagtcagaacagaatgacctgcgtttgcagatggaggcacaacgcatttgcctttccctggtttactcgactcacgtggatcaggtgcgtgagtacatggaaaatgagaaggataaagcgttatgtagtctgaaagaagagctgatcttcgcccaggaggaaaagatcaaggaactgcaaaagattcaccagttagaactacaaacgatgaaaactcaggagaccggtgacgaaggcaaacctctgcatttgctgatcggaaaacttcagaaggccgtctctgaggagtgctcctattttcttcagacattgtgcagtgttctgggtgaatactacacccccgcattaaaatgcgaggtgaatgcggaagataaggaaaactcaggagattacatcagcgagaacgaggaccccgaactgcaagattacaggtacgaggtacaggattttcaagaaaatatgcataccttgcttaataaagtcaccgaagaatataataagttactggtactgcaaaccaggctctccaaaatctgggggcagcagacagatgggatgaagctcgagttcggagaggagaatctgcccaaagaagaaactgaattcctctctatccattcccagatgacaaatctagaggacatcgacgtgaaccacaagtcgaagctgagtagcctgcaagatctggagaagacaaaactggaggagcaggtgcaagagttagaatccttaatctcctcactgcagcagcaattgaaggagacagaacaaaattatgaagcagaaatacactgcctgcaaaagcgactccaggctgtttctgaatccacggtaccaccgtcactacccgtggacagcgtagtcattacggagtctgatgcgcagcggacgatgtatcccggaagttgcgtgaagaagaacattgacgggaccatagagttttctggtgagttcggggttaaggaagagacaaatatcgtaaagctgctggagaaacagtatcaggaacaactggaggaggaggtggcaaaggttatcgtgtcaatgagcatagcttttgcacagcagacagagctttccaggatctctggtgggaaggagaataccgcgagtagcaaacaggcccatgccgtctgccagcaagaacagcattactttaatgaaatgaagcttagtcaggaccaaatcgggttccagaccttcgagactgtggatgttaagtttaaggaggagtttaaaccgctgtccaaggagctgggggagcacggtaaggagattctgctgagcaatagcgacccccatgacatacctgaatcaaaagattgcgtcctcacgatatctgaagagatgttttcgaaggacaaaacttttatagtgcggcagtcaattcacgatgagatcagcgtatcctcgatggatgctagccggcagttgatgttaaacgaagagcagctggaggacatgagacaggaattggtgagacagtaccaagagcatcagcaggccactgaactccttagacaagcccacatgcgacagatggaacgacaacgggaagatcaagagcagctgcaggaagagattaagcgacttaaccgccaactggcccagcgctcaagcatagataacgaaaatctggtctcagagagagaaagggtgctgctggaagaactggaagcattgaagcagctgtcgctcgccggtagagaaaagctgtgctgtgagctgcggaatagttccacacagacgcagaacggtaatgaaaaccagggggaggtggaggagcaaactttcaaggaaaaagaactcgaccgcaagccagaggacgttccgccagagattctgtcaaatgagagatacgcactgcagaaagcaaataaccgcctgctaaagatccttctggaggttgtgaagaccacggccgctgtggaagagacaattggccgtcacgtgctggggatactggacagatcttcaaaatcacagagctccgcctcgctcatctggcgttctgaggctgaagcttccgtaaagtcttgcgtccatgaggaacacaccagagtcacagacgaatccatcccctcctacagcggttccgatatgccaaggaatgatatcaacatgtggagcaaagtaactgaggagggaaccgagcttagtcagcgactcgttagatccggtttcgccggtaccgagattgatccggagaacgaagagctaatgctgaacatctccagccggctgcaggcggctgtcgagaagttgctggaagcaatctctgaaactagctctcagttagaacatgccaaagtaacccagaccgagctcatgagggagagtttccgccagaagcaggaagcaacagagtccctgaagtgccaggaggagctgagggagcgcttacatgaggaaagcagggccagggagcagttggcagtcgagctctccaaggccgagggcgtgatcgacggatacgctgatgagaagactctctttgaaaggcagattcaggagaaaaccgatatcatcgatagactcgagcaggagctcctatgtgcttccaatcggctgcaggagttggaggctgaacagcagcagatccaggaagagagggagctcctctcacgccagaaagaagcaatgaaggcggaggcgggtcctgtcgaacagcagttactgcaagaaaccgagaaactaatgaaagagaagttagaggttcaatgtcaggcagaaaaagtgcgggacgatttgcagaaacaggtgaaggccctggagattgacgtcgaagaacaggtgtcgaggtttattgagctagagcaggaaaagaataccgaattgatggacctccgtcagcagaatcaggcactcgaaaagcagttagagaagatgcggaagttcctggatgagcaagccatcgaccgggaacacgaaagagacgtttttcagcaggagatccagaaactcgaacagcagctgaaagtggtccccaggttccagccaatcagcgagcatcaaacccgggaagtggaacaactggccaaccatctgaaagagaagacagataaatgcagtgagttgctgttgagtaaagagcaactccagcgtgacatacaggaacggaacgaggagatcgagaaactggagttcagagtacgcgagttggagcaagccctcctcgtttctgcagatacgtttcagaaggtagaagatagaaagcatttcggagccgtggaggcaaagcccgaactctcactagaggtgcaactgcaggccgagcgtgatgccattgacagaaaagagaaagaaatcactaatttagaagagcagctagagcagttcagggaagagctggaaaacaaaaacgaggaagtgcagcagctgcatatgcagctcgaaattcagaaaaaggagtctaccacccggcttcaggagctagagcaggagaacaagctgttcaaggacgatatggaaaagctaggcctggccattaaagagtcagacgccatgtcaacccaggatcagcatgttctgttcggaaaattcgctcagattatccaggagaaagaggtggagatcgaccagttgaacgaacaagtcactaagttgcagcagcagctgaaaatcaccacggataacaaagtgatcgaagagaagaacgagttaattagagaccttgagactcagatcgagtgtctgatgtctgatcaggagtgcgtcaagcgcaaccgcgaggaggaaatcgagcagctcaacgaagtcattgaaaaattgcagcaggaactcgcaaatatcggccagaagacctctatgaacgcccatagtctgagtgaggaggctgatagtctgaagcatcaactagatgtggtgatagctgagaaactggccctagaacaacaggttgaaacagcgaatgaggaaatgacctttatgaagaacgtcctcaaggagacgaatttcaaaatgaatcagctcactcaagagctcttcagtcttaaaagggagagagagagcgtcgagaaaatccagtctatccccgaaaattcagtaaatgtcgcaatcgaccatttgagcaaggacaagccagagcttgaagtagtcctgacagaggacgctctcaagagtcttgaaaatcagacatactttaagtcattcgaggaaaacgggaaagggagcatcattaatctggaaactcgcctgctgcaactggaaagcactgtctccgccaaggacctcgaactcactcaatgttacaaacaaatcaaggacatgcaggagcagggccagtttgagaccgagatgctgcagaaaaagatagtgaatcttcaaaagatcgtggaagagaaggtggcggcagcgcttgtgtctcagattcagctagaagccgtacaagaatatgccaaattttgccaggataatcagaccatctcttctgaacctgaaagaaccaatatccagaatctcaaccaactaagggaggatgagctaggctctgatattagcgcgctaacgctccggattagtgagctcgagtctcaggtcgtcgagatgcacactagtttaatccttgaaaaagagcaggtggagatcgctgaaaaaaacgtgctggagaaggaaaaaaaactgctggaactacagaagctgctggagggcaacgagaaaaaacagcgagagaaagaaaaaaagcgaagtccacaggacgtggaggtcctaaagacaaccactgaactgttccatagcaatgaggaaagcggattctttaatgagctcgaagcccttcgagctgagagcgtggcaacgaaagctgagctagcgtcatataaggaaaaggctgagaagctccaggaagaacttcttgtgaaggaaactaatatgaccagtttgcagaaggatcttagccaggtgagggatcacttggccgaagccaaggagaagctgagtattctagaaaaggaggacgagacagaagtccaggagagtaagaaggcctgtatgtttgagccactgccaatcaaattgagtaagtctattgcgagtcagacagacggtaccctgaaaatctcgtcttctaatcagacacctcagattttagtgaaaaacgccggaatacagattaatttacaatccgaatgttctagtgaagaagttactgaaatcatttcccagtttacagaaaaaattgaaaaaatgcaggagctccacgccgcagagatccttgatatggaatcgagacatatatcagagactgaaacgttaaaacgcgaacactatgtggcagtgcagctgcttaaagaagaatgcgggacattaaaagcagtaatacagtgcctccgttccaaggagggtctgcttcgagctgtccataacgaagggatgcaggtgctcagccttactgaatcaccttattcggacggcgaggaccactccattcagcaagtatctgaaccttggcttgaagaacgcaaggcttacataaacaccatctccagtctgaaggacttgataactaaaatgcagctgcagagggaagccgaagtgtacgattcaagccagagtcacgaaagtttttctgactggagaggagaactgctcctcgcactgcagcaggtgtttttggaagagagatcagttctgctcgctgcctttagaaccgaactgactgctctcggaacaacagacgccgttggactgttgaattgtctcgagcagcgaattcaggaacaaggcgtggagtaccaggctgccatggaatgcttacagaaggccgacaggagatccctgctatcagagattcaggccctacacgctcagatgaacgggaggaagatcaccttgaagcgagagcaggaatcagaaaagccctcacaggaactcctggagtacaatattcagcagaagcaaagtcagatgttagaaatgcaagtggaactcagcagtatgaaagatcgcgcaacggagctccaggagcaactgtcaagcgagaaaatggtcgtagccgagctcaagagcgagctggcgcagactaagctggagctcgagacaacgctgaaagcacaacacaagcatctcaaggaattggaagcattcaggctggaggtaaaggacaaaacagatgaagtgcacctcctcaacgacactctcgcctccgaacagaagaagtcacgcgagctccagtgggctcttgaaaaggaaaaggcaaaacttggcagatccgaggagcgcgacaaggaggaactggaagacttgaagttttccctagagagccaaaagcagaggaacctacaattaaaccttctcttagagcagcagaagcagctgttgaatgagtctcaacagaagatcgagtctcagagaatgctttacgatgctcagctgagcgaagaacagggtcggaatctggagttacaggtgctgctcgagagtgagaaggtgaggataagagagatgtctagtaccctcgatcgagaacgcgagctccacgcccaactgcagtcctccgacgggactggtcagtcacgacctcctctgccgtcagaggacttgctgaaagagttgcaaaagcagctggaagaaaaacattctcgaatcgttgaacttcttaacgagactgaaaagtataaactggacagcctccagacccggcagcagatggaaaaagacaggcaggtccataggaaaaccctgcagacagaacaggaggccaacaccgaaggtcagaagaagatgcacgaactgcagtccaaggtggaagacttgcagcggcagcttgaagagaagcgccaacaggtgtataagttggacctggaaggacagcgactgcagggaattatgcaagaatttcaaaaacaggagctggaaagagaggagaaacgagagagtcggagaatcttgtaccaaaaccttaacgagcccaccacgtggtctctgacctccgacagaacaaggaattgggtactgcagcagaaaatagagggggaaacaaaagagtctaattatgcaaaacttattgagatgaacgggggaggcaccggctgtaaccacgagctcgaaatgatccgacagaagctgcagtgtgtggcttccaaactgcaggtgctgcctcagaaagcaagtgagcgcttgcaatttgagacagctgatgacgaggattttatctgggtgcaagagaacattgacgaaatcattttgcaactgcagaagctgacaggccagcagggcgaagagccaagcctagtgtcacctagcacatcctgtggcagccttacagagaggcttttgcggcagaacgccgaactaaccggacacatttcccagctgacagaagaaaagaacgatctgcgtaatatggtaatgaagctcgaagagcagattaggtggtatcggcagactggggcaggaagggataatagttcgagattttcactgaacggaggagcaaatatagaggctatcatagcctccgagaaggaggtgtggaaccgggaaaaactgacccttcagaagtcgcttaaacgagcggaagctgaggtgtacaaacttaaagccgagctgcgaaatgactccttgctgcagacattaagtcctgattcggaacacgtaactttaaagcgtatttatggaaagtatctgcgcgctgaaagctttagaaaggccctcatttaccagaagaaatacctgctcctgttactcggcggttttcaggaatgcgaagatgcaacactggccctactcgccaggatgggcggacaacccgcttttacagacctggaagtcatcactaatcgtccgaaagggttcaccagatttcggagcgccgttcgagtttccattgccattagcagaatgaagtttctggtccggagatggcatagggtgacaggtagcgtgagcatcaacattaatagggatggttttgggctcaatcagggagccgagaaaactgactcgttttaccactcctccgggggtctggagctctacggggagccccgacacactacgtatcggagccggagtgacctcgactacatccgatctcctctgcctttccagaaccggtacccgggaacccccgctgattttaacccagggtctctggcatgctctcagctgcagaattatgatccagatagagccctcactgattacattacccgattggaagccctccagcgccgtctgggtaccatacaatcaggaagcaccacacaattccacgcaggtatgaggagatac

SEQ ID NO: 212855 - DNA, 11736 bp, Artificial Sequence
  Description of Artificial Sequence: Synthetic coding sequence
atggaggatgaggagcgccagaaaaaactcgaagctggaaaagcaaagatcgaagagctaagcctcgcgtttctggtccggcagttggcccaatttcgacagaggaaagcacagtcagacggccagagcccctccaaaaagcagaagaaaaagcgcaaaacctcatcttctaaacacgatgtatccgcgcatcacgacctgaacatagaccaatcacagtgcaatgaaatgtacatcaatagctcacagcgcgtggagtctaccgtgatccctgagtctacgataatgcgcacactccactcaggcgaaatcacttcccatgaacaaggtttttccgtcgagctcgaaagcgagatatctactactgccgacgattgctcgtccgaggtcaacgggtgttcattcgtaatgcggaccgggaagccaaccaatttgcttagagaggaagaatttggagtggacgacagttactccgaacagggcgctcaggacagccccacccatctagaaatgatggaaagcgaactcgccggtaagcagcatgaaatcgaagaacttaatcgagaattggaggaaatgagagtgacttacggcactgaggggttgcaacagctccaggaattcgaggcagctatcaaacagcgagatggtatcattacccaattaactgctaacctgcagcaggcccgacgggagaaggacgagactatgcgcgagtttcttgagctcacggaacaatcccagaagctacagatacagtttcaacagttgcaagctagcgagactctgcggaacagtactcatagttcaaccgccgctgatctgttgcaggcaaaacagcagattctgacacaccaacaacagctcgaggaacaggatcacctactcgaagattaccagaaaaagaaggaggattttacaatgcagatcagcttcctgcaagaaaagatcaaggtgtatgagatggaacaggataaaaaggtggagaatagcaacaaggaggagatccaggaaaaggagaccattatagaagaactgaacaccaaaatcattgaggaagaaaaaaaaacgctggagctcaaagacaagctgactacagctgataagctcctaggggagcttcaggagcagatcgttcagaagaaccaagagatcaagaacatgaagttggaactaacgaactctaagcaaaaggaaaggcagagttcagaggagatcaaacagctaatgggaaccgtggaggagttacagaagagaaatcacaaagacagccagtttgaaaccgatatcgtccagagaatggagcaggagacccagcgcaaactcgagcagttgcgggcagagctagacgaaatgtacggacagcagatagtgcagatgaagcaggagctgattcgccaacacatggcgcagatggaggagatgaagacgcggcacaaaggcgagatggagaacgccctgagaagctatagtaacattaccgtcaacgaagaccagatcaagcttatgaacgtcgcaattaatgaattgaacatcaaactgcaggatacaaactctcagaaagagaagctgaaagaagaactgggcctcatcctggaagaaaaatgcgccctgcaacgacagctggaggatttagtcgaggaattgagcttttcgcgcgagcagatacagcgcgcacggcagacaatcgctgagcaggagagtaagcttaatgaagcacataagtcactgtccaccgtcgaagatctgaaggcggaaatcgtctcagcgtctgaatcccgaaaggaattagaattgaaacatgaagctgaggtaacaaattacaaaattaagctggagatgctcgaaaaagagaaaaacgcagtgctagatagaatggcagaatcccaggaggccgagttggaaagattgaggactcagttgctatttagccacgaagaggagctctctaagctgaaagaagacctggagatcgagcaccgcataaatattgagaagctgaaggacaacctcggtatacactacaaacagcaaatagacggtctccagaatgagatgtcacagaagattgagaccatgcaattcgaaaaagataaccttatcactaagcaaaatcaattaatcttggaaatttccaagctgaaggacctgcagcagagcctcgtgaattctaagtctgaagagatgacactgcagatcaacgagctgcagaaggagatagagatactcaggcaggaggagaaggagaaggggaccctggagcaggaggttcaagagctgcaacttaagactgagctgctcgagaagcagatgaaggagaaggagaacgacctgcaggagaagttcgctcaacttgaagccgagaactctattctgaaagacgaaaaaaagaccctagaggatatgttgaagatccacaccccagtcagccaggaagaaaggctcatctttcttgactcaatcaaatctaagagcaaagattccgtgtgggagaaggaaatcgaaatactgatagaggagaacgaagatttgaagcagcagtgcattcagttaaacgaagaaattgagaagcagagaaatacgttttccttcgccgagaagaactttgaagtgaactaccaggaattacaggaggaatacgcctgtctgttgaaagtgaaagacgatttggaggattcaaaaaacaagcaggaattggaatacaaatccaagttgaaagccctgaacgaggaactccacctgcagagaattaatccgactacagtgaagatgaaaagctcagtctttgacgaggacaagacattcgtggccgagacccttgagatgggcgaagttgtggaaaaagataccaccgagttgatggaaaaactcgaggtgaccaagagggaaaaacttgagctgtcgcagcgactgagcgatctgagcgaacagctgaaacagaagcatggcgaaatatctttccttaatgaggaagtgaagtctcttaaacaggagaaagagcaagtgtctctgaggtgccgtgaactggagattatcatcaatcacaacagggcggaaaacgtacaatcttgtgacacgcaggtttcttctttgctggatggtgttgtaacgatgacatcgcggggagcagagggaagtgtgagcaaggttaacaagagtttcggcgaggagagtaagatcatggtggaagacaaagtctctttcgagaacatgaccgtgggagaagagtcgaagcaggagcagttgatccttgatcatctgcccagcgtgactaaagaatcttcgttacgcgcaacccagccctcagagaacgataaactgcagaaagaattaaacgtgctgaagagcgaacagaacgacctcaggctgcagatggaagctcaaagaatctgtttatcactcgtgtacagtacccacgtagaccaagttcgggaatatatggagaatgagaaagacaaagctttatgctccctgaaggaagaactgatcttcgcccaagaggagaaaatcaaagagctgcagaaaatccaccagctggagcttcagactatgaagacccaggaaaccggcgacgagggaaaacctttacatctacttataggcaagctgcagaaggccgtgagcgaggaatgttcttatttcctgcagacactgtgtagtgtgctgggcgagtattacacaccggctttaaaatgcgaggtgaatgccgaggacaaggagaacagcggggattacatctccgagaatgaggatcccgaactgcaggactatagatacgaagttcaggactttcaagaaaatatgcacactttgctgaacaaagtcactgaagagtataataagttgctggtgttacagactaggctgtccaaaatttggggtcagcagacggatggtatgaaacttgaatttggcgaagagaatttgcctaaagaggagaccgagtttttgtcgatccacagccaaatgactaatctggaggatatagatgtgaaccacaaatcaaaattgtcgagtctgcaagacctggagaagaccaaactagaggaacaggtgcaggagttagagagtctgatctcatcactgcagcagcagctgaaagaaacagaacagaactacgaggcggaaatacattgtctgcagaagcgactgcaagccgtctcagaatcgaccgtgcctccgtccctccctgtcgacagtgttgtgatcacagagtctgacgcccagcgcaccatgtaccctggttcttgcgtgaagaagaatattgatggaaccattgagttcagcggtgaattcggtgtgaaagaggagacaaacatcgtcaaactcctcgaaaaacaatatcaagaacagttggaggaggaggtagccaaagtgatcgtgagcatgagtattgcctttgctcagcagaccgagctttccaggataagcggcggtaaagagaacaccgcctcctcgaagcaggcccatgcagtgtgccagcaagagcagcattatttcaacgaaatgaagctatctcaggatcagattggattccagaccttcgagaccgtcgacgttaagtttaaagaagaatttaagcctctcagcaaggagctgggagaacatggaaaggagatcttactgtccaactcagatcctcacgacatccctgaatctaaggattgtgtgcttacgatcagcgaagagatgttttccaaggacaagacgtttatcgttaggcaatccatccacgacgagatctcggtgtcctcaatggatgctagccgtcagctcatgctgaatgaggagcagctcgaagacatgcggcaagagctagtgaggcaataccaggagcaccaacaggccactgaactgctgcggcaggcacacatgaggcagatggagcgtcaacgcgaagatcaggagcagctgcaggaagaaattaaaagactgaatcgacagctcgcccagagatcttcaatagataatgaaaatctggtcagcgaacgggagcgtgtgctgctcgaggaactggaggcgctcaagcaattgagcctggctggaagagagaaactctgctgcgagcttcggaactctagcactcaaacccaaaacggcaacgaaaaccagggcgaagtcgaggagcagacctttaaggaaaaggaactggaccgtaagcctgaggacgtcccgccagaaattctgtccaacgaacggtatgcattgcagaaagccaacaatagacttctgaaaatcctgctggaagtggtcaagactactgctgcagtggaggagacaataggccgacatgtgttagggatccttgaccggagtagtaagtcccagtcttccgcgagcttaatctggcgcagtgaggcggaggcatcagttaagtcatgtgtacatgaggaacacacccgcgtgacagatgaatccattccctcctactccggctccgacatgccacggaatgatattaacatgtggagcaaggtcaccgaggaggggaccgagctatcgcagcgccttgttagaagcggattcgccggaaccgagatcgacccagaaaacgaggagctcatgcttaacattagcagcaggctgcaggccgcagtggagaaattgctcgaagctatttccgaaaccagctcccagttggagcatgctaaggtgacccaaaccgagttgatgcgagagtctttcagacaaaagcaggaagccaccgagtccctgaaatgtcaggaagaattgagagagaggctgcacgaggaaagtcgggcaagggagcagctcgcagtggaactctccaaggctgagggcgtcattgacggctacgctgacgagaagaccctcttcgaaagacaaatccaggagaaaaccgatatcatcgaccgcctagagcaggagctgctgtgcgctagcaacagattgcaagaactggaagccgaacagcagcagatacaagaggagagagagctgcttagccgacagaaggaggccatgaaggctgaagcgggtcccgtcgagcagcagttactgcaggaaaccgagaaattgatgaaggaaaaacttgaagtccagtgccaggccgaaaaagtgcgggatgatctgcagaagcaggtcaaagccttggaaatagatgtagaagaacaggtttccaggtttatcgagctggagcaggaaaagaatacagagctgatggacctgaggcagcagaatcaagctctggagaaacaacttgagaagatgcggaagtttctggacgaacaagctattgaccgcgagcacgagcgggacgtatttcagcaggaaattcagaagcttgagcagcagttgaaggttgttccccgatttcagccaatcagcgagcatcagacgagggaggtagagcagctggcaaaccatctcaaggagaagaccgacaaatgctcagagttactgctgtccaaggaacagttgcagagagacatccaggaacgaaacgaggaaattgaaaagcttgagttccgggtgcgagagctggaacaggcgctgctggtatccgcagataccttccagaaagtggaagataggaaacattttggtgccgtagaggccaagcctgagctcagtcttgaagtgcagttacaggctgaacgagatgccattgaccgtaaagagaaggaaatcacaaacctcgaagaacagctggagcagttcagggaggaacttgagaataagaacgaagaagtccagcaactccacatgcagcttgagattcagaagaaggaatctaccacccgtttgcaggagctggaacaggaaaacaagctgttcaaggacgatatggagaagctaggcctggccattaaggaaagcgacgccatgtccactcaggaccagcacgttttattcggaaaattcgctcagatcatccaggagaaggaggtggagatagatcaactcaacgaacaggtcaccaagctgcagcagcagctgaagattacaaccgataacaaagtgatcgaagaaaaaaatgaactcattagggatttagagacgcagatcgaatgcttaatgagtgaccaagaatgcgtgaaaaggaacagggaagaggaaatagaacagctgaatgaggtcattgaaaaactgcagcaggagcttgcaaatatcggccagaagacaagcatgaatgcccacagcctcagcgaggaagcggacagcctgaaacaccagcttgacgtcgttatcgccgagaagctggcacttgaacaacaagtggagaccgctaacgaggaaatgacgttcatgaagaacgtactgaaggagactaatttcaaaatgaatcagttaactcaggaattgttctcgcttaaaagagaaagggagtctgttgagaagattcaaagcataccggagaattcagtgaacgtcgcaatagatcacctgagcaaggataagcccgagctcgaggtcgttctgacagaagatgcattgaagtccctggaaaatcagacctatttcaagtcatttgaagagaacgggaaaggcagcatcattaatctggagaccagactgctgcagttggagtccaccgtctcagccaaggacttagagcttacacaatgttacaagcagattaaggatatgcaggagcagggacagttcgagaccgaaatgctgcagaaaaagatagtgaacctgcagaagattgtggaagaaaaggtggccgcagcacttgtgtctcagattcagttagaggccgtgcaggagtacgccaagttttgtcaagacaaccagactatcagctcagaaccggagagaacaaacattcaaaatctcaaccagcttagggaggacgagcttggctcagatattagtgctctcacgctgcggatcagtgagctggaatcccaggtcgttgagatgcatactagtctcatcctagagaaggagcaggtggaaattgctgagaaaaatgtgctggagaaggaaaaaaaactgctcgaactgcagaaacttctggagggcaatgagaaaaagcaaagggaaaaagagaagaaaaggtctcctcaagacgtggaggtcctgaaaaccaccacggaactcttccactccaacgaggaatccggatttttcaatgaattagaggcgctgagggccgaatctgttgccacaaaggcggaacttgcatcgtataaggagaaggccgagaagctccaggaagaacttttagtgaaggaaacaaacatgacctcattgcagaaggacctgtctcaggtccgggaccacttagctgaggctaaagaaaaactatcaatccttgagaaggaggacgagactgaggtccaagagtcgaagaaggcatgtatgtttgagccactgcccataaaattgtccaaatcaatcgcgagccagacggacggaactctgaaaattagcagcagcaaccagactccacagatcctggtcaagaatgccggaatacagattaatctacagtctgagtgttcaagcgaagaagttaccgagatcatcagccaatttaccgagaaaattgagaagatgcaggagcttcacgcagctgaaattctcgatatggagagtcgccatatctccgaaactgagaccttgaagagagaacactatgtcgcagtgcagcttctaaaggaagagtgtggcaccctgaaggctgtgatccagtgtctgcgatccaaggaagtatttgggttctacaatatgtgcttctctaccctctgtgatagtggtagtgactggggacagggaatctatctgactcactcacagggatttgacattgcttctgaaggacgcggagaggagtccgaatctgctaccgactccttccctaagaagatcaagggcctgttgcgtgcggtacataatgaggggatgcaagtcctctccttaactgaatcaccctattccgacggtgaagatcatagtattcagcaggtgtccgagccttggctggaagagaggaaggcttatattaatacaatcagcagcctcaaggatctgatcacaaagatgcagctgcaaagagaggcggaagtctacgactcctcccagagtcacgagtcttttagtgattggcgaggggaactgctcctggctctccaacaagtctttctggaggagaggtcagtgcttttagctgcttttcggaccgagctgactgcactcgggactaccgacgccgtcggcctcctgaattgcttggagcagcgaatccaggaacagggtgtggagtatcaggccgctatggaatgtctgcaaaaagccgatcgtaggtctttgctgtctgaaatccaggctttacatgcccaaatgaatgggagaaagatcacactgaaacgggaacaagaatccgaaaagccctcacaggaactgcttgaatacaatatccagcaaaaacagtcccagatgctggagatgcaggtggagttatccagcatgaaggaccgggcaacagaactccaagagcaactgtcctcagagaagatggtggtagctgaactcaaatcagaactggctcagacgaagctagaactggaaaccacattgaaggcccaacacaaacacttgaaagagcttgaagcatttaggctggaagtcaaagacaagactgatgaggtgcatctcctgaacgacacactggctagtgagcagaagaagagtcgtgagcttcagtgggcactggaaaaagaaaaggcaaagcttggtcggagtgaagaacgcgacaaggaagagctggaggacctgaaattctccctggagtcacagaaacagcgaaatttgcagttgaacctcctccttgagcagcaaaagcagttgcttaatgagtcccagcagaaaatcgagtcccagagaatgctgtatgacgcgcagctcagcgaggaacaaggcaggaaccttgaactgcaagtgctactcgagagcgagaaggtgaggattcgtgagatgtcatcgaccttagacagagagcgggaactgcacgcgcagctgcagtcttcagacggcaccggtcagtcccgacctcctttgccatctgaggacctgctgaaggagctgcagaagcagctggaggagaagcactctcgcatcgtagaactgctgaatgagacagaaaagtataagttggactctctacagacccgccaacagatggaaaaggaccgccaagtgcacagaaaaacactgcagactgagcaggaagctaacacagaaggccagaaaaagatgcatgagctgcagtcaaaggtcgaagatcttcagcggcaactagaggaaaagcgtcagcaagtgtataaattagacttggagggccagagactccagggaatcatgcaagaattccagaaacaagaactggaaagagaggaaaaacgcgagagccggcgtattctgtaccagaatcttaatgaaccaactacatggagccttacttctgaccgaactaggaactgggtactccagcagaagatcgaaggagagaccaaagagtcaaattacgccaagttaatcgaaatgaatgggggaggcacagggtgcaatcacgagctcgagatgattagacagaaactgcagtgcgtagctagcaagctccaggtacttccccagaaagccagcgaacggctgcaatttgagactgctgatgatgaggactttatctgggtccaggaaaacattgacgaaataatccttcagcttcagaaactaaccggccagcagggcgaagaacccagtctggtgtccccatcaacctcttgcggatctcttaccgaaaggctcctgagacagaacgctgagctgaccggccacatttcccagctcaccgaggagaaaaacgatttgcggaatatggtcatgaaactggaggaacagattaggtggtatagacagactggggcaggcagagacaactcaagtagatttagcctgaatgggggagccaatattgaggccatcatcgccagcgaaaaggaagtatggaaccgcgagaagctcaccttgcagaagagcttgaaacgtgccgaagctgaggtatacaagctgaaagctgagctcaggaacgactcactgcttcagacgctgagtccggactcggagcacgtcacactcaaaaggatttatggtaaataccttcgagctgaaagtttccggaaggcgttgatttaccagaaaaagtacctgctgctgctgctgggcggattccaggagtgtgaggatgcaaccctggccctgctggccaggatgggaggccagcccgcatttaccgatctagaggtaataacgaatcggcctaaggggtttacccgatttcgttccgctgttcgggtttccattgccatctcaagaatgaaatttctcgtgcgacgctggcatcgcgtgactggcagtgtctccatcaatatcaatcgagacggctttggcttgaatcagggggcagagaaaacggactcattttaccactctagcggcggactcgagctctatggagaaccacgccacaccacctaccggagtaggtctgacctcgattatatccggagtccactgccgtttcaaaatcggtaccccggaaccccagccgactttaatcccggaagcctcgcctgctctcagctacaaaactatgatccagacagggctctgacagactacattacgaggctggaagccctccagagacgattgggcactatccagtcaggctcaaccacgcagtttcacgctggcatgcggcgttat

SEQ ID NO: 212856 - DNA, 4932 bp, Artificial Sequence
  Description of Artificial Sequence: Synthetic coding sequence
atggaggatgaggaacggcagaaaaaactggaagctgggaaggccaaaattgaggagctgagtttagcttttctcgtgagacaactcgcccagtttcggcagcgcaaggcacagtctgacggacagtctcctagtaaaaagcagaagaagaaaagaaaaaccagtagttctaaacatgatgtttctgctcatcatgacctgaatatagatcagtcccagtgtaatgagatgtacataaattcaagccagagggtggagagtaccgttatcccagagagcacaattatgaggaccctacactctggtgaaattacctcccatgagcaggggttctcagtcgagctggaatccgagattagcactacggcagatgattgtagttctgaggttaatggctgctcatttgtgatgaggaccggaaaacccaccaatctgctccgcgaggaagaattcggcgtcgacgatagttactccgaacagggtgcgcaggactcacctacacacttggagatgatggagtccgaattggccggaaagcagcatgaaattgaggagctcaaccgcgagttggaagagatgcgagtcacctatggaactgaagggctccaacagcttcaagagttcgaggctgccatcaaacaacgcgatggcatcatcacccaattgaccgccaaccttcaacaagctcgcagagagaaagacgagaccatgagagagttcctagagctaaccgagcagtctcaaaagctccagattcagtttcaacagctccaggcgagcgaaacactgaggaactcaactcattctagcacagccgcagatctgttgcaggctaaacagcagatactgacacatcaacaacagctggaagaacaggaccacctgcttgaagattaccagaagaaaaaggaggattttactatgcagatctcgtttcttcaggagaaaatcaaagtctacgagatggaacaagataagaaagtggaaaactcaaacaaggaggagatccaggagaaagaaacaattatagaggaactcaataccaagattatagaagaggaaaaaaagacactggaacttaaggacaaactgactaccgcagataaactcctgggggagttacaggagcagatcgtgcagaagaaccaagagatcaagaacatgaagttggaattaactaactccaagcaaaaggagcgccagagctccgaggagatcaagcagttaatgggtacggtcgaagaactgcagaagagaaatcacaaagattcccagttcgaaaccgatatcgtccagagaatggagcaagaaacccagaggaaacttgaacagctgcgcgctgaactggacgagatgtacgggcagcaaatcgtgcaaatgaaacaagaactaattcgccagcacatggcccaaatggaggaaatgaagactcggcacaaaggcgaaatggagaacgccttgagaagttactctaatataacagttaacgaagatcagataaagttgatgaatgtggccattaatgagctgaacattaagctgcaggatacgaactcacagaaagaaaagttgaaagaggagctaggattgatcctagaggaaaaatgtgcgctgcagagacagttggaggatctggtggaagaactgtcttttagccgtgagcagatccagcgcgctaggcagaccatcgccgaacaagagagcaaacttaacgaagcccataagtccctgtctacagtggaagatttaaaggctgaaattgtcagcgcttccgagtctcgtaaagagctagagctcaagcacgaggctgaagttaccaactataaaatcaaactggagatgctggagaaagaaaagaatgctgtccttgatcgaatggccgagtcccaggaggcagagctcgagagattaaggacacaactgttgttctcacacgaggaagagctgtcaaaactgaaggaggatttggaaatcgaacacagaatcaatatcgagaagctgaaggataacctgggaatccactacaagcaacaaatagatggactccaaaacgagatgtcacagaagattgagaccatgcagtttgaaaaagacaacctgatcactaaacagaaccagcttattctggagatctctaaacttaaggatctccagcagtctctggtgaattcgaagtccgaggagatgaccttacagattaatgagctccagaaggaaatcgaaattctgcgacaggaagaaaaggagaagggtacgctggaacaggaagtacaggagctgcagctgaagaccgagctactggaaaagcagatgaaagagaaagagaacgacctgcaggagaagtttgctcagctcgaggcggaaaactcaattctaaaggacgaaaaaaaaactctggaagatatgctcaaaatccatacacccgtgtcacaagaagaaaggttgatttttctggacagtatcaagagtaagtccaaggattcggtgtgggagaaagaaatagagatcctgatcgaggagaacgaagatctgaagcaacagtgtatccagctcaacgaggaaatcgagaagcagcggaatacttttagctttgctgaaaagaactttgaggttaactatcaggaactacaagaggaatacgcctgccttctaaaagtgaaagacgaccttgaggattccaaaaacaagcaggaactcgagtacaaatctaaacttaaggccctgaatgaagaactccatcttcaacgcataaatccaactaccgtgaagatgaagagtagcgtttttgatgaggacaaaacctttgtagctgagacccttgagatgggcgaggtggtggagaaggatacaacagagttaatggaaaaactcgaagtaactaagcgggagaaattggagctgtcccagaggctgagcgatttatccgagcagctcaagcagaagcacggagaaatctcgtttctcaacgaggaggtgaaatcactcaagcaagagaaagagcaagtatctcttagatgccgtgagctggagattataatcaaccacaacagagctgaaaacgtccagagctgcgacactcaggtgtcaagtctcctggatggtgtcgtcaccatgacaagccgaggtgccgaaggcagtgtgtccaaggtgaacaaaagcttcggggaggaatccaaaattatggttgaggataaggtatcttttgaaaatatgacggtcggcgaagagagcaaacaggagcaattgattttagaccacctcccatcagttacaaaggagtcttctctcagagcaactcaacctagcgaaaatgacaagttgcagaaagaacttaacgtgctgaaaagcgaacagaatgacctgaggctccagatggaagctcagcgcatttgcctgtctttggtctactcgacacatgtagaccaggtgagagaatatatggaaaatgaaaaagacaaggctctgtgtagccttaaagaggagttgatcttcgctcaggaggaaaaaatcaaggaattgcaaaaaatccaccaacttgagttacagactatgaaaacacaggaaactggcgacgaaggaaaacccctgcatctacttatcggtaagctgcagaaggccgtgtccgaagagtgcagctacttcctacagactctatgcagcgtcctaggagagtattacacccccgcactgaagtgcgaagtcaatgctgaggacaaagaaaattctggggactatatcagtgaaaacgaagatcctgagttgcaagattatcggtacgaagtgcaagactttcaggagaatatgcacaccctgctcaacaaagtgacggaagaatataataaattgctcgtacttcaaacgcggttaagcaaaatttggggtcagcagacagacggcatgaagcttgagttcggagaggagaaccttcctaaagaggagaccgagttcttgtcgatacatagtcagatgactaacctggaagatatagacgtcaatcacaagagtaaactgagctccttacaggacctcgagaagacaaaacttgaggagcaggtacaggaactcgagtccctaataagctccctgcagcagcagttgaaggaaaccgaacagaactacgaagccgagatacactgcctccagaagcgactacaagccgtgtcggagtcgacagtgccgccttccctgcctgtcgactctgtcgtcatcaccgagtctgacgctcaaaggactatgtatccagggtcttgtgttaaaaaaaacatagacggaacaattgaattctcaggcgaatttggagtgaaggaggaaactaacatagttaagctgctcgagaagcaatatcaggagcagttagaggaagaagtggcaaaggtgattgtgtctatgagcatcgcctttgcccagcagactgaactgtctcgtatatctggtggaaaagaaaacactgcaagctcgaaacaggctcacgccgtgtgccaacaggagcagcactatttcaacgaaatgaaactgtcccaggatcagatcggctttcagacatttgaaacggtcgacgtaaagttcaaagaagagtttaaaccactgagtaaggagcttggtgaacacggaaaagagattctgttgtccaactccgacccccatgatattcctgaaagcaaggattgcgtgctgactatttcagaggagatgtttagcaaagataagacttttattgttcgtcagtccatacacgatgagatctcggtgtcctcaatggatgcctctcggcagttgatgcttaatgaggagcaactggaggatatgaggcaggagcttgtaagacaatatcaggaacaccagcaggctaccgagctgctgcgtcaggctcacatgagacagatggagaggcagagggaggatcaggaacagctgcaggtgagagttctgtag

SEQ ID NO: 212857 - DNA, 11631 bp, Artificial Sequence
  Description of Artificial Sequence: Synthetic coding sequence
atggaagacgaagaacgccagaaaaagctggaagctggcaaagcaaaaatagaagaactttctttggcctttctggtacgtcagctggctcagttcagacagcggaaagcacaaagtgacggccagtcaccttcgaagaagcaaaagaagaaacgcaagacatcctcttctaagcacgatgtgtccgcccaccacgacctgaatattgatcaatctcagtgcaacgagatgtacatcaacagcagtcagcgggtagagagcaccgtaataccagaatctaccatcatgagaaccttgcactccggagaaattacatcacacgagcaggggttttctgttgagctcgagtcggaaatatctacaactgccgatgactgcagctccgaggtaaatggctgtagcttcgtaatgcgaacggggaaacccaccaacctacttcgcgaagaagagttcggcgtggatgattcttattcagaacagggcgcacaggactcccctacccatttggaaatgatggaaagcgagctcgctggcaagcaacatgagatagaggaattaaacagagaattggaagagatgcgcgtgacctacgggaccgagggcttgcagcaattacaggaattcgaggctgcgataaagcaaagggacggaattattacgcaattaactgccaatctgcagcaggcccgaagagagaaggatgagaccatgcgagaattcctggaactgaccgagcaatctcagaagctgcaaatccagttccaacaattacaggcctcagagacactgaggaattctacgcatagcagtaccgcggctgacttgctgcaggctaagcagcagatcctaacgcatcagcagcagctcgaggaacaggaccacttactagaagactatcagaaaaaaaaagaggatttcaccatgcagatttcatttctacaagaaaaaataaaggtttacgagatggaacaagataaaaaagtggagaactcaaataaggaagagatccaggagaaagaaaccattattgaagagttgaacacaaaaatcatcgaagaagaaaagaagacacttgaactcaaggacaagttgaccacagctgataagctgctgggagagctgcaggaacagattgtacagaagaatcaagagattaagaacatgaagctggaacttaccaacagcaaacagaaggagcggcagtccagcgaagaaattaagcagctcatgggcactgtcgaggaactccagaaacggaaccataaagactcccagttcgagacagatatcgtccagcgcatggagcaagaaactcaaaggaagttggaacagctaagggccgagctggacgagatgtacggccagcagattgtgcaaatgaaacaggagcttattcgacagcacatggcacagatggaagaaatgaaaacacgccacaagggcgagatggagaatgctttgcggtcttactcgaacattactgtgaacgaagatcagataaaactgatgaacgtggcaatcaacgagctgaatattaagctccaagacaccaactcccagaaagagaagctgaaagaggaactcggactgattctggaagaaaaatgcgccctccagcgccaactcgaagacttagtagaagagctctcattctcccgagagcagatacagcgcgctagacagacgattgccgaacaggagtctaaactcaacgaagcacacaagtccctgagcaccgtcgaagacttgaaggccgaaatcgtgagcgctagcgaatcacgaaaggagcttgagctaaagcatgaagctgaggtgacgaattacaaaataaaactggagatgctagagaaggagaaaaacgcggtgttggaccgcatggccgaaagccaggaagctgagctcgagaggctgagaacacagctcctttttagccacgaggaggagctgagtaaacttaaggaggatcttgaaatcgagcaccggattaatattgagaaacttaaagataacctcggcatacactacaaacagcaaatcgacggcctacagaacgaaatgagccagaaaattgaaactatgcaattcgaaaaggataacctgatcactaagcagaaccagctcattctcgagatttctaaattaaaagatttgcagcagtccctcgtgaattccaagtccgaggaaatgactctccagatcaatgaactgcaaaaagaaatcgagatcctgagacaggaggaaaaggaaaagggcacactcgagcaggaagtgcaggagctgcagctgaagaccgagctgctggagaagcagatgaaggaaaaggagaatgatctgcaggaaaagtttgcccagctagaggccgagaattccatcctcaaggacgaaaagaaaaccctggaagacatgctgaagatacacacccctgtgtcacaagaagaaaggcttatcttcttggactccataaaaagcaaatcaaaggactcagtctgggagaaggaaatcgagatcctcattgaagagaacgaagacctaaaacagcagtgtattcagctgaatgaagagattgaaaaacagcgtaacacattctcctttgccgaaaaaaattttgaggtaaactaccaggagcttcaagaggagtacgcatgtctcttaaaggtcaaggacgatctcgaagattcgaaaaacaagcaagagttggagtataagtcaaagctgaaagcgctgaacgaggaactgcatctgcagagaatcaatccgaccacagtgaaaatgaagtccagcgtgtttgacgaagataagacattcgtcgcggagactcttgagatgggcgaggtggttgagaaggatactacggaactcatggaaaagttggaagtaaccaagcgggaaaaattagaactctcgcagcgactcagcgatctgagtgagcagttgaagcagaaacatggggaaataagcttcctgaatgaggaggtgaaatctttaaagcaggaaaaggaacaggtttctctgaggtgtcgggaactggaaatcatcatcaatcataaccgggctgagaacgttcagtcatgcgacacacaggtgtccagcctactcgacggagtggtcaccatgacctcccgcggagcggagggttccgtaagcaaggtgaataaaagctttggcgaggagtctaaaatcatggtagaggataaagtgagttttgaaaacatgaccgtgggggaggaaagtaagcaagagcaactgattctggatcatctgccttcagtgacaaaagaatcctctcttagggccacgcagccctcagaaaacgataagttgcagaaagaactgaacgtgctgaagtctgagcagaatgatctgcggttacagatggaagcgcagcgcatctgtctcagcctggtgtatagcacacacgtagatcaagtgcgggagtacatggagaacgaaaaggataaggctctgtgtagtctgaaagaggagcttattttcgcccaggaggaaaaaatcaaggagttacagaagatacatcagctggaactccagactatgaaaacacaggagactggagatgaggggaaaccactgcacctgctgatcggcaagctccagaaagcagtctccgaggagtgtagctacttcctgcagaccctatgctcagtcttgggtgagtattatacacctgcactgaagtgtgaagttaacgctgaagacaaggaaaattcaggcgattacatctccgagaatgaggacccggagctgcaggactataggtatgaggtacaggattttcaggaaaacatgcacaccctactaaataaggtgactgaagaatacaataaattattagtgctccaaactaggctgagtaaaatctggggccagcagaccgatggtatgaaactcgagtttggtgaggagaatttgcctaaagaagaaactgagttcctttctatccattcacaaatgactaacctggaggacatagatgtgaatcataaaagcaagctgtcctccctgcaggatcttgagaagaccaaactcgaggaacaggtgcaggagctcgaaagtctgatttcttcactccagcagcagctgaaagagacggaacaaaactacgaagccgaaattcactgtttacagaagcgtctgcaggctgtgagcgaatccacagtgccgccatctcttccagtggacagtgtagtaataaccgaatctgatgcccaaagaactatgtaccctgggagctgtgttaagaagaatattgatggaaccatcgagttctctggggaattcggggtaaaagaagagacaaatattgtgaagctcctcgaaaaacagtatcaagaacagttagaggaggaggtggccaaggtgattgtgagcatgtccatcgcctttgctcaacagacagagctgtccaggattagcggagggaaagaaaacaccgcctcttccaagcaggcccatgccgtgtgtcagcaggaacagcattattttaatgaaatgaaactgtctcaggatcagattgggttccagacatttgaaaccgtggatgtcaaattcaaggaggaatttaagccattgagtaaagaattgggggagcatggaaaggagatattgttgtccaatagcgaccctcacgacattcctgaaagtaaagactgtgtcttgaccatatccgaagagatgtttagtaaagataagacattcatcgtcagacagagtatacacgacgagataagcgtgtctagcatggacgccagtcggcagctaatgctgaatgaggaacaattggaggatatgaggcaggagctcgtgaggcagtatcaagaacaccaacaggccaccgagctgttgaggcaggcacacatgagacagatggagcggcagcgggaagatcaggaacagctacaagaagagatcaaacgcctgaacagacaattagcacagcgaagctccatcgataatgaaaacctcgtgtccgaacgagagagggtgctcttggaagaattggaggctctcaaacagctttcattagcaggtagggagaagctatgctgtgagctcaggaacagctccacccaaactcaaaatgggaatgagaatcagggtgaggtggaagagcaaaccttcaaagagaaagaattagatcgtaagcctgaggacgtcccacccgaaatcctcagcaatgagcgctacgcacttcagaaagccaacaataggctgttgaaaattctcctcgaggttgtcaaaacaaccgcagctgttgaggagactattggcagacatgtgctgggaatcctggaccggtctagtaaatcccagagcagtgcctccctgatctggcgatccgaggctgaagcatccgtgaagtcgtgcgtgcatgaggagcatacccgagttacggacgagtcaattccaagttactccggctccgatatgccgcgtaatgatatcaacatgtggtctaaagtaactgaggagggaacagagctatcacagcggctcgtgaggagtggctttgccggaaccgaaatcgatcccgagaacgaggaactgatgctgaatatttcctctagattgcaggcagctgtggagaagcttctagaagccatatcggaaacttccagccagctcgagcacgctaaggtcacccaaaccgaactgatgagagagtccttccggcaaaaacaggaagccaccgaatcactgaagtgccaggaggagctgcgagagagacttcacgaggaaagtcgggcaagggagcaactggcagtcgaattgtccaaggccgagggggttatcgatggctatgctgatgagaagacgctctttgaaaggcaaattcaggagaaaactgatattatcgacaggttagagcaggaacttctttgcgcaagcaatcgcctgcaggagctggaggcagaacaacagcagattcaagaggagagagagctgctctccaggcagaaggaggctatgaaagcggaggccggtcctgttgaacagcagcttctgcaagaaacagagaagctcatgaaagagaagttggaggtacagtgccaagctgaaaaagtacgagacgacctgcagaaacaggttaaggcactggaaattgacgttgaggaacaagtaagcaggttcattgagctggaacaagaaaagaacaccgaactaatggaccttaggcagcaaaatcaagcactcgagaagcagctggaaaaaatgcggaaattcctggatgagcaagctattgaccgcgagcacgagcgggatgtttttcagcaggaaattcagaaattggaacagcagctgaaagtggtgccacggttccaaccgataagtgaacatcaaactagagaggtagagcagctcgcaaaccatctcaaagaaaagaccgacaagtgttccgaactgcttctctctaaggagcagctccagcgagatatccaggaaagaaatgaggaaatcgagaaactagagttcagagtccgtgagctggaacaagcccttctcgtggaagacaggaagcacttcggagcggtggaagctaagccggagctgtcgctggaggtgcagctgcaagccgagcgtgatgccattgatcggaaagaaaaggaaattactaatttggaggagcagctggagcagttccgagaagaattggaaaacaaaaatgaggaggtccagcagctgcacatgcaactggaaattcagaaaaaggagagcactacccgccttcaggaactagagcaggagaacaagttattcaaggacgatatggagaagctgggtctggcgatcaaggagagcgatgctatgtcaacccaagaccaacatgtgttgtttgggaagttcgctcaaattatacaagaaaaagaagtcgagatcgatcagctcaatgaacaggtaaccaagctgcagcagcagcttaagatcaccacagacaataaggtgattgaggaaaagaatgagctgattcgtgacctcgagacgcagatcgagtgtctgatgagcgaccaggagtgcgtgaaacgaaacagagaagaggaaatcgaacaattgaatgaagttattgaaaaactgcagcaggagctggcaaacatcggccaaaagacatccatgaatgctcacagtctgagcgaagaggccgacagtttgaagcaccagctcgatgtggtgatcgctgaaaaactggctcttgagcagcaggtggagactgcaaacgaagagatgacgtttatgaaaaacgtcctcaaagaaaccaacttcaaaatgaatcagctgacacaggaactcttttctctgaagagagaaagagagagcgtggaaaaaatacagagcatacccgaaaacagcgtgaacgtagcaattgaccacctcagtaaagataagccagagctagaagtggtcctgactgaagatgctttgaaatctctcgagaaccaaacctacttcaagagctttgaggagaacggcaagggatccatcattaatttagagactcgactgctccagctggaatctacagtgtcagccaaagaccttgaactcacacaatgctacaaacagataaaagatatgcaggagcaggggcaatttgagacggaaatgctgcagaaaaaaatagtgaacctccagaaaatcgtcgaggaaaaggtcgccgcagccttggtctcccagatacagctggaagccgtgcaagagtatgccaagttttgtcaggacaatcaaactatatcttccgaaccagaacgcaccaatatccagaacctaaaccagctcagggaagatgagctgggaagcgatatcagcgctttaactttgagaattagtgagctggagagccaggtggtggagatgcacaccagtctgattttggagaaggaacaggtggaaatcgcggaaaagaacgtgttagagaaagagaagaagttactggagttgcaaaaactgctggaaggcaatgaaaaaaagcagagggagaaggaaaagaagcgttccccacaagacgttgaagtcttgaagacaaccacagagctgttccacagtaatgaagaatccggcttttttaatgaacttgaagccctgagggcagaaagtgttgccactaaagcagagctggcttcatataaagaaaaggcagagaaactacaggaggagctgctggtaaaagaaacaaatatgacaagcctacagaaggacttgagccaggtccgggaccatctcgctgaggccaaagagaagctgtcaattctggagaaggaggatgagacagaggtgcaggagagtaagaaggcctgtatgttcgagccacttccgattaaactttctaagtcaatcgcttcccagactgacggcactctcaagatctctagtagcaatcagactccccaaatcctcgtcaagaacgccggaatccagatcaaccttcaaagcgagtgcagtagcgaagaagtgaccgaaataatctcccagttcaccgaaaagattgagaaaatgcaggagttgcacgcagcggagatcttagatatggagtcacgccatatctcagaaacagaaaccctgaaacgagagcactacgtggctgttcagctcctaaaggaggaatgcggcactttgaaggctgttatccagtgtctgagatccaaagaagggtcaagtattcctgaattagcacatagcgatgcctatcagacacgcgagatctgctcaagcgattccggctctgactggggtcaggggatctacctgacgcacagccaggggtttgacattgcttcagaggggaggggggaggagagtgaaagtgccactgactcattcccaaagaaaataaaggggctgctccgtgcagtgcacaacgagggtatgcaagttctctctctcaccgaatcaccgtatagtgacggggaggaccactccatacagcaggtcagcgagccctggctggaagagcggaaggcatacatcaacacaatcagttcactcaaagatcttattacaaagatgcagctgcagagggaggctgaagtttacgattcatcccagagccatgaatcgtttagcgactggaggggggaactgctgttggcactgcaacaagtgtttctggaagaacgaagtgttctattggccgctttcagaacagaattgaccgcccttggcactacagatgcggtgggtctcctgaactgcctggagcagcggatccaggaacagggggtcgagtatcaggcagccatggagtgcttgcagaaggccgaccggcgaagcctcctgtccgagatccaagcactgcacgcacaaatgaacggcagaaaaattaccttaaaacgcgagcaagagtccgagaaaccatcccaggagctgctggagtataacattcagcagaaacaaagtcagatgttggagatgcaagttgagctctcctccatgaaggatcgagctactgagttgcaggaacagctgagttctgaaaagatggtggtagccgaactgaagtccgagctggcccaaaccaagctcgagcttgagacaacactgaaggcacagcacaaacaccttaaagagttggaagctttcagactggaggtgaaagacaagactgacgaggtacatcttctaaatgacactctagcttccgagcagaaaaaatcccgagaattgcaatgggcgctggaaaaggagaaggccaagctgggtaggtccgaggaacgggacaaggaggagctcgaagatctaaaattcagcctagagagccagaagcagcgcaatctgcagcttaacctgctgctggagcagcaaaagcagttgcttaacgagagccagcagaagattgagtcccagcgcatgctgtacgatgcccaactttcagaagagcagggcaggaatctggaactacaggtgcttctggagtccgaaaaagtccggatccgtgagatgtcttccacattggacagagaacgggagttgcatgcgcagctccagagttccgacggcaccggccagagccggcctccgctgcccagcgaggatctccttaaagagcttcagaaacaattggaggagaaacactcccgtatagtagagttgctcaacgagactgagaaatataagctcgatagtcttcaaaccaggcagcagatggagaaggaccgtcaggtacacaggaagactctgcagacggaacaggaagccaacactgaagggcaaaaaaagatgcacgaacttcaaagcaaagtggaagatctacagcgacagctggaggaaaaacgccagcaggtgtataagctcgacctggaggggcaaagactgcagggtatcatgcaggagtttcaaaagcaggaattggaaagagaagaaaagcgcgagtctcggaggattttgtatcagaatctgaacgagcctacaacctggtctctcacatctgatcggactcggaactgggtcctgcagcagaagattgaaggagagactaaggagtctaactacgctaagctcatagaaatgaatggcggaggcaccgggtgcaatcatgagctcgaaatgattagacagaaactgcagtgcgtcgcctcgaagctgcaagtcttaccccaaaaggccagtgaacgtttgcagttcgaaaccgcggatgacgaagattttatttgggttcaggagaacattgacgaaataatcctgcagcttcagaagctgacagggcagcagggcgaggagccctccctcgtcagtccaagcacctcctgtggctcgctgacagaacgcctcctgcgccagaacgcagagctgacaggccatattagccaactgactgaggagaagaacgatctcagaaacatggttatgaagctagaagaacaaataaggtggtataggcagaccggtgccggacgcgataactcttcacggttctcattgaatggcggtgccaacattgaggccattatcgccagcgaaaaggaagtttggaacagagaaaaactcactctccagaagagccttaagagggccgaggcagaagtatacaagctgaaagccgagctaaggaatgattcactgctgcaaactctgtcccctgattccgagcacgtcacactgaaaaggatctatggcaagtatttgagggcggaatctttccggaaggccctcatctaccagaagaaataccttctgttgctactgggcggatttcaggaatgtgaagatgccaccctcgcattgcttgccaggatgggcggacagcccgcattcaccgatctcgaggtgatcaccaataggcccaaaggctttacaagattccgttccgccgtcagagtgtctatcgctattagtcgcatgaaattccttgtgcgcagatggcaccgggtgactggatcagtgtctataaatattaacagggacggattcggcctgaaccaaggcgcagagaagactgatagcttctaccatagctctggcggactggagctgtatggtgagccacggcatacgacttatagatctcgatctgatttggattacatacgatcaccactgccttttcagaaccgctatcccggaacccccgctgacttcaaccccggatctcttgcatgctcccaactacagaactatgacccatag

SEQ ID NO: 212858 - DNA, 1782 bp, Artificial Sequence
  Description of Artificial Sequence: Synthetic coding sequence
atggcaattcaattccgctcattgtttccattggcgttgcccggaatgctggcattgttgggttggtggtggttcttcagcaggaaaaagggacatgtgtcctcccacgatgagcagcaggtggaggccggagccgtccagctgcgagccgatcctgcaattaaggagccactgccagttgaagacgtgtgtcccaaagttgtcagcaccccaccttctgtgaccgagccaccagagaaggaactgtccaccgtttcgaagctccctgccgaaccgcctgccttgctgcagactcacccaccctgccgcagatcagaatcaagcggcattctgcccaatactacggatatgcgcctgaggcctggtacgagacgcgatgattctaccaaattggaattggcacttaccggtggggaagcgaaaagcattccgctggagtgccccctgagcagcccgaaaggcgtcctgttttctagcaaatccgccgaagtatgtaagcaggactcccccttcagtagagtcccgcgaaaagtacagccaggatatcctgtggtccctgccgagaaacgctcttctggagagagggcacgggaaactgggggagctgaaggcacaggcgacgccgttctgggtgagaaggtccttgaggaggctctgctgtctcgcgagcacgtcctggaactcgaaaacagtaagggcccttccctcgcctcacttgagggagaggaggacaagggtaagtcaagctcctcccaggtggtgggcccagttcaggaagaggagtatgtcgcggaaaagcttcccagcaggttcattgaatctgcgcatactgagctggccaaggatgacgcagccccagcccctcctgtggccgacgccaaggcccaggaccggggagtcgaaggagagttgggaaacgaagagtcgctcgaccggaatgaggaagggctcgatagaaatgaggaagggctggacaggaatgaagaatcacttgatcgtaatgaggaaggcctcgaccggaatgaggagatcaaacgggctgcgttccaaattattagccaggtaatatcagaagctacagagcaggttctcgcgaccacagttggcaaagtcgcaggcagagtttgccaggcatcccagttgcaggggcagaaggaagagagctgcgttcctgtgcatcagaaaactgtgctgggaccagacactgccgaaccagcgacagccgaagctgcagtggctcccccagatgccggactgcctctccctgggttgcctgctgagggctccccccctcctaagacctacgtgagttgcttaaaatccctattatcaagcccgacaaaagacagcaaacccaacattagcgctcatcacatctctttggcttcctgcttagctttaacgacaccctcagaagaacttccggaccgggctggcattctcgttgaggatgctacttgtgtgacttgtatgtccgatagttcccagtctgtgccattggttgcttccccaggacactgttctgactccttcagcacctctggcctggaggattcctgcacagagactagctcttcgccacgagacaaagccatcaccccacccctccccgagtctactgtgccatttagtaacggcgtgctaaaaggtgagttgtcagatttgggggctgaagacggctggacaatggatgccgaggcagatcattccggggttgcagcaccccctccgggaaagagagggaccctgatcaccagatgccccggtttttttgagtgctag

SEQ ID NO: 212859 - DNA, 2712 bp, Artificial Sequence
  Description of Artificial Sequence: Synthetic coding sequence
atggccatccagttcagatcccttttcccacttgcactgccagggatgctggcattactgggctggtggtggtttttttcccgcaaaaagggccacgtcagctctcatgacgaacagcaggttgaagcaggggctgtgcaactaagagcggatccagccataaaggaacctctccctgtcgaggatgtttgtcccaaggtcgtgagcacaccgccatctgtgacagaaccccctgagaaggaactctcgaccgtttccaaacttccagccgaacccccagcactgctgcagacgcaccccccttgtcggaggagcgagtcgagtggcatcctccctaatacaactgatatgcggctgcggcctggcacaaggcgcgacgacagtactaagttggagctggctctgactggaggggaggctaagagcattccactggaatgtcctctgagtagccccaagggcgttttgttcagctcaaaatcagccgaagtgtgcaagcaggattccccattctcgcgcgttcctcgcaaggtccagccaggctaccccgtggtgccagcagaaaagcgtagcagcggcgagagggctcgggagaccggaggagctgaggggacgggagacgcagtgctcggcgaaaaggtgctggaagaagctttactatctagagagcatgtgcttgaattggagaactcaaagggaccatcgctcgcctccctcgaaggagaagaagacaagggaaagagttccagctcccaggtcgtgggcccagtgcaggaagaggagtacgttgctgagaaattaccttcaagattcatcgagagtgcccacacagaactagcaaaagacgacgccgctcctgcccctcctgtggccgacgccaaagctcaagatagaggtgtggagggtgaactgggcaacgaggaatctctcgaccgaaacgaggagggactggatagaaatgaagaaggcctggatcgcaatgaggaatcattagaccgtaatgaggagggattggatagaaacgaagagattaaacgcgcagccttccaaattatctctcaagtgatctccgaagccaccgaacaggtcttggccactacagtaggcaaggttgccggaagagtttgtcaggccagccaactgcaaggacagaaggaagagagttgtgttcctgtccaccagaaaaccgttctgggaccagatacggccgaacccgctacagctgaagcagcggtcgccccaccggatgctgggctgcctctgcccggtttgcctgctgagggttctcctccgcctaaaacatacgtatcttgtctgaaatccttactgagttcccctaccaaagacagtaaaccaaacatatctgcccaccacatttcacttgcctcgtgccttgctctgaccaccccgtccgaagagctaccggatcgagctggcatcttagtggaggatgctacttgtgtgacatgtatgagcgacagtagccagtccgtgcccctcgtcgcttctcctggccactgctccgatagttttagcactagcgggttggaggattcctgcacggaaacctcttcgagcccccgtgataaggcgatcacacccccactgcctgaatcaactgtgcccttctcaaatggggtgttaaaaggagagctgtctgacttgggggcagaggacggttggacgatggatgcggaagccgaccacagcggcggtagtgaccggaactcaatggacagcgtggatagttgttgcagtttgaagaagactgaatccttccagaacgcgcaggccggttcaaaccctaagaaagtagatttgataatttgggagatcgaggtccccaagcaccttgttgggaggctgattgggaaacaaggacgctacgtgtcatttttgaagcagacaagcggcgctaagatctatatctctactctgccctacacccagtcagtacaaatctgtcatatcgaaggatctcagcaccacgtggataaagctttgaatttgatcggtaagaaatttaaagaactcaacctaacaaatatttatgcccctcctctgccaagtctggccctcccctctctgcccatgacctcttggttgatgctgccagatggaatcacagtggaggtgattgttgttaaccaagtgaacgccggtcatctgtttgtgcagcagcacactcatcccactttccacgccctgcgcagcctcgaccagcagatgtacctgtgttactcccaacccggaattcccacactcccaaccccagtagaaatcacagtgatttgcgccgcaccaggcgctgacggagcctggtggcgcgcacaggtcgtagcttcctacgaggagacgaatgaggtagagattaggtacgtcgactatggcggatataaacgggtcaaggtggacgtgctgaggcagatccgaagcgattttgtgactctgccattccaaggtgcagaggtcctgctggactctgtgatgcccctttccgatgacgaccaattcagccccgaggccgacgccgctatgagcgaaatgaccggcaatacagctctcttggctcaggtcacaagctattcccctactggtctgccactgatccagctgtggtcagtcgttggcgacgaggttgtgctcattaatagaagtctggtagaacggggactggctcaatgggtggattcctactacacctcattgtag

SEQ ID NO: 212860 - DNA, 2838 bp, Artificial Sequence
  Description of Artificial Sequence: Synthetic coding sequence
atgggggctctaggagtatctggaagctcaagccctggaggctgcccaggctggaggcggctccccgcagctgtaaataccaaccccgttgacttcgcgccaggtgttatcacgcaggcttcccgcatggctatacagttccgctcgctgttccctctcgccctccccggaatgcttgcactgctaggttggtggtggttcttcagtcgcaagaaaggccacgtgtcctcccatgacgagcagcaggtggaggccggagccgtgcaactgcgggctgaccccgctattaaggagcccctcccggtggaggacgtttgccccaaagtcgttagtacccctccctctgtaaccgaacccccagaaaaggagctgagcaccgtgtccaagctgcccgcagagccccctgctctgctgcagacccatcccccttgtaggagaagcgagtcaagcggcatacttcccaacaccactgatatgaggctgcgccctggcacaagacgtgacgactccacgaaactggaattagccctgaccggaggcgaagctaaatcaatccccttggagtgtcccctttccagtccgaagggagtgttgtttagctctaagtcagctgaggtatgcaagcaggatagcccattctcacgagtcccccgtaaggtacaacccggatacccagtcgtgcctgccgaaaaaagatcctccggagaacgtgcacgggagactggtggcgctgagggtacaggggacgctgtgctgggggagaaggtcctggaggaggcacttctgtctcgcgagcacgtcctagaactagagaactcaaaggggccttcccttgcctcactagaaggcgaagaggataaaggaaagagcagcagcagccaggtcgtgggcccagtccaagaggaggagtacgtcgctgaaaaacttccatcaagattcattgaatcagcccatacagaactggccaaagacgatgcggctccggcaccccctgttgcagacgctaaggcgcaggataggggggtcgaaggcgagctcgggaatgaggagtccttggacaggaacgaagaagggctggaccggaacgaggaggggttagaccgaaacgaggagtcgcttgaccggaacgaagagggtctggatagaaacgaagaaatcaaacgagctgcgttccagatcatcagccaggttatatcagaagcaactgagcaggtgctggccacaacagttggtaaggttgcgggaagggtgtgccaggcatctcagctacagggacagaaggaggagtcatgtgtgcctgtacatcagaaaactgtactgggacctgacaccgccgagcccgctaccgccgaagcagctgtcgcccctccagacgctggacttccactccctggcttgcctgcagagggatcgccacctccaaagacttacgtttcttgccttaagagccttctaagctctccaactaaggactcaaagcctaatattagtgctcaccacatcagtctggcatcatgtcttgctcttacgacccccagcgaggaactgcccgacagggcaggaatattagtggaagatgctacatgtgtcacctgtatgtctgactctagccaaagcgttccgctggtcgctagccccggacattgttccgattcctttagcacctcagggctggaagacagttgcacggaaactagtagctctcccagggacaaggctatcacaccacctctgccggaatcgaccgtgcccttttcaaacggggttcttaagggagagctgagcgacctcggcgcagaggatgggtggacaatggacgccgaggccgaccacagtgggggttctgataggaactctatggactcggttgatagctgttgctcgctcaagaagacggaatcctttcaaaacgctcaggcaggcagtaaccccaaaaaggttgatttgattatctgggaaatcgaggttccgaaacatcttgtgggaagactgatcgggaagcaggggagatacgtttcctttttgaaacaaacctccggtgccaagatatacatcagtactctgccatatacccaatcagtgcagatatgccacatcgagggaagccagcaccatgtcgacaaggcgttgaatttaatcggcaagaagttcaaggagctgaacttaactaacatctatgcacctcccctgccatctctggcacttccatctctgccaatgaccagttggctgatgctacccgacggcatcaccgtcgaagtgatagtcgtaaatcaggtaaatgctggacacttgtttgtacagcaacacactcaccctaccttccacgcactgcgctccctcgaccagcaaatgtatctctgttatagccagcctggcatccctacactaccaacccctgtggagattacagtcatttgcgccgcaccaggagctgacggggcttggtggagggcacaggttgtcgcctcgtacgaggaaacaaatgaagtggagatccggtacgtagactacggtgggtacaagcgagtcaaagtcgacgtgcttcggcagatccgcagcgacttcgtcactctaccctttcaaggtgctgaagtcctgctcgactctgtgatgccgctatctgatgatgaccaattctcgcctgaagcggacgcagcaatgagtgagatgacaggcaataccgcacttctcgcccaggtaacgtcgtactcacctaccggcctccccttgatccagctgtggtcagtggtgggagatgaagtggtcctgatcaacaggagccttgtcgagcgcggactggcccaatgggtggactcctactacacctccctctag

SEQ ID NO: 212861 - DNA, 2712 bp, Artificial Sequence
  Description of Artificial Sequence: Synthetic coding sequence
atggccatacagttcagaagcctctttcccttggcactcccaggtatgctggcgcttttgggttggtggtggttcttctccagaaaaaagggacatgtgagtagtcacgacgaacagcaggtcgaggctggggctgtgcagttgcgagcagatccagctatcaaagagccgctccccgtggaagacgtgtgccctaaggtggtttctacgcctccttccgtgaccgagcccccagagaaagaactgtcaactgtatcaaaactccccgctgagccacctgctctgctccaaactcaccctccgtgcagacgtagtgagagcagcgggattttgccaaacacgaccgatatgagattacgaccaggaaccaggcgggatgactctacaaaactggaactggcactcaccggcggtgaggccaaatctattcctctggaatgtcctctgtcctcacctaagggggtcttgttttcctctaaaagcgccgaggtttgtaagcaggattcaccttttagccgggtgcctaggaaagtgcagccaggataccccgtggtccccgctgagaaacggtcaagtggcgagagagccagagagaccggaggagccgagggcacaggggacgccgtccttggtgagaaagtgctagaggaagcactgcttagccgcgagcatgtattggaacttgagaattccaaaggaccttctctggcttccctggaaggggaagaagataagggcaagagcagctccagccaagtcgttggtcccgtgcaggaggaggaatatgtggccgagaaattgcccagccggttcattgagagcgcccataccgagctcgcaaaggacgatgcagcacctgctcccccagttgctgacgctaaggctcaggacagaggagtagagggggagctcggaaacgaggaatctttggacaggaacgaagagggcctagatagaaatgaggagggactcgaccgcaatgaagagagcctggatcgcaacgaggagggacttgacagaaatgaggagatcaagcgcgctgcattccagattattagccaggtaatctctgaggcaactgagcaggtcctggctaccactgtgggcaaagttgccggtcgcgtgtgtcaggcctcgcagctacagggacagaaagaggaatcctgtgtgccagtacaccagaagacagtgttaggcccagacaccgcggagcccgcaacggctgaagccgcagtcgccccaccagatgcaggactgcctctgcctgggctgcccgcagagggctctcctcctcctaagacctatgtgagttgtctgaagagcctactgtccagcccaactaaggatagcaagcccaatatctccgcccaccatatctccttagcctcttgtctggccttaacaacccccagcgaagaacttcctgatcgggcaggcatccttgtcgaggatgctacttgtgttacctgcatgagtgactcttcccagagcgtccccttggtagcgagtccaggtcactgctctgactcctttagcacctcaggcctggaggattcctgtactgaaacgtcatcctcacccagggacaaagctatcaccccaccattgcccgaatcaaccgtgccgttttccaacggtgtgttgaaaggggagctatctgatttgggcgctgaggacggatggaccatggatgccgaagcggaccactccggaggctcggatcgcaacagcatggactctgtggattcgtgttgttctctgaaaaagaccgagtcgttccaaaatgcccaggccggatctaaccccaagaaggtcgacctgataatctgggaaattgaggtgcctaagcaccttgtcggaaggctcattggcaagcaaggaaggtatgtgtcctttctgaaacagacctctggggcaaaaatctacatcagtaccttgccctacacacagagcgttcagatctgtcacatcgaggggagccagcatcatgtggacaaggcactgaatctgatcggaaaaaagttcaaggaattgaatttaactaatatctatgccccacctctgccctccctcgcactgccgagtcttcctatgacatcctggctgatgctgcccgacggaatcaccgtggaagtaattgtggtaaaccaagtcaatgccggacacttgtttgtgcaacagcatacccatcctacttttcatgctttacgaagccttgatcaacagatgtacctctgctattctcagccaggtatccctactctgccaactccagtcgagattactgtcatctgtgccgctcccggagccgacggtgcctggtggcgagcacaggtggttgcttcgtacgaggaaaccaatgaggtggaaattaggtacgttgattacggagggtacaaaagggtgaaggtcgacgtattacgtcaaatacgttccgactttgtcactctgcccttccagggcgctgaagtgctgctcgactcggtgatgcccctgtccgacgatgatcagttctctcccgaagcagatgccgcaatgtctgagatgactgggaacaccgcgttgctggcacaggtgacaagttacagccctaccgggctgccacttatccagctatggagcgtcgtcggcgacgaagtagttctaattaacagatctctagtggaacgcggactggcccagtgggtggattcatattacacatccctctag

SEQ ID NO: 212862 - DNA, 1095 bp, Artificial Sequence
  Description of Artificial Sequence: Synthetic coding sequence
atgggcatactggagaaaatctcagaaatcgagaaagaaatcgccagaacacagaagaacaaggcgaccgaataccatctcggtttgctgaaagcgaaattagccaaatacagggcacagctgctcgagcctagcaaatctgcaagtagcaagggcgaagggttcgacgtgatgaagtctggcgacgctagagtcgccttaatcgggtttccgagtgtgggcaagtctaccttcctgtcgctcatgaccagtacggcctcagaggctgccagctacgagttcaccacgctgacgtgcatccctggcgtgatcgaatacaaaggtgcgaacatacagttactggacctgccagggatcattgagggagcggctcagggcaaaggcagagggagacaagtcatcgcagtggcaaggacagcagatgtaatcataatgatgctggacgccactaagggagaggtccaacgaagtctccttgagaaggagctggagtccgttggaatccggctcaacaagcataagccgaacatttacttcaaaccaaagaaagggggtggaattagctttaactccaccgtgacattaacccaatgcagtgaaaaactggtgcagctgatactacacgaatacaagattttcaatgccgaggtgttgtttcgggaagactgttctccagacgagttcatcgatgtaatagttggaaatcgcgtttatatgccctgcctgtacgtttacaataaaattgatcagatatctatggaagaggtcgatagactcgccaggaaaccgaattccgtcgttatctcctgcgggatgaagcttaacctggattatctcttagagatgttgtgggagtatcttgccctgacctgcatctataccaaaaagagggggcaacgccctgacttcactgatgccatcattctgcgtaagggcgcaagcgtcgagcatgtttgccatcggatccacaggagcctggccagtcaattcaagtatgcattggtctgggggactagtacaaagtactcgcctcaacgcgttggcctgacgcataccatggaacacgaagatgtaattcaaatagttaaaaagtag

SEQ ID NO: 212863 - DNA, 1815 bp, Artificial Sequence
  Description of Artificial Sequence: Synthetic coding sequence
atgcgaggtgccggtccctcccccaggcaatcccctcgaaccttgagaccagacccaggtcccgctatgtccttcttcagaagaaaggtgaagggcaaagagcaggaaaagacatccgacgtgaaatcaattaaggcgagtatcagtgtacatagtccacagaagtctactaaaaatcatgcgctgcttgaagccgctggtccttcacatgtagcgattaacgccattagcgctaacatggactccttctcctcttcacgaaccgctacactaaagaaacagccaagccatatggaggctgctcacttcggagacctcgggagatcttgtctcgactatcagacccaggagaccaagagttccctgagcaaaacattggagcaggtcttgcacgacacgatcgtgctgccttattttatccagttcatggagcttaggcggatggaacatctggtgaaattctggctcgaagcagaatctttccattcaactacatggtcacgtatccgcgcacactccctcaatactgtaaaacaatctagtttagctgagcccgtgagccctagcaaaaagcacgagacaacagctagtttcctcacagatagcctggacaaacggttagaggacagcggatctgcccagctgttcatgacccactcagagggcatcgacctaaataatcggacaaatagcactcagaatcacctgctgctgtctcaggagtgcgattctgctcacagtttgagacttgaaatggcaagggcaggcactcaccaggtgtctatggagacacaggagagcagtagcacgctcaccgtagcctcgaggaatagccctgccagccctttgaaggagctgagcggcaagctgatgaagagcatcgaacaggacgctgttaacacattcaccaaatatatttccccagatgcagccaaacctattcctatcaccgaggcaatgcgaaacgacatcatagcacggatctgtggtgaagacggacaggtggatcctaactgtttcgtactggcccaatccatagttttcagtgccatggaacaagaacactttagcgaatttctgagatcacaccacttttgcaaataccagattgaagttcttacttccgggaccgtgtaccttgccgatatactgttctgtgaaagtgccctgttttatttcagcgaatatatggaaaaggaggacgcagttaatatccttcaattttggctggccgctgataattttcagtcacagctcgctgctaaaaaagggcaatacgacgggcaggaggcacaaaacgatgctatgatactgtacgataagtactttagcctgcaggctactcaccccctgggttttgacgacgtggtgaggctcgagatagagagcaatatatgtagggaagggggtcctctccctaactgcttcactacccccctgaggcaggcttggacaaccatggaaaaatcatctgtcaaaaaagcatcgataaaaatactgaagaacttcgatgaagccatcattgtggacgccgcatcacttgacccggaatcactgtaccagcggacctacgccggaaaaatgacgttcggcagggtgtcggatctgggccagttcattagagaaagcgaacccgaacccgacgtgaggaagtccaagggttccatgttctcccaagccatgaagaaatgggtgcaaggaaatacagacgaggcccaagaagagttggcctggaagattgctaaaatgatcgttagcgatattatgcaacaagcacagtacgatcagccattagagaaatctaccaaggtctag

SEQ ID NO: 212864 - DNA, 8453 bp, Artificial Sequence
  Description of Artificial Sequence: Synthetic coding sequence
atgaagctgaatccccagcaagcaccactgtatggcgattgtgtcgtgacagtgctgctcgcggaagaggacaaggctgaggacgacgtggtgttctacctggtgttcctaggatcaacactgagacattgcacttcaacgcgtaaagtgtccagtgacacgttggagaccatcgctccaggccacgattgctgtgaaaccgtgaaggttcagctgtgtgcctccaaggagggactcccggtgtttgtcgttgctgaggaggatttccatttcgtgcaggatgaggcatatgacgcagcccagttcctggccacgtccgccggtaaccagcaagccctaaactttactaggttcctggaccagagtgggccaccgtctggtgacgttaactctctcgataagaaacttgtcctggcgttcagacacctgaagctgccaaccgaatggaacgtccttggtaccgatcagagcctccatgacgccggtccgagggagactctaatgcacttcgcagttaggcttgggttacttcggttgacctggttcctgctgcagaagcctggaggccgaggggctcttagtatccataaccaggagggtgcaacacctgtgtcactggcactcgagcgagggtaccataagctccatcagctccttaccgaggaaaatgcaggagaacccgacagctggtcctcactgtcatacgagatcccctatggggactgctcagtcagacatcatcgagagttagacatctatacattgacttccgagagtgactcccaccacgaacacccattcccaggggatggctgcaccggcccaatttttaaactgatgaatatccagcaacagcttatgaaaaccaatcttaagcagatggactcgctgatgcctttgatgatgacggcccaggacccatcatccgcgccagagacagacggacagttccttccctgcgctcctgagcctacagaccctcagcgtttgtcgagcagcgaggagaccgaatctactcagtgctgcccaggatcccccgttgctcaaacagagagcccatgtgatcttagcagtattgtggaagaggaaaatacggacaggtcttgcagaaagaaaaataagggggtagagcgaaagggtgaggaagttgaaccagccccaattgtggactctggcacagttagtgatcaggacagctgcctccagtctctgcccgattgtggagtcaaggggaccgagggactgagcagctgcggcaatcgaaacgaggagaccggcaccaagtcttcaggcatgcctacggaccaagaatcattgtcctctggtgatgccgtcttacagcgcgacctagtgatggaacctggcactgcccagtacagcagcggtggagagttaggaggaatctctaccacaaatgtgtccacaccagatactgcaggtgagatggaacacgggttgatgaatccagacgccacagtgtggaagaacgttctacaggggggtgagagcaccaaagaacggttcgagaactccaacatcggtacagcgggagccagtgacgtgcacgtgacctccaagcctgttgataaaatcagtgtgcccaattgtgctccggctgctagctctctggatggaaataaacctgccgaatcaagcctggcttttagcaacgaggaaacgtccaccgagaaaaccgcagagacggagacaagtcgttctagagaagagagtgccgatgcacccgtggaccagaatagcgtcgtgatacctgcagcagctaaggacaaaatatctgacggccttgagccctacactctacttgctgcgggaatcggcgaggcgatgtcgcctagtgacctggctctgcttgggcttgaggaggacgtcatgccacaccagaattcagagacgaacagcagtcatgcacagagtcaaaaagggaaatcttcacctatctgtagcaccaccggcgacgacaagctctgcgccgattccgcttgtcagcagaatactgtaacaagttccggagatctggtcgccaagttatgcgacaacatcgtctcagagagcgaaagcacaactgccagacagccttcgtctcaggatcctcctgatgcttcacactgcgaggatccgcaggcacacactgtaaccagcgatccagttcgggatacccaagaacgcgctgacttttgccctttcaaggttgtagacaataaggggcaaaggaaggacgtgaaactggataaacctctgacaaatatgctcgaagtggtgtcccacccccatcccgtcgtgcccaaaatggaaaaggagctggttcccgaccaagcagtgatttcagatagtacattttcgctggcgaattcgcctggatcagagtctgttaccaaggacgatgccctgtccttcgtgccatctcagaaggaaaaagggactgccacccccgagctccatactgccacggattacagggacggtcccgacggtaatagcaacgagcctgataccaggccactagaggaccgcgctgtgggccttagcacatcctccaccgccgcagaactccagcatggcatgggaaacactagtcttacaggcctgggcggagagcatgaaggtcccgctcctccggcaataccagaggctcttaacattaagggaaacactgactcatcgctgcagagtgtaggaaaagctactcttgccctggactccgtgctcactgaggagggcaagctgttagtggtgagcgaaagcagcgctgcccaagagcaggataaagataaggcggtgacctgttccagtataaaggaaaacgccctgagttccggaaccttgcaggaagagcaaagaactccaccacctggacaggatacccagcaattccatgagaaaagcatttcagcagattgtgccaaggacaaggccctccagctgagcaacagccctggagcctcatccgctttcctgaaagccgagaccgagcacaataaagaggtcgctccacaggtctccttattgacacagggaggtgccgctcagagtctcgtccccccaggcgctagcttggcaacggaatctcggcaggaagcactcggtgccgaacacaatagtagcgcactcctgccttgcctgctgccagacggcagcgacgggtccgatgctctcaattgttcacagccttctccattagatgtgggcgtgaaaaacacacaaagtcaagggaaaacctccgcatgcgaggtttccggtgacgtcacagtcgacgttaccggagtgaatgcattgcagggaatggcagaacccaggagggaaaatatttcccacaacactcaggacattctgatcccaaacgtgctcctgtcacaggagaagaacgccgtgctggggctgccagttgctctgcaggacaaggctgtgacagacccccaaggcgttggcacacccgagatgatccctttggattgggaaaagggcaaattagaaggggcagatcactcctgtacaatgggcgacgcagaggaggcacagatcgacgacgaggcccaccccgtcctgcttcagcccgtggccaaggagctgccaacagatatggaactgtctgctcatgacgacggcgctcccgctggtgtgcgcgaggtgatgagggccccaccgtctgggagggagcgcagcactccgtctctgccgtgcatggtgagtgctcaggacgcacccctaccaaagggtgccgacctaatcgaagaagccgcttcgcggatcgtggacgcggtgattgagcaagtcaaggcggcaggggctttgttgacagaaggagaagcttgtcacatgtcactatcctcccccgagctcggacctttgacaaagggtctggagtctgcctttactgagaaagtgtcaacttttcctcctggcgaatccctgcctatgggctccaccccggaagaggccacaggatctctggctggttgtttcgccggaagagaggagccagaaaaaatcatccttcccgtccagggacctgaacctgctgccgagatgcctgacgtgaaggcggaggacgaggtcgactttcgggcatcatctatttcggaggaagtcgcagttgggagtatagctgcaaccctgaagatgaagcagggcccaatgactcaggctatcaatagagagaattggtgcaccatcgaaccatgtcctgatgcagcctcccttctagcttccaagcagagcccagaatgcgaaaatttcctggacgttggacttggcagggagtgcacatcaaagcagggagtgctgaaacgggaatctggttctgattcggatctattccactcccccagcgacgatatggattctatcatcttccccaaacccgaagaggagcatttggcctgtgacatcaccgggagctcctcctccactgatgacacagcttcactagataggcacagttctcacgggtcagacgtgagcctttcacaaatactaaagccaaatcggtccagggatagacagagcctggacgggttctacagccacgggatgggagccgaaggacgggaaagcgaaagcgaacccgctgatcctggagatgttgaggaggaggagatggatagcatcacggaggtgccagcaaactgcagcgtgctaaggtcttccatgagatccctgtctccatttagacgtcacagttggggccctggaaaaaatgccgcttcggatgccgagatgaaccacagatcaatgtcctggtgccctagtggcgtgcagtacagcgcagggctttcagcagattttaactataggtctttcagtctcgaaggtttgaccggaggcgctggtgttggtaataaaccatccagctctctcgaagttagtagcgcaaacgccgaagagctgcggcatcctttctccggcgaggagagagtcgactccctggtgagcctttctgaagaagatttggagtccgaccaacgagaacatcgaatgttcgatcagcaaatatgccacagaagcaaacagcagggattcaattactgcacctctgctatctccagccccctgacgaagtcaatttcgcttatgacaatctcccatcccggactcgataacagcagaccctttcactcgacgtttcacaatacctccgcgaacctcaccgagtccatcaccgaggagaattataattttctgccacactctccatctaaaaaggatagtgagtggaagtccggaaccaaagtatcccgaacctttagttacattaagaacaaaatgtcctctagtaagaaatcgaaagaaaaagagaaagagaaagacaagattaaggagaaggagaaggactccaaggacaaagaaaaggacaagaagactgttaacggacacaccttcagctcaatcccagtagttggcccaatttcctgctctcagtgtatgaagccattcacaaataaggacgcatatacatgcgccaactgttcagcctttgtgcacaaggggtgcagggagagtctggcctcatgtgctaaggtgaaaatgaagcagcctaagggatcgctccaggcccatgacaccagtagccttcccaccgtgattatgaggaacaaaccctcacagccgaaagagaggcctcggagtgccgtgttgctcgttgacgaaactgccacaacacccatctttgccaatcggaggagccagcagtctgtctctctttccaagagcgtgagtattcagaacatcactggagtagggaacgacgaaaatatgagtaatacctggaaatttctgtctcactccacagattctctgaataagatctcaaaagtaaacgagtctacagaaagtctgaccgacgaaggcgtcggaactgatatgaacgaaggacagctcctgggcgactttgaaatcgagtccaaacaactggaagcagaatcttggtccagaatcatcgatagtaagttcctgaaacaacagaaaaaagacgtggtgaaaagacaagaagttatctatgagctgatgcaaactgagtttcaccatgtacgcacgctgaagatcatgtccggagtctactctcaggggatgatggctgatttattgttcgagcagcaaatggtcgaaaagctgttcccatgccttgatgaacttatctctatacacagtcagtttttccagagaatcctggaaaggaaaaaagagtcattagtggacaagagtgaaaaaaatttcttgattaagcgcattggggacgtgctcgtgaatcagttttctggtgagaatgccgagaggcttaagaagacctatgggaagttctgtggccagcacaatcagagtgtgaactattttaaggatctctacgccaaagacaagcgcttccaggcctttgttaaaaagaagatgtcgagctccgtcgtgcgccgacttggcatacctgagtgcatcctccttgtgacacagagaattaccaaatacccagttctctttcagagaattcttcagtgcacaaaggacaatgaggttgagcaagaggacctggctcagtcactttcactggtgaaggacgtgatcggagcggtcgattctaaggtggcgagctatgagaagaaggtgagactcaacgagatctatacaaagactgattccaaatcgattatgaggatgaaatcagggcaaatgttcgcaaaggaagatctgaagagaaagaaactggtgagggatggctccgttttcctcaagaatgccgcaggacgcctgaaagaggtgcaggctgtgttactgacagatattctggtgttcctgcaggagaaggaccagaaatacatattcgcctcactggatcagaagtccacggtaatttccctgaagaaacttatcgtccgcgaggtagcccacgaggagaaaggcctgtttttaataagcatgggaatgaccgatccagaaatggtcgaagtacacgcatctagtaaggaggagcgcaacagctggatccagatcatccaggacacaatcaacacactgaaccgcgacgaggatgagggaataccttccgagaacgaggaggaaaagaagatgctggatacgcgcgctcgagaattgaaagagcagctgcatcagaaagaccagaaaattctgctccttctggaggagaaagagatgatatttagagatatggccgagtgcagcactcccttgccagaagattgctcgcctacgcattctccccgagtactttttcgatctaacaccgaggaggctctgaagggaggccctctcatgaagagtgcaattaatgaggtggagattctgcagggtctggtgtctgggaaccttggcggaacgctcggacccaccgtgtcaagccctatagaacaggatgtggttggcccagtgagcctcccacgtagggccgagaccttcggcggattcgacagtcatcaaatgaacgcttcaaagggaggagagaaggaggagggggacgacggccaggacttacggcgaacagaaagcgattctgggttgaaaaaaggcggtaacgcaaacctcgtctttatgctgaagcggaatagcgagcaggttgttcagagtgttgtacacctgtacgagctgctgtcagctctccagggagtcgtgctacaacaggactcatatattgaagaccagaaactggtcttgagcgagcgggctttgacacgctccctgagtagaccctcctcccttattgagcaggagaagcagaggtctctcgagaagcaaagacaggacctggccaatctccagaaacagcaagcccagtacctcgaagagaagcggcgtcgcgaaagagaatgggaagcgcgagagagagagctgcgtgagcgcgaggccctgttggctcagagagaagaggaagtgcagcaaggccagcaggacctggagaaggaacgggaagagctccagcaaaaaaaaggaacataccaatatgacttggaacggctcagggccgcacagaaacagctcgagcgcgagcaggagcagcttaggcgagaagccgagcggttaagtcagcgacaaaccgagcgagatctgtgccaggtgtcacatccccacacaaagctcatgcgaatccccagttttttcccaagccccgaggaaccgcctagcccctcagcaccctcaattgccaagtcaggttccctcgacagtgaattatctgtgtctcctaagagaaacagcatatccagaactcataaggacaaaggccctttccacatactgagttctactagccaaaccaacaaaggcccagagggtcaatcccaggccccagcctctacatctgcctccactagactatttggactgactaagccaaaagagaagaaggagaagaaaaagaaaaacaaaactagtcggtcccagccaggcgatggtcccgcttctgaggtttctgctgaaggtgaggaaattttttgcta

SEQ ID NO: 212865 - DNA, 3177 bp, Artificial Sequence
  Description of Artificial Sequence: Synthetic coding sequence
atgagctcaagcaagaaatccaaagagaaggaaaaggagaaggataagattaaagaaaaggagaaggactcaaaagacaaggaaaaggataagaaaactgtgaacgggcataccttctccagcatccccgtggtgggacctatttcttgctcgcagtgtatgaagccttttacgaataaagacgcgtacacttgtgctaactgttctgcctttgtgcacaagggatgtagggagtccctcgcctcgtgcgccaaagtgaaaatgaagcagcccaagggaagtttgcaagcccacgatacttcctcccttcccaccgtcataatgagaaataagccctcacagccaaaagagcgcccaaggagcgctgttcttctcgtggacgaaactgctacaacgcccatctttgcaaacagacgatcacaacagagtgtctctttgtctaagagcgtatctattcagaatataacaggcgtgggcaacgatgagaatatgtccaatacctggaaatttctgtctcactcaactgattctctgaataaaatatccaaagtcaacgaatccaccgagtcactgaccgatgagggggtaggaacagatatgaacgaggggcagctcctgggcgatttcgagatcgaaagcaagcagctggaggcggaaagttggtccaggataattgacagcaaatttctgaagcagcagaagaaggatgtcgtgaagagacaggaggtcatctacgagttgatgcaaactgagttccaccatgtgcggaccttgaagatcatgtctggagtttacagccaggggatgatggctgacttattgttcgagcagcagatggtggaaaagctctttccatgcctcgacgagctcatttctatacactcccagttttttcaacgtattttggagaggaaaaaggagtccctggtggataagtctgagaagaacttcctcattaaacgcataggggacgtgctcgtgaatcagttctcaggtgaaaatgcggagcgcctgaagaagacatacggaaagttttgtggccaacacaaccagagcgtgaattatttcaaagacctctatgcaaaggacaagcggttccaagccttcgtgaaaaaaaaaatgagctcttctgttgtgcgtcggttggggatcccagagtgcattctgcttgtgacacagaggattacgaagtatcccgtgctgttccagcgaatcctgcagtgcactaaggacaatgaagtcgaacaggaggacttggcccagtctttgtctttggtgaaagacgtgataggcgcagtagattctaaagttgcatcctacgaaaaaaaagtccgccttaatgagatctacaccaaaacagactcaaagagcataatgcgcatgaagtcgggccagatgtttgccaaagaggatctgaagaggaagaaactggtcagagacggtagcgtatttctcaagaatgccgcaggcagattaaaagaagtccaggctgtgctactgaccgatatactggtgttcttacaggagaaagatcaaaagtatatattcgccagccttgaccagaagtccacagtcatttcactgaagaagctcatcgtgagggaggtcgctcatgaagagaaaggactgtttctcatatccatggggatgacagacccagaaatggtcgaagttcatgccagctctaaggaggaaagaaattcttggatccagatcatccaggacacaattaacacgttgaaccgcgatgaagatgaaggtattccttccgagaatgaggaggaaaaaaaaatgttggacactagggccagggaactgaaagagcaactccatcagaaggatcagaagatactgcttctgctggaggaaaaggaaatgatctttagggatatggcagaatgttcaactcctctcccagaggattgctccccaacgcatagtcctagagtgctgttcaggagtaacacagaagaggcactgaaaggcggacctctgatgaaatcagccataaacgaagtggagattctgcaagggctggtgagtggtaatctgggcggtacgttgggccctaccgtttctagtccgatcgagcaggatgtggtcggccctgtatcgctcccaagaagagcagagacattcgggggtttcgatagccaccagatgaatgctagcaagggcggagagaaggaagaaggagatgatggacaggacttgaggcggactgagagtgactcggggctcaagaagggcggtaacgctaatttagtcttcatgcttaaaagaaattccgagcaggtggtacaatccgtggtacatttatacgaacttctgagtgcacttcaaggggtcgtgctccagcaggacagctacatcgaagaccaaaagctcgtgctcagtgagagagcgctgaccaggtcactctccagaccaagcagcttgatcgagcaggagaagcagcggagtcttgaaaaacagaggcaagatctggccaatctgcagaaacagcaggcccaatacctggaggaaaaacggcgaagggagcgggagtgggaagccagagagcgagaactgcgtgaacgggaggctctgctggcccagagggaggaagaggtgcagcagggacagcaggatttggagaaggaacgagaggaactccagcaaaaaaaaggcacttaccagtacgacctggaaaggctgagggctgcacagaaacaacttgagcgggagcaggagcagttgcgacgagaagccgagcgcctctctcaaagacagacagagagagacctctgccaggtgtcccacccccacaccaagctgatgaggatcccctcctttttccccagtccagaggaaccgccatcaccttccgctccatccatcgccaagtctggtagtttggatagcgaactgagcgtgtccccgaaacgcaatagcatttcaaggacccataaagataagggcccattccatatcttgtcttctacttcccagaccaacaagggacccgaaggccagagccaggctcctgccagcacatcagcgtctacccgcctgtttggtctgactaagccaaaggaaaagaaagagaaaaaaaagaaaaataagacatctcgaagtcaaccaggagacggaccggcaagtgaggtgtcagcagagggagaagaaatcttctgttag

SEQ ID NO: 212866 - DNA, 8450 bp, Artificial Sequence
  Description of Artificial Sequence: Synthetic coding sequence
aaactgcttgaaaagcagcccccaatcgagggcgattgcgtagtgacagtacttctcgctgaggaggacaaagctgaagatgacgtcgtgttctatttggtgtttctcgggagcactctccgccattgtacctccacacggaaggtttccagcgataccctcgaaacaatcgctccaggccacgactgctgtgaaactgtcaaggtccaattgtgtgcctcaaaagagggcctccctgtgtttgttgtcgcagaagaggatttccattttgtccaggacgaggcgtatgacgccgctcagtttctagcaacttccgcagggaaccaacaggcacttaactttacacggtttctagaccagtctgggccaccttcgggagatgtaaactcattggataagaagttggtcctggccttccgccatcttaaactccccactgagtggaacgtgttgggtaccgaccaatccttgcacgacgccggtccaagggaaactctgatgcatttcgctgtaaggctgggactcctcaggcttacctggttcctgctgcagaagccaggtggcagaggtgcactatccatacataaccaagaaggggcaacgcctgttagccttgcgctggaacgcggataccacaaattgcaccagctgctcactgaagaaaacgcgggagagcctgactcttggtccagtctgagctacgagatcccatacggcgattgttctgtgcggcatcaccgcgagttggatatttacacgctcacatcagaatccgattcccaccacgagcacccattccccggtgacggctgtaccggccctattttcaagctgatgaatattcaacagcagcttatgaagacaaacttaaaacagatggattctctcatgcccctaatgatgaccgctcaggacccctctagcgcccctgagaccgacggccaatttctgccatgtgcccctgagcctaccgacccacagaggcttagctcttccgaggagacagagtctacacagtgttgcccaggatctcctgtggcacagacagagagtccctgcgacttgagcagcattgtggaggaggagaacaccgatcggtcatgtaggaaaaagaataagggtgtcgagcggaaaggcgaggaggtagaaccagcgccaattgtggattctgggaccgtgtccgaccaggatagctgcctgcaaagtctgccagattgtggagtcaagggcactgaaggcctttcctcctgcgggaacaggaacgaagaaacgggtacaaagtccagcggaatgcctacagatcaggaatcccttagcagcggggatgcagtcctgcagcgtgacctggtgatggagcccggaaccgcacaatattccagcgggggagagctgggaggaatttcaaccaccaacgtcagcactcctgatacggccggtgagatggagcatgggttaatgaacccagacgctactgtttggaagaacgtgttacaggggggtgaatctacgaaggagcgcttcgagaattctaacatcggaactgccggagcgagtgatgtgcacgtcacctcaaagccagttgataaaatctctgtgcccaactgtgcaccggctgcttcaagcctcgacggcaacaaaccagcggaatcctccctcgcgttcagcaacgaggagacgtctactgagaaaactgctgagaccgagacgtctcgctcaagagaggagtcagctgatgcccctgttgaccagaactcagtggttatacccgcagctgctaaagataaaatttcagatgggctcgaaccttataccttactggccgcaggcattggggaagccatgagtccctcggatctggccctgctaggcctggaggaagatgtaatgcctcaccaaaattccgagacgaacagctctcacgctcagtctcaaaagggcaaatcctcacccatctgttccacaactggcgatgacaagttgtgcgccgactccgcgtgccagcagaacactgtcactagcagcggagatctggtggccaaactctgcgataatatcgtctcggaaagcgagtccacaacagccagacagccgtcatcacaggatccccctgacgcttctcactgcgaggatcctcaggcacataccgtaacaagtgaccccgttcgcgatacccaggagagggccgatttctgtcccttcaaggttgtggacaacaagggtcagagaaaggacgttaaactggataaaccattgaccaatatgcttgaggtcgtatctcatccacatcctgtggttccgaaaatggagaaagagctcgtgccagaccaggcagtaatatccgatagcacgttttccctagcgaattccccaggcagcgaaagtgtgacaaaagatgatgcactgtcttttgtgcccagccaaaaagaaaaaggaaccgcaacccctgagctgcatactgccaccgattatcgggacggacccgacgggaactctaatgaacccgataccaggcccctggaggacagagccgtgggcttaagtaccagttccaccgccgcagaactgcagcacggaatgggaaacacttccctgaccggactgggcggtgagcatgaaggaccagcacctcctgccattccagaggcgctaaacattaagggtaataccgactcaagcttacagtcagtgggcaaagccactctcgctctcgactctgtgctcacagaagagggcaaactgctggtcgtcagcgagtcctctgcagcccaggaacaggataaagataaagccgttacttgttcatcaatcaaagagaacgccctatccagcggaaccttacaggaggaacagcggaccccaccccctggtcaggatactcagcagttccatgagaaatccatttcagccgattgtgctaaggataaggctctccagctgagcaatagtccaggcgcaagttctgcattcctgaaggcagagactgaacacaacaaagaagtggcccctcaagtgagcctgcttacccagggcggagcagcccagtccttggtgcctcctggcgctagcctcgctactgagagccgacaggaagctctgggagcggagcataactcctctgctctgctaccctgcctgcttcctgatggttctgatggaagcgacgcccttaactgctcccagccttcccccctggacgtgggcgttaagaacactcagtcccagggcaaaacaagtgcttgcgaggtgtccggggatgtcactgtggatgtgaccggcgttaacgcacttcaggggatggccgagcccagacgggagaacatttctcataatacccaggatattttaatacccaatgttctactgagccaggagaagaatgcagtgctggggctgcctgttgcattgcaggacaaagcagttaccgatcctcagggggtgggtacccccgagatgattccactcgactgggaaaagggaaaacttgagggcgctgatcactcttgtaccatgggcgatgcagaggaggcccaaattgacgatgaggcacacccagttttgctccagcctgtggctaaagagctccccaccgacatggagctcagcgcccacgatgacggagcccctgctggcgtgcgagaggttatgagggcccctccatccggaagagaaaggagcaccccttccctcccgtgtatggtctcagcccaggatgctccgctgccaaaaggggcagatctcatcgaagaagctgcctctcgcatcgtggacgcagtcatagagcaagttaaggctgccggtgcactgctcacggagggggaagcgtgtcacatgtctctatctagcccagaactgggcccattgacaaaagggctggagtccgccttcaccgaaaaggtgtcaacttttccacccggagagtctctccccatgggctccacccctgaggaagcgaccggctcactggccggttgttttgccggtcgcgaagaaccagagaagatcatcctgccggtccagggacccgaacccgctgctgagatgcctgacgtgaaggccgaggatgaagtggacttcagggccagcagtattagcgaggaggtggctgtgggatccatagcagccaccctcaagatgaaacaggggccaatgacacaggctataaacagggaaaattggtgcaccatagagccatgccccgacgctgcttctttactggcttctaagcagagccccgagtgtgaaaatttcctggacgttggcctgggccgagagtgcacgtcaaaacagggggtacttaagagagaatctggttctgactccgatctgttccactcgccatccgatgatatggattccataattttccctaagccggaagaggagcacctggcctgtgatatcacaggcagctcttcgtccacggatgacaccgccagcctggataggcacagttcgcacgggtctgatgtttcactgtcccagatcttgaaaccaaatcggagtcgggataggcagtctctagatggtttctattcccatggcatgggcgcagagggtcgggagtctgaaagtgagcctgcagacccgggtgatgtggaagaagaagagatggacagcatcacagaggtgccggcaaattgctcagttctgaggtccagtatgcggtcattgtcccctttcaggcgacactcatggggccctggcaagaatgcggcttctgatgcggaaatgaatcaccgaagcatgtcatggtgtccatctggggtgcagtactccgccggactttccgccgactttaattatcggtctttcagccttgagggcctgacagggggagccggagtcggtaacaagcctagctccagccttgaagtttcgagtgccaacgcagaggaactgcgccacccgttctccggagaggagagggtagattcactggttagtcttagcgaagaagatttagagtcggaccagagagagcacaggatgttcgatcagcagatttgccatagatccaaacagcagggatttaattactgtacgagtgctatctcttccccgctcacaaagagtatatccctgatgaccattagtcacccagggttagataactctaggccttttcatagtacattccacaatacatccgctaatctaactgagtctatcactgaagagaactataattttttgccccactctccttccaagaaagattctgaatggaaaagtggaaccaaggtatcaagaactttcagctatatcaagaacaagatgagctcctcgaaaaagtccaaggaaaaggaaaaagagaaagataaaataaaggaaaaagaaaaggattccaaggacaaggagaaggacaagaagacggttaatggccacacattctccagcatcccagtggtcggtcctatcagttgtagtcagtgtatgaagcctttcaccaataaagacgcttatacatgcgctaactgttccgcctttgttcacaagggctgtagagagagcctcgcatcctgcgcaaaagtcaagatgaagcagcccaaggggtctctgcaggcccatgacacgtcctctctgcctacggttattatgcgaaataaaccatctcagccaaaagagcggccaaggtccgccgttctgcttgtggatgaaacagccaccacgccaattttcgctaataggcgctcccagcagtcagttagcctaagcaagtcggtgagcattcagaacataaccggagttggtaacgacgaaaatatgtcgaacacctggaagttcctttcacacagtactgacagcctgaataagattagcaaggtaaacgagtctacggagtccctgactgacgaaggcgttgggaccgatatgaacgagggacagcttttgggggacttcgaaattgaaagcaagcagttggaagcagaatcatggtctcggattatcgactccaaattccttaagcaacagaagaaggacgttgttaagcgccaggaagtcatatatgaactgatgcagacagaattccatcacgtgaggactctgaagatcatgagtggagtgtattctcagggtatgatggcagacctgctgtttgagcagcagatggttgagaagctctttccttgcttggacgaactaatatccatccactcacagttctttcagcgcatcctggaacgcaagaaggaaagcttagtggacaagagtgagaaaaactttcttataaaacgaatcggggacgtgttagtgaaccagttctctggggaaaatgctgagcgcctgaaaaagacatacgggaagttttgcggccagcataatcagtccgtgaactattttaaagatctttatgctaaagacaaacggttccaagcttttgtgaagaaaaaaatgagttcttcggtggtccgaagattggggatacccgagtgcatcttgctggtaactcagcggatcacaaaatatccagtccttttccagagaatcctacagtgtacaaaggacaacgaagtggagcaggaggacctcgctcagagtctcagcctcgtgaaagacgtgattggggcagttgattccaaggttgccagctatgagaagaaagtccggctgaatgagatctacaccaaaacggacagcaagagcattatgaggatgaagtctggccagatgttcgcgaaggaggatctcaaaaggaaaaagttggtacgtgatgggagcgtcttcttaaaaaatgccgctggcagactgaaggaggtgcaggctgtgctgctgaccgacatactcgtgtttctccaagagaaggatcagaagtatatatttgcttccctcgaccaaaaatcgaccgtcatcagcctgaagaaactaattgtgcgagaagtcgcacacgaagagaagggtctcttcctcatcagtatgggtatgactgaccccgagatggttgaagttcacgccagctcaaaggaagaaaggaactcgtggatccagatcatccaggatacaatcaacacactgaaccgtgacgaagacgaaggtattccttccgaaaatgaggaggagaagaaaatgctggacactagagcacgtgaactgaaggaacaacttcatcaaaaggaccagaagatattgcttctgctggaggagaaagaaatgattttcagagacatggccgagtgttctacccctttgcccgaggattgttcacccacacactctccacgcgtgctgttccggtctaacactgaggaagcgctgaaggggggaccacttatgaagtcagccattaatgaggtagaaatcctccagggactggtctccgggaatctaggcggtactcttggccctacggtatcgtcaccaattgagcaggatgtcgttggtccagtgtctctcccacgccgagccgaaaccttcggaggttttgactcgcaccagatgaatgcaagtaaaggtggggagaaagaggagggagatgatgggcaggatctccggcgaacagagtcagattccggattgaagaagggagggaatgccaatctggtgtttatgttaaagcggaatagcgaacaggtggtgcagtctgttgtacacttgtatgaacttctgagcgccctgcagggcgtggtcctgcagcaggattcttacattgaagaccagaaactggttctgtcggaaagagccttgacgagatctttgtctcgcccttcaagcttgatcgagcaggagaagcagcgaagcttggagaagcagcgccaggacctggccaatctacagaagcaacaagcgcagtatctggaggaaaagaggcgcagagaacgtgagtgggaggcgcgagaaagagagttaagagaaagagaagcgcttctggctcagagagaggaggaggttcagcaggggcagcaagacctggagaaggagcgggaagagctgcaacagaagaaaggcacctaccagtacgaccttgagaggctccgagcggctcagaagcagcttgaaagggagcaggagcagcttcgaagagaggccgaacgcctgtcccaaagacaaactgagcgcgacctgtgccaggtgtcccatccccacaccaagttaatgcgcattccgtctttctttccaagccctgaggaacctccatccccctccgcaccttcaattgctaagagtgggtctctggactctgaactgtcagtgtcacctaaaaggaactcgatctcaagaacccataaggacaagggcccattccacattttatcaagcactagccaaaccaataaggggcctgaaggccagtcgcaagcacctgcttccaccagtgcctctaccaggctgtttggcctaacaaaacccaaagagaaaaaagagaaaaagaagaagaataagaccagtaggtcccagcctggagatggacctgcctcagaagtctcagccgagggcgaggagatcttttgtta

SEQ ID NO: 212867 - DNA, 8441 bp, Artificial Sequence
  Description of Artificial Sequence: Synthetic coding sequence
atgaagttgaatccccagcaggcccctctttacggggattgcgtggttaccgtcctactggcagaggaggacaaagccgaagacgacgttgttttttatctggtgtttctgggaagcacgctccgacattgcacttccaccaggaaggtcagcagtgacacactggaaactatagcaccaggacacgattgttgcgagacggtcaaggtccagctgtgcgcctctaaggaggggctgcctgtgtttgttgtggccgaggaagattttcacttcgtgcaggacgaagcttacgatgccgcacagttccttgctacaagcgctggtaatcagcaggccttaaatttcacgaggtttctggaccagagcggcccacctagtggggacgtgaactctctcgataagaagctggtgttagccttccgccaccttaaattgcctaccgagtggaacgtgctgggcactgaccagtccttgcacgacgctggacccagggagaccctaatgcacttcgctgtgaggctggggcttttacgcctgacatggttcctgctccagaagcccggaggtagaggcgcactatcaattcacaatcaggagggggctacgcccgtgtccctcgctttggaacgcggataccacaagctccatcagttgctaacagaagagaatgcaggagagcccgattcttggtccagcctgtcttatgagatcccgtacggtgactgtagcgtcagacaccatcgagagcttgatatctacactctaacctccgagagtgatagccaccacgagcacccattccccggtgacggctgtacaggtcctatatttaaacttatgaacatccaacagcagcttatgaagactaatctgaagcagatggactccctcatgcctctgatgatgaccgcgcaggatccctcctccgcccctgaaactgacgggcagttcctgccttgcgcacccgagcccacagacccgcagaggctttcctcctcagaagaaactgagtcaacgcagtgttgtccaggctcacccgtcgcgcagacagaatctccatgcgacctgtcgagtattgttgaagaggagaatactgaccgctcgtgccggaaaaagaataaaggagtggaaagaaagggggaagaggtcgagccagccccaattgtcgattcgggtactgtctctgaccaggactcatgtctgcagagtcttcctgattgcggagttaaaggcacagaagggctgagtagctgcgggaacaggaatgaggagaccggcaccaagtcttccggtatgcccaccgatcaagagtccctgtcctcgggtgacgccgtattacagagagatctggtgatggagccagggacagcacagtattcctccggaggagagctcgggggtatctctactaccaatgtgtctacacccgacacagccggtgaaatggagcatggcttgatgaatccggatgccaccgtgtggaagaacgtgttacaaggcggagaatccactaaagagaggtttgaaaattctaacatcggcaccgccggtgctagtgacgtgcatgtgacatctaagcccgtggacaagatctcagttcctaactgtgcacccgctgccagcagtctggacggcaacaaacccgctgagtctagcctcgccttttcaaacgaggagaccagcaccgagaaaaccgccgagaccgagacatcccgtagtagggaggagtctgccgacgctcctgtcgatcagaactctgtggtgattccagccgcagccaaggataagatctccgacggcctggaaccgtacactctgctcgccgcaggcattggcgaggctatgtctccctcagacctggctctacttgggttagaagaagatgtaatgccacaccagaatagcgagacgaattccagccacgcccaatcgcaaaagggaaagtcctctccgatttgttctacgactggcgacgacaaactctgcgcagattccgcatgtcagcagaacaccgtcaccagctcgggagacctggtcgcaaagctatgcgataacatcgtgagcgaaagtgagtcgactacagccaggcaaccttcctcacaagatccacccgatgcaagccactgtgaggaccctcaagctcacaccgttacttctgacccagtgcgagatacccaggagagagctgacttctgtccatttaaagtggtggataataaagggcaaagaaaggacgtcaaactggacaagccactgaccaatatgctcgaagtggtatctcacccacaccccgttgtcccgaaaatggaaaaggaactcgtgcctgaccaggctgttatttctgactcaactttttcactggccaattctccaggaagcgagtccgtgaccaaggatgacgccctttcctttgtaccttcgcagaaggagaaaggaaccgctacccctgaactacatacagccaccgactaccgggatggaccagatggaaattcaaacgagcccgatactagaccacttgaggatagggcagtgggtctatcaaccagttcaactgcggctgagctccagcatggaatggggaatacctcattaaccgggctggggggagaacatgagggccctgccccacccgcaattcctgaagccctgaatattaaaggcaacacagatagttcactacaatccgtgggaaaagcgacgttagcattagactcagtgctgaccgaagagggtaaattgctggtggtttcagagtcttcagccgctcaggagcaggataaagataaagccgtaacatgcagcagtatcaaagaaaatgccctgtcttctggcactctgcaggaggaacaacgcacacctccccctggccaggatactcaacagtttcacgagaagtcaatcagcgcggactgcgcaaaagataaagcccttcaactgtctaactcccccggagccagctctgctttccttaaggctgagacagagcacaataaagaggtggcgccacaggtgagcttgctcacccagggaggggctgctcagtccttggtgccgcctggcgcttctctagcaaccgagagccgacaagaggccctgggagcggaacacaacagcagcgccctgctgccatgcctcctgccggacggaagcgatgggagcgatgcgttaaattgctcccagccatctccactcgacgttggagtgaagaatacacagtcccaagggaaaacgtctgcctgtgaggtctccggggatgtgaccgtcgacgtgaccggggtcaacgcgctgcagggaatggccgagcccagaagggaaaacatttctcataacacacaggatatcctgatccctaatgtcctgttgtcccaagagaagaacgctgtgctgggtctaccagttgcactgcaggacaaagccgttacagatccccagggggtagggactccagagatgatccctctcgattgggagaagggaaagctcgaaggggctgatcactcatgcacaatgggtgacgccgaggaggcccagatagacgacgaagctcacccagtgttgctgcagcctgtggcaaaagaactccctacagacatggagctctcggcccatgacgacggtgcacctgcaggagtgagggaggtcatgcgggcacccccatccggcagggaacgttctaccccgagccttccatgcatggtgagtgcccaggacgctcccttgcccaagggggcagacctgatcgaggaagcagccagtcgcatcgtggacgctgttatcgaacaggtgaaagctgccggtgctcttctgaccgaaggagaggcatgtcacatgagcctgtcttctccagaactggggccactaacgaagggcctggagtcagcttttactgagaaagtgtctacattcccacctggagagtccctgccgatgggatctacaccggaggaagccaccggaagcctcgctggctgctttgccggaagagaggagccggaaaagatcattctgccggtccagggacctgagccggcagctgaaatgccggatgtgaaagcagaggatgaggtcgacttcagggcgtccagtatctcagaggaggtcgctgtcgggtccatagccgcaaccctgaaaatgaaacagggtccaatgacccaggctatcaaccgggaaaactggtgcactatcgagccatgcccagacgctgccagtctgctggccagcaagcagagccctgagtgtgagaacttcttggacgtaggtctgggccgtgagtgtacttccaaacaaggagtgctgaagagagagtcaggatccgattccgacctatttcactcgccaagcgacgatatggattcaattatattccccaagccagaagaagagcacctggcatgtgacatcaccggctcctcaagcagcacagatgatacggcaagcttggataggcacagctcccatggcagcgacgtaagcctctcccagatcttgaaacccaaccgatcccgcgatcggcagtcactggacggtttctactctcacgggatgggcgcagaggggagggagagcgagagtgagcccgctgatccgggtgatgtggaggaggaggagatggacagtatcactgaggtgcccgctaactgcagcgtactgcggtctagcatgcggtcgctgagccctttccgcagacactcttggggccctggtaagaacgccgcatcagacgcagaaatgaatcaccggtcttctatgcgagttctcggcgacgtggtgcggaggccacctatccaccggaggagtttctcgctcgagggcctgacagggggagctggagttggcaataagccatcgagctctcttgaggtgtcctccgccaatgctgaagaactgcgccacccattcagtggagaagaaagggtggacagcctcgtgtccctgtcggaagaagatctggaaagcgatcagcgggaacatcggatgttcgaccagcaaatctgccatcggtctaaacagcaggggtttaactattgcactagtgccatcagcagcccccttacaaagtccatttcactgatgaccatcagtcatccaggcttagataacagccggccatttcactcaacgtttcataatacatctgccaatctgaccgagagtattaccgaagagaactacaatttcctgccgcatagccctagcaaaaaagactcggagtggaagtcgggcaccaaggtgtctcgcactttctcgtatatcaagaacaaaatgtcttcgtccaagaaaagtaaggaaaaggaaaaggaaaaagataagatcaaagagaaggaaaaggacagtaaggacaaggaaaaagacaaaaaaactgtgaacggtcacaccttttcttcgatccccgtggtgggcccaatttcatgttcccagtgtatgaaaccttttactaacaaggatgcctacacatgtgcgaattgtagtgcatttgtccataaggggtgtcgggaaagcctggcatcttgcgctaaggtcaagatgaagcagcccaagggcagcctgcaagctcacgacactagcagcttgcccacggttatcatgcgcaacaaaccatctcagcccaaggagcggcctcggtccgctgtgttgctggtggacgaaaccgccaccacaccgatcttcgctaatagaaggtcccagcagtccgtaagtttatcgaagtcggtcagcattcagaatatcactggggttggtaacgacgaaaacatgagcaatacatggaaattcctctcgcactctaccgatagtctgaataaaatcagtaaagtgaatgagtcaaccgaaagccttactgacgagggggtggggaccgacatgaatgaaggacagctcctgggggattttgagatcgagtccaagcagcttgaggcagagtcctggtcgcgcatcatagactcaaagtttctgaaacagcagaaaaaggacgtggtgaaaaggcaggaagttatttacgaacttatgcagacagaattccatcacgtgagaactctgaagatcatgtcaggagtctatagccaaggaatgatggcggatttattgttcgaacaacagatggttgaaaagctattcccttgccttgatgagcttatctccatacattcccaatttttccagcgtatcttagagcggaaaaaagagagcttagtcgataagagcgagaagaacttccttatcaagaggataggagacgtcttagtgaatcagttctctggagagaatgctgagaggctgaagaaaacttacggaaaattttgtggccagcacaatcagtctgtaaactactttaaagacttgtacgcaaaagacaagagatttcaggcgttcgttaagaaaaagatgtcttcctccgtcgtgagacgcctggggatacctgagtgcattttgttggtcacacagaggattaccaagtatcccgttctgttccagcggatcctgcagtgtactaaagacaatgaagtggaacaggaggacctggcccagagtttgtccctggttaaggacgtcattggggcagttgattccaaggtcgccagctatgaaaaaaaggttcggctgaacgaaatatataccaaaacagatagcaagtctataatgcggatgaaatccgggcaaatgttcgctaaggaggacctgaagcggaaaaagctggttagagatggcagtgtttttctgaagaatgccgctggacgactgaaggaggtgcaggctgttcttctgacagatatcttagtgtttctccaagaaaaggaccagaagtatatctttgcttcgctggaccagaagtcaaccgtcatcagtctcaagaaactcattgtgagggaagtcgctcatgaagaaaagggcttgtttctcatctcgatgggtatgacggaccctgagatggtggaggtccacgccagctccaaggaggagcggaactcatggattcagataatccaggatacgatcaacaccttaaatagagatgaggacgaaggcatcccaagcgagaatgaggaggagaaaaaaatgttggacacgcgcgcacgtgagttgaaagagcagttgcatcagaaagaccagaaaattctgctgttgctggaggaaaaagagatgattttcagagacatggccgagtgcagtacacccctgcccgaggattgcagtcccacacattcccccagggttctctttaggagcaacactgaggaggcactgaaagggggaccactaatgaagagcgccattaatgaggttgagattctacagggcctggtcagcggtaatttgggcggtaccttaggcccaacagtatcgagtccaatcgagcaggacgtggtgggcccagtatcccttcctcgccgagccgagacgtttggcggtttcgactcgcaccagatgaatgcttctaagggaggggagaaagaagagggggacgacggccaagacctcaggagaaccgagagtgatagtggactcaagaaaggagggaacgccaacctggtgttcatgctcaagcgcaatagcgagcaagttgtgcagagtgtggtccatctgtacgagttgctgagtgccctgcagggcgtggtgcttcaacaggatagctatatagaagaccagaaactagtactgtctgaaagggctctgactcgcagcttaagtcggccttcttcccttattgaacaggagaagcaacggagtctagaaaagcagcgccaagacctggcgaatctgcagaaacagcaggcccagtatctcgaggagaagcgccgaagagagcgcgagtgggaggcccgagaacgggagctgagagaacgggaggcactgctagctcagagggaagaggaggtccagcagggtcagcaagatctggagaaggaacgcgaggaactccagcagaaaaaaggtacctatcagtatgatctggagaggctcagggctgcccaaaaacaattggagcgggaacaggaacagctccgtcgtgaagctgaaagactgagtcagcggcagacagagcgggatctctgtcaggtttctcatccgcacacaaagctgatgcgaatccctagtttctttccttctcccgaggagcctccatcgcctagcgcccctagtattgctaagagtggaagtcttgattcagagctgagtgtgagccccaagcgtaacagcatcagcagaacccacaaagataaaggaccttttcacatcctgtccagcacatcccagacgaacaaaggcccagagggacagagccaagccccagcctctacctctgcgtccactcggctttttggcttaaccaaacctaaggaaaaaaaagagaagaaaaagaagaataaaacctcccgttctcagccaggggatggtccagccagtgaggtctctgcagagggagaggagatcttctgtta

SEQ ID NO: 212868 - DNA, 1245 bp, Artificial Sequence
  Description of Artificial Sequence: Synthetic coding sequence
atgtctaacacgtggaagtttctgagccattcaactgactccttgaataaaattagtaaagtgaatgagagcaccgagtccttaactgacgagggtaccgacatgaacgagggccaactactgggagactttgaaatagaaagcaagcaattggaggctgagtcttggtccaggataattgatagcaagtttctgaagcagcagaaaaaggacgtggtgaaaaggcaagaggtgatctatgagcttatgcagactgaattccatcatgtacgaactctcaagatcatgagtggagtttattcgcagggaatgatggcagatttgttgttcgagcagcagatggtcgagaagcttttcccatgccttgacgaacttatctctatacatagtcagttctttcagaggattctcgaacgtaagaaagagtcactagtggataagagcgagaagaacttcctcattaaaaggatcggagacgtgctcgttaaccagttctcaggtgagaatgcagagcgtcttaaaaagacatacggcaagttctgcggtcagcacaaccagagcgtgaactattttaaagatctgtacgcaaaagacaagcggtttcaggctttcgtgaaaaagaaaatgtcgtccagcgtagtgcgcaggctcggtatcccagagtgtatactgttagtcactcagagaattaccaagtatcctgtgctcttccagaggattctccagtgcacgaaggacaatgaagtggagcaagaggacctggcacagtctctgagcctcgtaaaagatgtgattggggctgtcgacagtaaagtggccagctatgagaagaaggtgagactaaacgaaatctataccaaaaccgacagtaagagtatcatgaggatgaagagcggccaaatgttcgctaaggaggatttaaagcggaaaaaactggtgcgggacgggtccgtgttcttgaaaaatgccgcagggagactgaaggaggttcaggccgtcctgcttactgacatcctggttttcctccaggaaaaggaccagaagtatattttcgcatccctggatcagaagtctactgtgatctcgctaaaaaagctaattgtgagagaagtggcacatgaggaaaagggcttatttctgataagtatggggatgaccgatcccgaaatggtggaagtgcatgcatcctccaaggaagagagaaattcgtggatacaaatcatccaggacacaataaatacatag

SEQ ID NO: 212869 - DNA, 1158 bp, Artificial Sequence
  Description of Artificial Sequence: Synthetic coding sequence
atgtatgagagacacaaacgaaggtattccctgtgcgacattagcaaggtggatagaacagtagacgtcgtgttgttgaagattaatcgggaaaattggtgcactatcgagccttgccctgacgcggctagccttctcgcaagtaagcaatcacctgagtgtgaaaatttcttggatgttggtcttggacgcgaatgtacatcaaaacaaggggtgctcaagagggaaagtggtagcgactctgatttatttcattccccttccgatgatatggactctatcatcttccccaaaccggaagaggagcacctagcctgcgatatcacagggtcttcctccagcactgacgacaccgcttctctcgatagacactcgtctcacggcagtgacgtgtctttatctcagatcctcaaacctaacagatcacgagaccgacagtctttggatgggttctactcccacggtatgggagcagaaggaagagagtcagagtctgagccagcagaccctggggatgtagaagaagaggagatggactcgattactgaagtgccggcaaattgcagtgtccttagatcttccatgcgtagcctatcacctttccgcaggcattcttgggggcctggaaagaatgccgcaagcgacgccgaaatgaatcaccgctctttcagcttggaggggctcacagggggagccggagttggaaataagcccagtagtagcctcgaggttagctcagcaaacgctgaagagctgaggcacccgttcagtggtgaagaacgtgtagactcattggtaagtctgtccgaagaagatttagaatccgatcagcgcgagcaccgcatgtttgatcaacaaatctgtcatcggtcaaaacagcaaggattcaactattgcacttccgccatttcttcacctctgactaaatcgatcagccttatgacaatatcacaccccggactggacaactctcggccttttcatagcacattccataatacatcggccaacctaactgaatctattaccgaggaaaactataattttctgccccattccccttctaagaaagacagcgaatggaaaagtggcacgaaggtttctcgcaccttttcgtacataaaaaacaaaatgtcatcgagcaaaaagtctaaatag

SEQ ID NO: 212870 - DNA, 8378 bp, Artificial Sequence
  Description of Artificial Sequence: Synthetic coding sequence
aaattgttggagaagcagcctccaattgagggtgattgcgtggtcacagtcctgttggcagaggaggacaaggcagaggacgacgtcgtcttctatctggtgtttctgggcagtactctgcgacactgtacctctacacgcaaagtgtcttcagatacactggaaaccattgctccagggcacgattgctgtgagaccgttaaggtgcaactgtgtgcaagtaaagagggactccccgtttttgtcgtggccgaggaggacttccactttgtccaggatgaagcctatgatgccgcacagtttctcgcgacaagcgccggaaaccaacaggccctcaatttcaccaggtttctcgaccagtccggaccaccttctggagatgtcaattctctggacaaaaagctggtgcttgctttccgccacctgaagctaccaactgaatggaacgtgctaggcacagaccaatccctccacgatgccggacccagagagacgctcatgcatttcgctgtgcgacttggcctgctccgcttgacctggttcctgctccaaaagcccggtggcagaggggctctgtcaatccataaccaggaaggagccacccccgtgtctttggccctggaacgaggttatcacaaactgcatcagctgctgacagaggagaacgcgggtgaacctgattcctggtccagcttgagttatgagattccctatggggactgctccgttcggcatcatagggagcttgacatctacaccctgacctctgagtccgattcccaccatgagcaccccttcccaggcgacggctgtacaggacctatattcaaattgatgaatatccagcaacagctgatgaaaactaatcttaagcagatggattctctcatgcccttgatgatgactgcccaggacccatcctccgccccagagaccgatggccaattccttccctgtgcacctgagccaaccgatccccaacgacttagcagcagtgaggagactgaatctacgcaatgctgccccggttcacctgtcgcccagaccgagagcccgtgtgacttaagctctatcgtcgaggaggaaaatactgacaggtcgtgccggaagaagaacaagggcgtggaaagaaagggcgaagaggtcgagcccgcacccatcgtcgatagcggcacggtctcagatcaggattcttgtctgcagagcctgccggactgtggagtcaaggggactgaaggccttagctcttgcggaaaccggaatgaggaaacgggcaccaagtcctctggcatgcctacagatcaggaaagtttgtcatcaggggacgctgttttgcagagggacttggtaatggaacccggaactgcgcaatactcctcaggtggagaactcggagggatttccactaccaatgtgagcactcccgatacagccggtgagatggagcacggtctgatgaacccagatgccacagtttggaaaaacgttctgcagggtggggagagtactaaggagcgtttcgaaaactctaatatcggcactgccggagcctctgacgtgcatgtcacatccaaacccgtggacaaaatcagcgttccaaactgcgccccagctgcatcaagtctggacgggaacaagccggcagaaagctcccttgccttctccaacgaagagacttcgacagagaagacagcggagaccgaaacgtcacggtctagagaggagagcgcggatgcccctgttgaccagaacagcgtagtgatccctgcagctgccaaggataagatttctgatgggcttgagccatataccctccttgctgccggtataggggaagccatgagcccgtctgacctcgctctactgggcctggaagaagacgtaatgccacaccaaaatagtgaaacgaacagttctcatgctcagtcgcagaagggaaagtcctctccaatctgtagcacaactggtgacgataaactttgtgcggattctgcatgtcagcagaatactgtaacgtccagtggtgatttggtggccaaattgtgcgataatattgttagcgagtccgagagtaccacggcccgtcagccatcatcacaggatccacctgatgcgagtcactgcgaagacccgcaggctcatactgtcacaagcgaccccgtgcgggacacgcaggagcgggctgatttctgtcctttcaaagtggtcgataataaaggacagagaaaggacgtcaagttggacaagcctctcaccaatatgctggaggtggtcagccacccacatccagtggtcccaaagatggagaaggagctagtgcccgatcaagcggtaatttcagactccaccttttccttagcgaactctcccggttcggagtctgttaccaaagacgacgccctgagcttcgtgccaagccagaaggagaaaggtacagccactcccgagctgcacaccgctactgactaccgcgacgggcctgacggaaattcaaatgagcctgacacacggcctctcgaagaccgcgctgtgggactgtccacgtcgagtactgccgcagagctccagcatggaatgggcaataccagtttaactgggctgggcggagaacacgaggggccagctccccctgcaatccctgaggcattgaatattaaagggaataccgatagtagcctgcaaagcgtgggcaaagcaaccttggcactggatagtgtgctgacagaagaaggcaagctcctggtggtgagcgagtctagcgctgctcaggaacaagacaaagataaggccgtcacatgtagtagtattaaagaaaacgcactgtcttctggcaccctgcaggaggagcagcgcacccctccccctggccaggacacccagcagttccacgagaagagcatctcagcggattgtgccaaagacaaagcactgcaactgtctaattcaccaggcgctagcagtgcgttcctgaaggcggaaaccgaacacaacaaagaggtggcaccacaggtgagcctgctgactcaggggggtgcggcacaatccctggtgccccctggcgcaagcttagcgactgaaagtcgccaggaagccctgggagccgagcacaactcgtccgctctgttgccttgcctgctgccagatgggtccgatggttcagatgccctcaattgcagccagccgtcgccactggatgttggagtgaagaacactcagagccaagggaagacatccgcctgcgaggtgagcggggacgttacagtagacgtgacaggggtgaatgctctgcaaggtatggcggaacctcgacgggagaatatatctcacaatacacaggacattctcatacccaatgtcctgctatcacaggagaaaaacgcagtcctcgggctacccgttgctctgcaggataaggccgtaacagacccacagggagtagggactcccgagatgatcccccttgattgggaaaagggcaagctggagggagctgatcacagttgcactatgggtgatgctgaggaggcccagattgacgacgaagcccaccccgtgttactgcaacctgtcgcaaaagaattgcccactgatatggagctgtccgcccacgatgacggggcaccagcaggggtgcgtgaagtgatgagggcccctcctagtggcagggagagatcaaccccctcactgccctgcatggtaagcgcgcaagatgccccactgcccaagggggctgaccttatcgaggaggccgcttcaagaattgttgatgccgttattgaacaggttaaggccgctggggcactcttaaccgagggcgaagcatgtcatatgtcattgagtagccccgagctggggcctcttaccaaggggctggagtcagcctttaccgagaaggtttccactttcccacctggcgagtcactaccaatgggttcaacccctgaggaggctaccggcagcctcgcagggtgtttcgcagggcgagaagaacccgaaaaaatcatcctgccagtccagggacccgagcccgctgccgagatgccggatgtgaaagccgaagatgaggtggacttccgtgcaagctctatcagcgaggaggtagcagtcggtagcatagcagccacattaaaaatgaaacagggccctatgacacaagcgatcaaccgagagaactggtgcacaatagaaccatgtccggacgccgcaagtctgttggcgtccaaacaaagccccgagtgcgaaaattttcttgacgttgggctcggtagggagtgcaccagcaaacagggcgtgctgaaacgggaatctggatccgatagtgatttattccacagtcctagtgatgacatggactctataatcttccccaaaccagaagaagaacacttagcatgtgatatcactgggagcagtagcagcacagatgataccgcctcattggaccgccattctagtcacggatctgacgtctcactgagccagatcctgaaaccaaaccggagtagagataggcagtctctggatggcttctacagccacggtatgggggctgaaggacgagagtcggaaagcgaacctgccgacccaggggatgttgaggaggaagaaatggattcaatcacggaggtacctgccaactgcagtgtcctgagatccagcatgcggtctctctccccattccgaagacactcatggggaccaggaaagaacgcggcatccgacgccgagatgaaccacagaagtttctctttagagggactcaccggtggagccggagtgggaaacaaaccttcgtcctctttagaagtgagctcagcgaacgccgaagagctaaggcatcctttttctggagaagagagagtcgactctctagtgagtctcagcgaggaagacctcgaatccgaccagcgggaacaccgtatgttcgatcagcagatttgccacaggagcaagcagcagggctttaattactgtaccagcgccatttccagtcctcttactaagtctataagtctgatgactatctcgcatcctggacttgacaactccaggccattccactcaacatttcataatacttctgctaatctgacagagagcatcaccgaagagaactacaacttcttgccccatagcccaagcaaaaaggatagtgagtggaagagcgggactaaggtgagccggaccttctcatacatcaagaataagatgagttcatcaaagaagtccaaagaaaaggagaaggagaaggacaagattaaagagaaagagaaagattctaaggataaagaaaaagacaagaagactgtgaacggccatacattcagctctattccagtggtcgggccaattagttgctctcagtgcatgaaaccatttacaaataaggacgcctacacgtgcgccaattgttctgccttcgtgcacaagggctgcagggagtctctcgcctcgtgtgcaaaggtaaagatgaaacagcctaaaggctccctccaggcccatgatacatcatcattgcccacagtgatcatgcgcaataaaccaagccagccaaaggaacggcctagatcagccgttctgctagttgacgagactgccaccaccccaatattcgctaaccggagatctcagcaatctgtatctctgagtaaatcagtgagcatccagaacattaccggcgtcgggaatgacgagaacatgtctaatacatggaaattccttagccacagtacagacagcctgaataaaatcagtaaagtgaacgagagcactgagagtctgaccgacgaggggaccgacatgaacgaagggcagctgctgggggacttcgagattgagagcaagcaactggaagcagagtcttggagcagaattatcgattccaagttcctaaaacagcagaagaaagacgtggtgaaacggcaggaggtgatctatgaattaatgcagaccgagttccaccacgtgagaacactgaagataatgtccggagtttattcacagggcatgatggccgaccttctctttgaacagcaaatggtggaaaagctattcccatgcctagacgagttgatttcaattcacagccagtttttccagcgaatcttagaaagaaaaaaggagtccctcgttgacaaaagtgaaaagaactttctgatcaagcgtattggagacgtgctcgtaaatcagtttagtggggagaacgcagagcggctgaaaaagacttatggaaagttctgtggtcagcataaccagagtgtaaattactttaaggatctgtatgccaaggataagcgctttcaggcatttgtcaaaaagaagatgtcttcctcagttgtgcgccgactggggatccccgaatgtatcctgctcgtgacacagaggatcaccaagtatccagttctgttccaaaggatcctgcagtgtaccaaggacaatgaagtggaacaagaagacttggcacagtccctgagcttggtgaaggacgtgatcggggcagtggatagtaaagtggccagctatgaaaaaaaggttaggttaaacgaaatttatacgaaaacagattcaaagagcattatgcgcatgaagtcaggacaaatgttcgctaaagaggatctgaaacgcaagaagctggtgcgcgacggttccgtgtttcttaagaatgcggctggtcgtctgaaggaggtgcaagccgtacttctgactgacatactggtatttctgcaggaaaaggaccagaagtacattttcgccagtctggatcagaagtccacagtcatcagtttgaagaagctgatcgtccgggaagtggctcatgaggaaaaaggtctgtttctgatttccatggggatgacggaccccgagatggttgaagtacacgccagttccaaagaagagagaaattcttggatacagattatccaggatactattaatacgttaaatagggatgaagatgaaggcattcccagcgaaaacgaggaggaaaaaaaaatgctggataccagggctcgggagctgaaagagcagcttcatcagaaggaccagaagatcttattgctgctggaggaaaaagagatgattttccgagacatggccgagtgttccacacctcttcctgaggactgtagtccgacccattccccgcgagtactcttccgctccaacacagaagaggcactcaagggaggcccactgatgaagtccgccatcaatgaggtagagatactgcagggccttgtcagcgggaatctcggcggaacattgggaccaactgtgtctagcccaatagaacaggatgtggttggtcctgtgagcctgccacgtagggcggaaaccttcggcggattcgacagccaccagatgaatgcttccaagggaggcgagaaggaggaaggagacgatgggcaggacctgagacgcacggaaagcgattcgggccttaaaaaggggggtaatgccaatctggtgtttatgttgaagaggaactctgaacaggtcgttcagagcgttgtgcatctgtatgagctgctcagtgccctacaaggtgttgttctgcaacaggacagctatatcgaggatcagaagctggtgctcagcgaaagagcattgactaggtctctgtcaagacccagcagtctaattgagcaggaaaagcaaagaagccttgaaaaacagagacaggatttagccaaccttcagaaacagcaagcccaatatctggaagaaaaaaggcgccgtgagagggagtgggaggcgcgagagcgggaactacgcgaaagagaagccctcctcgcacagcgcgaggaggaggtgcagcagggtcagcaggacctagaaaaagagcgagaagagttgcaacagaagaagggcacttatcaatacgatcttgagcgccttcgggctgcacagaaacagctcgaacgcgaacaagagcagttgagaagagaagccgaaagactcagccaaagacaaacagagcgagacctctgccaggtgtctcatccacacaccaaattaatgcggatcccttcgttctttccaagtccggaagaaccgccaagtccctccgcgccttccattgcaaagtctgggtcactcgactccgagctgtctgtttcaccaaaacggaactcaatctctcgtacccataaagacaagggtccttttcacattttatccagcaccagccagaccaacaaaggtcccgaagggcagagccaagcccctgcttcaacaagcgcctccactaggctgttcggtcttacaaaacctaaggaaaagaaggagaaaaaaaaaaagaataagacgtctcgcagccagccgggagacgggcctgcttccgaagtaagcgccgagggggaagaaatcttctgtta

SEQ ID NO: 212871 - DNA, 5237 bp, Artificial Sequence
  Description of Artificial Sequence: Synthetic coding sequence
atgaagcttaatccacaacaggcaccgctctacggagattgtgtggttactgtccttcttgccgaggaggacaaggctgaagacgatgtggtcttctacctcgtcttcctgggcagtacactgcgccattgcaccagtaccagaaaggtgtcaagtgacacactggagacaattgcaccgggtcacgactgctgtgaaacagtaaaggtgcagctctgcgcctccaaggagggcctgcccgtcttcgtcgtcgctgaagaggacttccacttcgtacaggacgaagcatatgatgccgctcagtttcttgcaacatctgccggtaatcagcaggcactcaatttcacccgctttcttgaccagtctggtccaccgagcggagatgtgaatagcttggataaaaagttagtgctagcctttcgtcatctgaagctgcctacagagtggaacgtattgggaaccgatcagtctctacacgatgcagggcctcgcgaaacactgatgcattttgctgtacggctgggtctgttgcggctgacctggtttctccttcagaaacctggagggagaggcgctctgtccatccacaatcaagagggcgctaccccggtctctctggccctggaacgaggctatcacaagctccatcagctcttgactgaggagaacgccggagagcccgacagttggtcctccctgagttacgagatcccgtatggggattgcagcgtgcggcaccatcgggaacttgatatctatacactgacgtctgaatccgactcccatcatgaacacccttttcctggggatgggtgcactggacctattttcaaacttatgaatatccagcagcagcttatgaagaccaacctcaaacaaatggattctctgatgccattgatgatgactgcacaggacccatctagcgctcctgaaacagacggacagttcctgccgtgtgcacctgagccaaccgatccccaaagactgtcttcctccgaagaaacagagtccacgcagtgctgccctggaagccctgtggcccagaccgagagtccatgcgatctgagctccattgtggaagaagagaacaccgacagatcctgtagaaagaaaaacaagggagtggaacgtaagggggaagaggtagagccggctcctattgttgactccggaacagtcagcgaccaggactcctgccttcaaagcctgcccgattgcggcgtgaaaggtactgaaggactcagcagctgtgggaaccggaacgaagagactgggaccaagagctccggcatgcccaccgatcaggagagtctcagctctggagatgctgtgctccagcgagatctcgtgatggagcccggaacagcccagtacagcagtggaggggaattaggcggaataagtactaccaacgtgagcacaccggatacagcaggtgagatggagcatggtctgatgaatccagatgcaacagtctggaagaatgtgttgcagggaggagaaagtacaaaggagcgatttgagaactccaatatcggcacagccggagcctccgatgtccatgtaacatccaaaccggtggataagattagcgtgccaaactgcgccccagccgcaagtagtttagacgggaataaaccagcagaatcttcgctggcctttagtaacgaagaaacgagcacagagaagaccgccgaaacagagacgagccggtcaagggaggagtccgctgacgctcccgtcgatcaaaatagtgtagtaatcccggctgccgcaaaagataagatttccgacggactcgaaccttacaccctcctcgccgctggaataggggaagccatgagtccctcagatttggctctgctcggcctagaggaagatgtgatgcctcatcagaatagcgaaactaactcctctcatgctcaaagtcaaaagggcaaatcttcaccgatctgctctaccaccggagatgacaagctgtgtgccgacagcgcttgccagcagaacaccgtcacaagcagcggcgacctcgtggcaaagctctgtgacaatatcgtgagcgaaagcgagtctaccaccgcaaggcaaccatcttcccaggatccacccgacgcttctcattgcgaagatccccaggctcataccgtcacgagcgatccagtgcgcgacacacaagaaagagctgatttttgcccgttcaaagtggttgataataaggggcagcgcaaagatgtgaagttagataaacctctgaccaacatgcttgaggtggttagccatcctcatcccgttgtgccaaagatggaaaaggagctggtgcctgaccaggccgtaatctcagactcaacgtttagccttgctaatagccccggaagcgaatcggtgaccaaggacgacgctctgtctttcgttccgtcgcagaaggaaaaaggtaccgcaactccggagcttcatacagcaactgactatcgcgacggaccggatggaaactcaaacgagcccgataccaggcctctggaggacagagcagtaggcctgtcaacctcgtcaaccgcggcagagctgcagcatgggatggggaacacatccttgaccgggctaggcggagaacacgagggcccagcccctccggcaatcccagaggccttaaatattaagggcaatacggattcctctctgcagtctgtggggaaagccacacttgctctagacagcgtgcttactgaggaagggaagttgctggtggtgtcagagtcatcggccgctcaggaacaagacaaagacaaagcggtcacgtgtagctccataaaggagaatgcgctgtcctcggggaccctccaggaggagcagaggacgcctcctcctggacaggacacccaacaattccatgaaaaatccatttcagctgattgtgccaaggacaaggccctccagctcagtaatagtcctggagcctcaagcgcgtttctgaaagccgaaactgagcataataaggaagtggcacctcaggtgagcctgctgacacagggtggcgctgcacagagtctggtgccacctggcgcttctctggctactgagtccaggcaggaagccctaggagctgaacataactcaagcgccctgttgccttgtctgctgcctgatgggagcgacggcagcgacgccctgaactgctcacagccttctcctcttgatgtgggagtgaagaacacccagtctcaaggcaaaacctctgcctgcgaggtgagtggagacgtgacagtggacgtgacaggcgtgaacgctttgcaaggcatggccgaaccaaggcgcgagaatattagccataacacccaagacatcctgattccaaatgtgctgctgtcacaggagaagaacgctgtcctcggcctgcccgttgcccttcaggataaagcggtgaccgacccacagggagtggggactccagagatgatccccttagactgggagaagggcaagctagaaggggcagatcactcctgcaccatgggagatgcagaagaggctcagatagacgacgaagctcatcccgtcctgctacagccggttgcaaaggagctacccacggacatggagctcagtgctcatgacgacggcgctcctgccggtgtgagagaggttatgcgcgcacccccatccggcagggagcggtccacacccagtctgccctgcatggtgtcagctcaggatgcaccactacccaagggtgcagatttaatcgaggaggccgctagccgcattgtcgatgcggttattgaacaggtgaaggcagcaggggctctgctgacagagggcgaagcttgtcacatgagcctctctagccccgagttaggccctctgactaagggacttgaatcagctttcacagagaaggtcagtaccttcccgccaggagagtctctaccaatgggttctacaccagaggaagcaacaggcagcctggccggatgctttgctgggagagaggagcccgagaagattattctcccagtgcagggaccagaacccgctgcggagatgcccgatgtgaaggctgaagacgaggtcgatttccgggcttcttccatctccgaagaggtggccgtgggctccatcgcagctactctcaagatgaagcaaggcccaatgacgcaggcaatcaatcgtgagaactggtgcactattgaaccgtgtcctgatgctgcttcactgctggcttcaaagcagtcgcccgagtgtgagaactttcttgatgtagggttaggcagggaatgtactagcaagcagggtgtcctgaagagggagtccggctctgactcagatctcttccacagcccgtcagacgacatggatagcattatctttccaaaacccgaagaggagcatctagcatgtgacatcacgggatcctcaagctcgaccgatgataccgcaagcttagatcgccatagctcccatgggtcagacgtgtccctctctcagatcctgaagcccaataggtcacgtgataggcagtctctggacggattctacagccacggtatgggcgcagaaggaagggagtctgagagtgagcccgcagaccccggtgatgtcgaggaggaggaaatggattcgataaccgaggtgccagctaactgctccgtgcttcgaagttctatgcgttccctttctccctttcgtaggcactcttggggtcctgggaagaacgcggcaagcgacgctgagatgaaccaccgttcgttctcattggagggattgacaggtggtgcgggagtgggcaacaagccaagttcttctctcgaagtgagttctgctaacgcagaagagctccgccaccccttcagcggagaggagagggtggattcgctagtctccttatcagaagaggatcttgaatccgaccagcgagagcaccgaatgtttgatcagcagatctgtcaccggtccaagcagcagggatttaactattgcacttccgcaatctcctcccccctaaccaaatccatcagcttaatgacaatatcccatccaggtctggataactcccgacctttccatagcacctttcacaacacttctgccaatttgacagaaagtatcaccgaggagaattataactttctacctcattctccctcaaagaaggattcagaatggaagagcggcactaaagtgtctcgcaccttttcctacatcaagaataaaatgtcgtcaagcaagaagagtaagta

SEQ ID NO: 212872 - DNA, 828 bp, Artificial Sequence
  Description of Artificial Sequence: Synthetic coding sequence
ccatcagacgatatggactcaattatctttccgaagcccgaggaggagcatctggcctgcgacatcacggggtcttcatcttccactgacgacaccgcttccctggaccgccacagtagtcacggcagcgatgtgagcttatcacagattttgaaaccgaacaggagcagagatcgccagtccctagacggattttactctcatgggatgggggctgaggggcgagaatccgagtctgaaccagccgacccaggcgacgtcgaagaggaggaaatggattccatcaccgaagtacctgcaaattgcagcgttttgaggagctccatgcggtcccttagcccctttcgcaggcacagctgggggcctgggaaaaacgccgcttctgacgccgagatgaaccatcgaagctcaatgagggtcttgggggacgtagttagacgacccccaatccatcggcgtagcatgagctggtgccctagcggcgttcaatatagcgctggactatccgctgactttaactacaggtccttttctctcgaaggcctgacaggcggagccggtgttgggaataagccctcgtcaagcttggaggtgagttccgcgaatgccgaagagctgcggcacccctttagtggagaagaacgggtagacagcttggtctcattaagtgaagaggacctagaatccgatcagcgggagcatcggatgttcgaccagcagatttgccatcgttctaaacaacagggatttaattactgcacctcggcaatctctagtccactgaccaagagtatctctctgatgaccatctcccacccaggattgtag

SEQ ID NO: 212873 - DNA, 117 bp, Artificial Sequence
  Description of Artificial Sequence: Synthetic coding sequence
atgaagctaaatccacagcaggcacctctgtatggtgactgcgtagttactgtcctgctcgccgaagaggataaggccgaagatgacgtggtattctacctggtgtttctcgggtag

SEQ ID NO: 212874 - DNA, 540 bp, Artificial Sequence
  Description of Artificial Sequence: Synthetic coding sequence
atgaagctgaacccccagcaagcgcctttatacggggactgcgtggtcacagtactactggctgaagaggacaaggccgaagatgatgtcgtcttttaccttgttttcctaggctctacactgcggcattgcacttccacacggaaggtgtctagcgacaccctcgaaactatagcccctgggcacgactgctgcgagacggtgaaggtccaattatgcgccagtaaagaaggactgccagtcttcgtggtggccgaggaagattttcatttcgtgcaggatgaagcatatgacgctgcacagttcctggcaacgtccgccggtaatcaacaggcactgaacttcactcgttttctggaccaatcgggaccccctagcggcgatgtgaatagcctcgacaaaaaactcgtgctggcattccgccaccttaagttgcccaccgaatggaatgtcctcgggaccgaccagagcttacatggagagaacttgtatgatctgcagacgcatttcaaattcgtcattttcctgctgttcttttag

SEQ ID NO: 212875 - DNA, 414 bp, Artificial Sequence
  Description of Artificial Sequence: Synthetic coding sequence
atgtcagagacccagaatagcacctcacagaaggctatggatgaagataataaagccgctagccagaccatgccaaacacccaagataaaaattatgaggacgagctgactcaagtcgcattagcgttggtggaggacgtgatcaactatgccgtcaagatcgtggaagaagaacgtaatcccctaaaaaatatcaaatggatgacccacggcgagtttactgtggagaaaggcttgaagcagatcgacgaatacttctcagacgcccctatagtcgtctcgtacgtgggcgaccaccaggcactcgtccacagacctgggatggtgagatttagggaaaactggcagaagaaccttacagatgccaaatattctttcatggaatctttccctttcctatttaacagagtatag

SEQ ID NO: 212876 - DNA, 270 bp, Artificial Sequence
  Description of Artificial Sequence: Synthetic coding sequence
atgtctgaaacacagaactctacctcccagaaggccatggatgaggacaataaagctgctagccaaaccatgcccaacactcaggacaaaaactacgaggatgagctgactcaggtcgccttagcactggtggaagatgtgattaactacgccgtgaagatcgtggaggaagagcgtaatcccttaaagaacattaagtggatgacccatggtgaattcacggtagaaaaggggttgaagcagattgacgaatattttagcgtgtcttag

SEQ ID NO: 212877 - DNA, 417 bp, Artificial Sequence
  Description of Artificial Sequence: Synthetic coding sequence
atgtccgaaacgcagaattctactagtcagaaagccatggacgaggacaacaaagcagcatcccagaccatgccaaatacccaagataagaactacgaagatgaactcactcaagtcgcattggccctggttgaggacgttatcaactacgcagtgaagatcgtggaggaagaacggaatccactgaagaatatcaaatggatgacacacggtgagttcacagtggaaaaggggcttaaacagattgacgaatacttttctcccgacgcacccatcgtggtcagctatgtgggtgaccaccaagcactggtccataggcctggtatggtcagatttcgggaaaactggcagaagaatctaaccgatgccaagtactcattcatggaatcttttccctttctgttcaatcgggtgtag

SEQ ID NO: 212878 - DNA, 414 bp, Artificial Sequence
  Description of Artificial Sequence: Synthetic coding sequence
atgtctgaaacacagaatagcacgagccagaaggctatggatgaagataataaggctgcaagccagaccatgccaaatactcaggacaagaattatgaggacgagctgacacaggtggcactggctcttgtggaggacgttatcaattacgcagttaagatcgttgaggaggagagaaatcccctcaaaaacatcaagtggatgactcatggcgagttcacagtcgaaaaaggtcttaagcagattgacgaatacttcagtgacgctcccatcgtggtgagctacgttggtgatcatcaggccctggtgcaccgccctggcatggtcaggtttcgagagaattggcagaagaacctcacggatgctaagtatagtttcatggaaagcttcccctttctgtttaatcgagtttag

SEQ ID NO: 212879 - DNA, 594 bp, Artificial Sequence
  Description of Artificial Sequence: Synthetic coding sequence
atgtccgaaactcaaaactctaccagtcagaaagccatggacgaggataacaaggcagcgtctcagacaatgccaaatacccaagacaaaaattacgaggacgaattaacccaggttgccctggccctagttgaagacgtaattaactacgccgtaaaaatcgtggaggaagaaagaaaccccctgaagaatatcaagtggatgactcatggcgagtttacagtggaaaaggggcttaagcagattgacgagtatttctccaaatgcgtcagcaagaaatgctgggcgcacggagtagaattcgtcgagcgcaaggatctaatacatagtttcctatacatctattacgtccattggagtatttccacagcggatcttcccgtcgccagaatctcagctggaacttacttcaccatgaaagtgtcaaaaactaagccacccgacgccccaattgtggtttcgtatgtgggtgaccatcaggctctcgttcatagaccgggaatggtgcggtttcgggaaaattggcagaagaatctgaccgatgccaagtattcattcatggagtcattcccattcttgtttaacagggtctag

SEQ ID NO: 212880 - DNA, 270 bp, Artificial Sequence
  Description of Artificial Sequence: Synthetic coding sequence
atgagtgagacgcagaatagtactagccaaaaggcgatggacgaagacaacaaagccgctagtcagactatgccaaatacacaggacaagaactacgaagacgagctcacccaggttgcacttgccctggtcgaggatgtcataaattacgcagtcaagatcgtggaggaagaaagaaaccctctgaagaatattaagtggatgacacatggcgagtttacagtcgaaaagggacttaaacagattgatgagtacttcagcgtttcttag

SEQ ID NO: 212881 - DNA, 2088 bp, Artificial Sequence
  Description of Artificial Sequence: Synthetic coding sequence
atggccgcagccacaatcgttcatgacaccagcgaggctgtcgaactgtgccctgcgtacgggttgtacctgaaacccatcaccaaaatgactatttccgtggccttgccacagttaaagcagccgggaaaatcaatttcaaactgggaagttatggaacgactcaaagggatggtccagaatcaccagttctctaccctcagaatttctaagtcgacaatggacttcattaggtttgagggcgaggtggagaataagtcactggtcaaatctttcttggcctgcctggatggcaagacgatcaagctgtctggtttcagtgatatcctgaaggtgagagcagcagaatttaagattgatttcccgacacggcacgattgggatagcttttttcgggacgccaaagatatgaacgaaacattgcccggagaaagaccagacacaatccaccttgaagggttaccctgtaagtggtttgctctgaaggagtccggctccgaaaagccaagcgaggatgtgctggtcaaggtatttgagaagttcggagaaatacgaaacgtggacattccaatgctggacccatatcgggaagagatgaccggacgaaacttccatacatttagttttggcggacacctgaacttcgaggcttacgtacaatacagagagtatatggggttcatccaggcaatgtccgctctccgagggatgaaactgatgtacaaaggtgaggacgggaaggccgttgcgtgcaatattaaggttagctttgatagtacgaagcacttgtcagatgcctcaatcaagaaacgccagcttgagcggcaaaagctgcaggagttggaacagcaacgtgaggaacagaagcgtagagaaaaagaggcagaggagcggcaaagggcagaggaaaggaaacagaaggagcttgaggagctggagcgagaaagaaagcgggaggaaaagctgcgcaagcgggaacaaaagcagagggaccgggaactccgcagaaaccagaagaagctggaaaaactccaggctgaagagcaaaaacagctccaggaaaagataaagctggaggaacgcaagctcctgctggctcagaggaacctgcagagcattcgtctcatagccgaactccttagcagggcaaaggctgtgaagctccgtgaacaagagcaaaaagaggaaaagctcaggttacagcagcaggaagaacggagacggctacaggaggcggagctacgacgagttgaagaggaaaaggaacgagccctgggcctgcagcggaaagaacgggaactgagagagagactgctatccatcctgttaagtaagaaaccggacgacagccatactcacgacgaactcggggtggctcatgccgatctgctgcagccagtcctggacattctgcagacagtatcctctgggtgcgtgagcgctaccaccctccatcccctgggcggacagccacctgccggagcacccaaggaaagtccagcacatcccgaggccgatggcgctccaaagagcgtgaacggcagcgtggctgaagaagctccctgtaaggaagtccagtccagctgtcgggtggtgcctgaagatggcagccccgagaagcggtgtccgggtggggtcctgagttgtatcccggataacaatcaacagcccaagggaatccccgcatgcgaacagaacgtgtctcggaaggatactcgatccgaacaggacaaatgtaatcgcgagccttctaaggggagaggaagggcgacgggcgacggcctggccgacaggcataagcgcgagaggtccagagctcgcagggcttcctcccgggaagatgggagacctaggaaagagcggcgaccccacaaaaagcatgcgtataaagacgattcaccaaggagacgctccactagccctgatcacacccgaagcaggcgatctcactcaaaggaccggcatagacgggaaagatctagagagcgcaggggctctgcttcaaggaaacactcgcgtcatcgcagacgtagtgaacgtagccggagccgctcgccgtcccgccaccgctctacttggaaccgatag

SEQ ID NO: 212882 - DNA, 1341 bp, Artificial Sequence
  Description of Artificial Sequence: Synthetic coding sequence
atggccgcagctactatcgtccacgataccagtgaggctgtagaactgtgccctgcatacggactatatctaaagccaattactaagatgaccatctcagtggccctgccgcagttgaagcaaccaggcaaaagtatttcaaattgggaggtgatggagcggcttaaggggatggtccagaaccaccagttctcgaccctacggatatctaagtctacaatggatttcatacggtttgagggggaggtggagaacaaatctctggtcaaatcttttctcgcctgcctggatggtaagacaattaagctcagcggcttctccgatatcttaaaggttagagcagccgaatttaagatcgactttccgacaagacacgactgggactctttttttcgggacgctaaagatatgaacgagacacttcccggagagcgtcccgatacaatacacctagaaggccttccgtgtaaatggtttgcacttaaggagagtggatcggagaaaccaagtgaagacgtgctggtcaaggtgtttgaaaagtttggcgaaatcaggaacgtggacattccaatgctggatccttacagagaggaaatgacaggacggaacttccatacgtttagttttgggggtcacctgaatttcgaggcctacgtccagtacagggagtacatgggctttatacaggcaatgagtgccctgcggggtatgaagctaatgtataaaggagaggatggaaaggcagttgcttgcaacatcaaggtatctttcgactctaccaaacacctctctgatgcgagtattaaaaagagacaactggagaggcagaagctgcaggagcttgaacagcaaagagaggagcagaagcggagagagaaggaagcggaggaacgtcagagggcggaagagcgcaagcaaaaggagctggaggagctggagcgagagcgtaaaagagaggagaagctgaggaagcgggagcagaaacagagagacagagagctccgcagaaatcaaaagaagctcgagaaattgcaggccgaggagcagaagcagctgcaggagaagattaagctggaagaaaggaaactgctgctggctcagaggaacctccaatctatcaggctaatcgctgaactgctgtctcgtgcaaaggtgcccggaggcagcctgtgtagcaggcaaccgcgaccagggtgccctcagtgcccccctctgaaatgcggtcggcgtcatggtgcggtgtccccacctgcggctgccgtggcaacaaagcctgctctgatgccacgaatgaccgcaccttcacgcgaaggcgttgcccttgtttgccggagccggtag

SEQ ID NO: 212883 - DNA, 2580 bp, Artificial Sequence
  Description of Artificial Sequence: Synthetic coding sequence
atggaaattgaagtgtctgtggccgagtgcaaaagcgtcccaggaatcacatcgactccccatcctatggatcaccccagtgccttctattctccgcctcacaacgggctgcttaccgatcatcacgagtctctcgataacgatgtcgcccgagagattcggtacctagacgaggtactggaggcaaactgctgtgatagcgccgtggacggaacttataacggtacctccagcccggagccaggcgctgttgtgttagttggcggacttagcccaccagtccatgaggccacccagcccgagcccactgaaagaacagcttccagacaggcccctccccacatcgagctttctaactcttcgccagaccccatggctgaggctgaaagaaccaacgggcattcaccttctcagccccgtgatgcactgggggatagcctgcaggtgcccgtgtctcctagttctactacaagtagccgttgttcatcaagggatggggaattcacattgacgacgttgaagaaggaggccaagtttgagctgagggcatttcacgaggataagaagccctctaagctcttcgaagacgatgagcatgagaaggaacaatactgcataagaaaagtgagaccctctgaggaaatgctggaattggaaaaggagcgccgtgaactgattcggtctcaggccgtgaagaagaacccaggcatagcagctaaatggtggaacccaccccaggaaaaaacaatagaggagcaactcgatgaggaacacttggaaagccacaagaaatacaaggagaggaaggagcgcagagcccagcaggaacagttactgctgcagaaacaattgcagcaacaacagcaacaaccaccatcacagctttgcaccgctccagcctcttctcacgaacgagcaagcatgattgacaaagctaaggaagatatcgtaactgaacagatcgactttagcgctgcacgcaaacagtttcagctgatggagaattcacgtcaagctgtggccaaaggtcagagcactcccaggctcttttcaattaaacctttctatcggcctttgggaagtgtgaattcagacaagccactgaccaatcctaggcccccaagcgtgggcggacctcctgaggattctggggcaagtgctgccaaaggacagaaaagccctggagccctcgaaacccccagcgcagccggtagccaaggtaacactgcttctcaggggaaggaagggccatattctgagccctctaaacgagggccactgtccaaactatgggccgaagatggcgagttcacgtcagctcgagctgttctgaccgtggtgaaagacgatgatcacggcattctggaccagtttagccgaagcgtgaacgttagcttgacccaggaagagctagactcagggcttgacgaactcagcgtgcggtcacaggacaccacggtgctagaaactctgtccaatgacttctccatggataacatttccgattccggggcaagcaatgagaccacgaatgccctccaggagaattctttggccgatttttctcttccccagacccctcagaccgacaatccgtccgagggtcggggtgaaggggttagtaagagtttctctgatcacgggttctactccccgagctccaccctgggggactcaccgctggtcgacgatcctctagagtatcaggctggccttttagtgcaaaacgccatacaacaagccatcgctgagcaagtggacaaagccgtaagtaagactagccgtgatggagctgaacaacaaggtcctgaggctactgttgaagaggctgaggcagcggcatttgggagcgagaaaccccagtcaatgttcgagccaccccaggtaagcagccccgtacaggaaaagagagacgtcctgcccaaaatccttcctgccgaggacagagcacttcgggaacgcggtccgcctcagccattgcctgctgttcagccatctggcccaataaatatggaggagacgcgaccagagggttcctacttcagcaaatacagtgaagcagctgaactgaggtctaccgctagcttgctggctacccaggaatctgacgttatggtcggaccctttaagctgcgatcccggaaacagagaactctctcaatgatcgaggaagagatcagggccgctcaggagagagaggaggagctcaaacgacagcgccaggtactccagagtacccagtcaccacggacaaagaacgcaccgtcactgccttcaagaacatgttacaagacagcgccaggtaagatagagaaggtgaagccaccacctagtcccactaccgaggggccatctttacagcctgatctcgcacccgaggaggctgccggaacacagcgacctaaaaacctgatgcagactctcatggaagactatgaaacccacaagagcaaaaggcgggaaaggatggatgattctagtgtgctggaggctacccgcgttaaccgcagaaagtctgccctggctctgagatgggaggctggaatctatgcaaatcaagaagaggaggacaatgaatag

SEQ ID NO: 212884 - DNA, 2847 bp, Artificial Sequence
  Description of Artificial Sequence: Synthetic coding sequence
atgaggtggcctcagccaggggcagccgctcggctgcccccagagtcaccgggaccccctgagtcacctggccctccagagcgagaggctgccgcagctcgcaggtggaccggtgctgagcctcaggattgcgcccctgggtcaggtagacccgagaagccacctcagttaagcgaggacgacatatggctgaaatcagagggagacaattacagtgcaactttgttggagcccgctgcatcaagtctgtccccagatcataagaacatggagattgaggtttctgttgccgagtgcaagtccgtgccgggaattacttctaccccacacccaatggatcatccatccgccttttattctccaccccacaatggactgctgacagaccatcacgaatcactggacaatgatgttgcgcgtgagattcgctaccttgacgaggtgctcgaggctaactgttgtgactccgccgttgatggtacttataatgggacttcctccccagaacccggagctgtcgtgctcgtaggcggtttgagccctcctgtgcatgaagcgacccagcctgagccgacagaacgaaccgccagtcgacaagctccgcctcatattgagctgtccaacagcagccctgaccctatggccgaggcagagagaactaacgggcattcgccttcacagcctcgcgatgctctcggagactctctccaggtgcctgtaagccctagcagcaccacctcgtcgagatgttcctcaagagacggcgagttcactctcacaaccctcaaaaaagaggccaagtttgagctgagagcttttcatgaagacaaaaaaccatccaaactgttcgaggatgatgagcacgaaaaggagcaatactgcattagaaaggtcagaccaagcgaggagatgctcgagctggaaaaggagcgacgggagctcatccggtcacaagccgtgaaaaagaatcccggtattgccgctaagtggtggaatcctccgcaagagaagactattgaggaacagttggatgaggaacatctggagtcccataagaaatacaaggaacgtaaggaacgtcgagcccagcaggagcagctcttgctgcagaagcagctccagcagcagcagcagcagcctccatcgcaactctgcacagcccctgccagctctcatgagcgggcttcaatgattgacaaggccaaagaggatatcgtgactgaacaaattgatttctccgccgcaagaaaacagttccagttgatggaaaatagtaggcaagctgtcgctaagggacagtctactccaaggctcttcagtataaaaccattttataggccactagggtctgttaacagcgacaagcccctgaccaatccgaggcctcctagtgtcggcggtcctcctgaggactcaggtgcaagcgccgctaaagggcagaaatcaccgggtgcgctagagacccctagtgctgccggatctcaggggaacaccgcgtcccaaggcaaggaaggcccatactcagaaccaagcaagaggggtccgctgtcaaagctgtgggccgaagacggtgaatttacttctgctcgtgcagtgcttactgtcgttaaggatgacgatcacggcatcctcgaccagttttctcggtcagtgaatgtgtctttaacgcaggaagagcttgactcgggactggacgagctgagcgttcggtcccaggatacaacggtgttagagacattatcaaacgacttctctatggataacatttctgattccggggcatctaacgagaccaccaatgcactgcaggaaaattcactcgctgacttctctcttcctcagaccccacaaaccgataaccccagcgaggggagaggggagggagttagtaagagtttcagcgatcacggcttttacagcccatcgtcaaccctgggcgactctcctctggttgacgatcccttggagtaccaagctggactcctggtccagaacgccattcagcaagccatagctgaacaggtagataaggctgtcagcaagacctcaagggatggggcagagcaacaagggcctgaggccaccgttgaggaggccgaggcagctgctttcggaagtgagaaaccccagtcaatgttcgaaccccctcaggtatcaagtccagtgcaagaaaaaagagacgttctgccgaagatcctacctgctgaggacagggcacttcgcgagcgcggacctccccagcctctgcccgctgttcagcctagcgggcctatcaatatggaggagactcgaccggaaggctcctacttctctaaatacagtgaagcagccgaactcagatcgacagcctcgttgctcgcgacacaggaatccgacgtgatggtcggaccttttaaactgcgcagcaggaaacagaggaccctgagcatgatcgaggaggagattagggcggcacaggaacgagaggaggaactgaaaagacagagacaggtcttacagtctacacagagcccacggacaaagaacgccccaagtctgccatccagaacatgctataagaccgcacctggcaagattgagaaggtgaagccacctccctctcctaccacagagggtccctccttgcagccagacctagccccagaggaagccgctggtacccagcggccaaagaatctaatgcagaccctcatggaagattatgagacccataagtctaaacgcagggagagaatggacgattcctcagtgctagaggccacacgagtaaaccggaggaaatctgctcttgctctgagatgggaagccggaatatatgcgaatcaggaggaggaggataacgagtag

SEQ ID NO: 212885 - DNA, 3273 bp, Artificial Sequence
  Description of Artificial Sequence: Synthetic coding sequence
atggccgaggccgagctgcacaaggagagactgcaggctatcgcagagaagaggaaacgtcaaaccgaaatcgaaggaaaaaggcagcaattggacgaacaaatcctcctcctccaacatagcaagagcaaagtgctcagagagaagtggctgcttcagggcatccctgctgggactgccgaggaagaagaagccagacgaaggcagtccgaagaagacgagttcagagtgaaacagcttgaggacaatattcagcgtttggagcaggagatacagacacttgaaagtgaggagtctcagattagcgcaaaggagcagataatcctcgaaaagctgaaagaaacggagaagtcctttaaagatttccagaagggcttctcatctaccgacggtgatgccgtgaactacatcagctcccagctgccggatctgccaatcctgtgtagccgcactgcggagccttcaccaggccaggacgggacctctagagccgctggcgtgggatgggaaaacgtgctccttaaggaaggtgagagcgccagcaacgctacagaaactagtggcccagacatgactataaagaagcctccccagctcagtgaggacgatatctggttaaaaagtgagggcgacaactactcagccaccctgctggagcctgctgcttccagtctctctccagatcacaagaacatggagattgaggtgagcgttgcggaatgtaagtccgtgcctggcatcaccagtaccccccatccaatggaccacccgtccgcgttctactcaccgccacacaatggcctactgacagaccatcacgaatcactggataatgacgtcgcacgcgagataagatatctcgatgaggttttagaagccaattgttgcgacagcgcagtggatggtacttacaacgggacaagtagccccgagcccggtgccgtcgtgttggtcgggggattaagtcccccagtgcacgaagctactcagccagagccgaccgagcgcacggcttcccgacaagccccacctcacatcgagttgagcaatagtagtccagaccctatggctgaggcggaacgcacgaacggccactccccctcccagccgagagacgccctgggcgactctttgcaggtacctgtctcccccagcagcacgacatcatctagatgctcctcccgggatggggaatttacactcactactctcaaaaaggaagcaaagtttgaactaagggctttccacgaggacaagaagccatcaaaactctttgaggatgatgaacacgagaaggagcagtattgcatcagaaaagtcaggccatccgaagaaatgctggagctggagaaggagagacgtgaattaattcgctctcaggccgtcaagaagaatcccggaatcgctgcaaaatggtggaacccacctcaggagaaaacaattgaggaacagctcgatgaggagcacttagagagtcacaagaagtataaggagcgaaaggaaagaagggcccaacaggagcaactccttctacagaagcagcttcagcagcagcagcagcagcccccatctcagttgtgcacagcacccgcatcatcacatgaaagggctagtatgatagacaaggccaaggaagatatcgtgacagaacagattgatttcagcgccgctcgcaaacagttccaactgatggaaaactcaagacaggcggtcgccaaggggcagagcaccccacggctgttcagcatcaagcccttctaccgacctctagggtcagtaaatagcgacaagcccctcaccaaccccagacccccatcagtgggcggaccccctgaggactctggggcttcagcagccaaaggtcagaaaagccctggtgctctggaaacaccatccgctgctgggagtcagggcaacaccgccagccagggaaaagaaggaccttacagtgaacccagtaagagggggccattgtccaaactctgggccgaggatggagaatttacttcagctcgtgccgtgctcaccgtagtcaaagatgacgatcatggaatcctcgatcagttctctagatctgtaaacgtctcactgactcaggaggaacttgatagcggattggatgagctgagtgtcagatcacaggacacaaccgtgctcgagacgttgagtaacgacttcagcatggataatatcagcgactctggcgctagtaacgagacaactaacgccctacaggaaaacagcctggccgatttctctctcccgcagacacctcagacggacaatccctccgagggaaggggcgagggtgttagcaaaagcttctccgaccatggtttttacagcccctcatctacactcggcgatagccccttggtggacgatcccttggagtaccaagctgggctactcgtacagaatgcgattcagcaggcaatagcggagcaagtggacaaagcagtgtccaaaacctcaagagatggagcggagcagcaaggcccagaggctactgtggaagaggctgaggccgctgcgttcggaagcgagaagccccagtctatgtttgagccgccacaggttagttctcccgtgcaggaaaagagggacgtccttccaaagattctgcctgctgaggaccgggcactccgcgagaggggcccacctcaacccctgcctgccgtgcagccatccggaccgattaacatggaagaaacccggccagaaggctcgtactttagtaagtacagcgaagccgcagagctgagatccacagcttctctgctggccacacaggaaagcgatgtgatggtgggtcctttcaagctaaggtccagaaaacagagaaccctatctatgatagaggaagaaatccgggctgcccaagaaagggaagaggaattgaagcgtcaaagacaggtgcttcaatcaacccagagccccaggacaaagaacgccccatccctccccagcagaacctgctacaaaacagctcctggcaaaatcgaaaaggtcaaacccccacccagcccgacaaccgaggggccatccctgcaaccagacctggcccctgaagaggctgcgggaacacaaagaccgaaaaacctgatgcaaactctcatggaggattatgagacgcacaagtccaaaaggcgtgagcgcatggatgattccagcgtgctcgaggctacacgagtgaaccgcaggaagagcgctctggccctaagatgggaggcagggatttatgctaatcaagaggaagaagataatgagtag

SEQ ID NO: 212886 - DNA, 3312 bp, Artificial Sequence
  Description of Artificial Sequence: Synthetic coding sequence
atggcggaagccgagctacataaggagcggctccaagccattgccgagaagaggaagaggcagaccgagatcgagggaaaacgtcaacaattggatgagcagattctgcttcttcagcactcaaagtccaaagtacttcgcgagaaatggcttttgcagggcatcccggctgggaccgccgaagaagaagaagcgagacgtagacagagcgaggaggacgagtttagagtgaagcagctggaagacaacattcagcgacttgagcaggagatacagactctcgagtccgaagaatctcagatcagcgccaaggagcagattatactcgagaaactgaaggagactgagaagtccttcaaagactttcagaagggattctctagtaccgacggtgatgccgttaattacatctcctcccagttaccagatctccccattttatgtagccgaaccgccgagccaagccctggacaggatggtacctccagggctgccggagtggggtgggagaacgtgctgctcaaggagggtgagagcgcgtccaacgccactgaaacatctggcccagacatgacaattaagaagccaccccagctgagcgaggacgacatttggttgaagagcgaaggcgataattattcagccacactgttggagcctgccgctagctcactgtcacccgaccacaagaatatggagatagaagtttcggttgcggaatgtaagagcgtgcctgggattacgagcacaccccaccccatggatcaccctagcgccttttactcacctccccacaatgggctcctcaccgaccatcacgaaagtctggacaatgacgttgcacgggagatccgctatctggatgaagtgttagaagccaattgctgtgactctgccgttgacggcacatacaatggcacttccagccccgaacccggagctgtcgtactggttggcggtctgtcccctccagtgcacgaggccacccagcccgaacccaccgagcgcacagcatcgcgccaggccccaccccatatcgaactcagtaactcaagtccggaccccatggcagaggctgagaggacaaatgggcatagccccagtcagcctcgggatgcactgggtgatagtctgcaggtgcccgtttcgccctcttccactacatcatccagatgttcatctcgggatggtgagttcaccttaaccacactgaagaaggaggccaagtttgaactgcgggcttttcacgaggataagaagccctcaaagctcttcgaggacgatgaacacgaaaaggagcaatattgcattagaaaggtgcgtccatctgaagagatgcttgagctggagaaagagcgacgcgaacttattagatctcaggctgtgaaaaagaatcccggaatagccgctaagtggtggaaccccccacaggagaagacaatagaagagcaactggatgaagaacacctggagagccataaaaaatacaaggagcgcaaagagagaagggcacagcaagaacagctcttgttgcagaagcagctgcagcagcagcagcagcaaccgccatctcagctgtgcacagctccagcctcttcgcacgagcgtgcctccatgatcgataaggcaaaggaggatattgtgactgaacagatcgacttcagcgccgctcggaagcagttccagctcatggagaattctcgtcaggcggtggcaaagggccaatccacaccgaggctgtttagtattaaaccgttttaccggcctctcggatctgtgaattccgataagccactgaccaacccaaggcctccaagcgtgggcggaccgccagaggacagcggtgcatctgccgcaaaggggcagaaatctcctggagccctggaaacaccttctgctgctgggtcccagggcaacacagcctcacaggggaaggagggaccatactctgagccctccaagagaggccctctgagtaaactatgggctgaagatggggagtttacctccgctcgggctgttctgactgtggtgaaggatgacgaccacgggatcttagaccagttttccagatctgtgaatgtgtcactgacccaggaggagctggacagtggcctggatgaattgagcgtgagaagccaggatacaactgtgctggagaccctctcaaacgacttcagcatggataacatcagcgactcaggtgctagtaacgagacgacaaatgccttgcaagagaactctctcgccgacttcagcctgcctcagacgccacagaccgacaacccttccgaaggcaggggtgagggggtttccaagtcatttagcgatcacggcttctactctccgtcttccacgctgggggatagtcccttagtggacgatcccttggagtaccaggcagggcttctggtccaaaacgcaatccagcaggcaatagctgagcaagtcgacaaagccgtgagcaagactagccgggacggagccgagcagcaagggccagaagccacagtggaagaagcagaggcagctgccttcggcagtgagaagccacaaagtatgtttgaaccaccccaggtgagttcccccgtgcaggaaaagagggatgtcctccctaaaattttgcctgcagaagacagggccctgcgggaacgaggtccaccacaacccttacctgcggtgcagccctctggcccaattaacatggaggagacaaggcctgagggcagttatttcagcaaatattcggaggcagccgagctgcggtccaccgcttcattactcgccacccaggaatccgacgtgatggtgggaccattcaaactgcgtagcagaaagcaacggacattgagtatgattgaggaggaaatcagggctgcccaggaaagggaagaagaactcaaacgccagcgccaggtgctgcagagtacacagtctcctagaacaaaaaatgctccaagtttgccgagccgaacatgttataaaacggccccaggaaagatcgagaaggtgaagccacctcctagcccaactacggaagggccatccctccagcccgatctagcccctgaggaagccgctgggacacaaagaccaaagaacctcatgcagacgctcatggaggattacgagacccataaaagcaaacggcgagagcggatggatgacagctcctatacctccaaactcctgagctgtaaggtgacatccgaagttttggaggctacccgcgtgaaccgacgtaagtcagcgctcgctctccgctgggaggcagggatttacgccaatcaggaggaggaggacaatgagtag

SEQ ID NO: 212887 - DNA, 2886 bp, Artificial Sequence
  Description of Artificial Sequence: Synthetic coding sequence
atgagatggccccaacccggagcggcagccaggcttcctcccgagagccccggacccccagaatctccaggccctccagaaagggaggccgctgctgccaggcggtggacgggggctgagccacaggactgcgccccaggtagcggccgaccggaaaagcccccacagctcagtgaagatgacatttggctgaagagcgagggcgataactacagtgctaccttactcgagcccgcagcctctagcctgtcaccagaccacaaaaatatggagatcgaggtatccgtggctgagtgcaaaagtgtgcccggaatcacatcaactccccaccccatggaccacccatccgccttttacagtccgcctcacaatggtctgctgactgaccaccatgaaagcttggacaatgatgtagcacgagagatccggtatctggatgaagtactggaggccaattgttgcgacagcgccgttgacggtacttataacggaacaagctctcccgagcccggtgcagtggtgcttgttgggggactaagcccccctgtgcacgaggccacccagcccgaacccactgaaaggacggcttcacgacaagcacctccccatatcgagctgagcaacagcagccctgatccaatggccgaggcagagcggaccaacgggcacagtccctcccaaccccgagacgccctgggagactccctgcaagtgccagtgtccccatcaagcacaacctctagcagatgtagctcacgagacggcgagtttacactaacaaccctgaaaaaagaggcaaagtttgagctccgggctttccacgaggacaagaagccctccaagcttttcgaagatgacgagcacgaaaaggaacaatactgtattaggaaagtaagaccgtctgaggaaatgctcgaactcgagaaagaaaggcgtgagctcattagaagccaggcggtcaagaagaatcctgggatcgccgctaaatggtggaaccctcctcaggaaaaaacaatcgaagagcagctggatgaagaacacctggagtcccataagaagtataaggaacggaaagagcgcagggcgcaacaggagcaacttcttctacagaaacaactccagcagcagcagcagcagccaccctcccagctgtgtactgctcctgccagctcacacgagcgcgctagcatgatagacaaggccaaggaggacattgtcacggagcagatcgatttcagcgccgcaagaaagcagtttcagctgatggaaaattctcgacaggccgtcgctaagggccagagtaccccacgcctgttcagtatcaagccattttaccgtcctttagggagcgtgaattctgacaagccactcactaacccacggcctccaagcgtgggcggaccaccagaagactcgggcgcatctgccgctaagggccagaaatcacccggagctctggaaactccctcagcagccggttcccaaggcaatacggcgagccagggtaaagaaggcccttacagcgaaccgagtaagcggggacccctttcaaaactgtgggccgaggatggcgaattcacttctgctcgcgctgtgctgaccgtcgtaaaggatgatgaccacggaatccttgaccagttctcgagaagcgtcaacgtcagtctcacacaggaagaattggactccggactggatgagcttagcgtgcgtagtcaagatactactgtgctggaaacgctcagtaatgattttagtatggacaatatcagtgacagtggggctagcaacgaaaccacgaatgccctacaggaaaattctctcgcagatttttcactgcctcagaccccccaaaccgataaccctagcgaaggccgtggagagggcgtgagtaagagcttttcggatcatggcttttattctcctagttctaccctgggcgattctccactcgtggatgaccctctggagtatcaggcgggtcttctggttcagaacgccatccagcaggccattgctgagcaagttgataaagccgtatccaagacatcccgggatggcgctgagcagcaaggaccggaagccaccgtggaggaagcggaggcagctgccttcgggagtgagaagccccagtcaatgttcgaaccacctcaagtgagctcccctgtgcaggagaagcgcgacgtccttcctaagatcctcccagccgaggatcgcgctctgagagagcgcggaccgcctcagcccctcccagccgtgcagcctagcgggccaatcaacatggaggaaactagacccgagggctcctacttctcaaagtactctgaggccgctgaactgaggagcactgcttcactgctggccactcaggaatctgatgtgatggtgggacccttcaagctgcggtcacgcaaacagaggacccttagtatgattgaagaggagatccgtgccgctcaggaacgggaggaggaactgaaacggcagaggcaagttctccaaagtactcagtcccctcggaccaaaaatgctccttccctgccatccagaacttgttataaaacagcaccgggaaagatcgaaaaagtcaaacccccaccttctccaacgaccgaaggcccatctctgcagcctgacctggcgcctgaggaagccgctggtacgcagaggcctaaaaacctgatgcagacactgatggaagactacgagactcataaaagcaaacggagggaacgtatggacgactcatcatacaccagcaaactgctaagttgcaaggttactagtgaggttctggaagccacaagggttaatcggcgaaagagcgctctggcgttgcgatgggaggccggtatttatgctaaccaggaggaggaggacaacgagtag

SEQ ID NO: 212888 - DNA, 2565 bp, Artificial Sequence
  Description of Artificial Sequence: Synthetic coding sequence
atgatggcctatagtgatacaaccatgatgtctgacgatatcgactggctgcggagtcaccggggagtatgtaaagtggatttgtataaccctgagggccaacaggaccaggaccggaaggtgatatgttttgtggatgtaagtacgttgaacgtggaggacaaagattataaagatgcagcatcctcgtcctccgagggcaatttaaatttgggctctctcgaggagaaggaaattatcgtcatcaaggacacagagaaaaaggaccagtccaaaaccgagggatctgtctgcctcttcaagcaggctccgtctgatccagtgtcagttctcaactggctgctctctgatcttcaaaagtacgcactgggatttcagcacgccctgtccccttccaccagtacatgtaagcacaaggtgggagataccgaaggggaataccacagggcgtctagcgagaactgttactccgtttatgcggaccaagtgaatatcgactatctgatgaatagaccgcagaacctccgactcgagatgacagccgctaagaacaccaacaataaccagtctcctagcgctccccctgccaagcccccttccacccagcgcgctgttattagtcctgacggggagtgttcaattgacgacctgtctttttacgttaatcggttgtcctcactggtcatccaaatggcacataaagaaatcaaggagaagttagaggggaagtccaagtgcctccatcactcgatttgtccatctccaggcaataaagagagaatttctccccgaaccccagcttctaagatcgcctctgagatggcttacgaagccgtggaactgaccgcagccgagatgagggggaccggcgaggaaagccgagaagggggacagaagtcctttctttattccgaactgtctaataaatcgaaatctggcgacaaacagatgtcccagcgagagtctaaagagtttgcagattctatctctaagggtttgatggtctatgctaaccaggtggccagtgacatgatggtttccctaatgaagacactaaaggtgcatagctcaggaaaacccattccagccagcgtggtgctcaagcgcgtgctcctgagacataccaaggagatcgtgagtgatctcatagatagctgcatgaagaatctccacaacataacaggcgttctgatgaccgacagcgacttcgtgagtgctgtcaaacgaaacctcttcaatcagtggaagcagaacgcaaccgacattatggaggctatgctgaagagactggtcagcgctcttatcggagaggagaaggaaacaaagtcccaatctctatcatacgctagcctaaaggcaggctcgcatgatccgaaatgtcgaaaccagagtcttgagttctcgacgatgaaagccgagatgaaggagagggataaaggtaagatgaagagcgatccatgtaagagtttgaccagcgctgaaaaggtaggtgaacatatcctgaaggagggccttaccatttggaaccaaaagcaagggaactcctgcaaagttgccactaaggcctgctcaaacaaagacgagaaaggcgagaaaatcaacgctagcaccgactcgctggcgaaggacctgatcgtttccgccctgaagttgatacagtaccacttaactcaacaaaccaaagggaaagatacttgcgaggaggattgccccggttctacaatgggttacatggcacaatcaacccaatacgagaagtgtgggggaggccagtccgccaaagccttaagtgttaagcagttagaatctcacagagcccctggacccagcacatgtcagaaggagaaccagcaccttgattctcagaagatggacatgagcaatattgtgctcatgctgattcaaaaattgctcaatgagaaccctttcaagtgtgaggatccatgtgaaggcgaaaataaatgcagcgagccccgtgcttcaaaagctgcatcaatgtccaacagatccgataaagctgaagagcaatgccaagaacaccaggaactggattgcacgtcaggaatgaagcaagcaaatggtcagttcatcgacaagctggtagagtcagtgatgaaactgtgcctgattatggccaaatactctaacgatggggctgccctggccgaactggaagagcaggctgcatctgcaaacaagcctaactttaggggaacccggtgcattcactccggagctatgccccagaactaccaggacagtctcggccacgaggtgattgtgaacaaccagtgctccacaaactccctccagaagcagttgcaggcggtgctccaatggattgccgctagccagttcaacgtgccaatgttgtattttatgggcgacaaggacggccagctggagaaactcccccaggtatccgcaaaagccgcagaaaagggctattctgtggggggtctacttcaggaagtgatgaagttcgccaaggaacggcagccggacgaggccgtgggaaaagtggccaggaaacagctgctagactggttgctggcgaatttgtag

SEQ ID NO: 212889 - DNA, 2538 bp, Artificial Sequence
  Description of Artificial Sequence: Synthetic coding sequence
atgtccgacgatattgactggctaagatcccatcggggagtgtgcaaggtggacctgtacaaccccgagggccagcaggatcaggatcggaaagtcatctgtttcgtggacgtgtcaactctgaacgtggaagacaaggattataaagacgcagcttctagctcgagtgagggaaacctgaatttgggatccctggaagagaaagaaatcatcgtcatcaaagatactgaaaagaaggatcagagtaagactgaaggtagtgtgtgcttatttaaacaggcgccttcagaccctgtgagtgttctaaattggctcctttccgatctgcagaagtacgctctgggattccagcatgcactatctccttccacgtccacatgtaaacacaaagtaggcgacaccgagggagagtatcatcgtgccagcagcgaaaactgttattcggtgtacgcggaccaggtgaatatcgattaccttatgaatcgtccacagaatctaaggcttgagatgaccgccgctaagaataccaacaacaaccagagcccaagtgcccctccagcaaagcccccaagcactcagcgagccgtgatctcaccagatggagagtgctctattgacgatttgtcattctacgtcaaccgcctctcttcactcgtgatacagatggcccataaggagatcaaagagaaactggagggcaagtccaagtgtctgcaccacagcatctgtcccagcccaggaaataaagaaaggatctcgccccgaactccagcgtccaaaattgcatctgagatggcatatgaagcggttgagcttaccgccgcagaaatgcgaggaactggtgaagagtctcgagagggtggccagaaaagtttcctgtatagtgagctgagtaataagtctaagtctggtgataagcagatgagccagcgggagagcaaagaatttgccgatagcatctctaaggggcttatggtgtacgctaatcaagtggcctccgatatgatggtttcactgatgaagactttaaaggtgcacagcagcggcaagcctatccccgcatctgtggtgctgaagcgagtccttttgagacacacgaaggagattgtgagcgacctgatcgacagctgtatgaaaaacctgcacaacattactggggttctaatgaccgactccgatttcgtgtctgccgtcaaaaggaacctctttaaccagtggaagcaaaacgccaccgacattatggaggccatgctgaagcgactggtgtcagcgctgataggagaggagaaggaaactaagagtcagtcgttatcctacgcgtccctgaaggccggatcccacgacccgaaatgccggaatcagagcctggaattctctacaatgaaggccgagatgaaagagcgcgacaaaggcaaaatgaagtcagatccatgcaaaagtttgaccagcgctgagaaagtgggcgaacacatcctcaaggaaggtttgactatatggaaccagaagcagggtaactcctgtaaagtcgcaacaaaagcttgctctaacaaggacgaaaaaggggagaagatcaacgcctctacggactcactggccaaagacctcattgtttcagctctcaagctcattcaatatcatctgacacagcagacaaagggaaaggacacttgcgaagaggattgcccagggtctactatggggtatatggcccagagcacccagtatgagaaatgcggaggcggtcaatccgcaaaagctctttccgtaaagcagctggagagccacagagcccctgggccttcaacttgccagaaggaaaaccagcatcttgactctcaaaagatggacatgtccaacatcgtactgatgctaattcagaaactgttaaacgaaaatccattcaaatgcgaggatccatgtgaaggcgagaataaatgctccgagccgcgtgcgtctaaagccgcttcaatgtcaaatagaagcgacaaggctgaggagcagtgtcaggagcaccaggagctggattgtaccagtggaatgaaacaggctaacgggcaatttattgacaagctggtcgaatcagtgatgaagctgtgcctgattatggccaagtactcgaacgatggggctgccctagcagagctggaggaacaagccgcttccgcaaacaagcccaacttccgcggtacaagatgcatccatagcggcgcaatgcctcaaaactatcaggattctttgggccatgaggtgatcgtgaacaatcagtgtagtacaaacagccttcagaaacaactccaggctgtattgcagtggatcgccgctagccagtttaatgttccaatgctctactttatgggtgataaagacggccaactcgaaaagttgcctcaggtcagcgcaaaagcagctgaaaaggggtacagcgtgggaggcttattgcaggaagtaatgaagtttgctaaagagaggcaacctgatgaagcagtagggaaggtcgccagaaaacaactgctcgactggctgcttgccaacctgtag

SEQ ID NO: 212890 - DNA, 1416 bp, Artificial Sequence
  Description of Artificial Sequence: Synthetic coding sequence
atgtcagatgacatcgactggttacgaagccatcgaggtgtatgcaaagtcgacctgtacaatcctgaaggccagcaggaccaggaccgcaaggtgatatgctttgtcgatgtttctacacttaatgtggaggacaaggattataaggatgccgcttcttcaagttccgaaggcaatctgaacctgggctcgctagaggagaaagagataatagttatcaaggatactgaaaagaaggatcagtctaagactgaaggttctgtttgcctcttcaaacaggctccaagcgatcccgtttctgtgttgaactggctgctctcagatcttcagaaatatgccttagggttccagcatgccctgtccccttccacaagcacgtgtaaacataaggtcggcgataccgagggggagtaccacagggcctctagtgaaaattgttattcagtctatgctgaccaggtgaacatcgattatcttatgaatcggcctcagaacctgcggctagagatgactgctgcgaagaacacaaataataaccagaatacctgtgaggaagactgccctggttcaacgatgggttacatggcccagtcaacccaatacgaaaaatgcggtggtggacagtcagccaaggccttgtctgtgaagcagctcgagagtcacagagcaccaggtccttcaacctgccagaaggagaaccagcacctagactctcagaagatggacatgtcgaatatcgtgctcatgctaatccagaaactgctgaatgagaatcctttcaaatgcgaggacccctgtgaaggtgagaataaatgtagcgagccgagggcctcaaaagcagctagtatgtctaacaggagcgataaggccgaagagcaatgccaggaacaccaggagctcgactgcaccagcggcatgaaacaggctaacgggcagttcatcgataaactcgtcgaatctgtgatgaaactttgcctcatcatggcaaaatattcaaacgatggagccgctctcgctgaactagaggagcaggctgcttccgcgaacaagcctaattttagaggtactagatgcattcacagcggtgctatgccccagaactatcaggacagcctgggacatgaagtcattgtgaataatcaatgtagcacaaattctctgcagaagcagctgcaagcagtcctgcagtggattgccgcatcacagtttaacgttccaatgttatactttatgggggataaggatggccaactagagaagctgcctcaagtgagtgccaaagcagctgaaaagggctattccgtgggagggctcctacaggaagtcatgaagtttgctaaggaacggcaacctgacgaggctgtcggcaaggtggccaggaagcagctcttggattggctgctggccaacttatag

SEQ ID NO: 212891 - DNA, 2538 bp, Artificial Sequence
  Description of Artificial Sequence: Synthetic coding sequence
atgtccgatgatatcgactggctaagatcccatcggggagtgtgcaaagtcgacctttataaccctgagggccagcaggatcaagatcggaaggttatatgcttcgtagacgtaagcactctcaatgtcgaggataaggactacaaggacgccgcatctagcagttctgagggaaacctcaatcttggctccctagaagaaaaagagattattgtcattaaggatactgagaaaaaagatcaatcaaaaaccgaaggctccgtctgtctgtttaaacaggcaccgagtgaccctgtgagtgtcctgaactggctgctgtccgacctacaaaaatatgccctgggattccagcatgccctttcaccctccacatccacttgcaaacacaaagttggggacactgaaggggaataccatcgggctagctccgagaactgctactcagtctacgccgaccaggtcaacattgattacctaatgaaccgcccacagaaccttaggcttgaaatgacggcggctaagaacactaacaacaatcaatctccttccgccccacccgcaaaaccacccagcacccagcgcgcagtgattagtccagacggagagtgctctatcgacgacctctcgttttacgtgaacagactctcttcactggtgatacagatggcccacaaagagatcaaggagaagttagaaggcaagtcaaaatgtctccatcactctatatgccctagtccagggaataaagagaggatatctcccagaacgcccgctagtaaaattgctagcgaaatggcctatgaagcagtggaactgaccgcagcagagatgcggggaaccggcgaggaaagccgggagggtgggcagaagagcttcttatattctgagctgtccaacaagagcaaatccggagacaaacaaatgagccagagggagagtaaagagttcgccgactccatatcgaagggactgatggtgtatgccaatcaagtggcatcggatatgatggtgagtctgatgaagaccctgaaggttcacagctctggaaagccaatccctgcctcagtcgttctgaagcgagtactgttaaggcataccaaggagattgtgtctgacctgatcgattcctgtatgaagaacttgcacaatatcacaggcgtcctgatgaccgatagtgatttcgtgagtgccgtgaaacgcaacctgtttaatcagtggaaacagaatgcaacagatattatggaggcgatgctcaaacgactggtgtccgctctaattggggaagaaaaagaaaccaaatcacaatccttgtcttacgcctctttgaaagccggaagccatgaccctaagtgcaggaatcaaagtctggaattctctacgatgaaggccgagatgaaagaaagggataagggcaagatgaaatctgacccctgcaagagtctgacaagtgcagaaaaggtaggtgagcacatactaaaagaggggctcactatctggaaccaaaaacaaggcaacagctgtaaggtcgcaacaaaagcatgctccaacaaagacgagaagggggagaaaattaatgctagcaccgatagtctggcgaaggatctgattgtgagcgctcttaagctgatccaatatcacctgactcagcaaactaagggcaaagatacttgcgaagaagactgtccaggctctacaatggggtatatggctcaaagcacccagtatgaaaagtgcggaggcggacagagcgctaaagcactgtccgtgaaacaactggagtcacacagagcccctggcccatctacatgtcagaaggagaaccagcacctcgacagtcagaagatggacatgagcaatatcgtgctgatgcttatacagaagttgctgaacgagaacccattcaaatgtgaggacccatgtgaaggtgaaaacaaatgcagtgagcctcgggcatctaaggccgcaagcatgtcaaaccgctccgacaaggcagaagagcagtgtcaggagcaccaggaactcgattgcacgtccgggatgaaacaggctaatgggcaatttattgacaaactggttgagagcgtcatgaagctgtgtctaattatggccaaatatagtaacgatggagcagccttagctgaactggaggaacaggcagctagtgccaataagccaaactttaggggcacaagatgcatccactccggagccatgccacagaactaccaggattcactcggacacgaggtgatcgtgaacaatcaatgttctaccaacagcctgcagaagcagctacaggcggtgctgcagtggatcgcagcctcgcagttcaatgttcccatgctttactttatgggggataaggacgggcagctggaaaagctacctcaggtcagtgcaaaggccgcagagaagggttactccgtgggaggattgctgcaagaggtcatgaagttcgctaaggaaaggcaacctgatgaggctgtggggaaggtggcacgcaagcaactcctggattggctgctggcaaatctctag

SEQ ID NO: 212892 - DNA, 765 bp, Artificial Sequence
  Description of Artificial Sequence: Synthetic coding sequence
atgtcagatgacattgattggttgcgatcccaccgtggcgtgtgcaaggtagacctttataatcccgagggccaacaggatcaggacaggaaggtgatttgctttgtggacgtgagcaccctcaacgtggaggacaaggactacaaggatgccgcttcgagctccagcgaagggaatcttaacttgggaagtcttgaagaaaaggagatcatagttataaaagatacagaaaagaaggaccagagtaagactgaagggagtgtgtgcctgttcaaacaggccccaagcgacccggtgtccgttctgaattggcttttatctgacttgcagaaatacgctttgggatttcagcacgccctctcacccagtacaagtacttgcaagcacaaagtcggggacacagagggagagtatcaccgcgcaagcagtgaaaactgctacagtgtctacgccgatcaggtcaacattgattaccttatgaatcgcccacagaatctacgcctggagatgactgccgcaaaaaatacaaacaacaatcaatcgccttctgccccacccgctaagcctcccagtactcagagggctgtaatctcacctgatggtgagtgtagtatcgacgatctaagcttctatgtcaacagactttccagcctcgttattcagatggcccacaaggaaatcaaggagaaactggaaggtaaatccaagtgcctccaccactctatctgcccctcccctggtaataaggagcgtatctcgccctag

SEQ ID NO: 212893 - DNA, 642 bp, Artificial Sequence
  Description of Artificial Sequence: Synthetic coding sequence
atgtccgacgacatcgactggttgagatcccatagaggagtgtgtaaagtggacctctataatccggagggacaacaagatcaggaccgtaaggttatctgctttgtggatgtctcgaccctcaacgttgaagataaggattacaaagatgccgcttcgagcagttctgaaggaaacctgaacttaggatcactcgaagagaaagagatcattgtgatcaaagatacagaaaagaaggaccagagtaaaaccgagggttctgtctgtttatttaagcaagcaccaagcgacccagtgtcagttttaaattggctgctctccgaccttcagaaatacgcattaggctttcagcacgccctatcaccgagcacatcaacctgtaaacacaaagtgggcgatacggaaggcgagtaccatagggcatcatctgagaattgctatagcgtctatgccgaccaggtgaacatagattatttaatgaacagacctcagaacctgcgcctggagatgacagcggcaaagaacacaaacaataaccagaatacctgcgaggaagactgccccggatctacgatgggatacatggcacagagtacccaatatgagaagtgtggcggtggacagagtgccaaggctctttag

SEQ ID NO: 212894 - DNA, 552 bp, Artificial Sequence
  Description of Artificial Sequence: Synthetic coding sequence
atggacaactgcctggcagctgctgctttaaacggcgttgataggcgttctctgcagagatctgctcggctggccctggaggtcctggagcgcgctaagaggagagctgtggactggcatgcgctcgagaggcccaaggggtgcatgggcgtgctggccagagaggcgcctcacctcgaaaagcagccagccgcaggcccacaaagagtgctgcccggagaaaagtactatagttctgtgcccgaggaaggaggagcaactcacgtgtacagatatcaccggggtgagtccaagctgcacatgtgtctggacatcggcaacgggcagcggaaagacaggaagaagacctcactcggcccaggcggatcttatcaaattagcgagcatgcgccagaggctagtcaaccagccgagaacatctctaaggacttgtatattgaggtgtaccccggaacttattccgtaacagtaggtagcaacgatttgacaaaaaaaactcacgtggtggccgtggactccggccagtcagtggacctcgtgtttcccgtgtag

SEQ ID NO: 212895 - DNA, 552 bp, Artificial Sequence
  Description of Artificial Sequence: Synthetic coding sequence
atggacaactgtttggccgctgcagccctgaacggtgtggatcggaggagccttcagagatccgctagactggcccttgaggtgttagagcgcgcaaagagaagagctgtcgattggcacgcacttgagcggccaaagggctgcatgggcgtgttagcgagggaagcgccacatctggaaaaacagccagccgcaggacctcaacgagtgctccctggagagcgtgaggagcgaccacccacacttagtgcatcttttcgtacaatggccgagtttatggactatacatcctcacagtgcggcaagtattatagtagtgtccccgaggaaggtggcgctactcacgtgtatcgatatcaccggggagagtctaaattgcatatgtgcctggatattggaaatgggcaggccgaaaacataagtaaggatctgtatatcgaagtttacccaggaacatacagcgtgactgtaggctcgaacgacctgaccaaaaagacacacgttgtcgctgtcgattcaggacagagtgtagatctcgttttccctgtgtag

SEQ ID NO: 212896 - DNA, 633 bp, Artificial Sequence
  Description of Artificial Sequence: Synthetic coding sequence
atggacaattgtcttgcagctgcagccttaaatggtgtggaccgtcggtcactgcagaggtcagccaggctggccttagaggttcttgaacgggcaaaaaggcgtgctgtggactggcacgccctggagagaccaaagggatgcatgggtgtgctggctagggaggcaccccaccttgagaagcaaccggcagctggaccccagcgcgtgctgccaggtgaacgcgaggagagacccccaaccctgtcagcctctttccgcaccatggccgagttcatggattacacctcgtcacagtgcggaaagtactattcgtctgtcccagaagaagggggtgcaacgcatgtttaccgctatcaccgtggagagagcaaactccatatgtgcttggacattggcaacgggcagcggaaagacagaaagaaaacatcactgggacctggcggatcgtaccagatttcggaacatgcgccagaagctagccagccagctgagaatataagtaaggacctttacatcgaagtttatcctggaacttattctgttactgttggttcaaatgatctcacgaagaaaacgcacgtggttgccgttgactccggacaatcagttgacttggtatttccagtttag

SEQ ID NO: 212897 - DNA, 552 bp, Artificial Sequence
  Description of Artificial Sequence: Synthetic coding sequence
atggacaattgtctcgccgcagccgcactgaatggggtggatagacgcagcctacagcggtcggccaggctggcgcttgaggtcctggagcgtgcaaagcgcagagcggtggattggcatgcactggagcgcccaaagggatgtatgggcgtgctagccagagaggccccacatttggagaaacaacctgccgcaggtccccagcgtgtattgcccggagaaaagtactatagctccgtgccagaggagggcggagccacacacgtctacaggtaccatcgcggagaatcaaagcttcacatgtgcctggatatcggcaacggtcagcgcaaggatagaaaaaaaacaagtcttgggcctggcggtagctatcagatcagtgaacatgccccagaggcctcccaaccagccgaaaacatcagcaaggacctgtacatagaagtgtatccaggcacctattccgtcaccgtgggcagcaacgacctgactaaaaagacgcatgtggtcgccgtcgacagtgggcaatctgtcgatctggtgttcccagtgtag

SEQ ID NO: 212898 - DNA, 633 bp, Artificial Sequence
  Description of Artificial Sequence: Synthetic coding sequence
atggataactgtctggcggctgctgccctcaacggggtggatagacgctcactgcagaggtccgcaaggctggccttagaagtgctggagagggcaaagagaagggctgttgactggcatgcgctggagcggcctaagggatgcatgggagtcctggctcgagaagcgcctcacctggagaaacaaccggctgctggccctcagagggtcctgcctggtgagagggaggaacgccctccaacattaagtgcctcctttcgtaccatggcagagttcatggactatacatcctcacagtgcgggaagtactacagctctgtgcccgaggagggcggagcaacccatgtctatcggtaccataggggggaaagcaaattgcatatgtgcctagatattggtaatggccagcgcaaagacagaaagaagaccagcctgggcccaggaggatcctaccaaataagcgagcacgcacccgaagcctcccaacctgccgagaatatatccaaggacctttatatcgaagtctatcccggtacgtatagcgtcacagtggggagtaacgacttgaccaaaaaaacacacgtggtcgcagtggattccggccagagcgtggacctggtgtttcccgtatag

SEQ ID NO: 212899 - DNA, 1479 bp, Artificial Sequence
  Description of Artificial Sequence: Synthetic coding sequence
atgggtttccaaagaaggttcttccatcaggatcagtccccagtcggcggactcacagccgaagatatcgagaaggccaggcaagcaaaagcgagaccagagaacaagcaacataaacaaaccctgtccgagcatgcccgagagagaaaagtgccagtgactaggatcggcaggctcgccaattttggcggactagcggtcggacttggattcggagctttggcggaagtggcaaagaaatcattacgaagtgaagatcccagcggcaagaaggccgtgctcggatccagtcctttccttagtgaagccaatgctgaacgcattgttagaactttatgcaaggttaggggagccgctctgaagctgggtcagatgctcagcatccaggatgatgcctttataaacccacacctcgccaaaatctttgagagagtgcggcagtccgccgacttcatgccactgaagcagatgatgaaaacgctcaataatgatctcgggccaaattggagggacaaactcgagtattttgaggaacgacctttcgcagccgcttcaatcggacaggttcacttggctcggatgaaaggcggaagagaagttgctatgaagatccagtatcccggagtcgcccagagtattaattcagatgtgaacaacctgatggcggtgcttaacatgtctaatatgctgcccgagggactgttccctgaacacttaatcgatgtgctgagacgcgaattggccctcgagtgtgactatcaaagagaagccgcatgtgctcgcaagtttagggacctgctgaagggccaccccttcttttatgtccccgagattgttgacgagttgtgttctccccacgttttgacaactgagctcgtaagtgggtttcctctggaccaggccgaggggctgagtcaagaaatccgcaatgaaatctgctataatatcttggtgctgtgcttgcgggagctgtttgaatttcatttcatgcagaccgacccaaattggagtaacttcttttatgatccacagcagcacaaagttgccctgctcgattttggtgctactcgggagtatgataggtcgtttacggatctgtacattcaaatcatcagagccgcagccgatagagaccgggaaacagtccgggctaagtccatcgagatgaaatttcttacagggtatgaagtaaaagttatggaggacgcccacctggatgcaatccttatcctgggcgaagcctttgcctcggacgaacctttcgattttgggactcagtccaccaccgaaaaaattcataacttgatacccgtcatgctcaggcataggctagtccccccacccgaggagacatattccctgcatcggaagatgggcggtagtttcttgatctgcagcaaactgaaggctaggttcccctgcaaagccatgttcgaggaggcgtattcaaactactgcaagcgacaggcccagcaatag

SEQ ID NO: 212900 - DNA, 1719 bp, Artificial Sequence
  Description of Artificial Sequence: Synthetic coding sequence
atggctgccatactcggggataccatcatggtagccaaaggtctggttaagctgacacaggccgcagtggaaacccacctgcagcacctcggcatcggcggtgagctgatcatgggcccagcccctgcatatgtggcgagtggccctttcagggaagccggttttcctggtcaggcttcatcacctctgggccgagccaacgggaggctgttcgctaacccacgcgactcctttagtgccatgggctttcagcggcgtttctttcaccaagaccaaagccctgtcggagggttgactgctgaggacatcgagaaggcaaggcaggctaaagctaggcccgagaacaagcagcataagcagaccttgagcgagcatgccagagagagaaaggtccccgtcactaggattggcaggctcgcaaatttcggcggtctggctgtgggtcttggattcggcgctttggcagaagtagctaaaaaatcgctcaggtctgaggacccttctggcaagaaggctgtgctgggcagttcaccttttctctccgaggccaacgcagaaaggatagtgagaacactctgcaaagtacggggtgcagccctgaagctcgggcagatgctgagcattcaggacgatgctttcatcaacccacatcttgccaaaatttttgaacgggtgcggcaaagcgctgattttatgcccctgaaacaaatgatgaagactctgaataatgatctggggccaaattggcgtgacaagctagaatacttcgaggagcgtccttttgccgctgcttctatagggcaggttcacctggctagaatgaagggagggcgtgaagtcgccatgaagatccagtatcctggcgttgcccaaagtataaacagcgatgtgaataacctgatggctgtacttaacatgtccaacatgctaccagagggtcttttccctgagcatctgattgacgtcctgcggcgagagctcgcccttgaatgcgactaccaaagggaagctgcctgtgcccgaaaattccgggacctgctgaaggggcaccctttcttttatgtccccgaaatcgtcgacgagctttgtagtccccacgtccttaccaccgaacttgtgagcgggttccccctggaccaggccgaagggcttagtcaagaaattcgcaacgaaatatgctacaacatattagtcctctgtctgagggaactatttgagttccacttcatgcaaactgatccaaattggtccaattttttctacgacccacagcagcataaagtggccttgctcgacttcggtgctactcgggaatacgataggtcttttacagatctgtacattcaaattattcgcgctgcagccgacagggatcgtgagaccgtcagggcaaagtctatagagatgaaattcttgacgggctacgaggtcaaagtgatggaagacgcccacctggacgccatcctcatactgggggaagcgttcgcatcagatgagccttttgactttggcacacagtcaacaacagagaaaatacacaacctgatcccagtgatgctgaggcatcgccttgtgccgcctccagaggagacatattcgttgcatcgaaaaatgggagggagttttctgatctgcagcaaacttaaggcacgctttccctgcaaagctatgtttgaggaggcttattccaactactgtaaaaggcaggcccagcagtag

SEQ ID NO: 212901 - DNA, 1944 bp, Artificial Sequence
  Description of Artificial Sequence: Synthetic coding sequence
atggctgccattctcggcgatactatcatggtggccaagggcctcgtcaagctgacgcaggccgcagtagagacacatctgcagcacctggggattgggggagagctcattatggccgctcgggctctgcagagtacggcggtggagcaaattgggatgttcctcggcaaggtgcagggccaggataaacacgaggaatattttgccgaaaactttggtgggccagagggagaatttcacttctctgtcccgcatgctgccggtgcatcaactgatttctcatcagccagcgcacctgatcaatctgcaccacccagcctggggcacgctcatagtgaaggtcctgcacccgcttacgtggcgtccggaccatttcgggaggctggatttcctggccaggcctcctctccactgggcagggccaatggcaggttattcgccaacccgagggacagcttttctgccatgggattccagcggcgtttcttccatcaggatcaaagtcccgtaggagggctcacagcggaagatatcgagaaagctagacaggcaaaggcccgacctgagaataaacagcacaaacagaccttgagcgagcatgccagggagaggaaagtccctgtgactagaatcgggagactcgccaactttggtgggctggcagtaggccttgggttcggcgctctggccgaggtggccaaaaaatcccttagaagtgaggacccttcggggaaaaaggccgtactggggagtagcccatttctgagtgaggccaacgctgagcggatcgtccgcactctctgcaaggtgcgcggagcagctctaaaactagggcaaatgctctccattcaagatgacgctttcatcaatcctcatcttgcaaagatattcgagcgggtacgacagagtgccgactttatgcctctcaagcaaatgatgaaaacactgaataatgacttaggccctaactggagagataagctggagtacttcgaagagcggccattcgccgcagcttctattggacaggtgcacctcgctagaatgaaggggggaagggaagtggccatgaaaatacagtatccgggagttgcccagtctattaatagcgatgttaataacctcatggctgtgctgaacatgtctaacatgctaccggagggtctgttcccagaacatctgatcgacgttcttagacgcgagttagcgctagaatgcgattatcagcgagaggccgcttgcgccagaaaatttagagatttgctcaagggccaccctttcttctatgtccctgagattgtcgacgagctttgtagtccgcacgtccttaccacggaactggtctctggctttcccctggaccaggccgaagggttaagtcaagagattcggaatgaaatctgctataacatacttgtactgtgtttgagagaactgtttgagttccactttatgcagaccgatccaaattggagcaattttttctatgatccgcagcaacataaggtggccctgcttgattttggcgcaacaagggagtacgatcggagcttcacagatctgtacatccagattatccgggctgctgcagatagggaccgagaaacggtgcgcgctaagtctatagagatgaagttcctgaccggttacgaggttaaagtcatggaagatgcacacttggacgcgattctgatcttaggcgaagcattcgcatcggatgagccttttgatttcggtacacagtccacaactgagaaaatccataacttgatccctgtgatgctcagacatcgtctggtgcctccaccggaagagacatattctctgcacaggaagatggggggaagtttcctcatctgttccaaactgaaggctaggtttccatgtaaggccatgtttgaagaagcctacagcaactactgcaagcgccaggcccaacagtag

SEQ ID NO: 212902 - DNA, 1788 bp, Artificial Sequence
  Description of Artificial Sequence: Synthetic coding sequence
atgttcctgggtaaggtgcagggacaggataagcacgaagaatactttgctgaaaacttcggcggaccggagggggagtttcatttctctgtacctcacgctgccggtgctagtactgacttctctagcgcctccgcaccggatcagtctgccccaccctccctgggccacgcacattcagagggacccgctcccgcttacgttgcctctggcccttttcgagaagcaggattccccggacaggcctctagtcctttagggagggccaacggaagactattcgcaaaccctagggattcattcagcgccatgggctttcagcgtaggttttttcaccaggatcaatctcctgtggggggactaacagccgaggacattgaaaaggcaagacaagccaaagctcgaccggagaataagcagcataaacagacgctgagcgagcatgcaagggagaggaaggtacccgttacgcgaatcggtcgtttggccaacttcggcggattagccgtcgggttagggtttggtgccctggctgaagtagctaagaagtcgctgagatctgaggacccatccggtaagaaggcagtcctgggatccagtccgttcctctccgaagcaaatgccgagagaattgtcagaacgctctgcaaggtgagaggtgcagctttgaagctggggcagatgctctctattcaggatgacgcttttatcaacccacatcttgccaagatatttgaacgcgtgcggcaatcagctgatttcatgcctctcaaacagatgatgaaaaccctcaataatgacttaggaccaaattggagagataagctggagtacttcgaggagaggccgttcgccgctgcctccatcggccaggtgcatctggctagaatgaagggcggtagagaggtcgcaatgaagatacagtatccgggagtggctcagtcgatcaactcagacgtgaacaatctcatggccgtgctcaacatgagcaatatgttgcccgagggcttgtttcctgagcacctgattgacgtcctgcggagagagttggccctcgagtgtgattatcagagggaggctgcatgcgcccgaaaatttcgtgacctcttgaagggccacccattcttctacgtgccggaaatcgtagatgaactttgttcacctcatgtactcacaactgagctggtgtcagggtttcctttggatcaggctgaaggcctgtcccaagagatcagaaatgagatctgttacaacatcctggtgctgtgcttaagggagttgtttgaatttcactttatgcaaactgaccctaattggagtaattttttttacgatccccaacagcacaaggtcgctctcttagactttggagccaccagggaatacgaccgaagtttcactgatctgtatatccagatcatccgtgctgccgctgatcgcgaccgggagactgtcagagcaaagagcatcgagatgaagttcctgacggggtacgaggttaaagtaatggaggatgcacatctcgatgcaatcctcattctaggggaggctttcgcctcagatgaaccattcgatttcggaactcaaagcaccaccgaaaagatccacaacctgatcccggtcatgctgcgtcatcgtttggttccaccccctgaggagacatacagtctccacaggaaaatggggggatcgttccttatctgcagtaagctgaaagctcgctttccttgcaaagcgatgttcgaggaagcctacagtaattattgcaaaagacaggcacagcagtag

SEQ ID NO: 212903 - DNA, 1944 bp, Artificial Sequence
  Description of Artificial Sequence: Synthetic coding sequence
atggcggctatcctgggtgacacaatcatggtggcgaagggcctggtgaaattgacccaggctgcagttgagactcatctccagcatctgggaattgggggagaactgatcatggccgctcgggctctgcagagcaccgccgtagaacagatcggaatgttcttggggaaggtgcagggccaagataagcatgaagaatattttgctgaaaactttggtggcccagaaggagaatttcacttcagtgtcccccatgcggcaggtgccagcactgatttcagttctgcgtccgctcctgaccaaagcgcccctcctagtctgggacacgcgcactccgaaggacctgctcccgcttacgtggcctctggccctttccgcgaggccggattcccaggtcaggcatcaagcccactgggcagggccaacggacgattgtttgctaacccacgggatagtttcagcgcgatgggcttccagcgcagattctttcatcaggaccagagcccggttggcggactcacagcagaggacatcgaaaaggccaggcaggccaaggccagacccgaaaataagcaacataagcagaccttgagcgagcacgctagggagcggaaagtcccagtgacccgcattggcagactggccaatttcggtgggttagccgtgggcctcgggtttggcgctctcgccgaagtagcaaagaagagtctgcgttccgaagaccctagtggtaaaaaagcagtccttgggagcagcccgttcctttccgaggccaatgcggaacggatcgtgcgaacgctgtgcaaggtgcggggagcagctctcaagttaggacaaatgctgagcattcaagatgacgcattcatcaatccacatctggctaaaatcttcgagcgagtgcggcagtcagctgactttatgcctctcaaacagatgatgaaaaccttaaataatgatctgggtccaaactggcgcgataagttagaatacttcgaggagcgccctttcgctgctgcgtccattggccaggtacatctggccaggatgaaggggggtagggaggtggccatgaaaattcagtaccccggagtcgcacagagtatcaacagtgacgtgaataacctgatggcagttctgaatatgagcaacatgcttcccgaaggattgttccccgaacacttgatcgatgttttacgacgggaactggccttggagtgcgactaccagagggaggcagcctgcgcaagaaagttccgcgaccttctgaagggacatccttttttctacgttccagaaattgtggacgaattgtgttcaccgcacgttctgacaactgaattagtgtctggcttccccttggatcaggccgaggggctctcgcaggaaatcagaaacgaaatttgttacaatattcttgttttatgcctccgggaactcttcgagttccacttcatgcaaacagaccccaattggagcaatttcttctatgatcctcagcagcataaggtggcattgctggactttggagcaaccagagaatatgataggtcctttacagatctgtatatccagatcattcgagcagccgctgacagggatagggagacagtgagggcaaaatcgatcgagatgaaattccttacgggctacgaggtcaaggtgatggaagacgcgcacctagacgcaatactcatattgggggaagccttcgccagtgacgaaccgtttgatttcgggacacaaagtacaaccgagaaaatacacaatcttatcccagtgatgcttagacacaggttagtaccaccacccgaggaaacctattccttgcaccgcaagatgggtgggtccttcctgatttgttctaagttgaaagcacgcttcccctgtaaggccatgtttgaagaggcttacagcaactattgtaagagacaggcccaacaatag

SEQ ID NO: 212904 - DNA, 1797 bp, Artificial Sequence
  Description of Artificial Sequence: Synthetic coding sequence
atggctgcacgcgctttgcaatccaccgctgtggagcaaataggaatgttcttgggtaaggtccagggccaggataagcacgaggaatactttgcagagaatttcggtgggccagagggcgagtttcattttagctctgcctctgcccctgatcagagcgcaccaccctccctcggtcacgcacattccgagggacccgctcccgcttatgtggcatccggcccttttcgggaagctggattccccggtcaagccagcagcccattaggccgagcgaacggacgattattcgcaaatccacgggactccttctcggccatgggattccagagacgattcttccaccaggaccagtccccagtgggaggcctgactgccgaggacatcgagaaggcacgacaagccaaggcgcgtccagagaataaacaacacaagcagacactctcagaacacgcacgcgaacgtaaggtgcccgtaacacgaatcggcagattggccaactttggcggactcgccgtgggcctgggtttcggggctctggcagaagttgccaagaaaagtctccggtctgaagatccaagcggtaaaaaagcagtcctcgggtccagcccattcctgtccgaggcaaatgccgagagaatcgtgagaactttgtgtaaggtccgcggagctgcactcaagctgggccagatgctgagcattcaggacgacgcgtttatcaatccgcaccttgctaagattttcgaaagagttcgccagtcggcggattttatgcctctgaagcaaatgatgaagaccttgaataacgacttaggaccaaactggagggataagctggagtacttcgaagaacggccattcgcggctgcctctattggccaggtgcatttggctcgaatgaagggtgggagggaggtcgcaatgaaaattcagtatccaggcgttgcccaaagtatcaatagtgacgtgaataatctgatggccgtgctgaatatgagtaacatgctccctgaaggcctgtttcctgagcacctgatcgacgtcctgaggagggaacttgctttggaatgcgactaccagagggaggccgcatgcgccagaaaattccgcgacttactgaaaggccatccctttttttatgtgcctgagattgtggacgagctatgctcaccacacgtcctgaccaccgaactggtaagcggcttcccactcgatcaggccgaaggcctgagccaggaaatccggaacgagatttgttacaacatcctggtgttgtgcctcagggagttattcgaatttcattttatgcagacagatcccaattggagtaatttcttctatgatccacagcagcacaaggtggccctgcttgactttggtgctacccgcgagtacgaccggtcatttacggatctgtacattcaaattattcgggctgccgcagaccgggaccgcgaaactgttagagccaaatccattgagatgaaatttcttacaggctacgaagtgaaagttatggaagacgcgcatctggatgcaattttaattctcggcgaggcttttgcttccgatgaaccgtttgattttggcactcagtcaactacggagaagatccacaatctcatacccgtcatgttgcggcatcggctggtgccgccacctgaagaaacatattcactgcacagaaaaatgggaggctctttcttaatttgttccaaattgaaagcaaggttcccgtgtaaggctatgtttgaagaggcctacagcaattattgtaagcgccaggcacaacagtag

SEQ ID NO: 212905 - DNA, 966 bp, Artificial Sequence
  Description of Artificial Sequence: Synthetic coding sequence
atgttatcaatccaggatgatgcatttatcaatccgcatctggcgaaaatcttcgagcgtgttcgtcagagtgccgacttcatgccactgaagcagatgatgtaccccggagtggcccagtcgataaactctgacgtcaataatttaatggcggtactcaacatgtcgaacatgctcccagagggactctttccagagcatctgattgacgtactgagacgcgaactagcccttgagtgcgactaccagcgggaagctgcatgtgccagaaaattccgggaccttttgaaaggacatcctttcttctatgtacccgaaattgtcgacgagctgtgctctccacatgtcctgacaacagaacttgtttctggctttccgcttgatcaagccgagggacttagtcaggagatacggaacgaaatctgttacaatatactagttctgtgtctacgggaactgtttgaatttcacttcatgcagacagatcccaactggagcaacttcttctacgatccccagcagcataaggtggccctgcttgattttggcgctaccagggaatatgatcgttccttcaccgatctttacatccaaatcattcgagccgctgccgaccgtgatagggagactgtcagagccaaatctatcgagatgaagtttcttacaggctatgaagtcaaagttatggaagacgcgcacctggatgctatcctgattctcggagaggcttttgccagcgatgagcccttcgatttcgggacacaaagtacgactgagaagattcacaacctgattcctgtcatgctcagacatagattggtgcctccacccgaggagacctattctcttcaccggaagatggggggatcattcttaatatgtagtaagttgaaggcccgtttcccgtgcaaagctatgttcgaggaagcgtactctaattactgcaagaggcaggcccagcaatag

SEQ ID NO: 212906 - DNA, 1107 bp, Artificial Sequence
  Description of Artificial Sequence: Synthetic coding sequence
atgttaagtatccaggacgacgcttttatcaatccccatttggcgaagattttcgagcgggtgcggcagtctgctgactttatgcctctgaagcagatgatgaaaaccttgaataatgatctgggacccaattggagagacaagcttgaatatttcgaagagcgaccgtttgctgccgcatcaattggccaggtacatcttgcgcgtatgaaaggtggaagagaagttgctatgaagatacagtacccaggcgtggcgcagagcatcaattctgatgttaacaatctgatggctgtgctcaacatgtcgaatatgcttcccgaaggactgtttccggagcacctgattgatgtgttacgccgagagctcgcactcgagtgtgattaccagagggaggccgcttgcgccagaaagttcagagatctgctgaagggtcatccttttttttatgtacctgagatcgtggacgaattatgttcaccacatgtcttgacaacagagcttgtgagcggcttcccgctggatcaggctgaaggcttgtctcaggagattaggaatgaaatttgctataacatactggtgctgtgtttaagagagctgtttgagtttcatttcatgcagactgaccctaactggagtaatttcttctatgaccctcaacagcataaagtggctcttctagacttcggagcaacccgggagtatgaccggagttttactgacctgtatatacagataattagagccgctgccgatagggaccgagagacagttcgggctaagtccattgaaatgaagtttttaaccggatacgaagtgaaggtcatggaagacgcccaccttgatgctatcctaatcctaggagaggccttcgcctccgatgagccctttgatttcgggactcagtccaccaccgagaagatccacaatttaattccagttatgctgcgtcaccggttggtgccacctccggaggaaacctatagcctacaccggaaaatgggcggttcattcctgatctgctccaaattgaaagcacgctttccatgcaaagccatgttcgaagaagcctattccaactattgcaaaaggcaagcccagcagtag

SEQ ID NO: 212907 - DNA, 3591 bp, Artificial Sequence
  Description of Artificial Sequence: Synthetic coding sequence
atgcccaccgcggagagcgaggcaaaggttaagacgaaggtgcggtttgaagaactgcttaaaacccacagcgacttaatgcgagagaagaagaagttaaagaagaaactggtgagaagcgaggaaaatatatcccctgacacaataagatcaaatctacactacatgaaggagacaacgtccgatgatccagataccataagatcgaacctcccacatattaaagaaacaacctccgacgacgttagcgccgcaaatacaaataatctaaagaaatccacaagagttaccaagaataagctgcggaacacacagcttgctactgagaatcctaacggcgatgcctcagtagaggaggacaagcagggtaagcccaacaaaaaggtgattaagacagtgccccagcttaccactcaggatctgaaaccagagacacccgaaaataaggtggacagtacacatcagaaaacccatacgaaaccccaaccaggtgtggatcaccagaagtctgaaaaggcgaacgaggggcgagaggaaaccgacctggaggaagacgaagagctgatgcaggcatatcaatgtcacgtcaccgaggaaatggccaaggaaatcaagcgtaagatcagaaaaaagcttaaagaacagctgacttattttccctccgatactctattccacgacgacaagctttccagtgaaaaaaggaagaaaaagaaggaagtgcctgtatttagtaaagctgagactagtactctcacgatatctggggatacagtggaaggggaacaaaagaaagagtcatccgtacggagcgtgtccagcgactctcatcaggacgacgagataagctccatggagcagtctacggaagatagcatgcaggatgacaccaagccaaaacccaaaaagaccaaaaagaaaaccaaggccgtggccgataacaatgaggatgtcgacggtgacggcgtgcatgaaattacttcaagagacagccccgtgtaccccaagtgcctgctcgatgacgacttggtcctgggcgtgtacattcacaggacagatcgactgaagtctgattttatgatctcccacccaatggtaaagatccatgtggtggacgagcataccggacagtacgtaaagaaagatgattcgggcagaccagtctcttcctattatgaaaaggagaatgttgactacattctgccaattatgactcagccctatgattttaaacagctcaagagtagactccccgagtgggaagaacagatcgtctttaacgagaatttcccttacctcctgcgaggtagcgacgagagtcccaaggtgatcctgttcttcgagattcttgatttccttagcgtagacgaaatcaaaaacaattctgaagtgcagaaccaggagtgtggctttagaaagattgcctgggcatttcttaagctgctgggcgctaacggcaatgccaacatcaattcgaaactcagattgcaactctactacccccctactaagcctagatcccctttgtccgtagtcgaagccttcgaatggtggagcaagtgcccacgaaatcactacccaagtacactttacgtgacagttcgaggactcaaggtgcccgactgcatcaagccttcctatcggtccatgatggcacttcaagaagaaaaagggaagcctgtgcattgcgaacggcaccatgagagtagttccgtggatactgagcctggtctggaagagtcgaaggaggtgatcaaatggaagaggctgcccggacaggcctgtcgaatcccgaataagcatctattttctcttaatgccggagaaaggggttgtttctgcttggacttctcccacaacggcaggattctggcagcagcatgtgcatcacgcgatggctacccaatcattctgtatgagattccaagtgggcgttttatgagggagctttgcggccacctcaacattatatacgatctgtcatggtccaaggatgaccattatatcctgacaagcagttctgacgggaccgccagaatctggaagaacgagatcaataacactaatacctttcgagtactcccgcacccatcgttcgtctatactgctaaattccatcctgcagttcgggagcttgtggtcaccggctgctacgacagtatgatccgaatatggaaggtagagatgagagaggattctgccatcctcgtccggcagtttgatgtgcataaaagtttcatcaactcattgtgctttgacaccgagggccatcacatgtactccggagattgtaccggggtgatagtggtctggaacacatatgtcaaaataaatgatcttgagcacagtgtccaccactggaccattaacaaggagatcaaggagactgagttcaagggcattccaatcagctacctggagatccaccccaatgggaagcggttgcttattcacaccaaagactcaaccctccggataatggacctgaggatcttagtggccaggaaatttgtgggcgctgctaattatagagagaagattcacagtacactcactccttgcgggacgttcttgtttgctggttccgaggatggtatcgtttatgtgtggaaccctgagaccggagagcaggtggccatgtactcagacttacccttcaaaagtccaatccgagatattagttatcacccctttgagaacatggtggcattttgcgccttcggccagaatgaacctatcctgctgtacatctacgacttccacgtagcacagcaggaggccgaaatgtttaagcgatataatgggacctttccccttccaggcatccaccagagccaggacgcactgtgtacctgccccaaattacctcatcaggggtcatttcagatagacgagtttgtccatacagagtcttctagcactaagatgcagctggtcaagcaacgccttgaaaccgttactgaagtgatacgctcttgtgcggctaaggttaacaagaacctttctttcactagccctccggcagtgagcagccaacagtcgaagctcaaacagagtaacatgctcaccgcccaagagattcttcaccaattcgggttcacgcaaactggtattatatcgattgagagaaagccgtgtaaccaccaggttgatacggctcccactgttgtggctctgtatgattatacggcgaacagatcagatgagctcaccatccatcggggtgatatcattagggtctttttcaaggacaatgaggattggtggtatggttcaataggaaaaggacaagagggatacttcccagccaaccatgtggcgtcagaaacgctgtaccaggagttacccccagagatcaaggagcggtctccacctttaagccccgaagagaagaccaagatcgaaaaaagtccggctcctcagaagcagtctattaataagaataaatcacaagactttcgattaggttcggaatccatgacgcacagcgagatgagaaaggagcagagccatgaggatcaaggccatattatggacacccgcatgcgcaaaaacaaacaggctggcagaaaagtgactctcattgaatag

SEQ ID NO: 212908 - DNA, 3162 bp, Artificial Sequence
  Description of Artificial Sequence: Synthetic coding sequence
atgcccaccgcggaaagcgaagcaaaggttaaaactaaagtaaggtttgaagaacttctgaagacacattctgatctcatgcgcgagaaaaagaagctcaaaaaaaaattagtcagaagtgaagagaacattagtcctgataccatccggagtaacctccactacatgaaggagaccacgagcgacgacccagacacaatcagaagtaacctacctcatattaaggaaaccaccagcgatgacgtgtccgcggctaataccaataatttgaaaaaaagtacgcgtgtgaccaaaaataaactgcgtaatactcagttggccaccgaaaatcccaatggggatgcttctgtcgaagaagataaacaaggcaaacccaataagaaagtgataaagaccgtgccccaattgacaacccaggatctgaagccagagaccccagagaataaggtagacagcacacaccaaaagacacacacaaaaccccagccaggggtggatcaccagaagtcagaaaaagctaacgaaggaagggaagagacagatctggaggaggatgaagagctgatgcaagcctatcagtgccacgtaaccgaggagatggcaaaggagataaagcggaagatcagaaagaagttaaaagagcagctcacctatttcccgagcgatactttgttccatgatgacaaacttagtagcgaaaaacgcaaaaagaaaaaggaggtgcctgtcttttcgaaagccgaaacttctacactcaccatcagtggagataccgtcgagggtgaacagaagaaggaatcttccgtgcgaagtgtgagttcggattctcaccaagacgatgaaatcagttctatggagcagagcacagaagacagcatgcaggacgatacaaagcccaagcctaaaaaaacgaagaagaagacaaaggccgttgccgacaacaacgaggacgtcgatggcgacggagttcatgagataaccagtcgcgattcccccgtgtacccaaaatgtcttctagacgacgatctggtcctgggagtgtacatccaccgcacggataggctgaagtcagatttcatgatctcccacccaatggttaagattcatgtagtggatgagcacactggacagtatgtgaaaaaggacgattccggacgtcctgtaagctcctactatgaaaaagagaacgtggattacatccttccaattatgacacagccttacgatttcaagcagttgaagtcaagactgcccgagtgggaagagcagattgtgttcaatgaaaacttcccctacttgcttcgaggttctgacgaaagcccaaaggtcattcttttcttcgagatcctcgattttctttcagtcgacgaaattaaaaataatagcgaggtgcagaaccaggagtgcggttttcggaagatcgcatgggcctttctgaaactactgggcgctaatggtaacgccaacatcaactccaagcttagattgcagctatactaccccccaactaagccccgttcgcctttgtccgtcgttgaagcctttgagtggtggtcaaaatgtcccaggaatcattacccttccacgctgtatgttacggtcagggggctgaaagtgccagactgcatcaagcccagttaccggtccatgatggcattgcaggaggaaaagggcaagcctgtccattgcgaaaggcaccacgagtcttctagtgtcgacacagagccaggtctcgaagaatccaaggaagttatcaagtggaagcggctgccgggacaggcatgccggattcccaataagcatcttttctccctcaacgccggagagcgagggtgtttttgcctcgattttagtcataacggaaggatcttggctgcggcttgcgcttcccgcgatggataccccatcattttgtacgaaatcccctccggcagattcatgcgcgaactgtgtggacacttaaatattatttatgacctatcttggtccaaagatgaccactacatcctcacgagcagtagtgatggaacggcacgtatttggaaaaatgagataaacaatacaaacacatttcgagtactgccgcacccaagctttgtgtacaccgctaagtttcaccctgcagtgagagagctggtcgtgactggatgttacgattcaatgatccggatttggaaagtggagatgagagaagatagtgctatcctagttcggcagtttgacgttcataaatcatttattaactcactgtgcttcgatacagaaggccaccatatgtattccggggactgtaccggggtcattgtagtgtggaacacctacgtcaagattaacgacctggaacacagcgtccatcactggaccattaacaaagagataaaggagaccgagttcaaagggattcccatttcctacctagagatccaccctaacggcaaacgcctgctcatccatacaaaggattcaacccttagaattatggacctgaggatcctggtagcccgtaagttcgtaggagcagctaactaccgcgagaagatacattccacactcacaccctgtgggacgttcttattcgcaggtagcgaggatggaattgtctatgtatggaaccccgagaccggagaacaggtcgcgatgtattccgatttacctttcaaatctcctataagggatattagctaccaccccttcgaaaacatggttgctttttgcgcttttggacagaatgagcctattctcttgtatatctatgacttccacgtggcgcagcaggaagccgaaatgttcaaacgctataatggaaccttcccactgcccggaattcatcaatctcaggacgctctatgtacctgtccaaaattgccacaccaggggtcctttcagatagacgagtttgttcacacagaatccagcagcacaaagatgcaactggtaaagcagcggctggagaccgtgacagaagtcatccgatcatgcgccgcaaaggtgaataagaatctgagctttaccagcccacctgccgtgtcatcccaacagagtaaactgaagcagtctaatatgcttacagcccaggaaatattgcatcagtttggcttcacccagacggattcccacttcgccgagttcaatacgtgtatcctatggtggaagaagcattag

SEQ ID NO: 212909 - DNA, 165 bp, Artificial Sequence
  Description of Artificial Sequence: Synthetic coding sequence
atgcccactgctgaaagcgaggcgaaggtcaagacaaaagtccgcttcgaagagctgctgaagacccactcagacttaatgagggaaaaaaaaaagctgaagaaaaagcttgtgaggtctgaggaaaacatttcaaaccaggagaaatctatggcagtctggtag

SEQ ID NO: 212910 - DNA, 3591 bp, Artificial Sequence
  Description of Artificial Sequence: Synthetic coding sequence
atgcccacagccgagtcggaggccaaagttaagacaaaggtgcgatttgaggaactactgaaaacacactcagatctgatgagggaaaagaaaaagctgaagaaaaagctggtgagatcagaggaaaatatcagtccggatacgattcgttccaacctgcactacatgaaagaaaccacttccgacgatcctgacacaatccgttccaacctacctcatatcaaggaaactacaagcgacgacgtgtctgccgctaacacaaataatctcaaaaagtccactagagtgaccaaaaacaaactacggaacactcaactcgctaccgaaaatccaaacggggacgctagtgttgaagaagataagcaaggcaagcctaacaagaaagttatcaagaccgtacctcagctcacgacacaagatcttaaacccgagacgcctgagaataaagtcgatagcacccatcaaaaaacacacacaaagccccagcccggagtagaccaccagaagtcagagaaggccaacgagggtcgagaggaaaccgatttggaggaggatgaagaacttatgcaggcatatcaatgtcacgtcaccgaggagatggccaaggaaatcaagcgcaagatcaggaagaaactgaaagagcagcttacttatttccctagcgacacccttttccatgacgataagttgagcagtgagaagcggaaaaagaagaaagaggtgccagtgttctcaaaagctgaaacttctacactgacgatcagtggggacacagtagaaggggagcagaagaaggaaagcagtgtcaggtcagtttcatccgattctcaccaagacgacgaaatcagctcgatggagcagagtactgaggacagtatgcaggacgataccaaacccaaacccaaaaaaactaaaaagaaaacgaaggccgtggctgataacaatgaagatgttgacggcgacggggttcatgaaatcacgagcagggactcaccagtctatccaaagtgcctactggacgacgacctggttctgggagtctacatccatcgcaccgatcgtctaaagagtgatttcatgatttcccacccaatggtgaaaatccatgttgtcgacgagcatactggccaatacgtcaagaaagatgattccgggagacctgtatctagctattatgagaaggaaaatgtggactacatcctgccaatcatgactcaaccatacgattttaaacaactgaagtctcggctgcccgagtgggaggaacagattgttttcaatgagaatttcccgtacctgctgcgagggagcgatgaaagccccaaggttatcctgtttttcgaaatcctggattttttaagcgtggacgagataaaaaataacagcgaagtacagaatcaggagtgcggcttccgtaagatcgcctgggccttcctgaagcttcttggagccaatggcaacgcgaatatcaatagcaagttgcgattgcagctgtactaccctccgaccaagccacgatctccactcagcgtagtggaagccttcgagtggtggtccaaatgtcctcgcaatcattatccctctacactttatgtgaccgtccgaggccttaaggtgccagactgtatcaagccgtcttaccggtccatgatggcgctgcaagaggagaaagggaagcctgttcattgtgagaggcaccatgaaagcagctcggtagacacggaaccgggacttgaggagtccaaggaagtgatcaagtggaagcggcttccgggtcaggcatgtcgcatccccaacaaacatctgttcagcctgaatgcaggtgagcgtgggtgtttctgcctggacttttctcacaacggcaggatcctggccgcagcttgtgccagtagagacgggtacccaatcatcctgtacgaaatcccgagcgggcgatttatgagagagctctgcggacatctgaatatcatctacgacctctcatggagtaaggatgaccattacatactgacatcttcgagcgatgggaccgcgagaatatggaagaatgaaattaataacaccaacacatttcgcgtcttacctcaccccagcttcgtctacactgcgaagtttcacccagccgttagggaactggtggtgacgggctgctacgacagtatgatccgcatctggaaagttgagatgcgcgaggactctgcgatcctggtgcgccagtttgatgtacacaaaagttttataaattccttgtgcttcgatacagagggtcaccatatgtattctggcgattgtaccggtgtgatagtggtgtggaacacatacgtgaagatcaacgaccttgagcactctgtccaccactggaccatcaataaggaaattaaggagacggagttcaaaggcatcccaatctcttatctggagatacatcccaacgggaaacgactgctcatccataccaaagattctaccctgagaattatggatctaagaattttagtcgctaggaagttcgtgggagctgctaattacagggaaaagatccattcgacgctgactccctgtggtacattcctgttcgcaggaagcgaggacgggatcgtgtacgtctggaaccctgaaacaggcgagcaagtagcaatgtacagtgatttgccatttaagtcgcccatccgagacatctcttaccaccccttcgagaacatggtcgccttctgcgcttttggacaaaatgaaccgatactcctctacatctacgattttcacgtcgctcagcaagaggctgaaatgtttaagcggtataacggaacgtttcccttacctggaatccaccagtcccaggatgccctctgtacttgtcccaaactgccccatcagggttcatttcagattgatgaattcgtgcacacggaaagttctagtacgaagatgcaattagtgaaacagcgcttagagacagtgaccgaggtcatacggtcctgcgccgctaaggtaaacaagaatctttcatttacttcaccacccgcagtgtcctcacagcagagtaaacttaagcaaagtaatatgcttacagcccaggaaattctgcatcagtttgggtttacgcaaaccggaatcatttccatcgaacggaagccctgcaatcatcaggtcgatactgcacccaccgtagtggcactgtacgactataccgccaaccgttccgacgaactcactatccaccggggtgatattatccgggtcttctttaaagacaacgaggattggtggtacggatcaatcggtaaaggccaggaggggtacttcccagccaatcacgtggctagtgaaactctttatcaggaactgccccctgagattaaggaacgaagcccacctctgtcaccggaagaaaagacaaagatcgagaaatctcccgcaccccaaaagcagtctatcaataagaacaaaagccaagactttagactaggctctgaaagtatgacccacagtgaaatgcggaaggaacaatcacatgaggaccaagggcacataatggacacacgcatgcgcaaaaacaaacaggccggacgtaaggttaccctaatagaatag

SEQ ID NO: 212911 - DNA, 3162 bp, Artificial Sequence
  Description of Artificial Sequence: Synthetic coding sequence
atgcctacaacagagtctgaggctaaagtaaaaaccaaagtgaggttcgaagaactcctgaagactcacagtgacctgatgagagagaaaaagaaactgaagaagaagctcgttagatcagaggaaaatatctcccctgacaccattcggtctaacctgcattacatgaaagagacaacaagtgacgaccccgacaccatcagaagtaacctgccccatattaaagaaactacgagtgacgacgttagcgctgcaaacactaacaatcttaagaaaagcactagagttaccaagaacaagttgcgtaacacacaattggccacagaaaatcctaacggagatgcttcagtcgaggaggataagcagggcaagccaaataagaaagtgatcaagacggtgccacagctaactacacaggacctaaagcctgagacccctgagaataaggtggattccacacatcagaagacgcataccaaaccgcaaccgggagtggaccaccagaagtctgaaaaggctaacgagggcagagaagagacggatctcgaagaggatgaagagctgatgcaggcttaccaatgtcacgtcacagaagaaatggcgaaggagattaaacgtaagattaggaagaagttaaaagaacaactgacctattttccatctgatacccttttccacgacgataagctgtcctccgaaaagaggaagaaaaaaaaagaggtacctgtgttttctaaagcagaaacttccactctgacaataagtggcgacacagtcgaaggagagcagaagaaagaatcatcagtgcgctcagttagttcagactcacaccaggacgacgaaatttccagtatggaacagtccacagaggattcaatgcaggacgacaccaagccaaaaccaaagaagactaagaaaaagaccaaggcggtggctgacaataacgaggatgtggacggcgacggagtccatgagataaccagccgagacagcccggtttatccaaaatgtctgctggatgatgacctagtgctaggggtctacatccataggacggataggctgaagtcagacttcatgatttctcaccccatggtcaagatccatgtcgtggacgagcatacggggcaatatgtgaaaaaagatgattctggaaggccagtttccagttactatgagaaggaaaatgtggattatatactgccaattatgacccagccgtacgatttcaagcagttgaaaagcagactgccagaatgggaagagcagatcgtcttcaacgagaacttcccttatctgctgcgcggtagcgatgaatccccgaaggttatattgtttttcgaaatcctggacttcctttccgttgacgagatcaaaaataatagcgaggtgcaaaaccaggagtgcggattcagaaaaattgcctgggcgttcctcaaactcctgggggctaacggcaatgcaaacattaactcgaagctgcgacttcagttgtactacccgccaacaaagccccgtagtcccctgtctgtcgtggaagcttttgaatggtggagcaagtgcccaaggaatcattatccatcaacactctatgtaaccgtccgaggactcaaagtccctgactgcatcaaaccaagctatagatccatgatggctcttcaggaggaaaagggcaaacctgttcactgcgagcgtcatcacgagtcttcatccgtcgatacggaacctggactggaagagtctaaggaggttattaagtggaagcgtctgcctggacaggcatgtaggattcccaacaaacacctgtttagccttaacgctggagagagaggttgcttctgtcttgatttctctcataacggacgtattttggcagccgcttgtgcttccagggacggatatcctatcattctgtacgaaataccaagcgggaggttcatgcgggagctgtgtgggcatctcaacatcatttacgacttatcctggagtaaagatgaccactatattctgactagtagcagtgacggcacagcacgcatttggaagaatgagataaataacactaacacttttcgtgtcttaccgcacccctctttcgtatataccgccaagtttcaccctgctgtacgcgagctcgtggtcaccggatgctatgattctatgattcggatatggaaggtggagatgcgcgaagattcagccattctggtccgtcaatttgatgtccacaagtccttcataaattctctgtgttttgatacagaaggacatcacatgtactccggggattgcactggggtaatagtggtctggaatacttacgtcaaaatcaatgatttggagcactcagtccaccattggacaatcaataaagagatcaaggaaaccgaattcaaagggatcccaatttcttacctggagatacacccaaatgggaagcggttattgattcacaccaaggattctaccctgcgcattatggaccttcgtatacttgtcgccagaaagttcgtgggagcggcaaattatcgcgaaaagatacactctacattaacaccctgcggaacattcctcttcgccggttccgaagatgggatagtgtacgtgtggaacccagaaactggagagcaggtggccatgtatagtgacttgcctttcaaatcaccaattagagatattagttatcaccctttcgagaacatggtggcattctgtgccttcggtcagaacgagcccattttgctttatatctacgacttccacgtagcccagcaggaagccgaaatgtttaaaagatataatggaacctttcccctgcctgggattcaccagtcacaggatgccctttgcacctgcccgaagctgccgcaccagggttcgttccaaattgatgagttcgtgcatactgagagtagctccaccaagatgcagttggtgaaacagcgtctggaaactgtgaccgaagtgatcagatcctgcgctgcaaaagtgaataaaaacctttcattcacatctccgccagccgtgagctcacagcaaagcaaactgaagcagagcaacatgctgactgcccaggagatcctacatcaatttggcttcactcagaccgactcgcacttcgcagaatttaatacatgcatattgtggtggaaaaagcactag

SEQ ID NO: 212912 - DNA, 1497 bp, Artificial Sequence
  Description of Artificial Sequence: Synthetic coding sequence
atgagagaactctgcggccatctcaacattatctatgacctgagctggtctaaagacgatcactacatactcacaagttcctctgatggtacagcacgcatctggaaaaatgagattaataatactaatacatttcgcgtgctgcctcacccttcctttgtgtacacagctaaattccatccagcagtaagagagctggtggttaccggttgttacgatagcatgatcaggatctggaaagtggaaatgcgggaggattccgcaatactcgtgaggcagtttgacgtgcacaaatccttcattaattctctgtgcttcgacactgagggccaccacatgtactctggcgactgtaccggagtaatcgtcgtgtggaacacctacgtaaaaatcaatgatctggaacactctgtacatcactggacaatcaataaggagatcaaagaaacagagtttaagggcatacccatttcttacttagaaatacatccaaacggaaagagactgctgatccataccaaggactccaccctgaggattatggacctccgaatccttgtcgctcgcaaattcgtgggggcagccaactatagagagaaaatccatagtactttgaccccttgcgggacctttctctttgcaggatcggaagatggcatcgtctatgtctggaaccctgaaaccggcgagcaggtggctatgtactctgatctgccttttaagtctcccatcagagacatttcataccacccgtttgagaatatggtggccttttgcgcgttcggtcaaaacgagcccattttactgtacatctacgactttcatgtggcccaacaggaagcagagatgttcaaacgctacaatggcacctttcctcttccagggatccatcagagccaggacgctttatgtacttgcccaaagctcccacaccagggcagtttccagattgatgagttcgtccataccgagagctcttcgactaaaatgcagcttgttaaacagcgcctggagaccgtcaccgaggtcattaggagctgtgctgcaaaggtaaataaaaatttaagtttcactagtccgccagccgtgagttcccaacagtcaaagctaaagcagtcaaatatgctgacggcccaggaaattctgcatcagtttggcttcacacagacaggcatcatatccatcgagaggaaaccatgtaaccatcaagtcgacactgcccctactgtcgtggcactctacgactataccgccaaccgcagcgacgagctgactattcataggggagacataataagggtgtttttcaaggacaacgaggattggtggtacggatcaatcggaaaggggcaggaaggctactttcccgctaatcacgtcgccagtgagaccctctaccaagagctgcccccagagatcaaagagcgctccccccctctttccccagaagagaaaaccaaaattgagaaatcacccgcacctcagaaagtgaaatag

SEQ ID NO: 212913 - DNA, 3591 bp, Artificial Sequence
  Description of Artificial Sequence: Synthetic coding sequence
atgcctaccgcagaaagtgaggccaaggtaaaaactaaagtacggttcgaagagctcctgaaaacacattcagacctcatgcgtgagaagaaaaagctaaagaagaaactagtgaggagcgaggagaacatctcgcccgatactattcgcagcaatctccattacatgaaagagactacttctgacgatccagacacaattcgctcaaacctccctcacattaaggaaacgaccagcgacgatgtcagtgctgccaatactaacaatctgaaaaagtctacccgagtgactaagaacaagctacgaaatacccagctggccactgagaaccctaatggggatgcttctgtggaggaggataagcaaggcaaacctaacaaaaaggtcatcaaaaccgtgccgcagctgaccacacaagatctgaagcccgagacccccgagaacaaagtggattccacgcaccagaaaacccataccaagcctcagcccggtgttgaccatcagaagagtgagaaagctaatgaagggcgtgaggagacagatctcgaggaggacgaagaactaatgcaggcataccagtgccatgtgaccgaagaaatggccaaggagatcaaaagaaagatcagaaagaaactgaaagagcaactgacatatttcccaagtgatactttatttcacgatgacaaactgtcctccgagaaaaggaagaaaaaaaaagaggttccggtgttcagcaaagccgagacctctactcttacaatcagcggtgatacagtggaaggggaacaaaagaaggagtcatctgtgcggagtgtgtcctccgattcgcatcaggacgacgaaatcagcagtatggagcagagcactgaggactccatgcaggacgacactaaacccaaaccaaagaagacaaaaaagaagacaaaagcagtcgcagacaataatgaagatgtagacggagatggggtacacgagatcacctctcgggactctccagtgtaccctaaatgccttctggacgacgatctggtgttgggggtctacattcataggaccgaccggctcaagtctgacttcatgataagccatcctatggttaaaatccatgtcgtggatgagcatactggacagtatgtgaaaaaggatgattcaggccgacccgttagttcctattacgagaaagagaatgtggattatatcttgcctatcatgacacagccgtacgactttaaacaactgaaatcccggttaccagaatgggaggaacagattgtgtttaacgagaacttcccgtacctgcttcggggttccgatgaaagtcctaaagtcatccttttctttgaaatcctggactttttgagcgttgacgaaattaagaataatagtgaggtccagaatcaggaatgtgggtttaggaaaatagcttgggcatttctgaagttactgggcgctaacggcaacgcgaatattaactccaagcttaggctgcagctgtactacccaccaacaaaaccacggagtcccctgtctgtcgtcgaggcattcgaatggtggagcaagtgtcccaggaaccactacccaagcaccctatatgttactgttcggggattgaaagtgcctgactgtattaagccgagctatcggtccatgatggccctccaggaggagaaggggaaaccagtccactgtgagagacaccacgagtccagcagtgttgataccgagccgggtctggaagagagtaaagaagtgatcaaatggaagcgccttccaggccaggcatgtaggattccaaataagcacctgttcagcctgaacgctggggagcgcggttgtttttgcctggatttctcccataatggccgtatcctcgctgcagcctgcgccagtagggacggttatcccataatcttgtacgagatcccgtctggacggttcatgcgagaactctgcggccatcttaatattatctacgacttgtcctggagcaaggacgatcattatatactgacaagttcgagcgacgggaccgctcggatctggaagaatgaaattaataatactaacaccttcagagtactcccccacccatctttcgtctataccgcaaaatttcatcctgcggttcgtgagctggtggttacgggttgctacgattccatgatccggatctggaaagtggaaatgagagaagatagtgcaatcctcgtccgacagttcgatgtccataagtctttcataaattccttgtgctttgataccgaagggcatcacatgtacagcggggactgcaccggagtaatcgtggtttggaatacatacgttaagattaatgatctcgaacactccgttcaccattggactatcaacaaggagatcaaggaaaccgaatttaagggaatccccatttcctatctggagatccaccccaacggaaaaaggctgctgatacacaccaaggacagtaccttacgcataatggacctccgtatcttagtggcccgtaagttcgttggcgcagctaactaccgcgaaaaaattcactcaacgctgacgccctgcgggaccttcctcttcgctggcagtgaggacgggattgtgtacgtttggaaccccgagaccggcgagcaggtggctatgtactctgatctgccctttaaaagcccaatccgggacattagctaccatcccttcgaaaacatggtggcgttttgtgcgttcgggcaaaatgagcccattcttctctatatatatgacttccacgttgctcagcaggaagctgaaatgttcaaaagatataacgggacttttccactgcccggaattcaccagtcacaggatgctttgtgcacctgtcccaagctgccacaccaaggcagttttcaaatcgatgaattcgttcatacggagtcctcctctacgaaaatgcagctggtcaaacagcggctggagacagttaccgaagtgatcaggtcctgtgccgcaaaagtcaataagaacctgtcctttacatcacctccggcagtttcatcacagcagagcaaactcaagcaaagtaatatgctgacagctcaagagattctccaccagttcggcttcactcaaaccggcattatctcaatagagcgcaaaccctgtaaccatcaggtggatactgcccctaccgtagttgcactttatgattacaccgccaatcgttctgatgagctcacgatccacaggggtgatattatcagggtctttttcaaggacaacgaagattggtggtacggttctattggcaaaggccaggaaggatactttccagctaatcatgttgcatcagagactttgtaccaggaactgccacctgagatcaaagaacggtcaccccctttgtcccctgaagagaaaacaaagattgagaagagtccagcgcctcaaaaacaatctattaacaagaacaagtcgcaggatttcaggttggggtctgaatccatgacgcattcggagatgaggaaagaacaatctcacgaggatcaggggcacattatggatactcggatgcgcaaaaacaaacaggcaggccgaaaagtcacacttatcgaatag

SEQ ID NO: 212914 - DNA, 1218 bp, Artificial Sequence
  Description of Artificial Sequence: Synthetic coding sequence
atgttgtctagttttctgtctccacagaacggaacctgggcagacaccttctcactgctccttgctcttgccgtggccctctacttgggatactattgggcctgtgtgctgcaaagaccacggctggtcgcaggaccccagtttctggcgttcctggagcctcactgtagcattaccaccgagaccttctatcccactctctggtgcttcgaagggcgactgcagagtatattccaggtgctcctccagtcccagccacttgtgctgtaccagtccgacatcctgcagactcctgatggaggacagcttctcctcgactgggcaaagcaaccagatagctcccaggacccagatcctaccacacagccaatcgtgttactgctgcctgggatcactggtagctctcaggatacttacgtcctgcatctggtgaaccaggctctgcgcgacggatatcaggctgtggtttttaacaaccggggatgtcggggagaggaactcagaacccaccgagctttctgtgcaagtaacactgaggatctagagactgttgttaaccacatcaagcaccggtacccgcaggccccactgttggcagtaggtatttcatttggaggtattctcgttctgaatcacttggcgcaggccagacaggctgccggactggtcgcagcactgaccctcagtgcttgctgggactctttcgagactacaaggtcactggagacccccctgaacagtctccttttcaaccagcctctaacggcaggactttgtcagttggtcgagagaaatcggaaagtgatcgaaaaggtagtggacatcgactttgtgctgcaagccaggacaatacgccagtttgacgagaggtatacctctgtggcattcggctatcaggattgcgtcacttattacaaagcggctagcccaagaaccaagatcgacgccattcgcattccggttctatacttatctgccgctgatgacccctttagtccagtgtgtgcactgcccatccaggctgcgcagcatagtccctacgtcgcactcctgattaccgctcgcggaggtcacatcggttttctggagggtctgctgccctggcagcattggtatatgagtcgactacttcatcaatacgcaaaggcaattttccaggatcccgagggattgccggacctgagggccttgctgcccagcgaggataggaacagctag

SEQ ID NO: 212915 - DNA, 1197 bp, Artificial Sequence
  Description of Artificial Sequence: Synthetic coding sequence
atgcgcaaaagaactgagcctgttgcgctggagcacgagcgatgcgctgctgctggcagcagtagtagcggctccgcagctgctgcgttagatgcagattgtcgattaaaacaaaatctgagactcactggaccagccgctgcagagccaaggtgtgccgctgatgccggaatgaagcgggctttagggcgtagaaagggggtgtggcttcgcctgcggaaaattcttttctgtgttcttggcctgtatatcgccattccattcttgataaagctgtgtccagggatccaagccaagcttatttttctgaactttgtccgggtgccatattttattgatcttaagaaacctcaggatcaaggtctgaatcacacctgtaattactacttgcagccagaagaggacgtaaccatcggtgtttggcacacagttcctgctgtctggtggaaaaacgcccagggtaaggaccaaatgtggtatgaggatgcccttgcgagtagtcatcctattatcctgtaccttcatggcaacgctggaacacgcggtggcgatcacagagtcgagttatacaaggttctgtccagtctgggctaccatgtcgtgacctttgattacagggggtggggagacagcgtgggcacaccgagcgagaggggcatgacatacgatgccctgcatgtgtttgactggattaaggctaggtcaggggacaaccctgtgtatatttgggggcattcactgggaactggcgtggccacgaatcttgttcggaggttatgcgaacgggagactcctccagatgccctgattttagagtcgccgttcacgaatattcgtgaggaggcgaagagccatccctttagcgtgatctaccggtatttccctggattcgactggttcttcctggatcctatcactagtagcggaattaaattcgccaatgacgaaaatgtcaaacatatttcctgccccttactaatcctccatgccgaggatgatcccgtggtccctttccagctgggcaggaagctgtatagtatagccgctccggctaggagtttcagggattttaaagtgcagttcgtaccctttcacagcgaccttggctataggcacaagtatatttacaagagtccagagctcccacggattcttagagagttcctgggtaagagtgagcccgaacaccagcactag

SEQ ID NO: 212916 - DNA, 1215 bp, Artificial Sequence
  Description of Artificial Sequence: Synthetic coding sequence
atgaggaagaggacagaaccggtggctctggaacacgaacgctgtgctgccgctggaagttcttcctctgggagtgcagccgcagccctggatgctgattgtagactgaaacagaacctcaggctcacaggccctgccgctgccgagccaaggtgtgccgctgatgccggtatgaaacgcgctctcgggagacgcaaaggagtttggctgaggctgagaaagatccttttctgtgtcttgggtctttacattgccattccatttctgattaaactgtgccccggtatccaggctaagcttattttcctgaatttcgtccgcgtgccatattttatcgaccttaaaaagccccaggatcagggcctgaatcatacttgtaactactacctccagccagaagaagatgtgactatcggcgtttggcacacagttccagctgtgtggtggaagaatgctcaggggaaagatcaaatgtggtatgaggacgcactggcaagcagtcatcctattattctgtacctgcacggcaatgctgggacccgaggaggggatcaccgcgtagaactttacaaggttctgagttcgctcgggtaccatgtagttacttttgattaccgtggatggggcgactctgtgggtacgccctccgagcggggaatgacctacgacgccctgcatgtcttcgattggataaaggccaggtcaggggacaacccagtctatatctggggtcacagcctggggactggcgtcgccacaaatctcgtgaggcggctgtgcgagcgtgagacccctccggacgccctaatcctcgaaagccccttcaccaatattagggaagaagcaaagtctcatcctttcagcgtgatctatcggtattttcccggttttgactggttttttcttgacccaatcacaagcagtggaatcaagtttgcaaatgatgagaatgtgaaacatatctcctgccccctcctgatactgcatgctgaggatgaccccgtcgtgccattccagcttgggcgtaaactatacagcatcgcagcgccagcccgttcattccgagacttcaaagtgcagttcgtccccttccatagcgatcttgggtatcggcacaaatatatctataaaagtccagaacttcccagaatcttgcgccctcagcagggaccaggatcatcacctgacccaagtatgtggtctgagttggtgtag

SEQ ID NO: 212917 - DNA, 564 bp, Artificial Sequence
  Description of Artificial Sequence: Synthetic coding sequence
atgtcagggggaggccatgggggagtgtgttttctgtgctgtatattgctgcagggacgaaaaggagtttggctccgactgagaaagatcctgttctgtgtgctggggctgtacattgccatcccctttctaattaagctctgccccggaatacaagccaagttgattttcctcaatttcgtcagggtgccctacttcattgacctgaagaagccacaggaccaggggctgaaccacacctgtaactactatctgcagccagaagaggatgtcaccattggtgtatggcacaccgtgccagccgtgtggtggaaaaatgcccagggaaaagaccagatgtggtacgaggatgctcttgccagctcacatcccattatactatatctccacggcaacgctggaacacggggaggcgatcaccgggttgagctgtataaagtcctgagttctctagggtaccatgtggtgacgttcgactacagaggctggggggacagcgtcggaactccaagcgagcgcggaatgacgtatgacgccctgcatgtcttcgactggattaaatag

SEQ ID NO: 212918 - DNA, 1083 bp, Artificial Sequence
  Description of Artificial Sequence: Synthetic coding sequence
atgagaaaacgcaccgagcctgtggctcttgagccgaggtgtgcggctgatgccggtatgaaacgggcacttggcagaaggaagggggtatggctgcgcctgagaaagattttgttctgcgtgctggggctctatatcgctattcccttcttaatcaagctatgcccaggaatccaagctaagttaatttttctgaattttgtgagagtgccctatttcatcgatttgaaaaaaccccaagaccagggtctgaatcacacctgtaactactacctgcagcctgaggaggacgtgaccatcggcgtctggcacaccgtcccagccgtgtggtggaagaacgcccaaggcaaagatcagatgtggtacgaggacgctctggcttcaagccaccccatcatcttgtacctacacggcaatgctgggacccgcggaggcgaccatcgtgtggagctgtataaagtgctatcatctctggggtaccacgtggtgacgttcgattaccgcggttggggagattctgtgggcaccccctccgagcgcggaatgacgtatgacgcactgcacgtcttcgattggatcaaagcacggtccggggacaatcccgtctacatatggggacacagcctgggaaccggggtggcaactaaccttgtcagacgattgtgtgaaagggagactccacctgacgccctaatactggagtcaccctttacaaatattagagaggaagcaaaatctcaccccttcagcgtaatctatcgctactttcccggatttgattggtttttcttggaccctatcacctcgtccggtatcaagttcgcaaacgacgaaaatgttaagcacatctcatgccctctcctgatactgcacgcagaggatgaccccgtcgtccccttccagctgggcaggaagttgtactcaattgccgcaccggctcgatcttttagagattttaaagtgcagttcgtgccctttcattcagacttgggctacagacacaaatacatatataagtccccagagctccccagaatactcagggagtttttaggcaagagtgaaccggaacatcagcattag

SEQ ID NO: 212919 - DNA, 1020 bp, Artificial Sequence
  Description of Artificial Sequence: Synthetic coding sequence
atgctgtatcccggaagcgtctacttattacagaaggccctgatgccagtgcttttacaggggcaagcgaggctggtggaagaatgcaacggcaggcgtgccaaactcctggcatgcgacggcaatgaaattgacactatgttcgtggacagaaggggcacagccgaaccccagggtcaaaaattagtgatttgttgtgaaggaaatgccggattctatgaagtgggctgtgtgagtactccgctcgaagctggttacagtgtgcttggctggaatcaccccggtttcgcagggtccaccggtgttccatttccccaaaatgaggcaaatgcgatggacgtggtcgtgcagtttgccatccaccgactcggctttcagcctcaggatatcattatttacgcatggtcaatcggcggattcacagcgacgtgggccgcaatgtcttatcctgacgtcagcgccatgattctggatgcttctttcgatgatctggtcccactcgcactgaaggttatgccagactcttggagaggtctggttacccggaccgtgaggcagcatctcaatctgaacaatgctgagcagctttgtcgttaccaaggccctgtattactgatcaggcgaactaaagacgagatcattaccaccactgtccctgaggatattatgtcgaaccgaggaaacgacctccttcttaaattgctccaacatcgatatccccgtgtgatggcggaggaaggacttagagtggtgcgtcagtggctggaggcctcttctcagctggaggaggcttcaatctacagtagatgggaggtggaggaagactggtgtttaagcgtcctccggagctatcaggccgaacacgggccagattttccatggagcgtgggcgaagatatgagcgcggatggacggagacaactggccctcttcttggctcgtaaacacctgcacaatttcgaggctacccactgtacacccttgcccgcacaaaactttcaaatgccttggcacctctag

SEQ ID NO: 212920 - DNA, 1677 bp, Artificial Sequence
  Description of Artificial Sequence: Synthetic coding sequence
atggctaaactgctgtcatgcgtgctgggccctcggctgtataagatctaccgcgaaagagatagtgaacgggctcctgcaagtgtacctgagactcccaccgctgtcacggccccacacagttctagctgggatacgtattaccagccacgtgcgcttgagaaacatgccgattcgattctggcgctcgcaagcgtgttttggtccattagttactactcttccccattcgccttcttttacctgtacaggaaaggctacctttctctgtctaaagtcgttcccttttcgcattatgcaggcaccctgttactcctcctggccggtgtggcttgtctgcgaggcatagggaggtggacaaacccgcagtacaggcagtttatcaccatccttgaggctactcacagaaatcagagctctgagaacaaacggcagttagccaattataattttgacttccgaagctggcccgtggatttccattgggaagagccttcttctagaaaggaatctcggggtggcccaagtcgtcgtggagtcgcacttctcagaccagaaccattgcacaggggaacagccgataccctgctgaatcgagtgaagaagctcccatgccagatcactagttatctcgtagcacataccctcgggagacggatgttgtacccaggcagcgtttacctgctccaaaaagctctgatgccggtcttgctgcaggggcaggcaagactcgtggaagagtgtaatggcaggcgagctaaacttctggcttgcgatggcaatgagatcgacacaatgtttgtagaccggagggggactgcagaaccccaaggacaaaaactcgtcatttgttgcgaaggaaatgccggattctatgaggtcgggtgcgtaagtacgccactcgaagccggttacagcgtgcttggctggaatcacccgggtttcgccggttctacaggggtaccgtttccgcaaaacgaagctaacgctatggacgtagttgtgcagttcgcgatccacaggctgggttttcagccccaggatattatcatctatgcctggtccattgggggtttcacagcaacgtgggctgcaatgtcctatcctgatgtgagcgccatgatactggatgcctcctttgatgacctggtgccacttgctctcaaagtgatgcccgactcgtggagaggactcgtgacccgaaccgttcgacagcacctgaatcttaacaacgctgaacagctctgccgctaccaaggacctgttctgctcattagacggaccaaggacgagattatcactacaaccgtgccagaggatatcatgtccaatagaggcaatgatctgctgctcaaattgctgcagcaccggtaccccagagtgatggccgaggagggactgcgggttgtgagacagtggctcgaggcatcctctcaactggaagaggcttcaatctattctcgctgggaggttgaggaggactggtgcctcagcgtgctccgatcctatcaggcagagcatggtcctgattttccttggtctgtgggcgaggatatgtccgccgatgggcgtaggcagcttgctctgtttctggcgcgaaaacatttacacaacttcgaagccacgcattgtacgcccttgcctgcccagaacttccagatgccttggcatctgtag

SEQ ID NO: 212921 - DNA, 1806 bp, Artificial Sequence
  Description of Artificial Sequence: Synthetic coding sequence
atgagtcagcttgctcgcaggaggtcccgctatggattgacgagcagggcgcacaatacctccgaggctgggagagcaggccctgccggtggccctgcagcgggacgcgcagctgcgcgtgcaggagctatggcaaagctgcttagctgcgttctaggtccaaggctctacaagatctatagagagagggactcagaaagagctcctgcttccgttccagagacaccaaccgctgtcactgcacctcattcctcctcatgggatacatactatcagccccgagccttagaaaaacatgctgactctatcttagccctagcgagcgtcttctggtctatttcttactattcttctccatttgcatttttctacttgtaccgcaagggctatctctctctgtccaaagtcgttcctttctcgcactacgccggaacattactcttactccttgctggggtcgcctgtctccggggaattggaaggtggactaacccacagtaccggcagttcattactattctggaagcaacgcaccgcaaccagtcatctgaaaataagaggcagcttgccaactataacttcgactttagatcgtggcctgttgattttcattgggaggagcctagttctaggaaggagtccagagggggaccttcaagacgcggagtggccttactacgaccagaaccactgcaccgaggcaccgccgatacgctcctcaaccgggtgaagaaactcccctgccagataactagctacctcgtggctcacacactgggaagacgcatgttgtacccgggatccgtgtatctcttgcagaaagcactcatgcctgtgctacttcaagggcaggcacggctagtggaggagtgtaatggacgcagagctaaactgctcgcctgtgacggtaatgaaattgacactatgttcgtggacaggcgaggcactgctgaacctcagggacagaagttagtgatatgttgtgaggggaacgctggcttctatgaggtggggtgtgtgtctacaccactggaggctggctactccgttctgggctggaatcatccgggatttgcaggatctacaggtgtgccctttcctcagaatgaagcgaacgcgatggatgttgttgttcagtttgcaatccatcgactcggcttccagccccaggacattatcatttacgcgtggagcataggcggattcactgccacctgggccgctatgtcctaccctgatgtatccgctatgatcttggacgcgagctttgacgacctggtgccgctggctttgaaagtcatgcccgactcatggcgcggactggtgactaggacagtgcgtcagcatttaaacctgaacaacgctgagcaactgtgcaggtaccaggggccagtgctgctcatcaggcgcaccaaagatgagattattacgacaacagtgcctgaagacatcatgtcaaaccgcggaaacgacttgctgctgaagttactgcaacaccgatatcctagggtgatggctgaagaaggcctaagagtggtgcgccaatggctggaagcgagttcacagctggaggaagctagtatctattccagatgggaggtggaggaagattggtgtttaagcgtgctgagaagttatcaagcggagcacggtccagacttcccttggtcggtaggggaagacatgagtgccgacggcaggcggcaactggcattgttcctcgcgagaaagcacctccacaatttcgaagctacgcactgtacacccctgccagctcagaatttccaaatgccatggcacctctag

SEQ ID NO: 212922 - DNA, 795 bp, Artificial Sequence
  Description of Artificial Sequence: Synthetic coding sequence
atgccaccaccagccctctttctctcctccctgtaccccaggcttgagttccaaaatgatttctatcggtcctgcattcgacggtcctctccacaacctcctccaaaccttgcttggaggccagaatcactttattccggagaattggcaggcggtggctatctaagtctctcaaaggtggtgcccttctcacactatgctggcaccctgctcctgcttcttgccggagtggcctgtttacgcggtattggccgttggactaatcctcagtaccgccagtttattacaattctcgaagcaacacaccgtaaccagagctcagagaataagcgtcagctcgcaaactataattttgactttcggagctggccagtggatttccactgggaagagccctctagccgcaaggaaagcaggggcggacccagccggcgaggtgttgccctgctgaggccggaacccctacaccgtggtacagctgataccttgctgaacagggtgaagaaactaccatgtcagatcacttcctatttggtggctcacacccttgggaggagaatgctttatcccggaagtgtgtacctcctgcagaaggccttaatgccggtcttattacaagggcaggcgaggctagtggaagagtgcaacggaagaagggccaaacttctggcttgtgatgggaatgaaattgacacaatgttcgtcgataggcgcggaaccgccgaaccacagggccagaagttggtgatttgctgtgagggcaacgccggattttacgaggtcggatgcgtctag

SEQ ID NO: 212923 - DNA, 795 bp, Artificial Sequence
  Description of Artificial Sequence: Synthetic coding sequence
atgccacctccggctttgttcctctcctctctttacccgaggttggaattccagaatgacttctatcgttcctgtatacgacgtagttctccccagcctccacctaatctcgcctggcggcctgaaagcctgtacagcggcgaactggctggagggggttacctctccctttctaaagtggtgcctttttcccattatgctgggaccctactgctgctcctggctggcgtggcgtgtctcaggggaattggcaggtggacaaatcctcagtatcgccagtttatcacgattctggaagccacccacagaaatcaatcctcagaaaataaacggcagctggccaattacaatttcgactttcgttcttggcccgtcgacttccactgggaggagccctcttcccgcaaggagtccaggggtggtcccagcaggcgcggtgtggccctgctcagacctgaacccctccaccgtggcactgctgacactctactgaatcgcgtgaagaagctcccctgtcaaattacctcatatctggtcgcccacactctgggcagaagaatgttgtaccctggttcagtgtacttgttgcagaaggcacttatgcctgtgctccttcaggggcaggctagactcgtagaggagtgcaacggcaggagagcgaagctgctggcctgtgatggaaatgagatcgacactatgttcgtggacagacggggaactgctgagccgcagggccagaagctagtcatctgttgtgaggggaatgccggattctacgaggtgggctgtgtatag

SEQ ID NO: 212924 - DNA, 795 bp, Artificial Sequence
  Description of Artificial Sequence: Synthetic coding sequence
atgccccctcccgctctgttcctgtcctcgctttacccgaggctcgagttccagaacgacttttacaggtcttgcattcggcgaagctcccctcagccgccaccaaatcttgcatggcgcccagaaagtctgtattctggagaactagccggaggtggctacctgagcctgtctaaggtggtgcctttttctcactacgcaggaaccctattactcctgctggccggtgtcgcatgccttagggggatcgggagatggactaacccccaatatcgtcaatttatcaccatcctggaggcaactcaccgaaaccagtcaagcgagaacaaaagacagttggccaattacaacttcgatttcagatcatggcccgtggactttcattgggaagagccatccagcaggaaggagagtagagggggaccttcaagaaggggcgtagcactgttacggcctgaacccctccatcgaggcacggctgacacgttacttaacagggtgaagaagcttccatgccagatcacttcttacttggtggcacatacccttgggaggaggatgttataccccggttctgtgtacctgctgcagaaagcgctgatgccagtcctcctgcaaggacaggcaaggctggtggaagagtgcaacggacgccgagccaaactacttgcttgtgatggtaatgagatcgacactatgttcgttgacaggcggggaaccgcggagccacagggtcagaaactcgtcatctgttgtgagggcaacgccggattttatgaagttgggtgcgtgtag

SEQ ID NO: 212925 - DNA, 1806 bp, Artificial Sequence
  Description of Artificial Sequence: Synthetic coding sequence
atgagtcagttggccagaagaagatcacgctacggcctgacgagtagagctcacaacactagcgaagcgggacgtgctggtccagccggtggtcccgcagccggtagagccgctgctagagccggagcgatggccaaattgttatcctgtgtgctgggacctcgactttacaaaatttacagggagcgagattccgagcgggctcctgcctcagttcctgaaacacccacagccgtgacagccccacatagctcatcatgggacacctattaccagccgagagctctcgaaaaacacgcagactctattctggcactcgcgagcgtattttggagcatcagttattattcatccccattcgccttcttctacttgtaccggaagggatatctttctctgtcaaaggtcgtgcctttctcacactacgccggtacgctcctgctactgttagccggtgtggcatgcttgagggggatcggtaggtggaccaatccccagtaccgccagtttattacaattcttgaagccactcacagaaaccaatcttcagaaaacaagcggcagctcgctaactataattttgatttcagatcctggccagtggatttccattgggaagagcctagttccagaaaagaaagtagagggggtcccagccgaagaggcgtggctctcctgcggcctgagcctctgcatagaggtacagccgacaccttgttgaatagggtcaagaagcttccatgccagataacgtcctacctggttgcccacacactaggacggagaatgctgtaccctggctcagtgtacctgctgcagaaagccttgatgccggttctgctgcaggggcaggcacggctggtcgaagagtgcaatggaaggcgagccaaattgctagcctgcgatggcaatgagatagatactatgttcgtggatagaagagggacagcagaaccccagggacagaaattagtcatttgttgtgaaggtaacgcaggcttttatgaggtgggatgcgtgtccacccccctggaggccggatattccgtcctcggctggaaccaccccggttttgccggaagtactggcgttccctttccccagaacgaggcaaacgcgatggatgtggtggtccagttcgcaatccacagactgggtttccagccacaggacattataatttatgcttggagcatcgggggtttcaccgcgacatgggcggctatgtcttaccctgacgttagtgcgatgattctggatgccagctttgacgatctggtcccccttgccctgaaagtaatgcccgactcctggagaggcctggtgacccggactgtcaggcagcatctaaatcttaacaacgccgagcagctgtgccgataccaggggcctgtgctcctgatccgacgaaccaaggacgagatcatcaccactactgtaccagaggacatcatgagcaaccgaggcaatgatcttctcttgaaactcttgcagcaccgctacccccgagtgatggccgaggagggactcagggtggttaggcaatggttagaggccagctctcagctcgaagaggcatcgatttactctcgttgggaagtggaggaagactggtgcctgagcgtcctgcgctcatatcaagctgagcatgggccagacttcccctggtccgtaggggaagacatgagtgccgacgggaggcgccaattggctctctttctcgctcgtaagcacttacacaatttcgaagccacccactgtactccgctgcctgcccagaatttccagatgccatggcacctatag

SEQ ID NO: 212926 - DNA, 795 bp, Artificial Sequence
  Description of Artificial Sequence: Synthetic coding sequence
atgccacctccggcacttttcctgagttctttataccctcgacttgagttccagaatgacttctacagatcctgcattaggcgctcgagtccccaacccccacccaacctggcatggcgccctgagagtctctatagcggagagctggccggtggcggttatttgagcctgtctaaagtggtgcctttctcacactacgctggcaccctgttgcttctgttggcaggggtcgcttgtttgagaggaattggcaggtggaccaacccacagtatcgtcaatttattaccattctagaggctacacacaggaaccagagtagtgagaataagcgccaattggccaactataattttgacttcagatcctggcctgtcgactttcattgggaggaaccaagttcaagaaaagagtctaggggaggtccaagtagacggggagttgcgcttcttcggcctgaacccctgcacagggggacggccgatacccttttgaaccgcgtaaagaagcttccttgtcagattacgtcctatctggtggcccacacacttggcagacgcatgctatacccaggaagcgtgtacctgctgcagaaagcgctcatgcccgttttgctgcaaggccaggcacgccttgtggaggagtgcaatggcagacgtgccaagctgctcgcttgcgatgggaatgagatcgacacaatgtttgtggacagaagaggtacggctgaacctcagggccagaaactggtcatttgctgcgaaggcaacgctgggttctatgaagtggggtgtgtatag

SEQ ID NO: 212927 - DNA, 1806 bp, Artificial Sequence
  Description of Artificial Sequence: Synthetic coding sequence
atgtcccagctcgcccgtcgtaggtcaagatacggactgacgagccgggctcacaatacatccgaagccggacgggcaggtcctgccggaggtcccgcagctggtcgtgcagccgctagggcaggggcaatggcaaagctcctgtcctgtgtgttgggccctcgcctatataagatctaccgggaaagagacagcgagagggcgcctgctagcgttccagaaacccccaccgctgtcacagcacctcatagcagctcctgggacacatattaccaacctcgtgcactggagaaacatgcggattccatcctggcgctggcctctgtgttctggagcatctcgtattactcctcaccatttgccttcttctatttatatcggaaaggctacctgagcctgagtaaggtggtgcccttctcccactacgccggaacccttctgttgctgctggccggagtggcatgtttgcgtggcataggcaggtggaccaaccctcagtatagacagttcatcaccatcctcgaagccactcaccgcaaccagtccagcgagaacaagcgtcagcttgcaaattacaacttcgattttaggagttggccagtggacttccattgggaggaaccaagcagcagaaaagagagtagaggaggccctagccggaggggggtggcattacttcggccagaacctttacaccgagggactgcggatacactgctgaatagagtcaagaagcttccgtgccaaattacctcttacctcgtcgcgcacactctcggacgcaggatgctgtacccgggatccgtgtacttattgcaaaaagctctgatgcccgtgttgttgcagggtcaagcgcgtctcgttgaggaatgcaacggccgacgggcaaaattattggcctgtgatggtaacgaaattgacacaatgttcgttgacagacggggtaccgcagagcctcaggggcaaaaactggtgatatgttgtgaagggaatgcagggttttatgaagtgggctgtgtttcgacacctctggaggccggatacagcgtgcttgggtggaaccatcccggatttgcaggcagtacaggggtccccttccctcaaaatgaagcaaatgccatggacgtggtggtacaattcgctattcatcgcctgggcttccaaccacaggatattataatttacgcatggagcattggaggttttacagccacctgggcagcaatgtcttatccagacgtgagtgcgatgatcctcgacgccagctttgacgatttggtgccactcgccctgaaggtgatgccagacagctggcgcggtcttgttacccgcactgtgagacagcacctgaatctaaataatgcggagcaactgtgcaggtatcagggccctgtcttgctcattagaagaaccaaagacgaaatcataacaacaaccgtgccagaggacataatgtccaatcggggaaacgacttgctgctgaaactcttgcaacaccgttacccacgggtgatggctgaagagggcctgcgtgtggtgaggcagtggttggaggcatcctcccagctagaggaagcttctatatactctcgatgggaggttgaagaggactggtgccttagcgtgttaagaagttaccaagccgagcacggtcccgatttcccttggagcgtcggagaggacatgtctgccgacgggagacggcagctggctttgtttctggcccgaaagcatctgcacaacttcgaagccacccactgtacacccttgccggcacaaaacttccagatgccatggcatctgtag

SEQ ID NO: 212928 - DNA, 795 bp, Artificial Sequence
  Description of Artificial Sequence: Synthetic coding sequence
atgccccctcccgctcttttcctctcaagcctgtaccccagacttgaattccagaacgatttctatcgatcctgtatccggaggtcgagcccccagcctccaccaaatcttgcttggcgtcctgagtccctctattcaggcgagcttgctgggggtggttacctcagcctgagcaaggtcgtgccattcagccactatgccggaactctgctcctgctgcttgctggcgtcgcatgcctccgaggcattggcaggtggaccaatccacagtacaggcaatttatcaccatactggaggccactcaccgtaatcagtcctctgagaacaagaggcagctcgccaactataatttcgactttaggtcctggccagtagacttccactgggaggaaccttctagcagaaaggaaagccgcggtggcccttcccgcaggggggtggccctcctgcggcctgagcctctgcatagaggtactgccgatacgctcttgaatcgagtcaaaaagttgccttgccagatcacatcctacctggtggcccataccttggggaggagaatgctgtacccagggtccgtctatcttttgcaaaaggcccttatgccggtcctgctacagggccaagctcgactggtggaagagtgcaatggaagacgcgctaagttgctggcctgtgatggtaacgaaattgacaccatgtttgtggaccggcgtggcaccgctgagccacagggccagaagctggtaatttgctgcgagggtaacgccggattttatgaggtgggctgtgtgtag

SEQ ID NO: 212929 - DNA, 1806 bp, Artificial Sequence
  Description of Artificial Sequence: Synthetic coding sequence
atgagtcagcttgcacgccgacgatctaggtacgggctcactagcagggcacacaacacaagcgaagcagggagagccggacccgcaggtgggcctgctgctgggcgtgcagccgcaagagctggcgcaatggctaaactgctgtcctgtgtgctcggacctcgcttgtacaagatctacagagagcgagattcggagcgggctcccgcttccgtgcccgagacaccaactgcagtgacagccccacacagcagttcatgggacacttactaccagccaagagcacttgaaaagcacgccgatagcattcttgctctcgcgtccgtcttctggagcatttcttattactcctcacctttcgcatttttttacctgtaccgcaagggttacctttccctgtcaaaggtcgttcctttctcacactatgctggcactctgctcctgttgctggccggtgtggcctgtcttcgcggaattggacgttggacaaacccacagtataggcagttcattacaatcctggaggctacccatcgaaaccaatcttccgaaaacaaaaggcagctcgccaactataatttcgattttcgctcctggccagttgactttcattgggaggagccgtctagccggaaagagagtcgaggaggcccttcccgtcgtggcgtggccttgctgcgacctgaacctctgcatagaggcaccgccgatacactgttgaatcgcgtgaagaagttaccgtgtcagatcaccagctacctcgtagcccataccttggggaggagaatgttgtaccccggttctgtgtatctgctgcagaaggcccttatgcccgtgctgctgcagggccaagctagactggtggaggagtgtaacgggagacgtgcaaaactgctggcttgtgatggaaacgagatcgatacaatgtttgtggacaggagaggcacagccgagcctcaggggcagaaacttgtcatatgttgcgagggtaatgcgggtttttatgaagtgggctgcgtgtccacaccattagaagcagggtatagcgtcctggggtggaatcatccagggtttgctggaagcactggggtaccattcccacagaatgaagcaaatgccatggacgtagtagtccagttcgccattcaccgcctgggatttcagcctcaggacataatcatctacgcatggtctatcggaggcttcacggccacatgggctgctatgtcttatccagacgtgagtgcaatgattctcgacgcatcatttgacgatctggttcctctcgctcttaaagtgatgcccgacagctggcgcggtctggttacacgcaccgtgcgccagcatctgaacctgaataacgccgagcagctgtgtaggtatcaaggcccagtactgctgatccgtcgcaccaaggacgagatcatcaccaccactgtgcccgaggacattatgagtaacaggggcaatgatctgttgctcaagttactccaacatagatacccaagagtcatggcggaggaaggactgcgcgtggtgaggcagtggttagaggcttcctctcagttagaggaagctagcatctactccagatgggaggtggaagaagattggtgcctgagtgtgctccggtcgtaccaggctgaacatggacccgactttccatggagcgtcggagaagatatgagtgctgatgggcgacggcagctggctctgttcctcgcccgaaagcacctgcacaactttgaagccactcactgcaccccactgcctgcacagaatttccaaatgccttggcatctttag

SEQ ID NO: 212930 - DNA, 795 bp, Artificial Sequence
  Description of Artificial Sequence: Synthetic coding sequence
atgcctccgcctgccttgttcctatctagcctctacccccgacttgagttccagaacgacttttataggagctgcattcgcagaagctctcctcagcctccacctaacctcgcctggcggcctgaatctttatactctggtgagctggcaggtggcggatacctgtccctgtcgaaagttgtaccctttagtcactacgccggtacactgctcctgcttctcgcgggtgtggcatgtctgagagggattggcagatggaccaacccgcagtaccgtcagttcattacaatcttagaagcaacccaccgaaatcaatcatctgaaaacaaaaggcagttggcgaattataactttgactttcgctcctggcccgtagattttcattgggaggagccgtcctccaggaaagagagtcggggaggcccaagtcgcaggggagttgcattgctaaggcccgagcccctgcaccgcggtacggcagacactctgcttaaccgcgtgaagaaactgccttgtcagattacatcatatctcgtcgcgcacactttgggcaggcggatgctgtaccctggatccgtgtacctcctacaaaaggcgctcatgcctgtgttgctgcagggccaggcgaggctggtggaagagtgcaacggcagaagggctaaactattagcttgcgacggaaatgaaatcgacactatgttcgtcgatcgacggggaactgccgagccacaagggcagaagctggtgatctgctgtgaaggtaacgcagggttctacgaggtcggctgcgtttag

SEQ ID NO: 212931 - DNA, 1677 bp, Artificial Sequence
  Description of Artificial Sequence: Synthetic coding sequence
atggcaaaactgttatcatgtgtcctcggacccagactttacaagatctatagagagcgggattcggagcgcgctccggctagtgtccccgaaacccccaccgcagttacagctccgcacagctctagctgggatacttactatcagccgcgagctcttgaaaagcacgcagattcgatacttgctctggcttctgtgttctggagtatctcatattacagtagtccattcgccttcttttacctatacagaaagggctatctctcgctgtctaaggttgtcccgttttcccattacgccggtacactgttgttgctattggccggtgtggcctgtctcaggggaatcggtcgttggacgaatccacagtaccggcaattcatcacgatactggaggcaacgcaccgcaatcagtcgtctgagaacaagcgccagctagcaaactacaacttcgacttcagatcctggcccgtggactttcactgggaagaacctagcagcagaaaggaatccagagggggaccctctcggaggggagtggcactgctgagaccagaacccttgcataggggtacagccgacacgctcctgaatcgagtgaagaagcttccctgccagataacgtcttacctggtggcacacacattgggcagacgcatgctttaccccggtagcgtctacctcctgcagaaagccctgatgcctgttttgctgcaaggacaagctaggcttgtggaagagtgtaatggtcggcgagctaaactcctagcgtgtgacggcaatgagattgacaccatgttcgtggatagaagagggactgccgagccccaagggcagaaactagtgatttgttgcgaggggaatgccggattttacgaagtggggtgcgtgagtacgccgcttgaggccggatatagcgtcttgggatggaatcatccaggattcgcaggaagtactggtgtccctttccctcagaatgaagccaacgccatggatgtcgtggttcagttcgcaattcatcggttgggctttcaaccacaggacattatcatctatgcctggagcattggcggattcacagcaacatgggccgcaatgtcctatccagacgtttcagcaatgattctggacgcctctttcgatgacttagtgcccctagctctgaaagtcatgccagatagctggagaggcctggttacccgtaccgtccggcaacacttgaaccttaataacgcagagcagctctgccgctaccagggccctgtgttgctcatccgtagaactaaagacgaaattattactactaccgtccctgaggacattatgagtaatagggggaatgatttgctgttgaaactgctacagcatcgctaccccagggtcatggctgaggaaggcttgcgagtcgttaggcagtggctcgaagcgtcctctcaactggaagaggcaagcatttattccagatgggaggtggaagaagattggtgcttaagcgtgctgcgatcctaccaggccgagcacggcccagacttcccttggagcgtgggcgaagatatgagtgcggacggacgacggcagctagctctgttcttggcaaggaagcatctgcacaattttgaagccacacattgcacacctttgcccgcacagaatttccaaatgccttggcacttgtag

SEQ ID NO: 212932 - DNA, 1806 bp, Artificial Sequence
  Description of Artificial Sequence: Synthetic coding sequence
atgagtcaactggcacggagaagatctcgatatggcctgacatcaagagcacataatacaagtgaagccggtcgcgctgggcctgcaggcggacccgcagcaggcagagctgccgctcgagccggtgccatggctaagttgctgtcttgtgtgctgggaccgaggctctataagatctaccgagaaagggattccgagagggcccctgcgtcagtccctgagacacctaccgctgtgaccgcacctcattcctcctcttgggatacttactaccagcctagagcattagagaaacacgctgacagtatattagccttagcgagcgtgttttggtccattagctactatagctcccctttcgccttcttctacctctaccgcaagggatacctgagcttatcaaaagtggtgccattctcccactatgccggtactctgctgctgcttctcgccggtgtggcatgtcttcgagggatcgggagatggactaacccacagtatagacaattcatcactatactggaagccactcatcgcaaccagtcatccgaaaataaaagacagctagccaactacaattttgactttcgcagctggccggtagactttcactgggaggaacccagcagccgaaaggagtctcggggtgggccaagcaggaggggcgttgcactgctcaggccggaaccgttacaccgtgggacggctgatacactgttaaacagggtaaaaaaacttccatgccaaattaccagctatcttgtggcacataccctgggcagaaggatgttatacccagggagcgtatacctgctgcaaaaggccttaatgccagtgttgttacaggggcaagccaggttggttgaagaatgcaacggtcgtcgagccaaactgttggcttgtgacggaaacgagatcgacacaatgttcgtagataggcggggaacagccgagccccaaggtcaaaaactggtgatttgttgtgagggcaacgccggattttacgaggtgggatgtgtgagtacacctttggaggctggttacagtgtcctgggctggaatcatcctggcttcgccggtagcaccggagtgcccttcccccagaatgaggccaatgccatggatgtggttgtccagtttgccattcatcgtctcgggttccaacctcaggatatcatcatttacgcttggtcaattggcggttttaccgctacatgggctgcaatgtcatacccagacgtgtccgctatgatcttagacgctagctttgatgatcttgtgccactggccttgaaggttatgccagactcctggcggggactcgttactcggacggtaagacagcatctgaacttgaacaacgcagaacagctctgcagataccaggggccagttctgctgattcgcagaaccaaggatgaaataataaccacaaccgtgccagaggatatcatgagtaacaggggcaatgatctgctcttgaagttgctgcaacaccgataccccagggttatggcagaggaggggttgcgggttgtgcgacagtggttagaagcctcctctcagctagaagaggcttccatctatagccggtgggaggtagaagaggactggtgcctgtcagtcctgagatcatatcaggccgagcacggccctgacttcccatggtctgtaggcgaagatatgagtgcagatggtcggcgtcagctcgccctgttcctagcgaggaaacatctacacaacttcgaagcgactcattgtacgcccctgcctgctcaaaattttcagatgccctggcatttatag

SEQ ID NO: 212933 - DNA, 438 bp, Artificial Sequence
  Description of Artificial Sequence: Synthetic coding sequence
atgttggggcattgctgctacttctggcaggtatggcccgctagcgaagcgcttgcggcagggcctacaccctccaccggaagttccagccccagctggaaacagcatataggaactagtctccagaagactaggggttccctccctacgacaaccctaacctcgggtgcaggccaaagcacttcaactggcaagaaccccgctgccggtcgcagcctcgagggagcgctccctgccggagtatggccatgctttgcgcagagcccatgcacagggggacaacagacgccaagcagcaccggactgcgtagttgtctggtgagaagccctggtggcaagcagcagagaggggaagctcattggggcggtggtgccatatcgggtgtgctttgggaatgggcgctccactgcaagattgccgtcacacattgggcatag

SEQ ID NO: 212934 - DNA, 1677 bp, Artificial Sequence
  Description of Artificial Sequence: Synthetic coding sequence
atggccaagctgctgagctgtgtcctgggtcccaggctgtacaaaatctatagggaaagggattctgaacgggctccagccagcgtgcccgaaacacccaccgcggtgacagcaccgcatagcagttcatgggacacctattaccagccaagagcattggaaaagcatgctgatagcattctggcactggcgtccgtgttttggagtatctcctattacagctctcccttcgcctttttttatttgtatagaaaggggtatctctcactgagtaaggtagtgcctttctcacactatgccggtacactgctgttactcctggccggagttgcctgccttcggggaatcggtcgttggaccaacccacagtacagacagtttattaccatcttagaggctacacaccgcaatcagagctccgagaacaaacgtcagttagccaactacaacttcgatttccgatcctggccagttgactttcattgggaggaaccgagctcccggaaggaaagccggggaggccctagtcgcagaggagtggctctgctcagacctgagcccttgcatcgcggtacggccgatacccttcttaatcgagttaaaaagctgccatgccagatcacctcctatttagtcgcccacacactagggcgtcgaatgctgtaccccggatccgtgtacctgctgcagaaagctttgatgcctgtactgttacaggggcaagccagattagtggaggaatgcaatggccgtagggctaagctgctcgcctgcgatggaaacgagattgacacgatgttcgttgacagaaggggtaccgcggaaccccagggccagaaactggtgatctgttgcgaaggtaacgcagggttctatgaagtaggatgcgtttctacccccctagaggctggatactctgtcctcggctggaatcacccagggtttgccggttccacaggcgtcccttttccccagaatgaggcaaatgccatggacgtagtggtccagtttgcaatacatcgactggggtttcagcctcaagacattatcatctacgcatggtcgattggcggattcactgctacttgggctgcaatgagctacccagacgtttccgcaatgattctcgatgcctccttcgacgacttagtccccctagctctaaaggtgatgccggattcttggcggggacttgtgactcggaccgtgcgtcagcacctgaatctcaacaatgccgagcagctttgtcgctatcaaggaccagtcctgctgatcaggcgtacaaaagatgagatcattaccactacagtccctgaagatatcatgagtaaccgtgggaacgatctgttgctcaagctcttgcagcacagatatccaagggtgatggctgaggagggccttagagtggtgagacagtggctagaagcgtcaagtcagctcgaggaagcctctatctactctcgctgggaggtggaagaagattggtgtctcagcgttctgcgcagctaccaggctgaacacggacctgatttcccctggtccgtaggagaagacatgtctgctgacggacgcagacaactggcactcttccttgctcggaaacaccttcataacttcgaggcaacacactgcacacctctgcccgcacagaacttccagatgccttggcatctgtag

SEQ ID NO: 212935 - DNA, 1677 bp, Artificial Sequence
  Description of Artificial Sequence: Synthetic coding sequence
atggctaagctgctctcatgtgtcctcggaccacgcctgtacaaaatctacagagaaagggattccgaaagggcccctgctagcgtccccgagacacccacggccgttactgcccctcattcaagctcctgggatacatactaccagccaagggcccttgaaaagcacgctgacagtattctcgctctggccagtgtcttctggtcaatatcatattactcttctcccttcgcatttttttacctctatcgcaaggggtacctgtctctcagcaaggtggtgcccttttctcactacgcaggtaccctgctgctgctgctcgccggtgtggcatgtctgaggggaataggcagatggaccaatccacagtatcgacagttcataacgatacttgaggccacacatcgaaaccagagttctgagaataaacggcagttggctaattataattttgatttcagatcttggccggtggacttccactgggaggaaccgtcctccaggaaagaaagcaggggcggaccctccaggcggggagtggctctcctgaggcctgaaccattgcaccggggtacagccgacactctgctgaacagagtgaaaaagctgccttgtcaaattacatcatatttagtggcacatacattgggcaggaggatgctttatcctgggtctgtttatttgctgcagaaagccctcatgcccgttctccttcagggacaggctcgacttgtggaagagtgtaatggcagaagagccaaactgctcgcttgcgacggtaatgaaattgatacaatgttcgttgaccgtagaggtactgccgagcctcaggggcagaaactcgtgatttgttgcgaaggaaacgcagggttctacgaggtcggttgcgtcagcactccattggaagctggttactcagtcttgggctggaatcaccccggattcgccggttccactggcgtccccttccctcagaacgaagctaacgctatggatgtggtagtccagttcgcaatccaccgactgggatttcagcctcaggatattatcatctatgcttggtcgatcggcggttttaccgccacatgggctgccatgtcgtatcctgacgtgtcagccatgatcttggacgcaagtttcgatgacctcgtgcctctagccttgaaggtgatgccagattcatggcggggattagtgaccaggaccgtccgtcaacatctgaatctcaataacgcagagcagctgtgccggtatcagggtcctgtgctgttaatccgccgaacaaaggacgaaataattaccaccaccgtgcctgaagacatcatgagcaaccgcggtaacgaccttctcctgaagttactccagcacaggtatccaagagtgatggccgaggagggacttcgggttgtccgccaatggctggaagccagctcccaactggaagaggcgagcatttactctcgttgggaggttgaggaggactggtgcctctctgttctcaggtcgtaccaagccgaacacggtccagacttcccctggagtgttggagaggatatgtctgcggatgggagacggcagctggctctgtttttggccagaaagcaccttcacaatttcgaagccactcattgtactcctttacccgcacaaaacttccagatgccttggcatctgtag

SEQ ID NO: 212936 - DNA, 1677 bp, Artificial Sequence
  Description of Artificial Sequence: Synthetic coding sequence
atggcaaaattattgagctgcgttctgggccctaggttatacaaaatttatagagaacgagatagcgaaagggctcccgcttcggtgcccgaaaccccaaccgcagtgacagcgccacactccagtagctgggatacatactatcaacccagggccctagaaaagcacgccgatagtatcttggccctggcgtcagtattttggagcatttcgtattactcctccccctttgcattcttttacctctataggaaaggatacctctcactcagcaaggtcgtgccgttctcgcattacgccggtaccctgctgctgctactggcaggcgtcgcttgcctgcgaggaataggtcgctggaccaaccctcagtaccgccaatttataactattctggaagcaacccaccgtaaccagtcttccgagaacaaacggcagctcgccaattacaacttcgacttccgatcctggcccgtcgacttccattgggaggagcctagctccagaaaagagagccgaggcggaccctcacgccgtggagtcgctctcctgaggcctgagcctctgcataggggaacagctgacaccctcctgaatagagttaaaaaactcccctgtcagatcacctcatatctcgtggcacacactctgggtagacgcatgctgtaccctgggtctgtgtacctgctccagaaggccctgatgcccgtgctgctccagggacaggccagattagtggaggagtgcaatggcaggagagcaaagctattagcttgcgacggtaacgagatagacacgatgttcgttgaccgccgtggcactgcagagcctcagggtcaaaaactggtcatctgctgtgaggggaatgccggattttacgaagtgggttgtgtgagtaccccactggaggcaggctacagcgttttgggatggaatcaccccggtttcgctgggtctaccggggtccctttcccccagaatgaagctaatgctatggatgtggttgtgcaattcgcaattcacaggctgggcttccagccacaggatatcattatttacgcttggagcattgggggattcaccgcaacatgggctgctatgtcctaccctgacgtttcagctatgatcctcgacgctagctttgacgatctagtacccctggcactaaaggtgatgcctgatagctggaggggtctagtgacgagaacagtgcgtcaacacctaaacctgaataatgctgaacaactttgtcgttaccagggcccagtgctgttgatcagaaggacaaaggacgagattattacaacgactgttcctgaggacatcatgagtaataggggaaacgacctgctcctgaagcttctccaacacagatacccccgagtgatggccgaggagggcttgagagtcgtgcgtcaatggttggaggccagcagccagctcgaggaagcttccatttactccaggtgggaagtggaggaggactggtgcctgtctgttcttcgtagctaccaggctgagcacggccctgacttcccctggtccgtcggggaggacatgagcgccgacgggcgtagacagttggctctatttcttgccagaaagcatctgcacaactttgaagcaacgcactgcacccctctcccagctcagaatttccagatgccgtggcacctttag

SEQ ID NO: 212937 - DNA, 438 bp, Artificial Sequence
  Description of Artificial Sequence: Synthetic coding sequence
atgcttgggcactgctgctacttttggcaggtttggccagcctcggaggctctggctgcagggccaaccccttccactggctcctcctctccttcctggaaacagcatatcggcacctcattgcagaagacaagaggaagccttccaacaactacgttaacctctggggcaggccaaagtacatcaacaggcaaaaaccccgcagctgggcgaagtctcgagggcgcacttccggctggcgtctggccttgtttcgcccagagcccttgtacgggcggacagcaaaccccttcaagcacaggattgaggtcctgtcttgttagatcacctggcggaaagcaacaaagaggggaggcccactggggaggaggagctatctccggagtgctctgggaatgggctctgcactgcaagattgctgttactcactgggcttag

SEQ ID NO: 212938 - DNA, 438 bp, Artificial Sequence
  Description of Artificial Sequence: Synthetic coding sequence
atgcttggccattgttgttacttttggcaggtgtggcctgcgagtgaagccctcgcagctggaccaacccccagcacaggcagttcttctcccagctggaaacagcacattggaacctcattgcagaagacgagaggatccctgcccactaccaccctgaccagtggagcaggccagtccaccagtactggcaaaaatccagcagccggaagatcgcttgaaggcgcactaccagccggagtatggccatgcttcgctcaaagcccatgcacgggagggcagcagaccccttcctccaccggcctgcgaagctgtcttgtgcggtccccagggggtaagcaacagaggggggaagctcattgggggggaggggctataagtggagtgctgtgggaatgggctctgcactgtaagatagccgtcacccattgggcttag

SEQ ID NO: 212939 - DNA, 438 bp, Artificial Sequence
  Description of Artificial Sequence: Synthetic coding sequence
atgcttggccactgctgttatttttggcaggtctggccagctagtgaggccttggcagctgggccaactccaagcacagggagctcttctcccagctggaagcaacacatcggaacctcactgcagaaaactcggggatccctgcctacaaccacgctcacctctggagctggccaaagtacctcaactggaaagaaccccgctgcaggccgttccctggaaggagccctcccagccggtgtttggccctgttttgcgcagtcgccatgcactggcggtcagcagactccatcgtctacgggcctccgtagctgtctggtgcggagccctggtggcaagcaacagcgcggagaggcccattggggaggcggagcaatcagtggggtcttgtgggaatgggctctgcactgtaagatcgccgtgacacactgggcatag

SEQ ID NO: 212940 - DNA, 1578 bp, Artificial Sequence
  Description of Artificial Sequence: Synthetic coding sequence
atgcctcctccggcactctttctctcgtccctttatccacgacttgagtttcaaaatgatttctatagaagctgtattaggagaagtagtccccagccgcctccaaatctggcttggaggcccgaatcactctattccggagagttagcgggaggcggatacttgtctctgagtaaagttgttccattctcacactacgcagggactctgctcctccttttagcgggtgtggcctgtctcaggggcattggccgttggacaaacccccagtacaggcagttcatcaccattcttgaggctacacataggaaccagagcagcgagaataagaggcagctggcaaactataatttcgactttagatcctggccagtagatttccactgggaagagccttcaagccgaaaggaatcaagagggggaccttcccgacggggtgtggcgctgttgaggccagagcctctgcatcgtggtactgccgatacattgctgaaccgcgtcaaaaaactcccttgtcagatcacgtcatacctcgtggcccatacgttaggcagaaggatgctgtatcctggtagcgtctatcttctccagaaagctctcatgcccgtacttctgcaaggacaggcgcgattggtggaggaatgcaacggcagacgggctaagttactcgcatgcgatggcaatgagattgataccatgtttgtcgatcggcgagggaccgccgagcctcagggccagaaactcgttatttgctgtgaggggaatgcgggattttatgaagtaggatgcgtgtccaccccgctcgaggctggctatagtgtgctgggatggaatcatcccggatttgccggaagcacaggtgtgccattccctcagaacgaggcaaacgccatggatgttgtggtccagttcgctattcatcgcctgggttttcagccacaggatatcattatctacgcatggtccatcggtggcttcacggcaacttgggctgccatgagctaccccgacgtgagtgccatgatcctggatgctagctttgacgacttagttcccctggccctgaaggtgatgcctgacagctggcgcggtctggtcacaaggaccgtgcggcaacacctgaatcttaacaatgcagagcagttgtgcaggtaccaggggcctgtgctcttgatccgaagaacaaaagacgagatcatcactaccaccgttcctgaggatattatgtcgaatcgcggtaatgatctgcttttaaagctactccagcatcgttatccgagagttatggctgaggaaggtctgcgggtggtgagacaatggcttgaagcctccagccagctcgaagaggcttccatctatagcagatgggaggtcgaggaagactggtgcctgtctgtgttgcgaagctaccaggccgagcatggcccagacttcccttggtctgtgggcgaggacatgtccgccgacggacggaggcagctggctctttttctggccaggaagcatctccacaatttcgaagcgactcactgcacacccctccccgctcagaacttccagatgccgtggcacctttag

SEQ ID NO: 212941 - DNA, 1677 bp, Artificial Sequence
  Description of Artificial Sequence: Synthetic coding sequence
atggcaaaattactgagctgtgtgctcggaccaaggctgtataagatctaccgagagcgggactctgagagggccccagctagcgttcctgaaacgccaacagccgtgactgctccacatagctcttcttgggatacctactaccagccccgagccctagaaaagcacgccgattctattctggctttagcctccgtgttctggagcattagctattatagcagccctttcgctttcttctatctgtacagaaaaggatacctcagcctgtctaaagtagtgccgttttcgcactacgctgggactctacttctgctactggccggagtcgcatgcttaagaggcatcggcaggtggacaaatccacagtataggcagttcatcacaatcctggaggctacccatagaaatcagtccagcgagaacaagcggcagctggccaattataactttgatttccggagttggccagtggacttccactgggaagagccaagcagccgtaaagagagccgtggcggaccttcccggaggggcgttgctctgctcaggccagagccactgcacaggggtaccgccgatacactgctgaatagggtcaagaagctgccctgtcagatcacatcctacctcgtcgctcacaccttggggagacgtatgctgtatcccggttctgtgtacctgttacagaaagcactcatgcctgtgcttctccagggacaggctcgcctcgtggaagaatgcaatggacgcagggccaagcttctcgcctgcgatggaaatgaaatagatacaatgtttgtggatcgccgtggcacagccgaaccacaaggacagaagctagtaatttgttgcgaaggcaacgcaggattttatgaagtcggatgtgtcagcactccccttgaagccggttactctgttctcggctggaatcacccaggctttgccggttctaccggcgttccctttccccagaacgaagccaatgcaatggatgttgtcgttcaatttgccatccatcgtcttggctttcagccacaggacatcatcatttatgcctggtcgattggagggtttacagccacatgggctgctatgagctaccccgacgtgtctgcaatgatccttgatgcttccttcgacgatctcgtgcccctggctctgaaagtgatgcccgacagttggagaggcttagtgactcgcacagtacgccagcacttaaacttgaacaatgccgaacagctgtgccgctaccagggccctgtgctgctgattcgacggacgaaggatgaaatcatcactaccactgtcccagaagacattatgagcaacagaggtaatgatttactgttgaagctgctccagcataggtatccgagggttatggccgaagagggcctgagagtggtcagacaatggctcgaggccagttcccagctggaagaggctagcatatactccaggtgggaggtggaggaggattggtgtctctctgtgctccgctcttaccaggccgaacatggtccagactttccatggtccgtcggggaggatatgtccgcggacggtagacggcaactggcactattcctagcgagaaagcatctgcataactttgaggccacccactgtaccccactcccagctcagaatttccagatgccctggcacctatag

SEQ ID NO: 212942 - DNA, 1578 bp, Artificial Sequence
  Description of Artificial Sequence: Synthetic coding sequence
atgcccccacctgccctgttcctgtcctctctttatccgagactcgagtttcaaaatgacttttatcgctcttgcattaggcggtctagtccccagccccctcccaatctcgcctggaggcctgagagtctgtactccggggaactcgcaggcggaggttacctctccctctcaaaagttgttccatttagccattacgccggaacattgttgttgttattggcaggcgtcgcctgcctccgtgggatcggcagatggaccaatccccagtacaggcaattcattaccatcctggaggccacacaccgcaatcagtcatctgaaaacaaaaggcagctcgcaaattacaactttgacttccggtcttggccggtggacttccactgggaagagccttccagcaggaaggagtcccgaggtggaccatcccggagaggagttgcactgttaagaccagaaccactgcaccggggaacggcagatacgctgctcaatcgggttaagaagctgccatgccaaattaccagctacttagtcgcccataccctcggcagaagaatgctttaccctggatccgtgtaccttctacagaaagcgctgatgcctgtgctcttgcaggggcaggcaagacttgtggaagagtgtaacggaaggcgcgctaaactgctggcatgtgatggcaacgaaatcgacaccatgttcgtggatcgtaggggaacggcagaaccccagggccagaaattggtcatctgttgtgagggcaacgcaggtttctacgaggtggggtgcgtctcgacgccgctcgaggcaggatacagtgtcttaggctggaaccaccctgggttcgctggcagcaccggagttccttttccacaaaatgaggccaacgcaatggacgtagtggtgcaatttgcgatccaccgactgggatttcagccacaagacataataatctatgcttggtctatcggcggttttactgccacatgggccgctatgtcatatccggacgtttcagccatgatcttggacgccagctttgatgacctagtgcctctcgcactcaaggtgatgcctgactcctggagggggttagtaacgaggacggttcgacaacatttaaacctgaacaacgcggaacaactttgtcgctatcaggggccagtgcttctaatccgcaggacgaaagacgagataattaccaccactgtacccgaagacatcatgagtaatagggggaacgacctgctgcttaaactactacagcaccgctatccccgagtgatggccgaggaaggcctgagagtggtgagacagtggctagaagcatctagccagctggaggaggccagtatctattctagatgggaagtggaggaagactggtgtttatcggtccttcgatcctaccaagccgagcatggcccagacttcccctggtccgtaggtgaagacatgtctgccgacggaaggaggcagctcgcgttattcctggcgagaaagcacctgcacaactttgaggctacccattgtacccctctccctgcccagaactttcagatgccatggcatctgtag

SEQ ID NO: 212943 - DNA, 1578 bp, Artificial Sequence
  Description of Artificial Sequence: Synthetic coding sequence
atgccacctcctgctcttttcctctcttccctttatccaaggctggagtttcagaacgacttctaccggtcttgtatccggagatcttccccccagccacctcccaacttagcatggagacccgagtccctatactcaggagagctggccggtggagggtacctgtccctttcaaaagtcgtgcccttttcacactatgccggtaccttactgttgctgctagcaggtgttgcctgtctcaggggcatcggacgctggacaaatccgcagtaccgacagttcattaccatcttggaggccactcatcggaatcagagcagtgagaacaaacgccaactcgcgaactacaacttcgacttcaggagctggcctgtcgattttcactgggaggaaccctcaagcagaaaggagtcccgtggcggaccctctcgcagaggggtggcactcttgcggccagagcccttgcatcggggtacagcggacactctgctaaaccgcgtcaagaagttgccttgccagattacaagctacctagtcgcccataccctggggaggcggatgctgtaccccggaagtgtctatctcctccagaaggcattaatgccagtgctgctgcaaggacaagcaagacttgtggaagagtgtaatgggaggcgggctaaactgctggcatgtgacggtaatgaaattgataccatgttcgtggatagacggggaacagcagaaccccaaggccaaaaactggtcatttgctgcgaaggaaacgctggtttctatgaagtcgggtgcgtctccactccgctggaggcagggtactctgtgctagggtggaatcaccccggtttcgccggatcgactggcgtgcccttcccccagaacgaagcgaacgccatggacgttgtagtccaattcgccatccacagattaggcttccagcctcaggacatcatcatctatgcttggtcaatagggggattcacggccacctgggcggctatgtcttaccccgacgtgtctgcaatgatccttgacgctagcttcgacgatctggtacctctggcactgaaagtgatgcccgacagctggcgagggctcgtcactcggaccgtaagacagcatctgaatttgaataacgcagaacaactgtgcagataccagggacctgtcctcctgatccgtcggaccaaggatgaaatcattaccaccactgtaccggaggatataatgtcaaatcggggaaatgatctcctgctgaaactattacagcaccggtaccccagagtcatggccgaagaggggctgagagtcgtgagacagtggttggaggcctccagccagctggaagaggccagcatctatagcaggtgggaagtagaggaagactggtgcctctcagttcttaggagttatcaggctgaacatggacctgacttcccgtggagcgttggcgaagacatgagcgccgacgggaggcgtcagctggctctcttcctggccagaaagcatctgcacaactttgaggccacacactgtacgccgctccccgcacagaatttccagatgccctggcacctctag

SEQ ID NO: 212944 - DNA, 438 bp, Artificial Sequence
  Description of Artificial Sequence: Synthetic coding sequence
atgctcgggcactgttgttatttttggcaggtatggccagcgagtgaagcactggcagccggacctacaccctcaacgggatcttcatcaccaagctggaaacagcatattggaacatcccttcagaagactcgcggttccctccctaccaccaccttaacctcgggagctggtcagtcaacctccaccgggaaaaaccccgcagctggacgctcccttgagggcgctctcccagctggtgtatggccgtgcttcgcacaatccccttgcaccggcggacagcaaacacccagctctacaggcttacgctcatgtttggtcagatctcccggaggtaagcagcagaggggagaggcgcattgggggggtggcgcaatctcaggcgtcctatgggaatgggcgctccattgcaaaattgcagtcacccactgggcttag

SEQ ID NO: 212945 - DNA, 1578 bp, Artificial Sequence
  Description of Artificial Sequence: Synthetic coding sequence
atgccccctcccgcattgttcctgagttcattgtacccgaggctcgagtttcagaatgatttttacaggagctgcattagacgaagctctcctcaaccccctcccaacctggcctggcgccctgagagcctttatagtggagaactggctgggggaggatatctcagcctgtcaaaagtggttccctttagccactacgctgggacccttttactcctgctagcaggagtagcctgtctgcgaggcatcgggaggtggaccaatcctcagtaccgccaattcattactatccttgaagcaactcatagaaaccagagcagcgagaataagaggcagctggctaattacaacttcgactttcgatcttggccagtggattttcattgggaggagcccagtagccgtaaggaatcaaggggtggcccatccagaagaggcgtggccctactccgccctgagccattgcaccgcggtaccgctgataccctgctgaaccgggttaagaagctgccttgccagatcacaagctatctggtcgcccatacactgggtcggaggatgctgtacccgggaagtgtgtaccttctccagaaggctctcatgcctgtactattgcaaggccaggctaggctggttgaggagtgtaatggcaggcgtgccaagctccttgcctgtgacgggaacgagatcgacaccatgttcgtcgatcgcaggggtaccgccgaaccccagggacaaaagctcgtgatatgctgcgaaggcaatgccggtttctatgaggttggatgtgttagtacccccctcgaggccggatactcagttctcggctggaaccatcccggatttgcgggttccactggcgtgccatttccccagaatgaagccaatgccatggatgtagttgttcaatttgccattcatagattaggcttccagcctcaggatattataatctatgcatggtcaatcggaggatttacagcaacctgggccgctatgtcctatccggatgtgagcgctatgatcctcgatgccagctttgatgatctggtgccactagccctgaaggttatgcccgactcatggcggggactggtcacgcggactgtccgacagcacctgaatctgaacaatgctgagcagctgtgtcgctatcagggccctgtgctgcttattcggcgtacgaaagacgagatcattaccacaaccgtgccagaggacattatgagtaacaggggcaacgacctcctgctgaaactacttcagcatcgctatcccagagtcatggccgaagagggactgagagtggtgagacagtggttggaggccagttcccaactggaagaggctagtatctactctcggtgggaggtagaagaggactggtgcctttccgtcctcagatcataccaggcagaacacggaccagatttcccctggtcagtgggagaagatatgtcagccgacggtagaagacaactggcactgttcctcgccagaaaacatctgcataactttgaggcaacgcactgcacccctctccctgcacagaatttccagatgccgtggcatttatag

SEQ ID NO: 212946 - DNA, 1677 bp, Artificial Sequence
  Description of Artificial Sequence: Synthetic coding sequence
atggctaaactgctgtcttgtgttctcggacccagactgtacaaaatctacagagaacgagactcagagcgggctccggctagcgtcccggaaaccccgactgcggtgactgcccctcatagttctagttgggacacttactaccagccacgggcattggagaaacacgctgactcaatcctagcgctcgcttctgtgttctggtccatcagctattattctagcccctttgcattcttctacctgtacagaaaaggatacctatccctgagcaaggtggtacccttctcccattatgctggcactctgctgttattgctcgccggagttgcctgcctacgcggaatcggtcggtggactaaccctcagtataggcagttcataacaattctcgaggccacacaccgaaaccagtcgtcagaaaataagcgccagcttgccaattacaactttgacttcaggagctggcctgtcgacttccactgggaggaaccttcctctagaaaggaaagcagggggggaccttcccggagaggggtcgcactgctgcgcccagagcccctccacaggggaactgcagatacattgctcaaccgagtgaaaaagctaccctgtcaaattacaagctacctagttgcccatacgcttggcaggagaatgctctaccccggtagtgtgtatttacttcaaaaggctctcatgcctgtactgttacagggacaggcccgactcgtcgaagaatgcaatggtcgcagggccaagctgcttgcatgcgatgggaatgaaatcgatacaatgttcgtggatcggagagggactgccgaaccccagggccaaaaactcgtcatttgctgtgagggtaacgccggattttatgaggttgggtgcgtgtctacaccactggaagccggatactctgtcctaggatggaaccacccaggatttgcaggctctacaggggtcccgtttccacagaatgaagcaaatgctatggatgtggttgtgcaattcgccatacacagactggggttccagccccaagacataattatttacgcctggtctattggaggatttacagccacatgggccgcaatgtcatatcctgacgtttctgcaatgatcctagatgcctcttttgatgacctggtgccgctggctctgaaggtcatgcccgacagctggaggggcttggttacacggaccgtcagacagcacctaaacctcaataatgctgaacagctgtgcagataccaggggcctgttctccttatacggaggacaaaagacgagattatcactacgacagtgccggaggacattatgtctaatcggggtaacgacttgctgctaaagttgctgcagcatcgctacccacgggttatggccgaggaagggctgcgcgttgtccggcaatggcttgaggccagctcacaactcgaagaagccagcatttactctagatgggaagttgaagaggactggtgcctcagtgtactgaggtcttatcaggccgagcacggccctgacttcccatggtcagttggcgaggatatgtccgcagacggccgtaggcaactcgcgctttttctggctagaaaacacctccacaattttgaggccactcattgtacacccctgccagcccagaatttccagatgccctggcacttatag

SEQ ID NO: 212947 - DNA, 1578 bp, Artificial Sequence
  Description of Artificial Sequence: Synthetic coding sequence
atgccaccacccgcactctttttgagttccttatatccacgccttgaattccagaatgatttttacaggtcttgcattcgaaggtccagccctcaaccccctccaaatctggcctggagaccagaaagtctatactcaggggaattagcaggcggtggataccttagtctctctaaagtggtgccctttagccactatgccggaacccttctgctactgctggcaggagtcgcgtgccttagagggataggacgatggaccaacccacaatacaggcagttcattacaattctggaggccacacacagaaatcagtcgagcgagaacaaaagacagctcgctaactataattttgacttccgttcttggcctgtggactttcattgggaggagcctagctctaggaaagagtcccggggaggcccaagcaggcgcggagtggccctgctcaggcccgagcctttgcacagaggcactgcggatactctgctgaatcgggtgaaaaaactgccatgtcagatcaccagctacctggtggctcatactcttgggaggcggatgctttacccaggaagcgtgtatctgctgcagaaagcgctgatgcctgtcctgcttcagggccaggcacgcttggtggaagagtgcaatggacgcagggccaagctgctggcctgtgacggaaacgaaatagacaccatgtttgtggataggcgtggcactgccgaaccacaagggcagaaactggtaatctgctgcgaggggaatgcagggttttatgaggtcgggtgtgtgtcaactccactggaggccggttactcagttctgggatggaaccaccctggattcgctggctccaccggagtgccttttccccagaacgaagccaacgcgatggacgtcgtggttcagttcgcaatccaccggttgggcttccagcctcaggatatcatcatctacgcttggtccatcggaggcttcactgcaacctgggccgcaatgtcttaccccgacgtatctgccatgatacttgatgctagttttgatgaccttgtgcccctggctttaaaggtgatgcctgattcctggagggggctggtcacaagaacggtgcgccagcatctgaacctgaacaatgccgagcaactatgcagataccaggggccagttctccttattcgaagaactaaagacgagataatcacgaccactgtgcccgaagacatcatgagcaaccgagggaatgacctcctgttgaagcttctgcagcacagatacccaagagttatggccgaggagggacttagggtggtgcgtcaatggctcgaggcctcttctcagctagaagaagccagcatttattcaagatgggaagtggaagaggactggtgtttgtctgttctccgtagttaccaggccgagcacggccctgattttccctggagcgttggcgaagatatgagcgctgacggacgacgccaacttgcactgtttctagcacgtaaacatctgcataactttgaggcaacccattgcacaccattaccagcacagaattttcagatgccttggcatctgtag

SEQ ID NO: 212948 - DNA, 438 bp, Artificial Sequence
  Description of Artificial Sequence: Synthetic coding sequence
atgctcgggcactgttgttacttttggcaggtttggcctgcatcggaggcattggccgcaggtccaacgcccagcactggctctagctcccccagttggaagcagcatataggtacttccttacagaagacgcggggttctctccctacaacgaccctgacttccggagctggacagtctacttccaccggaaagaaccccgctgccggacgtagtttggagggcgcactgcctgcaggagtgtggccatgttttgctcagagcccctgtacaggaggtcagcagacccccagtagtactgggctgcgttcttgtttggtgagaagtcccggaggcaagcagcagagaggtgaggcccactggggaggtggcgcaatatccggtgtgctgtgggagtgggccctgcattgcaaaatagcagtcacccattgggcctag

SEQ ID NO: 212949 - DNA, 1578 bp, Artificial Sequence
  Description of Artificial Sequence: Synthetic coding sequence
atgccaccccctgccctcttcttgagtagcctttacccaagacttgaattccagaatgatttctaccgctcttgcatccggaggagttccccccagcctccccctaacctggcgtggcggccagagagtctctattccggagagctggccggtgggggttacctgagcctatccaaagtggttccatttagccattacgccggaacactcctgctcttgctggccggtgtggcctgtttgagaggcatcgggaggtggaccaatccccaatatcgccagtttatcacgattctggaggctactcaccgaaaccagtcctcagaaaataagagacagctcgctaactataactttgacttccggtcttggcccgtcgattttcattgggaagaacccagcagtcggaaagagtctcgcggaggcccatctcgaagaggcgtagctttgctcaggcccgagccacttcaccggggaaccgccgacactctgctgaaccgggtgaagaagctaccatgtcagattacttcctaccttgttgcacataccctcggcagacgcatgctgtaccccggaagcgtatacctgctgcagaaagctctgatgcctgttctactgcaaggccaggcacggcttgtggaggaatgcaatggacgacgagcgaaattactggcttgcgacgggaatgaaatcgacacaatgtttgtggatcgccgagggacggccgaaccacaagggcagaagctggtgatctgttgcgagggaaatgctggattttacgaggtgggctgcgtctcaactccactggaagccggatacagcgtgcttggatggaatcatcctggcttcgctggttccaccggggtacccttcccgcagaacgaagccaacgcaatggacgtggtggtccaattcgccatccaccgactcggatttcaaccccaggatataatcatttatgcatggtccatcggtggattcactgctacttgggcagctatgtcataccctgatgtctccgcgatgatcctggacgcatccttcgacgacctcgtccccctggcgctaaaggtaatgcctgatagctggagaggactcgtgaccagaaccgtccgccaacacctcaatctgaacaacgctgagcagctctgcaggtatcaaggtcccgtgttgctgattcggagaaccaaggacgaaatcattacaacaactgtccctgaggacattatgagcaatcgcggtaacgatctcctactaaaactcctgcagcaccgataccctcgggtgatggccgaggaggggttaagagtagtccgtcagtggcttgaagcctctagccagttggaggaagcttctatctacagtcggtgggaggttgaagaggattggtgcctgagcgtactccggagttatcaggctgagcatggtcccgatttcccgtggagcgttggcgaggacatgagcgctgatggacggagacagcttgctttgttcctggcccgaaaacatctgcataactttgaggcaacccactgtaccccactcccagctcaaaatttccagatgccctggcacctgtag

SEQ ID NO: 212950 - DNA, 438 bp, Artificial Sequence
  Description of Artificial Sequence: Synthetic coding sequence
atgctcggccattgttgttacttctggcaggtgtggcccgcttccgaagcactggccgcaggaccaaccccatccaccgggagctcaagtccgtcatggaagcagcatatcggcacttctcttcagaagacacgaggctctttgccgacgaccaccctgacaagtggggctggacagtccacatccactggaaagaaccctgccgctggtcgcagcctggaaggggctctacccgcaggtgtttggccatgttttgctcaaagcccatgtacgggcggacagcagaccccatcgtccacaggtctcagatcgtgtctggttcgttcccccggtggcaagcagcagcgcggtgaggcccattggggcggaggcgctatctcaggagttctgtgggagtgggcattgcactgtaaaatagccgtgacccattgggcctag

SEQ ID NO: 212951 - DNA, 1578 bp, Artificial Sequence
  Description of Artificial Sequence: Synthetic coding sequence
atgccgcctcccgctctgtttctgtcatcattgtatcccaggctggaattccagaacgatttttatcggtcttgtattcggaggtcctcccctcagccgccaccaaatctcgcttggcggcctgaaagcctgtacagtggagaactcgctggagggggatacctgtctctctccaaggttgtgcctttttcgcactacgccggaacactactgctcctgctggctggcgtcgcatgcctacgcggaatcgggagatggactaacccccagtataggcaatttataaccatactcgaggctacccatcgcaaccagagcagcgaaaataaacggcaactcgcaaattataactttgactttcgcagctggcccgtggacttccattgggaggaaccatcttcgagaaaagagagccgcggaggcccatcccgccgaggcgtggccttacttcgaccagaaccattgcatcggggaaccgctgacacccttctcaatcgagtgaagaagctaccttgtcagataacctcctacctcgtcgcacatacgctgggtcgacgtatgctgtacccgggatcagtttacctgctccagaaagcactgatgcctgtgctgttgcagggccaggctaggctcgttgaagagtgtaatggtagaagagccaagttgttggcatgcgacggcaatgagatcgacacaatgtttgtagataggcggggaaccgccgagcctcaggggcagaagctggttatttgctgtgagggcaacgccggtttttacgaggtgggatgcgtcagtacccccctggaggcgggatactcagtcctcggttggaatcaccccggattcgccggatcaacaggagtcccgtttcctcaaaatgaggcaaacgccatggatgttgtggtgcagtttgccatccaccggcttggcttccaacctcaggatattattatctacgcctggagcatcggaggctttacagcaacatgggccgctatgtcttacccagatgtaagcgccatgattctggacgccagcttcgatgacctggtgcccctcgccttaaaagttatgcccgatagttggaggggcctcgtcacaagaaccgttcgtcagcacctaaatctgaataatgctgaacagctgtgtaggtaccaggggcctgtgctgctgattagaagaacaaaagacgagatcatcactactacagtgccagaggatatcatgtctaataggggtaatgacttgttgttaaagcttctgcaacatagataccccagggttatggctgaagaggggcttcgtgtggtcaggcagtggctcgaggcttcatctcaacttgaagaggcctccatctattcacgatgggaggtggaggaggactggtgtctgtccgttctgcggtcctatcaggccgaacatgggcctgactttccttggtccgtcggcgaggacatgagtgcagacggcaggcgccagctggctctttttctcgccagaaaacaccttcacaacttcgaagccactcattgtacccccctcccagcccagaactttcagatgccatggcatctgtag

SEQ ID NO: 212952 - DNA, 1278 bp, Artificial Sequence
  Description of Artificial Sequence: Synthetic coding sequence
atgaatgccatgctggaaacccccgagctgcccgctgtgttcgatggagtcaagctggcagccgtggccgctgtgctgtatgttatcgtgcgctgtcttaatcttaaatcgccgacagctccccctgatctctattttcaagattcaggattgagtcgattcctattgaaatcctgtcccctgctgacaaaagagtatatcccccctctaatttggggtaaatcaggtcacattcaaacagcactctatggaaagatgggaagggtacggtcgccacatccatacgggcatcgcaagttcatcacaatgtctgatggcgcaaccagtacattcgacctgtttgaacccttagccgagcattgcgtcggagacgatattacgatggtcatatgccctgggatcgcaaatcacagcgaaaaacagtacatccggactttcgtggattatgcccagaagaatggctatcgctgcgcagtcctcaaccatttgggagctctgccaaacatagagctgacctcccctcggatgttcacctatggctgcacctgggaatttggcgctatggtgaactatatcaaaaaaacataccccctgacccagctggttgtggttgggttcagcctgggcggaaatatcgtgtgtaagtacctgggggagacacaggcgaatcaagaaaaggtactatgttgcgtgtcagtatgtcagggatactcagccctgagagctcaggaaacatttatgcagtgggatcagtgcaggcgcttctataattttcttatggccgacaatatgaaaaagatcattctctcacataggcaggccctttttggtgatcacgtaaagaagccgcagtctttggaagacacagatctgagtcgcctgtacacagcgacctctctcatgcagatcgacgataacgttatgagaaagttccacggatacaactcattgaaagagtattatgaggaagagtcgtgtatgcgctacctgcaccgcatttacgtgccgcttatgttggtgaacgccgcagacgatcctctggtgcatgagtcgctgctgacaatcccaaaatccctgtccgagaaaagggaaaatgtcatgtttgtcctgcctctacatgggggacatttgggctttttcgaaggcagcgttttgtttcctgaacccctcacctggatggataaactggttgttgaatatgcaaatgctatttgtcagtgggaaaggaacaagctccagtgctcggacacggagcaggtggaggcggaccttgagtag

SEQ ID NO: 212953 - DNA, 1278 bp, Artificial Sequence
  Description of Artificial Sequence: Synthetic coding sequence
atgaacgctatgctcgagactcctgagctaccagccgtgtttgatggcgtaaagttggccgctgtggctgcagtactatatgtgatagtgaggtgcctgaatcttaagagccccaccgccccacctgatttgtatttccaggattctggacttagccgcttcctcctcaaaagctgtcccctgctcactaaagaatacatcccccctttgatctggggaaaatccggccatattcagaccgcgctttatggcaagatgggtcgcgtacggtcaccacacccttacggccacaggaaatttattactatgtcagacggcgctacaagtaccttcgacctcttcgagcctcttgccgagcattgcgtgggggatgacattactatggtcatctgtccgggtatcgccaaccattcagaaaagcaatacatacgcacattcgtggattacgcccagaaaaacggctaccgatgtgccgtcctgaatcaccttggagctttgccaaacattgaactgactagccccaggatgttcacatatggatgcacatgggaattcggggcaatggttaattacatcaaaaagacctatcctctgactcaattagtggttgtcggctttagcttggggggaaacatcgtctgtaagtacctgggcgagacgcaggcaaatcaagaaaaggttttatgttgcgtcagtgtttgtcagggctatagcgctcttagagcccaagaaacatttatgcagtgggatcagtgtcggagattctacaatttcttaatggccgataacatgaaaaagattatcttatcacacaggcaggcgttatttggagaccacgttaagaaaccccagtcactcgaggacactgacctctcaagactatatactgccactagtctcatgcagattgacgacaacgtgatgcgtaaattccacgggtacaattctctgaaggagtattacgaggaggaatcctgcatgcgctacctccaccgaatctacgtgcccctcatgctggtcaacgccgctgatgaccctctggtacacgagtcattattgacaatacctaagagcttgtctgagaagagagaaaacgtgatgttcgtccttccgctccacgggggtcatctcggattctttgagggctccgtactattccctgagccactgacctggatggataagctcgtggtggagtatgccaatgctatctgccagtgggagcgcaacaagctgcagtgtagcgataccgaacaagtggaagccgacttggagtag

SEQ ID NO: 212954 - DNA, 1230 bp, Artificial Sequence
  Description of Artificial Sequence: Synthetic coding sequence
atgcagcgcctggccatggatttgcggatgttaagccgtgagctgtctctgtacttggagcaccaggtgagggtgggtttctttggttcaggagttgggttgtctctcatcctggggttttcagtggcatacgcattctactacctttcctctatagctaaaaagccgcagctggtgaccggcggagagagctttagtcgattcttgcaagatcactgtccagtggtgaccgagacatactaccctactgtctggtgctgggagggtcgcggacagacactcttacgaccctttatcactagcaagccgccagtccaatatcgaaatgaactgatcaagaccgccgatgggggacagatctccctggactggttcgataatgataactccacctgctacatggacgcttcgacccggcctactatcctgcttttgcccggactgactggaacaagtaaggaaagttacatattgcacatgatccacctaagcgaggagctaggctaccgttgcgtggtgttcaacaataggggtgtcgccggagaaaacctgttgactccaaggacttattgttgcgccaacacagaggatctggaaacagtgatccatcatgtgcactccctttacccgtccgcaccttttctagcagctggcgtgagtatgggtggaatgttattgctcaattacctgggtaaaatcggcagcaagacccctcttatggcggctgctacattctcagtaggttggaacacgtttgcttgctccgagtcactagaaaagccactgaattggctactctttaactactatctgacaacgtgcctgcaaagctcagtgaataagcacagacatatgttcgtgaaacaggtggacatggaccacgttatgaaggcaaagtcaattcgggaattcgacaaacggttcactagcgtgatgtttggatatcagaccattgatgactactacaccgacgccagccccagcccacgcttaaagtctgtcggcatccccgtcctgtgcctgaattcagttgacgatgtcttttctccgtcccatgccatccccattgagactgcaaaacagaatccaaatgtggccctggtgcttacctcatacggcggtcatattggcttcctggagggcatctggccgagacagtcgacctatatggatagagttttcaagcagttcgtccaggcgatggttgagcacgggcacgagcttagttag

SEQ ID NO: 212955 - DNA, 1050 bp, Artificial Sequence
  Description of Artificial Sequence: Synthetic coding sequence
atggcagcagaagaagaggaggtggatagtgcggacacaggggaaagatctggctggctgactggctggctgcctacatggtgtcctaccagtatttctcatctgaaggaagcggaggaaaaaatgctgaagtgcgtcccttgtacttacaagaaggagcctgtccggattagtaacggcaacaagatttggactctgaaattcagccacaacatctccaataaaaccccgctggttctcctgcatggcttcggcggtggacttggcctgtgggctctaaatttcggagatttatgtacaaaccgcccagtctatgcctttgacctcttaggttttggcaggagctccaggccacggtttgattccgatgcggaagaggtggagaaccaattcgtggagtccatcgaagagtggcgttgtgcccttggcttagacaagatgattttgctaggccataatctggggggtttcctcgctgcagcgtactctctaaaatacccttccagagtgaaccacctgatacttgttgaaccatggggattccccgaacgtccagacctggctgaccaggatcgacccatccccgtgtggatccgggctctgggggcagccttgacaccttttaacccactggctggtttgaggatcgcgggaccttttggtttgtcgttggtgcagagactgcggccagattttaagaggaagtatagcagcatgtttgaagacgatacagtgacagagtatatctatcactgtaatgtgcagacgccatcaggagaaaccgcattcaaaaacatgacgatcccttacgggtgggcgaagcgccctatgctccagcggatcggcaaaatgcaccccgacataccggtaagtgtgatcttcggtgcacgttcctgtatcgatggaaattctgggactagcatacagtcacttaggccgcacagttatgtgaagacaattgccatcctgggcgctggacattacgtctacgccgaccagcccgaggaattcaatcaaaaggtaaaggagatttgtgataccgtggactag

SEQ ID NO: 212956 - DNA, 1491 bp, Artificial Sequence
  Description of Artificial Sequence: Synthetic coding sequence
atggccgagttgcagatgctgctggaggaggaaataccaagtggcaaaagggcactgatcgagtcctatcagaatttaacgagggttgctgattactgtgagaataactacattcagaggcatggtttcgccgttttactgtgtctactgagcaactcttggcctcaagccaccgacaagcgcaaagcactcgaagagacaaaggcctacacaacccagtctctcgcatccgttgcctaccagataaacgcacttgcaaacaacgtgctgcagctgctagacatccaggcatctcagttgaggcgcatggaatctagcataaatcacataagtcaaactgtggatatccacaaggagaaggttgccaggagagaaatagggatccttaccacaaataaaaacacatctcggacccataagataatcgcaccggctaacatggagagacctgtgcgctacatccgaaaaccgattgactacacagtcctagatgacgttgggcatggcgtaaaatggttgaaggctaaacacggcaataaccagcccgctaggacaggaacactctccagaaccaatccacccacccaaaaaccccctagcccaccaatgtccggtaggggcactctggggagaaacacaccatacaaaactttggagcccgtgaagccccctacagtgccaaatgactacatgacgagccccgcacggctgggatctcagcattctcctggcagaaccgcttctttaaaccaaagaccgcgaactcactcggggtcttctggcggatcaggatctcgcgaaaatagcggctccagttccatcggtataccaatagcagtccccacaccgtcccctcccacaataggccctgagaacatttcagtcccaccaccatctggcgctcctcctgccccaccattggcacccctgctgcctgtgtccacggtgatcgccgctccgggatctgcaccaggcagtcagtacggaaccatgacccggcagatctctaggcacaacagtacaacctctagcacctcatcgggcggatacaggcgcactcccagcgtgacagcccagttctctgcacagccgcatgtaaacggaggcccactctacagccagaacagtatcgccgactctccaacacctccaccgccaccaccccctgatgacattcccatgttcgatgacagtccccctcctcctccacctccccctgtggattatgaggatgaagaggcagcagtggtgcagtataacgacccttacgccgacggcgatcctgcctgggcccctaaaaattacatcgaaaaagtggttgccatctatgactacactaaagataaagacgatgaactctcattcatggaaggggcaatcatatacgtcatcaagaagaatgacgatggttggtacgagggcgtgtgtaacagagttacaggcttattcccaggcaactacgtggaatcaattatgcactataccgattag

SEQ ID NO: 212957 - DNA, 1530 bp, Artificial Sequence
  Description of Artificial Sequence: Synthetic coding sequence
atggcagagctgcagatgttgctggaagaggaaatccccagcggcaaaagagcgctcattgaaagctaccagaatttgacccgcgtggcagactactgcgaaaacaactatattcaagccacagacaaacggaaagctctagaggagacaaaagcttacactacacaatcccttgcctcagttgcttaccagatcaacgcactcgcaaataacgtgctccagctcttggacatccaggcgagccagctacggagaatggagagcagcatcaatcacataagccaaactgtagatatccacaaagaaaaagtggctcgtcgggagattggcatactgacaacgaacaagaatacctcccgaacacataaaatcatcgctcctgcgaacatggagaggccagtgcggtacatccgcaagcctattgactacaccgtgctagatgatgtagggcacggagtgaaaaaatggcataagatcatccacggaaataaccagcctgcgaggactgggaccctcagccgaactaacccacccacccagaagcctccctcgccacctatgtccggacgagggactctggggcgaaacacaccttacaagacactagagccggtaaagccccctactgtcccaaatgactatatgacttcgcctgctaggctgggaagccagcactccccgggaagaacagctagtctgaaccagcgcccacggacacacagcggatcaagtggaggatccggcagcagagaaaactctgggtccagctctatcggcatcccgatcgctgtacccaccccttcgccaccgactattgggcctgaaaacatttcagttccccctcctagcggtgcgccaccagcccctccactcgcaccactgctcccagttagtactgtcatagcagcccctggcagtgccccaggatctcaatatgggacaatgacgcgccagatcagtagacacaactcgacaacttcttccaccagctctggtggatataggagaacaccttccgtaaccgctcagttctccgcgcaaccgcacgttaatggtggaccgctctattcacagaactccatctcgattgccccaccgcctccaccgatgccccaactgacacctcagatccctctgactggtttcgttgcccgtgtacaggaaaatattgcggactctcccactccaccccctcccccaccccctgacgacataccgatgttcgacgacagtccccctcccccacccccacccccagtggactatgaagacgaggaagccgctgttgtgcagtacaacgacccatatgctgatggcgaccctgcatgggctcctaagaactacatcgagaaggttgttgctatttacgactatacaaaggataaggacgacgagttatctttcatggaaggcgcaattatctatgtcatcaagaaaaatgatgacggctggtatgagggcgtgtgcaatcgagttacagggctctttcctggcaactacgttgaatcaatcatgcactacaccgactag

SEQ ID NO: 212958 - DNA, 1443 bp, Artificial Sequence
  Description of Artificial Sequence: Synthetic coding sequence
atggcagaactacaaatgctgttggaagaggagatcccttcaggtaaacgggctcttattgaaagctaccagaatctaacacgagtcgccgactattgcgaaaacaactatattcaagctacagacaaacggaaagccttagaggagactaaggcctatactactcagagtctcgcttccgtggcttatcaaatcaacgccctggctaacaacgttttgcaactactcgatatccaagcatctcaactgcggagaatggagtcttcaatcaatcacatttcccaaactgtcgatatccacaaggaaaaggttgccaggagagagataggtattttgactactaataagaacacctccaggacccacaagatcatcgcgcctgcaaacatggagcggcctgtgagatatatcagaaaacccattgactacactgttctcgatgacgtggggcatggcgtaaaatggctcaaagccaagcacggtaataatcaacctgcacggacaggaacgctaagcagaactaatccacccacgcaaaaaccaccctctccacctatgtccggtcggggaacactaggtcgaaacacaccttacaaaaccttggagccggtgaagcctcctacggtccccaatgattatatgacctctcccgcaagattggggagtcagcattcccctggcaggacggcaagtcttaaccaaaggccaaggacacacagtggtagctccggcggtagcggatcccgcgagaattccggatccagtagcatcggtatcccaatagcagtgcctacaccttcaccgccaaccatagggccagctcctgggtcagctcctgggtctcagtacggtacaatgaccagacagatttccaggcacaatagcacgacctcatctacttcatccggcggatacagacgaacgccctccgtgactgcgcaattcagtgcccagcctcacgtcaacggcggacctctgtattcccagaattcaatttccatcgcccctccgcctcctcctatgccacagttaacaccgcagatacctctgaccggtttcgtggcaagagttcaggagaatattgcggacagccctacacccccaccacctccgccacccgatgacatacctatgtttgacgatagccctcctcccccacctccaccacctgtcgattatgaggatgaggaagccgcagtggttcagtacaacgacccctatgccgacggagaccccgcttgggccccaaaaaactatattgagaaggtggtggcaatttacgactacactaaagataaagatgacgaactgagcttcatggaaggggctataatatatgtgatcaaaaagaacgatgacgggtggtacgagggggtgtgcaatcgggtcacgggcttgtttcctgggaattacgtcgagagcatcatgcactacaccgattag

SEQ ID NO: 212959 - DNA, 1449 bp, Artificial Sequence
  Description of Artificial Sequence: Synthetic coding sequence
atggctgagctacagatgttgctggaggaagaaattcctagcggtaaaagagctctgatcgagtcatatcaaaatctcacgagggtggcggattattgtgagaacaactatatccaggctactgacaaacggaaagctctagaagaaacaaaggcatataccacccagagcctggcatcagtggcctaccagatcaatgctctcgcaaacaatgttcttcagctactagatattcaagcctcacagctccgccgaatggaatcttccattaaccacatctctcagacagtcgacattcataaggagaaagtggccagaagggagatcggcatcctgacgacgaataagaatacgtcacggacacataaaatcatcgccccagccaatatggaacgcccagtacgctacataaggaaacccattgactataccgtactggatgatgtaggccacggcgtcaagaaatggcacaagattatccatggcaataatcagcccgcacgtacaggaactctgtcacggacaaacccaccaacccagaaaccgccatccccccctatgagcggcagaggtactctcggacggaatactccgtacaagactctcgagcctgtaaaacccccaaccgtgccgaatgactacatgacaagccccgctcgactgggatctcagcattcgccaggaagaacagcttccctcaaccagagacctaggacacactctggatcatctgggggatctggctcgcgggagaattccgggtcatctagtatcggcattcccattgccgtcccaaccccgagccccccaacaattggcccagccgcaccgggaagtgcaccaggcagtcagtatggtaccatgacacgccaaataagtcggcacaactctacgacttcatccacaagttctgggggttataggcgaactcccagcgtgacagcccaattctccgcacaacctcatgtgaacggtggtccgctatactctcaaaactctatctcgattgcgcctccccctccacccatgcctcagctcaccccccagatccccctaacaggcttcgtggccagagtacaggaaaacattgccgacagccctacaccaccccctccaccccctccggacgatatccctatgttcgacgactccccccctccgcctccaccaccaccagtcgattacgaagacgaagaggctgcagttgtgcagtataatgatccatacgccgacggagaccctgcctgggccccaaagaactatattgagaaggtggtggcgatttatgactacacaaaggacaaagatgatgagctttcatttatggagggcgcaattatttatgtgattaaaaaaaacgacgatggatggtatgagggggtctgtaatcgggtcaccggactgtttccaggcaattatgtcgaaagcatcatgcactatacagactag

SEQ ID NO: 212960 - DNA, 1272 bp, Artificial Sequence
  Description of Artificial Sequence: Synthetic coding sequence
atggccgaactccagatgctcctggaagaggagattccatctggaaagcgggcacttatcgaatcctatcagaacttgacgagagttgcagactactgcgaaaataattatatccaggccacggataaacggaaggcccttgaagaaacaaaggcttatactacccagtccctcgccagcgtggcttatcagatcaatgccctggctaacaatgtgctgcagttgctggatatccaggctagtcagctgcgtaggatggagtcaagcataaaccatatcagccagactgtggacatccataaagagaaagtcgcaagacgtgaaattggcatcttgacaactaacaaaaatacctccaggacacacaagattatcgcccctgccaatatggagcgaccggtgagatatattcgcaaaccgatcgattacaccgttttggatgacgtgggccacggcgtcaagaaatggcacaagattatccatggcaacaatcagcccgcacgtacaggtaccttgtcccgtacgaacccccctacccagaaaccacctagcccaccgatgagtggaaggggaactctgggaaggaacactccatataagactttggagcccgttaagcctccaactgttcccaacgattatatgacttcccctgcccgactcgggtcccagcatagtcctgggaggacggcctccttgaaccaaagaccaaggactcactcaggcagcagcggtggcagcggctccagggaaaacagcgggagttcgagcatcggaatcccaattgcagtaccaacaccctctcctcccacaattggtcctgtcagcatagctccacctcccccacccatgcctcaattaactcctcaaataccactcacaggatttgtagccagggtacaggaaaacatcgctgattccccaaccccgcctccaccaccccctccagacgatatcccaatgttcgatgatagccccccaccacctcccccacccccagtcgactatgaggatgaggaagctgctgtcgttcagtacaacgacccatacgcagacggggatcccgcatgggcaccgaaaaattacatcgagaaggtggtggcaatttacgactatactaaggacaaggacgacgaactgtcttttatggagggcgctatcatttatgtgatcaagaagaatgatgacggctggtatgagggggtgtgcaaccgagtaactgggctctttccgggtaattacgtcgagtcgatcatgcactataccgactag

SEQ ID NO: 212961 - DNA, 1359 bp, Artificial Sequence
  Description of Artificial Sequence: Synthetic coding sequence
atggccgaactccaaatgctgctggaagaagagataccttccgggaagagggcccttattgagtcctaccagaatctaacccgagtcgctgactactgcgaaaacaactatatccaagctaccgacaagcggaaggccttggaagagaccaaagcttacacgacccaaagcctcgcgagtgtcgcttaccagatcaacgcgctggcaaataatgttctgcaattgcttgatatccaggcctcccaactccgacggatggagagttccattaatcatattagtcagacagtggacatacataaggagaaagtcgcgcgacgagaaatcggcatactcacaaccaataagaatacatcacgtacgcacaagatcatagctcccgcaaacatggagcgcccagtgcgatacatccggaaaccgatcgattataccgtccttgacgacgtggggcacggggttaagtggctgaaagccaagcacggcaacaaccaacccgctcggacaggcaccctcagcagaaccaatcccccaacccaaaaaccgccttctccaccaatgtctggaaggggcactctggggagaaacacaccatataagacgttggaaccggtgaagccccctaccgtgcccaacgactatatgacatctcccgcacgcctggggtctcaacacagtcccggtcgtaccgccagcctgaaccagcgccctagaactcactccgggagttccggcggttcgggatcgcgagagaacagcggatcaagctctattggcatccctatagccgttccaaccccttcacccccaacgattggtcccgcagcacctggcagcgctccaggttcccaatacgggactatgacacgccagatatccagacacaattcaacgacgagtagcacctcctccggaggctatcgtcgcaccccgtcagtgaccgcacagttcagtgctcagccccatgtgaacggcggaccactgtactcccagaactccatagccgattcccccacgccgcctcccccacctccccctgacgacatccccatgtttgacgattcaccaccaccgcctccgccaccgcctgtagactacgaagacgaagaagcagccgttgtccagtataacgacccgtatgccgacggcgaccccgcttgggcccctaagaactatattgaaaaggtggtagctatctatgactacacaaaagacaaggatgacgaactgtctttcatggagggtgcaatcatatacgtcatcaaaaagaatgacgacggatggtatgaaggtgtgtgcaatcgagttacaggactcttccccggtaattacgtcgaaagtattatgcactacactgactag

SEQ ID NO: 212962 - DNA, 1431 bp, Artificial Sequence
  Description of Artificial Sequence: Synthetic coding sequence
atggccgagctgcagatgctgttggaagaggagatcccctctggcaagagggcattgatagagagctaccagaatctcacccgtgtcgcggattactgcgaaaacaattatatacaggcaaccgataagcgcaaagcactagaggagacgaaagcctataccacccagtctctcgcatcagtggcctaccagattaatgcccttgccaacaacgtactgcagttgctggacatacaggctagccagctgaggagaatggaatccagtattaaccacatttcccagacagtcgacatacacaaggaaaaagtggcacgcagggaaatcggtatcctgactactaataagaacacgagcaggacccacaagatcatcgcacccgctaacatggaacgtcctgtgaggtatatacggaagcccatcgattacactgtgttggacgacgtgggtcatggggtgaaacacggaaacaatcaacctgctcggacaggaacactgtccaggaccaatccacccactcagaagccaccctcgccccctatgtctggtagagggaccctcggtcgtaataccccttataaaaccctcgagcctgtgaaaccgccaacggttcccaacgactacatgacttcacccgctagactcggctcgcagcacagccccggaagaacggcttcattgaaccagcggccaaggactcactccgggagtagcggcggttctggtagccgggaaaacagtggatccagctctattggtatcccgatcgcggtacccactccatcacccccaactattggcccagccgctcctggctcagcaccaggatcacagtacggaacgatgacacggcaaatatcaaggcacaattctacgacatctagtaccagttccggcggatacagacgaactccaagcgtgaccgcccagtttagtgctcaacctcacgtgaacgggggaccgttatacagccaaaattctatcagtattgcaccacctccacctcccatgccccagttgacgcctcagatccccctgactgggtttgtcgccagagtgcaggaaaacattgccgacagtccgacccctcctcccccaccccctcctgatgacatccccatgttcgacgatagccctcccccaccacctcctcctcccgtggattatgaggacgaggaagccgctgtcgtgcaatacaacgacccttacgccgatggagatccagcatgggcccctaaaaactacatcgagaaagtcgtggctatctacgattacaccaaagataaggatgacgaattgtcattcatggagggggcaataatttacgtgatcaaaaaaaatgatgatggttggtatgagggtgtctgtaacagggtcacaggcctgtttcctggtaattacgtggagagtattatgcactatactgactag

SEQ ID NO: 212963 - DNA, 1446 bp, Artificial Sequence
  Description of Artificial Sequence: Synthetic coding sequence
atggccgaactccagatgttgctcgaggaggagataccttctggaaaacgggcacttattgaatcctatcagaaccttacgcgggtggcagattactgtgaaaacaactacattcaggccaccgacaaacgaaaggccctggaagagacaaaggcctatacgacacagagcctggccagtgttgcataccaaatcaacgccttggctaacaacgtgctccagctcctcgacatccaggcgagccagttgaggcgcatggagtccagcatcaaccatatcagtcaaactgttgacattcataaagaaaaggtggctcgacgcgagatcggtatacttacaacaaataaaaatacatcaagaacccacaagattattgctcccgcaaacatggaacgtcccgtaaggtatatccgcaagcccattgattataccgtcctggatgatgtaggtcatggggtgaaatggctaaaggcaaaacacggtaataatcaacccgcaaggactggaacgctgtcacggactaacccccctactcagaaacccccatcacctccaatgtccgggagagggactctcggaaggaatactccctacaaaacgctggagcctgttaagcctcccaccgtacccaatgattatatgaccagtcccgctcgccttggcagccaacattcaccagggcgaaccgcaagccttaaccaaaggcccagaacccacagcggctccagcggcggaagtggcagtcgcgaaaattccggctccagctcaattgggattcctattgcggtgccaacgccttctcccccaacaattggcccagctgcccctggaagtgcgcctggtagtcagtacgggacaatgactcgccagatctcccggcataactcaactacgagcagtacgtcctcaggcggttataggcgaaccccctctgtcaccgctcaattcagtgcccagccccacgtgaatggtgggccactgtacagccagaactctatttctatagctcccccaccgcctccaatgccccagctaaccccccagatcccactgactggctttgttgctcgagttcaggagaacatagcagattctccgacacccccaccccctcctccgccagacgatattcccatgtttgatgacagccccccaccccctccaccgcctccggtcgattatgaagatgaggaggcggctgttgttcagtataacgacccttatgctgatggggaccctgcttgggcccctaaaaattacattgaaaaggttgttgctatttacgactacaccaaagacaaagacgacgaactgagcttcatggaaggggcaatcatttacgtaattaagaagaacgatgatgggtggtacgaaggggtgtgcaacagagtgacggggctgtttccgggaaactatgtagaatccatcatgcactatactgactag

SEQ ID NO: 212964 - DNA, 1527 bp, Artificial Sequence
  Description of Artificial Sequence: Synthetic coding sequence
atggctgaactccagatgctactcgaggaggagatcccctccgggaaaagagcactgatcgagtcctaccagaacctcactcgcgttgcagactattgcgagaacaactacatccaggccacggacaagagaaaggcccttgaggagacaaaggcctataccacacaatcactagcgtcagtggcataccagataaacgccctggctaataacgtactgcagcttctagacatccaggccagccagctgcgcagaatggaaagcagcattaaccacatcagccagactgtcgacatacacaaagaaaaagtcgcccgaagggagatcgggattctgacaactaataagaatacttcgcgcacacataagataattgctccggctaatatggaacgacctgtgaggtatatcagaaaacctatcgattatacagttctcgacgatgtaggacacggggttaagtggttgaaagctaagcacggcaacaatcagcccgcacggacaggaacactatcgcgcaccaaccctccaacccaaaagccaccttcgcccccaatgtcaggacgcggaacgctgggtcgcaatactccctacaagacattggagcccgttaagccgccaaccgttccgaacgattatatgacatcgcccgcacgactaggctcacagcacagccccggaaggactgcttctctgaatcagcgccctcggacccactcagggagctcagggggtagcggcagcagggaaaattccgggtcttcaagcatagggatcccaatagctgtgcccaccccttcaccacccactatcggacccgaaaacatatcggtccctcccccatccggcgctcccccagcgcctccccttgcccctctcctcccagtttctactgtgatcgctgccccaggctcagcgcctgggagccaatatggaacaatgactcggcagattagccggcataatagcaccacctcctcaacctccagcggaggttatcgtcgaactccctctgtcaccgcccagttcagcgcacagcctcacgttaacggcggaccactttattcccagaatagcatctctattgcaccaccacctcctcccatgccacagctgacccctcagatcccactgaccggattcgttgctagggtccaggagaacattgccgattctccaacacctcccccaccgccacctcccgacgatatccctatgtttgacgactcccccccacctcctccgccaccacctgtggattacgaagatgaggaagctgctgttgtgcagtataatgatccgtatgccgatggcgatcctgcatgggccccaaaaaattacatcgaaaaggtggtcgcgatttacgattatacgaaggacaaggatgacgaactttccttcatggaaggcgctatcatttacgtcattaagaagaatgacgacggttggtatgagggcgtgtgtaaccgagtgacggggctgtttccgggaaactacgttgagtcaattatgcactatacagattag

SEQ ID NO: 212965 - DNA, 1428 bp, Artificial Sequence
  Description of Artificial Sequence: Synthetic coding sequence
atggcagaactgcagatgctgctggaggaggaaatcccaagcggcaaacgggcattgatcgagagctatcagaatctcactagggtggccgactattgtgaaaataattatatccaagccactgataaacgcaaagctcttgaagaaacaaaggcttacactacccagtctctggcatctgtggcataccagattaacgccctagccaacaacgttcttcagttactggatatccaagcctcacagcttaggcgcatggagagttcaatcaatcatatctcccagactgtggacatccacaaggaaaaagtggcacgtcgggagattggtattctgacgactaataaaaacacctctcgcacgcataaaatcatcgctcccgctaatatggaacggcctgttcgttacattcggaagcctatagattacactgtcctggacgacgtcggtcacggcgtgaaacacggcaacaatcagccagccagaactggcacgctgagtcgcacaaacccacccacccagaagcctccgtctccaccgatgtccggtcgaggcacccttgggaggaacacaccgtacaaaacgctggaacccgttaaacccccaacagtgcctaacgactacatgacgtcacccgctcggcttggatcacagcattctcccggtaggacggcgtccctgaaccagagacccaggactcattctggatcctctgggggtagtggcagtcgagagaactcgggcagctcctctatcggcatccctatcgcggtccccactccctcacctcctactataggccctgcacctgggagcgcccctggttcccagtacggaactatgacgcgccagatcagccggcataactccaccacctcaagcacatcaagcggcggttaccggcgaactcctagcgttaccgcccagttttccgcccagccgcatgtaaacggcggacctctgtacagccagaactccatttcaatagcccctccccctccacccatgccccaactgactcctcagatccctttgaccgggtttgtggctcgcgtgcaggagaacatcgctgacagccctactccacctcctccacccccaccagacgacatccctatgtttgacgattccccacccccacccccaccaccccctgttgattacgaggacgaggaggctgctgttgttcagtacaatgatccatatgcggatggcgatcctgcctgggccccaaagaattacattgagaaagtggtcgccatatacgattacactaaagacaaagacgatgagttatccttcatggagggagccataatttatgtgatcaaaaagaacgatgacggctggtatgagggagtctgcaatcgtgtgactgggttatttcctggcaactatgtcgaatccatcatgcactacactgattag

SEQ ID NO: 212966 - DNA, 1341 bp, Artificial Sequence
  Description of Artificial Sequence: Synthetic coding sequence
atggccgaactgcaaatgctgctcgaggaagaaatacctagcgggaagcgggcactgatagaaagttaccaaaatctgacccgggtagcggattactgcgagaacaactacatccaggccaccgacaaacggaaggcactagaggaaacgaaagcctatacaactcagtctctggcatccgtagcttaccagattaacgctctggcgaacaacgtgcttcaactattggatatccaggcatcacaacttcgtagaatggaatctagtataaatcatatcagtcagaccgtcgatatccataaagaaaaagtcgcaagacgcgagatcggaatcctgaccaccaacaagaatacctctcgaacccataaaatcatcgctcctgcaaatatggagcgtccggtgcgctatattcgtaaacccatagactatacggtccttgatgatgtcggccatggtgtgaagcatggcaacaatcagcctgctagaacagggactctgtcccgaacgaacccacctacacaaaagccacccagccctcccatgtccggtcgcggaacgctcggaagaaacacgccctacaagaccttagagcccgttaagccgccaaccgttcctaacgattacatgacatcaccagccagactcgggtcacaacacagccccggtcggaccgctagcctgaaccagagacctcgtacccactccggatcttctggcggtagcggcagcagggaaaacagtgggagctcttccatcggcattccaatcgccgtgcccactcccagtccccctacaatcgggcctgccccaggctctgcccctgggtcccagtacggaacaatgactcgccagatctctcggcacaactcgacgacgtcctctacctctagcggaggttacagacgcacacccagtgtgactgcccagtttagcgctcaacctcacgtgaacggtgggcctttgtactcccagaactctatcgccgactcccctaccccccctcctcctcctcctcccgacgatataccaatgttcgacgattctcccccaccccctccacctccacccgtggattatgaggacgaagaggcagcagtcgtacaatacaacgacccttacgctgacggcgaccctgcctgggcaccaaagaactacattgagaaagtcgtcgccatctatgattataccaaggacaaagacgacgagctgtcattcatggagggcgctatcatatacgttattaaaaagaacgatgatggctggtacgaaggagtgtgcaacagagttactggactgttccctggaaactacgtggagtcaattatgcactacacggactag

SEQ ID NO: 212967 - DNA, 1356 bp, Artificial Sequence
  Description of Artificial Sequence: Synthetic coding sequence
atggctgagctacagatgttgctcgaagaagaaatcccttctggtaagagagccttgattgagtcctaccaaaacctgacccgggtggcagattactgtgaaaacaattacattcaagccaccgacaaacgcaaagccctggaggaaaccaaagcttacacgacacagagtctagcttccgtggcctaccagatcaacgccctggccaataacgtgttacagctgctggacatccaggcttctcagctccgaaggatggaatcttcaataaatcatatatctcagactgttgacattcataaggagaaggtcgcacggagggagattggtatacttactactaacaagaacacctcaaggacccacaaaattattgcccctgctaatatggagcgcccagttagatatattcgcaagccgattgattataccgtgttagacgatgtcggtcacggtgtcaagtggctgaaggcaaagcacggcaacaatcagcccgctcgtactggtacgctgagccgtaccaaccctcccacccagaaacctcccagtccccctatgagcggcaggggaacgttgggaagaaatacaccttataagactctggagcctgtaaaacctcctaccgtgccaaatgattacatgacctccccggctagactcggttctcagcatagtccgggtcggacagcgtcccttaatcagaggccacggactcacagcggctcttctgggggatcaggatccagggagaactccggttcctccagtattgggatccccattgccgtgcctacgccctcccctccaacgataggcccagcacccggatctgcacccggatcccagtacgggaccatgacacgtcagattagcagacacaattcaactacctcaagcacaagttccggaggataccggagaacgcctagcgtgacagcccagtttagcgcccaacctcacgtcaacgggggacctctctattcgcagaacagcatcgcagattccccgacccctccgccacctcccccaccagatgacattcctatgttcgatgactccccaccacctccaccaccgcctccagtagattacgaagacgaggaggctgccgtggtgcaatataatgatccgtacgcggacggcgatcccgcttgggctcccaaaaactatatcgaaaaggtggtggcgatttatgattatacaaaggacaaagacgatgaactgagcttcatggagggcgctattatttatgtaatcaagaaaaatgatgacggctggtacgagggcgtgtgtaaccgagtgactggcctgttcccagggaactatgtggagtccattatgcactacactgattag

SEQ ID NO: 212968 - DNA, 990 bp, Artificial Sequence
  Description of Artificial Sequence: Synthetic coding sequence
atggccgagctgcagatgttacttgaggaagagatcccttccggtaagagagctctgatcgagagctatcaaaatctgactagagtggccgattattgcgagaataactatattcaagctacggataagcggaaggctctggaagaaacgaaggcctacaccacacagagtctcgcgagcgttgcttatcagatcaatgcacttgccaataacgtactgcaactgcttgatatacaggcttcacaactgagaagaatggagtcctccataaatcatatatcccagcatggcaacaaccagcccgcacgcaccgggacactgagccgtacgaatccccctacccagaagcccccaagcccacccatgtcaggaagagggactctcggcagaaataccccctataaaacactggaaccggtgaaacctcctacggtgcctaacgattacatgacctctccagctcggctgggctcccaacactccccaggtaggacagctagcctcaatcaaaggcccaggacccattcgggatcctctgggggatccggaagtcgcgagaattctgggtctagctcgatcggcattcccattgccgttccgactcccagtccgccaactatagggcctgtagctgacagccctacgccccctcctccaccccctcccgatgatatcccaatgttcgacgattctcctcccccaccgcctccaccgcctgtcgactatgaggacgaagaggcagccgttgtgcagtataatgacccatacgccgatggcgaccctgcatgggcacccaagaattacattgagaaggtcgtagccatctacgattacaccaaggacaaagatgatgagctatcgtttatggagggcgctattatttacgtgattaagaaaaacgacgatgggtggtacgagggcgtgtgtaaccgagttactggcttgtttcccggtaattacgtcgagagtattatgcattataccgactag

SEQ ID NO: 212969 - DNA, 1185 bp, Artificial Sequence
  Description of Artificial Sequence: Synthetic coding sequence
atggcagaattgcagatgctactagaggaagagatcccttctggtaagcgggcactgatcgagtcataccagaacctgactagggtggccgactattgcgagaataattatatacaggccacggataaaaggaaagctttggaggagaccaaagcttacacaacacaatccctggcctcagtggcctaccagatcaatgccctggctaacaacgtcctgcagctgctggacatccaggcatcccagctgaggcggatggagagttctattaaccacatatctcagacagtcgatatccacaaggaaaaggtggctcgtcgcgagatcggaattctgaccacgaataagaacacttccagaacccacaaaattattgccccagctaacatggagcgaccggtgagatatatcagaaagcctattgactacaccgtgctggatgacgtgggccacggtgttaaaaaatggcacaaaataatacatggtaacaaccagcctgcaagaactgggaccctaagcaggacgaacccacctactcaaaagcccccaagccctcctatgagtggccgaggaacgttgggcagaaataccccgtataagaccctcgagccggtaaagcctccaaccgtccccaacgactacatgacctcccccgctaggctggggtcccagcattctcctgggcgaactgccagtctgaatcagcggcctcgcacccatagcggatcttcaggaggaagcggcagtcgtgaaaactcaggaagttccagcattggaatccccatcgccgtacccacacctagccctcctacaataggcccagtcgctgactcccctaccccacctcctccgcctcctcctgacgacatacccatgttcgatgactcacctcccccaccgcctcccccacccgtggactacgaagacgaagaagccgctgtggtccagtacaatgatccctacgcggatggcgacccagcatgggcgccaaagaattacatagagaaagtggtggcgatttacgactatacgaaggacaaggatgacgagctgtcattcatggaaggcgcaatcatctatgtgataaaaaagaatgacgatggttggtacgagggggtgtgtaacagggtgaccggcctgttcccgggaaactatgttgagtccatcatgcactataccgattag

SEQ ID NO: 212970 - DNA, 3993 bp, Artificial Sequence
  Description of Artificial Sequence: Synthetic coding sequence
atgccgctttcgcctcccgctcagggcgaccccggtgagcctagtccgtgccggcctcccaagaagcacaccaccttccacctgtggcggtccaaaaaaaaacagcagccggctcccccagactgtggggtttttgtgccgcaccctttacccgctcccgctggcgaagccagggccctggatgtcgtggatggtaagtacgtggtccgcgactctcaggagttccccttgcactgcggcgaatcacagttcttccataccaccagcgaggccctggggagccttcttctagagagtggaattttcaaaaagtcgagggctcagccgccagaagacaaccgcagaaagcccgtgctcggcaagctgggaaccctatttaccgcaggacgcagacggaattcaaggaatggcctcgaaagtcccacaagatctaacgctaagccactgtcccccaaggacgttgtagcttctccaaaactgcctgaacgggaatcggagcgaagtcggagccaatcaagtcaattaaaacagactgatacaagtgaggagggctcacctagagaaaacccaagggaggcagaaggggagctgcccgagtctggagggcctgctgccccacctgatgctgagcttagccctaggtggtcatctagcgccgcagcagtggctgttcagcagtgccatgaaaatgacagcccacagcttgaaccccttgaagccgaaggagaaccgttccccgatgcaactacaacggcgaagcagttgcattcctctccgggaaactcctctagacaggaaaatgcggagacacccgctaggtcccctggagaagacgcttcgcctggtgcaggtcatgaacaggaggcattcctaggagtgcgaggtgcgccaggcagtccgactcaggagcgccctgccggtggactcggagaagcgcctaatggtgccccaagcgtgtgcgccgaggaaggctcactgggacctcggaatgcccgatcccagccacctaaaggggcttccgatctgcccggtgaaccacccgctgagggggcagcccacactgcatcctctgcgcaggccgactgcacagccaggcccaaggggcacgcccatcctgccaaagtactcacattagacatctacctgagtaaaactgaaggagcgcaagtcgacgagccagtagtgataacacctagggctgaagactgtggcgactgggatgacatggagaagaggagtagcgggcgacggtcaggccgacgaagagggtcgcaaaagagcactgattctccaggcgcagacgccgagttgcccgagagcgctgctcgggatgacgccgtgttcgacgatgaagtggcccctaatgctgcttctgataacgctagtgccgagaaaaaagtcaagagccccagagctgcactggatgggggtgtcgcaagcgccgcttctccagaaagcaaaccttcgcccggtacgaaaggccagctaaggggtgagtcagatcgttccaagcagccgcctccagcttcgtcacccacgaagcggaagggccgaagtagagcgctcgaagctgtgcccgctccacccgcatccggacctcgtgccccagctaaagagagccccccaaagcgggtacccgacccgagtcccgttacaaagggaaccgcagctgagagtggggaggaagctgcaagagctatccctcgagaattacccgtcaagtcctccagcttgttgccagagattaagcctgaacataaacggggacccttacccaatcacttcaatgggagagccgaaggcggaagatctcgggaactaggaagagctgctggcgctcctggcgcttcagatgcagacggcctgaagcccagaaatcatttcggggtgggcaggagcacggttactactaaggtcaccctacccgcaaagcctaagcacgttgagcttaatctgaaaacccctaagaacctagattcactgggtaacgagcacaacccgtttagccaaccagtccacaagggaaacacagctacaaagatttctttgttcgagaataagcggactaattcgtctcctaggcatactgacatcagagggcagcggaacacccctgcgagtagcaaaactttcgttggcagggccaagctgaacctggccaagaaggctaaggagatggagcaacctgagaaaaaggtgatgccaaattctccacagaatggtgtgctagttaaagagaccgcgatcgagaccaaggtaaccgtgtctgaggaggaaattctgcccgctaccagaggaatgaacggagactcctctgaaaatcaggcattgggcccacaaccgaaccaagacgacaaggccgatgtgcaaactgatgctgggtgtctgtctgaacctgtcgcctctgccctgatcccagtcaaggaccacaaactcctcgaaaaagaggactccgaggctgccgattccaagtccttagtgcttgaaaacgtgacagacactgcccaagacatacccaccactgtggacacgaaggatctcccccctactgccatgccaaaaccacaacacaccttcagtgactcacagagccctgccgagtcatctccagggccttctcttagtttatccgctccagcacccggtgacgtcccaaaggatacgtgcgtccagtctccaatttcttctttcccatgcactgatctgaaggtgtccgagaatcacaaggggtgcgtgctgccggtctccagacaaaataatgaaaagatgcccctgcttgaactcgggggagaaaccactcctcccctgtcaacagagagatcacccgaggctgtgggctcagaatgcccatcaagggtgctcgttcaggtcagatctttcgtactgcccgtagaatctacacaggacgtctcaagccaggtcattcccgagtcttccgaggtgcgagaagttcaactgcctacatgccattctaacgaacccgaggtggtgtcagtggccagttgcgcccctcctcaggaagaggtactgggaaacgaacactcccattgcaccgcggagcttgccgcaaaatcagggcctcaggtgatcccaccggcatctgagaaaacattaccgatccaggcgcagagccaggggtccagaaccccactgatggccgagtcatctcctactaactcacctagtagcggcaatcatctagcgacacctcagaggccagaccagacagtaactaatggacaggactcccccgcatcactgctgaacatctccgcaggaagcgatgattccgtcttcgactcttcatctgatatggagaagtttaccgagatcatcaagcagatggactcagctgtttgtatgcctatgaagcgtaagaaagcacgcatgccgaatagtcctgcccctcattttgcaatgccccctatccatgaagatcatttggagaaagtgtttgatccgaaggtattcaccttcggactgggcaaaaagaaagagtctcagccggaaatgtcacccgcactacacctcatgcagaatctagacacaaagagtaaacttcggcctaagagggcatccgcggaacagtccgtccttttcaagtcactacatacaaatactaacggaaatagtgagccactcgtaatgccagaaatcaatgataaggagaaccgagacgtgacaaacgggggaattaagagaagccggctcgagaaatccgcattgttcagtagcctgttatctagcctcccgcaggataaaatattctccccatctgtgacatccgtgaataccatgaccaccgctttctccacatctcagaatggctctcttagccagtcgtcagtttctcaacccaccactgaaggcgcacccccttgcgggctgaataaagagcagtccaatctactgcccgacaactccttgaaggtattcaacttcaactcaagcagcactagccactcgtcactgaaatccccaagccatatgtag

SEQ ID NO: 212971 - DNA, 5171 bp, Artificial Sequence
  Description of Artificial Sequence: Synthetic coding sequence
atggaaaagcgatcctccggaaggaggtctggcagaagacgcggtagtcagaaatcaactgatagcccgggtgcggacgcggagcttccagaatcagctgctagggacgacgctgtgttcgatgacgaagtggccccaaacgccgctagtgacaatgccagtgcggaaaaaaaagttaaaagtcctcgcgctgcactggatggaggggtggctagtgccgcttccccagagtcaaaacccagtcccggtacaaaaggccaactgagaggcgaatctgacagatcgaagcaacctccccctgcctcctctcctactaagcgcaaaggcaggagtcgcgctctggaagcagtgccagcaccgccagcttcgggtccccgagctccagctaaggaatctccgcctaaaagagtgccagatccctctcctgtgacaaagggaacggccgctgaaagcggggaggaagcggcaagggcgatacctagagagctgccggttaaatcttcatctcttttacctgagataaaaccggagcacaagcgagggcctctgcctaaccattttaacgggagggctgaagggggaagaagtcgcgagttagggagggcagcgggtgccccaggtgccagtgatgctgacgggctcaaacctagaaaccattttggagtgggacgatccaccgtaaccactaaggtgaccctgcctgccaagcctaaacatgtcgaattgaacctgaaaacacccaagaacctcgattctttaggcaatgagcacaatcctttttcgcagccggtccacaaaggcaacacggccacaaaaatctctttgttcgagaacaaacgcaccaattcgagtccgcgacatacagacattcggggacagcgaaacacaccagcctccagtaagacatttgtcggcagggctaagctgaatcttgcaaaaaaagccaaagagatggagcagcctgagaaaaaggtgatgccaaattctcctcagaacggggtgctcgttaaagaaaccgccattgaaaccaaagtcaccgtttccgaagaagagattctcccagcgacaagaggtatgaatggggatagttctgaaaaccaggccctcgggcctcaacccaaccaggacgataaggccgacgtgcagactgatgccggttgtttatctgaacccgtcgcctcagcgctgatccctgtgaaagaccacaagttgctagaaaaggaggactccgaggccgctgattcaaaatccctcgtactcgagaacgttaccgatactgcacaggacatccctactacggtggacaccaaagaccttccacctaccgctatgccgaagccgcaacacactttctctgacagtcagtcccccgctgaatcttctcccggtccttcactgtctctaagtgctcctgcacccggtgacgtccccaaagatacctgcgtgcaatcacctatctcatcgtttccgtgcactgatttaaaagtctcagagaatcataagggctgtgtcctgccagtgagtcgacagaacaacgaaaaaatgcctctacttgagctgggaggggagacaactcccccactttccaccgagcgcagtcctgaggccgttgggagcgagtgtccatccagagttctcgtccaggttaggtcattcgttctgccagtggagagtacacaggatgtgtcatcacaggttattcccgaaagctctgaggttcgcgaagtccagctaccaacttgccattcaaatgaacctgaagtcgtgtctgtcgcatcttgcgctcctcctcaggaagaggtcctgggaaacgaacacagccattgtactgcggagttagccgcaaagtccggacctcaggtgatcccacccgcatctgaaaaaacacttccgatccaggcacagtcccagggttccagaacgcccctaatggccgagagctctccaaccaactcacctagctctggcaatcaccttgcgacaccacagcgacctgatcagaccgtgaccaacggccaggacagccccgctagcttacttaacatcagtgcagggtccgacgacagcgtgttcgactcaagctccgatatggaaaagttcacagaaatcatcaagcagatggactcggccgtctgcatgcctatgaagcggaaaaaagccagaatgccgaattcccctgcgcctcatttcgccatgccgcctatccacgaggatcacctagaaaaggtgtttgatccgaaggttttcacattcggcttaggaaagaaaaaggaaagccagcctgaaatgtctcccgctctccacctcatgcaaaatctggacaccaaaagcaagctccgacctaaaagagcctctgccgagcagagcgtgctgttcaagagtttgcatactaacaccaacggaaacagcgagccactcgtcatgcccgaaattaacgataaagaaaaccgggacgtgaccaatgggggtattaagcggtctagactcgaaaaatcggctctgttttcaagccttctctccagtctgccccaggacaaaatctttagcccctccgtcaccagcgtcaataccatgactacagctttcagcactagccaaaatggaagcctgtcccaaagcagcgtctctcagcccacaacagaaggagcacctccttgtgggttgaacaaagagcagtctaatttgctgcccgataattcactcaaggtgtttaactttaactcctctagcaccagccactctagcctgaagagcccctcccacatggagaagtatccgcagaaggaaaaaacaaaggaggacttggactctcggagcaatctgcatctgcctgagacaaaatttagcgaattatctaagctgaagaacgacgatatggagaaggccaatcatatagagagcgtcatcaaatcaaatctcccaaactgcgcaaattccgacacagattttatgggcctgtttaaaagtagtagatacgatcccagcattagcttttcaggcatgtcactgagtgacacgatgaccctaagaggctccgttcagaataaactcaatcctcgcccaggcaaggtggtcatctactcagagccggacgtgagcgaaaagtgtattgaggtgtttagcgacatccaggactgtagctcctggtccctgtcgcctgtgatccttattaaggtggtgaggggctgctggattctgtacgagcagcccaactttgaggggcactccattcctctggaggagggcgaactagaactgtctgggctttggggaatcgaggatatcctcgaaaggcatgaagaggccgaatcagataagcctgtcgttattggctcgatccgtcatgtcgtccaggactatcgggtgagtcacatcgacctttttacggagccagaaggcctgggcatcctctcctcatatttcgacgacactgaagagatgcaaggcttcggtgtcatgcagaaaacatgctccatgaaagttcattggggaacctggcttatttatgaggagcccggttttcaaggggtcccattcatcttggagccaggggagtatcctgatctgtcattctgggatactgaagaagcttacatcggtagtatgcgcccactaaagatgggaggaaggaaagtggagtttcccaccgaccctaaagtggtggtgtatgaaaagcccttctttgagggcaagtgtgttgaattggaaaccggaatgtgctcattcgtgatggaaggtggggaaacagaggaggctacaggcgatgaccacctcccatttacttccgtgggttcaatgaaggttctccggggaatatgggttgcctatgaaaagcctggatttacaggacaccaatacctgctggaggagggggagtatagggactggaaggcttggggtggatacaatggggagctccagagtttgcgcccaattctcggcgatttcagcaatgcacatatgatcatgtattctgagaagaactttggttctaaagggtcttccatcgacgtcctggggatagtggccaatctgaaagaaacgggatatggagtgaaaacccaaagcatcaatgtgctgtccggagtgtgggtcgcctacgagaacccagacttcaccggagagcagtatatcctcgacaaggggttctacacctccttcgaggactgggggggaaagaattgcaaaattagttctgtccaacctatttgcctcgacagttttaccgggccacgtcggcgtaaccagatccacctgttttccgagccacaattccaggggcattcccaaagttttgaggagactaccagccagatcgacgattcattttcaacaaagagttgccgagtcagcggcggtagctgggttgtctacgacggagagaacttcactgggaaccagtacgtgcttgaggagggacattatccctgcctgtccgctatgggttgccctcccggagctacgttcaagtctctgaggtttattgacgttgaatttagcgagcccaccatcatcctctttgagagggaggattttaaaggaaaaaaaatagaactcaacgcagaaacggttaatctgcggtctctcggctttaatacccaaatccggagcgtccaggttatcgggggaatatgggtcacctatgagtatggctcatacagggggagacagttcctgctgtcgccagccgaagttcctaattggtacgagttcagcggttgtagacagattggctctctcagaccatttgtgcaaaagagaatctattttcgcctgcggaacaaggcaacagggctgttcatgtctactaacggaaacctggaggatctgaagctcctgagaattcaggtcatggaagatgtcggagcagacgaccagatttggatttatcaggaaggctgtattaagtgtaggatcgccgaagactgttgcctcaccattgtgggctctttggtgactagcggttctaagctcggtctagcccttgaccaaaacgctgacagccaattctggtccctcaaaagcgacgggaggatctactctaaactaaaacctaacctcgtcttagatataaagggcggtactcaatacgatcagaaccatattatcctcaatacagtatcaaaggaaaagtttacccaagtatgggaggccatggtcttgtacactta

SEQ ID NO: 212972 - DNA, 951 bp, Artificial Sequence
  Description of Artificial Sequence: Synthetic coding sequence
atgcagaaacctaaaaccgtcgcctgggagaatttgggaccggaaatgagtgctcttggaaccgcattcagcagagagggtggcagaaaggtagagtttccaactgatcccaaggtggttgtgtacgagaaacctttttttgaaggcaaatgtgtcgagctcgagaccggaatgtgttcttttgtcatggaaggcggtgaaactgaggaggctaccggcgatgaccatctcccattcacttctgttggttcaatgaaagtgctgaggggaatctgggtggcctatgaaaaaccaggcttcaccggacatcagtatctgctcgaggaaggtgagtaccgcgattggaaggcttggggcggttataacggggagttgcagtctctgagacctatcctgggggatttcagcaacgcccacatgatcatgtactcagagaagaacttcggaagcaagggttcctccatcgacgtactcggaatcgtggctaatctgaaggaaacgggatacggcgttaaaacacagtccattaacgtgctaagcggcgtgtgggtggcttacgagaatcccgattttactggcgagcagtatatcctcgataagggattttacacatccttcgaggattggggcggtaaaaactgcaaaatatcctctgtgcagcccatttgtctagacagctttactggcccacgccgtcgcaatcagatccatttattttctgaacctcaatttcagggccactcacaaagttttgaggagaccacaagccaaatcgacgacagcttttctacaaagtcgtgtcgggtcagcggaggaagctgggtggtttacgacggagaaaactttaccggcaatcaatacgttttggaggaggggcactatccttgtctttcagccatgggatgccccccaggggcaacattcaaatctttgcgcttcattgacgtctag

SEQ ID NO: 212973 - DNA, 1629 bp, Artificial Sequence
  Description of Artificial Sequence: Synthetic coding sequence
atgcagaaacctaaaacagtcgcctgggagaacctcggcccagaaatgagcgctcttgggaccgccttctcaagggaaggtggcaggaaagtcgaatttcctaccgaccctaaagtggtcgtgtacgagaaaccgttctttgaagggaaatgtgttgagctcgaaaccgggatgtgctcatttgtcatggagggaggggagacagaggaagcaactggtgatgaccacttgccattcactagtgtggggtccatgaaagttctgaggggcatatgggtagcttatgagaagccaggcttcacaggacatcagtatttgctggaggagggcgagtatcgcgactggaaggcctggggcggatataatggggagctccagtccctgagaccgatcctgggagactttagtaatgcacatatgattatgtacagcgagaaaaactttgggagtaaggggtcctccatcgacgttcttgggatcgttgcaaaccttaaagagacagggtacggagtgaagacccaaagtataaacgtcctctccggagtttgggttgcttatgagaatcctgacttcactggagagcaatacattctagataaggggttttacacctcatttgaagattgggggggtaaaaactgcaagatctcgtctgttcagcccatctgtcttgactcatttacggggccacgtcggcgtaaccagatacatctcttcagcgaaccacagttccaggggcattcccaaagtttcgaagaaactacctctcagatagacgattccttctctactaagtcatgccgtgtttctgggggttcttgggtagtgtacgacggcgaaaatttcacaggaaaccagtacgtgctggaagaaggacactacccttgtctgtcagccatgggatgtccccctggggcaactttcaaatccctcagatttattgacgtcgaatttagtgagccaaccattatcctgttcgaaagggaagactttaaaggaaaaaaaattgagctgaacgcagaaactgttaatctgagaagtctcggatttaatacacagattcggagtgtgcaggtcatcggcggtatttgggtgacctacgagtatgggtcctacaggggaagacagtttctgctgtctcccgcagaggtgcccaactggtacgagttcagcggatgtcggcagatcggaagtctgaggccgtttgtccagaaacggatctactttagattacgcaacaaagctacaggactcttcatgtccactaacggaaacctcgaggatctgaaattgctccggatccaagtgatggaggatgtaggcgcagatgaccagatttggatttaccaggaggggtgcataaaatgccgaatagctgaagattgttgcctgacaatcgtaggcagcctcgttacatctggctctaagcttggtcttgcgctggatcagaacgccgattcccaattctggtcattaaagtcagacgggagaatctacagcaagcttaagcccaatctggtgctcgacattaaagggggaacacaatacgaccaaaatcatataattctcaatacagtctctaaggaaaagttcactcaggtgtgggaagcaatggtgttgtacacctag

SEQ ID NO: 212974 - DNA, 504 bp, Artificial Sequence
  Description of Artificial Sequence: Synthetic coding sequence
atggtcgcacagcaagaaagcatcagggaaggattccaaaagaggtgcctgcccgtaatggtgttaaaggctaaaaagccattcacttttgaaacacaggaaggcaagcaggagatgttccacgccaccgttgcaacagagaaagaattcttttttgttaaggtgttcaacaccctcctaaaagacaagttcatacctaagcgtattatcatcatcgcgaggtactacagacactcgggatttctggaagttaattcagcctctcgtgtgctggatgcagagtctgaccagaaagtgaatgtgcctctcaatatcatcaggaaggccggtgagaccccaaaaatcaacactttacagacacagcctctgggcacaattgtgaacgggctcttcgttgtgcagaaggtgacagagaagaagaaaaatatcctatttgatctgtctgataatactggaaaaatggaggtgcttggcgtgagaaacgaggatactatgaaatgctag

SEQ ID NO: 212975 - DNA, 1032 bp, Artificial Sequence
  Description of Artificial Sequence: Synthetic coding sequence
atggaatccaaatataaagaaattttactgttgaccggactcgacaatatcactgacgaggagctcgatagatttaaattcttcctgtccgatgagtttaacatagccacaggtaaactgcacacggccaatcggatccaggtcgctaccctgatgatccagaacgccggagccgtgtctgctgtgatgaagacaattcggatattccaaaaacttaattacatgctcctggctaagaggctccaagaggaaaaagagaaagtagacaagcagtacaaatcagtgactaaaccaaagccattgagccaggccgagatgagccctgcagcgagtgcggcaatcagaaatgacgtggccaaacagcgggctgcgcctaaggtgagtcctcacgtaaaaccggaacaaaagcaaatggtggcccagcaagagagcatccgcgaaggatttcagaagcgatgcctgcctgttatggtgctgaaggctaaaaagccgttcacctttgagacacaggaggggaagcaagagatgtttcacgcaactgtggcaaccgagaaagagttcttcttcgtaaaggtgtttaacaccctgttgaaggacaagtttattcccaaacgcattataattatcgctagatattacaggcacagcggattcctcgaggtgaacagcgcttcccgcgtacttgacgcagagagcgatcaaaaggtcaacgtgcctttgaatatcatccgaaaggcaggcgaaacgcctaagataaataccctgcaaacacagcccctggggactatcgtgaatggcctgtttgttgtgcagaaagtgaccgagaagaagaagaatatcctgtttgacctctccgacaacaccggcaaaatggaggtgctaggcgttcgtaacgaggacaccatgaaatgtaaggagggtgacaaggttagactcacgttctttacgttaagtaagaacggtgaaaagctgcagctgacatcaggtgtgcattccactatcaaggtgattaaagccaagaagaaaacctag

SEQ ID NO: 212976 - DNA, 411 bp, Artificial Sequence
  Description of Artificial Sequence: Synthetic coding sequence
atggagagcaagtacaaagaaattctgctgttgacaggtctggacaacatcaccgatgaagagctggataggttcaaattctttctgagcgacgaattcaacatagctactggcaagctacatactgcaaatcggatacaggtggcaaccctgatgatccagaatgccggtgcagtttctgcggtcatgaagaccattcgaatatttcagaagttgaactatatgctcctggccaagcgcctgcaagaggaaaaggagaaggtggataagcagtacaagtcagtaactaagcccaagcctctctctcaagccgaaatgtccccagccgcatccgctgctattcgaaacgatgtagccaagcagagggctgcaccaaaagtttccccccatgtgaaacccgagcagaagtag

SEQ ID NO: 212977 - DNA, 1800 bp, Artificial Sequence
  Description of Artificial Sequence: Synthetic coding sequence
atgtccaaggaagaacgccctggaagggaggaaattttggaatgccaggtgatgtgggaacccgattctaaaaagaatacccagatggaccgctttcgagcggctgttggggctgcctgcggacttgctctcgaatcatatgacgatttataccattggtctgtcgagtcttactcagatttctgggcagaattctggaaattcagcggcattgtgttctcgcgagtttacgatgaggtggtggacacaagcaagggaattgctgacgtcccggagtggttcaaaggtagcaggcttaactatgcggagaacttactccggcacaaagaaaacgatagggtcgcactttatatagcaagagaaggtaaggaagagattgtaaaggtcacatttgaggaactgagacaagaagtggccctgtttgcagccgctatgagaaagatgggcgtcaaaaagggtgatcgtgttgtgggatacctcccgaactccgaacacgctgtcgaagcgatgctggccgcagcgtctattggagcgatttggagtagtacgtcaccggactttggggttaacggagtgctagacaggttttcccagattcaacctaaactgatcttctcggtggaggctgtcgtctacaacggtaaagaacacaaccacatggagaagttgcagcaggtggtgaagggactcccggacctgaagaaagtcgttgttattccctacgtcagctcgcgggagaacatcgatctttctaagatcccaaactccgtcttcttagacgactttctcgccacaggcacctctgaacaagcccctcaactggagttcgagcagctgcctttttcccaccctctcttcattatgttttcttcaggcactacaggcgcaccgaaatgcatggtgcattccgccggtggcaccttgattcagcacttgaaagagcatctactgcacggcaacatgacaagctcggacatcctgctgtgttataccactgtagggtggatgatgtggaactggatggtgtcgctcctggcaacgggggctgctatggtcctatacgatggatcccctctggtgccaacccctaacgtgttgtgggatcttgttgatagaatcggaattactgtgctggttactggcgcaaaatggctgagcgtcctagaagaaaaggccatgaagccagtggaaacccattcactgcagatgctgcacacgatcctatctactggcagtccgctgaaggctcagtcttacgagtacgtctaccggtgcataaagtcttcgatcctgttggggtccattagcggtggcacggacattatttcttgctttatgggccataatttcagtctccccgtctataaaggggaaatccaggcccgaaatcttggcatggcggtggaagcgtggaacgaagaaggcaaagccgtttggggtgaatccggggaactggtatgcactaaaccgatcccctgtcagccaacccacttctggaatgacgagaacgggaacaaataccggaaagcctacttttccaagttccccggtatttgggcccacggtgattactgtagaattaatcccaagactgggggaatcgtgatgctaggacggtccgatggaacccttaatcctaacggagtgagattcgggtcctctgaaatatacaatatagtttacgcccagcgccaggagtctggcagctgcaggcagaccgatcaccggtggaaaagtcgcggagcccgtcgctgtttccttgaacccagagaccccggttccgtgcccggtcatccatag

SEQ ID NO: 212978 - DNA, 2019 bp, Artificial Sequence
  Description of Artificial Sequence: Synthetic coding sequence
atgtccaaggaagagcggcctggacgcgaggagattttggagtgtcaggtgatgtgggagcccgacagtaaaaaaaacacccagatggacagatttagagccgcagttggcgcagcttgtggattggctcttgagtcttacgatgacctgtaccattggtcagtcgaatcctattcagatttttgggccgaattctggaagttttcagggattgtgttctcaagggtctacgacgaagttgtggacaccagtaagggtatcgctgatgtgcctgagtggtttaaggggtcacggctgaactatgcagagaatttgctccgccacaaagagaacgatagagtagcgctttacatagccagagagggcaaagaagagatcgttaaagtgacctttgaagagttgcggcaggaggtggccctcttcgccgcagccatgcggaaaatgggagtgaaaaagggagatcgcgtggtgggatatttgcccaatagtgagcatgctgtagaagcgatgctcgccgctgcgtccatcggggctatttggtcatctaccagcccggactttggagttaatggcgtgctcgatcggttctcccagatccagccaaaactcatttttagtgtcgaagccgtggtttataacggcaaagaacataaccatatggagaaactccagcaggtggtgaaggggctgcctgatctcaagaaggttgtggtgattccatacgtcagctcccgagagaatattgatctgtcgaagatccctaactctgtgttcctcgacgacttcttggcaacaggaacctcagagcaagctccacagctggaatttgaacagctccccttcagccaccccctgtttatcatgtttagtagcggaacaacaggtgcccctaaatgcatggtccacagtgctggcggtactctaatacagcacctaaaagaacatcttctgcacggcaacatgacatctagcgacattcttctgtgctatacgaccgtcggctggatgatgtggaattggatggtgtcactattggctaccggagccgcaatggtactatatgacggttccccattggtgcccacgccaaatgttctgtgggatcttgtggatcgtatcggcatcaccgtcctggttactggtgctaagtggttgagcgtgttggaagaaaaagccatgaaacccgtggagactcactccctgcaaatgctgcacaccatactatctacaggttcccctctgaaagcacagagttatgaatacgtctaccggtgtatcaagagtagtattctgcttggaagcatctccggcggaaccgatatcatctcctgcttcatgggtcataatttctccctacccgtctataaaggtgagattcaggcacgaaacctggggatggccgtcgaggcttggaacgaagaggggaaggccgtatggggtgaatccggcgagttggtctgtaccaagcctattccgtgtcagcctacgcatttctggaatgatgagaacggtaacaagtacaggaaggcgtatttttctaaatttcctgggatttgggcccacggtgattattgtcggatcaacccaaaaaccggcggaattgttatgcttggaaggtccgacggaacattgaatcccaacggcgtgagattcggctcctctgagatttataatattgtagaatccttcgaggaggtggaggacagcctgtgtgtgccgcaatacaacaaataccgcgaggaaagggtgattctctttctgaagatggcgtcaggtcatgccttccagcctgatctggtaaaaaggatccgagacgctattcggatgggactgtccgcgaggcacgtaccgagcttaattcttgaaaccaaaggtattccgtacactctgaacggaaaaaaagtcgaggtcgcggtcaaacaaataattgcaggcaaggccgtagaacagggaggtgccttctccaatccagaaactctcgacttatatcgcgatataccggaactgcagggtttctag

SEQ ID NO: 212979 - DNA, 762 bp, Artificial Sequence
  Description of Artificial Sequence: Synthetic coding sequence
atgagaaaaatgggtgtgaagaagggcgacagagtcgtcgggtatttgcccaacagcgaacacgccgtggaggcaatgttagccgctgcttcaataggcgcaatctggtctagtacttccccagacttcggggtcaacggcgtgcttgacaggttttcacagatccagccaaagctgatattctcagtggaagccgtggtttataatggtaaggagcataaccacatggagaaattgcagcaggttgtaaagggtctgccggacctaaaaaaagtcgtggtgattccttacgtctcttctagggaaaatatcgatctttccaagattcccaattcagtttttttagacgatttcctagccactggtacatctgagcaggccccacagctggagttcgagcagctcccttttagtcaccccctttttattatgttctcatcaggcaccaccggagctccaaagtgtatggtgcatagcgctggcggtactttgatacagcatctgaaggaacacctactgcatggaaatatgacaagtagcgatatacttttatgctatactaccgtgggctggatgatgtggaattggatggtctctctcctggccaccggtgcagcaatggtgttgtacgatggctcccccttggtgcccactccaaatgtactctgggacttggtcgaccgaattggatacctggggagttggcgactgctgcagaatcagccgcaggaccgcggtcaccgccatgcctggcctgaatag

SEQ ID NO: 212980 - DNA, 1845 bp, Artificial Sequence
  Description of Artificial Sequence: Synthetic coding sequence
atgaggcctccacaatgtttactgcacaccccaagcttggcaagtcctctgctgctcctgttgctgtggctactcgggggaggcgtcggagccgaagggagagaagatgccgaattgctcgtgactgttcgaggaggcagactccgaggcatcagactgaagacccctggtggtccagtcagcgccttcctgggcattccctttgctgagcctccaatgggccctaggcggtttttgccgccagaacccaagcagccttggtcaggcgtcgtggatgctacaacttttcagagcgtttgttaccagtatgttgacacactgtaccccggatttgaaggaactgagatgtggaatccaaatcgcgagcttagcgaagactgcttgtacctgaatgtttggactccatacccccgacctacatctccaacccctgttctggtctggatatacggaggtggcttctatagcggcgctagcagcctggacgtgtacgatgggagatttctggtgcaggcagagagaaccgtgctggtaagtatgaactacagggttggtgcattcggatttctggctcttccgggaagcagagaggctcctggcaatgtgggactgttggaccagagactggctctccaatgggttcaggaaaacgtggctgcctttggtggggatcccacctctgtgacacttttcggggagtctgccggagccgcttctgttggtatgcatttgctatcccctccctctcgaggccttttccatcgcgctgttttgcagagtggggctccaaatggaccatgggctacggtgggcatgggtgaggccaggagacgggcaacgcagctcgcgcacctcgtgggctgccccccaggaggcaccggagggaatgacacagagttagtggcgtgtctccgcacgaggcctgcccaggttctggtgaaccatgaatggcatgtgctgcctcaagagtcagtcttcaggttttccttcgtgccagtcgttgacggagacttccttagtgacactccagaggccctcattaatgccggagacttccacgggctgcaggtgcttgttggggttgtaaaagatgaaggctcctactttctggtgtacggagccccagggttctcaaaggataatgaaagtttgataagcagagctgagttcttagccggtgtgcgggtaggagtgccacaggtgagtgacctggccgcagaggcggtcgtgctccactataccgattggctgcatccagaggatcctgctagacttagggaggccctttctgacgtggtgggggatcataacgtggtgtgcccagtggcgcagctggccggtaggctggctgcccagggtgccagggtatacgcttatgtctttgagcaccgggctagtaccttgtcctggccgctgtggatgggagtcccgcacggttatgagatcgagtttattttcgggatcccccttgatccatctcggaattatacagccgaggagaaaatttttgcacagcggctgatgcgctattgggctaacttcgcacgcaccggcgatccgaacgaacccagagaccccaaggcacctcagtggcctccatacactgcgggagctcagcagtacgtctccctggacctcagaccgctggaagtgcggagagggcttagagcccaagcgtgtgcgttttggaataggttcctgcctaaattgctgagtgcaaccgataccctcgacgaagcagaacgccaatggaaagcagagtttcataggtggagctcttacatggtgcactggaaaaatcagtttgaccattactctaagcaggataggtgtagtgatttgtag

SEQ ID NO: 212981 - DNA, 1854 bp, Artificial Sequence
  Description of Artificial Sequence: Synthetic coding sequence
atgcgcccaccccagtgcctgctgcatacaccctctctagcgtctccacttttattactgctactgtggttactcggcggaggcgtgggagcagaaggacgcgaagacgcggagctactggtgaccgttcggggtggccgacttcgcggtatcaggctgaagactcccggaggacccgtgtccgcttttttaggcatcccatttgccgaacccccaatgggcccacgccgatttctgccaccagaacctaagcagccgtggagcggtgttgttgacgctaccaccttccagtccgtgtgctaccagtacgtggacactctctacccgggattcgaaggaacggagatgtggaacccgaatagagagctcagcgaagattgcctgtacctcaacgtctggactccttacccgagacccacatctcctacacccgtcctggtctggatttatggtggtggcttctactccggcgcttcgtcactagacgtctacgacggcaggttcctggttcaggccgagcgtaccgtgctcgtttctatgaactaccgcgttggcgctttcggattcttggcactgccaggcagccgggaagccccagggaacgtcggccttctcgaccagagactggccctacaatgggtccaagagaatgtcgccgcatttggcggtgaccccacaagtgtcacgctctttggagagtcagctggggcagccagtgttggaatgcatctcttaagtcctccctctcgaggcctgtttcatagagccgtgttacagtctggggcacccaacggaccctgggccaccgtgggaatgggcgaggcccgtcgacgagccactcagctggcccatcttgtgggctgtccccctgggggtaccgggggaaacgacacggagctcgtggcttgtctccgcactcggcctgcccaggtgctggtaaaccatgaatggcacgtcctgccccaggagagcgtttttagattcagttttgtgcctgtagtcgacggcgactttctctctgacactcccgaggcgctgatcaacgccggtgatttccatggcctccaggttctggtgggagtcgtcaaagatgaaggttcctatttcctcgtgtacggggcaccgggattttccaaagacaatgagagtctcatctctcgtgctgagtttcttgccggtgtcagagtgggtgtgccacaggtgtcagacctcgctgccgaggccgtggtgctgcattacacagattggctccaccccgaggaccctgcccgtctccgcgaagcactgtccgacgtcgtgggagatcacaatgtggtgtgtccagtcgcacaactggcaggtcgcttggccgctcagggcgctcgcgtctacgcctacgtcttcgagcatagggcctccaccctgtcatggccactctggatgggtgtccctcacggatacgagatcgagttcatcttcgggattccactcgatccttctcgcaactatacggcagaggagaagatcttcgcacagcgccttatgaggtattgggctaactttgcacgcaccggggaccccaatgagcctagggatcctaaggcccctcagtggccaccctacaccgccggagcacaacagtatgtaagcctcgacctgaggccactagaagtgcgcaggggcctccgggcacaagcttgcgcattttggaacagatttctcccaaaactgctgtctgcaacagcctcagaggccccttcaacatgtccagggttcacccacggtgaagcagctccgaggccagggctgccacttcccctcctgctgctacatcagctgctactgctgttcttgtctcatctcagacgtctctag

SEQ ID NO: 212982 - DNA, 1854 bp, Artificial Sequence
  Description of Artificial Sequence: Synthetic coding sequence
atgcgccctccacagtgtctgcttcatacacctagcctcgcgagcccattactgttgctcctcctgtggttgctggggggtggagtcggtgccgagggccgagaggatgcggaactgctagtgacagtacgcggaggcagactaagaggtatccgtctaaaaaccccaggtgggcctgtgagtgcattcctcggcattccgtttgcagaacctcccatgggtcctagaaggttcttgcctccggaaccaaagcagccctggtccggggtggtggacgccaccacgttccagtccgtgtgctatcagtatgtagacactttgtacccagggttcgagggaactgaaatgtggaatccaaacagagagcttagcgaagactgtctgtatctaaacgtgtggactccttacccccgtcccacttcccctacacctgtgctggtctggatttatggaggcggattctactcaggagcaagtagcctggatgtctatgatggtagatttctggttcaggcagagcgcacggtactggtatccatgaactatcgagtgggagccttcggtttccttgccttaccgggaagtcgggaagcaccaggaaacgttggacttctcgatcaacggctggctctgcagtgggttcaggaaaatgtggccgcttttggcggagatcctactagtgtcacactgttcggcgaaagtgccggtgcagcatcagttggtatgcatctcttatctccgccatcccgcggactcttccacagagccgtgctccagtctggggctcctaacggcccatgggctactgtgggcatgggcgaggcaagaagacgggctacacagctggcccatcttgtaggctgcccacccggagggaccggcggaaacgatacggagctcgttgcctgcttgcgcacccgccctgcacaggtgcttgtgaatcatgaatggcatgttctgcctcaagagtccgtgtttcggttcagctttgtacccgttgtggatggagactttctgtcagatacccctgaggctctgatcaacgctggagactttcatggactgcaggttcttgtaggcgttgtgaaagacgagggatcctactttcttgtttatggcgcacctgggttctctaaggataatgagagtctgattagccgagccgagttcctggcaggcgtgcgcgtcggggttccacaggtttcagatcttgcggcagaggcagttgtactgcactacactgattggctgcatccagaggaccccgctcggctgcgggaagctttgtctgatgtggttggcgaccacaatgtggtgtgccctgtcgcacagttggccggtagactggccgctcagggagcaagagtgtacgcctacgtctttgagcatcgggcttcgacattgagctggcccttatggatgggcgtgcctcatggatacgagattgagtttattttcggcatcccgctggacccctcccgtaactatacagctgaggaaaaaatcttcgcccagcgtctgatgcggtactgggcaaactttgcgaggaccggcgaccccaacgagcctcgggaccctaaagcccctcaatggccgccatatactgccggagcacaacagtatgtctctcttgatctgagaccgctagaggtccggaggggcttacgggcacaggcgtgcgccttctggaacaggtttcttcccaagctcctgtcagctacggccagcgaagccccttccacatgtcctggcttcacccacggcgaggcagctcccaggcccggactgccactcccactgcttctgctgcatcagcttctcctgctgttcctcagccacctgagacgtctatag

SEQ ID NO: 212983 - DNA, 1845 bp, Artificial Sequence
  Description of Artificial Sequence: Synthetic coding sequence
atgagaccccctcagtgcctgctgcatactccttctctggcctcgcctttgctgctcttattgctctggctgctgggaggcggagtgggggcagaagggagggaggacgccgagctccttgttactgttagagggggacgtctccgaggcatccgactgaaaaccccaggtggccctgtcagcgcgtttctgggaattccgtttgccgagccccctatgggaccgaggcgcttcttaccacccgagcctaagcaaccatggtccggggttgtagatgccacaacctttcagagtgtgtgctaccagtatgtagataccttgtacccgggatttgaaggaactgagatgtggaatcctaacagggaactgagtgaagactgtctgtaccttaatgtatggactccctatcccaggcccacctctccgacacctgtcctcgtgtggatctacggcggaggcttttacagcggagcctcttcactagatgtctacgacgggaggtttctggttcaagcagagaggaccgtgctggttagtatgaattaccgtgtaggggcattcggattcctggcactccccggatccagggaggctcctggaaatgtgggcctgttagaccagcggctggccttacaatgggtgcaggagaacgtcgctgcatttggaggagacccaacaagcgtgacattattcggggagagcgcgggtgccgcttctgttggtatgcacctgctgtccccaccatctagaggcctcttccatagggcagtcctacagtcaggagcaccgaatgggccatgggctaccgtagggatgggggaggccaggcgccgagccacgcagttggcacaccttgtgggctgtccaccgggaggcacaggaggcaatgatactgaactcgtggcctgcctgcgtacaaggccagctcaggtcctcgtgaaccatgaatggcacgtgttgccccaggaatcagtctttcggtttagcttcgtgcccgtggtggatggtgatttcctgagtgacactccagaggctctgatcaacgctggcgactttcacgggcttcaggttctagtgggcgtggttaaggacgaaggctcatactttctggtctacggtgcgcctgggtttagcaaagacaacgagtcactaatctcaagagcagagtttctggcaggagttagggtgggagtgccccaggtgagcgacctggcggcagaggcagtggtcctacactatacagactggctgcacccagaagaccctgctaggctgcgggaagcattgagtgatgttgtcggagaccataacgtcgtgtgccccgtggcccagctcgcgggaaggctggctgcccagggcgcacgcgtctacgcctatgtgttcgagcatagagcctccactctcagctggccactctggatgggcgtgccccacggctatgagatcgagttcatttttggtatacccctggatccaagcaggaattacaccgccgaagagaagatctttgcccagaggctcatgcggtactgggcaaacttcgcccgtactggggacccaaacgaacccagagatcctaaggcgccacagtggcctccatacaccgccggagctcaacaatacgtgagcctcgatctccggccactcgaagtgcgtaggggactacgagcccaggcttgcgctttttggaatcggttcctccctaaactgctgtccgccaccgacaccctggacgaagccgagcgacagtggaaagccgagtttcacagatggtcaagttatatggtccactggaagaatcaatttgaccactacagcaagcaagacagatgcagcgacttgtag

SEQ ID NO: 212984 - DNA, 1581 bp, Artificial Sequence
  Description of Artificial Sequence: Synthetic coding sequence
atgaggcccccacagtgtttgctgcataccccatccctggccagcccactcctgttgctactcctctggcttttggggggtggcgtgggagccgagggacgcgaggacgctgagctcctcgtgacagtcagaggaggacggctgcggggaatccgcctgaaaaccccaggaggtcccgtgtctgcatttcttggcatcccatttgctgagccaccaatgggccctcgaagattcctccccccagagccaaaacagccttggtcaggagtcgtggatgctaccactttccagtccgtgtgttaccagtatgtcgacaccctctatcctggatttgagggcacggaaatgtggaaccctaacagagagttatcagaagactgtctgtacctgaacgtctggaccccatatcctcggccaactagcccaacaccagtgctcgtgtggatctacggtggaggcttttacagcggtgcatcttcgctggacgtctatgatggaagattcttggtgcaggcagagcgcaccgtactggtcagtatgaactacagagttggagcatttggctttctggccctgcctgggagtcgagaggctccgggtaatgtgggcctcctggaccagcgcttggccctgcaatgggtccaggaaaacgttgcagcgttcggaggtgatccgacctccgtcactctgtttggcgaatctgctggagcagcctcggtgggcatgcatctgctcagtcctccctcacggggactgtttcatagggccgtcctgcaaagtggggctcccaacgggccttgggcgactgtcggaatgggggaggcacggaggcgtgccacccagcttgcccacctggtgggatgcccacccggtggcaccgggggtaacgacaccgagctagtggcttgtctgcgcaccaggcctgcccaggtgctggtgaaccacgagtggcacgttctcccacaggagagtgtcttccgctttagtttcgtaccagtcgtggatggagattttctctctgacaccccagaggccctaataaatgcgggtgactttcatggcctgcaattagccggtcggctcgcggctcagggcgcacgtgtgtacgcttacgtctttgaacaccgcgcatcgacactgtcttggcctctgtggatgggggtgcctcatgggtatgaaatagaatttatctttggtatccctctggatccgtccagaaattacaccgctgaagaaaagatattcgctcagcgcctcatgcggtattgggctaattttgccagaactggagatccaaacgaacctcgcgatccgaaagcaccgcagtggccaccctacactgcaggtgcacagcagtatgtgagcctagatcttaggccactggaggtcaggcggggactgcgcgctcaagcttgtgcattctggaatagatttctgccgaaattattgtcggccacagacaccctggacgaagctgaacgacagtggaaggcagaatttcatcggtggtctagctacatggtgcattggaaaaatcagtttgaccattattctaagcaggatcgctgttcggacctctag

SEQ ID NO: 212985 - DNA, 1806 bp, Artificial Sequence
  Description of Artificial Sequence: Synthetic coding sequence
atgaggcctccacaatgcttactccacacaccatcactcgcctcgcctcttttgttgctcctgctgtggttgctgggcggaggtgtaggggctgagggcagggaagacgcagagctcctcgtgacagtccgaggtggcaggctgaggggcattcggctgaagacaccaggcggacccgtcagcgccttcttagggattccttttgcagagccccctatggggccacggcgtttcttaccgccagaacccaagcagccctggtccggggtcgttgatgctacaaccttccagtcagtgtgttatcagtacgtggatacactgtatcctggctttgaggggactgagatgtggaaccctaatagagaactgagcgaggattgcctataccttaacgtgtggacgccctacccacggccaacgagcccaacaccagtgctggtgtggatttatggcggaggcttctactccggggcaagttctttggatgtttacgacggcaggtttcttgtgcaagcggaacggaccgttttggtctccatgaattaccgggttggggctttcggatttctggctctcccaggctctcgggaagccccaggcaacgtgggactgctcgaccaacggttggccttacagtgggtgcaggagaacgtcgcggctttcggcggagatcccactagcgttaccctctttggcgagtccgccggtgccgcttcagtgggcatgcatctgctgtctccaccgagcagaggcctctttcacagagccgtactgcagtcgggagcacctaacggcccatgggcaacagtgggcatgggcgaggcaaggagaagggcaacgcaactggcccatctggtaggatgccctcccggaggaacgggcggaaatgacactgagctggttgcatgcttgcggactcgcccagcccaggttctggtaaatcacgaatggcatgtgctgccacaggaatccgtgttccggttttcattcgtacccgtcgttgatggcgacttcttatcggacacacccgaggccctcatcaatgcaggtgacttccacggtctacaggtccttgttggcgtggttaaggatgaaggaagttacttcctggtgtacggcgcacctgggttctcaaaggacaatgaatctttaatttctcgcgctgagttccttgctggtgtccgagtgggcgtcccacaagtctccgacctggccgcagaggcagtggtgctccattataccgactggctgcaccctgaagaccctgccaggttgcgagaggcactgtctgatgttgtcggcgaccataatgtcgtttgtccggttgctcaactcgcagggaggctggctgcccagggggcacgtgtctacgcctatgtgttcgaacacagagcttcaacccttagctggccactgtggatgggggtcccccacggatacgagattgaatttatcttcgggatcccccttgatccatcaaggaactacaccgccgaagagaaaatattcgctcaacgccttatgaggtactgggccaactttgctcgaactggtgaccctaacgagcctcgggatcctaaggctccccagtggcctccctacaccgctggggctcagcaatacgttagcctggacctgcgtcctttggaggtgaggagaggtttacgggctcaggcttgtgccttctggaataggttcctgccaaagttgttgtccgccacaggaatgcagggacctgctggctctggcaggaggggcgtgggggcacgctgcaacccctctctgctgccccttgcctccgagtag

SEQ ID NO: 212986 - DNA, 1845 bp, Artificial Sequence
  Description of Artificial Sequence: Synthetic coding sequence
atgagacctccacagtgtctgctgcacacaccctcactcgcatcgcccctacttttactgttactgtggctcctcggtggaggggtgggagctgagggccgagaagatgccgagctgcttgtgaccgttagggggggaagattgcgtggaatccgcctcaaaacccccggaggtccggtgtccgcatttctaggaattcccttcgcagaaccacccatgggtcctcgtcgcttccttccacccgagccgaaacagccgtggagcggggtagtcgacgccacaacatttcagtctgtctgttaccaatacgttgatacactgtaccctggcttcgaaggaactgaaatgtggaaccctaatagagaactgtccgaggactgtctctaccttaacgtgtggaccccatatccgaggcccacttcgccaacaccggttcttgtgtggatttatgggggaggcttctacagcggcgcaagttcccttgatgtgtacgatgggagatttctggttcaagctgaacgaacagtgctagtatcgatgaattacagggtcggggctttcggattcctcgccctccccggttcgagggaggctccaggcaacgtaggtttgctggaccaacggctggccctgcagtgggtgcaagagaatgtggcggcatttgggggagatccaacttccgtcacattgtttggtgaatcggcaggcgcagcatccgtcgggatgcacctgttgtcgccccctagccgagggttattccaccgcgctgtgttgcaatccggagcccctaatggaccttgggccaccgtgggcatgggggaggcgaggcggagggccacccagctggctcaccttgtgggttgcccgccaggaggcacgggtggaaacgatactgagttagtcgcttgtttgcggacacgccctgcgcaggtgctggtgaatcacgaatggcatgtgttgccacaggagtccgtgttccggttttctttcgtgcccgtggtagatggcgatttcctctctgatacacctgaagcactgatcaatgctggagacttccatgggctgcaggtgctagttggcgtcgtcaaggatgagggatcttactttctcgtttacggcgctcccggattttcgaaggataatgagtctctcatcagtagagccgaatttcttgcaggagttcgggtgggagtccctcaggtgtctgatctggcagctgaggctgtggtgttgcactacaccgactggcttcaccctgaggatcccgctcgcctacgcgaagcattgtccgacgtggtcggggatcataatgtggtgtgcccagtcgcacagttggctgggagactggcagcccagggtgcacgggtttatgcgtatgtgtttgagcatagggcctccaccctgtcgtggcctctatggatgggggtgcctcatggctacgagatcgagttcatcttcggtattcctttggatcctagcaggaattatacagccgaagagaaaatatttgcacagagactgatgcgctactgggcgaattttgcaagaaccggcgatccaaatgagccacgggatccaaaagcaccccagtggcctccctacaccgccggagctcaacaatacgtctcccttgatctgcgcccattagaggtccggcgaggcttgagagcacaggcgtgcgccttctggaacaggtttcttccaaagctactctcagccacagacaccttggacgaggcagagagacagtggaaagcagaatttcaccggtggtcctcatatatggtgcattggaagaatcagtttgaccattactcgaaacaagatcggtgcagcgacttgtag

SEQ ID NO: 212987 - DNA, 480 bp, Artificial Sequence
  Description of Artificial Sequence: Synthetic coding sequence
atgcgtccacctcagtgtctgctgcacactccctcgctcgcttcacccctacttcttctcctgctgtggttgctcgggggaggagtgggggcagaaggaagagaggacgcagagctgcttgtcacagtgaggggcggtcggctccggggtatccgcctgaagactcccggtggacctgtgtccgcattcctgggtattcctttcgctgaacccccaatgggacctaggcgcttcctgcctccagagcccaaacagccctggtcaggagttgtggatgccacgacttttcagtctgtgtgttatcagtacgtggacacactttacccagggttcgaggggacagagatgtggaacccgaacagagagttgagtgaggattgcctgtatctcaacgtgtggactccctaccctcgacccacatcgccgacaccggtgttggtatggatttacgggggagggttttactctggcgcaagctag

SEQ ID NO: 212988 - DNA, 87 bp, Artificial Sequence
  Description of Artificial Sequence: Synthetic coding sequence
atgcggcctcctcagtgcctgctgcacacaccctccctggcttcccccctactgttgctgctgctgtggctcctcggtggcggttag

SEQ ID NO: 212989 - DNA, 282 bp, Artificial Sequence
  Description of Artificial Sequence: Synthetic coding sequence
atgttgggacttgtcatgagttgccccgaccggacactggtcaccaaggtgcgatctcatcctagcggtaaccagcacagacccacccgcggaggctctcgctcattccattgtaggagaggcgtgcctcgaccggcagccctgagagtcctgccccgatgccccgcattcagcgatgccgcttgcccggctgcgatgcgtccacctcagtgcctcttacacacgcctagcttggcctccccactgcttttgctcctgctttggctattagggggtggctag

SEQ ID NO: 212990 - DNA, 1284 bp, Artificial Sequence
  Description of Artificial Sequence: Synthetic coding sequence
atggctgtcctggcagccttgctgcgatcaggggctcgcagtaggagtccccttctcagaagactggtgcaagagatacggtatgtggagcggagttacgtttcaaaacctacacttaaggaggtagtaatcgtttccgctactaggacaccgattgggtcgtttctgggcagtttatccctgctgccagccacaaaacttggcagcatcgcgatccagggagccatagagaaggctggcattccaaaggaggaagtgaaggaagcctatatgggaaatgtcctacagggtggggagggacaagccccaacccgccaggctgtgctgggcgctgggcttccaatttcaacaccttgtacaaccataaacaaggtatgtgcctctggaatgaaggcaataatgatggcctcacagagtctaatgtgcggccaccaggatgttatggtcgccggaggcatggaatcaatgtccaatgtaccatatgttatgaatcgcggatccactccctacggtggagtaaaacttgaggaccttatcgtgaaggatgggctcactgatgtctacaacaaaattcatatgggatcttgtgccgaaaataccgctaaaaagctcaacattgctcggaatgagcaggacgcttatgccatcaattcctatacaagatcgaaggcagcatgggaggctgggaaattcggcaatgaagtgatcccagtcaccgtgaccgtgaaaggtcagcccgacgtggtcgtgaaggaggatgaggaatataaacgggtcgacttcagtaaggtcccgaaactcaagaccgtcttccagaaggagaatggtacagtgacagctgccaacgcttccaccctgaacgatggcgctgccgcactggttctgatgaccgctgatgctgcgaagcgtttgaacgtaactcccctggccaggattgtggcgttcgccgacgctgctgtagagccaatcgactttccaatcgcaccagtgtatgcagccagcatggtgctgaaagatgtgggtctgaaaaaggaagacattgccatgtgggaagttaatgaggcattctcgctggttgttctggcaaacattaagatgctagaaattgacccccagaaagtaaatataaacggaggagccgtatctttgggccatcccattggaatgtctggggctaggatcgtcggccatcttacacacgcgctgaagcagggtgaatacggcctcgcttctatctgcaacggcggtggtggagcttcagctatgttaattcaaaaactgtag

SEQ ID NO: 212991 - DNA, 1194 bp, Artificial Sequence
  Description of Artificial Sequence: Synthetic coding sequence
atgaatgcagggtctgacccagtggtcatcgtgagcgctgccagaacaatcatcgggtctttcaacggagcgctcgccgctgttccggtccaagatcttgggtctaccgtcattaaagaggtcctaaaaagagctactgttgcccctgaggatgtcagtgaggtgatctttggtcacgtcctcgcagccggatgtggccagaaccccgtgcgtcaggccagcgtcggagctggcatcccttacagcgtcccagcctggtcatgtcaaatgatttgcgggtccggcttgaaagcagtctgtctcgccgttcaaagtatcggtatcggggactcctcgatagtcgtggcaggcggaatggaaaacatgtctaaggcacctcatctggcttatctgcggacgggcgtcaaaatcggggaaatgccgcttaccgattcaatcctttgcgatggcctcacagatgcgtttcacaactgccatatggggattacagccgagaatgtagcaaaaaagtggcaggtgtcaagagaggatcaggacaaagtcgccgtgctttctcaaaaccggaccgaaaatgcgcagaaagcgggtcatttcgataaagagatcgtgccggtgctggtttccactcggaaaggtttgattgaagtcaagactgacgagttccccagacacggttccaacatcgaagcaatgtctaaactaaagccatattttctaaccgatggcaccgggaccgtcactcccgcaaatgcctccggcattaacgatggggctgccgctgtggtcctcatgaagaagagtgaagcggacaaaagggggctcacacccctggcacgaattgtgtcatggtcccaggtgggggtagaacctagtattatgggtattggccctattccagctataaagcaggctgtgacgaaggcagggtggtccctggaagacgtcgacattttcgaaatcaatgaggcctttgcagcggtgtctgctgcaatcgtgaaagaattgggcctcaatcctgagaaagtgaacattgagggtggggcaattgcgctgggccacccactgggcgctagtggttgccgaatccttgtcacgctactccataccctggagaggatggggagaagcaggggcgtcgccgctttatgtattggcggtggtatggggatcgcaatgtgcgtccaaagagagtag

SEQ ID NO: 212992 - DNA, 1281 bp, Artificial Sequence
  Description of Artificial Sequence: Synthetic coding sequence
atgggttctcaccccgtcctgcgaatttggggaaatcgcagagctacagcggcttcactaggcagatctggcggtcgcttgagttcacctaggctgctgagggtggtggcccctaccctcacgttcgcccagacatcccgctgtagcttcaatggggctttggccgctgttccagtacaggacctgggatctactgtcataaaggaggtgctgaaaagggccaccgtggctcctgaggacgtgtcggaggtgatatttggccacgttcttgcagctggatgcggccagaatccagtgagacaggcaagtgtgggcgctgggataccctatagcgttcctgcctggtcttgccagatgatatgcgggtcaggtctgaaggcggtgtgtctggctgtccagtctattgggattggcgactcctccattgtggtggctggtggcatggagaacatgtcaaaggctccccacctcgcgtacttgcgcacaggagtgaagattggggagatgcccctgacagattccatactctgtgacgggctcacagatgcgtttcacaactgtcacatggggataactgccgaaaacgtagccaaaaaatggcaagtttcaagagaagaccaggacaaggttgctgtgttatcccagaacaggaccgagaatgcccagaaagcagggcatttcgataaagaaatcgtgcctgttttggtgtccacgcggaagggactgattgaggtgaaaactgatgaatttcctagacatgggagtaacatcgaagccatgtctaagcttaagccatacttcttgactgacggcaccggaacggtgactcctgctaacgcctcaggaatcaacgacggtgctgccgcagttgtactcatgaagaagagcgaagctgataagcgcggtctgacccccctggccagaattgtgtcctggtcccaggttggcgttgagcctagtatcatgggaatcggtccgatcccagccataaaacaggccgtcaccaaggccggatggtctctggaggatgtggacatttttgagatcaatgaagctttcgctgcggtttccgctgcaatagtgaaagagttgggcctaaacccagagaaagtgaatattgagggaggagccatcgcgcttggccatcctctgggagcctccgggtgtaggattttagtaaccctgcttcacaccctggagagaatgggtcgctccaggggggttgctgccctatgcatcggcggaggtatggggatcgccatgtgcgtccagcgcgaatag

SEQ ID NO: 212993 - DNA, 1275 bp, Artificial Sequence
  Description of Artificial Sequence: Synthetic coding sequence
atgcagagactgcaggtcgtgttgggccacctgcggggacccgcagatagcggttggatgcctcaggccgctccctgtttgagtggggcaccacaggcatcagccgcagatgtagtcgttgtgcatggaagacgcacagccatatgtagggccggacgaggcggattcaaggacaccactcctgacgaactgctgtcagccgtgatgaccgcggtgttgaaggatgtgaacctgcgaccagagcagctaggcgatatatgcgttggaaatgtccttcagccgggtgctggcgctataatggccaggattgctcagtttctgtccgatatacccgaaaccgtgccattgtccacagtgaatcgccagtgcagttctgggctgcaggccgttgcgtcaatcgcgggtggcatccggaatggcagttacgacatagggatggcctgtggcgtagagtcaatgtccctagcggatcgtggcaaccctggcaacattactagtcgtctgatggaaaaggaaaaggccagggattgcctgatccccatgggcattacaagcgaaaatgtcgccgagagatttggtatctcacgcgagaaacaagatacctttgctctcgcctcgcagcagaaagctgcaagagcccagagcaagggttgtttccaggctgaaatagttcccgtgactacaactgtacacgatgataaagggacaaagaggtcaatcaccgtcacacaggacgagggaattaggccctcgacgactatggaaggcctggccaagctaaagccggcatttaaaaaagacggcagtaccactgccggtaattccagccaagtgtcagatggtgccgctgcaattttactcgctcggagatctaaagcagaagagctgggactccctatcctgggtgtgttgagatcttacgccgttgtgggcgttcctcccgacatcatgggaatcgggccagcttacgctattccagtcgctctgcagaaggctggtctgaccgtctcagacgttgacatatttgagatcaatgaggcttttgcctcccaggccgcatactgcgtggagaaattgcggttgcctccagaaaaggtaaaccccctcggtggagctgtcgccctagggcaccccttgggttgcactggggctagacaggtaataaccttgcttaatgaactaaaacgcaggggcaaaagagcatatggggtggtaagcatgtgcattggcacaggcatgggtgctgccgcagtattcgagtaccctggaaattag

SEQ ID NO: 212994 - DNA, 1071 bp, Artificial Sequence
  Description of Artificial Sequence: Synthetic coding sequence
atgaccgccgtcctgaaggacgtaaacctgcggcctgagcagcttggggacatttgtgtgggcaacgtcctgcagcctggcgctggggctatcatggctcgtatcgcccagttcctgtccgatatccctgaaacagtgccgctgagtaccgtgaacagacaatgctcatctggcctccaggcagtagcatcaatcgccggaggtattagaaatgggagctatgatatcgggatggcctgtggtgtcgaaagcatgagcttggccgacaggggtaatcccggtaatattacaagccggttgatggagaaggagaaggcccgtgattgtctgatccctatggggatcacgtccgagaatgtcgcggagcgattcggcatcagtcgagaaaaacaggatacattcgcccttgcaagccaacaaaaagctgcgagggcacagagcaagggatgcttccaggccgaaatagtgccagtgactactaccgtgcacgacgataagggtaccaagagatccatcacagtgacacaggatgaggggatacgaccatccacgacaatggaaggtctggccaaactaaagcccgcatttaaaaaagatggctctaccaccgcgggtaattccagtcaggtgtctgacggcgctgctgcaatccttctggctcgcagaagcaaagcggaggaactagggctcccaatcttaggagtgctgaggagttacgccgttgtgggagtgccacccgacataatgggaataggtccagcctacgccatcccggttgctctgcagaaggccggattgaccgtcagcgacgtggacattttcgaaataaacgaagcctttgccagtcaagcagcatactgtgtggagaagctgcggctgcctcccgagaaggtgaacccactcggtggcgctgtcgccctaggtcacccactcggctgtaccggggctcggcaagtcattaccctgctgaatgagctgaaacgcagggggaaacgtgcctatggggtggtttccatgtgtattgggacgggcatgggcgcagccgctgtgtttgagtatccgggaaattag

SEQ ID NO: 212995 - DNA, 462 bp, Artificial Sequence
  Description of Artificial Sequence: Synthetic coding sequence
atgcagagactgcaggttgtcctcgggcacttgcgaggccctgccgacagtgggtggatgccacaggcagccccttgtttgagcggagctccacaggcctcggccgctgatgttgtggtggtgcacggcaggcggaccgcgatatgcagagccggtaggggaggatttaaggatactactccagatgaactgctctccgccgtgatgacagcggtattgaaggatgtaaaccttagacccgagcagttgggggatatatgcgtggggaacgtgcttcagccaggcgcaggtgccattatggctaggattgcgcagttcctttctgatatccccgaaacagtcccgttatccacagttaatagacagtgcagttccgggctgcaggcagtggccagcattgctgggtggtcaccttgcccttggcttaccgaaggtaccctcgaaatccttctgcgggcatag

SEQ ID NO: 212996 - DNA, 381 bp, Artificial Sequence
  Description of Artificial Sequence: Synthetic coding sequence
atgagcctcgcagacagaggcaaccccggtaatatcacctcccgacttatggaaaaggagaaggctagggactgcctcatcccaatgggcatcacatcagagaatgttgccgaaaggttcggaatttctagagagaagcaggataccttcgcactggccagccagcagaaagccgcacgggctcagtccaaaggctgcttccaagccgagatcgtcccagtaacgacgactgttcacgacgacaagggcacaaaacggtcaatcacagtaactcaggatgaaggaatccgacctagtaccacaatggaggggctagctaagttaaagcccgcatttaagaaagatggcagcacaaccgcgggtgagactgggccaggttag

SEQ ID NO: 212997 - DNA, 996 bp, Artificial Sequence
  Description of Artificial Sequence: Synthetic coding sequence
atgcaacgactgcaagtggtcctcggtcatctgaggggccctgcagacagcggctggatgccccaggcagctccttgcctctcaggcgcaccgcaggccagcgccgctgatgtagtcgtggtgcacggcaggagaactgccatctgtagggccggtagaggaggattcaaggataccaccccggatgaactgctgtctgccgttatgactgccgtgctgaaggatgtaaacctcaggccagagcaattgggtgatatctgtgtgggtaatgtgctgcagcccggagctggtgctatcatggcgcgaatcgctcaatttctctccgacattcccgaaaccgtgcccctgtctacagtgaaccgtcagtgttcatccggccttcaagccgtcgcgagcatcgccggtggtatccgaaacgggagctacgatataggtatggcctgcggcatcacgagcgagaatgtcgctgagcgctttggtataagtcgtgaaaaacaggatacattcgctctcgccagccaacaaaaggccgcaagggcacaatcgaagggatgttttcaggcagagattgtgcccgtcacaaccacagtgcatgacgacaaaggtacaaaacgcagcatcactgttacccaggatgagggtatacggccatcaacaactatggaaggcttagccaaactgaagcccgcattcaaaaaggatggcagcacaaccgcagggcttacagtttccgatgtggacatatttgagattaacgaagctttcgcgagccaagcggcatattgtgtggagaaactccggctccctccagaaaaagtgaaccccttgggtggggctgtcgcattggggcaccctttggggtgcactggcgctagacaggtgataacactgcttaacgagctgaaacgcaggggcaaacgggcatacggggtggttagtatgtgtatcgggacaggaatgggagcagcagccgtcttcgagtaccctgggaactag

SEQ ID NO: 212998 - DNA, 7376 bp, Artificial Sequence
  Description of Artificial Sequence: Synthetic coding sequence
atggttttactcctgtgtttgagctgcctgatcttcagttgccttacattttcttggctcaaaatttggggtaaaatgaccgacagtaaaccgataacgaagagcaaatccgaggccaacctcatacccagccaggagccttttcccgctagtgacaactctggtgagaccccccagcggaacggtgagggacacacgttacctaagacgccgagccaggccgagcctgcatcccacaaaggtccgaaggacgctggtagaaggcgcaactcattgccaccctcacatcagaagcctcctcgcaatcccctgagcagcagtgatgccgctccttctcctgaactgcaggcaaatggaaccggaacacaaggtcttgaagccacagacacaaatggcctaagcagctcagcccgaccccaggggcagcaggcaggcagtccatccaaagaagataagaagcaagcgaacataaagcgacagctcatgacaaatttcatactgggctctttcgacgactatagcagcgatgaggactcagttgctggtagctcccgagagtccacacgaaagggttccagagcttctcttggcgcactttccttggaagcctatctcacaaccggggaggcagagaccagggtcccaactatgagaccatcaatgagcggattacacctcgtgaaacgcggaagggagcataaaaaactagatctgcacagggatttcactgtagccagccccgcagaatttgtgacacggtttggcggagaccgcgttatcgagaaagtcctgatagcgaataatggcatcgctgcagtgaagtgtatgcgcagcattaggagatgggcttacgagatgttccggaacgaaagagccattaggtttgtggtgatggtgacccccgaagatctaaaagcgaacgccgagtacataaagatggcggatcattatgtgcctgtgcccggtggcccaaacaataacaattatgccaacgtcgaattaatcgttgacatcgcgaagaggatccccgttcaggcagtgtgggcgggatggggtcatgcatccgagaatcctaaactccctgagcttctgtgtaagaatggggtcgccttcctgggtcccccaagcgaggccatgtgggcactgggagataaaattgcgtctaccgtcgtggcccagacactgcaggttccgaccctgccctggtctggtagcggacttaccgtggagtggaccgaggacgatctgcagcaggggaaacgcatctccgtgccagaagatgtttatgacaagggatgcgttaaggacgtggacgaagggcttgaggccgctgaacgcatcggttttcccttgatgatcaaggccagcgaaggcggtggcggaaaggggatacgcaaagccgaaagcgccgaggactttccaatactgtttaggcaggtccaatcagaaatcccagggagtcccatatttttaatgaaactggcacaacacgccagacatctggaggttcagatactcgcagaccagtacggaaacgcagtgtcgctcttcggtagagactgttccatccagcgcaggcatcaaaagattgtcgaggaggcccctgctacgatagcgccattggcaatcttcgaattcatggagcagtgcgccatacggctggcaaagacggtgggttacgtctctgctggaaccgtagaatatctgtattcgcaggacggctctttccactttttggagctgaatcctcgcctacaggtcgaacatccatgtactgagatgattgctgacgtaaacctgccggcagcgcagctgcaaatagcgatgggggtgcccctgcacagactgaaagatatccggcttctgtacggcgagtcaccgtggggggtcacacccatcagctttgaaaccccaagtaatccacctctagcacggggacacgttattgccgctcgtatcacctccgagaacccagacgagggcttcaaaccgagctcaggaactgtacaggaactgaactttagaagttccaagaatgtgtgggggtatttttccgtggctgctactggcggtctgcatgagtttgccgacagtcaattcggacattgttttagctggggggaaaatagggaggaggcaatcagtaatatggtggtggccctgaaggaactgtcaatcaggggcgacttccgaactaccgttgaatacctcatcaacctgctggagaccgagagcttccagaataatgacatagacaccggttggctggattacctcattgctgagaaggttcaggcagaaaagcctgatataatgttgggcgttgtgtgtggcgctctcaacgtcgcagacgccatgtttaggacctgcatgaccgattttttacattctcttgaacggggacaggttttaccagccgactccctgctgaacctggtggatgtggagcttatttacggtggagttaagtatatcctgaaggtggcaaggcagtcacttacaatgtttgtcttgatcatgaatggttgccacatcgaaatcgacgcccaccgcctgaatgatggcggactgctcctgtcctacaatggaaattcctataccacctacatgaaggaggaggtggacagttatagaatcaccatcgggaataaaacatgcgttttcgaaaaagaaaatgaccctacagttctgcgttccccatcagcaggaaagctaacccagtacactgtcgaggatggagggcacgttgaagccggatcttcctatgcggagatggaggttatgaaaatgatcatgactctgaatgttcaggagcgcggaagggtgaagtatattaagcgcccaggcgcagtgctagaagccggatgtgttgtggccagactcgagttggacgatccctccaaggtgcaccctgccgaaccatttaccggcgaattgcccgctcaacagaccttaccgattcttggcgaaaagttgcatcaggtgtttcacagtgtactggaaaacctaacgaatgtgatgtccggcttttgcctgcccgagccagtctttagtattaaactgaaagagtgggttcagaaacttatgatgactctccggcatcctagccttccactgctggaactgcaggaaatcatgacgtcagttgccggaaggatacctgccccagtggaaaaatctgtgaggagggtgatggctcagtacgcctctaatattacttcagtgctgtgccagttcccgagccagcagattgctactatcctcgactgccatgctgcgactttgcaacgtaaagccgacagggaggtcttctttatcaatacccagagtattgtccaactcgtgcagcggtaccgatcagggattagaggttatatgaagacggtcgttcttgacctgctgagaaggtatctgcgagtggagcaccattttcaacaggcccactacgacaagtgtgtgattaacctgagagaacaattcaagccagacatgtcacaggtgctggactgtatcttctcacacgcccaagtcgccaaaaaaaaccagcttgtgattatgttgattgacgagttatgcggacccgatcccagtctgtccgacgagctcatctctatactgaacgagctgacacagctttctaagtccgagcactgtaaggtggctctccgggcacgtcagatcctcatcgcatcacacctgccttcttacgaactaagacataaccaggtggagtcaatcttcttatccgctatcgacatgtacgggcatcagttttgccccgaaaatctgaagaagttgatcctatcagagaccacaatttttgacgtcctgccaacttttttttaccatgcaaataaggtggtatgcatggcttctctggaagtgtatgtgcgcagggggtacatagcctacgagctaaactccctgcagcaccggcagcttcccgacggtacctgtgtggtggagttccagtttatgctaccttcatctcatcctaatcgcatgactgttccaataagtattactaacccagatctcctccgacactcaactgaattgtttatggatagtggctttagccctctgtgccagcgcatgggtgccatggtcgcctttcgacgcttcgaagactttacacggaactttgacgaagttatttcatgttttgccaatgttcctaaagatactcctttgtttagcgaggcgagaacttctttatacagcgaagacgactgtaaatcactcagggaggagcctatccacattttgaacgtgagcatccagtgcgcggaccacctcgaggacgaagccctggtgcctattctgcgcactttcgtgcaaagcaagaagaatattcttgtggattatggactgagacggatcacctttctgatcgcccaggagaaggaattccctaaattcttcacattccgcgctagggatgagtttgcagaggacaggatctatcgacatttggaacccgctctggcctttcagctcgaattgaacagaatgcgtaatttcgacctgaccgcggtgccttgcgcaaatcacaaaatgcacttatatctgggcgcagcaaaggtgaaggaaggggtggaagtcactgaccatcgtttttttatccgcgcaatcatcaggcatagcgacttgatcacgaaggaagccagctttgaatatttgcaaaacgaaggcgagcgtctccttctcgaggcaatggatgaactggaagtggcatttaacaatacttcggtccgaaccgactgcaatcacattttcttaaactttgtgcccaccgtgattatggatccctttaagattgaggagagtgtacggtatatggtgatgcgatacggttctaggctgtggaagctgagagtactgcaagcggaagtgaagattaacatccggcagacaacaactgggagcgccgtgcctatccgccttttcatcactaatgagagtggatactatctggatatatcactgtacaaagaggtgaccgactcccggagtggcaatatcatgttccactcctttggaaacaaacaggggccacagcacgggatgctgatcaacaccccctacgtcactaaggatctcctccaagcaaagaggtttcaggcacagacattgggaactacctatatctatgactttcctgaaatgttccgtcaagccctgtttaaactgtggggctctccagataagtacccaaaagatattctcacctacacggagttagtactggacagccaaggccaactagtagaaatgaatcgtctccctggcggaaacgaagtaggtatggttgcctttaagatgagatttaaaacacaagagtatccggaagggagggacgtgattgtcattggcaacgatatcaccttcaggattgggtcctttgggcctggggaggatctactctacttaagagcctcagaaatggccagggccgaggggatccctaagatttatgtagccgcaaacagtggtgctagaatagggatggctgaggagattaaacatatgtttcacgtggcatgggtcgaccccgaggacccacataaaggttttaagtacctgtacctgacaccccaggattatactaggatttcctcactcaacagtgtccactgcaagcacattgaagaaggcggtgagtcgcggtatatgattactgatatcatcggcaaggacgacgggcttggggtagaaaaccttcgtggcagtggtatgatcgccggagaaagttcgctggcctacgaagagattgtgacgatctctttggttacatgtagagctataggcattggagcttacctggtgaggctgggacagcgcgttatccaggtcgagaatagccacattattctgactggggcttcagccctgaacaaagtgctcggccgtgaagtctatacatccaacaatcaactagggggagtgcagattatgcactacaacggggtgagccacattactgtgcccgacgactttgagggcgtgtacacaatcctggaatggttgtcatacatgccgaaggataatcattctcctgtccctattattactccaacggatccaatcgaccgagagattgagttcctgccctctcgggcaccctatgatccgaggtggatgctggccggacgacctcatcccaccctgaaggggacctggcagagtggcttctttgatcacggctctttcaaagagatcatggccccatgggcccaaactgtggtcacaggcagggctcggctgggcggtatccctgtaggcgtgattgccgtggaaacgcgtactgtggaagtcgctgtccccgcagacccagctaatcttgattctgaagccaagattatccagcaggctgggcaggtatggtttcctgactcagcatataagacggcccaggccgtgaaggacttcaaccgagagaaacttccactcatgatctttgctaattggagagggttcagcgggggaatgaaagacatgtatgatcaggtcttaaagtttggggcttatatagtcgacggtctcagacagtacaagcagcccatcctgatatacattccgccttacgccgaattacgcggtgggtcctgggtggtgatcgacgcaaccatcaacccactttgcattgaaatgtacgccgataaggaaagccggggaggggtgttggagcccgaaggaacagtggagatcaaatttcgaaagaaggacctgataaagagtatgcgtcgcatcgatcctgcctataagaagctgatggaacagttgggcgaacctgacctatccgataaggacaggaaagatctggaagggaggcttaaagctcgggaggatttgctgctcccaatctaccatcaggtggctgtccagttcgcggatttccacgacactcccggacgcatgctggagaagggcgtgattagcgacattcttgagtggaaaacagcccgtacttttctctactggcgcttacgacgcctactgttggaagatcaagtgaaacaggaaatactccaggcgagtggggaacttagccacgtacatattcagtccatgctgaggcgttggtttgtggagaccgaaggcgcagtgaaagcatatttgtgggacaacaaccaggtcgtggtgcagtggttggaacaacattggcaggcaggcgatggccctcgtagcacaattcgcgagaacatcacatatttgaagcatgattctgttttaaaaactatccgcggtcttgtagaggaaaatcctgaagttgcagtcgactgcgttatatatttatcccagcatatttcccctgccgaaagggcccaggtggtgcaccttctcagtacaatggacagtcctgcatcgacata

SEQ ID NO: 212999 - DNA, 7376 bp, Artificial Sequence
  Description of Artificial Sequence: Synthetic coding sequence
atggtcttgctcctgtgcctgtcatgtctcatatttagctgcctcaccttcagctggctgaagatctgggggaaaatgactgactccaagcccatcactaagtcaaagtctgaggccaatttgattccgtcccaggagccatttcctgcgagcgacaattccggggaaactccccagagaaatggggaggggcacacgttacctaaaaccccctctcaggcggaacccgctagtcacaagggccctaaggacgccggaagacgacgcaattccctcccacccagtcatcagaagccaccacggaaccctctgagctcttctgacgccgctcctagcccggaacttcaggcaaacggtaccgggactcaggggttggaggccaccgacactaacggcctttcctcctctgctcgtccccagggacagcaagcagggtcccccagcaaagaggacaaaaagcaggccaatatcaaacgccagttgatgaccaattttattctgggcagctttgacgattatagctcagacgaggattccgtggccggatcctctcgagagtcaacgcgaaaggggagtcgcgcaagcctaggggcactgtccttagaggcatacttaaccaccggagaggctgaaaccagagtaccaaccatgcggccatccatgagtgggcttcatctcgtcaagaggggtcgggagcataagaagttagatctccaccgagacttcaccgtggcaagtcccgctgagtttgttaccagatttggcggtgaccgagtaattgagaaggttcttattgcaaataatggcatcgcagccgtgaaatgcatgagaagtataagaaggtgggcatacgagatgtttaggaacgagagggctataagattcgtcgtcatggtgacgcctgaggaccttaaggcaaacgcagaatatattaagatggccgaccactacgtcccggtgccagggggtcctaacaacaacaattacgccaacgtggagctcattgtcgatattgcgaaacgtatccctgtccaagctgtttgggccggatggggccatgcctctgagaaccccaagttgcccgagctcctgtgcaagaacggggtggcgtttttggggccaccctccgaagctatgtgggccctgggtgataaaatcgcttctaccgttgtggcacaaactctgcaagttcctacactcccatggtccggatctggcttgactgttgagtggactgaagatgacctgcagcaaggcaagcgtatctccgtacccgaagacgtttacgacaaaggctgtgtaaaagatgtggacgaaggactcgaggccgctgagcggataggtttcccactaatgatcaaggcatctgaggggggtggtggcaagggaattcggaaagctgaaagcgccgaggattttcctattctgtttaggcaagtgcagtcggaaatccctggtagcccaatttttctgatgaagttagcacaacacgcccgacatctggaggtgcagatactcgcagaccagtatggaaacgcggtgagtctgttcggacgagactgctcgattcagaggcgccatcagaaaatcgtggaggaagcaccagctacaatagcccctttagccatcttcgaatttatggagcagtgtgctatccgtctcgccaaaaccgtgggttacgtctctgcgggtactgtggaatatctgtactcccaggatgggtcttttcatttcctggaactaaacccccgacttcaagtggaacacccgtgtactgaaatgattgcagacgttaatctgccggctgcccaactccaaatagcaatgggagttcctctgcatcgactgaaggatataagactcctctacggcgaatcaccatggggggtgacccccatcagcttcgagacgcccagcaacccccctctggcaagggggcacgtgatcgcagcccgaattacctccgagaatcccgacgaaggcttcaagccatctagcggcaccgtgcaggaattgaattttaggtcgtctaagaatgtctggggatacttttcagtggctgccacgggaggccttcacgagttcgcagacagccagtttgggcattgctttagttggggggaaaaccgggaagaggccatatcaaatatggtagtggccctgaaggagctgtctatccgcggagacttccgcacaactgtggaatacttgatcaacctcctcgagactgagtccttccagaataatgacattgacacagggtggcttgactacttaatagccgaaaaagtgcaggccgagaagcctgacatcatgctaggcgtcgtctgcggggcactaaacgtggccgacgctatgttcaggacatgtatgactgatttccttcacagcttagagcgcggacaagtcctgcccgcagacagccttctcaacctggtggatgtcgagttgatttacggaggcgttaagtatattctcaaggtggccaggcagagcctgacaatgttcgtgctgattatgaacggatgtcacatcgagatcgatgcacaccgactgaatgacggagggctcttactgtcatacaacggcaactcctacactacttatatgaaagaggaagttgatagctacagaatcactatcggtaacaagacatgcgtgttcgagaaagaaaacgatcccacggttctgagatcaccttctgctgggaagctgacacagtatactgtcgaggatggcggacatgtcgaagcaggatcctcctatgctgaaatggaggttatgaagatgataatgacactgaacgtgcaggagagagggagggtgaagtacataaagaggcctggggctgtgttggaggcgggttgtgtcgttgccaggctcgagctggacgatccatcaaaggttcatcctgctgaacctttcacaggggagttgcccgctcaacagaccttgccaattctcggcgagaagctgcatcaagtgttccatagtgtgctggagaacctcaccaacgtgatgtccggcttctgtctccctgaaccagtattcagtattaagttgaaggagtgggttcaaaagttaatgatgacactaaggcatccctccctgcccctgctggaactccaggagatcatgacatccgtggctggtaggatacccgcaccagtggaaaaaagcgtgagacgggtgatggcgcagtacgcgagcaatatcacttcggtcttgtgtcagttccctagccagcagattgcaactattctggactgccacgccgctacgttgcagaggaaggctgatagagaagtcttcttcatcaatacccagtccatcgtgcagttagtgcagcggtaccgctcaggaatccgaggttacatgaaaaccgtggtgctggaccttctccgcagatatctgcgggtggagcatcatttccagcaggcccattatgataagtgtgtgattaatctgagagaacagtttaaacctgatatgagtcaagttctcgattgcatattcagccacgcacaggtcgctaaaaagaaccagctggttatcatgctgatcgacgaactgtgcgggccagatccatcgctcagtgatgagttaatctctatcctcaatgaattgacgcagctgagtaaatctgagcattgtaaggtcgccttaagggcacgacagatcttgatcgcatctcacctgccctcctacgagctacgccacaatcaggttgagtccattttcctctccgccattgacatgtatggacaccaattttgcccagagaatctgaaaaaactgattctgagtgaaaccaccatctttgatgttctccccacctttttctaccatgccaataaggtggtgtgcatggcaagcctcgaagtctacgtgaggcggggatacatagcctacgagctcaattctcttcaacatcggcagttgcccgatggcacgtgcgtggtcgagtttcagtttatgctgccttcttcccatcccaatcgaatgacggtgccaataagcattaccaacccagatctgctcaggcatagcactgagctgtttatggatagtggtttcagtccactctgccaaaggatgggcgcaatggtggcatttagacgctttgaggacttcacacgcaacttcgacgaggtaattagctgcttcgccaacgtaccaaaggatactcccctattttctgaggccaggacttccctgtattccgaggacgactgcaagagcttgagagaggagccaatccacattttgaatgtgtcgatccagtgtgccgatcatctcgaggacgaggccttggtgcccatcctgagaacctttgtccagagcaaaaagaacattctggttgactatggacttcgcagaattaccttcctgattgcccaagagaaagaatttccaaaattttttaccttcagagccagggatgagttcgcggaagacaggatatatagacatctggagccagccctcgccttccagctcgaattgaaccgcatgagaaatttcgacctgactgcagtaccctgcgcgaaccataagatgcacctttacctgggagcagccaaggttaaggagggcgtggaggtgactgatcaccggttttttatcagagcgataatccgacattctgacctgatcaccaaagaggctagcttcgaatacctgcaaaatgagggggaacgcctgctacttgaggccatggacgaactcgaggtcgcctttaacaataccagcgtgaggaccgactgcaaccacatattcctgaacttcgtccctacagtcattatggatccctttaagatcgaagagtctgttagatatatggttatgcggtatggttctcgactttggaagcttcgggtgctacaagcagaggttaagattaatatcagacaaactaccacaggttccgcagtgccaatccgtctgtttattacaaacgagtcaggctattacctagacatctcgctctataaagaggtcaccgattcacggtctggcaacattatgtttcactcctttggaaacaaacaaggcccacagcatggcatgctcatcaatactccttatgtgacaaaggatttacttcaagctaagcggtttcaagcccagacactgggcaccacctacatctatgattttccagagatgtttaggcaagcattgttcaaactgtggggcagccccgataaatatccaaaggacatactgacatacactgaactggtgctagatagccaaggtcaattagtggagatgaaccgtctgccgggaggcaacgaggtggggatggtcgcttttaagatgaggttcaagacacaggaatacccagaaggcagggatgttatagtgatcgggaatgatatcacatttcgcatcgggagttttggccctggcgaggacttactctacttgagagcaagtgagatggcacgcgctgagggcataccgaaaatctatgtggccgctaactccggtgcacgtatcggaatggcagaggagatcaagcacatgttccatgtggcttgggtcgaccctgaggatccacacaaagggtttaagtatctgtacctcactcctcaggactacactaggatcagcagcctgaatagcgtccactgcaagcacatcgaagagggaggggaatcacgatacatgatcacagacattatcggaaaagatgatggtttaggcgtggaaaacctaaggggttccggaatgattgctggcgagagtagcctggcctacgaagagattgtcaccatctctctggtcacgtgtcgggctatcggcattggcgcatacctcgtgcgcctcggccagcgtgtgattcaggtcgagaactcgcatattattctcactggtgcctctgccctaaacaaggtcctgggccgagaggtgtacacctccaataaccaattagggggagtgcagataatgcattacaatggcgtgagtcatattacagttccagacgatttcgagggcgtttacacaatcctcgaatggctgagctacatgccgaaggataatcactcccctgtcccaatcattacgccgacagacccaatagatcgggagattgagtttttgcccagccgtgctccctacgatccacgatggatgctggccggtaggccacatcccacgttgaaaggcacttggcagagcggcttttttgatcacgggagctttaaggagataatggccccatgggctcagactgttgtcacaggcagggccaggctcggcggtattcccgtgggtgtcattgccgtggagacacggactgtggaggtggcagtacctgccgatccagcaaatctggatagcgaagctaaaatcatccagcaggccggacaggtctggttccctgacagcgcatacaagactgctcaggccgttaaggatttcaaccgtgagaaactgccgctgatgatatttgctaactggcgaggattctctggcggaatgaaggatatgtatgaccaagttctgaagtttggagcatacatcgtggacggactgcggcagtataaacagcctatccttatatacatcccaccgtacgctgagttgagaggcggatcctgggtggtgatcgatgctactatcaatcccttgtgcatcgagatgtatgcagacaaagagtccagggggggagttctcgagcctgaaggcactgttgaaatcaaatttaggaaaaaagatctcatcaaaagtatgcggaggattgatccagcttataagaaattgatggagcagctcggggaacccgacttgagtgataaggaccgcaaagacctggagggaagactcaaagcacgggaggacctgcttttacccatctaccaccaagtagccgtccagtttgccgactttcacgacaccccaggacgaatgcttgagaagggtgttatctcagatatcctggagtggaagacagcacgcactttcctgtactggaggctgaggcggctacttctcgaggaccaggtcaaacaggagatcttgcaggcatcaggggagctgtcacacgtgcatattcagtccatgctgaggcggtggttcgtggagacagaaggcgcagtcaaagcctatctgtgggacaataatcaggtggtggtacagtggttggagcaacactggcaagccggtgacgggccacgaagtacaatcagggaaaatattacctatctcaaacacgatagtgtattgaagaccatacggggtcttgtcgaggaaaaccccgaagtcgccgtggactgcgtgatctacctgtcgcagcacatatcccccgcagaaagggctcaggtggtccatctgctgtctactatggacagcccggcatcaacata

SEQ ID NO: 213000 - DNA, 7166 bp, Artificial Sequence
  Description of Artificial Sequence: Synthetic coding sequence
atggtgctgctactgtgcctaagttgtcttattttctcatgcttgaccttttcatggctcaagatatggggcaaaatgaccgatagtaagcccatcaccaagtctaaaagcgaggccaatctgatcccatctcaggagccgtttcctgctagtgacaacagcggggagactcctcagcgcaatggggaaggacacacattaccgaaaacccctagccaagcagagcctgcctcacataaggggcctaaagacgccggaagacggagaaactccctcccaccaagtcatcagaaaccaccaaggaaccctctgtcatcctcagatgctgctccctccccggaacttcaagccaatgggactgggacacagggcctggaagccacagataccaacggactgtcctccagtgcaagacctcaggggcaacaggccggttcaccaagcaaagaggataaaaagcaggccaacattaagaggcagctgatgactaacttcatcttgggctcctttgacgattactcaagtgatgaggacagcgtcgccggatcgagcagggagtcaaccagaaagggttctagggccagtttaggcgctttgtctctggaggcctatctcaccaccggcgaggcagaaacccgggtgcctacaatgcggccaagcatgagcgggctgcacctcgtcaagcgaggtagggaacacaagaaattggacttacatagagacttcacggtggcttccccagctgaatttgttacacggtttggtggcgaccgcgtcatagagaaggttctgatcgctaacaatggcatagcggcagtcaaatgcatgcgaagcatcaggaggtgggcatacgaaatgttccggaatgagagggccataagatttgtggttatggtgacacctgaggatctgaaggccaatgcagagtatattaagatggccgatcactacgtgccagtgcctggcggaccgaacaacaacaattacgccaacgtggaactcatagtggatattgctaaacggatcccagtgcaggccgtgtgggccggatggggccacgcctctgaaaaccccaagctgcctgaactgctctgcaaaaatggcgtggcattcctgggcccaccatcagaggccatgtgggcacttggcgataaaatcgcatctacggtggttgcccagacattgcaggtaccgacattgccctggtcaggcagtggcctgaccgtcgaatggacagaagacgatctgcagcaggggaagaggatttccgtccctgaggatgtgtacgataaaggatgcgtgaaggacgtggacgaaggtctcgaggccgctgagcgtatcgggtttcctttaatgatcaaggcatcggagggaggaggtggtaaaggaatcaggaaggccgagtccgcagaagatttcccaatcttgttccgtcaggtccagtctgagatccctggaagtcccattttcctgatgaaattagcccagcatgcgagacatctggaagtgcagatcttggcggaccaatacggcaacgccgtctcactcttcggccgagactgctctattcaaagaagacaccagaagattgttgaggaagcacccgctacaatcgctccccttgcaattttcgagttcatggagcagtgtgctattagacttgccaagaccgtcggctatgtttccgcgggaaccgtggagtacctctactcgcaggatgggagcttccactttctcgaattgaatcctagattgcaggtcgagcatccgtgcaccgaaatgatcgcagacgtgaacctgcccgcagcccagctgcagatagcaatgggcgttcccctgcatagactcaaggatatacggctgctgtatggcgaaagtccgtggggggtgacaccgattagtttcgagacaccaagtaatcccccactggcgaggggtcacgtgatcgccgcacggatcaccagcgaaaaccctgatgaggggtttaagccatctagtgggaccgtgcaggagttgaacttccggtctagcaagaatgtttgggggtatttcagtgtagcagccaccggaggtctgcacgagttcgcagattcgcagttcggccattgcttcagttggggagagaatcgtgaggaagctatcagcaacatggtcgtcgctcttaaagagctgtccattaggggagatttcaggacaacagtggaatacctgatcaacctgcttgagacagagtcatttcagaataacgatattgacaccgggtggcttgactatttgattgcagaaaaggtgcaggctgagaagcccgatatcatgctgggcgttgtatgtggggcacttaatgttgccgacgcaatgttcagaacatgtatgacggactttttgcacagcctggagagggggcaggtgcttcccgctgacagtctgcttaacctggtcgacgttgaacttatatatggcggtgtcaaatatattctgaaggtagccagacagtcattgactatgttcgtcctgatcatgaacgggtgccacatcgaaattgacgcccacagactcaacgatggagggcttctgttgtcttacaatggtaattcatacacaacctacatgaaagaggaggtggattcttaccggatcaccatcggcaataaaacgtgcgtttttgagaaggagaacgatcccacagtgctgagatccccttctgcaggtaaacttacccagtatacagtagaagacggcggtcacgtcgaggcgggatcctcctatgccgaaatggaagttatgaaaatgattatgacactcaatgtgcaggagcgtggaagggtgaagtatattaaaagaccaggcgctgtgttggaagcaggatgcgttgttgccagactggagctggacgacccttcaaaggttcatcccgcagagcctttcacaggcgagctgcctgctcagcagacactgcctatcctcggtgaaaaactgcaccaggtcttccacagtgttctggaaaacttgacaaatgtgatgtccggtttttgcctgccggagccagtgttttccattaaactcaaggagtgggttcagaaactgatgatgaccttgcggcacccttcgcttcctctgctggagctgcaggaaatcatgacaagtgtggctggcagaattccagccccagttgaaaaatcagtcaggcgagtgatggcacagtatgccagcaacatcactagcgtgctgtgccagtttcctagtcaacagatcgcgacaattttggactgccacgccgctactctgcaacggaaggccgaccgagaggtgttttttataaacacgcagtctattgtccagcttgtccagagtaaagacgaattgtgtggcccagacccttcactcagcgacgaacttattagtattttaaatgaattgactcagctttccaagtccgagcactgcaaggtggcactccgagctagacaaatcctgattgctagccacttaccatcctacgaacttcgccataatcaagtagaatcgattttcctctctgccattgatatgtatgggcaccagttctgccccgagaacctaaagaaacttattctgtctgaaacgacaatcttcgacgtgctcccaactttcttttaccacgctaacaaggtggtgtgtatggcatctctcgaagtgtatgtccgtagaggatacatcgcttacgagctcaacagtctccaacatcgccagctgcccgacggaacgtgtgtcgtcgaattccagtttatgctacctagctctcacccaaacagaatgactgttcctatatctatcactaaccctgacctactgcggcactcaacagagctatttatggactcgggcttctccccactctgccagcggatgggggcaatggtggcatttcgccgatttgaggatttcacacgaaatttcgacgaggtgatcagctgctttgcgaacgtcccgaaagataccccccttttttcagaagccaggacatcactctacagcgaagacgactgcaagagcctgagagaagagccgattcatatcttaaacgtgagcattcaatgcgcggatcatctcgaggacgaggccctggtccccatcctgcgaacgtttgtgcagagcaagaaaaacattctggttgactatgggttgaggagaatcacattcctcatcgcacaggagaaggaatttccaaaattcttcactttccgggctagggacgaattcgccgaggacagaatttatcggcatctggaacccgctcttgcgttccagctggagctgaacaggatgcgcaacttcgacctcaccgctgtcccatgcgccaatcacaaaatgcacctttacctgggagcagcaaaagtgaaagagggcgtggaggttaccgatcatcgattcttcattagagccattattaggcatagcgacttaattactaaggaagcgtctttcgaataccttcagaacgagggtgagcgcctccttcttgaagccatggacgagcttgaagtggccttcaataataccagtgtgagaaccgactgcaatcatatctttctcaattttgtccccactgtcattatggaccctttcaaaatcgaggagagtgtacgttacatggtcatgagatatggttcgcggctgtggaaacttcgggtgctacaggctgaggttaagatcaatataagacaaacaaccacaggatcggcggtaccaattcgcttattcattactaacgagagcgggtactatctggatatctcactctacaaggaggtgacagactcacgcagcggtaacataatgttccactctttcggaaacaaacaggggccacagcatggaatgctaataaataccccgtatgttacaaaggacttgttacaagcaaagagattccaggcacagactctcggaacaacatacatttacgatttccctgagatgttccggcaggctttgtttaagctctgggggagtccagacaagtatccaaaggatattcttacatataccgagctggtgctggactcccaaggtcagcttgtggagatgaaccggctccccggaggaaatgaagtagggatggttgcctttaagatgcggttcaagacacaggagtacccagagggaagagacgtcatagtcatcggaaacgacatcacatttcggatcgggtcgtttggacccggagaggaccttttgtatctgagagctagcgaaatggctcgggctgaaggcattcctaaaatatacgtcgctgcaaattcaggcgctagaataggcatggccgaggagattaagcacatgttccatgttgcttgggttgatcctgaagacccacataaaggtttcaaatacctttaccttacacctcaggactacacaagaatttcgtctttaaacagcgtccattgcaagcacatcgaagaaggtggcgagtcacggtatatgatcaccgatatcatcggaaaggatgatggtctgggtgtggagaatttgcgaggctcgggcatgattgccggtgagtcctccctcgcctatgaagagattgtgactatctctctggtgacctgtcgggctatcgggattggggcttatttagttcgactcgggcagcgtgtgatccaggtcgagaactcccacatcatcctgactggtgctagcgcgctgaataaggtcctaggacgcgaggtgtacacctcaaacaaccagctggggggtgtacagattatgcattataacggtgtgtctcacattactgtgcctgatgacttcgaaggcgtgtacactatcctggagtggctatcttatatgccaaaggataatcacagtcccgtgccgatcattacacccactgacccaattgaccgagagattgaattcctaccaagccgcgctccttacgatcccagatggatgctggctggcaggccacaccctaccttgaaaggaacctggcaaagcggattctttgatcacggtagcttcaaagagattatggcgccatgggctcagacagttgtgaccggtagggcccgactcggaggcatccccgtcggagtcattgccgtcgaaactaggacagtggaagtggcagttccggcagaccccgcaaatctggattctgaggcaaaaatcatacagcaagcagggcaggtgtggttccccgacagcgcttacaaaaccgctcaggccgtgaaggactttaacagggaaaagctgcccctgatgatcttcgccaactggcggggttttagcgggggtatgaaagacatgtatgaccaggtactcaaatttggagcctatattgtggatggcctgcggcagtacaaacagcctatcctcatttatatcccgccatacgctgagcttaggggcggatcttgggtggtgatagatgccaccattaaccctctttgcatcgaaatgtatgccgataaagagagtcgcggtggcgtgctggagcccgaagggactgtggagattaaatttaggaaaaaagatcttattaagagcatgcgtcgcattgatcccgcttataagaagttaatggagcagctgggagagcccgatctctctgataaggatagaaaagatcttgagggtcggttgaaagcacgcgaagatctactgctgcctatataccatcaggttgccgtgcagtttgctgatttccacgacacaccgggtcgcatgctcgagaagggggttatctccgacatccttgaatggaaaacagcaagaaccttcctttactggagactccgacgactccttctcgaggaccaggtgaagcaggagatcttgcaggctagcggggagctgagccatgtccatattcaaagtatgttgagacgttggttcgttgagacagagggagcggtaaaagcctacctgtgggacaacaaccaggtggtggttcaatggctggaacagcactggcaagcaggcgatggcccaaggagtactatccgcgagaacataacttacctgaagcacgacagtgttcttaagacaatccgtgggctggtcgaggagaatcctgaggttgcagtagactgtgtcatttacctgtcacagcatatctcccccgcagagagggctcaggtggtccacctgttgtctaccatggacagtcctgcttcaactta

SEQ ID NO: 213001 - DNA, 5069 bp, Artificial Sequence
  Description of Artificial Sequence: Synthetic coding sequence
ctgccctttctcctcaaacctccccaaacactgccttctccggacgctatgttcaggacctgcatgaccgactttctacactcccttgagcgtggacaggtgctgccagccgacagcctgctgaacctcgtcgatgtggaattgatttatggaggcgttaagtatatcctcaaggtggcaagacagagccttacaatgtttgtgctgattatgaacgggtgtcacattgagatagacgcgcaccgactcaacgacggaggcttactgctgagctacaacggcaattcttacacaacgtacatgaaagaagaggtagattcatatcggatcactatcggaaacaagacatgtgtgtttgagaaagagaatgatccaacggtgctgcgatctccttctgctggaaagctcacacagtacaccgtcgaagatggaggtcacgtagaagcgggaagtagctatgcagagatggaggtgatgaagatgatcatgaccctcaacgtgcaagagcgcggacgagtgaaatacattaagaggcccggagcagtgctcgaagcaggatgcgttgtagccagacttgaacttgacgacccatcaaaggtgcaccctgccgaaccattcacaggggagttgccagcccaacagaccctgccaatcctgggggagaagcttcaccaggtctttcacagtgtgctggagaaccttactaacgtcatgagcgggttctgccttccggagccagtattttcgatcaagctgaaggagtgggtccagaagctgatgatgacgctacggcacccttccctgcccttactcgaactccaagagattatgacctcggttgccggtagaattccagcgcctgtggaaaaatccgtacgacgcgtgatggcccaatacgcttccaacatcacatccgtcctatgtcaatttccgtcccagcagattgcaacgattttagactgccatgctgcaacactacagcggaaggctgatcgcgaggttttcttcatcaatactcagtccatagttcagctcgtgcagcgctaccgctcaggcatccggggttatatgaagacggtggtgctcgacctacttcggcgttaccttcgtgtggagcaccacttccagcaggcccactatgacaaatgtgtgataaatctccgcgaacaatttaagcctgatatgtcacaagtcctagactgtattttctcacatgcgcaggtggccaagaagaatcaactggtcatcatgctcatagatgaattgtgtggaccagacccctccctcagcgatgaattaatcagcatcctcaacgagctcacacagctgtcaaaatcggagcactgtaaggtcgcactgagggccaggcagattctcatcgccagccatctcccgagctatgaactgcggcataatcaagtcgaaagcattttcctgtccgctatcgacatgtatggtcatcagttctgcccggagaacctgaagaaactgatcctcagtgaaactacaatctttgacgtgttgcctacgtttttctaccacgctaacaaggtagtctgcatggcctctctggaggtgtacgtgcgcagaggctatatcgcctacgagctaaacagcctccagcatagacagttaccagatgggacatgcgtggtggagttccagtttatgttacctagctcacatccaaatcgcatgaccgtgccaattagcataacgaaccctgacctgctgcgacacagtacggagctattcatggatagcggtttttctccactttgccagagaatgggggctatggtggcctttaggaggtttgaggactttacccgaaacttcgatgaagtcattagttgttttgctaatgtgcctaaagacacccccctgttctcagaggccaggacatccctgtacagcgaggatgactgcaagagtctccgcgaggaaccaattcatattctcaacgtctcaatccagtgtgccgaccacctggaagacgaggcattagtcccaatcctcaggaccttcgttcaaagcaaaaagaacatcctggtggactacggcctgcgaaggattacatttctgatcgcccaggagaaagaattccctaagttctttacctttagggccagagacgagtttgccgaggataggatatatcgccacctcgagcctgcactagcttttcagttggaactgaatagaatgcggaattttgacctgacagccgtgccttgcgccaatcacaaaatgcacctgtatctaggcgctgccaaagttaaagagggcgtcgaggtaacggaccacagattctttattcgggctattataagacactcagatcttatcacaaaagaggcctcgttcgaatacctacagaacgagggagagcggctgctgctggaggccatggacgaactggaagtcgcttttaacaatacttcagtccgaaccgattgtaatcacattttcttaaatttcgtgcccacagttattatggatccgttcaagattgaggagtcggtgcgatacatggtcatgcgttatggtagtcgtttatggaaactgagggttctgcaggcagaagtgaagattaacattcgacagaccaccactggcagcgccgtgccaattagactctttatcaccaacgaatcgggctattaccttgacatttccctctacaaggaagtgactgactctagatctggtaacatcatgttccattcctttgggaacaagcagggccctcagcacgggatgctcatcaatactccttatgttaccaaagatctgctccaggccaagaggttccaggcacagacgttgggaacaacctatatctatgactttccagagatgttccggcaagccctgtttaaactgtggggcagcccagacaagtatccaaaggacatcctgacgtacaccgaattagtgctggattcacagggtcagctggttgagatgaataggcttcctggaggtaatgaggtgggaatggttgcttttaaaatgcggtttaaaacgcaggaataccctgagggcagggacgtgatcgtaattggcaatgacatcacctttagaataggatcctttgggccaggcgaggaccttttatacctccgagcttctgaaatggccagagccgaggggattcctaaaatctatgtggcggcaaactcgggtgcaaggattggtatggctgaggaaatcaagcacatgttccacgtcgcatgggtcgatcccgaggatcctcataagggattcaagtatctttacctcaccccacaagactacacgcgcatcagcagccttaattctgtgcattgcaagcatatcgaggaaggcggtgagagccggtatatgataacagatattataggaaaggacgacggcctaggcgtagaaaatctccgcggttctggcatgatagcaggggagtcgagtctcgcctatgaagagatcgttacaatatcactggtcacttgcagggctattgggatcggggcttacctggtgagacttggccaaagagtgattcaggtggagaactctcacatcatccttaccggtgccagcgccctgaacaaagtgctcggacgagaggtgtacacctccaacaaccagttgggaggggttcaaatcatgcactacaacggcgtcagccacattaccgttccggatgacttcgaaggcgtctacacaattctggagtggctctcatatatgcccaaggacaatcattccccagtccccattatcacccccaccgacccaatcgacagggaaatcgagtttctccccagcagggcgccatatgatccccgatggatgctggcaggcaggcctcaccctaccctgaaaggaacatggcaatcaggattttttgaccacggaagttttaaggaaataatggcaccttgggctcaaaccgtggtgaccggcagagccagattggggggtatcccagttggtgtgatcgctgtcgaaacccgtacggtcgaagtggcggttccagccgatcctgcgaacttagacagtgaagcaaagattatacagcaggctggacaagtttggttccccgatagcgcatacaagaccgctcaggcggttaaagatttcaacagagagaaactgccacttatgatattcgctaattggagaggctttagtggaggaatgaaggatatgtacgaccaggtgttgaagtttggcgcttatatcgtggacgggctgcggcagtataagcagccgatcctgatttacatcccaccctacgcggaacttcgcggtgggtcatgggtggtaattgacgctacgattaacccgttgtgtatcgagatgtatgccgataaggagtcccgtggaggcgtgctggaaccagagggaacagtggagatcaaattccggaaaaaggacttaattaagtcgatgcggaggattgatccagcctacaaaaaactcatggagcagttaggagaacctgaccttagcgacaaagatagaaaagacctggaaggacggctgaaagcacgagaagatcttctgctgccaatctatcatcaggtggctgtccaatttgccgactttcatgacacacccggtagaatgctagagaaaggtgtaatctccgatatactggagtggaagactgcccgaacatttctgtattggcggctcagacgccttttgctcgaggatcaggtgaaacaggaaattctgcaggctagtggcgaactgtcccatgtgcacatccagagcatgctgcggcgatggtttgtggaaacagagggagctgtgaaggcttacctgtgggataataaccaggtcgttgttcagtggctggagcagcactggcaggcaggcgatggtccgagaagcacaattagagagaacattacctatttgaaacacgactccgtactgaagaccatccgaggactcgtggaggagaaccccgaggtcgctgtcgattgtgtcatctacctgtcacaacatatctctccagcagagagagcacaggtggtgcaccttttatcaaccatggattcacctgcctccaccta

SEQ ID NO: 213002 - DNA, 432 bp, Artificial Sequence
  Description of Artificial Sequence: Synthetic coding sequence
atgacggactctaagccgatcaccaaatcaaagtctgaggctaatcttatccctagtcaagaaccctttcctgcatcagacaactccggcgagacaccccagaggaacggcgagggtcacactctcccaaagacgccttcccaggctgaacctgcctcccacaaaggaccaaaagacgccggaagaaggagaaattccttgcctccttcacaccaaaaacccccaaggaacccactttctagttctgacgccgcaccatcaccagagctccaggcaaatgggactggtactcaaggactggaggccactgacaccaacggactctcaagcagcgcacgaccccagggtcagcaggcagggagtccctccaaagaagataaaaaacaggcaaacatcaagcgccaactcatgacaaactttatcctgggctag

SEQ ID NO: 213003 - DNA, 2577 bp, Artificial Sequence
  Description of Artificial Sequence: Synthetic coding sequence
atgacagtgccgatttctatcaccaaccccgatttactgcgccactccaccgagctctttatggattccgggttctcaccattatgccagcgaatgggcgctatggtcgctttccggcgatttgaagacttcacaaggaattttgacgaagtcatttcttgttttgctaatgtcccaaaagacacgcccctgttctccgaggctagaaccagtctctatagtgaggatgattgcaagtccctccgcgaggaacctatccatatcctcaacgtgagcattcagtgcgccgaccatcttgaagatgaggccttggtgccaattttacggaccttcgttcaatcaaagaaaaacatcttggtggattatggacttcggagaattacattcctgattgcgcaggagaaagagtttccgaagtttttcacattccgtgccagagatgagtttgcagaagatcgaatctaccgccaccttgagccagctctagcattccagctcgagttgaatcgtatgcgcaacttcgacctgactgccgtgccctgcgctaaccacaagatgcatctttacctgggcgctgctaaggttaaagaaggtgtggaggtgacagatcacagattctttataagggctatcattcggcactctgacctcatcacaaaggaggcctcatttgagtatttacagaacgaaggtgagagacttcttctggaggctatggatgagttggaggtggcattcaataacacgagtgtcaggacagactgcaaccatatttttctgaattttgtgccaaccgttatcatggatcccttcaaaatagaggaatctgtgagatatatggtgatgaggtacggatcccggttatggaagctcagagtgctgcaagcagaggttaaaattaacatccgccaaacaaccacaggcagtgctgtacctatacggctctttatcaccaacgagtccggttactatctcgacataagcctctacaaagaggtgactgacagcagatccggaaacatcatgtttcattcttttggtaacaaacagggcccacagcatggaatgctgatcaacacaccttacgtgactaaggatcttttacaggctaagcggtttcaggctcagactttgggaactacctatatctacgactttcccgagatgtttagacaagccctattcaaactgtggggatcccccgacaaataccccaaggatatcttaacatataccgaactggtgctggacagtcaggggcagctcgttgagatgaaccggcttccaggcggaaacgaagttggaatggtggcgttcaaaatgaggtttaaaacgcaggagtacccagagggcagagatgttattgtgataggcaacgacattacctttcgtattggctcctttgggccaggcgaggacctgctgtacttgcgtgcgtcggagatggccagggcggaaggtatccccaagatttatgtggccgcaaattccggggctcgaatagggatggctgaggaaattaaacatatgttccacgttgcgtgggtagaccctgaggatcctcataagggtttcaagtatctttacctgaccccccaggactatactcggatcagctcattaaattccgtgcactgtaagcacatcgaagagggaggagaaagccgatacatgataaccgacattatcggtaaagatgatgggctgggcgtggagaaccttcggggaagtggcatgattgccggagaaagttctttagcatatgaagagatcgttacgataagcctggtcacctgccgggcaatagggatcggtgcatatctggttcgtctggggcagcgcgtaatccaagtggaaaattcacatatcattctgactggagcatcagcactgaataaggtgctgggacgggaggtgtacaccagcaacaaccaactcgggggagtgcaaatcatgcactataacggagtaagccatatcaccgttcccgacgatttcgaaggagtctacaccattctggaatggttgtcctacatgccaaaggataaccatagcccagtgcccatcattacccccacagatcccatcgatagagagatcgagttcctccccagtcgcgctccttacgatccgaggtggatgctggctgggagacctcaccccacgctgaagggtacatggcaatctggcttttttgaccatggcagcttcaaggagattatggctccctgggcacagactgtggtcactggacgagcgaggctggggggtattcccgtcggcgtgattgccgtggagacaaggaccgtcgaggttgcggtgcccgcagacccagcaaatttagactctgaggctaagataatacaacaggcgggacaggtgtggtttcccgacagtgcatacaagactgcgcaggctgtcaaagatttcaacagagagaaactccccctgatgatttttgccaattggcgcggttttagcggcggaatgaaaggatgtctcggtacttggagagacgtctcttggtggaagataagggccatgctgcctatgcacatcggcgaagggagcgtgtag

SEQ ID NO: 213004 - DNA, 1038 bp, Artificial Sequence
  Description of Artificial Sequence: Synthetic coding sequence
atgggctcttccgaggaccaggcctacagattactcaatgactatgccaacgggttcatggtgtcacaggttctgtttgctgcgtgtgagctaggcgtttttgatctgctggcagaggccccagggcctctagatgtcgcagcagttgccgcaggcgtgcgggcatccgcacacgggacagaattgctgctggatatctgcgtctcactgaagttactgaaggtggagacgaggggcggaaaggcattctaccgaaacacggagctctcttcagattatttaacaaccgtgtcccctacatcacagtgttctatgctgaagtacatgggtagaacatcctatcgatgctggggccacctcgctgatgccgtgagagaagggcgaaaccaatacctggaaacattcggcgtccccgcagaggagctgttcaccgccatctaccgcagtgaaggcgagcggctgcagtttatgcaggctttacaagaagtgtggagcgttaacggcagatcggtactcactgccttcgacctttccgtgttccctctgatgtgcgaccttggaggcggagcaggggcactggctaaggagtgtatgtccctgtaccccggatgcaagatcacagtatttgatattcccgaagtcgtgtggaccgccaaacaacactttagcttccaggaggaggagcagatcgacttccaggaaggagactttttcaaagaccccttgccagaggctgatctttacatcctggccagggtgctccacgactgggccgatggtaagtgctcacacttgctggagaggatctaccatacctgcaaacctggcggaggcatcctggtcattgaatcactcctggacgaggaccgacgtggccctttgctcactcaactgtactcactcaatatgttagttcagacagaaggtcaggagagaactcctacccattaccacatgctccttagctctgccggattccgggacttccagtttaagaagaccggagctatctacgatgctattctggcgaggaaatag

SEQ ID NO: 213005 - DNA, 897 bp, Artificial Sequence
  Description of Artificial Sequence: Synthetic coding sequence
atgggtagctcagaagatcaggcctaccgcctcttgaacgattacgccaacggatttatggtctcccaggtactgttcgcagcatgcgaactgggggtgtttgatttacttgcagaagcccctggcccactggatgtcgctgctgtagctgcaggggtgcgagcctccgcccatggtacagaattgttactcgacatctgcgtgtctttgaaactcctgaaagttgaaacaagaggaggaaaggccttctaccgcaacaccgaactctctagtgactacttgactacagtctcccctacttcacaatgtagcatgctgaagtacatgggaagaacttcctatcgctgttggggtcatctggccgacgctgtaagagagggacggaatcagtacctggagacctttggcgttcccgcagaagagttgtttaccgcaatctacagaagcgagggggaaaggctccaatttatgcaggccttgcaggaagtgtggagcgtgaatggccgatccgtgctaaccgcctttgacctctcagtgttcccactgatgtgcgatctcggaggcgacttcttcaaagatccgttacctgaggcggacctttacattctcgctagggtcctgcacgactgggccgacggtaaatgcagccatctgctcgagagaatctaccatacctgcaaacccggtggcggaattctggtgatcgagtccctactggacgaggataggcggggacctctgcttactcaactttatagtctgaatatgctggttcagaccgaagggcaagagcgcaccccgacgcactaccacatgctcctcagctcagcaggcttccgcgacttccaattcaagaagacaggtgccatttacgatgccattttggccagaaagtag

SEQ ID NO: 213006 - DNA, 1122 bp, Artificial Sequence
  Description of Artificial Sequence: Synthetic coding sequence
atgggcagctccgaagatcaagcctaccgtctcttaaatgactacgccaacggcttcatggtgtctcaggtgctgtttgccgcatgcgagctcggcgtgtttgacctcttggctgaggctccgggacctcttgatgtggccgcagtcgccgctggtgtccgggctagcgcgcacggtacggagctccttctagacatctgcgtgtccctgaaactgcttaaggtggagacccgtgggggtaaggcattttatcggaacaccgagctaagttccgactacctcactacggtatcacccacctcacagtgctctatgcttaagtacatggggaggaccagctacagatgctggggccacctggccgatgctgtgcgggagggcaggaatcagtatctcgaaacctttggcgtgccagccgaggagttgttcaccgcgatctataggagcgagggagaaagacttcagttcatgcaggcgctccaggaggtgtggtctgttaatggccgttctgttctcaccgcatttgacctcagcgtgttcccgctgatgtgtgacttgggtggaacctggattaaattagaaacaatcattctgtcaaagctgtcccaggggcagaagactaaacatagggtgttttccctgattggaggagctggtgccttagctaaggagtgtatgtcactgtatccgggttgcaagattaccgttttcgatatccctgaggtggtatggaccgcaaagcagcactttagcttccaggaggaagagcagatcgattttcaggagggtgatttctttaaggaccccctgccggaagccgacctatacatcttagccagagtgctgcacgattgggcggacgggaagtgttcgcacctcctggaaagaatttatcacacctgtaagccaggtggagggatcttggtaatagagtccttactagacgaagatcggagaggacctctcctaacgcagttatatagcctcaacatgcttgtgcagacagagggccaggagaggaccccaacacactaccatatgctactgtcatccgccggattcagagatttccagttcaaaaagaccggcgctatctatgacgcaatccttgcgcgaaagtag

SEQ ID NO: 213007 - DNA, 375 bp, Artificial Sequence
  Description of Artificial Sequence: Synthetic coding sequence
gattgcagactgacatccgtatgcttaccctgtgtacctggtgattttttcaaggatccactacccgaagccgacttgtatatccttgcacgcgtgctccatgactgggccgatggcaagtgtagtcatctgctcgaacgaatttatcacacttgtaagcccggaggcggtatattagtgatcgagtccctgctagatgaagatcgaaggggccctctgcttactcagttgtacagcctcaatatgctcgtccagacagagggacaagagcgaacaccgacccattaccacatgctcttatcctccgccggattcagagactttcagttcaagaagactggagccatttatgacgctattcttgcccgtaagtag

SEQ ID NO: 213008 - DNA, 711 bp, Artificial Sequence
  Description of Artificial Sequence: Synthetic coding sequence
atggagagctcagccaagatggagtcgggtggcgcaggacaacagcctcagccccagccacagcagccttttcttcccccagccgcttgcttcttcgctactgccgcagccgctgcagctgctgcagctgccgcagccgctcaaagtgcacagcagcagcagcagcagcagcagcagcaacagcaagctccgcagcttcgaccggctgccgatggccagccgagcggtggtggtcataaatcggcacccaagcaggttaaacgtcagcgatcatcctcccctgagctgatgaggtgtaaaagaagactgaatttctctggcttcggctatagcctgccccagcaacagcctgccgcagtggctagaaggaacgagcgcgagcgaaatcgggtgaagctcgtcaacttgggcttcgctacgcttagggagcacgtaccaaatggcgctgctaataagaagatgtccaaagtggagactctgcgtagcgcggtggagtatatccgagccctgcagcagctcctggacgagcacgatgctgtttcagcggctttccaagctggagtcctgtcgcccaccatatctccaaattactctaatgatctcaacagtatggccggatcaccagtgtcatcgtatagcagtgatgaaggatcttacgacccactgagcccagaggagcaggagctgctcgacttcacaaattggttttag

SEQ ID NO: 213009 - DNA, 582 bp, Artificial Sequence
  Description of Artificial Sequence: Synthetic coding sequence
atggacggtggcactctgccgaggagcgcccctccggcacctcccgttccagtggggtgtgccgctagaagacgacccgcttctcctgaacttcttaggtgctctcggagacgtagacctgccacggccgagacagggggtggggctgctgccgtcgcaagacgcaatgagagagagaggaaccgcgtgaaactggtgaatttggggtttcaggctctacggcagcacgtgccccacggcggagcttccaagaagctcagcaaagtagaaactctgcgaagcgctgtggaatacatcagggcccttcaaagattgctggccgaacacgacgcagtaagaaatgccctggccggtggacttaggccacaggctgtgaggccttccgcccctaggggaccaccgggtactactcctgtggcagcctctccatcccgtgcttccagcagtcctggtcgtggcggatcatctgagccaggatccccacgctcggcgtactcatctgatgacagcggctgtgaaggagcactgagcccagccgagcgagaactgctcgatttcagttcctggctgggcggatattag

SEQ ID NO: 213010 - DNA, 1542 bp, Artificial Sequence
  Description of Artificial Sequence: Synthetic coding sequence
atgtgttctctcgggctgtttccccctccccctccacggggacaggttaccttatacgaacacaacaacgaactcgtgactggctcgtcctacgaaagcccgcctccagactttcggggacagtggatcaatctgccggtactgcagctgaccaaagatccattaaaaactcccggacgacttgatcatggcacacggacagcctttatacaccatcgggagcaggtgtggaaaaggtgcatcaatatctggcgtgacgttggcctattcggcgtgctcaacgagatagctaactctgaggaggaagtgttcgagtgggtaaagaccgccagtggatgggctctggcgttatgtcgctgggcatcctccctacacggctcccttttcccccacttgtcattgcggtccgaggatctgatcgcagagttcgcacaggtgacaaactgcacaattgtcccatctctaaagcaccggcttcagcgcaatgtggcttccctggcctggaaaccactcagcgcaagcgtgctcgcggtcgcctgccagtcatgcatcctcatctggaccctggatccaacgagcctgtcaaccaggccatcttcagggtgcgcccaggttttatcccatcctggccatactccagtcacctcacttgcttgggccccttctggaggcaggcttctttcagccagccctgtcgacgcggctattagagtgtgggacgtaagcactgagacatgcgtcccacttccctggttccggggtggcggagtgacgaacctgctctggtcccccgacgggagcaagatcctggctacgacaccctccgccgtcttcagggtgtgggaggcgcagatgtggacttgtgagcgttggccgacattaagcggtagatgccagactggatgttggagtcctgatggcagtcgcctgctgtttactgtcctgggcgagcccctgatttacagcctgtcatttcctgaaaggtgtggagaagggaaggggtgcgtcggcggagctaaaagcgcgaccatcgtggcagatttgtctgagaccacaatccagaccccagacggagaggaacggctcggaggcgaggcacattcaatggtctgggaccccagcggagaacgactggccgtcttgatgaagggtaaacccagggtgcaggatggaaagccggtgatactgctctttcgaacacggaatagcccagtgttcgagttgctaccttgcgggattattcagggagagcctggcgctcagccccagctgattaccttccacccaagctttaacaagggagccttgctcagcgttggctggtctacagggaggatcgcccatatccctctctattttgtaaatgctcagttccctcgcttcagtcccgtgctgggacgggctcaagagccacctgccggtggcggtggctcgattcatgacctacctctttttaccgagactagtcccaccagcgcaccatgggatcccctgccgggtcctccccctgtgctccctcactctccacacagccacctatag

SEQ ID NO: 213011 - DNA, 1683 bp, Artificial Sequence
  Description of Artificial Sequence: Synthetic coding sequence
atgccccagacccggtcccaagcccaggccactatatcattccctaagcgcaagctgagcagggctctaaataaagccaagaattcctccgacgccaaattagaaccaaccaatgtgcagacggtcacatgctctccaagagtaaaagctcttccattgtctcccagaaagaggcttggtgacgacaatctgtgcaacacgccacacctgccaccttgttcaccgcctaagcagggtaagaaagaaaatggaccaccgcactcacatacattgaagggccgaaggttggtgtttgataaccagctgaccattaaatctccctctaaacgagaattggctaaggttcatcagaataaaatcctctcaagcgttcgaaagtcccaggagattactactaacagcgaacagcgctgtccactgaaaaaagagtcggcctgtgtaagactgtttaaacaggagggaacttgttatcagcaagcaaagttagtgctgaacaccgctgtgcctgatagattgcccgctagggagcgcgagatggacgtaattcgaaatttccttagagaacatatctgtgggaagaaggcaggcagcctgtacctgagcggtgctcccggaactggaaagactgcctgcctttccaggatcctccaagacttgaaaaaagagcttaaggggtttaagactatcatgttgaattgcatgtctctcagaaccgcccaagccgtctttcctgccatcgctcaggagatttgccaggaggaagtaagtagaccggctggcaaagatatgatgcggaagctggaaaagcacatgaccgctgagaaggggccaatgatcgttctcgtgctcgacgagatggaccagctggattccaaaggccaggatgttctctatacactgtttgaatggccctggctgtccaattcacatctcgtgctcattgggatcgccaacactctggatctcaccgatcgcatcctgccacggctgcaggcccgagaaaagtgtaaaccacagctgttgaactttcccccatatacaaggaatcagattgtgacaattttacaagacagattgaaccaggtttctagagaccaggtgttagacaatgcagctgttcagttttgcgccaggaaggtttccgctgtctccggagatgtacgtaaagcgctggatgtgtgccggagagctatcgaaattgtggagtccgatgttaaaagtcagacaatcctcaagccactcagtgaatgcaagtctccgtctgagcccctgattcctaaacgtgtcgggctgatacatatcagccaggttattagcgaagtggatgggaaccgcatgacgctttcccaagaaggagcgcaggatagctttcctctccaacagaaaatcttggtctgttctcttatgctgctgatcagacagctgaagattaaggaggtgacactcggtaaactgtacgaggcttactcaaaggtgtgtcgtaagcagcaggtggctgctgtcgaccagtcagaatgcctaagcctgagcggtctactcgaggctcggggtatcctcggactaaagcgcaataaagaaacacgcttaaccaaagtgttcttcaaaatagaggagaaagaaatcgagcatgcccttaaggataaagcactgatcggaaacatccttgccaccgggctcccctag

SEQ ID NO: 213012 - DNA, 339 bp, Artificial Sequence
  Description of Artificial Sequence: Synthetic coding sequence
atggctgagcaggccacgaaatctgtgctgttcgtctgtctgggcaatatttgcaggagtcccattgccgaggccgtttttaggaaactcgtaactgaccagaacataagtgagaactggcgggtggactccgcagctacctctgggtacgaaatcggaaaccctcccgattatcgcggtcagtcgtgcatgaaacgacacggtattccaatgtcacacgtggccaggcaggtgccttcgctcgaccttaaactctgtgtgctgtgcttttcaggatctctcaccgctgtactctttctcactgggacttgggcaggaccccaaactcaggagttgtag

SEQ ID NO: 213013 - DNA, 477 bp, Artificial Sequence
  Description of Artificial Sequence: Synthetic coding sequence
atggccgagcaggcaaccaaatccgttttattcgtttgtttaggcaatatctgcaggtctcctatcgcagaggccgtgtttcggaagctagtaactgaccagaacatcagcgaaaattggcgcgtcgactccgccgcaacgagtggctacgagatcggaaaccctcctgactaccgcggtcagtcatgcatgaagcgccacggtatccccatgagtcatgttgcccgtcagattacgaaagaggattttgctacgttcgactacattttgtgtatggacgagtccaatctgcgagatctgaacaggaagagcaatcaagtcaagacctgtaaagcaaagatcgaactcctgggtagctacgacccacaaaagcaactgattatcgaggacccatattacggcaatgactcggactttgagactgtgtaccagcaatgtgtaagatgctgccgcgcatttctggaaaaagcacactag

SEQ ID NO: 213014 - DNA, 477 bp, Artificial Sequence
  Description of Artificial Sequence: Synthetic coding sequence
atggcagaacaagctacaaagtcggtgctgttcgtctgtctgggaaatatctgtcgcagccccattgctgaggctgtgttcagaaagctcgtgaccgaccagaacatcagcgaaaactgggtcatcgatagcggcgctgtgagcgactggaacgtcgggagaagccccgaccctcgagctgtcagctgcctaaggaaccacgggattcataccgcccataaggcccgacagattactaaggaggacttcgccaccttcgactatatcttgtgcatggacgaatcgaatttgagagatctaaatcggaagagcaatcaggtaaagacctgtaaggcaaagatcgagctgctaggtagctatgacccccagaagcaactgatcattgaagacccttactatggaaatgatagcgattttgagacggtgtatcagcagtgcgtgcgttgctgtagggccttcctggaaaaggcacattag

SEQ ID NO: 213015 - DNA, 219 bp, Artificial Sequence
  Description of Artificial Sequence: Synthetic coding sequence
atggcggaacaagctactaagagtgttttatttgtttgtcttggaaacatttgtagaagccccatcgccgaggccgtgttcaggaagctggtgactgatcagaacatttcggagaattggcgtgtcgactcagcggctacctctggcggtagcctgactgccgttttgtttcttacagggacctgggctgggccacagaccaaatcttgcgctgcttag

SEQ ID NO: 213016 - DNA, 483 bp, Artificial Sequence
  Description of Artificial Sequence: Synthetic coding sequence
atggcagggaaaaggagtggttggagccgcgctgcgttgctacaactgctcctgggtgttaatctggttgtcatgcccccaacccgagccaggagcctgcgatttgtcactctattgtatcggcatggtgatagatcccctgtaaaaacctacccgaaggacccatatcaggaggaggaatggccccaagggtttggccaactgactaaggaggggatgctgcaacactgggaactgggccaggcgctgcgccagagataccatggatttttgaacacctcgtaccatcgccaggaggtgtacgtccggtcaaccgacttcgataggacgctgatgagcgccgaggcgaatttagccggactgttccctccaaacggaatgcagcggttcaatccaaatatctcctggcaacctatccctgttcataccgtgcctataacagaggaccgggtgcgcgtggctagccccagcctgggatggtag

SEQ ID NO: 213017 - DNA, 1272 bp, Artificial Sequence
  Description of Artificial Sequence: Synthetic coding sequence
atggccggaaagagaagcgggtggtcccgggcagctctgttgcagctactactaggcgttaacttggtagtcatgccacctacaagggccagatctttaagatttgtgactctgttgtatcgacacggcgaccgaagccccgtgaaaacctatcctaaagacccttaccaggaagaagagtggccccagggattcggacaactcacgaaagaaggtatgctgcaacattgggagctggggcaggccctcaggcagcgctaccacggctttctcaatacctcatatcatcgccaagaagtctatgtgcgcagcaccgacttcgatcgcactctcatgagcgccgaggctaatctcgcaggcttgttcccacccaacggcatgcagcgatttaacccaaatatcagttggcaaccaattccagttcatacagtgcctatcaccgaggaccgcctcctgaagttcccactgggcccttgtcccaggtacgagcagctccaaaacgagacccggcagacccccgaataccagaacgagtcatctcgcaacgctcagtttctggatatggtggcaaacgagaccggcctcacagacctgaccttagaaaccgtttggaacgtgtacgataccttgttttgcgagcagacccacggactgcgcctacccccatgggccagtccgcagaccatgcaaaggctatcccgattaaaggacttctcttttcggtttctgtttgggatctatcagcaggccgagaaagctcgactgcagggcggagtcttgttggcccagatcaggaaaaatctcacgctgatggctacaaccagccaactgcccaagctactcgtgtatagcgcccatgatactaccctcgtggctcttcagatggctctggacgtttacaacggggaacaggccccttacgcttcttgccacattttcgaactctatcaggaggattccggaaacttttctgtcgaaatgtactttagaaacgagtccgataaggcgccatggcccctttccttgccaggctgtccccataggtgcccactccaggactttctgcgcctcactgagcctgtcgtgccaaaggattggcagcaggagtgtcaactggcatctggcccagcggataccgaggttatagttgctctcgctgtgtgcgggagtatcttatttctgcttattgttctcctcttgacggtgttgtttcgaatgcaggcacaaccccctggatacagacatgtggcagacggagaagaccatgcctag

SEQ ID NO: 213018 - DNA, 1176 bp, Artificial Sequence
  Description of Artificial Sequence: Synthetic coding sequence
atggccggaaagaggagcgggtggtctcgcgcagcactcctccagctgctcctgggagtgaaccttgtagtcatgccacccacccgcgctcggagtttgagattcgtcacccttgagggaatgctgcagcattgggaactcgggcaggctctacggcagcgctatcacggcttccttaacacttcttatcaccggcaagaagtttacgttcgttccactgatttcgaccgcactctcatgtccgccgaagctaacctcgctggtttgttcccccctaacgggatgcaacggtttaacccgaacattagttggcagcctatacccgtgcatacagtacctatcacggaagaccgcttactcaagtttccgcttggcccatgtcctcggtacgaacaactccagaacgagactaggcagaccccagagtatcaaaacgaatcaagcagaaacgcccagtttcttgacatggtggctaatgaaacaggactgacagatctgactttggagactgtgtggaatgtgtatgacacacttttctgcgaacagacccacggacttcgcttacctccgtgggctagccctcagactatgcagaggctaagccgactgaaagatttttcattccgctttttatttggaatctaccagcaggccgagaaagccagattacaaggaggcgtgctgctggctcaaatccggaaaaatcttacgttgatggccacaacatcccagcttcctaaattgctcgtatacagtgcacatgataccacactggttgctttgcagatggctcttgatgtctacaatggcgagcaggcaccatatgcctcctgtcatatctttgagctttatcaggaagacagcggtaacttctctgtggaaatgtacttccgtaatgagtccgacaaggctccctggccactaagcctacccggttgtccccaccgttgtccgctgcaggacttcctgcgcctgaccgaacccgtagtaccaaaggactggcagcaggaatgccagcttgccagcggacccgcagacacagaggtgatcgtggctctggccgtgtgtggctccatcctctttctccttattgtcttactcctcaccgtgctgttcaggatgcaggcacaaccaccaggttaccgacacgtggcagatggcgaggatcacgcctag

SEQ ID NO: 213019 - DNA, 711 bp, Artificial Sequence
  Description of Artificial Sequence: Synthetic coding sequence
atggtggcaaacgagacgggcctaaccgacctaacattagaaacagtctggaatgtgtacgataccctgttttgcgagcagactcatggccttaggttgcccccatgggcctcaccccagacaatgcagaggctttcaaggctgaaggactttagttttcggttcctgttcggaatctatcagcaggccgagaaagcacgtctgcagggtggcgtgcttctagcacagatacggaagaacctaacacttatggcaactacctctcagctgcctaagctcctggtgtattccgcacatgacacaacactggtagcgcttcaaatggcgttggatgtctacaatggtgagcaggctccttacgcttcatgccacatctttgagttataccaggaagacagcggcaacttctccgtggagatgtacttccgcaatgaatcagacaaagccccttggccattgtcactgccaggatgcccccatagatgtccgctccaggacttcctgcgcttaacagaacccgtggttcccaaggattggcagcaggagtgtcagctcgcttcaggtccagccgatacagaggtcatcgtggcacttgcagtatgtggtagtatcctgttcctgttgattgtcctactcctcactgtgctcttccggatgcaggctcaacctccaggctatagacacgttgctgacggggaggaccacgcctag

SEQ ID NO: 213020 - DNA, 1242 bp, Artificial Sequence
  Description of Artificial Sequence: Synthetic coding sequence
atggctggaaaaagatccggatggtcacgcgcagctctactgcagctcctccttggcgtgaatctcgtcgtcatgccacctactcgggctcggtctctccgcttcgtgacgctgctgtatcgacatggtgatcgttcccctgtgaagacctatccgaaagatccataccaggaagaagagtggccacagggattcggtcagctcacaaaggaaggcatgctgcagaggtatcacggattcctgaacacatcctatcaccgtcaagaagtgtacgtgagatctacagattttgatcgcacactaatgtctgccgaagcaaacctcgcgggattattcccaccaaacggaatgcagaggtttaaccctaacatcagctggcagcccatcccagtgcacacagtccccattaccgaagatcgcttactgaaattcccacttggaccgtgtccaaggtacgagcagctgcagaacgagaccaggcagacccccgaatatcagaacgagagctctagaaacgctcaattcttggatatggttgcaaacgaaaccggacttaccgatctgacgctggagacagtgtggaatgtttatgatacccttttctgcgaacaaactcatggcttgcggcttcccccatgggccagcccacagacaatgcagcgattgtcccgcttaaaagacttttcatttcggttcctcttcggcatttaccagcaggccgagaaagcgagactgcaggggggagtgctgctagcccagattaggaaaaatttgactctcatggcgactacctctcagctgcccaagctcctggtgtattcagctcacgataccactctcgtggcgcttcagatggccttagacgtgtacaatggtgagcaggccccatatgcatcttgccacatctttgaactgtatcaagaggactcagggaacttctcggtcgagatgtattttagaaatgagagcgataaggctccctggccattaagtctgccgggttgccctcaccggtgtccattgcaagatttcttacggcttaccgagcctgtggtgcctaaggactggcagcaggagtgccagttggcttctggcccagctgacactgaagtgattgtggcattggctgtctgtggtagtatattgtttctgctgattgttctcctgcttacggtcctgttcaggatgcaggctcagccacctgggtatcggcatgtggccgacggcgaagaccacgcctag

SEQ ID NO: 213021 - DNA, 978 bp, Artificial Sequence
  Description of Artificial Sequence: Synthetic coding sequence
atggacatgtggacggcattgcttatattacaggccctgctactgccctcgctggctgatggagctaccccagcattgaggttcgtggctgtgggtgactggggcggagttcccaatgcccctttccataccgctagagagatggcaaacgcgaaagaaatcgcgagaactgttcaaatactgggggctgatttcatactgtcgctgggggataacttctattttaccggggtgcaggatatcaacgataaacgctttcaggagacctttgaggatgtcttctctgaccgatctctgcgtaaggtaccctggtacgttttggccggaaaccacgaccacctagggaacgttagcgcacagattgcatattcaaagatcagcaagaggtggaactttccttcaccgttttatcgcttgcattttaagataccacagactaatgtgtcagtggctatatttatgctggatacggtaacactgtgtggtaattcagacgacttcctttcacagcaacctgagcgaccaagggatgttaagctcgctaggacccagctctcctggttgaagaagcagttggctgcagcccgtgaggattacgtgttggttgctggacactaccctgtgtggtcaatcgccgagcacggaccaacgcattgcctggtgaagcagctgcgcccattactggctacctatggggtcaccgcctatctgtgcggccatgaccacaatctgcagtatctgcaggatgagaacggcgtcggatacgtattaagcggggctggcaatttcatggaccctagcaaaagacaccaacgcaaggtccccaacggctaccttcgcttccactacggcacggaggacagcctgggcggtttcgcatacgtggagatcagcagcaaggaaatgactgtgacgtatatcgaggcctcaggtaagtcactgtttaagactagattgccaaggcgggcacggccttag

SEQ ID NO: 213022 - DNA, 1239 bp, Artificial Sequence
  Description of Artificial Sequence: Synthetic coding sequence
atgggcagtccctggaatgggtccgacggtcctgaaggggctagggaacccccttggcctgctctgcccccttgcgatgaacgcaggtgctccccatttccactgggcgctctggtgcctgtcaccgctgtgtgtctgtgtctcttcgttgtcggcgtttccggcaacgttgtgaccgtcatgctgatcggaagatatagggatatgcggactacaacgaatttgtatcttgggagtatggcagtctcagacttgttgatcctgctcgggctgccattcgatctctacaggctctggcggagccggccttgggtgttcgggccactcctttgtaggctgagcctgtacgtgggagaagggtgcacatatgcgactttgttgcacatgaccgcattatccgtcgaacggtacctggccatttgcaggccgttaagggcacgcgtgttggtgacgcgacggagggtcagagccttaattgccgttctgtgggccgtcgccctgttgtctgctggccctttcctttttcttgtgggagtggaacaggaccccggaatttcagttgttcctggccttaatggaacagcaagaatcgcttctagtcccctagcttcctctcccccactatggctctcaagggctcctccacctagcccccctagcggacctgaaacggctgaggcggcagccctgttctcgagagagtgtcggccttcccctgcgcagctgggcgcactgcgagtgatgttatgggtcacaactgcatacttcttcttgcctttcctctgtctgtcaatcctctacggtctgataggtagagagctgtggtcctcacggagaccattaagaggacctgctgcttccggccgtgaaaggggccaccggcagacagtgcgggtccttctggtggtcgtacttgccttcataatttgttggctgccctttcatgttgggagaatcatttatattaacacagaagattcccggatgatgtatttctcacaatacttcaacattgttgcactgcagctgttttatctctcagcatcgattaaccctatactttacaacctcatatctaagaagtacagggccgcagccttcaaactgctactggcacggaagtcccgccctcggggatttcacagaagccgggataccgctggggaggtcgccggagacaccggtggagacaccgttgggtataccgagacctctgctaacgtgaaaactatggggtag

SEQ ID NO: 213023 - DNA, 978 bp, Artificial Sequence
  Description of Artificial Sequence: Synthetic coding sequence
atggacatgtggaccgctcttctcatactccaggcgctactactaccgagcctggctgacggcgcaacccccgctcttaggttcgtcgcggtgggtgactggggcggagtgcctaatgccccatttcacaccgcaagggagatggccaatgccaaggagatcgccaggaccgtgcagatcctgggggcagactttatattatcccttggagacaacttctactttaccggcgttcaggacatcaatgacaagcgctttcaagaaaccttcgaggatgtgttttctgataggtccctcagaaaagtgccgtggtacgtcctcgccggaaatcatgaccatctcggaaatgtgagcgcgcagattgcttactctaaaattagcaaacggtggaacttcccttcccccttctatagactgcactttaagattccccagactaatgtctcagtggccattttcatgttagataccgtgacgctgtgcggcaactcagacgactttctgagccagcagcccgagcgccctagagacgtgaaattggctcggacacagctgtcctggcttaaaaagcaactggcggctgctagggaggactatgtcctcgttgccggtcactatcccgtgtggtccattgccgaacacggaccaacgcactgcttggtgaaacagttacggcctctgctcgccacctacggggtcacagcatatctgtgtgggcacgatcacaacctgcagtatctccaggacgaaaatggagtgggatacgtgctctccggcgctggtaacttcatggacccttctaaacgacatcaacgtaaggttcccaatggatatctgcggttccactatggcactgaagattctctgggcggattcgcctacgttgaaataagctcaaaggagatgacagtaacatacatcgaagccagcgggaagagtctgtttaagacacgactccccagacgcgcacgcccatag

SEQ ID NO: 213024 - DNA, 978 bp, Artificial Sequence
  Description of Artificial Sequence: Synthetic coding sequence
atggacatgtggaccgcattactgatcttacaagctttgttactgccaagtttggccgacggagccaccccagcccttcggtttgtggcagtcggggattgggggggtgtcccaaacgcacccttccacaccgctcgtgagatggccaacgctaaggagattgcccgaaccgtccagattctaggggctgactttattctctcccttggggacaacttctacttcaccggagtgcaggacatcaacgacaagcgatttcaggaaacatttgaggatgtgttttccgataggagcctgcgaaaggtcccatggtatgtgcttgcagggaaccatgaccacttggggaacgtctctgctcaaatcgcctattccaaaatcagcaagaggtggaattttccctcacccttctatcggctccactttaaaatcccccaaacaaatgtcagcgttgctattttcatgctggacacggtaacactctgtgggaatagcgacgactttctcagccagcagcctgagcgaccccgagacgttaaactggcgcgtactcagctgtcctggctaaagaagcagctcgctgcggcaagggaggactacgtgcttgtggccggtcactaccccgtttggtctatcgccgaacacggcccaacgcattgtctggtaaagcagctgcggccattgctggcgacgtacggagtgactgcctacctgtgcggacatgatcacaacctccagtatctgcaagacgagaacggcgtgggttatgttctcagcggggctggcaactttatggatccatcaaagagacaccagcggaaagtgccaaatggctatctcaggttccattatggcacagaagattcgctgggtggtttcgcttatgtggaaatctcatcaaaagaaatgaccgtgacatatatcgaggccagcggtaagagtcttttcaagactcgcctgccacgccgagctcgaccttag

SEQ ID NO: 213025 - DNA, 1161 bp, Artificial Sequence
  Description of Artificial Sequence: Synthetic coding sequence
atgagggccgcaccccttctcctggcaagggcagcctccctgagcctggggtttctgtttctgctgtttttctggctggataggtcggttctggcaaaagagctcaagtttgtgacccttgtgttccgccacggcgaccgtagccctattgacacatttccaactgacccaataaaggaaagctcttggcctcagggcttcggccagctgacacagctggggatggagcaacattacgagctgggagagtatatcaggaagcgttatcgcaaattcctgaatgagagctataaacatgaacaggtctacattcggtctacagacgtcgaccggacactgatgtccgcaatgactaatcttgctgcgttatttccgccagaaggcgtcagcatctggaatcccatcctgttgtggcagcccattcctgtgcataccgtgcctctcagtgaagatcagctactctacctcccctttcgcaactgtccaaggttccaagagctggaaagtgagacgctgaagagcgaagagttccagaagcgcctccacccttacaaggatttcatagcaaccctcgggaaactgagtggcctgcatggccaagacttgttcggcatctggtcaaaggtgtatgaccctctgtactgcgagagtgtacataacttcacacttccaagttgggcaacggaggacacaatgacaaagctcagagaactgtctgagctatctttgttatcactgtacggcatccacaaacaaaaggagaaaagtcggctacaggggggtgtccttgtaaacgagatcctgaatcacatgaagcgtgcgacccagataccttcttacaagaagttgatcatgtactcagctcatgacacaaccgtgagcggtctccagatggcattggacgtgtataacggactgctgccaccatatgcttcatgccacttaacagaattgtactttgagaagggcgagtattttgtcgaaatgtattatcgcaacgaaacccagcacgagccttaccccctcatgctgcctggctgcagccccagttgccctttagaaaggttcgccgagctggtgggtccagtgatcccccaggactggtctactgaatgcatgacaaccaattcacatcaaggaacggaagactctactgattag

SEQ ID NO: 213026 - DNA, 1257 bp, Artificial Sequence
  Description of Artificial Sequence: Synthetic coding sequence
atgcgcgcagcccctttgctccttgcacgagctgcctctttgtctttgggtttcctcttcctcctgtttttttggcttgatagatccgtcctcgccaaagaactaaaattcgtgaccctcgtctttcgccatggagatagatcccctatcgacacattccccaccgatcccattaaagagagctcctggccacagggttttgggcaacttacacagttgggcatggagcaacattacgagttgggcgagtatattcgcaaaagataccgcaaattcctcaatgaaagttacaagcacgaacaagtctacatccggtcaacagatgtcgatagaactctcatgagcgccatgaccaatctagctgcactgtttccccctgaaggcgtgagtatctggaacccaatcctcttatggcagccaattcccgtgcacacagtgcccctcagtgaggaccagctcctctacttgcctttcagaaactgcccacgttttcaggaactggagtccgagactctgaagtcagaggagtttcaaaaacgcttacatccatacaaagactttatcgccactctggggaagttatcgggtctacacggccaggacttgtttggtatttggagcaaggtttacgaccctctttactgcgaatctgtacataatttcacgctgccttcctgggctacggaagacacaatgaccaaactccgtgaattgtccgaactgagtctgttgtccttgtacggtatccacaaacagaaggagaaaagtagacttcaggggggagtgttggttaacgagatcctgaatcacatgaagcgcgctactcaaattccatcttataagaaactgattatgtacagtgcccacgacactactgtctctgggttgcagatggccctcgatgtatataacggactcctccccccatacgctagttgccacctgacagagctgtactttgagaagggtgagtactttgttgagatgtattataggaatgagacacagcacgaaccttaccccctaatgctgccagggtgttccccctcctgcccgctcgagcgatttgcagagttagtgggccctgttatccctcaagattggagcaccgagtgcatgacaaccaatagccaccaggtgcttaaggtaatctttgcggtagcattctgcttaatcagcgctgtgcttatggttctcctgttcattcatatccgcagaggcctgtgctggcagagagagagctacggcaatatctag

SEQ ID NO: 213027 - DNA, 1281 bp, Artificial Sequence
  Description of Artificial Sequence: Synthetic coding sequence
atggctggcctgggtttctggggacatcccgctgggccacttcttctgttattgctcttggtcctgcctccaagggcactgcccgagggccctctggtcttcgtggctctggtgttcagacacggcgacagggctcctctggcgtcctaccccatggacccccataaggaagtggcctctaccttgtggcctaggggtctcggccagcttaccaccgaaggcgtgagacagcagctagagctcgggagatttcttcggtcccgctacgaagcatttttatctccagagtatcgcagagaggaagtctatatccgctcgaccgattttgaccgcacattggaatccgcccaggccaacctcgctggactctttccggaggccgctcccggttctccagaggctcgatggcggccaatccccgtgcacacagtgcccgtcgccgaggacaaactcttgaggtttccgatgcgaagttgcccccgataccatgagctgctgcgcgaggcaacagaagcagccgagtaccaggaggccctcgagggatggactggtttcttgagccggctggaaaattttacggggttatcacttgtaggagagccactcaggagagcctggaaagtactggatacactcatgtgccagcaagcccatgggcttcctctacctgcttgggcatctcctgacgtgctgagaactttagctcagattagcgccttggatataggtgctcacgtaggtccccctagggctgcagaaaaagcacagctaaccggcggaatcctactcaacgcaatcctggctaacttcagccgggtgcagaggcttggtctgcccctcaagatggtgatgtacagcgctcatgactctaccctgctagcgttgcagggggctctcggcctgtatgatggacataccccaccctacgcagcgtgcttgggctttgagtttagaaagcatttgggaaacccggctaaggacgggggaaatgtcaccgtgagcctgttctatagaaatgactcggcacacctgcccttgcccctgtcccttccagggtgtcccgctccttgccccctcggaaggttttatcagctgaccgcgccagcacgaccacctgcccacggcgtgagctgtcacggcccttatgaagctgctattccacccgcacctgttgtgccgctgcttgccggagcagtcgctgtacttgtagctctgtctctggggttgggcctgctggcctggcggccagggtgtttgcgggctctgggcggacccgtgtag

SEQ ID NO: 213028 - DNA, 1002 bp, Artificial Sequence
  Description of Artificial Sequence: Synthetic coding sequence
atggccggacttgggttctggggtcatccagcaggacctttgctgctccttttgctgcttgtgctgccccctcgagctctacccgaagggcctctggtatttgtcgctctggtcttcaggcatggggacagggcaccactggcctcctaccctatggatccacataaagaggttgcgtctaccctttggccacgaggcctggggcagctgaccacagagggtgtaagacagcaactggaactcgggaggttccttcgaagccggtacgagggatttctgtcacggctagagaactttactgggttgagcctggttggcgagcctctgcgcagggcttggaaagttctggataccctcatgtgtcagcaggcacatgggttgccactgcccgcttgggcttccccagacgtgctacggacacttgctcagatttcggctctggacataggggctcacgtcggcccaccacgcgctgcagagaaagcacagttgaccggcggaattctgcttaacgcgatcctagctaacttcagcagagtgcagagactggggttgccactcaagatggtgatgtatagcgcccacgatagtaccctactggcgctccaaggagcacttgggctctacgatgggcacacccccccttatgctgcatgtctggggttcgaattcaggaaacacttgggtaatcccgcaaaggatggcggaaacgttaccgtgagtctcttttacagaaacgacagcgcgcatcttccattaccgttgtcactgccagggtgccccgcaccatgcccccttggaaggttctatcagctcaccgcccctgccagaccccctgcacatggagtctcctgtcacggaccatacgaagctgctattccacccgcacctgtggtacccctgttggccggagctgtggccgtgctggtcgctctgagcctcggcctggggttattggcatggcgcccagggtgcttgagggcactaggagggccagtttag

SEQ ID NO: 213029 - DNA, 633 bp, Artificial Sequence
  Description of Artificial Sequence: Synthetic coding sequence
atggagatgggaagaagaatacatctggaactccggaataggaccccgtcagacgtaaaggaactagtgctcgataattcaaggagcaacgaagggaagcttgaaggccttaccgatgagtttgaagaattggaattcctcagtacaatcaatgtaggcctgacatctatcgcgaatctccccaaactcaacaaactcaagaaactcgagttatcagacaatcgcgtcagtggcggactggaagttcttgctgaaaagtgcccgaacctcacacaccttaacttatccggcaataagataaaagacctctcaacgatcgagccccttaaaaaactcgagaacctcaagtctctggacctgttcaattgcgaggtcactaatttgaacgactaccgggagaatgtgtttaagcttcttcctcagctcacttacctggatgggtacgaccgtgatgataaagaggctcctgattctgatgccgagggctatgtcgagggcctggatgatgaagaggaggacgaggacgaggaggagtacgatgatgaggaaggatataatgacggcgaagtcgacgatgaagaggacaagaaaaaaaaaaagaaaaagaaaaaaaagaagaaaaagaagaagtag

SEQ ID NO: 213030 - DNA, 750 bp, Artificial Sequence
  Description of Artificial Sequence: Synthetic coding sequence
atggagatgggacggagaatccacctggaactacgaaacagaacacctagcgatgtgaaagaactcgtcttggataactctaggagcaacgaaggcaagttggagggactgacagacgaattcgaggagcttgaattcctctctaccattaacgtcggccttactagcatcgcaaatttgccaaaactaaataagctgaagaaattagaattgagcgacaatagagtctcagggggacttgaggtcttggcagagaagtgcccaaatttgacacatctgaatctgtctggaaacaagattaaggatttaagtactattgaacccctgaagaagctcgaaaatctcaagtctctcgacctcttcaactgtgaagttactaacctaaatgactatcgtgagaatgttttcaagctgctgcctcaactgacataccttgatggctatgatcgcgacgacaaagaagcccctgactccgatgccgaggggtacgtagaagggctcgatgacgaggaggaggacgaggacgaagaggagtacgacgaggacgcccaagtggtggaagatgaggaagatgaggatgaagaggaagagggtgaagaggaagatgtctctggcgaagaggaggaggatgaagaaggttataatgatggtgaggtcgacgatgaggaagacgaagaggagttaggagaagaagaacgcggtcagaagaggaaaagagagcccgaagatgagggtgaagacgacgattag

SEQ ID NO: 213031 - DNA, 396 bp, Artificial Sequence
  Description of Artificial Sequence: Synthetic coding sequence
atggagatggggaaatggattcacctggagttacgcaaccgtaccccctcagatgtgaaagagctcttcttagataactcccagtccaatgagggcaaactggaaggattaactgatgagtttgaggaactcgagttgcttaacacaatcaatatcggtttgacaagtatcgccaacctgcctaagctgaacaaactcaaaaagttagagctctcatcaaacagagccagcgtgggcctggaggtcctggcagaaaagtgtcccaatctaatccacctcaacctgtccgggaataagattaaagacctatctaccatcgaacctctgaaaaagctggaaaatctcgagtcactggatttgtttacctgtgaagtgactaatcttaacaactattag

SEQ ID NO: 213032 - DNA, 807 bp, Artificial Sequence
  Description of Artificial Sequence: Synthetic coding sequence
atggagatgaagaagaagatcaatcttgagctacggaatcgctcaccggaggaagtcaccgagctggtgctcgataattgcctctgcgtgaacggagaaattgaagggttgaatgatacatttaaggaattagaatttctcagtatggcaaacgtggaactgtccagcctggcgaggctccccagtctgaacaaattgaggaagctggagctctcagacaacattatctcgggaggcctggaggtcctcgcagaaaagtgccccaatttgacatacttgaaccttagcggaaataaaatcaaggacctaagcactgtagaggctctgcaaaacctgaagaatctgaaatccttggatctgtttaattgcgaaatcaccaacctagaagactaccgcgagagcatctttgaactgctgcaacaaatcacatatctggacggtttcgaccaggaggacaacgaagctccagattccgaagaggaagatgacgaagacggtgacgaggatgacgaggaggaagaggagaatgaagctggccctccagagggctatgaggaagaggaggaggaggaggaagaggaagatgaggatgaggacgaagatgaggatgaggctggtagtgagctcggcgaaggtgaggaggaagttgggctgagttacctcatgaaggaggagattcaggatgaagaggacgacgatgactatgtggaggaaggggaagaagaggaagaggaggaagaaggcggattacgcggagaaaagaggaagagggatgccgaggatgatggagaggaggaggacgattag

SEQ ID NO: 213033 - DNA, 411 bp, Artificial Sequence
  Description of Artificial Sequence: Synthetic coding sequence
atggaaatgaagaaaaaaatcaatctggaacttagaaatcggtcccctgaagaagaggacaatgaggcaccagattctgaggaagaggatgacgaggatggggacgaggacgatgaggaagaagaggaaaacgaagccggtccacccgagggctacgaagaggaagaagaagaagaagaggaagaagacgaggacgaagacgaagatgaggatgaggccggatccgagctgggagaaggggaggaggaggtgggcctctcctatttaatgaaggaggagatccaggatgaggaggacgacgatgactacgttgaggagggtgaggaggaggaggaggaggaagaaggaggtctacgtggtgagaagcggaagcgggatgctgaggacgacggtgaggaagaggatgattag

SEQ ID NO: 213034 - DNA, 663 bp, Artificial Sequence
  Description of Artificial Sequence: Synthetic coding sequence
atggccaatgtagaactgtccagtctggctaggctgccatcactaaacaagctgagaaaattggaacttagtgacaatataattagcggagggctggaagtgttggccgagaagtgccctaatctgacgtacctgaacctcagcgggaataagataaaggatctgtccactgtggaggcgctgcagaatctgaagaacctgaagagcctcgacctttttaactgcgagatcacgaaccttgaagactatcgggagtccatcttcgaattgctgcagcaaatcacttatctggatgggttcgatcaagaggataacgaggctcccgacagcgaagaggaggacgacgaagatggcgacgaggacgatgaagaagaggaagagaacgaggcgggtccccctgaaggttacgaggaggaagaggaagaggaagaggaggaggatgaagacgaggatgaggatgaagacgaagccggatccgagctgggtgagggcgaagaggaggtcggtttgagctacctcatgaaagaggaaatccaagatgaggaagatgatgatgactatgtcgaggaaggtgaagaagaggaggaggaagaggaagggggactgagaggcgagaagcgcaagagggacgcagaggacgatggcgaagaggaggacgactag

SEQ ID NO: 213035 - DNA, 684 bp, Artificial Sequence
  Description of Artificial Sequence: Synthetic coding sequence
atggagatgaagaagaagatcaatcttgaacttagaaatcgtagcccggaggaggtcacggagctcgtcctggacaactgcttatgcgttaacggtgagattgaagggctgaatgatactttcaaggagctggagtttctttcaatggctaacgtggagttatcatcgctcgcgcgactcccgtctttaaacaagttgagaaaacagaatctgaaaaatctaaagagtctcgacctgttcaattgtgagatcaccaatctcgaagactatagagagtctatcttcgaactcctgcagcaaataacctatctagacggcttcgatcaggaagacaatgaagcacccgattcggaggaggaagacgatgaagatggcgatgaggacgatgaagaggaagaagaaaatgaggctggacctccagaagggtacgaagaggaggaagaagaggaggaggaggaggacgaggatgaagacgaggacgaggatgaggcaggtagcgagctcggggagggcgaagaggaggtgggactcagctacctgatgaaggaagagatccaggatgaagaagatgatgacgattacgtggaggagggcgaagaggaggaggaagaggaggaggggggtctcagaggagagaagcgcaagcgggacgccgaagacgacggcgaggaggaggacgattag

SEQ ID NO: 213036 - DNA, 2076 bp, Artificial Sequence
  Description of Artificial Sequence: Synthetic coding sequence
atggacgggtgtaaaaaggagctaccgcgacttcaggaaccagaagaagacgaggattgttacattctgaatgtgcagagttcatccgacgatactagcggatcctcagttgccagacgggctccaaagcggcaggcaagctgtatcctgaacgtgcaaagtaggtccggagataccagtggatcaagcgttgctaggcgtgcccctaaaagacaggcgagcagcgtggtagttattgattctgatagcgacgaggaatgccacactcacgaagagaaaaaagccaaactgctggagatcaatagcgatgatgaatcccccgaatgctgtcacgtgaagcccgctattcaagagcctcctatcgtgatctcagacgacgataatgacgatgacaacggtaacgatctggaagtacccgatgataactccgacgattccgaagctcctgatgataattccgacgactctgaggctcctgacgacaattccgacgactccgaagcccctgacgacaattcagacgactccgaggctcctgacgacaatagcgatgattccgatgttcctgacgacaattccgacgattcaagcgatgacaatagcgatgacagttctgacgacaactccgatgattccgatgtccccgatgataagagtgacgactctgacgtccctgatgatagctccgacgattccgacgtgccagatgatagctctgacgacagcgaagctcctgacgattccagcgatgacagcgaggcacctgacgactcgtctgatgacagcgaggcacctgacgacagctcagatgactccgaagcacctgacgattcttctgatgacagcgaggctagtgatgattcctcggatgattctgaggcgagcgacgacagctcagacgatagtgaggcacccgacgacaaatcagatgactctgacgtgcccgaggataaaagcgatgacagcgatgtccccgatgacaattcagatgacttggaggtccctgttcccgctgaggacttgtgcaacgaagggcagatcgcctccgatgaggaggagctcgtggaggccgctgccgcagtctctcaacacgactcttctgacgacgccggagagcaggacctcggagaaaacctgtctaagcccccaagcgatcccgaggccaatcccgaggtgtctgaacggaagctccctacagaggaggagcctgctccagtagtcgaacaatcagggaaacgcaaaagcaagactaaaactatagtggagccacctaggaaacgccagaccaagactaagaacatagtggagccaccacggaaaaggcagaccaaaacaaagaatatcgtggaaccactgaggaagcggaaggctaagactaagaacgtaagcgtgactccagggcacaagaagcggggtccgtcaaagaagaaacccggtgctgcgaaagttgaaaagcggaagactcgaacccctaagtgcaaggtgccaggctgtttcttgcaggacctggaaaaatcaaagaaatattcaggcaagaatctgaagcgcaacaaagacgaactggttcagcggatctacgatcttttcaatagatccgtctgcgataagaaattgccggagaaacttcgaattggctggaacaataaaatggtgaagactgccggtctgtgcagcaccggcgagatgtggtaccccaaatggcgcagatttgccaagattcaaattggactgaaggtctgcgactcagcagacaggattagagataccctcattcacgaaatgtgccatgctgcaagctggctcattgatggtatccacgacagtcacggtgatgcctggaaatattacgccagaaagtctaatcgtatccatccagagcttcccagggttactcggtgccacaattacaagataaactataaagtgcactatgagtgtactggctgcaagacccgcataggatgttatacaaagtcactggatacatcccgctttatctgtgccaaatgtaaaggcagcttggtgatggtgccactgacacagaaggatgggacgcggatcgttccgcatgtttag

SEQ ID NO: 213037 - DNA, 2076 bp, Artificial Sequence
  Description of Artificial Sequence: Synthetic coding sequence
atggacggttgtaagaaagagctgcccaggctacaggagcctgaggaggatgaagattgttacattctcaatgttcagagttctagcgatgacacctcaggcagctctgtagcacgacgggctcccaagcgccaggcttcctgcattttgaatgtgcagagccgctccggcgacactagtggatcaagcgtggcccgacgggctccaaagcggcaggcctcctctgttgtcgtgattgactccgatagtgatgaggagtgccacactcacgaggaaaagaaggcaaaactgttggaaattaactcggatgacgagtcacccgagtgctgccatgtcaagcccgctattcaggagccacccatcgtgataagtgatgatgacaacgatgacgacaatggcaatgatctggaggttcctgatgataattcagatgactcggaagctccggatgataatagtgatgattcagaagctcctgacgacaatagcgacgacagtgaggctcctgacgataactccgacgacagcgaagcaccagatgacaactctgacgattccgatgtacccgacgataattccgacgactcgtcagatgataattccgatgactcgtctgatgacaattctgacgactctgacgtcccagacgacaaatccgatgacagtgatgttccagacgacagctctgacgattccgatgtccccgatgattcttcagatgattccgaggctcccgacgactcctcagacgacagtgaggcaccggacgactccagcgacgattcagaggcacccgacgactctagtgacgacagcgaagcccctgacgacagctcagacgattccgaggcctccgacgacagctcagacgactcagaagcttctgatgattcctctgacgactcagaagcccctgatgacaaaagtgatgatagtgacgttcccgaggacaagtcagatgattctgatgtccccgacgataatagtgacgacctggaggttccagtccctgcagaagacttgtgcaatgaaggtcagattgcttccgacgaggaagagctggttgaagctgccgctgctgtatcccagcacgactcctcagatgatgctggagagcaggacctgggcgagaatctgagcaaacctccaagtgatccggaggctaatcctgaggtctccgagcgcaagcttcctacagaggaggagcctgcaccagttgttgaacagagcggcaaacgcaaatccaagacaaaaacgatagtagaaccacccaggaagagacagacaaagactaagaacatcgtagagccccctcgaaaacgacagacaaagacaaagaacatcgttgagcctctgaggaagcgcaaggctaaaactaaaaatgtatcagtcacacctgggcacaagaagcgcggaccttccaaaaagaaacctggcgctgctaaggtggagaagcgaaagacccggacacctaagtgtaaagtgccaggctgctttttacaagacctcgagaagtctaaaaagtatagcgggaagaacctcaagcggaataaagacgaactggtccaaagaatatacgacctgtttaacagatctgtgtgtgataagaagctccctgaaaagcttcgaattgggtggaataataagatggtgaaaacagcagggttgtgctcaacaggcgagatgtggtatccaaagtggcgcaggttcgctaagattcagattggattgaaagtgtgcgacagcgcggatcgaattcgcgacactcttatccatgagatgtgtcatgctgcaagttggctgattgatggcatccacgatagtcacggagatgcatggaagtattatgcaaggaaatcgaatagaatccaccccgaactgccgagggtgacaaggtgtcacaactataagatcaactacaaagtgcactacgaatgtacgggctgtaaaacccgcatcggatgctacacaaagtcgcttgataccagtcgatttatttgcgcgaagtgcaagggaagtctggtgatggtgcctttaacacaaaaagacggtactaggatcgttccgcacgtgtag

SEQ ID NO: 213038 - DNA, 540 bp, Artificial Sequence
  Description of Artificial Sequence: Synthetic coding sequence
atggtgcaggcctggtacatggacgacgccccaggcgatccacgccaaccccaccggcctgacccaggcagaccggttggcttggagcagctgaggagattgggagttttatattggaaactcgatgcagacaagtacgagaatgacccagagctcgaaaagatccgacgagaacggaattatagctggatggacatcattacaatttgcaaggacaaactgccgaactatgaggaaaaaataaagatgttctacgaagagcatctacacctcgacgatgagattagatacatcttggacggctctggatattttgatgttcgcgataaggaggatcaatggatccgaatttttatggagaaaggcgatatggtcacactcccagccggaatctatcacagatttaccgtcgacgagaagaattacacaaaagccatgagactgtttgtcggcgaaccggtctggaccgcctacaatagaccagcagatcatttcgaggcacgcggacaatatgtaaagttcctggctcagactgcttag

SEQ ID NO: 213039 - DNA, 2670 bp, Artificial Sequence
  Description of Artificial Sequence: Synthetic coding sequence
atgtctaacccttttgctcacttagccgaacccctagaccctgtccagcccggaaagaagtttttcaacctgaacaagctggaagattctcgctacgggcgtctaccgttctccatacgcgtcctattggaggccgctatccgtaattgcgacgagtttttggtaaagaaacaagatatcgagaacatcttacactggaatgtgactcagcataaaaacatagaagtcccctttaagcctgctcgagtgattctgcaagactttactggcgttcctgccgtggtcgattttgccgcaatgagggatgctgtgaaaaaattaggcggagatcccgaaaaaataaaccccgtctgccctgccgacctggtgatcgaccacagtattcaggtcgacttcaaccggcgtgctgatagcctgcagaaaaaccaggacctggagtttgaaaggaatcgggagcgctttgagttccttaagtggggctcgcaagcattccataacatgcgcattattcccccaggaagtggcattatccaccaggtgaatctggaatatctggcccgagtggtgtttgaccaggacggatactactatccagactcactggtgggtacagactcccacacaacaatgatcgacggattgggtattctggggtggggggtgggaggcattgaggccgaggctgtcatgcttggacagccaatcagtatggtgttgccccaggtgatcggttacaggctaatgggtaaacctcacccgctggtgacttctactgacattgtgctgacaatcacaaaacacttacggcaagtgggcgtggtaggaaaatttgttgagttcttcggccctggggtcgcccagctctctatcgctgatcgcgcaacgattgctaacatgtgtcctgaatacggcgctaccgctgctttctttcccgtagacgaggtctccattacatatctcgtgcagacaggtcgagacgaggaaaagttgaagtacattaagaaatacctgcaggccgtgggcatgtttcgcgatttcaatgatccttctcaggatcctgattttacccaggtagtagagttggacctcaagactgtcgtgccttgttgttccgggcctaagcggccacaggacaaagtggccgtaagcgacatgaaaaaagatttcgagagttgcttgggcgctaagcaaggcttcaaagggtttcaggtcgctccagaacaccacaatgatcacaaaacattcatctatgataacaccgagtttaccctggcccacgggtccgtcgtgattgccgctatcacctcttgtactaatacatccaatcctagtgttatgctgggagctggcctgctggccaagaaggcagtcgatgctgggctgaacgtcatgccctatataaaaacaagtctcagcccgggtagtggcgtggtcacctattatctacaggagagcggcgttatgccttatctctcacagctagggtttgacgtggttggctatgggtgtatgacatgcattggcaattccggtcccctcccggagccagtggtggaagccattactcagggagatctggtggccgtcggagtgctcagcggaaataggaacttcgaaggcagagttcaccccaacacgagggcaaactacctcgccagtccaccactcgtgatcgcatacgcaatcgcagggactattcgaattgattttgaaaaggagccactaggtgtgaatgccaaggggcagcaggtctttctgaaggatatctggccaacgcgggacgagatccaggccgtcgagaggcagtacgtgataccgggaatgtttaaggaggtttatcagaagattgagacagttaacgaatcctggaatgctctcgctacaccctctgacaagttatttttttggaatagtaaatctacgtacatcaagtcccccccattcttcgaaaatctgactttagacttacaaccgcctaagtccattgtggatgcttatgtgctcctcaacctaggtgatagcgtcactaccgatcatatatctcctgcaggtaacatagctcgcaacagccctgcagcaaggtacctgactaatcgcggactgacacctcgtgagttcaactcttacgggagccgtagagggaatgacgccgtgatggctcgcggtaccttcgccaatatccgactgctgaatagatttctcaacaagcaggctcctcagacaattcacttgccctcgggcgaaatactcgacgtctttgatgccgcagagcgctaccaacaggcgggtctgccactcattgtgctggctggaaaagagtatggagccggttcttctagagattgggcagccaagggcccatttctgcttggaatcaaggccgtgctggctgaatcatacgagcggattcatcgttcaaaccttgtaggtatgggggtgatacccctggagtacctgcctggtgagaacgccgacgccttgggactcacaggacaagagaggtacacaattattatacccgagaaccttaaaccacagatgaaagtgcaggtgaagttggacacaggcaagactttccaggcagtgatgcgcttcgataccgatgtcgagctgacgtacttcctgaatggcggaatactgaactacatgattcgaaaaatggcgaaatag

SEQ ID NO: 213040 - DNA, 1305 bp, Artificial Sequence
  Description of Artificial Sequence: Synthetic coding sequence
atgagcaatcccttcgcccatctggccgagcctctggatcccgtccagcctgggaagaaattcttcaacttaaacaaactggaggactctaggtacggccgactccctttttcaattcgtgttctcctcgaggctgccattcgtaactgtgatgagtttctggtaaaaaagcaggatatcgaaaacatcctccactggaacgtgactcagcataaaaatatcgaagtaccgtttaagccggctcgagtaatcttacaagattttacaggggtgccagccgtcgtggactttgcagctatgagagacgccgttaagaagctcggaggtgaccctgaaaagattaatcccgtatgtcccgcagatcttgtgatagaccattcaatacaggtggatttcaatcggagagccgactccctgcaaaagaaccaagatcttgagttcgaacgaaacagagaacgctttgaattcttgaagtgggggtcgcaggccttccacaatatgcggattatccccccagggtcaggcatcattcatcaggtgaatctcgagtacctggcaagggtcgttttcgaccaagacggctactattatcccgattcactggttgggactgacagccacacaacaatgattgatggcctcggcatattgggatggggcgttgggggaattgaagctgaagctgtgatgctggggcagccaatttccatggtactgccacaggtaattggctataggctgatgggaaaaccacatcccctggttacaagcacagacatcgttcttaccatcacgaagcatctgcgccaagtgggagttgtgggaaaatttgtggagtttttcggcccaggggtggcacaactaagtattgcagatagggctactatagcaaacatgtgtccagagtatggggctacggctgccttcttccccgtcgacgaagtcagcatcacttatttagtgcagacgggcagagacgaagaaaagttaaagtatataaaaaaataccttcaggccgtgggaatgttccgggactttaacgacccttcccaggacccagatttcacacaggtggttgagttagatttgaagacagtggtaccatgttgttctggacccaaacggccacaggataaagtagccgtgagtgatatgaagaaagacttcgagtcttgcctgggggctaaacaggggtttaaggggtttcaggtggccccagagcaccataacgatcataagacctttatttacgataacactgagttcactctggctcatggctctgttgtgattgctgctctctag

SEQ ID NO: 213041 - DNA, 2670 bp, Artificial Sequence
  Description of Artificial Sequence: Synthetic coding sequence
atgtccaacccattcgcacatctggccgaaccccttgacccggtgcagcctggaaagaaatttttcaacctgaacaagctcgaggactcccgatatgggaggcttcccttctctataagggtgctgttggaagccgctatcaggaactgtgatgagttcttggtcaagaaacaggatatcgaaaacatactccattggaatgtgacccagcacaaaaatatcgaggtgccctttaagcctgcacgcgtaattctgcaggacttcaccggtgtgcccgctgttgtcgacttcgctgcaatgagagatgcagtgaaaaagctcggcggagatcctgagaagatcaaccccgtctgccccgctgatttggtgattgaccactctatacaggtagattttaacagaagggccgactcgctgcagaaaaatcaggatctggagttcgagaggaaccgggaaagatttgagttccttaaatggggttcacaggccttccataacatgaggatcataccacccggatcaggcatcattcaccaggtcaacctggagtacctggcccgtgtggtttttgatcaggacggatactattatccggattctctcgtgggaaccgattctcatactacgatgatagacgggctcggtatcctaggatggggagtcggcggaatcgaggctgaagccgttatgttaggccagcccatttctatggtcctgccacaggtgatcggctacaggttgatgggtaaaccacatccgctggttaccagcacagatattgtgttgacgattactaagcatttacggcaggtcggggttgtgggcaaattcgtcgaattttttgggcctggagtggcgcaactgtcaatagctgatcgggctacaatcgccaatatgtgcccagagtacggggcaactgccgcattcttccccgttgacgaggtgtccattacctatctggtacaaacaggacgggatgaggagaagcttaagtatattaagaaatatcttcaggccgtgggaatgtttagagatttcaacgacccctcgcaggaccctgacttcactcaagtggtcgagctggacctgaaaacggttgtcccatgctgtagcggacccaagcgaccccaagacaaggttgccgtctcagatatgaagaaggatttcgagagttgtctgggcgctaagcaggggtttaagggcttccaagttgccccagagcaccacaacgatcacaagactttcatatatgacaacaccgaattcacccttgcccatggcagcgtagtgatcgcggcaatcacaagctgtacaaacacctctaatcccagcgtcatgctcggagctggcctgctggctaagaaggctgtggacgccggacttaatgtgatgccatatattaaaacatccctcagtccgggaagcggtgtcgtcacttactacctccaagagtctggagtaatgccgtacctcagtcaactggggttcgacgtagtgggctatgggtgtatgacatgtatcggtaactcaggacccctccctgagcctgttgtggaggctataactcagggtgatttggtggctgtaggcgtcctgtcgggtaatcgcaactttgaaggcagagtgcaccctaacactagagcgaattacttggccagcccccctttggtcatcgcttatgctatcgcagggactattcgtattgatttcgagaaggaacccctaggcgttaatgcaaagggacagcaggtttttttaaaagatatatggcctacgagggacgagattcaggcagtcgagcgccagtatgttattccaggcatgttcaaggaggtttaccaaaaaattgagaccgtgaacgagtcgtggaatgctctggcaacaccatcggataagctgttcttttggaactcaaagtccacttatatcaaatctccgcctttcttcgagaacctcacgctggatttgcaacctccgaagtctatcgtcgatgcatacgtcctgctgaacttaggcgacagcgtgaccactgatcacatctcccccgctggcaacattgccagaaactcacctgcggcaaggtatctcaccaatagaggtttaacacccagagagtttaactcttatgggagccgcagaggaaacgacgcagttatggccaggggcaccttcgccaacatacgcctgcttaaccggtttctgaataagcaggccccacagaccattcatctgcccagtggggaaattctggatgtgtttgacgctgcggaaagataccagcaggccggtctgcccctaatagtgctggccggaaaggagtacggggctggttctagtcgtgattgggcagccaaaggcccttttcttctcggcattaaggcagtgctcgctgagagctatgagagaatccatagatcgaacctggtggggatgggagtcattccgttggaatacttgccaggcgagaatgccgacgcactcggcttaactggccaggagaggtacacaatcattatcccagaaaacctcaaaccccagatgaaagtccaggtgaagctggacactggaaagacctttcaggcagtcatgcggttcgatacagacgtggagctgacttattttttgaatggaggcatcctgaactacatgattagaaaaatggccaagtag

SEQ ID NO: 213042 - DNA, 2346 bp, Artificial Sequence
  Description of Artificial Sequence: Synthetic coding sequence
cagctcgagcccagatccgctcgggagcgcgtgcccctgctcggctcaggcagcccggtcgccggagctccaccctgtagcaggaggaacacatggccctctgtgataatgtccaatccattcgctcatctggccgaacctttggatcctgtccagccaggcaaaaagttttttaatcttaataagctcgaggatagccggtatggtcgcctaccctttagtatcagagttctgctggaggccgctatacggaactgcgatgagttcttagtgaaaaagcaggatattgagaatatcttgcattggaacgttacacaacacaaaaatatcgaggtgcccttcaagccagcaagagtcatcttgcaggatttcacaggagtccctgctgtcgtcgattttgccgcaatgcgagacgcggtcaaaaagctaggtggagatccagagaagataaaccccgtctgtcctgcagatctggtcattgatcattcgatccaggtggacttcaacagacgcgctgactcactccagaagaatcaagatttggaattcgaaaggaatagagagaggttcgaatttctcaaatgggggagtcaggccttccataacatgcgcatcattcctccaggatccgggattatacatcaggtcaacttagaatacctggctcgggttgtatttgaccaagacgggtattattatcctgatagcctggtaggcacagatagtcatacaacaatgatagatggattgggaattctcggttggggggttggcggaatcgaggcggaggccgtgatgctggggcaacctattagcatggtactgcctcaggtgatcggataccggctgatggggaaaccccaccccttagttactagcactgacatcgtgctgaccattaccaaacacctccgtcaggtgggcgtggtcggtaagttcgtagagttcttcgggccaggggtcgcgcaactgagcatcgccgacagggccactatagcaaatatgtgccctgaatacggggctacagctgcctttttccctgttgatgaggttagcataacctaccttgtgcaaacaggcagagatgaagagaagctgaagtacatcaagaagtacctgcaggccgtgggcatgttcagggactttaacgacccttcgcaagatcccgactttacacaggtagtcgagctggatctcaaaaccgttgtgccatgctgctccgggcctaagcgccctcaagacaaggtggctgtctctgatatgaagaaggattttgaatcctgccttggagccaagcaggggttcaaaggctttcaggtggctcccgaacaccacaatgaccacaaaacatttatttatgataatactgaatttacattagctcacggttcagtggtgattgccgctatcaccagttgcactaatacttcgaatcccagtgtgatgcttggcgctggcctgctcgcgaagaaggcggtcgacgcgggactcaatgtgatgccatacataaagacttctctgtcacctggatctggggtcgtaacctattacctgcaggagtctggcgtgatgccgtatctcagtcagctgggattcgacgtcgtgggatacggatgcatgacatgcatcgggaacagtggccctttgcctgagcctgtagtggaggctatcacgcagggagacctggttgcagtgggtgtactcagtggaaacagaaattttgagggcagggtccacccaaatactagagccaactatttggccagtccaccactggttatagcttatgctattgctggcactatcagaattgatttcgaaaaggaacctctaggagtcaatgccaagggacaacaggtattccttaaagacatctggccaacgcgggatgaaattcaagccgtcgaacgccaatacgtgatcccgggaatgttcaaggaggtgtaccagaaaatcgagacggtaaacgaaagctggaacgcactcgccactccttcagataaactgtttttttggaattccaaatcaacatacattaaatccccaccatttttcgaaaatttgactctggatctgcagccgccaaaaagcattgtggacgcctatgtgctgctcaacctgggcgactctgttactactgaccacatcagtcctgctggcaacatcgcacgaaacagcccagctgcgaggtacttgaccaacagaggttttgagcgccagcttacacaggagaacacagatctctgcctcagcccacccttgttgacctctttaagttcccccctgaaactgtgggggcagctcttctgccacggtgagcagtgcctaggcgatctggaaaaatag

SEQ ID NO: 213043 - DNA, 2373 bp, Artificial Sequence
  Description of Artificial Sequence: Synthetic coding sequence
atgcgagatgctgtgaagaaactgggaggcgatccagagaagattaaccctgtgtgtcctgctgacctcgtaatcgatcattcaattcaagtggacttcaacagaagagccgattcactgcagaaaaaccaggatctcgagtttgaaagaaatagggagcgatttgaatttctcaagtgggggtcacaagcgttccataacatgaggataatcccgccaggcagcggcatcatccatcaagtgaaccttgaataccttgccagggtggtttttgaccaagacggttactattacccagactcactggtgggcaccgactctcacactactatgatcgacggcctgggcatactgggttggggggtggggggaatcgaggccgaagccgtgatgctgggacagccgatctcaatggtgcttccccaagtgattggctacaggctaatgggtaaaccgcatcctctagttacgtcaaccgacatcgttctcacaatcactaagcaccttcgccaggtcggcgtggtagggaagtttgttgagttcttcggccctggcgttgcccagttatcaattgccgaccgcgcaacgatcgcaaacatgtgtcccgaatacggagctacagcagcctttttccctgtagatgaggtgtcaatcacgtatttggtgcagaccgggagggacgaagaaaagttaaagtacataaagaagtacctacaggctgtgggaatgtttagggacttcaatgatcccagtcaggacccagactttacgcaggtggtggagcttgatctcaaaacagtggtgccctgttgttccgggccaaagcggccacaggacaaggtggccgtttctgatatgaagaaggacttcgagtcttgtcttggcgctaagcagggcttcaaaggcttccaggttgctcctgaacatcataacgaccacaagacctttatctatgacaataccgagtttactttggcccatggctctgtagtcatcgccgctataacctcctgtacgaatacaagcaaccctagcgtcatgctgggtgcaggtctgctcgccaagaaggccgttgatgccggacttaacgttatgccctacatcaaaacaagtttgagtccagggagtggtgtggtgacctactacttgcaggagtcgggcgtgatgccatatctgtcccagcttggcttcgatgtcgtaggatatgggtgcatgacctgcatcggaaactccggccctctgcccgagcctgtggtggaggctattacacaaggcgacctcgttgctgtaggggtgttgtccggaaacaggaactttgaaggcagggttcatcccaatactagggccaattatttggcctccccaccgctcgtcatagcttatgcaatcgcaggcaccatccgaatcgactttgaaaaagaacccctcggtgttaatgctaaaggtcagcaggtctttctgaaggatatttggccaaccagagacgaaatccaggcagtggaaagacagtacgtgatcccagggatgtttaaagaagtgtaccaaaagatcgaaaccgtcaatgaaagctggaacgccctagcaacaccttctgataagctattcttctggaatagtaagtctacttatatcaagagccctcctttcttcgagaatctcactctcgatctgcagccaccaaaaagtatcgtcgacgcatacgtcttactgaatctgggcgatagcgtcacgactgatcacattagtcccgcaggcaatatcgctagaaattctccggctgccaggtacctcaccaatagaggcctcacaccgagggagtttaacagctacggctcccggaggggaaatgatgcagttatggcgcgtggcacgttcgctaacatccgcctgctgaatcgcttcctgaacaaacaggcgccacagaccatacacttgccttcgggcgagatcttggacgtgttcgacgccgctgaacgataccaacaggctggtcttcccctaattgtcctggcaggtaaggaatatggagccggttcatctagagattgggctgcaaaggggccatttctgctgggaatcaaggccgttctggcggagtcctatgaaaggatccacagatctaacctcgtggggatgggtgtaatccctttagagtatctccccggagagaacgcagatgccctgggattgaccgggcaggaacgttataccatcatcattccagaaaatctaaaacctcagatgaaagttcaggtgaaactggacaccggcaagacatttcaggctgtgatgagatttgacaccgatgtggaactcacttacttcctgaacggcggtatcctaaactatatgattcggaagatggccaaatag

SEQ ID NO: 213044 - DNA, 333 bp, Artificial Sequence
  Description of Artificial Sequence: Synthetic coding sequence
atggcaaagcaccaccccgacctgatcttttgtaggaagcaggccggtgtcgcaatcgggcgattgtgtgaaaagtgcgatgggaagtgcgtgatctgtgacagctatgtgagaccctgcactctggtgcgtatctgtgacgagtgcaattatgggtcgtatcaaggcaggtgtgtcatctgtgggggaccaggcgtgtctgatgcatactactgcaaagagtgcaccattcaggagaaggatcgggatggttgtccaaagatcgtcaatttgggctccagcaaaaccgacctcttttatgagcgtaaaaagtatggctttaaaaagcggtag

SEQ ID NO: 213045 - DNA, 2418 bp, Artificial Sequence
  Description of Artificial Sequence: Synthetic coding sequence
atggcaccttattccttgcttgttactagactgcagaaagcactgggagttagacagtatcacgtggcatcagtgttgtgtcagcgcgcaaaggtcgcaatgtcccactttgagcctaatgagtacatacactatgatcttctggagaaaaacatcaacattgtgagaaagagactgaaccgccctctcacgctgtccgagaagatcgtttacggccatcttgacgaccctgcttctcaggaaatcgagaggggtaaatcttatctgaggctgcgcccagacagggtggcgatgcaggacgcgacggcacaaatggcaatgctgcaattcataagcagcggtctctcaaaagtcgccgttcccagcactatccactgcgaccatctcattgaggcacaggtgggaggcgaaaaagacctgagacgagctaaagatatcaaccaagaggtgtacaatttcctggctaccgccggagccaaatacggagtagggttttggaagccaggatcaggtattattcaccagatcatcctggaaaactatgcatacccaggcgtgctcctcatcggcacagattcacacacccccaatggtggcggtctgggaggcatctgcataggcgtggggggagccgacgccgtggacgtcatggccggaataccttgggagcttaagtgtccaaaggtcatcggggtgaagctgacgggctccctatccgggtggagttctccaaaagacgtaatcctgaaggtagcgggaatcctaactgtcaaaggtggcacaggggcaattgtggagtaccatggtccaggcgtggacagcatcagttgcaccggtgaggaggggggacaggccacttggccactgccatgtgcgggaccggatggatctcccgtcggctcaagatccgggatggctaccatatgtaatatgggcgctgagataggcgctaccaccagtgtgttcccctacaaccacagaatgaaaaaatatctgtctaagactggaagggaagacatcgcaaacttagccgatgagttcaaggatcacctggtccctgaccctggctgccactatgatcaacttattgagattaacctgtcggaactgaagccccacatcaacggaccttttactcctgaccttgcacatccagtggccgaggtcggaaaggtcgctgagaaggagggctggccacttgacatacgcgtcggactcattggttcctgtacaaatagctcttacgaggatatgggacgatcagctgcggtggcaaagcaggcgctggcacacgggctgaagtgcaagagtcagtttaccatcacccccggttccgaacaaattagggctacaatcgaacgcgatggttacgcccagattctgagggatctgggtggtattgtcttggctaatgcatgtggaccctgcattggacagtgggatagaaaggacatcaagaagggagagaaaaataccattgtgacaagctataatagaaacttcacgggtcgaaacgatgccaaccccgaaacacacgccttcgtgacatcccctgagattgtgaccgcactggctattgctggcacgcttaaatttaatcctgagaccgattatctgacaggaactgatgggaaaaaatttagactggaggcgccagatgccgacgaactcccgaaaggggagtttgatcccggacaggacacctatcaacacccacctaaagactcctcaggacagcacgtggatgtgagcccaacctcccaacgactgcagctgttggaacctttcgacaaatgggatggaaaagacctggaggatctgcaaattctcatcaaagtgaagggcaaatgtaccaccgaccacatctcagccgctggtccgtggctgaaattccggggtcacctagacaacatctctaacaatcttttgatcggggctatcaatattgagaatgggaaagcgaactccgtaaggaacgctgtcacccaggagtttggcccagtaccggacacagcaaggtactataagaaacatggaatacggtgggttgtgataggcgatgaaaattacggggaagggtcctctcgggaacatgccgctctggaaccacggcatctgggcggtcgcgctatcattacaaagtctttcgcaaggatccatgaaacaaaccttaagaagcagggcctgttgcctcttacattcgctgaccctgccgactacaacaaaatccacccagtggataagctcactatccaaggcctcaaagactttactccaggcaagcctttgaagtgcatcatcaagcaccctaacggtacccaggagactattctgttgaaccatacgtttaatgaaacacagatcgaatggttccgtgcaggatccgctctgaacagaatgaaggaactacaacagtag

SEQ ID NO: 213046 - DNA, 1506 bp, Artificial Sequence
  Description of Artificial Sequence: Synthetic coding sequence
atggcaaccatctgtaacatgggagccgagattggagccaccaccagtgtattcccctacaaccatcgcatgaaaaaatacttatccaagacaggccgagaggatattgcgaatttagccgatgagtttaaggaccatctcgttccagacccaggctgccactacgaccagttgattgagattaacctgagcgaactcaaaccacacatcaacggcccattcacccctgatcttgcccaccccgtcgccgaggtgggaaaagtggcagagaaagaaggctggccactggacatccgcgtcggtctgatcggttcttgcactaacagctcatacgaggacatgggaagatcagccgcagtggcaaagcaggcacttgctcacggtttgaagtgtaaaagccaatttaccattacgccaggctccgagcagataagagctacaatcgaacgcgatggctatgctcaaatcctgcgcgatcttgggggtattgtccttgccaacgcttgtggcccttgtatcggtcagtgggataggaaggacattaagaagggcgagaagaataccattgtcacttcctacaacaggaattttactgggagaaatgatgccaatcctgagacacatgcgtttgtcacgagtccagagattgtcactgctctcgcaatcgcgggaacactcaaatttaacccagaaactgattatcttacaggaactgacggcaagaaattccggctcgaggccccagacgcagatgaactgcccaaaggggagtttgaccccggacaagacacatatcaacaccctcctaaggatagctccgggcagcatgtagatgttagtcccacttctcaacgcttacaactactggaaccttttgacaagtgggacggcaaggacctggaggacctccagattcttatcaaggtcaagggaaagtgcacgacggaccacatatctgccgctggcccttggttaaagtttcggggacacttagataatatcagtaataacttgctaatcggagccattaatatcgaaaatgggaaggccaatagcgtccgaaatgccgtgacccaggagtttggacctgttcctgacactgcgaggtactataaaaagcacggcattcgctgggtggtaatcggcgacgaaaactacggagaaggttcctcccgggaacacgcagcacttgagccgaggcatctggggggaagagccataattactaagtccttcgctcggatccatgagacaaacctgaagaaacagggtctcctgccactgacttttgccgacccggctgactacaataagatccatccagttgacaaattgacaatccaagggctcaaagatttcacccccggtaagcccttgaaatgcattattaagcaccccaacggaactcaggagactattctgttaaatcatacttttaatgagacacaaattgaatggtttcgagccggttcggccctgaaccggatgaaagagttgcagcagtag

SEQ ID NO: 213047 - DNA, 2286 bp, Artificial Sequence
  Description of Artificial Sequence: Synthetic coding sequence
atggctccctacagtcttctggtcacaagactccagaaagcattaggtgttcgccagtaccatgtggcctcagtgctgtgccagagggccaaagtggccatgagccattttgaacctaatgagtacatccactacgacctcttggagaagaacatcaacattgttcgcaagaggctgaatcgccctctcacgctatcggagaagatcgtgtacgggcacctggatgaccctgcaagccaggagattgaacgcggtaaaagttatctgagactccgacccgacagagtggccatggttgctgtgccatccaccatccactgcgaccatctgatcgaggcccaggttgggggtgagaaagacctcaggcgagctaaggacatcaaccaggaggtttacaatttccttgccaccgcaggtgccaagtatggcgtgggtttctggaaaccaggcagtggcataatacaccagataatcctggagaactatgcatatccaggggttttactgattggcacagactcacacacgcctaatggagggggacttggcggtatttgtatcggggtggggggagcagacgccgtggacgtgatggcgggaatcccttgggaactgaagtgccctaaggtcattggagttaagctgactggctccttgtctggatggagctcccccaaggacgtgatccttaaggtggccggtatcctcactgtgaagggtggcactggcgctatagtggagtaccatggccctggcgtggatagcatcagttgcacggggatggctaccatttgtaacatgggggcagagataggtgctacaacaagtgtgttcccttacaaccaccggatgaagaagtatctgtcgaagaccgggcgagaagacatcgctaatctagccgacgaatttaaagatcatctggtgcctgatccgggatgccactatgatcaactcatcgagatcaacctgagtgaactcaaacctcatatcaacgggcctttcacacccgacctagcacaccccgtggccgaggtcggtaaagtggccgagaaggaggggtggcctttggatatacgggtgggcctcatcgggtcatgtactaatagcagttatgaggatatgggtcggtccgctgccgttgcaaaacaggcacttgcacatgggctgaaatgcaagagtcagttcaccattacccccggtagtgagcagattagggccactatagagcgggatggttacgctcaaatcttgagggatctcggaggcattgtcctggccaacgcctgtgggccatgcatcggtcagtgggaccggaaagatattaagaaaggggagaaaaataccatcgtaacatcctacaaccgaaactttacaggccgtaatgacgcgaaccctgagacccacgccttcgtgacaagtcccgaaatcgtcactgccctcgctattgccggaaccttaaaatttaaccctgaaactgattatttaactggcacagatggtaaaaagttccggttagaggcaccggatgctgacgaacttccgaagggcgaatttgaccctgggcaggatacatatcagcaccctcccaaggatagttctgggcaacatgtggacgtcagtccaaccagtcagagactacagttactagaaccatttgataagtgggacgggaaagacctcgaagatctacaaattttaatcaaagttaagggcaagtgcaccacggaccatattagcgccgcaggcccatggctcaagttccggggtcacctggataatataagtaacaaccttctcatcggtgctattaatatcgaaaatggcaaggccaactccgttaggaacgccgtgacccaggagtttggccctgtcccggatacagctcgctattacaaaaaacacggaattcgttgggtggtcatcggagacgagaattatggcgaagggtcgagcagggagcacgccgctctcgagcctcgacatttgggcggaagggctattatcacgaagagctttgccaggatccacgagactaatctcaagaagcaaggcctgctcccacttacatttgccgatcccgctgactataataaaattcatccagtggacaaattgaccattcagggacttaaagatttcacccctgggaaacctctgaaatgtattattaagcaccccaatggcactcaggagacaattctactgaaccatacctttaacgaaacccagatagaatggttccgggctggaagtgcactcaatcgcatgaaggagctgcaacagtag

SEQ ID NO: 213048 - DNA, 756 bp, Artificial Sequence
  Description of Artificial Sequence: Synthetic coding sequence
atggaacttagcgcaattggcgaacaggtgtttgctgtagagtcaatcagaaaaaagcgggtgagaaagggaaaagtggaatatctcgtgaaatggaagggctggcccccaaaatattctacatgggaacccgaagagcacattctggacccgaggttggtgatggcctatgaagagaaagaggagcgagatcgggcaagcggatacagaaaaagaggacccaaacccaagcgactgctgctgcagcggctgtactcaatggacttacgctcttctcacaaagcaaaaggcaaggaaaaactgtgttttagcctcacctgtccactcggttcaggatcccccgaaggggtggtcaaagcgggagcccctgaactggtggataagggtcccctggtgccaactcttcccttccctctgcgcaagccacgaaaagcccataagtatctcagactctcacggaagaagtttccacccagggggcctaacctcgaatctcacagccataggagagaactctttcttcaggaaccacctgcccctgacgtgctgcaggctgccggagaatgggagcctgcagcccagccccctgaggaggaagcagacgcagatctggccgaaggaccgccaccttggactcccgcactcccgtcctccgaggtcaccgttactgacatcaccgccaactctattacggtcacctttcgggaagctcaggccgctgagggctttttccgagatcgtagcggcaaattctag

SEQ ID NO: 213049 - DNA, 633 bp, Artificial Sequence
  Description of Artificial Sequence: Synthetic coding sequence
atgaatcggttcttattacttatgtcgctctaccttctgggcagtgccaggggcacctccagccagccaaacgagctgtcaggatcgatagatcaccagacttctgtccagcagctccccggagaacctgccgctaccgagcatgcagagggcgagcatactgtcggagaacagccatccggagagcaaccctccggtgagcatctttctggggaacaacccctctcagaactggaatcaggtgaacagccgtctgacgagcagccgagtggagagcacgggtctggagaacagcccagcggcgagcaggcttccggggaacagccctccggagagcacgcctctggcgaacaggcctccggggcacctataagttcaacatccactggtaccatcttgaattgctacacttgcgcctatatgaacgatcaaggaaagtgcttgaggggagaaggcacatgcataactcaaaactctcagcaatgcatgctgaagaaaattttcgagggcggaaaactccaattcatggtacagggatgcgagaatatgtgcccctcaatgaacctcttctctcacggcacccgaatgcagataatctgttgcaggaatcagtctttctgtaacaagatttag

SEQ ID NO: 213050 - DNA, 741 bp, Artificial Sequence
  Description of Artificial Sequence: Synthetic coding sequence
atgaaccggtttctcttactgatgtccctctatcttctcggatctgctcgtggcacttcctcacagccaaatgagctgagcggcagtattgatcaccagacatctgtgcagcagttgccgggagagttcttttcattagagaatccctctgatgccgaagcactttatgagacttctagcggcctcaataccctgtccgagcacggttcctctgaacacggttcaagtaagcacacagtggctgagcatacaagcggggagcacgccgaatcggagcacgccagtggcgaacccgctgctactgagcacgcagaaggggagcacaccgttggagagcagcccagtggcgagcagccgtctggggaacacttgagcggcgagcagccactcagcgagctggagagtggtgagcagcctagtgacgagcaaccgtctggggagcatggtagtggagaacagccatcgggtgaacaggccagtggcgaacagcccagcgggactatccttaattgctacacctgtgcctacatgaacgatcaaggtaaatgcttgcggggagaaggcacctgtataacccagaactcccagcagtgcatgttgaagaagatatttgaaggcggaaagctgcagttcatggtgcaagggtgtgaaaacatgtgtcccagcatgaacctcttctcccacgggaccagaatgcaaataatctgttgccgtaaccaatctttttgcaacaagatttag

SEQ ID NO: 213051 - DNA, 468 bp, Artificial Sequence
  Description of Artificial Sequence: Synthetic coding sequence
atgaataggtttctcctattaatgtctctgtatttgctcggctcagcacgcggaacttcttctcagccaaatgagttatcaggcagtattgatcaccagacttctgtgcagcaattgccgggtgaacagccgagcggagaacagccaagcggggaacacctatccggcgagcagcctttatcggagttggagagtggagagcagccatccgacgagcagcctagtggcgaacatggaagtggagagcagccatctggcgagcaagcaagcggtgagcagccctctggggaacacgcttctggagaacaagctagcggagctcctataagctccacgtctacaggaggcaagctgcaatttatggtccagggctgcgaaaacatgtgtccttctatgaacctcttttcgcacggaacccgcatgcaaattatttgttgcagaaatcagtctttttgcaataaaatctag

SEQ ID NO: 213052 - DNA, 498 bp, Artificial Sequence
  Description of Artificial Sequence: Synthetic coding sequence
atgaataggtttttgctgctaatgtcgctttacctcctagggagcgctagaggcacgagttcacagcccaacgaactctccggttccattgatcatcaaacctctgtgcagcagttaccaggggagcctgcggcaaccgaacacgcagaaggtgagcacacagtcggcgagcagccctccggcgagcaaccgtctggcgagcacgcctctggggaacaagcttcaggcgcacccattagcagcacttccacaggcaccatcctgaattgctacacctgcgcgtacatgaatgatcagggaaagtgccttcgcggtgaaggcacgtgtatcactcagaactcgcagcagtgtatgctgaagaaaattttcgaggggggtaaactgcagtttatggtgcaaggctgtgagaacatgtgcccctccatgaatcttttttcccatggcacgcggatgcagatcatttgctgcagaaaccagagcttctgcaataaaatctag

SEQ ID NO: 213053 - DNA, 246 bp, Artificial Sequence
  Description of Artificial Sequence: Synthetic coding sequence
atgaatcgcttcctgctgctaatgtcactctacctcctcgggtctgcaagaggaaccagtagtcagcctaatgagctgtctggttctatcgaccatcaaacgtctgtgcagcaactgcccggaggcaaactccagttcatggtgcagggttgcgaaaatatgtgtccttccatgaatttattctctcacggaactagaatgcagataatttgctgtaggaatcaatccttctgtaacaaaatctag

SEQ ID NO: 213054 - DNA, 366 bp, Artificial Sequence
  Description of Artificial Sequence: Synthetic coding sequence
atgaaccggttcctgctcctcatgagtctttatttactggggagcgcacgaggaacctcctcccagcctaacgaactctcaggctctattgaccatcaaacatctgttcagcaactccccggtacaatcctcaattgctacacctgtgcctatatgaacgaccagggtaagtgtttgcgcggtgaaggtacctgtataactcagaattcacagcagtgcatgctcaaaaaaatcttcgaagggggaaagctacagtttatggtccaggggtgcgaaaacatgtgtccctcaatgaacttgttctcccatgggacacggatgcagattatctgttgtcgaaatcagtcattttgtaacaagatttag

SEQ ID NO: 213055 - DNA, 588 bp, Artificial Sequence
  Description of Artificial Sequence: Synthetic coding sequence
atgaatcgcttcctgctgcttatgagcctgtacctgctgggcagcgctagaggcacttcatcgcagccgaacgagctaagtgggagtatcgatcaccagacctccgtacagcagctgcccggtgagcaaccttcaggtgagcaacctagtggcgagcacctctcaggggaacagcctctgagtgagctggagagtggcgaacagccatccgatgagcaaccctccggagaacacggctccggggaacagcctagcggagaacaagcgtccggagagcagccctctggtgagcacgccagcggagagcaggccagtggggctcccatttctagcacctctactggcacgatcttgaactgctacacatgtgcttacatgaacgaccagggaaagtgtttgcggggagagggaacatgtatcactcagaacagccagcagtgtatgctaaagaagatctttgagggtggaaagttacagtttatggtgcagggctgcgaaaatatgtgtccttccatgaacttgttcagccacggtaccagaatgcagataatttgctgtcgaaatcaatccttctgcaataaaatctag

SEQ ID NO: 213056 - DNA, 741 bp, Artificial Sequence
  Description of Artificial Sequence: Synthetic coding sequence
atgaacaggttcctcctgctgatgagcttgtatcttctggggtcagcccgagggacaagcagccagccaaatgagctgtctggatcgatcgaccaccagacttccgttcagcagctacctggggagttcttctcattggaaaacccttcagatgcagaggccctctacgaaacaagcagcggcctgaataccctcagcgagcatggaagctcggaacatggcagcagtaaacacacagtcgctgaacacacctccggagagcatgcagagtccgaacacgcctccggcgaacccgctgccacagaacacgcagagggggagcacacagttggtgaacagccaagcggtgagcagccctcgggagagcatctctcaggggaacagcctttgagcgaattagagtcgggtgaacagccttctgacgaacaacctagcggcgagcatggctctggcgaacagccctccggggagcaggcgagtggagagcaaccaagcggtactatcttgaactgctacacatgcgcctatatgaacgaccaggggaagtgtctcagaggcgaaggcacatgtatcacccaaaatagtcagcaatgcatgctaaagaagatttttgaaggcggaaagttgcagttcatggttcaaggatgtgagaatatgtgcccctccatgaatctgttctcgcatggcacacggatgcaaataatttgctgtaggaaccagagcttttgcaataaaatctag

SEQ ID NO: 213057 - DNA, 513 bp, Artificial Sequence
  Description of Artificial Sequence: Synthetic coding sequence
atgaaccgatttctcctgctgatgtctttgtatctgttgggaagtgcacgaggtacaagctctcaacccaacgagctctctggaagtatcgaccaccagacctcagttcagcaactccccggtgagcaaccctccgatgagcagccttctggtgagcatgggtctggggagcagcctagtggagagcaggcatctggggagcagccctctggagagcacgctagtggcgaacaggccagcggtgcacctattagctccaccagtacaggcacaattttgaactgctatacatgcgcttatatgaatgatcagggcaagtgtctgagaggcgagggcacctgcataacgcagaattcacagcagtgtatgctgaagaaaatattcgagggaggcaagctacaattcatggttcaaggttgcgagaatatgtgccccagcatgaacctgttctcccatgggacgcgaatgcagatcatttgctgtcggaatcagtccttttgcaacaagatatag

SEQ ID NO: 213058 - DNA, 531 bp, Artificial Sequence
  Description of Artificial Sequence: Synthetic coding sequence
atgaatagatttctgcttttgatgagcctgtacttacttggctccgccaggggcaccagctcccagcccaacgagctcagcggctccatcgaccatcaaacaagcgtccaacaactcccaggagagcaaccgtcgggcgaacaacctagcggtgagcacttgtctggcgaacaacctcttagcgaattagaatctggagagcagccgagcgacgaacaaccatccggagaacatggctccggcgaacagccgtctggcgagcaggccagcggcgagcagcccagtggaacaatcttgaactgttacacgtgtgcctacatgaatgatcaggggaagtgtttacgtggggagggtacatgtatcacgcagaattcgcagcagtgcatgctgaaaaagattttcgagggtggcaaattgcagttcatggtgcaaggctgcgaaaacatgtgtccatcgatgaacctgttttcccacggtactcgtatgcagatcatatgctgtcgtaaccagtcattttgtaataagatctag

SEQ ID NO: 213059 - DNA, 588 bp, Artificial Sequence
  Description of Artificial Sequence: Synthetic coding sequence
atgaacagattcctcctgctgatgtccctgtatctcctcggcagtgctcggggtaccagtagccagcctaatgaactgtctggctccattgatcaccaaacctctgtgcagcaattgcctggcgaacaacccagcggcgaacagccttccggcgagcacttaagtggtgagcagcccctctccgaattggagagcggcgagcagccctccgatgaacagccctctggcgagcatgggagtggcgaacaaccaagcggagaacaggcaagcggcgagcagccatctggcgagcacgcaagtggagagcaagcctccggggcacctataagttcaactagcacaggcacaatactgaattgttatacttgcgcatacatgaacgatcaggggaagtgtctgcggggtgagggcacatgtattacccaaaactcccagcagtgtatgctcaagaagatttttgaaggaggaaagctgcagtttatggtccaaggctgcgagaacatgtgcccttccatgaatttattcagccacggcacccggatgcaaatcatctgctgccgcaaccagtccttttgcaataagatctag

SEQ ID NO: 213060 - DNA, 633 bp, Artificial Sequence
  Description of Artificial Sequence: Synthetic coding sequence
atgaacaggtttttgctcttgatgagtctgtatctcctggggagtgccaggggtactagctctcagcctaatgagttaagtggctcaatcgaccaccagacgagcgtccagcagctcccaggggaacccgctgccaccgagcatgccgagggcgagcacaccgttggggagcagcccagtggcgagcaaccatcaggggagcatctctctggggaacagcctcttagcgaacttgagtcaggggaacagccatcggacgaacagccaagtggggagcacggatcaggtgaacagcctagcggcgagcaggcctcaggcgaacagccctccggtgagcacgcctccggtgaacaagctagcggagcaccaatttcaagcacatcaactgggacgatcttaaactgttacacctgcgcctatatgaacgatcagggaaagtgcttaagaggggagggaacctgcattactcagaacagccaacagtgcatgctaaaaaaaatcttcgagggcggtaagttgcagtttatggtacagggctgtgaaaatatgtgtccaagcatgaatctgttctcccacggcacgcggatgcagatcatctgttgtagaaaccaatctttttgcaacaaaatctag

SEQ ID NO: 213061 - DNA, 798 bp, Artificial Sequence
  Description of Artificial Sequence: Synthetic coding sequence
atgaatcggttcctattgctcatgtccctctaccttctcggtagcgcacgtggtaccagcagtcaacctaatgagttgtctggtagtattgaccaccaaacgtccgtccaacagcttcccggtgaattctttagtctcgaaaatccctcagacgcggaggccctctatgagacatccagcggcctaaatacactgtcagaacacggcagtagcgaacacggatcttcgaagcacacagttgctgagcatacatcgggagaacatgctgaaagcgagcacgctagcggagagcccgctgccactgagcacgcagaaggcgaacataccgtgggcgagcagcccagcggtgagcagccctccggtgagcacctatctggtgagcagccactgtccgaattagaatcgggagaacagcccagcgatgaacaaccttccggcgagcatggtagcggcgaacagcctagcggagaacaagcttcaggcgagcagccatctggtgagcatgcttcaggcgaacaggcatctggagccccaatatcctccacctctaccggcaccattctgaactgttatacctgcgcctacatgaatgaccaggggaagtgcctgcggggagaagggacgtgcatcacccagaattctcagcaatgtatgttaaagaagatctttgaggggggaaaactgcagtttatggtgcaaggctgcgagaacatgtgcccctccatgaatttgttctcccatgggacacggatgcagatcatttgctgcaggaatcagtcgttctgtaacaagatttag

SEQ ID NO: 213062 - DNA, 1722 bp, Artificial Sequence
  Description of Artificial Sequence: Synthetic coding sequence
atgagtgctgtgagtcagcctcaagccgctcccagccccctggaaaagagcccatccactgctattctgtgtaatacttgcgggaatgtctgtaaaggtgaagtgctgcgagtgcaggataagtattttcatatcaaatgtttcgtctgtaaggcttgtggatgcgatctggcagaaggaggctttttcgttaggcagggtgagtatatctgcacgttggattatcagagactatacggtaccagatgtttctcctgtgaccagttcatcgaaggcgaggtggtgagtgcactggggaagacataccaccctgactgttttgtgtgcgccgtctgccgcctgccctttcccccaggcgatcgggtgacttttaatgggaaagaatgtatgtgtcagaaatgctcgctccctgtatcagtggggtcctctgcccacctgagtcagggcctgcggagctgcggtgggtgtgggactgagatcaagaacggtcaggccttggtggcccttgataagcattggcacttaggctgcttcaagtgcaaatcgtgcggcaaactactgaacgccgaatatatctccaaggatggattgccatattgtgaggctgattaccatgccaagttcggaatccgttgtgactcttgtgagaaatatatcacaggtagggttcttgaagccggtgaaaaacactaccacccctcctgtgccttgtgtgtgcgatgcggacagatgtttgcagagggggaggaaatgtacctgcaaggcagctctatctggcatccagcctgccgccaggctgctaggaccgaagaccgaaacaaggagacaaggaccagttccgagagtattatctccgtgcctgctagcagtacatcaggctctccttctagagtcatctacgccaagctcggaggagagatattggattatcgtgacctggccgcactccccaagtcaaaagccatctacgatatcgacaggcccgatatgattagttatagtccttacattagtcactctgcaggtgatcggcagtcctatggagaaggagatcaggacgatcgatcctataaacaatgtagaacgagttcgccatctagtacagggtctgtcagtctcgggagatataccccgacaagccggtccccccaacattattccagaccgggttctgagagcggacgatcgactccatccctgtccgttctcagcgatagtaagccccctccaagcacataccagcaggcacccaggcacttccacgtgcccgacaccggcgtcaaggacaacatctatcgaaagcccccaatttatcgacagcatgcggcaaggcgatctgatggggaggatggttctctcgatcaggacaataggaagcagaaatcctcttggctcatgctcaaaggagacgccgatactaggaccaactcacccgacctggacacccagtccctgtcccactcatctggcaccgatcgggacccgctgcaaagaatggcaggcgattcctttcatagtcgcgagaagatttacccctatgattcattaattgtaaccaataggataagagttaagctccccaaggacgttgatcgcactcgactggagcgacacttgtctcctgaggagtttcaggaagtgttcggcatgtctatcgaagaatttgaccgcttggcactatggaaaaggaacgacttaaaaaagaaggcactgctgttttag

SEQ ID NO: 213063 - DNA, 1041 bp, Artificial Sequence
  Description of Artificial Sequence: Synthetic coding sequence
atgttcgcagagggggaggaaatgtatctgcaggggtccagcatctggcaccccgcttgccgccaggcagcacggacagaggacaggaacaaggaaaccaggacctcaagcgagagcattatttctgtcccagcttcctcgacctccggctcaccgagtcgcgtgatttatgctaagctgggcggtgaaatactggattaccgggatctggcagccctgcccaagtctaaagcgatctacgatattgacagacccgatatgattagctacagtccttatatctcacacagcgcaggggatcgccagtcctatggagaatcgccccaattactttcacctactccaacagagggcgaccaagatgaccggtcttataaacagtgccgaacttctagcccctcaagcaccgggtccgttagtctaggtcgatacacacccacttcccggagcccccagcactattctaggcctgacacaggcgttaaagataatatttatagaaaaccaccaatctaccgccagcacgcagccagacgatccgacggcgaggacggatcattggaccaggacaacagaaagcaaaagagctcgtggctaatgctgaagggcgacgctgacacccgtactaattcacccgatctcgacacccagagcttgtctcactcatctggaactgaccgggatccccttcagagaatggcaggagattcctttcacagtcgcttcccatatagcaagagcgacccgctgccaggccacggtaagaacggccttgaccagcgaaacgcaaatcttgcgccatgcggcgcagaccccgacgcttcctggggcatgcgcgaatataaaatttatccatatgattctctgattgtgacaaatagaattcgagtcaagcttccaaaggacgtggaccgtaccaggctcgagagacatctgtcaccagaggagtttcaagaagttttcggaatgagcattgaggagttcgatcgcctggccttatggaagaggaacgatttaaagaagaaagcactcctgttctag

SEQ ID NO: 213064 - DNA, 1836 bp, Artificial Sequence
  Description of Artificial Sequence: Synthetic coding sequence
atgtccgccgtttcacagcctcaggcagcaccgtctccactggaaaaatctccctccacggccatcttgtgcaacacctgcggcaacgtatgcaagggcgaggtcttgagggtgcaggataaatactttcatatcaagtgctttgtctgcaaggcatgcggatgcgatttagccgagggtggctttttcgttcggcaaggagagtacatctgcacgttggactaccagcgactgtacgggacccgctgtttctcatgtgaccagttcattgagggtgaagtagtcagtgctctgggcaagacctatcacccggactgttttgtgtgcgccgtgtgtaggcttcctttccccccaggcgatcgcgttaccttcaacgggaaagagtgcatgtgccagaagtgcagtctgccggtgtccgtagggagctcagctcatctcagccagggcttgaggtcctgcggcggatgtggcactgaaatcaagaatggccaggctctggtggccttagataaacactggcatttgggttgcttcaagtgtaaatcctgtgggaagctcctcaacgccgagtatattagtaaggatgggttaccttactgtgaggcagactaccatgctaaatttggcattagatgcgacagctgtgaaaaatatataaccggcagagtcttggaagccggtgaaaaacattatcacccctcgtgcgcgttatgcgttaggtgcggacaaatgttcgccgagggggaggagatgtatctgcaggggtcctccatatggcacccggcatgtagacaggcagccagaacagaagaccgcaataaggaaacccggacaagtagtgaatcaatcatttccgttccggcatctagcacatccggctctccatctagagtcatctatgcaaagctaggaggagagatcttggattaccgcgatctggccgcactgcccaagagcaaggccatctacgacatagaccggcctgatatgatatcctactccccatacatctctcatagtgcaggcgaccgccagagctatggagaaggcgatcaggacgaccgatcatacaagcaatgccgcacaagtagtccttcaagcaccggatcagtttctctcggaagatatacccctacctcgcgctcaccccagcactattcacggccaggctcggagagcggacggagcacaccatccctctccgtgctgtctgattctaaacctccaccaagcacatatcagcaagcccctaggcacttccatgtgcccgataccggcgtgaaggataatatctatcgcaaacccccaatctatagacagcatgctgccagaaggagcgacggcgaagacggcagtcttgaccaggataatcgtaaaaaatcatcctggctgatgttaaagggtgatgcagacactaggacaaactctccagatctcgatacgcaatcgttgagtcatagttctggtaccgatagagatcccctgcaacggatggcaggagatagcttccactccaggttcccctactctaagtctgatcccctccccggacacggaaaaaacgggttagaccaaagaaacgcaaacctcgccccatgcggcgcagaccccgacgcttcctgggggatgcgggaatacaagatctatccttacgactcacttattgttacaaaccggatccgagtgaagctgccaaaggatgtcgatcgaacgcggcttgaacggcatctcagtcctgaggaatttcaggaagtctttggcatgtccatagaggagtttgataggctggcactgtggaaaaggaacgacctgaaaaagaaagctctactcttctag

SEQ ID NO: 213065 - DNA, 1719 bp, Artificial Sequence
  Description of Artificial Sequence: Synthetic coding sequence
atgagtgcggttagtcaaccgcaagctgcacctagccctctggagaagagcccaagcaccgcgattctttgtaatacttgcggcaatgtgtgcaagggagaagtgttgagggtccaggacaagtatttccacatcaagtgttttgtgtgtaaggcatgcggttgcgatcttgccgaagggggattctttgtgcggcagggagagtatatatgcaccctcgactatcaacgactttatggaactcgctgctttagctgtgatcaattcatcgaaggggaggtagtttcagcccttggcaaaacataccacccagactgtttcgtgtgcgccgtttgccgactgccatttcccccaggagatcgggtcacattcaacggtaaggaatgcatgtgccagaagtgctcactcccagtgtccgtcggttcctccgcacacctgagtcaaggcctgcgttcatgcgggggatgtggtacggagattaaaaacggtcaggccctagtagccctggacaaacactggcaccttggctgcttcaagtgcaaatcctgtggcaaactgcttaacgctgaatatatcagcaaagacgggctaccttactgtgaagctgactaccatgccaaatttggcattaggtgcgactcctgtgaaaagtatatcaccggccgagttctcgaagccggtgaaaagcattatcatccctcatgcgccttgtgcgtgaggtgcggtcagatgttcgcagagggcgaggagatgtacctgcagggctcgagtatctggcatcccgcatgcagacaagccgctagaaccgaagataggaacaaggagacaagaacctcatccgagtctatcataagtgtgcccgctagcagtacctcagggtcccccagccgggtcatttatgccaaactaggaggggagattcttgattatcgcgatctggccgctcttccaaagtctaaggctatttacgatatcgaccgtccggatatgatttcctactcaccctacatatctcattctgctggggatcgccagtcatatggcgaaggtgaccaggatgacaggtcttataagcaatgtagaactagctcaccctcttcgaccggctcagtgagcctggggagatacacccccacttctcgctctccacagcattactcacggcctggcagcgagtctgggcgtagcactccatctctctccgtactctccgatagtaaacctccccctagcacctaccagcaagcaccacggcacttccatgtgcctgacacaggcgtcaaggataacatctatcggaagcctccgatttacagacaacacgctgcgaggcggagtgatggagaagacgggagcctggaccaagacaatcggaaaaaatcgagctggttgatgttgaagggcgacgcggatacacggactaacagcccggacctagacacccaaagcctgagccactctagcgggactgaccgcgatcctctgcagagaatggccggtgattcctttcattcacaatacaagatctatccgtatgattcccttatcgtaaccaaccgtatccgcgtgaagctgcctaaggacgtggacaggacccgattggagaggcacttaagccccgaagaattccaagaagtgttcggaatgtcaatcgaggagtttgaccgactggccctctggaaacggaacgatctaaaaaagaaggcccttctgttttag

SEQ ID NO: 213066 - DNA, 1596 bp, Artificial Sequence
  Description of Artificial Sequence: Synthetic coding sequence
atgtctgcagtttcacagccccaggctgctccctcacctctggagaaatcccctagcacggctatcttatgtaatacctgcggcaacgtgtgcaagggcgaggtgcttcgcgttcaggacaaatacttccatatcaagtgcttcgtctgtaaggcctgcgggtgcgacctggctgaaggcggtttttttgtgcgtcagggcgagtacatctgcactctcgactatcaaagactctatggaacgcgctgtttctcctgcgaccagttcatcgaaggagaagtggtcagcgccctggggaaaacctatcaccccgattgctttgtgtgtgccgtctgccgcctgccgtttccgcctggagatagagtgacatttaacgggaaagagtgtatgtgccagaagtgttctttgcctgtgagcgtaggaagttcagcccacttaagccaggggttgagatcatgcgggggatgcggcactgagatcaagaacggccaagctctagtggcattagacaaacattggcatctggggtgctttaagtgcaagagctgcggcaagttgttaaatgcagaatatatcagcaaagacgggcttccatactgcgaggccgactatcacgcgaagttcggaattaggtgtgacagctgtgaaaagtacatcacaggtcgagtgctggaggccggtgagaagcactatcaccctagctgcgccctctgcgtaaggtgcgggcagatgttcgccgagggcgaagaaatgtatctccaggggtcatccatctggcatcctgcttgtagacaggcggcacggactgaagaccgtaacaaagaaacacgcaccagcagcgaatccatcattagcgtgccagcttcatccaccagcggcagcccgtcacgcgtaatctacgcaaagctgggcggagagattctagattacagggacttggctgctctccccaaatctaaggctatctatgatattgatcggccagatatgatcagctacagtccatatatttcccattcagccggtgatcgacagagctacggcgaaagtccccagttactcagtccaactcccaccgagggggatcaagatgaccgttcttataagcagtgcagaactagctcaccgagctctacagggagcgtgtcactgggaagatatacgccgacatcaaggtccccacagcactacagtaggcctgcagcgaggcgttcagatggagaggatggctcacttgatcaggataatcgcaagaaatcctcatggctgatgcttaagggggatgctgatacccgcaccaacagcccggatctggatacgcagtcactcagccactcatccgggactgacagagaccccctccagcgcatggcaggagactcttttcacagtcagtataagatctacccttatgacagtctgattgttaccaataggatcagagtgaagctgccaaaggacgtcgatcggaccagactagagagacatctgagccctgaagagtttcaagaggtctttggaatgtctattgaagagttcgaccgtctcgccctctggaaacggaatgatctgaagaagaaagctctcctgttttag

SEQ ID NO: 213067 - DNA, 1935 bp, Artificial Sequence
  Description of Artificial Sequence: Synthetic coding sequence
atgagcgccgtttcccagccccaagccgcaccctcgccgctggaaaagtctccaagcactgctattctgtgcaatacgtgtggtaatgtgtgcaagggcgaggtgctgagggtgcaggacaagtattttcacatcaaatgtttcgtgtgtaaggcttgcggatgtgacctagccgagggaggtttcttcgttcgccaaggggagtacatctgtacgctggattatcagcggttgtatggtacgcgttgctttagctgcgaccaattcattgagggcgaggtggtaagtgcattgggcaaaacctatcaccccgattgcttcgtgtgcgctgtgtgcagactcccattccccccaggcgatagagtgacattcaatggaaaagagtgtatgtgtcaaaagtgcagcctgccggtgtcggtggggtcatcagcccatctgagccaaggacttcgttcttgtggcggatgtgggactgagatcaaaaatggccaggcattggtggctctggacaaacactggcacctggggtgctttaaatgcaagtcatgtggcaagctcctgaacgccgagtacatttcaaaagacgggttgccgtactgcgaagccgattaccatgccaagtttggcatccgctgtgacagctgcgagaagtatatcacgggacgggtgctcgaagcaggggagaaacattaccacccaagctgcgctctgtgcgtgcgatgcggtcagatgttcgccgaaggtgaggaaatgtatctgcagggatcctccatttggcacccagcctgcagacaagcagcacgcacagaagatcgtaacaaggaaactaggacatcgtcggaatctatcattagtgtgccggcttccagtaccagtggttctccctctcgcgtcatttatgctaaacttggcggagaaattttagattatcgcgacctcgccgctcttccgaagagcaaggccatatacgacattgataggccggatatgatctcctatagcccgtacatcagccattctgctggagaccgacagtcatacggggagggggatcaggatgaccgttcctacaaacagtgccgcacctcctcacctagctcaaccggaagcgtaagtctgggcaggtacacgcccacaagtaggagcccacagcattatagccgcccagcaggcaccgtctcagttggaacaagcagttgcctcagtctcagtcaacatccctcccctaccagcgtgtttaggcaccattatatcccctatttccggggatccgagagtggaagatccactccgtcactcagtgtgctctctgactccaaacctccaccaccacctacctcgaggcatctggctacccacgtgcccgatactggcgtgaaggacaacatttatcgtaaacctccgatctataggcagcatgccgctagaaggagtgatggcgaagacggcagccttgatcaggataaccgcaagcagaagagttcatggctcatgctgaaaggagacgccgataccagaactaacagtcccgatctggacactcagtctctttcacattccagtggaactgatcgcgaccctctgcaacggatggctggggactcatttcatagccgattcccttactctaagtccgacccgctgcccggtcatggtaaaaacggtcttgatcagcggaacgccaacctggctccttgtggtgcggatcctgacgcatcatggggcatgagggagtataaaatttatccctatgattcactgatcgtgaccaatcgtattcgcgtaaaactacccaaagacgttgaccgcacacggcttgagcgacacttgagccctgaggagtttcaggaagtattcggcatgagcatcgaagagttcgacaggctggccctgtggaagcggaatgacctcaagaagaaggccctgctgttttag

SEQ ID NO: 213068 - DNA, 1566 bp, Artificial Sequence
  Description of Artificial Sequence: Synthetic coding sequence
atgagcgccgtttcccagcctcaggccgctcctagccctttggagaagtcccccagcacagcgatcctctgtaatacatgtggaaatgtgtgtaagggtgaagtactacgggttcaggacaagtatttccacattaaatgcttcgtgtgcaaggcttgtggctgcgacctcgcggaagggggattcttcgtgagacagggagaatatatatgcacgttggactaccaacgattatatggcaccaggtgcttctcatgtgatcagttcattgagggagaagtcgtttcagccctgggcaagacgtatcaccctgattgctttgtttgtgctgtatgccggttacccttcccccctggtgacagggtgacattcaatggcaaggagtgtatgtgtcagaagtgctccctgcctgttagtgtgggctcctcggcgcatctgtcacagggcctgaggagctgcggcggatgcggaactgagataaaaaacggacaggccttggtggcactcgataaacactggcacctgggctgttttaaatgcaagtcatgtggcaagcttctgaatgctgagtatatttccaaggacggcttgccctactgcgaagctgactatcacgccaagttcggaattagatgtgacagctgtgagaaatatatcaccggaagagtgcttgaagcaggtgagaaacactaccacccgtcctgcgccctgtgcgtccgatgtgggcaaatgttcgccgagggggaggagatgtacctacaaggatctagcatctggcacccggcttgcaggcaggcagccagaacggaggaccggaacaaagagacaaggactagcagcgaatcaatcatctcagtccccgcttcctctactagtgggtcccccagtcgggtaatctatgccaagctgggtggtgagattcttgactaccgggatctggcagctctgccaaagtctaaggccatatatgatatcgacagaccagacatgatatcctattccccctatatttcccattctgccggtgatcgtcagagctatggggagggagatcaggacgacaggagctataaacaatgtcggaccagtagccctagcagtacgggatccgtttctctgggacgttatactcctacatcaaggagcccccaacactacagtcgcccagcagcacggagatccgatggggaagatggaagcttagatcaggataacagaaaacagaaatctagctggctgatgttaaaaggcgacgccgatacacgcacaaattctcctgacctagacacccagtccctatcccacagctcagggaccgaccgggatccactgcagcgcatggccggagatagcttccattcccaatataagatatatccttacgactctctgatagtgaccaaccgcatacgagttaaactgccaaaggacgtagaccggactagactcgaacgccacttatcacccgaggagtttcaggaagtgttcggcatgagcattgaggaattcgatcggcttgctctctggaagcgaaacgacttaaagaaaaaggcattactgttctag

SEQ ID NO: 213069 - DNA, 1413 bp, Artificial Sequence
  Description of Artificial Sequence: Synthetic coding sequence
atgagtgctgtgtctcagccacaggcagccccttcaccactggagaagagccctagcaccgccattctctgtaatacatgcgggaatgtctgtaagggcgaagtcttacgtgtccaggataaatacttccatattaaatgcttcgtatgtaaagcttgtggctgtgacctggccgaaggcggatttttcgtgagacaaggtgagtatatttgcaccctggactaccagagactttacggcacccggtgcttcagctgtgatcagtttatcgagggcgaagtggtgtccgcactgggcaagacctatcaccctgactgcttcgtatgcgctgtctgcagattgccgttccctcctggcgacagagtcacatttaacgggaaggaatgcatgtgccaaaagtgcagcttgcctgtgagtgtgggcagctctgcccacttatcacagggcttgcgtagctgcggcggttgcgggacagagatcaagaatgggcaggccctggttgctctggataaacattggcatcttggttgcttcaaatgcaaatcttgcgggaaactgctcaatgccgagtacatcagtaaagatggacttccttattgtgaggctgactaccacgctaagttcggtatcagatgtgatagctgcgaaaagtacatcaccgggcgtgtactcgaagccggagagaagcactaccacccctcctgtgctctgtgcgttagatgcggccaaatgttcgccgagggtgaagaaatgtatctgcaaggatcatcaatctggcatcctgcatgccggcaggctgcccgaaccgaggaccggaacaaagagacaaggaccagctccgagagtataatctcagtgccggcttcttcgacaagcggctcaccctcccgggttatttatgctaagctcgggggagaaattctcgactatagagatctagccgcactccccaaatccaaagcgatttatgatatcgataggcccgatatgattagttacagtccttacatttctcactccgcgggagaccggcagtcctacggagaatcccctcagctgctctcgccaacccccaccgagggggaccaggacgatcggagttacaaacagtgccgtacgagctccccctccagtaccggctcagtgtcccttggcaggtatacgcccacatcaagatccccgcaacattattcgagacctgcagccaggcgaagcgacggagaggacggaagtttggaccaggataataggaaacagaaatccagttggctgatgttgaagggcgacgctgacaccaggacaaacagtccagatctagatactcaatccctgtcccatagttcaggtaccgacagggacccacttcagagaatggccggagactcttttcacagccgagagtggttcttctag

SEQ ID NO: 213070 - DNA, 1938 bp, Artificial Sequence
  Description of Artificial Sequence: Synthetic coding sequence
atgtctgccgtatctcagcctcaggctgcaccaagccctctggagaagagcccttctactgccatcctgtgtaatacatgcgggaatgtctgcaaaggcgaggttctccgtgtgcaagacaagtacttccacattaagtgttttgtttgtaaggcttgcggctgcgaccttgccgagggcggtttttttgtgaggcagggtgagtacatttgtaccctcgactatcaacgcctctacggcacccgatgcttctcttgcgatcagttcattgaaggcgaagtggtgtctgctctcggcaagacctatcatcctgattgtttcgtttgcgctgtctgccggttgcccttccctccaggggacagggtgacgttcaacggcaaggaatgtatgtgccaaaaatgtagtctgcccgttagcgtgggctcgtctgcacacctcagccagggacttcgcagttgtggcggatgcggcaccgagatcaaaaatggacaggcactggtcgctctggacaagcactggcacttgggctgctttaagtgcaagtcttgcggcaagttactgaacgctgagtacattagcaaagatggactgccatattgtgaagctgattatcacgccaagttcgggatacggtgtgattcatgcgaaaagtacatcacaggaagagttctggaggcaggggaaaagcactatcatccctcttgtgccctgtgcgttagatgtggacaaatgttcgccgagggcgaagaaatgtacttacaaggctcttcaatttggcaccctgcctgcaggcaggctgcaagaactgaagatcggaataaggagactagaactagtagcgagagtatcatctccgtgcccgcaagctctaccagcggcagtccctctagggtgatctacgccaagctgggtggtgagatcctggattatagggacctcgccgctctgcccaagagcaaggcaatctatgatattgataggccagacatgatatcctactccccttatatctcacactccgcgggtgataggcagtcctatggagagggagaccaggatgatcgctcatataagcagtgccggactagcagcccatcctctacgggatccgttagccttggacgctatacgcctaccagccgctctccacagcattattctcggccagccggtacagtgagcgtgggcactagttcttgtctgtccctcagccagcacccctctccgacatcagtgtttagacatcattacataccatactttagggggagcgagtcaggccgttctacaccctctctttcagttttgagcgacagcaagcccccaccctcaacctaccagcaggccccacggcattttcatgttcctgacactggggttaaagacaatatctatcggaaacccccaatttacagacagcacgccgctcggaggtccgatggcgaggatgggtcccttgaccaggacaacagaaaacagaaatcctcctggctgatgctcaagggggacgctgacacacgcacaaacagtcctgatttggacacccagtctctctctcattctagcgggacagaccgagacccccttcagcgcatggctggcgactccttccactcaaggttcccctattctaagtccgatccattgcccggacacgggaaaaacggcctcgatcagcgaaacgcaaatctggcaccctgtggcgcagaccctgacgctagctgggggatgagagagtacaaaatttacccttatgacagcctcatagtgaccaacagaattcgggtcaaattacccaaggacgtggataggacaagactcgagcggcacctgtctcctgaggagttccaggaggtatttgggatgtcaatcgaggagtttgaccgtctagcactctggaaacgcaatgacctcaagaagaaagccctgctgttctag

SEQ ID NO: 213071 - DNA, 1680 bp, Artificial Sequence
  Description of Artificial Sequence: Synthetic coding sequence
atgtctgccgtgtcccagccccaggctgctccatcgcccctcgagaaaagtcctagcaccgcaatactgtgtaatacttgcggaaacgtgtgcaagggcgaggtgttgcgcgtgcaggacaagtatttccacattaaatgcttcgtttgcaaagcgtgtggttgtgacttagctgaaggtggctttttcgttagacaaggcgagtacatatgtaccctggactatcagcgtttgtacgggacgagatgtttctcatgtgaccagttcattgaaggcgaggtcgtttcggcactggggaagacctatcatcccgactgctttgtctgtgcagtgtgtcgattacctttcccgcctggtgaccgtgttactttcaacggcaaagaatgtatgtgtcaaaaatgctctttacctgtgtccgttggaagcagcgcacatctgtcccagggactgaggtcctgtggcggatgcgggacagagatcaagaatggacaagctcttgtggcgctggacaagcactggcatctcgggtgctttaagtgtaagtcttgcggcaaacttctgaacgctgaatatatctcaaaagacggcttgccatactgtgaggccgactaccacgccaagttcggaatacgctgtgacagttgcgagaaatatattacaggacgcgtgctggaggcaggggaaaaacattaccacccgtcttgcgccttgtgtgtgagatgtggccagatgtttgctgaaggcgaagaaatgtatctccagggatccagtatctggcacccagcctgtcgacaggcagctcgcacagaagacagaaataaggagaccagaacatccagcgagtccattatctctgtgccagcgagcagcacatccggtagtcctagtagagtcatctatgccaaactggggggagaaatcctcgactaccgagatctggctgccctgccaaaatccaaagccatctatgatattgaccgtccggatatgatcagttatagtccctacatctcccacagcgcaggagatcgccagagttacggggaaggagaccaggacgatagatcttacaaacagtgtcgtactagctcaccatcaagcacagggagcgtcagtttgggtcgctacacgcctacatcccggtccccacagcactattcacgaccagcagcacggcgtagcgacggcgaggatggttctctcgaccaagacaatcggaagaaatcttcctggctcatgctcaaaggggatgcggatacacggacaaatagccctgacttggatacacaatccctgagtcactctagtggcacggatcgagacccactgcagaggatggcaggagacagttttcacagccgattcccatattccaaaagcgacccactgcctggacatggaaagaacgggctggaccagaggaacgccaatctcgccccatgtggggcagatcccgatgcaagctgggggatgcgcgagtacaaaatctatccatacgacagcctgattgttactaatcgtatccgcgtcaagttgccgaaggacgttgacaggacacggctggaacgccacttgtcacccgaagaatttcaagaagtattcggtatgtctatagaagagttcgatcggttggctctttggaagcggaacgaccttaaaaagaaggcactgctgttctag

SEQ ID NO: 213072 - DNA, 1041 bp, Artificial Sequence
  Description of Artificial Sequence: Synthetic coding sequence
atgtttgccgaaggcgaggaaatgtatttacaaggaagctctatctggcatccagcttgccggcaggcagcccgtactgaagaccgcaataaagagacgcgcaccagcagcgagagcattatcagtgttcctgcctcttcaacatccggttctccaagcagggtgatctatgctaaattaggcggtgagatactggactacagggatctcgctgctctacccaaatcgaaagcaatatatgatattgatcgtccagatatgatctcctatagcccgtacatatcacactccgccggagaccggcagtcctacggtgaatccccccagcttctgtcgccaacaccgactgagggcgaccaagacgatcggagctacaaacagtgtcggactagctcgccctcatcgacaggctcagtctctctcggacgttatacccctaccagcagatccccccaacattacagtagaccagacactggagttaaggataatatctatcggaaaccaccaatctaccggcagcacgcagcacgcagatccgatggcgaagacggcagcctggatcaggataatcgaaaacaaaaatcctcatggctgatgctgaaaggtgatgcggacacacggaccaattctccggacctggacacacagtcgctgagtcatagttctggaactgacagggatccgctccagaggatggcgggagactcttttcactctagattcccgtattcaaagagcgatcccttaccaggacacgggaagaacggtctggatcagcggaatgcaaacctggcaccatgtggcgctgatcccgacgcctcttggggaatgcgagagtacaagatctacccctacgactccctcatcgtgactaaccgcatccgggtgaagctgccaaaagacgtagatcgtacgagactggaacggcacctatcacctgaagaatttcaggaagtgttcggcatgagcatagaagagttcgatcgcctcgctttgtggaaacggaatgatctgaagaaaaaggcgttactcttttag

SEQ ID NO: 213073 - DNA, 1716 bp, Artificial Sequence
  Description of Artificial Sequence: Synthetic coding sequence
atgtctgccgtctcacagccacaggcggctccatcacccctagagaagagtccatctactgccatactctgcaatacctgcggtaatgtatgtaaaggagaggtcctccgggtgcaggataagtacttccatattaagtgctttgtatgtaaagcttgcggctgtgatttggccgagggcggattcttcgtccgccagggggaatatatttgcactttggactatcagaggctgtacggaacccggtgctttagctgcgatcaatttatcgaaggagaagtggtatcggccttgggcaaaacatatcatcctgactgttttgtgtgcgctgtttgccggcttcccttcccgccaggcgatcgagtgacttttaacggcaaggagtgcatgtgccagaagtgcagccttcctgtaagcgtgggtagtagcgcacacctttcccagggcctgagaagttgtggagggtgcgggaccgaaataaaaaacgggcaggcgctcgtagccctcgacaagcattggcatttgggctgcttcaagtgcaaatcatgcgggaagctgctaaacgctgagtacatttctaaggatggcctgccctattgcgaagcggattaccacgctaagtttgggattagatgcgattcatgtgaaaagtatatcaccggtagggtgctcgaggcgggagaaaaacattatcacccctcctgtgccctctgcgtgaggtgtggccaaatgttcgccgagggcgaggagatgtaccttcagggctccagcatctggcacccagcctgtaggcaggcagccagaacagaggacagaaataaagagaccaggacatcatcggaatcgatcatttcagtgcccgcatcctctactagcggttcacctagtcgtgtgatatacgccaaactgggtggggagatcctagactatcgagatttggccgctcttccgaaatctaaagccatttatgacattgatcgcccagatatgatctcatattccccctatattagccacagcgccggagaccgacagtcatacggcgagggcgaccaggatgacagaagttacaaacagtgccgtacttcttcaccttcatcgactggatccgtatcactgggccgttatactcccactagccgctctccccagcactacagtcggcctggttcagagagcggcagaagtaccccctctttaagcgtgctctctgactctaaaccccctccttccacctaccagcaggctcctaggcatttccacgtacccgacaccggcgtaaaggacaacatataccgaaagccccctatttaccgacagcacgcggctcgaaggtctgatggcgaggacggaagcctggaccaggataaccgtaaaaaatcctcttggctgatgctcaagggcgacgcagatacccgcaccaacagccctgatcttgatacacagtctctcagtcatagctctggcaccgatagggaccctcttcagagaatggctggagattcattccacagccaacagatctatccctacgacagtctcattgtgactaataggatccgcgtgaaactgcccaaggatgttgacagaaccaggctggaacggcatctatctcctgaggagttccaggaagtatttggtatgagcatcgaggagttcgataggctagcactttggaagagaaacgacttgaagaagaaggcactcctcttctag

SEQ ID NO: 213074 - DNA, 1596 bp, Artificial Sequence
  Description of Artificial Sequence: Synthetic coding sequence
atgagcgccgttagtcagcctcaggcggcaccctctccactggagaaatcccccagcaccgcgatcctgtgcaatacctgtggtaacgtctgcaagggagaggtcctgcgggtgcaggacaaatacttccacataaagtgctttgtgtgcaaggcttgcggctgtgacctggcagagggagggttttttgtccggcagggagagtatatctgcacgctggattatcagcggctgtacgggacacgatgcttctcgtgcgatcagttcatcgaaggagaagttgtcagcgccctcgggaaaacttatcatccagactgctttgtgtgcgctgtgtgtaggctgccatttcctcccggtgacagagtcacgtttaacggaaaagaatgcatgtgccagaagtgttcgctgcctgtgagcgtaggatccagtgctcatctctctcaaggcctgcgctcttgtggagggtgcggcacggagattaagaacggacaagctctggtggccctcgataaacactggcatctcgggtgcttcaagtgcaagagctgcgggaaactgttgaatgccgagtacatcagtaaagatgggctgccctactgcgaggctgattatcacgccaagttcggaataaggtgcgattcgtgtgagaagtacatcacagggagagtgcttgaggccggtgagaaacattatcacccctcttgtgccctgtgtgttcgttgtggacagatgttcgccgagggcgaagaaatgtacctgcagggaagctcaatttggcaccccgcatgtcggcaggctgcgagaactgaggaccggaacaaagagacaaggacttccagtgaatccataatctccgtgcctgccagcagcaccagtggatcacccagcagggtaatctatgccaaactggggggtgaaattcttgactaccgagacctcgccgctcttcctaaaagcaaggctatttatgacatcgatcggccagacatgatctcttacagcccgtatatctcccactcagctggcgacagacagagttatggtgagtcaccccaactgctgagccccacaccaaccgagggggaccaagatgacaggtcctacaaacagtgccgtacctccagccccagttctacggggtcagtgtcccttggcaggtacacacccacatctagaagtcctcagcactactcacgaccagctgccagaaggtctgacggtgaggacggctcattggaccaagataacaggaaaaaaagctcatggctaatgttgaagggcgatgcagatacgcggaccaactcacctgatttagacacacaatccctgagtcattcaagcggaaccgaccgagacccactccagcgcatggcaggagactcatttcacagccgcgagcagatatatccctacgactcgctcattgtgactaacaggatccgcgttaaactgcctaaggacgtggaccgcactcgactagagaggcacctcagcccagaggaattccaagaagtctttgggatgtcaattgaggaattcgaccggctggcgctgtggaagcggaacgatctcaagaagaaggctctgttgttctag

SEQ ID NO: 213075 - DNA, 2193 bp, Artificial Sequence
  Description of Artificial Sequence: Synthetic coding sequence
atggaagagttgatagttgaactcaggctttttctcgagctgctggaccatgaataccttaccagcactgtgagagaaaaaaaggctgttatcactaacatcctcctaagaatccaaagtagtaagggttttgatgtgaaagaccatgcgcaaaagcaggagactgcgaacagcctaccagcgcctccacagatgcctctgccagagatacctcagccttggctgcctccggacagtgggcctccacccctgccgacctcatcgcttccggaaggctactatgaagaggccgtgcctttgtccccaggcaaagcccctgagtacattaccagtaactacgactctgacgctatgtcaagctcatacgaaagttatgacgaggaggaggaggacggcaaggggaaaaaaactaggcaccaatggccttcagaggaagcttcaatggatctcgtgaaggatgccaagatctgtgccttcctgcttagaaagaaacggttcggacagtggaccaagttgttatgcgtcataaaggataccaaattgttatgttacaaatcttccaaagatcagcagccacaaatggaactgccattgcaggggtgtaatattacctacatccctaaggatagtaagaagaaaaagcacgaattaaaaattactcagcaggggactgaccccttagttctggcagtccagtccaaggaacaagctgaacagtggctaaaggtgatcaaagaagcctattctggctgtagcggccctgtggactcagagtgtcccccacctcctagctctcccgttcataaagcggaactcgaaaaaaagttaagcagtgagagaccttcttccgacggggagggggtggtggagaatgggattaccacttgtaacggcaaagagcaggtgaagagaaagaaatcctctaagtcggaggcgaagggaaccgtcagtaaggtgactggaaagaagattactaaaattatctccctcggcaagaaaaagccaagcacggatgagcagacctccagtgctgaggaggatgtccccacatgtggctatttgaacgtattaagcaattcacggtggcgagagaggtggtgtcgagttaaagataacaaactcatttttcataaagaccgcacagatcttaaaacacatatcgtcagcatcccgctgcgtggctgcgaagtgatcccgggactcgattctaagcatcctctgactttcagactgttgcgcaatggccaggaggttgcagtgttagaagcctccagtagcgaagatatgggtcgttggatcgggattttgttagcggaaaccgggagcagcacagatcctgaggctttacactatgactacattgacgtggagatgtctgcctccgttattcaaacggcgaagcagacattttgcttcatgaacaggcgagtaatctctgcgaacccctatctgggcggaactagtaacggttacgctcatccttctggcacagccctccattatgatgatgttccttgtatcaacggttcgctgaaaggaaagaagcccccagtcgcaagtaatggggtcaccgggaagggaaagacgctgagcagtcagcccaagaaggcagaccctgccgcagtggtgaagcgtaccggttccaacgcagctcagtacaaatatgggaagaatcgggtagaggccgatgcaaagcgactgcagacaaaggaagaagagcttctcaagcgaaaagaagcactccgcaatagactggcccagctacgaaaagagagaaaagacttacgtgcagcaatcgaggttaatgctgggcgtaagccccaagctattctcgaggaaaagcttaagcaacttgaggaagagtgtcggcagaaggaagctgaaagagtaagcttggaactggaattgacagaagtgaaggaatccctgaaaaaagccctggccggaggtgttactctaggacttgcaatcgaacctaagtctggtacaagttcgccccagagccctgtctttaggcatagaacgcttgagaattctccaatctccagctgtgacacatctgatacagagggtcccgtgccggtgaacagtgcagccgtgctgaaaaaatctcaggctgcacccggaagtagcccttgtagggggcatgttctgcgtaaggcaaaagagtgggagctaaagaacggtacctag

SEQ ID NO: 213076 - DNA, 2193 bp, Artificial Sequence
  Description of Artificial Sequence: Synthetic coding sequence
atggaggagctcattgtggagctacgcctgttccttgagctgctggatcacgaatatctgacctctacagtaagagaaaaaaaggctgtcattaccaatatcctcctgcggatccagtcctccaaagggtttgatgtaaaagaccacgcacagaagcaggaaaccgccaactcacttcccgctccgccacagatgccgctgcccgaaattcctcagccctggctgccacccgactctgggcctcccccactccctacttcctccttgccagaaggctactacgaagaagccgtaccactcagccctggcaaagccccagagtatatcacaagcaactatgacagcgatgctatgtccagcagctacgagtcttacgatgaggaggaggaagatggaaagggaaaaaagacacgacatcagtggccctccgaggaagcttctatggatctggtcaaggacgctaagatctgcgcatttctgctccgtaaaaaaagatttgggcaatggaccaaactgttatgcgtgattaaagacacaaagctgctttgttacaaaagtagcaaagatcagcaacctcaaatggaattgccccttcagggctgtaatatcacttatattccaaaggatagcaagaaaaaaaagcatgaactcaaaattacccagcagggaactgatccacttgtgttggccgtacagagcaaagagcaggcagaacagtggttaaaagtgatcaaggaggcttactccggctgtagtgggcctgtggattcggaatgtccaccccctccgagtagccccgttcataaggccgaacttgaaaagaaattgtcttcagagcgcccttcgagtgacggggaaggcgttgttgagaatggaattaccacatgtaatggcaaggagcaggtgaagcgaaagaagtcatcaaagtcggaagcaaaggggactgtgtccaaggtgactgggaaaaagatcacaaagatcatttcactggggaagaaaaaacctagcaccgacgagcagactagctctgccgaagaagacgtccctacatgtgggtacttaaacgtgctgtctaattccagatggcgcgagcggtggtgtcgggtcaaggacaacaaactcatctttcacaaggatagaaccgacttaaagacgcatattgtgtcaatccctctccgcggttgcgaagtcataccagggctggactctaagcaccccctcactttccgactactgagaaatggccaggaggtcgctgtcctagaggctagcagtagcgaagatatgggacggtggatcgggatcctcctggccgaaactgggtcatcaacagaccccgaggccctgcactacgactacattgacgtcgagatgtcagctagcgttatccagacggcaaagcagactttctgtttcatgaatagaagggtgatctccgccaacccgtacttggggggtacctccaacggatacgcccaccctagtggaactgccctgcactacgatgatgtaccatgcatcaatgggtccttaaagggtaaaaaaccaccagtggcctctaacggcgtcactggtaagggaaaaactctgtcatctcagccaaagaaggctgatcccgcagccgtggtgaagcggactggcagtaatgccgctcagtataagtacggaaaaaacagggttgaggccgacgctaaaaggcttcaaaccaaggaagaagagctgcttaagagaaaagaggcccttaggaatcgcctggcccagcttaggaaagaacggaaagacctgagagctgcaatagaagtaaacgccggacgtaagcctcaagccatacttgaggagaaactcaagcagctggaagaggaatgcagacaaaaggaggctgagcgggtaagcctggaattggagctgactgaagtcaaggagtcccttaagaaggcactggctggtggcgtgactctggggttggccatcgaacctaagtccggtacttctagccctcaaagccccgttttccgacatcgaaccctggagaattcgcctatttctagctgcgacaccagcgacacagagggcccagtgcccgtgaactcagcagcagtgttaaaaaagagccaagccgctccaggctcgtccccctgtaggggtcacgttctccggaaagcgaaggaatgggagctcaagaatggtacgtag

SEQ ID NO: 213077 - DNA, 2445 bp, Artificial Sequence
  Description of Artificial Sequence: Synthetic coding sequence
atggaagagttgattgtggaattgcgactgtttctggagcttctcgatcacgaatatttgacttcaacagtacgcgagaagaaggctgtgataaccaatattctgttgaggattcaaagtagtaagggcttcgatgttaaggaccatgcccaaaagcaggagacagccaactccctaccagctccacctcaaatgccgctcccagaaattccacagccctggctcccaccggacagcggaccaccgcctctgcctacgagttcactgcctgaggggtactatgaggaggccgtacctctatcaccaggcaaagcaccagaatatatcacctctaattatgattctgacgccatgagcagcagctacgagtcatatgacgaagaggaggaagatggtaagggcaaaaaaacccgacaccagtggccatccgaagaggcttctatggacttggtcaaggatgccaaaatttgcgctttccttctgaggaagaagcgttttggacaatggactaagctactgtgtgttatcaaagacacaaaattgctgtgctacaaatccagcaaagaccagcagccgcaaatggagctccctctgcaggggtgcaacattacctacattccaaaagactctaagaagaaaaaacacgagctaaaaattacacagcagggaacagatccgctggtgctggctgtccagtctaaagagcaggccgagcaatggttaaaggtgataaaagaggcctactccggttgctcaggcccagtggatagcgagtgccctcccccaccatcaagccctgtgcacaaagccgagctcgagaagaaactaagcagcgagcgaccaagtagcgatggggaaggcgtggtggaaaatggaataacaacgtgcaacgggaaggaacaggtgaaaaggaaaaagtcgagcaaatctgaggctaagggaactgtcagtaaagttaccggaaaaaagataactaagatcatttcactggggaagaagaagccctcaacagacgagcagacgagcagcgcagaagaagacgttccaacctgtgggtatctcaacgttctgtcaaactcacggtggcgagaacgctggtgtcgcgttaaagataacaaactgatcttccataaggatagaaccgatcttaaaacacacattgttagcattcctcttcggggatgcgaggtaatcccgggacttgattctaaacaccccctaacattcagactcttaaggaatgggcaggaggtggcagtcctggaggcaagcagctcagaagacatggggcgatggatcggcattctgctcgctgagactggcagttcaaccgacccagaggctttgcactacgactacattgatgttgagatgtcagcgtctgttattcagacagccaaacagaccttctgctttatgaaccgccgagtcatttctgcgaatccataccttggagggacaagcaatggttacgcccatccctccggtaccgcattgcactatgatgatgtcccatgtatcaatgggagctgggaacccgaagacggatttccagcttcctgctctagaggactgggtgaggaggtgctatacgataacgccggactctatgacaacctgccccctcctcacatttttgcccgatacagccctgcagacaggaaggcttcccggctctctgccgataagctgtcttctaatcattacaaatacccagcatctgcccagtccgttacaaatactagctcagtgggaagagcatctctcgggttgaattcccaactcaaggggaaaaagccacctgtggcttcgaacggtgtcaccggaaagggaaaaacattaagctcccaaccaaagaaagcagacccggcagctgtggtcaaaaggaccggcagtaatgcggctcagtacaagtatggaaagaatcgggttgaggctgatgccaagagattgcaaactaaggaagaggagctcctgaaacgcaaggaagctctgagaaatcgccttgctcagttacgaaaggagcgtaaagatcttagggccgctatcgaagtcaacgcgggacgcaagccccaggcaattctggaggagaaattaaagcaactggaagaggaatgcaggcagaaggaggccgaacgcgtgtcccttgagctggaactgacggaagttaaggagtctctcaaaaaggccctcgccggaggagttactttagggcttgcaatagaacccaagagcggaacgtcttcacctcagtctccggtgtttcgccaccgtactctggaaaattcaccaatctcaagctgtgatacttctgacaccgagggtccagtgcctgtgaactcggccgctgtgctgaagaaatcccaggccgctcccggaagctcgccatgtcggggtcatgtgcttcgaaaagcaaaggagtgggaattaaagaacggcacctag

SEQ ID NO: 213078 - DNA, 2307 bp, Artificial Sequence
  Description of Artificial Sequence: Synthetic coding sequence
atggaccgagggcaggtgttggaacagttgctgcctgaattaactggtctgctgtcactgctcgatcacgagtatctcagtgacactacactggaaaagaagatggctgttgccagcattctgcagagcctgcaacccttgccagccaaggaggtctcgtatctgtacgtgaacactgccgatttacattccggcccatccttcgtggaatccttatttgaggaatttgattgcgatctgtccgaccttcgggacatgcctgaagatgacggcgagccttccaagggcgcatcgccggagttggcgaagtcccctaggttgcgcaatgccgctgatctgccgccacctctacctaacaagcctcccccagaagattactacgaagaagctctgcctctgggtccaggcaagtcgcccgaatatatatcatctcacaatgggtgttcaccttctcattccattgtggacggttactatgaagatgctgatagctcgtacccagccacacgggttaacggggaactgaaatcctcctataacgactctgatgcaatgtctagcagctatgagtcttatgacgaggaagaagaggaaggtaagagtccgcagccacggcaccagtggccttctgaggaggccagtatgcaccttgtccgcgaatgccgaatttgcgcctttctgctccgcaaaaagcggtttgggcagtgggcaaagcagctaactgtgatcagagaagatcagttactgtgctataagagcagcaaagaccgccagccacacttacgtctggccctggatacttgctccatcatttacgtgcctaaagacagccgacacaagaggcacgagctgaggtttacccagggcgcaactgaggtgctggttctagcattgcagagtagggaacaggctgaggagtggttaaaggtgatacgggaagtgtcaaagcctgtaggtggagcagagggagtggaggtgcccaggtcccccgtcttgctgtgcaagttagacctggacaagaggctgagtcaggagaaacagacatctgatagcgattctgtgggagtcggagataactgctctacactgggcagacgtgagacctgcgaccacggtaaaggcaagaagtctagcctggcggagctgaaagggagcatgagcagagccgcaggcaggaagattacacgcataattggattcagcaagaaaaaaaccctcgccgacgacttacagacttcctccaccgaagaagaagtcccctgctgtggatatctaaacgtcctcgtgaatcaggggtggaaggaacgttggtgccgtctcaaatgcaacaccctttattttcataaagatcatatggacctgcggacccatgtgaatgcgattgcactccagggatgtgaagtcgctccgggttttggaccacggcacccttttgctttccgtattctccgcaatcgccaagaggtggcgatcttggaggcctcctgttccgaagatatggggagatggctgggtctgcttcttgtagaaatgggttctcgagtcactccagaagccctgcactacgattacgtggacgtcgagacactaactagtatagtgtctgctggcaggaactcgtttttatatgcaaggagctgccaaaatcagtggcccgagccacgggtgtatgacgatgtgccctatgaaaaaatgcaagacgaggaacctgagagaccaactggcgctcaggtaaaaaggcatgcttctagttgttcggagaaatcccatcgcgtggatcctcaagtgaaggtcaagaggcatgccagctccgctaaccagtataaatacggcaagaatagggctgaggaagatgccaggagatacctggttgaaaaggagaagctcgagaaggaaaaggagacgatccgaacagaattgatcgctctgcgtcaggaaaagagggaactgaaggaagcaattcggagttcacccggtgccaagctgaaagccctggaagaagcagtcgcaacgctcgaggcccagtgtcgcgctaaagaggagcgacgaatcgatttggagctcaaacttgtggccgtgaaagagcggttgcagcaatcacttgccggtggtccggcactggggttaagcgtatcctccaagcccaaatccggagaaacggccaacaaaccgcaaaactcggtgcctgagcaaccccttccagtaaattgtgtttctgagctgcggaagagaagcccgtctattgtagcctcgaaccaaggcagagtccttcagaaggctaaagaatgggagatgaagaagacctag

SEQ ID NO: 213079 - DNA, 2178 bp, Artificial Sequence
  Description of Artificial Sequence: Synthetic coding sequence
atggatcggggacaggttctcgagcagcttctgcctgaacttaccggcctcctctctctgctggatcacgagtacctttctgacacaactcttgagaagaagatggctgtggccagcattctacagagcctccagcctctgccggcaaaggaggtgtcttacctatacgttaacaccgccgacctgcacagtggcccatctttcgtggagtccctcttcgaggagttcgattgtgatctgtcagacctaagggatatgccagaggacgacggtgaaccctctaagggtgcctccccggaacttgccaagtctcctaggctccgtaacgcagctgatttgccaccaccactgccaaataagccacctccagaggattattatgaggaagctctcccactcgggccagggaagagtcccgaatacatctccagtcataatggatgctcgccttctcatagcatcgtggacggctattacgaggatgcggactcctcctacccagctactcgggtcaacggcgagctaaaatcaagttataacgactccgatgccatgagttcctcgtatgagagttatgatgaggaagaagaggagggcaaatccccacagccgagacaccagtggccaagcgaggaagcaagcatgcacctggtccgagaatgccggatatgtgcgttcttgctccgcaagaagcggttcggccagtgggcaaagcagctgacagtcatccgagaagatcagctgctttgttacaagagcagcaaagaccgccagccccacctgaggcttgcacttgacacgtgctcaatcatatatgtgcccaaggacagcagacataaaagacatgagctcaggttcacgcaaggcgctacagaggtgctggtgttggccctgcaaagcagagagcaggcagaggagtggctgaaggtaatcagggaagtgtccaaaccagtggggggtgcagagggagtcgaggttccacgtagtcctgtcctgctgtgcaagctggatctcgacaagagactctctcaggaaaaacagacatccgattccgatagcgtgggagtcggcgacaattgtagcacactgggtcgacgagagacctgtgaccacggaaaaggtaaaaaatctagcctagccgaactgaagggctccatgtctagggcagccggtaggaagattactcgtatcatcggcttctcaaaaaaaaaaaccctcgctgacgatctccaaacatcatctacggaggaggaagtcccctgctgcggctacctgaacgtactggtcaaccaggggtggaaggagcggtggtgtcggcttaagtgtaatactctctatttccacaaggaccatatggacctcaggacacacgttaacgctattgctcttcaggggtgtgaggtggctcccggttttggacccagacatcccttcgctttcagaatactgcgcaatcggcaagaagttgctatcctggaggcttcatgctccgaagatatgggcagatggctgggcttactcttagtggaaatggggtcacgggtcacccctgaggcactacactacgattatgttgatgtggagactcttacttcaatcgtaagtgctgggcgaaattcgtttctgtatgcacgtagctgtcaaaatcagtggccagagccgcgagtgtacgatgatgtcccatacgagaaaatgcaagatgaggagcccgaacggccaaccggagcacaggtaaaacgtcatgcatcttcatgctctgagaaatcccacagagtggacccacaggttaaggtgaagagacacgcctcaagcgctaaccaatacaagtacggcaagaacagggccgaggaggatgcgaggaggtacctggtggagaaggagaagttggaaaaggagaaagagacaatacgcacagagctgatcgcgctgagacaggaaaaacgcgagctgaaggaagctattaggtcttccccaggggcaaagctgaaggctcttgaggaagcagtagccactttggaggcacagtgccgtgccaaagaggagagacggattgatctggagttaaagctagtagccgtgaaggagcgcttgcaacagagcctggcaggcggacccgctctgggcttgtccgtcagctccaagccaaagtctggggaatgggagatgaagaaaacgtag

SEQ ID NO: 213080 - DNA, 2457 bp, Artificial Sequence
  Description of Artificial Sequence: Synthetic coding sequence
atggaaaggtataaagctttggagcaattactcacagaattagacgacttcctgaaaattctcgatcaggagaatttgtcctccacagcattggtgaaaaaaagctgtctcgctgaactgttaaggctgtacacaaaatcctcatctagcgacgaagagtacatttacatgaacaaagtgaccataaacaagcagcaaaacgcggagagccagggtaaggcaccagaagaacagggactgttgcctaacggtgaaccaagtcaacactcctccgcaccacaaaaaagcctccctgacctcccgccaccaaaaatgatccctgagagaaagcagctcgccattcctaaaactgagagcccagagggctattacgaagaggctgaaccttatgacacaagtctgaacgaggatggcgaggctgtgagcagtagctacgaaagttacgatgaggaagacggatcaaagggcaagtctgcaccctaccagtggccctctcccgaggccggtatcgagttgatgagggatgcccgaatctgtgccttcttgtggaggaagaaatggctgggccaatgggcgaaacagctgtgtgtcattaaggataatcggctcctgtgctataaatcctctaaagatcattccccacagctggatgtcaatctgctcggcagtagcgtgatacacaaggaaaagcaagtgcggaagaaggaacataaattgaagatcacccctatgaatgccgatgtgattgtgctggggctccagtcaaaggaccaggctgaacagtggttgagagttatccaggaggtatctgggcttccaagtgagggcgcttcagaggggaaccagtacacacccgatgcacagagatttaactgccagaaaccggacatcgccgaaaaatatctttctgcgagtgagtacggaagttctgtagacggtcaccctgaagtccctgaaacgaaagacgtgaaaaagaagtgcagtgccggactgaaattgtcaaatctcatgaacctggggaggaagaaatcgacgtcattagagccggtcgagcgatccctcgaaacatcttcttatctgaatgtgttggtgaacagccagtggaagtcgcgatggtgctctgtacgagacaaccatctgcatttttaccaggacagaaaccgatcaaaggtggcccagcagccactgtccctcgtcggttgcgaagttgtgcctgacccttcaccagaccacctgtatagcttcaggatccttcacaaaggcgaagagctggccaaactcgaagccaagtctagtgaggagatgggccattggcttggtctgctgctgagcgaatctgggagtaagaccgaccccgaggaattcacgtatgattacgtggacgctgatcgggtctcctgtatcgtgagcgctgcaaagaattcgctgctactgatgcaaagaaagttcagcgagcccaacacatacatcgacgggctgccatctcaggatcgccaggaggagctgtacgatgatgtagacctttctgagctgacagccgcagttgaaccaaccgaggaagcgactccagtggcggacgacccgaacgagcgagaaagtgatcgcgtgtatttggacctgacacccgtgaagagctttctgcacggtccatcgtccgcccaggctcaagcctccagtccaaccctcagctgcctggacaatgcaacagaggcactgcccgcagactctgggcctgggccaactcccgacgaaccatgtatcaagtgccccgaaaatcttggcgagcagcagcttgagtccctagaacccgaggatccctcgctgagaattacaaccgtgaagattcaaacagaacaacaacgtatctcttttccacctagctgccctgacgcagtcgttgctacaccaccgggtgcttcaccccctgtcaaagacagactacgggtgactagtgccgaaatcaaactcgggaaaaatagaacagaggcagaagttaaacgctacacagaagagaaagaaaggctcgagaagaagaaggaggagattaggggacacttggcgcagcttcggaaagagaaacgggaactcaaggaaaccctattgaagtgcaccgataaggaagtgctggcgtcactcgaacaaaaacttaaggaaatagacgaagaatgtcggggagaagaaagtagacgcgttgatcttgagttgtctatcatggaagtgaaagacaatctgaagaaggcggaggcaggacctgttacattggggacaaccgttgatacaactcacctagagaacgtgtctccaagacccaaggcagtgaccccagcttctgcacctgattgtacccctgttaactccgcaacaaccttgaaaaataggccactgagtgtggtggtgacaggcaagggcaccgtgctgcaaaaggctaaagaatgggagaagaagggtgcgagctag

SEQ ID NO: 213081 - DNA, 2445 bp, Artificial Sequence
  Description of Artificial Sequence: Synthetic coding sequence
atggaacggtacaaggccctggaacagctgctgaccgaattggatgacttcctgaagattctggaccaggaaaatctctctagcacagcattggtaaagaagtcctgcctcgctgagttgctccgattgtatacgaaaagtagttctagtgacgaagagtacatctatatgaataaggtgactattaataaacagcagaacgcggagagtcagggtaaggcaccagaggagcaaggtttgctaccaaacggggagccctcccaacactccagtgctccccaaaaatctctgccagacctaccacctcccaagatgattcctgagaggaaacagctggcaattcctaaaaccgaatcccctgaagggtactatgaggaggccgagccttacgacacgagtcttaatgaggatggtgaggccgtaagttcctcctacgaatcctatgacgaggaggatggctctaaagggaaaagcgcaccataccagtggccttctcctgaagctggcatcgagctcatgcgagacgccagaatctgcgccttcctttggagaaaaaaatggctggggcagtgggcaaagcagttgtgcgtcatcaaagataaccgccttctgtgttataagtcatctaaggatcatagcccgcagcttgacgtgaatctgctaggttcatctgtgatccacaaggaaaaacaggtgcgaaagaaggagcataaactaaagataactcctatgaatgccgacgtaattgtcctcggattacagtccaaggatcaagctgagcagtggctccgggtcatccaggaagtgagcgggttgccatctgagggtgccagcgagggcaatcagtacaccccagacgctcagcgcttcaactgccagaagcctgacattgccgaaaagtacctgtcagcctctgagtatgggtcatctgttgatggccacccagaagttccagaaactaaggacgttaagaagaaatgcagcgctggcctgaaactctctaatctcatgaaccttgggaggaagaaatctacaagcctggagcccgtcgaaagatcactggaaacatcctcctacttgaatgttttggtgaattcgcagtggaagagccgatggtgcagtgtcagggacaaccacctgcacttctaccaggacagaaatagaagtaaagtagctcaacagcccttatcgctggtgggatgtgaggtggtccctgatccctcccctgatcatctctatagtttccgcattcttcataaaggagaggaacttgccaagcttgaagccaagtccagcgaggaaatggggcactggttgggtctcctgttgagcgaaagcgggtcaaaaaccgatcctgaggagtttacttacgactatgtcgacgccgacagggtgagctgtatcgtgtcggcagcaaagaacagcctgctcctcatgcagaggaagttctcagaaccgaacacttacatcgatggactgcccagccaggacaggcaagaggaactttacgatgatgtggatctctccgagttgacggcagccgtggagcctaccgaggaggctacacccgttgccgatgaccccaatgagcgggagtcagacagagtgtatcttgacctgactcccgttaagtccttcctgcacggcccatcttcggcccaagcccaggcctcgagcccgacactcagctgcctggacaacgctacagaggcactgcccgctgacagcgggccaggccctactcccgacgagccatgcatcaaatgccccgagaatctcggcgaacaacagctggaatcccttgagcccgaggatcctagtcttagaatcacaacggttaagattcagaccgagcagcagcgtatctcatttcccccttcctgtccagacgccgtcgtggcaaccccccctggtgctagtcccccagtgaaagatcgtctgcgtgtgacctctgctgaaatcaaattaggtaaaaatcgcacagaggcggaagttaaaagatacaccgaggagaaggagcgcctggaaaagaaaaaagaagagattaggggccatctggcgcagctgcggaaagaaaagagagagctcaaggagacactcctcaagtgcaccgataaagaggtgctcgccagtctcgaacagaaactcaaagaaatcgatgaggaatgtcgtggcgaggaatctagacgggtcgacctggagctctccattatggaggtcaaggacaatcttaagaaggccgaagccggacccgtgacccttgggaccactgtggacactactcatttggagaacccgaaggcagtcacccctgcatcagccccagattgcacacccgtgaacagtgcaaccacgctaaaaaatagaccgctaagcgtggtggtcacagggaaaggcactgtcctacagaaggcaaaagagtgggagaaaaagggggcttcctag

SEQ ID NO: 213082 - DNA, 2526 bp, Artificial Sequence
  Description of Artificial Sequence: Synthetic coding sequence
cagcgggtaagggcactggagcaattgctcacagaactggacgacttcttgaagattctggaccaggaaaatctatcttctaccgctctggtgaaaaagtcctgtctcgcggagctgttgcggctgtataccaaaagttcttccagcgatgaagagtacatatacatgaataaggtcaccattaataaacagcagaatgccgagagtcaaggaaaagcgcctgaagaacagggactgctgcctaacggggaaccaagccagcacagtagcgctcctcaaaaaagcctgcctgacctcccgccacccaagatgatccctgaaagaaaacaactcgctattcctaaaactgaatccccggagggctactacgaggaagccgagccctacgacacctcccttaacggccactccggaggatttctcccaaccggggtgccacgctgggttcaggtccctgaaggggtgatatatgccaccatcacactcgaagatggggaggcagtgtcaagttcatatgagtcttacgacgaagaggatggctcaaaagggaagtccgctccatatcagtggccttctcctgaagctggaatcgagctgatgagagacgcccgtatttgcgccttcttgtggcggaagaagtggcttgggcaatgggccaaacagctttgtgttattaaggacaatcgcctgctatgctataagtcctcaaaagaccatagtccccaattggatgtaaaccttttgggcagcagtgtaatccacaaagagaaacaggtgaggaaaaaagagcacaagctgaagattactcccatgaacgcagatgtaatcgtacttggtctgcagtccaaagatcaggctgagcagtggcttcgggtgatacaagaggtgtctgggttgccatccgagggggcatctgagggaaaccagtacactccagacgcacagagatttaattgtcagaagccggatatcgcagagaagtacctgtctgccagtgagtacggaagcagcgtcgacggacaccccgaggtaccagagaccaaggatgtcaagaagaaatgtagcgcgggtttgaagctttctaatctgatgaatctcggtagaaaaaaatccactagtctcgaacccgtagaacggagcctcgagacaagtagctatctgaatgtccttgtgaattcccagtggaagtctaggtggtgctccgtgagggataatcacctccacttttatcaggaccggaatcgttcaaaggtggctcagcaaccacttagtttggtcggatgcgaagtggtgcctgacccaagtcccgatcatctttactcctttcgaatcctgcacaagggtgaagaactcgccaaacttgaagccaagtcgagtgaggaaatgggccattggctgggactgctcctgagcgaaagtggcagtaagactgaccccgaggaatttacctatgactatgtggacgctgatcgagtctcttgcattgtgtccgcagccaaaaactccctgctccttatgcagcgaaagttcagtgaaccaaacacttatattgacgggctcccatcacaggacaggcaagaggagttgtacgatgatgtggatctctcagagttgactgcagccgtagagccgacagaggaggccacacctgtggccgatgaccccaacgagcgagaatcggatcgggtgtacctagacctcaccccagtgaaaagttttcttcacgggccaagcagcgcccaggcccaggcctcttcacccaccttgtcctgccttgacaatgctaccgaagccttacctgccgactccggaccgggaccaacacccgatgagccgtgcataaagtgccccgaaaaccttggagaacaacagttggagtctctggaaccagaagaccccagccttaggatcaccaccgtgaaaatccagactgagcagcagagaatttcgtttccacctagttgtcctgacgcagtggtggcgacccctccaggagcctctcctccagtcaaggaccgccttagagtaacctcagctgagatcaagttgggtaaaaaccggactgaagccgaagtgaaaagatacactgaagagaaggaacgcttggagaaaaaaaaggaagaaatcagaggacatctagcccaactgcgaaaagaaaaaagggaactgaaagagacactcttaaagtgcactgataaggaagtgcttgcaagcctagaacagaaactcaaggagatcgacgaagagtgtcggggagaggagtcacgcagagttgatctggagctgtctattatggaggtcaaagataacttgaagaaagccgaggctgggcctgtcacccttgggaccaccgttgacaccacccatctggaaaacccaaaggcagttactcccgctagtgcacccgattgcaccccagttaattcagctactaccctgaagaaccgcccactctccgttgttgtcaccggcaaggggactgtcctgcagaaagcaaaagagtgggagaagaaaggcgctagctag

SEQ ID NO: 213083 - DNA, 939 bp, Artificial Sequence
  Description of Artificial Sequence: Synthetic coding sequence
atggagcggtacaaggcacaagggtgctgttgtctggtcgttcagagacgtatcagacaagtctccgccagcttggaacagctgctgactgagctagacgatttcctcaaaatattagatcaggaaaatctgtcctccaccgccctggtgaagaagtcttgtctagccgaactcctgcgattatacaccaagtcaagttctagcgacgaggagtacatctacatgaacaaggtgactataaacaaacagcagaacgctgagagccaagggaaagccccagaagagcagggactattgccaaacggagaaccctcccagcattcgagcgctccccaaaaatctttgcccgatctccccccacctaaaatgatccccgaacgcaagcaactggctattcccaagacagagagcccagaaggctattacgaggaagcggaaccctacgatacctctctgaatgaggacggcgaagccgtttcctcttcgtatgaaagttacgacgaggaggatgggtctaagggaaagagcgccccttatcagtggccttcccccgaagccggaatcgagctgatgcgagatgcccgtatctgcgcatttctctggcgaaagaagtggcttggtcaatgggcgaagcaactttgtgtcataaaggacaaccggttgctatgctacaagagttccaaagatcactctcctcagcttgacgtcaatctgcttggctcatccgtcattcacaaggaaaaacaggtccggaaaaaagagcacaagctaaagattacaccgatgaacgcggacgttattgttcttggcctgcaatccaaggaccaggccgaacagtggctgagggtaattcaggaggtttcagggctgcctagcgagggcgctagcgagggcaatcagtacacgcctgacgctcagcgctttaattgccagaagtag

SEQ ID NO: 213084 - DNA, 939 bp, Artificial Sequence
  Description of Artificial Sequence: Synthetic coding sequence
atggaaagatacaaggcccagggctgttgctgcctggtagtgcagagaaggatcagacaggtgagtgccagccttgaacagcttctgactgagcttgacgactttctgaagatcttggaccaggagaatcttagtagcacggcccttgtcaaaaaatcatgcttggctgagctgttgagactgtacactaaatcttcttcctcagacgaagagtacatttatatgaataaggttaccattaacaaacagcaaaatgccgaaagccaggggaaagcgccagaggagcaaggtctcctgccaaatggcgaaccgagccaacattcatccgccccacagaagtcactgcccgacctgccacctcccaagatgatcccggaacgcaaacagctggccatccccaagacggagagtcctgagggatactatgaagaggctgaaccatacgatacatccctgaatgaagacggcgaggccgtgtcatccagttacgaatcatatgatgaggaggacgggtccaaggggaagagtgcaccatatcagtggccaagcccggaagccggtatcgaactgatgcgggatgccagaatttgtgcattcctctggaggaagaaatggttgggccagtgggccaagcaactgtgcgtcatcaaggacaatcgattgttatgttacaaatccagcaaagatcactcccctcagctggacgtgaatctactcggctccagtgttatccacaaagagaagcaggtgagaaaaaaagagcataagctgaaaatcacaccgatgaatgccgacgttatcgtgcttggactgcagtccaaggaccaggcagagcagtggttgcgggtgatccaggaggtgtcgggactgcctagcgagggcgcatctgaaggcaaccaatatactccagacgcccagaggttcaattgccagaagtag

SEQ ID NO: 213085 - DNA, 2616 bp, Artificial Sequence
  Description of Artificial Sequence: Synthetic coding sequence
atggaaaggtacaaggccctggaacagctactgactgagctggacgacttcttaaaaatcctagatcaggagaacctgtcctcgacggccctcgtcaaaaagagctgcctggctgaactgctgcgcctctacaccaaaagctcctcgtcagacgaagaatatatctacatgaataaagtgaccataaataaacagcagaacgccgagtctcaagggaaggcccctgaggaacaaggactgctcccaaacggagaaccttctcagcacagcagcgcgccacaaaaaagcctccctgatcttccccctcctaagatgaggattctaacccttggacagatctcaggcgctcagtccttctcaccagacggaacccatttgaccggtactgagttcctaggcggatggtcatggcggccaagccaaatccgcttgatgtccccaggaacccattggggggatttgacagctactgaaattccagaaagaaagcagctggctatccccaagaccgagagtccggaagggtattacgaggaggctgaaccctacgatacctcactgaacgaggatggtgaagccgtcagcagctcctacgagagttacgacgaggaggatggaagcaagggtaaatctgctccctatcaatggccctcgcccgaggcgggtatcgagttgatgcgggatgcacgaatatgtgcattcctctggcggaaaaaatggctgggccagtgggcgaaacagctgtgtgtgattaaggataatcgcctgctctgctacaagagtagcaaggatcactctccccaactcgacgtgaatctgctgggttcatccgtcatccacaaggaaaaacaggtgaggaaaaaagagcacaaattaaaaattactcccatgaatgccgatgttatcgtgcttgggcttcagtctaaagatcaggctgaacagtggttgcgcgtaatccaggaggtaagtggtctcccatctgagggggcttctgaggggaatcagtacacaccagatgcacagcggttcaactgtcagaaacccgacattgcggaaaagtatctgtctgcgtccgagtatggctctagcgtcgacggccaccccgaagtgccagagaccaaggacgtgaagaaaaaatgtagcgctggtctaaagctttcaaacctgatgaatctgggtagaaagaagtccactagtctggagccagtggagaggtccctggaaacgtcctcctatctgaacgtgctggtgaattctcaatggaaatctcgttggtgtagcgtgcgggataatcacttgcacttttaccaggatcgtaaccgtagcaaagtcgcccagcaacccctgtccctggtcggatgtgaagtggtcccagatccctcaccagaccacttgtatagttttcgcattttgcataaaggagaggaactggctaagctcgaagctaaaagctccgaagagatgggccattggctcgggctgttgctctccgagtcaggcagcaaaactgaccctgaggagttcacttacgactacgtggatgccgacagagtgtcctgcattgtgagtgccgctaagaactcgctgctactgatgcaacggaagttctccgaaccaaatacctatatagatggcttgcccagccaagatcgccaggaggaactctacgacgacgtggatttgtcagagcttactgcagccgtggagcctactgaggaggccacgcccgtagcagatgaccccaacgaaagagaatctgacagggtgtatttggacctcacaccggtgaagtcttttctgcatggcccttccagtgcccaagcccaggcctcaagtcctacacttagttgcctggataacgctaccgaagcactgcccgcagattccggtcctggtcccacacccgatgagccctgtatcaaatgccccgagaacctgggcgaacagcagttggagagtctggagcccgaggatccctctctgcgtatcactacagtgaaaatccaaaccgaacagcagagaatttccttccctccttcttgcccagatgctgtcgtggcaactcctccaggggcttcacctcctgtgaaagatcgcctcagagttacaagtgcagagattaaactcggcaaaaacagaacagaggcagaggtcaagcgttacaccgaagagaaagagagactggaaaagaagaaggaagagattagaggccacttggcacagcttcgaaaggaaaagcgtgagttaaaggaaacattgctgaagtgcacagacaaagaggttctggcaagtctagagcagaagctcaaggaaattgacgaggagtgtcggggagaagagtcccggagagtcgacctggaactgtccattatggaggtgaaagataacctgaaaaaagccgaagcaggacccgtcacgttagggacaacagtggatacaacccaccttgaaaatgtctcaccccgtcctaaggcagtgactcctgcgagcgccccagactgcacacctgttaattctgctacaaccttgaagaatcgacccctctcagtcgtggtgacaggaaagggaaccgttctgcagaaggccaaggaatgggaaaaaaagggggcaagttag

SEQ ID NO: 213086 - DNA, 1002 bp, Artificial Sequence
  Description of Artificial Sequence: Synthetic coding sequence
atgtgtgaagaggagacgacggccttggtttgcgacaacggctctggattatgcaaggcaggattcgccggtgacgatgccccacgagctgtgttcccttctatcgtcggacgaccccgacatcagatttggcaccattctttctacaatgagctgcgagtggctcccgaggaacacccaactctcttgaccgaagcccctctgaaccctaaggccaatcgcgagaaaatgacccagattatgttcgagacatttaacgtgcccgctatgtacgttgccatccaagcagtcttaagcctatacgccagtggcagaacaacaggtatcgtcctcgactccggagatggtgtaacccataatgtccccatctatgaaggctacgcgctgccacatgcgattatgaggctggatctggccggtcgggatctgacggactacctaatgaaaattctgacagaacgcggatattccttcgttaccacagcagaacgggagattgtgagagacataaaagagaaattatgctacgttgctttggatttcgagaatgaaatggccaccgccgcaagtagcagtagcctggaaaagtcttacgagctgccagacggacaggtgattaccattggtaatgaacgatttcgatgccccgagacgctgttccaaccctctttcattggtatggagtctgctgggattcatgagactacgtataattctatcatgaagtgcgatatcgatattcgtaaagatttatacgcaaacaacgtgctgtctggaggaacaaccatgtaccccggaattgctgacagaatgcaaaaggaaataaccgccttagcgccttccactatgaagatcaaaatcattgccccaccagaacgcaaatactctgtttggataggtggctctatcctggcatctctgagcacatttcagcaaatgtggatatctaaacctgagtatgatgaggccggaccctcaatcgtccatagaaaatgcttttag

SEQ ID NO: 213087 - DNA, 1113 bp, Artificial Sequence
  Description of Artificial Sequence: Synthetic coding sequence
atgtctctgcaccaatttttactggaacctatcacttgccatgcctggaacagggaccgcacgcagattgccttgtctccaaataaccacgaggttcatatttacaaaaagaacggcagccaatgggtaaaagcgcatgaactgaaggagcataacggtcacatcaccggaatcgattgggcacctaaatcagatagaatcgttacttgtggagccgacagaaatgcttacgtctggtcccagaaggatggtgtctggaaacctacgttggttattctgcggataaatagagccgctaccttcgtgaaatggagcccactggaaaataagtttgctgtggggagcggagccaggctgataagtgtttgttacttcgaaagcgaaaacgattggtgggtgtctaaacacattaaaaagcccatccgcagcacagtcctgtcattggattggcacccaaataacgttctcctcgctgcgggaagctgcgacttcaagtgcagggtgttttctgcctacataaaggaggtcgacgaaaaaccggcttccaccccctggggcagtaaaatgccattcggccagctaatgtcggagtttggcggttctggaacagggggttgggtgcatggtgtttccttttcagcttcagggagtcggctggcctgggtgagccatgactctaccgtaagtgtcgctgacgcctctaagagtgtgcaggtatccacactgaagacagaatttttgcctctgctgtcggtgagctttgtgagcgaaaattctgtggtggcagcgggacacgattgctgccccatgctttttaactacgacgaccgcggatgtctcacctttgtgtctaagctggatattcccaaacagtcaatccagcgcaacatgtcagccatggagagattcagaaatatggataaaagggcgactacagaggataggaataccgcacttgaaactctgcaccaaaatagtatcacacaggtgtcgatctacgaagtggacaaacaggactgtagaaagttttgcactactggtatagacggtgctatgaccatttgggattttaagacactcgagtcgtccatacagggtcttcgtattatgtag

SEQ ID NO: 213088 - DNA, 1038 bp, Artificial Sequence
  Description of Artificial Sequence: Synthetic coding sequence
atgcacgagcggttcattcattgtttctgtatcgattgggcccctaagagcgaccgcattgttacttgcggcgctgacagaaatgcatatgtgtggtcccagaaagatggtgtgtggaaaccgacactggtcattcttagaattaacagggccgcaacctttgtgaagtggtccccactggaaaataagttcgccgtcggtagcggggcacgcctgatctccgtttgctattttgaaagcgagaacgattggtgggtctcaaagcatatcaagaagcccattaggagcactgtgcttagcctggattggcacccaaataacgttctgctggccgcaggcagctgcgactttaaatgtagagtcttctctgcttacatcaaggaagtcgacgagaaacccgcatcgacaccatggggaagtaagatgcccttcgggcaactcatgtcggagtttggagggagcggcactggcggttgggtgcacggcgtgtcattcagcgcctccggcagccgcctcgcctgggtgtcacacgatagcactgtgtcagttgccgacgcatcaaagagcgtgcaggtgtctaccctgaaaacggagtttctcccattactgagcgtgtctttcgtgtcagaaaacagcgtcgtcgcagcaggccatgattgttgtccgatgttgtttaattatgacgacaggggatgtctcaccttcgtaagcaagttggacatccctaagcaaagtattcagcgaaatatgagcgccatggaacgcttcaggaatatggataagcgggctacgaccgaggacaggaatactgcactcgagacactgcatcagaatagtatcactcaggtctcaatttacgaggtggataaacaagactgtcggaaattctgcacgacgggaattgacggcgctatgaccatctgggatttcaaggagccttccagacatgggctaccacagttgccaggtggggcacaccagctcccacgcctcgagcagggtccacaccccgactgtcatttaccacaacagccttag

SEQ ID NO: 213089 - DNA, 1119 bp, Artificial Sequence
  Description of Artificial Sequence: Synthetic coding sequence
atggcataccacagttttttagttgaacctatctcttgtcatgcctggaacaaggaccgtacccagatcgctatttgtccaaataaccacgaggtccacatttacgagaaaagcggagctaaatggactaaggtccacgaactgaaggagcataatggccaggttaccgggatcgactgggctcctgagtctaatcggatcgtaacctgtgggacggacaggaacgcctatgtatggactcttaagggtcgcacctggaagcccaccctggtgattctgaggatcaacagagccgctaggtgtgtgagatgggcacctaacgaaaacaagttcgcggtgggatccggcagccgggtgatctcaatctgttacttcgaacaggaaaatgactggtgggtctgtaagcacataaaaaagcctatccgcagcacggtcctcagtcttgactggcatcctaacaacgtcctgttggctgcaggctcatgcgatttcaaatgtcgcatattcagcgcttacatcaaagaagtggaggaaaggcctgcccctacaccttggggtagcaagatgccttttggggaattaatgtttgaaagcagtagctcttgcggctgggtgcacggagtctgcttcagcgcctcgggctctagagtagcttgggtgtctcatgatagcacggtgtgcctggccgatgctgataaaaaaatggccgtggcaacactggctagtgagaccctacctcttcttgccctcacgttcattaccgacaactctcttgtcgccgctggacacgactgcttccccgtgctgtttacttacgacgccgctgccggtatgctgtcctttgggggaaggctcgatgtgccaaagcagtcaagccagcgaggtctcaccgcgagagagaggtttcagaacctggataaaaaggctagttccgaaggaggtaccgccgctggtgcaggtctggatagcctgcataagaacagcgtctcccaaatctccgtcctgtcaggtggcaaagccaagtgctctcagttctgtacgactggaatggatggcggtatgagtatatgggatgtgaagtccctcgagtcagccctgaaggacctgaaaattaaatag

SEQ ID NO: 213090 - DNA, 309 bp, Artificial Sequence
  Description of Artificial Sequence: Synthetic coding sequence
atggcatatcacagtttcctggtggaaccaatctcatgccatgcatggaacaaggatagaacacaaatcgcaatttgccctaataatcacgaagttcatatttacgaaaagagtggcgctaagtggaccaaggtgcacgagttgaaggaacacaacgggcaagtcaccgggatcgactgggccccagagtcgaatcgaatcgtgacatgcggcactgatagaaatgcatatgtgtggacattaaagggccgtacctggaaacccacgctggtcatacttcggataaaccgtgcggctaggtgcgtgtag

SEQ ID NO: 213091 - DNA, 393 bp, Artificial Sequence
  Description of Artificial Sequence: Synthetic coding sequence
atggcttatcactcctttctagtcgagcccatctcgtgccatgcatggaataaggaccgcactcaaatcgccatttgcccgaataaccatgaggtccacatttatgagaagtccggcgctaaatggaccaaggtgcacgaactcaaggaacacaatggacaggtaacagggattgattgggctcctgaatcgaataggatcgtcacctgtggaactgatcggaacgcctatgtgtggacactcaaaggtagaacctggaagcccacactcgtgattctgcgaattaacagggcggctaggtgtgttcggtgggctcctaacgagaataagtttgcagttggctccggctcccgggtgatatccatttgctactttgagcaagagaacgactag

SEQ ID NO: 213092 - DNA, 252 bp, Artificial Sequence
  Description of Artificial Sequence: Synthetic coding sequence
atggcctatcacagttttctggttgaacctataagttgccatgcctggaacaaagaccggacccagatcgctatctgccctaacaaccatgaagtgcacatttacgaaaaatcaggtgctaagtggaccaaggttcatgagctcaaagagcataatggacaggtgacgggaatcgattgggccccagagtcgaatcgtatcgttacctgtggtacagatagaaacgcatacgtctggactcttaaaggctag

SEQ ID NO: 213093 - DNA, 402 bp, Artificial Sequence
  Description of Artificial Sequence: Synthetic coding sequence
atggcataccattcattccttgtggaacccatctcctgtcatgcctggaataaggatagaactcagattgccatctgtcccaataaccacgaggttcatatctatgaaaaaagtggggctaaatggaccaaagttcatgagctgaaggaacacaatggccaggtgaccggaatcgactgggcccctgagtctaataggattgtgacatgtggcactgatcgtaacgcctacgtctggacccttaaggggagaacatggaagcccacccttgtaattctccgcatcaatcgcgctgccagatgcgtccgatgggccccaaatgaaaacaaattcgctgtgggcagcggctctagggtcatttccatctgctactttgagcaagagaacgactggtgggtatag

SEQ ID NO: 213094 - DNA, 66 bp, Artificial Sequence
  Description of Artificial Sequence: Synthetic coding sequence
atggcataccatagctttctggtcgagccaatcagttgtcacgcctggaataaagacagaacttag

SEQ ID NO: 213095 - DNA, 402 bp, Artificial Sequence
  Description of Artificial Sequence: Synthetic coding sequence
atggcgtaccacagctttctagtggagcccatatcttgccatgcttggaataaggacagaacacaaatcgctatctgtcccaataaccacgaggtccatatttatgagaagtcaggggctaagtggacaaaagtgcatgaacttaaagagcacaatggtcaggttactgggatcgactgggcgcctgaaagcaatcgaatagtgacctgcgggaccgatcggaatgcttatgtatggactcttaaggggagaacatggaagcctactcttgttatcctccgaatcaatagggcggcacggtgcgttcgctgggccccaaacgagaacaaattcgccgtcgggtctggctccagggtgatctcgatctgctactttgagcaggagaacgactggtgggtctag

SEQ ID NO: 213096 - DNA, 327 bp, Artificial Sequence
  Description of Artificial Sequence: Synthetic coding sequence
atggcatatcactcatttctagtcgaacccatttcatgccatgcatggaataaagaccggactcagatcgcaatttgcccgaataatcatgaagtccacatctacgagaagtcaggcgctaaatggaccaaagtgcacgagctaaaggagcataacgggcaggtgacaggcatcgattgggcacctgagagcaaccgaatagtgacttgcggcacagaccgcaacgcttacgtctggactctgaaagggaggacatggaaacccacactggtgatattgcgcataaatagagccgcacgttgcgtccgctgggctcccaatgagtag

SEQ ID NO: 213097 - DNA, 1119 bp, Artificial Sequence
  Description of Artificial Sequence: Synthetic coding sequence
atggcttatcatagcttcctggttgaaccgatctcctgtcacgcgtggaataaagaccggacacagatcgctatttgccctaataaccacgaagtgcatatctacgagaaaagtggtgccaagtggactaaggtgcacgagctgaaggagcacaacggccaggtcactggcatcgattgggcacctgaatctaaccggatagttacatgcggtaccgatagaaacgcttacgtctggacccttaagggtaggacctggaagccaacactggttattctgcgcatcaatagggctgcgcgatgtgtgagatgggcccctaatgagaacaagttcgccgtcgggtcaggcagtcgggtaatcagcatatgctatttcgaacaggaaaacgactggtgggtgtgcaaacacataaagaagcccatcagatctacagtgctctctctcgactggcaccccaataatgttcttctagccgcaggttcatgcgactttaaatgccgcattttctctgcatacatcaaagaagtcgaggaacgacccgcacctacaccttggggcagcaagatgcctttcggggagctgatgttcgagagcagtagcagttgtggatgggtgcacggggtttgctttagtgccagcggcagtagagtggcttgggttagccacgattctaccgtgtgccttgccgacgctgataagaagatggctgttgcaacgctagccagcgagactttaccactgcttgccttgacttttatcaccgacaatagccttgtcgccgcaggtcacgactgtttcccagtgctatttacctacgatgccgctgccggaatgctgagtttcggagggaggctggacgtgccgaagcaaagctcccaaagaggtctcaccgcgcgagagcggtttcagaacctcgacaaaaaggctagcagcgagggcggtaccgctgctggagccggacttgattccctgcataaaaactcagtgagccagatatccgtgctaagcgggggtaaggcaaagtgtagtcaattctgtaccaccggcatggatgggggaatgtccatctgggacgttaaaagtctagagtcagcgcttaaagatctgaaaattaagtag

SEQ ID NO: 213098 - DNA, 387 bp, Artificial Sequence
  Description of Artificial Sequence: Synthetic coding sequence
atggcttatcatagttttttggtggaacctatctcctgccacgcctggaacaaagaccgaacgcaaattgcaatttgcccaaacaaccacgaggtccatatatatgaaaaatctggagcaaagtggaccaaagtgcacgagttaaaagaacataatggtcaagtgactgggatcgactgggccccagaaagtaacaggattgtgacttgcggcaccgatcgcaacgcctacgtctggaccctcaaaggccgaacctggaagcccaccctggttatccttcgcattaaccgcgcagccaggtgtgtgcgctgggctcccaatgaaaacaagttcgccgtgggctctggtagtcgggtcatcagcatctgttacttcgagcaggagtag

SEQ ID NO: 213099 - DNA, 402 bp, Artificial Sequence
  Description of Artificial Sequence: Synthetic coding sequence
atggcataccactcgttcctcgtggaacctattagttgccacgcatggaacaaggaccggactcagatcgcaatctgcccaaataatcatgaggtgcacatttacgaaaagtcaggggctaagtggactaaagtgcacgagctgaaagaacataacgggcaggtgactggtattgactgggcgcctgagtccaatcggattgtgacttgtggtacagatcgtaacgcttacgtctggaccctcaagggcagaacgtggaaacctacgcttgtgatcctgcggattaaccgcgctgcgcgttgcgtgcggtgggcaccgaacgagaataagttcgctgttggatctggctcacgggtgatttcaatctgttacttcgagcaggagaatgactggtgggtgtag

SEQ ID NO: 213100 - DNA, 903 bp, Artificial Sequence
  Description of Artificial Sequence: Synthetic coding sequence
atgatcctcctcgaggtgaacaataggattatcgaagagacgctagccctgaagtttgagaatgcggcagccggtaataagccggaggctgtggaggtgaccttcgcagatttcgatggggttttataccacatttccaatcctaacggagacaagacaaaggtcatggtgagtatttctctgaaattctataaggagctccaggcacacggtgctgacgagctcttgaaacgggtatacggaagctttctggtaaatcctgaaagtgggtacaatgtgtcacttctctacgaccttgagaatctccccgcaagcaaggatagtattgtgcaccaggcaggtatgctaaaaagaaactgttttgcctcagtatttgagaagtactttcagttccaggaagaaggcaaagaaggcgagaatcgggctgtcatccattacagagacgacgagaccatgtacgtcgagagcaaaaaagaccgggttaccgtggtcttcagtacggtttttaaggatgatgacgacgtggtgatcggaaaggtattcatgcaggagttcaaggaggggagaagagcctcgcataccgctccccaggttctgttctcacaccgtgagccacctctggagcttaaagacaccgacgccgctgtgggcgataatatcggctacattacatttgtcttattcccaaggcacacgaacgcaagcgcacgggacaatacaataaacctgattcacacctttagggactatttacactatcacattaaatgctctaaagcctacatccacacaaggatgcgggcaaagactagcgatttccttaaggtgctaaatcgggcaaggccagacgccgaaaaaaaagaaatgaagacaattacaggaaaaacctttagcagcagatag

SEQ ID NO: 213101 - DNA, 903 bp, Artificial Sequence
  Description of Artificial Sequence: Synthetic coding sequence
atgattctcttagaggtcaacaataggataatcgaagaaacccttgcattgaagttcgagaatgcggctgccggtaataagcctgaagccgtagaggtgacctttgcggattttgatggtgtgttataccacatatccaatcctaacggcgacaagacgaaggttatggttagtataagtctcaaattctataaggagctgcaggcacacggtgcagatgagcttttgaagagagtatatggcagctttttagtcaaccctgagtctgggtataatgtaagtcttttgtacgacctggaaaatctaccagctagtaaagactcgatcgttcaccaagctggtatgctgaagaggaactgctttgcatcagtgttcgagaagtacttccagttccaggaagagggaaaggagggggaaaatcgcgctgtgatccattaccgcgatgacgagaccatgtatgtggagagcaagaaagatcgggtcacagtcgtcttttctactgttttcaaggacgatgatgacgtggtaatcggaaaagtttttatgcaggaattcaaagaggggagaagagctagccacactgcacctcaagtgctatttagccaccgtgagcctccactggagctcaaagacacagacgctgctgttggcgacaatattgggtacattacttttgttctctttcctagacatacaaacgccagcgcccgagacaacactatcaatcttatccacacgtttcgcgattacctccactaccacattaaatgcagtaaggcgtacatccacacaaggatgcgtgctaaaacctctgattttcttaaggtacttaatagagccagaccagatgccgagaaaaaagaaatgaaaacaattaccggcaagaccttcagtagtcgatag

SEQ ID NO: 213102 - DNA, 273 bp, Artificial Sequence
  Description of Artificial Sequence: Synthetic coding sequence
atgatattgctggaggtcaacaaccgcataattgaagaaacactggcactgaaattcgagaacgccgctgctgggaacaagcccgaagcagtcgaggtgacattcgctgactttgacggcgtgctgtaccacatctcaaaccccaatggcgacaaaacaaaggtgatggtgagcattagtctgaagttttacaaggaactgcaggcccatggggcagatgaattacttaaaagagtgtatggatcctttctggtgaaccccgaaagcggctag

SEQ ID NO: 213103 - DNA, 864 bp, Artificial Sequence
  Description of Artificial Sequence: Synthetic coding sequence
atgtgcgatgaagacgagactaccgccctggtgtgtgacaacggcagtgggctggtgaaagcaggtttcgctggggatgatgctccacgcgcagtgttcccatcaattgtgggaaggcccagacaccagggcgttatggtgggcatgggccaaaaagatagctacgtgggggatgaggcccagagtaaacgagggatccttacattaaaatacccaatcgagcacggtattattaccaactgggatgatatggagaagatttggcatcacacattctacaacgagcttagggtcgctccagaagagcacccaacgttactgaccgaagcaccacttaaccctaaggcaaatagggagatagtacgtgatattaaggagaagctgtgctatgtggcgctcgatttcgagaatgagatggctaccgccgcttcatcgagtagtctcgagaaatcgtatgaactgcctgatggccaggtgattactattgggaacgagcgctttcggtgtcccgaaaccctcttccaaccctctttcattgggatggaaagcgctggaattcacgaaactacttataattccatcatgaaatgtgacatagacatccggaaggatttgtacgccaacaatgttatgagtggcggtactacgatgtaccctggtattgccgaccggatgcagaaagagataacggctcttgcccctagcaccatgaaaattaaaatcattgctcccccagagcgcaagtactcagtctggatcggcggttcaatactggcctccctaagtaccttccaacagatgtggattacaaagcaggagtacgacgaagcaggaccttctatagttcataggaaatgtttttag

SEQ ID NO: 213104 - DNA, 765 bp, Artificial Sequence
  Description of Artificial Sequence: Synthetic coding sequence
atgtgcgatgaggacgagactacagcactggtgtgtgataacggaagcggactggtcaaagctggattcgcaggcgacgacgctcccagggccgtttttccatctattgtagggaggcccaggcatcaaggcgtgatggtggggatgggccagaaggactcatacgttggggatgaagcccaatctaaacgcggaatcctgacattgaagtatcctatcgagcatgggattattaccaattgggacgatatggagaaaatttggcaccacacattttacaacgagctgagggttgcaccagaggaacatccaacactgctcaccgaggcacccttaaatcccaaagccaacagggaaaaaatgactcaaatcatgttcgagacgtttaatgtgcccgcaatgtacgttgctatccaagccgttctttcactctacgcgtccggacgcacgacagggattgtcctggactccggcgatggcattatgaagtgcgatatcgatattaggaaggacttgtatgctaacaacgttatgagtgggggaacaacaatgtatcccggaatcgccgaccggatgcagaaagagattaccgctctggctccctcaacaatgaagattaagattattgcccctccagaacggaaatacagcgtttggattggaggatcaatcctcgctagtctttccacattccagcaaatgtggatcaccaagcaagaatacgatgaagccggtcctagcattgtgcaccggaaatgcttctag

SEQ ID NO: 213105 - DNA, 1029 bp, Artificial Sequence
  Description of Artificial Sequence: Synthetic coding sequence
atgtgcgatgaggatgagactacagctcttgtgtgtgataacggatctggactcgtgaaagccggatttgccggagatgacgcacccagagctgtgtttccatcgatcgtggggcgtccccgacaccagggggttatggtggggatgggccagaaagactcatatgttggagacgaagctcagtccaaacgcggaattctcacccttaaatatcccatagaacacgggattattacgaaagccaacagggaaaaaatgacgcagataatgtttgagacattcaatgtgccggctatgtatgtagcaatacaggcggtgctgagtctgtatgcttcagggcgaacgactgggattgtcctggattccggagatggtgtgacacataacgttcctatttacgaaggctacgcgctgccgcatgcaattatgaggcttgacctggccggtagagacctgacagactatctgatgaagatccttaccgagagagggtacagttttgtgacaaccgcggaacgggagattgttcgcgacatcaaagagaagctgtgttacgtggctctggattttgagaatgaaatggccacagctgccagctcatcgagcctcgagaagtcttatgagctgccagacggacaggtgataacaattggtaatgaaaggtttcggtgtcctgaaacactgttccagcctagcttcattggaatggaatccgccggaatccatgagactacatacaacagcattatgaagtgcgatatagatatcaggaaagacctctacgcgaacaatgtcatgagtgggggaaccactatgtaccccggaatcgccgataggatgcagaaagagattaccgcactggccccttctactatgaagatcaagattattgcgccacccgagcgcaagtacagcgtttggatcggcggaagtatcttagcaagcttatctacgttccagcagatgtggatcaccaaacaagaatatgacgaggctgggccttccattgtacatcgaaagtgcttctag

SEQ ID NO: 213106 - DNA, 870 bp, Artificial Sequence
  Description of Artificial Sequence: Synthetic coding sequence
atgtgtgatgaggatgaaactaccgccttggtctgtgacaacggctctggcttggtgaaggccggattcgcaggcgatgatgcgcctcgcgctgtgttcccctcaatcgtaggcagaccccgacatcagggagtgatggtggggatgggtcagaaagacagttacgtaggagacgaagcccaaagtaagcggggaattctcactcttaagtatccgattgagcatggtattattaccaactgggacgacatggaaaaaatttggcaccacaccttttacaatgagttgagagtcgcccctgaagagcacccaacactgctgacagaagctccactgaatccaaaggccaaccccgagcgcgagattgtgagggatatcaaagagaagctgtgctacgtggccttggatttcgagaacgaaatggccaccgccgcttcatcatcctctctagagaagagttacgaattgccagatgggcaagttatcacaatcgggaacgagcgttttcggtgccctgagacgctctttcagccctcattcatcggtatggaaagtgcaggcatccacgaaaccacctacaatagcattatgaagtgcgatattgacatacgaaaggatttatacgcaaataatgtgatgtctggcggtaccaccatgtaccctgggattgctgataggatgcagaaggaaattacggccctcgcgcctagcacaatgaagattaagattatcgcccctcctgagcggaaatatagcgtctggattggcggatctattctggcttcactgtccacatttcagcaaatgtggatcactaaacaggaatacgacgaggctggcccatctatcgtacatagaaaatgcttctag

SEQ ID NO: 213107 - DNA, 1134 bp, Artificial Sequence
  Description of Artificial Sequence: Synthetic coding sequence
atgtgtgacgaggacgagacgaccgcgctggtttgcgataatggatccggcctcgtcaaagccggtttcgccggtgacgatgcccctagggcggtgtttcctagcatcgtcggaaggccgcgacaccagggagtcatggtgggcatgggccaaaaagacagctatgtaggggatgaagcccaaagtaaacggggaatactcactttgaaataccccatagaacacggtatcattacaaactgggacgacatggagaaaatttggcaccacacattctacaatgaactgcgggtcgctcccgaggagcatcctaccttgctcactgaagcaccgctcaatccaaaagcaaaccgggaaaaaatgacccagatcatgtttgagactttcaacgtccccgctatgtacgtagctattcaggccgttctctccctgtacgcttcaggacggacaaccggcatcgttctggactccggcgacggcgtgacccacaacgtccccatttatgagggatatgcactgccacatgccattatgagactggatctcgcgggacgagacttgacagattatttgatgaaaatattgacagaaaggggctactctttcgtgacgaccgccgagcgggagattgtgagggatatcaaggagaagctgtgctacgtggctctggactttgaaaacgaaatggctactgctgccagcagctctagcctggagaaaagctacgaactgccagatggccaggtgattactatcgggaacgagcggttccggtgcccagaaactttattccaacctagtttcattggcatggaaagcgccggaatccatgaaaccacatataactctattatgaagtgcgacatcgacatcaggaaagacctatacgctaacaatgtgatgtccggcggtactacgatgtaccccggaatcgctgacaggatgcaaaaggagatcactgcgctagccccaagcacaatgaagatcaaaataatagcgcctcccgaaagaaagtatagcgtatggatcggcggatcgatattggcctccctctctactttccaacagatgtggattaccaaacaggagtacgacgaggccggtcccagcattgtccataggaagtgcttttag

SEQ ID NO: 213108 - DNA, 1146 bp, Artificial Sequence
  Description of Artificial Sequence: Synthetic coding sequence
atggccccaggtgagaaggaaagcggagaagggccagcaaaaagtgccctacggaagattcgaaccgcaacgcttgtgatctcactcgctcggggatggcagcagtgggctaacgagaacagcattcggcaagcacaagaacctacggggtggctgccagggggtactcaagactctccccaagccccaaaacctatcaccccccctacgtctcaccagaaggcacagtccgcaccgaagagtcctcctaggctgccagaagggcacggcgatggccagagttctgagaaggcccctgaggtatcacacattaaaaaaaaggaagtcagtaagacagtggtgagtaagacctacgagaggggtggcgatgtctcacatctatcgcacagatatgagagggacgccggagtgctcgagcccggtcagccagagaatgatatcgaccgaatcttgcactcacacggtagccccactaggcgcagaaaatgtgctaacctggtgtccgaattgaccaagggatggcgtgtgatggaacaagaggaacccacttggcggtcagatagtgtcgacactgaggactctggctatggaggcgaagccgaagagcggccagagcaggacggtgtacaggtggccgtggttcggattaagcggcctcttccctcacaggtgaatcgatttacagagaagctgaattgcaaggctcagcaaaaatactcccctgtgggaaatctcaagggtcggtggcagcaatgggccgacgagcatatccaaagccagaaattaaacccctttagtgaggaattcgactacgagttagccatgagtacacggctccacaagggggacgaaggatacgggagaccaaaggaggggactaaaacagcagagcgagctaagcgtgccgaagagcacatctatagagaaatgatggatatgtgtttcattatatgtacaatggcacgacaccggcgtgacgggaagattcaggtaacatttggtgatctattcgaccgctatgtacgtatcagcgataaagtagttggcatactaatgcgggcacgtaagcatggtctggttgattttgagggggaaatgttgtggcagggcagagacgaccacgttgttatcacactcctaaagtag

SEQ ID NO: 213109 - DNA, 2685 bp, Artificial Sequence
  Description of Artificial Sequence: Synthetic coding sequence
atgaatcagatagagcctggggttcagtataattatgtatacgacgaagacgaatacatgatccaggaggaagagtgggatagagacttactgcttgaccctgcctgggagaagcagcagagaaagacctttaccgcctggtgtaacagtcacctgcgaaaggcaggcactcaaatcgagaatattgaggaagacttccggaatgggctgaaactcatgctgctccttgaagttatatctggagagaggttacccaaacccgacaggggaaagatgaggttccacaaaattgctaacgtgaacaaagccttggattacattgcatccaaaggcgttaaactggtgagtattggagcagaggaaattgttgacggcaatgttaagatgacgttggggatgatctggacaatcattcttcgcttcgctatccaagacatctccgtggaggaaaccagcgctaaggagggactactgctgtggtgtcagcgaaagaccgcgccataccgcaacgtcaacatccagaactttcatacctcctggaaggacggccttgggttgtgcgccctgatacaccgtcatcgcccagacctgatcgactattcgaagctaaacaaggatgatccgataggcaacatcaacctggctatggaaatcgctgagaaacacctcgacataccgaaaatgctcgacgccgaagatattgtgaatacacccaaacctgacgagcgcgcaatcatgacctacgtgtcatgcttctatcacgcctttgctggagccgaacaggcagagaccgcggctaacaggatctgtaaagtgttggctgttaaccaggagaacgaacggctgatggaggagtacgaacgactcgcctctgaacttttggaatggattcgacgcacgattccatggttagaaaaccgcacgccagagaagaccatgcaagccatgcagaagaaactcgaggattttcgggactatcgtcggaagcacaaaccaccaaaagtacaggaaaagtgccagctcgagatcaacttcaataccctccagacgaagttacggatctccaatagaccggctttcatgccaagtgaggggaagatggtgagcgatatcgcgggtgcatggcagcgtttggagcaggcagaaaaaggttacgaggagtggctgctgaacgagatccggaggttggagcggctggagcacctggccgagaaatttagacagaaagccagtacacacgaaacatgggcctacggcaaagagcagatcctgctgcaaaaagactacgaaagcgcttccttgacggaggttagagccttactccgtaaacatgaggcattcgaatctgatctggctgcccatcaggaccgcgtggaacaaattgctgctatagcccaggagctgaacgagctggattaccatgacgctgtgaatgtcaatgatcgctgccaaaagatctgcgaccagtgggatcggctaggaacactgactcaaaagaggcgggaagctcttgaacgaatggagaaactgctcgagactatcgaccagctacatctagagttcgccaaacgggcagctccttttaataactggatggaaggagcaatggaagacctgcaggatatgtttatcgtgcattcgatcgaggagatacagagcttaatcactgcgcatgagcagttcaaagcaacactcccggaggccgacggggagagacaatccattatggccatacagaacgaggttgagaaagtcattcagtcttataacatccggattagctcttccaatccatacagcacagttaccatggacgagttacgcactaagtgggataaagtgaagcagcttgtgcctattcgcgatcaatcactgcaggaggaactagctcgccaacatgcgaatgagcgcctgaggcgtcagtttgcagctcaggcaaacgccatcggcccatggatacagaataaaatggaagagattgcaagaagctccattcagataaccggggcactggaagatcaaatgaatcagcttaaacaatacgaacataacatcataaattataaaaacaacatcgacaagctggaaggtgatcaccagctcatccaggaagcgctggtttttgacaataaacataccaattatacaatggagcacatccgagttggctgggagctcctcctcaccactatcgcccgaaccatcaatgaggtagagacacaaatacttacacgcgacgccaaggggatcacgcaggaacaaatgaacgaattcagggcgagtttcaatcatttcgacaggcggaaaaacgggctgatggaccacgaagattttagggcgtgcttgatctctatgggctacgacctgggagaggcagagtttgctcgcatcatgacactcgtcgacccaaacggacaagggacggtaacttttcaatcatttatcgattttatgaccagggagaccgcagacacagataccgccgaacaggtcattgccagtttccgaatcctggcctctgacaagccttatatcttggctgaggaactccgcagggagcttccacccgatcaggcacagtactgtattaagcggatgccagcctattccggcccaggttccgtgcccggagcactggattatgccgcttttagctcggccctgtatggtgagtctgatctgtag

SEQ ID NO: 213110 - DNA, 2685 bp, Artificial Sequence
  Description of Artificial Sequence: Synthetic coding sequence
atgaatcaaatcgaaccaggagtccaatataactatgtgtacgatgaggatgaatacatgattcaggaagaggagtgggatcgagatctgctcctcgaccccgcatgggaaaaacagcaacggaaaacattcacagcctggtgcaattcccacttaagaaaagccggtacccagattgaaaatattgaggaggatttcagaaacgggcttaagctcatgctcttactggaggttatcagcggcgagcgtctgcccaagccggatcggggaaagatgagatttcataagattgcaaacgtgaataaagcattagattatattgcttctaagggagtgaagctggtatctatcggcgcagaggagattgtggatggaaacgtgaaaatgacccttggaatgatttggacaattatcctccggttcgccatccaggatatttccgtggaggagaccagtgcaaaagaaggtttgttgctttggtgccagcgcaaaactgctccctatagaaatgtgaatatccagaactttcatacttcatggaaagacgggctaggcctatgcgcattaatccaccgccaccgtcctgatttaattgactactcaaagttaaacaaggacgatcctatcggaaatattaacctagctatggagatagctgagaaacacctcgacattccgaagatgcttgacgcggaggacttagtgtacacagcacggcctgatgaaagagcgattatgacttacgtgagctgttactatcatgcctttgccggtgcccagaaagctgaaacggctgccaatagaatttgtaaggtgctcgccgtaaatcaagagaacgagcgactcatggaggaatatgagcgtctcgccagcgaactccttgagtggatccggagaaccatcccatggctagagaacagaacgccagagaaaaccatgcaagcaatgcagaaaaagttagaagactttagagactacaggagaaagcacaagccgccaaaagtacaagagaagtgtcagttagaaattaactttaatactttgcagaccaagttgcggatatccaaccgtcccgctttcatgccatcagagggcaagatggtcagtgacatagccggagcatggcagcgcttggaacaagcagaaaaggggtacgaggaatggctgctgaatgagatccgcaggttggagagattagagcacctcgctgaaaagttcaggcagaaggctagcactcacgaaacatgggcttacggcaaagaacagattcttcttcagaaggattatgagtcagccagtctgacagaggtccgggctctgctcaggaagcatgaagcgttcgagtccgacctggccgcacatcaggaccgagtggagcagatcgcggctatcgctcaggagctcaacgaactggattaccatgatgctgtcaacgtaaatgatcggtgccagaagatttgcgatcagtgggacaggttgggtaccctgactcagaagaggcgcgaagctctcgagaggatggaaaagctactcgaaacaattgatcagcttcatcttgagtttgccaagcgcgcagccccatttaataactggatggagggagccatggaggacctgcaggacatgttcatcgtgcattctatcgaggagatccagtcgttgataaccgctcatgaacaattcaaggccacattacccgaagcggacggtgagcgccagtcaattatggctatccagaacgaagtagaaaaagtcattcaatcatacaacatccgaatttcgtcaagcaatccgtatagcactgtaactatggacgagctccgcacaaagtgggacaaggttaaacagctggtcccaatccgtgatcagtccttgcaggaggagctcgctaggcagcacgccaacgagagactgaggcgacagttcgccgctcaggccaatgccatcggcccatggattcagaacaagatggaggagatcgctcgctcatccattcaaatcacgggggctctagaagaccaaatgaaccagttgaagcaatatgagcacaacatcattaactataagaacaacatagataaactcgaaggcgaccaccagcttattcaggaagctctggtattcgacaataagcataccaattatactatggagcacattagggtgggctgggagctgttactgacaactatcgccaggaccataaatgaagtcgaaacgcagatcctcacgagagatgcaaaaggaatcacacaggagcagatgaatgaatttcgtgcctcttttaatcacttcgacagaaggaaaaatggtctgatggaccacgaggattttagggcatgcctgatctctatggggtacgacctgggcgaagccgagtttgcccgtatcatgacattggtggaccctaatggccaggggactgtgacatttcagtccttcattgactttatgacacgcgagaccgcagacaccgacacggcagaacaggttattgccagtttcagaattcttgcgtcagataagccatacatacttgctgaagaattgcggcgagaattacccccagatcaggcacagtattgcattaagagaatgcccgcatatagcggcccaggatctgtcccaggggcacttgactatgccgctttctcctccgccctgtacggggaaagcgatctttag

SEQ ID NO: 213111 - DNA, 1992 bp, Artificial Sequence
  Description of Artificial Sequence: Synthetic coding sequence
tcgaccctctcaagtgttgaagggcctccggaatcctctacctgctcttatcaggagatgcgtcggtcttccgtgaacagttccgcaatggccgagactgctgccaacaggatctgcaaggttctggccgtgaatcaggagaacgagcgcttgatggaagaatacgagaggcttgccagcgagctgctcgagtggatccggaggaccattccttggctggagaacagaacacctgagaagacaatgcaggctatgcagaagaagctggaggatttcagggactaccgcaggaaacataaaccaccgaaggtgcaggaaaagtgccagctggagatcaactttaacacgcttcaaactaaattgaggataagtaataggcccgcttttatgccctctgaggggaagatggtcagcgacatcgcaggggcttggcaacgattagagcaggctgagaaaggatacgaagaatggcttcttaacgagatacgtcggcttgagcgactggaacatctggcagagaagttcagacagaaagccagcacccacgaaacttgggcctatggtaaggagcagatcctgttacaaaaggactatgagagcgcttcactcaccgaagtgcgcgcacttcttagaaagcatgaagcctttgaatcagacctggcggcacatcaggacagggtggagcagattgctgcaatcgcacaggagctgaatgagctcgactaccacgacgcagtaaacgtgaacgatcggtgtcaaaagatctgtgaccaatgggaccggctgggaactctaacacagaagcgcagggaagcgctggagcgaatggaaaaattgcttgagaccatcgaccagctgcatctagaattcgccaaaagagcagcgccattcaacaactggatggaaggtgctatggaggaccttcaggatatgtttatcgtccattcaatcgaagagatccagtcccttatcacagcacacgaacagttcaaggccactctccctgaagctgacggagaaagacagagtattatggcaatccagaatgaagtcgaaaaagttatacaaagctacaacatccggattagtagttctaatccatattcaactgtaacaatggacgaactgaggactaaatgggataaggtcaaacagttggtgcctattcgtgatcagtctcttcaagaagaactcgcaagacagcacgctaacgaaaggcttcgcaggcagtttgccgctcaggccaatgccatcggaccatggattcaaaacaaaatggaagaaatagcacgttcttctatccagatcacaggagctttagaagaccagatgaatcagttgaaacagtacgagcataacattattaactacaagaacaacatcgataagctcgagggtgaccatcaactgattcaggaagccctggtctttgataacaagcacacaaactacacaatggagcatatccgcgtggggtgggagctgctccttacgactattgcacggaccatcaacgaggtggaaacccagatcctgacgagagatgccaaaggaattacccaggaacagatgaatgagttccgggcaagttttaatcactttgatcgaaggaaaaacggtttaatggaccatgaagattttcgggcttgcttgattagcatgggctacgacctcggagaagctgagtttgcgaggataatgacattggtcgatcctaacggacagggcacagttacatttcaaagcttcatcgacttcatgacccgcgaaactgcggacacggacacagccgagcaggtgattgcatctttccgcattttggcgtctgacaagccttacattctggcggaggagttaagaagggaattaccaccagaccaggcccaatactgtatcaagaggatgcccgcatactctggccctggttccgtgccaggagctttggattacgcggctttttcttcagcgctctacggcgagagcgacctgtag

SEQ ID NO: 213112 - DNA, 1167 bp, Artificial Sequence
  Description of Artificial Sequence: Synthetic coding sequence
atggagaagctgctggagacaattgaccagctgcacctggaatttgccaagagggcggctccttttaacaattggatggagggcgctatggaggatctgcaggatatgtttatcgtccactctattgaggagatccaatctctgattacagcacacgaacagtttaaagcaacactgcccgaagcggacggcgaacgccagtctatcatggccatccaaaacgaggtagaaaaggtaattcagtcctataatataagaatatccagcagcaacccttactcgacggtcacaatggatgaattaaggacgaagtgggacaaagtaaaacaattggttccaatcagagatcagtcactgcaggaagagttggcccgtcagcacgctaatgagagactccgcaggcaattcgctgcccaagccaacgccatcgggccatggatccagaacaagatggaagaaatagcgagaagcagtatccaaatcaccggggctcttgaagatcagatgaaccagctcaaacagtacgagcacaacatcatcaattataagaataacatagacaaactcgagggcgatcatcagttgatacaagaagctctagtctttgacaacaagcataccaattacactatggagcatataagggtggggtgggagcttctgctgacgacaattgcccgtacaatcaacgaagtcgaaacgcaaattctgactcgggatgccaaaggaattacccaagagcagatgaacgaatttcgcgcatcatttaaccactttgaccgtcggaaaaacggtcttatggaccatgaggatttccgtgcttgtctaattagtatgggatatgatctcggagaagccgagtttgccaggatcatgacactggtggatcctaacggacaaggcaccgtcactttccagtcatttattgatttcatgacacgagaaactgctgacactgatacagcggagcaggtcattgcaagctttcggatccttgctagtgataagccatatatcctggctgaggagctccgccgtgagctgccacccgatcaggcacagtactgcatcaagaggatgcctgcgtattctggccctggcagcgtccctggggcattggattatgctgctttctctagcgctctgtatggagagagcgatctgtag

SEQ ID NO: 213113 - DNA, 1131 bp, Artificial Sequence
  Description of Artificial Sequence: Synthetic coding sequence
atgttcaacccccacgccctagacgtccctgccgtgatatttgataatggaagtggactgtgtaaagccggactaagtggggagattggtccccgacacgtgatttcatctgtactcggacattgtaaatttaacgtgccactggctcgattgaaccaaaagtactttgtgggtcaggaggcgctgtacaagtatgaagccctgcatctgcactaccctatagagcgagggttggtgaccggctgggacgatatggaaaagctgtggaaacacctgtttgaacgggagcttggggttaaaccatctcagcagccagtcctcatgactgagccaagtctgaatccccgagagatccgcgaaaaactcgcggaaatgatgtttgagacctttagcgtcccaggattctatcttagcaaccacgccgttgctgctttatatgcctctgcttgcgtgaccggactggtagtagactcaggcgatggagtcacgtgtaccgtgcctatcttcgaaggttacagcttaccccatgcagtcaccaagctgtgcatggcgggtcgcgacatcactgagcacctgacacgcctcctgttcgctagtggctttaactttccttgcatcctgaataaagctgtggtgaataatatcaaggaaaaactctgctacatagctcttgagccagagaaggaactgagaaaaagtcgaggcgaggttctgggtgcatatcgactgccggacgggcacgtcattcacttcggggatgagctgtaccaggttccagaggtactctttgcaccagaccaattaggcatacacagcccaggactttccaagatggtgtccagcagcattatgaagtgcgatacagacattcagaataagctgtacgctgacattgtgctgtcaggaggcaccaccttattacccggacttgaggagaggcttatgaaagaggttgaacaattggcctccaaaggcacccctataaaaatcaccgcttcccccgatcgctgcttcagcgcttggataggagcgagcatcatgacatcaatgagctcctttaaacagatgtgggtgacctccgcagatttcaaggaatacggcacatctgttgtgcagcggaggtgcttttag

SEQ ID NO: 213114 - DNA, 1134 bp, Artificial Sequence
  Description of Artificial Sequence: Synthetic coding sequence
atgttcaacccccacgctctggacagtcccgcagtgattttcgacaacggatcaggcttctgtaaggccggactttccggagagttcggcccaaggcacatggtttcgtccatcgttggccatctgaagttccaagctccctccgctgaagctaatcagaagaagtactttgtcggggaggaagcgctgtataaacaagaggcactccaacttcattccccttttgaacgcggactgataacaggatgggacgacgtggagaggctatggaaacacctgtttgagtgggagctcggcgtaaagcccagcgatcagcctttactggctaccgagcctagcctgaatccgagggagaatagggagaagatggctgaagtgatgttcgagaactttggtgtgccagccttttatctatctgatcaggccgtcttagctctttacgcatcagcctgcgttacaggcctggtagtcgattcaggtgacgctgtcacctgtactgtacccatctttgaagggtactctttgccccatgcagttactaagctacacgtcgcaggtcgggacatcaccgagctgctaatgcagctcctactcgcctcaggtcatacgttcccctgccagctggacaagggactggtggatgacataaagaagaaattgtgttacgtggcactggagccagagaaggaactgtcacgacgccctgaagaagtgcttcgagaatataagttgcctgatggtaatatcatcagcctgggtgatccactgcatcaggcaccagaagctctcttcgtgccacagcaactgggctcccaaagtcccggactgtctaacatggtgagcagttcaatcaccaaatgcgacaccgacatacagaagatactgttcggcgaaatagtcctatctggcggtaccactctgtttcacggcctcgacgaccgcctgttgaaagaacttgaacagctggcatcgaaggatactcccatcaaaattacggctccgcctgacagatggttctctacttggattggagcctcgattgttacatccctgagtagctttaagcagatgtgggttactgctgcggacttcaaagaatttggcacatctgttgtccagcggaggtgtttctag

SEQ ID NO: 213115 - DNA, 987 bp, Artificial Sequence
  Description of Artificial Sequence: Synthetic coding sequence
atgttcaacccccatgccctggactccccagcagtcatattcgacaacgggagcggtttttgcaaggccggactgtctggagaattcgggcctagacacatggtttcctccatcgtggggcatctgaaatttcaggctccgagtgcggaagctaaccagaagaaatatttcgtgggcgaggaagcgctgtacaagcaggaggcactacagctgcacagcccattcgaaagaggtctcataaccggctgggatgacgttgaacgcctctggaaacacctattcgaatgggaattgggagtcaaaccctctgaccagcccctcctcgcaaccgagccttcacttaaccccagagagaatagagaaaagatggctgaggtgatgttcgaaaattttggcgttcccgcattttatctcagtgatcaggcagttttggcactctatgccagcgcatgtgtgactggactggtggtcgactccggcgacgctgtaacttgcacagtcccaatttttgaaggctattcactgcctcatgctgtgacaaaacttcacgtggcaggacgtgacattaccgagctgttgatgcagttgcttctcgctagcggacacaccttcccctgccagttggacaaggggttggtcgacgatattaagaaaaagctgtgttatgtcgccctggagcccgagaaggagctgtctagaaggcccgaggaggtcctcagagaatacaaattacccgatggcaacattatctctctcggggacccgctccaccaggcccctgaggctttattcgtgccccagcaactgggctctcaaagtccagggctgtcaaatatggtatcatccagcatcaccaagtgtgacaccgacattcagaaaattctgttcggagagatcgtcctgtccgggggaactactctgttccatggactggacgacagactgctgcacttggactggagcctgcatagacatctgagcgagtag

SEQ ID NO: 213116 - DNA, 1752 bp, Artificial Sequence
  Description of Artificial Sequence: Synthetic coding sequence
atggagagcaaaggtgcctcaagctgcaggttgctgttttgtctgctaatctctgcaactgtgtttcggccaggcctggggtggtacactgtgaattccgcttacggcgatacgattatcatcccatgtagactcgatgtccctcagaacttaatgtttgggaagtggaaatacgagaaacctgatgggtcacccgtgttcatcgcgttcagatcttcaaccaagaaatcagtgcagtatgatgacgtcccagagtacaaggatcggcttaacctctctgaaaattacacgctgtcgatcagtaatgcgaggattagcgatgaaaaaaggtttgtttgcatgctggtcactgaggacaatgtctttgaggcccctaccatcgttaaggtgtttaagcagcctagcaagccagaaatcgtatctaaagcactgtttttggagacagaacaacttaaaaagttgggcgattgtatatcagaagatagttacccagacgggaatattacctggtacagaaatggcaaggtcttgcacccgctagagggcgcagtggtgataatattcaagaaagagatggaccccgtcacccagctatacaccatgacgtcaacgctggagtacaagacaaccaaggcagatatccagatgccgtttacctgctctgtcacgtactatggcccatccggacagaagactatccatagtgagcaggccgtgttcgacatctactaccctactgagcaggtgactatccaggtgcttccgcctaaaaacgcaattaaagagggcgataacattacattaaaatgcctgggaaacggaaacccaccccctgaagaatttctgttctatctgcccggtcagccagaggggattcggagcagcaatacctatacacttactgatgtcagacgaaatgctaccggagactacaaatgttccctcatcgacaaaaagtcaatgattgcttctaccgcgataactgtgcattatctcgacctgtcactcaatccatctggtgaggtcactcggcaaattggagacgccctcccagtgagctgcacaataagtgcatcccgcaatgccactgttgtgtggatgaaggacaacatcaggttgcgctcttcgccatccttctcttctctccactaccaggacgccggaaattatgtgtgcgaaactgctctacaagaagttgaaggcttaaaaaagcgagagtctcttacactcatcgtggagggcaaaccccaaatcaagatgacgaaaaagaccgacccgagcggactctcaaagactataatctgtcacgtggagggctttccgaagccagccattcagtggactattaccggctcaggtagcgtcattaaccaaacggaagagtctccatatattaatggcaggtactatagcaaaatcatcatcagtccagaggaaaacgtgacactgacctgtacggccgagaaccagctggaacgaacggtgaatagcctgaacgtgtctgccatctccatccccgagcacgatgaagccgacgagattagtgacgagaatagagagaaggttaacgaccaggcaaagcttatcgtgggcatcgtggtggggcttttgcttgcagctctcgtggctggtgtggtatactggctgtatatgaagaagtccaagacagcttccaagcacgttaacaaggatctaggcaacatggaggagaataaaaaactcgaggaaaacaaccacaagacggaggcatag

SEQ ID NO: 213117 - DNA, 918 bp, Artificial Sequence
  Description of Artificial Sequence: Synthetic coding sequence
atggacccggtaactcagctctataccatgacatctactcttgaatacaagactactaaagcagatatccaaatgccgtttacctgtagcgtgacatactatggtccctctggacagaagacaatccatagcgagcaggctgtttttgacatctattatttagacctatcgcttaaccctagtggcgaggttaccagacagattggggacgccctgccagtcagttgcacaatctccgcttcacggaatgccactgtggtgtggatgaaggacaacattcgtctcagatccagcccatccttttctagtttgcattatcaggacgcaggtaactacgtgtgtgagaccgcgctccaagaggtcgaggggctcaaaaaacgagaatcactgaccctcatcgttgagggcaagccacagatcaagatgacaaaaaagactgacccatccggcctgtctaagaccatcatttgtcacgtggagggcttcccgaagccagccattcaatggaccattacaggcagcggctctgtaatcaaccagacagaggagtccccttacatcaatggccgttattactcaaaaataattattagccctgaggagaatgtcacactgacatgcaccgctgaaaatcagcttgagaggaccgtgaattccctgaacgtgtctgccatttccatcccagagcacgacgaggcagatgagatttccgatgaaaacagagaaaaggtcaacgaccaggcaaaactgatcgtagggatcgtcgtcggattgctgctggccgctctggttgcaggagttgtgtactggctgtacatgaagaagtccaagacagccagtaaacacgtgaataaggatctggggaacatggaagaaaacaagaagttagaagagaacaatcacaagactgaggcatag

SEQ ID NO: 213118 - DNA, 1035 bp, Artificial Sequence
  Description of Artificial Sequence: Synthetic coding sequence
tgattaggggactgtatttcagaagatagctatccagacggtaacatcacctggtaccgaaacggaaaagtgctccacccgctcgaaggagctgttgtcatcatattcaagaaagaaatggaccctgtgacacagctttatactatgacaagcaccctggagtacaagacaaccaaggccgatattcagatgccttttacatgtagtgtgacctattacggccctagtgggcagaaaacaatacacagcgaacaagccgtgtttgacatctactatttggatcttagcctcaacccgtccggggaggtaacccgccaaattggagatgccctacctgtgtcctgcaccatttccgcctcccggaacgccaccgtggtgtggatgaaagataatataagattgagaagctctccgagcttcagtagcctgcattatcaggacgctgggaactatgtgtgcgaaacagccctccaggaggtggaggggttgaagaagagagagtccttgactctaatagtggagggaaaacctcaaattaaaatgacaaagaaaaccgacccgagcgggctgtccaagacaatcatctgccacgtggaagggtttcctaagccggcaatccagtggactataaccggaagcgggtcagtaatcaaccagaccgaggagagcccttatattaatggacgctactacagtaaaatcatcatttcgccagaggaaaacgttacattaacctgtactgcagagaaccagttggaacgcacagtaaattcgttgaacgtgagcgccatctccataccggaacacgacgaagccgacgagatctcagacgagaaccgcgagaaagtcaatgatcaggccaaacttattgtgggtatcgtcgtgggcctcctcctggctgctctggttgccggagtggtatactggctctatatgaagaagtccaaaacggcctccaaacacgtgaacaaggatttggggaacatggaggaaaataaaaaactggaggagaataaccataagacagaagcgtag

SEQ ID NO: 213119 - DNA, 1713 bp, Artificial Sequence
  Description of Artificial Sequence: Synthetic coding sequence
atggaaagcaaaggcgcttcatcgtgtcgactgttgttctgtttgctcatatccgcaacagtctttcgacccggtctgggctggtatacagtgaatagcgcctatggcgatacaataatcatcccatgtagactagacgtccctcagaacctcatgtttggcaagtggaaatacgaaaagccggatggaagtccagtgttcatagcctttcgctccagcactaaaaagtctgtgcaatacgacgacgtccccgagtataaagatcgcttaaacctctctgagaactacactctttcaatttctaacgctaggatctctgacgaaaagagattcgtttgtatgcttgttaccgaggataacgtgtttgaggcaccaaccatagtgaaggtgttcaaacagcccagcaaaccggagattgtctccaaagccctctttctcgaaaccgagcagcttaagaaactgggcgattgcatttctgaggactcctacccagatgggaatattacctggtacagaaacggtaaggttctgcatcctctggagggtgccgtggtgatcatcttcaagaaggagatggatcctgttacacaactctatactatgacctccactttggaatataagaccaccaaggccgacatccagatgccgtttacctgctccgtcacctactacggtccttcagggcaaaaaaccattcacagcgagcaagctgtcttcgacatctactacccaaccgaacaggtgaccatccaggtgttaccccctaagaatgctataaaggaaggagacaatatcacgttgaagtgcttaggcaacggaaatcccccacctgaagagtttttgttttacttacctggtcaacccgaaggcatcaggtcttcaaatacttacacgcttactgatgtgcggaggaatgccactggcgattataagtgctctctaattgacaaaaagtctatgatcgcgagcaccgcgatcactgttcattacttggacctctcacttaatccctcaggagaggtgacacggcagattggcgacgcactgcccgtcagctgcactattagcgctagtcggaacgctacagtcgtttggatgaaagataacatcagactccgcagtagcccctctttcagttccctccattaccaggatgccggaaactatgtgtgtgaaaccgcgcttcaagaggtcgagggattgaagaagcgtgaaagtctgaccctcatagttgagggaaaaccccaaatcaaaatgacgaaaaagactgacccatccggactgtcaaagacaatcatatgccacgtggagggattcccgaagcccgctattcagtggaccataaccggttccggttccgtgattaatcagacagaggagagtccttatattaatggtcgctactactctaagattatcatctccccagaagagaatgttaccctcacatgtaccgcagaaaatcagttagagaggacagtcaactccctgaacgtgtcagctaatgaaaatcgggaaaaagttaacgatcaggcaaaactcatcgtgggcattgtcgtcggactcctcttggctgctcttgtcgccggagtggtgtattggctgtatatgaaaaaatctaagaccgcttccaagcacgtgaataaagatctgggcaacatggaggaaaataaaaaacttgaagagaataaccacaagactgaagcttag

SEQ ID NO: 213120 - DNA, 1074 bp, Artificial Sequence
  Description of Artificial Sequence: Synthetic coding sequence
atggaggtgctgcggccacagctgatccgaatcgacggacggaactaccgcaagaatccagtgcaggaacagacctatcagcacgaagaagatgaggaagacttttaccaggggtcaatggagtgcgccgacgagccttgtgatgcctacgaggttgagcagacacctcagggatttagaagcactctaagggctccatcactcttgtacaagcatatcgtgggaaaaagaggagacaccagaaagaaaatagaaatggaaacgaagaccagcatcagtatccccaaacccggtcaggacggggaaatcgtgatcacaggccagcacagaaacggggttatttcagctcgcacaagaatagatgtcttactggataccttcaggcgcaagcagccatttactcatttcctggccttcttcctaaatgaagtggaagtacaggagggttttttgcggttccaggaagaggtgttggcaaagtgctccatggaccatggtgtggatagctctatctttcagaatcccaaaaagctgcatttaaccatcgggatgcttgtgttactgtcagaagaagagatccagcagacatgcgaaatgttacagcagtgtaaagaagaatttattaatgacattagcggaggtaaaccactggaagtcgaaatggccggaatcgaatacatgaatgatgacccagggatggttgacgtgctgtatgctaaggtgcacatgaaggatggatcaaatagactgcaggaactggttgaccgcgtcttggaaagatttcaagcctcgggattgatcgtgaaggagtggaactcagtgaagctccatgccacagtcatgaatactctgttccgaaaggaccccaacgcagagggacggtataatctgtataccgccgagggtaaatacatattcaaggagagggagagctttgatggaagaaacatacttaagctgttcgaaaatttttacttcggcagcctgaaactcaacagcatacacatctcgcagaggtttaccgttgatagctttggcaactacgccagctgcggccagatcgacttctcttag

SEQ ID NO: 213121 - DNA, 1074 bp, Artificial Sequence
  Description of Artificial Sequence: Synthetic coding sequence
atggaagtcctgagacctcaattgatcagaatcgacggcaggaactacaggaagaatcccgtccaagagcagacatatcagcatgaggaggacgaggaagacttctaccagggatccatggaatgtgcagatgagccttgcgatgcttacgaggtggaacagacaccgcagggctttcggtcaacccttcgcgctccttcactgctatacaagcacatagtgggcaaacggggagacacacggaagaagattgagatggaaactaagacatctatttctatccccaaacctgggcaggacggtgagattgtcataaccggacaacacagaaacggtgtcatctctgcaaggacgagaattgacgtgctcttagatacattccgtcgcaagcaacccttcactcacttcctcgcattcttcctcaatgaggtggaggttcaggagggtttcctcaggttccaggaggaggtgcttgcgaaatgtagcatggaccacggtgtcgacagcagcatattccagaatccaaagaagttgcatctgacaataggcatgcttgtgcttctctcagaggaggagattcaacagacatgcgaaatgttacagcagtgtaaggaggaattcattaacgatatctcggggggtaaaccactggaggtcgaaatggctggaatcgagtatatgaacgacgatcctgggatggtggacgtgttgtatgccaaggtgcatatgaaggatgggtctaataggctgcaagaattggtggatagagtcctggagcgcttccaggcctccggcctgatagtgaaagagtggaatagcgtaaaactccacgccaccgtgatgaacaccctgttccgcaaagaccccaatgctgagggcagatacaatctttatacagcagagggtaagtatatctttaaggagagagagtcttttgacggtcggaacattctcaaactgttcgagaacttctactttggctcgcttaaacttaactctatccacatctcccagcgttttacggtggactccttcggtaattacgcttcttgcggacagattgatttctcctag

SEQ ID NO: 213122 - DNA, 1203 bp, Artificial Sequence
  Description of Artificial Sequence: Synthetic coding sequence
atggaggtcctgcggcctcagttgataaggattgacggtcgcaactatcggaagaaccccgtgcaggagcagacataccaacacgaggaggacgaggaggatttttaccaggggagcatggaatgtgctgatgagccgtgcgacgcgtatgaggttgagcagacaccccaggggttccgaagcacactgcgagcgccaagtctgttatacaacttaattcatcttaatacttccaatgattgtggattccaaaaaattacccttgattgccagaatatctacacttggaagtcgcgtcatattgtcggaaagaggggggacacccgaaagaagatcgagatggaaaccaagaccagtattagcattccaaagcccggtcaggatggtgagattgtcataactggccagcatcgcaacggcgttatctctgccagaacacgaatagacgttttacttgacacttttagaagaaagcagccttttacccacttcctagctttcttcttaaatgaggtagaggtgcaggaggggtttttgcggtttcaagaagaagtcttggcgaaatgcagcatggatcacggagttgatagtagtatttttcagaatcctaagaaattacacctgacgatcggcatgttggtgctcctgtccgaagaggagattcagcagacatgtgaaatgctccagcagtgtaaagaggagtttatcaatgacatcagcgggggtaagcccctggaggtggagatggcaggtatagagtacatgaacgacgatccaggaatggtagatgtgctctacgctaaggtacatatgaaggacggatctaaccggctgcaggagctcgtagacagggtgctcgagcggttccaggcgagcggcttgatcgtgaaggaatggaattccgtgaagcttcacgccaccgtcatgaacaccctgttccggaaagaccccaatgctgagggtagatacaacctttacactgccgaggggaagtacatattcaaggagagggagagctttgacggtcgaaatatcttgaagtctttcgcactacttcccaggctcgaatacaatgatgcgataagtgcccactgtaacctgtgcttgcccggtagtagcgatagcccggcttccgcttcccaggttgccggaataacaggggtttctgacgcctactcccaaagcttaccagggaaaagttag

SEQ ID NO: 213123 - DNA, 1074 bp, Artificial Sequence
  Description of Artificial Sequence: Synthetic coding sequence
atggaagtgcttcggcctcagctgatccgaatcgacggccgtaattaccgcaagaatcctgtgcaggagcagacataccagcacgaggaggacgaggaggatttctaccagggatcgatggaatgcgctgatgagccttgcgatgcatacgaggtggaacagacaccacaaggctttcgctctactctcagggcgccttctcttctgtacaagcatattgtcggaaagcggggagacactcggaaaaagatcgagatggagaccaagactagtatttcaattccgaaacccggacaagacggtgaaatcgtaatcacagggcaacatcgtaacggagttatttcagccaggactagaattgacgtcctgctggatacgtttcgccgaaagcaaccatttactcacttcttagccttttttctgaacgaggtcgaagtccaggagggattcctgagatttcaggaggaggtgctggccaagtgcagtatggatcacggcgtggatagctcaattttccagaatcccaagaaactgcacctcaccattggcatgttggtgctgctgtcggaagaagaaatccagcagacctgtgagatgttacaacagtgtaaggaagagttcatcaacgatattagcggtgggaagcccctagaggtcgaaatggccggtatagagtacatgaacgatgacccaggcatggttgacgtattgtacgcaaaggtccacatgaaggatggttcaaataggctgcaagagctggttgacagagtcctagagcgtttccaagcttctgggctgatcgtcaaggagtggaatagtgtcaaactgcatgccaccgtcatgaacaccctctttaggaaagaccccaatgcagaaggtcgttacaatctgtacacagcagagggcaaatacatttttaaggaacgcgagtcctttgatggacgaaacattctgaaactgttcgaaaatttctacttcggatcgctcaagctaaattcaattcatatttcccagagattcacagtggactcctttggcaattacgcctcctgcgggcaaatcgacttctcctag

SEQ ID NO: 213124 - DNA, 1203 bp, Artificial Sequence
  Description of Artificial Sequence: Synthetic coding sequence
atggaagtgcttagacctcagttgatcaggatcgatggaaggaactataggaagaacccagtccaggaacaaacgtatcagcacgaggaagacgaggaagacttttatcagggctccatggagtgtgcagatgaaccatgcgacgcctacgaagtagagcaaacaccacagggctttaggtcgaccctgagggccccaagcctcctatataatctcatccacctgaatacatccaacgactgcggctttcagaaaatcaccctcgactgtcagaatatatatacctggaagtctcgccacattgtaggcaagaggggcgataccagaaagaagattgaaatggagaccaaaacatccatctcaatcccaaagcccggtcaggacggggaaattgtgataacaggccagcacagaaacggggtcatttcggcccgaactagaatagacgtcctgctcgataccttccggagaaagcagccgtttacgcattttctcgcgttctttctcaatgaggttgaggtccaggagggttttctgaggttccaggaagaggtccttgccaagtgttctatggaccatggcgtggatagcagtatctttcagaatccgaaaaaactgcatctaacgatcggcatgttagtcctactgagcgaagaggaaattcaacagacatgtgaaatgttgcagcagtgtaaggaagagttcatcaatgatatctcaggtggaaaacccctggaggtggaaatggccggtatcgagtacatgaatgacgatccagggatggtcgacgtgttgtacgccaaagtccatatgaaagatggatccaatcgcttgcaggagcttgtagatagagtattggagcgctttcaggctagcgggctgatagtgaaggaatggaatagcgtgaaattacatgccaccgtgatgaacacgctcttcaggaaggacccgaacgccgaggggagatacaatctctacacagccgagggtaagtatattttcaaggagcgcgagagcttcgatggtagaaacatcctgaaatctttcgccctgctgccaaggcttgagtacaatgacgctatttctgcacattgcaacctctgcttgcccggttcatcagactcccctgcttctgcctcacaggtggctggaattacaggagtgagcgacgcttactctcaaagtctgccgggaaagtcatag

SEQ ID NO: 213125 - DNA, 1074 bp, Artificial Sequence
  Description of Artificial Sequence: Synthetic coding sequence
atggaggtgcttcggccacagctgattagaattgacggtaggaactaccggaaaaatccggtgcaggagcagacctaccagcacgaagaggacgaggaggatttctaccagggtagtatggaatgcgccgatgagccttgtgacgcttatgaagtagaacaaaccccacagggattccggtcaactctccgcgctccctctctactctataagcacatcgtgggcaaaaggggcgatactaggaagaagatagaaatggagactaaaacaagcattagcatccccaaaccgggacaggatggggaaatcgtgatcactgggcagcataggaatggggtcatctccgcccgtaccaggatcgacgtgttgttagatacgtttcgtcgcaaacaacccttcacacatttcctagccttcttcctgaatgaggttgaagtgcaggagggctttctgagattccaggaggaggtactagccaagtgctctatggaccacggtgtagacagctctatttttcaaaatcctaagaagctgcatctgactattggtatgctggtgttactctcagaggaggagatccagcagacctgcgagatgcttcagcagtgtaaggaggagttcattaacgacatctctggcggaaaaccactggaggtagagatggccggtatcgaatatatgaacgacgacccaggcatggtggacgtgctgtatgctaaggtgcatatgaaggatggttcaaataggttacaggagttggtggatagggtgctggaacgcttccaggccagcggactcattgttaaagagtggaacagcgtgaaactgcatgcaactgtgatgaacactttgttccgaaaagacccaaacgcagaagggagatacaatctttatacggcagagggaaaatacatatttaaggagcgagagagcttcgatggccgaaacatcttgaaattgtttgagaatttttactttgggagtctgaagctgaatagcattcacatctcccagagatttaccgttgatagcttcggcaactatgcatcctgcgggcagatagactttagctag

SEQ ID NO: 213126 - DNA, 879 bp, Artificial Sequence
  Description of Artificial Sequence: Synthetic coding sequence
tgatacaaacacattgtcggcaaacggggtgacaccagaaaaaaaattgagatggaaacaaaaaccagtatttccatccctaagcccggtcaggatggggaaatcgtgattaccgggcagcaccgcaacggtgtgatatccgcccgaactcgaatcgatgtgctgttggatactttccgccgaaaacagccgttcacccactttctcgcattctttctcaatgaggtcgaggtccaggagggcttcctccggtttcaggaagaagtcctggctaagtgttcgatggaccatggagtggactcctctatctttcagaaccctaagaagctccatctcaccatagggatgctggtgctcctgagtgaagaggaaatccaacagacctgcgaaatgctgcagcagtgcaaggaggagttcataaacgacatcagcggaggcaaaccactagaggtagagatggcagggattgaatacatgaatgatgaccctggcatggtcgacgtgctgtatgcaaaggttcacatgaaggatggaagcaatcggttgcaggagctggtggatcgggtgctcgagagatttcaggcctctggacttatagttaaggaatggaactcagttaagctgcacgccacagtcatgaataccctatttaggaaggaccccaatgccgagggtcggtacaacctatatacagccgaaggcaagtatattttcaaggagagagagagcttcgatgggagaaatatattaaaaagtttcgcactgctgcctcgactggaatacaatgacgccatatctgctcactgtaacctgtgcttgcctggatctagtgacagtccagcttcagcatcccaggttgccggtatcacggtggtgtag

SEQ ID NO: 213127 - DNA, 828 bp, Artificial Sequence
  Description of Artificial Sequence: Synthetic coding sequence
atggaaaccaaaacttccatctccatcccaaagccaggccaggacggagagattgtaattacgggccagcatcgaaatggagttatttctgccagaacacgaatcgacgtgctgctggacaccttccgacgtaaacagccgtttacacacttccttgccttttttctgaacgaagtggaggttcaagagggctttcttaggtttcaagaggaggtgctggccaaatgtagcatggaccatggagtggattcatccatttttcaaaacccaaaaaagctccatctcaccatcgggatgctggtgcttctctccgaagaagagatccagcagacttgcgagatgttgcagcaatgtaaggaggagttcatcaacgacatcagtggaggcaaaccactagaagtcgagatggccggaattgagtacatgaacgatgatcctggtatggtcgacgtgttatacgccaaagtgcacatgaaagacggcagtaacagacttcaggaactcgttgaccgggtcttagagcgtttccaggcctccggtctgatcgtaaaggaatggaacagtgtgaaactgcatgccactgtaatgaacaccctcttccggaaagaccccaatgccgagggcagatataacctgtacacggccgagggcaaatatatctttaaagagcgggagagcttcgacggcaggaacatacttaaatctttcgccctgttacctaggctggagtataacgatgccattagcgctcattgcaacctctgcctgcccggatcctccgattcaccggcatctgccagccaggtcgcaggaattacagttgtgtag

SEQ ID NO: 213128 - DNA, 372 bp, Artificial Sequence
  Description of Artificial Sequence: Synthetic coding sequence
atggaggtgctacgacctcagcttattcgcatagacgggagaaattatagaaagaaccccgtccaggagcagacttatcagcacgaagaggatgaggaagacttctaccagggctctatggagtgtgcagatgagccttgtgacgcctatgaggtggagcagacccctcaggggttccgatctaccctaagggctccatccctgctctataagcacatagttggcaagaggggagatactcgcaaaaaaattgagatggagacaaagacatctatctccattcctaaacccggacaggatggtgaaatcgtgattacgggtcagcaccggaacggagtgattagcgctcggacgagaattgacgtactgtag

SEQ ID NO: 213129 - DNA, 312 bp, Artificial Sequence
  Description of Artificial Sequence: Synthetic coding sequence
atggaggtcctgagaccacagctgattcggattgacggaaggaattatcgtaagaaccctgttcaggaacagacctatcaacatgaggaagacgaagaagacttctaccagggatctatggagtgcgcagatgagccctgcgacgcttacgaggtcgaacagactccacagggcttccggagcacgttgcgtgcacccagtctgctgtacaagcatatcgtgggaaagcggggagatactcgcaaaaaaattgagatggaaacaaaaacctccatttccatcccaaagccagggcaggacggcgaaatctag

SEQ ID NO: 213130 - DNA, 459 bp, Artificial Sequence
  Description of Artificial Sequence: Synthetic coding sequence
atggaggtgcttcgccctcagctcatccggattgatggccgaaattacagaaaaaaccccgtgcaggaacagacctaccagcacgaggaggacgaggaagatttctaccaagggagcatggaatgcgctgatgaaccctgtgacgcatacgaagtcgaacagacaccgcaggggttcaggagcacattgagggcgccttccctgctgtacaaacacatcgtaggtaaaagaggtgacactcgaaagaagatagagatggaaaccaagaccagtattagcatcccgaaacctggtcaggacggggagattgttattactggccagcacagaaacggcgtgatttccgctaggactcggattgacgtactactcgacaccttcaggcgaaagcagccattcactcacttcctcgcattctttctcaatgaagtggaagttcaggaggggtttctgcggtag

SEQ ID NO: 213131 - DNA, 171 bp, Artificial Sequence
  Description of Artificial Sequence: Synthetic coding sequence
atggaagtgctacgccctcaactgattcggatagatgggaggaattatcgcaaaaaccccgtgcaggaacagacgtaccagcacgaggaggatgaggaagatttctatcagggttctatggaatgtgctgacgaaccatgcgacgcctatgaggtcgaacagaccccttag

SEQ ID NO: 213132 - DNA, 1140 bp, Artificial Sequence
  Description of Artificial Sequence: Synthetic coding sequence
atgatgaaataccccggaacatggccctgtcaaggaatcattggaataagctttggcgagagcgtaatggaggtgctcagacctcagctgatcagaatcgatggccgaaattatcgaaaaaatccagttcaagagcagacctatcaacatgaggaagatgaagaagacttttaccagggatccatggagtgtgctgatgagccatgcgacgcttacgaggtggagcagacaccgcaaggttttcgttccaccttgagagctccctcgcttctttacaagcacattgttggcaagcgtggggacacccggaaaaagattgagatggagaccaaaacatccatctctatccccaagccagggcaggatggggagatagtgatcaccggacagcatcgaaacggggtgatctcagcaagaacacggattgatgtgctgctagatacgtttcggcgtaaacagccattcacgcactttctggccttcttcctaaatgaagtggaagtccaggaagggtttctcaggtttcaggaggaggtgctggccaaatgctctatggaccatggagtggacagctccattttccagaacccaaagaaacttcacctgaccatcgggatgttagttctgctgtctgaggaggaaatccagcagacttgcgaaatgctccagcaatgcaaagaagaatttattaatgacatttcgggagggaaaccactggaggtagagatggccggaattgagtacatgaacgacgatcctggaatggtcgacgtcttatatgcaaaagttcatatgaaagacggctccaacaggctgcaggagctggtggaccgggtgctggaaagatttcaggcctcgggactcatcgtcaaggagtggaactcagtcaaactacacgcaacggtgatgaacacacttttcaggaaggatcctaacgcagaaggtcgatataatctttacactgccgaaggcaagtacatatttaaggagcgagagtctttcgacggacggaacatcctgaagctgtttgaaaacttctactttggcagtctgaaacttaactcaatccatattagtcagcggttcaccgtggattccttcgggaattacgcctcctgcggccaaattgactttagctag

SEQ ID NO: 213133 - DNA, 2274 bp, Artificial Sequence
  Description of Artificial Sequence: Synthetic coding sequence
atgcccgcactcccccttgaccaacttcagattacacataaggaccccaagacaggaaagttgcgcaccagtcccgctctgcaccctgagcaaaaagcagataggtactttgtgctatacaagccccctcccaaagacaatatcccagccctagttgaggaatatttggagcgagctactttcgtggcgaatgacttagactggctgctggccttgcctcacgataagttttggtgccaggtgatctttgatgagaccctgcaaaagtgtcttgatagctacttgcgctatgttccccgtaagtttgatgaaggcgttgcatctgctccggaggtagttgacatgcagaaacggctgcataggtctgtgttcttgacattcctccgtatgtctacccacaaagaaagcaaggaccacttcatatctcccagcgcatttggcgagattctgtacaacaatttcctgtttgacattcctaagatattagatctgtgcgtcctgtttggtaaaggcaactccccccttctgcagaagatgattggcaatatctttacacaacagcctagttactatagtgatttggatgaaactctgcccacaattctgcaagttttttcaaatatccttcagcactgcggcctccagggagacggcgctaatacaacaccacagaaattggaagagcgtggaagactgacccccagcgacatgccactcttggagctgaaagatatcgtactctatctatgcgacacttgcacaaccctgtgggccttcctggatatttttcccttggcctgccaaaccttccagaagcacgatttctgctatcgacttgcctctttttacgaagccgcaatacctgagatggaatctgctatcaagaagcggaggctggaagactcgaaacttttaggggacttgtggcagcgactgagtcactctcgcaagaaactgatggaaatcttccatattatactgaaccagatttgcctcctgcccatcctagagtccagttgcgacaacatacaagggtttatcgaggaattcctgcaaatattctcctccctgctccaggaaaagcggttcttgcgggattacgacgccctgttccccgtcgccgaggatatcagtctgttgcagcaggcctcttcagtgcttgacgagacaaggacagcttatatactacaagccgttgagagtgcctgggaaggcgtggaccgacgtaaggccacggacgctaaagacccatctgtgatagaagagcctaatggggagcccaatggggtcacagttaccgcagaggcagtcagtcaggcatcatctcaccccgagaactccgaagaggaagaatgcatgggcgctgcagccgcagtgggtccagctatgtgcggggtagagcttgattcattaataagccaagtgaaggatcttctgccggacctgggtgaaggcttcatcttggcctgtctcgagtattaccactacgacccagagcaggtgattaataacatattagaggagcgactggctcctactctcagtcaactggacagaaatctggaccgcgaaatgaaacctgacccaactcccctgcttaccagtcggcataacgtctttcaaaatgatgaattcgatgtgttttcacgtgattctgtcgacctgagccgtgtgcataagggcaaaagtacaaggaaggaggaaaatacacggtcgctactcaacgacaaacgcgctgtcgcagcgcagaggcagcgatatgagcagtactccgtcgttgtcgaggaggtccctctccagcctggagagagtttgccataccactctgtttactacgaggacgagtatgacgacacctacgacggcaatcaggttggcgcaaatgacgccgatagtgatgatgaattaatcagccgacgtcctttcaccatcccacaggtgctgaggaccaaggtgccccgagaaggacaggaggaggacgacgacgacgaggaggatgatgctgacgaagaggctcctaagcccgaccatttcgttcaagacccagctgttttaagggagaaagccgaagctagacggatggcattcctggccaaaaaggggtatcgacacgactcgtccacagccgtggcaggaagcccccgtggtcacgggcagtccagggaaactactcaggagcgccgtaaaaaggaagcaaacaaagctaccagagctaatcacaatcgtaggacaatggctgataggaagcggtccaaggggatgatcccttcatag

SEQ ID NO: 213134 - DNA, 2274 bp, Artificial Sequence
  Description of Artificial Sequence: Synthetic coding sequence
atgcccgctttgcccctggaccagctgcagattacacataaagatccgaagaccgggaagctccgtaccagtcccgcactacacccagaacaaaaggccgatcgatactttgtgctgtataaaccccctccaaaagataacatccctgccctggtggaagagtacctcgaaagagccactttcgtggccaatgatttggactggctcctggccctccctcacgacaaattctggtgtcaagtaatcttcgacgaaactttgcagaaatgcctggattcgtatctcagatatgtacccagaaagtttgacgagggggtggcctcagctcccgaggtcgtggatatgcaaaagagactgcaccggagcgtctttcttactttcctgcgtatgtcaacgcacaaggagagcaaggatcatttcatcagtccgtctgcatttggggagattctgtataacaatttcctattcgatatcccgaaaattctggatctgtgtgtgctgttcggcaagggcaactctccactattacagaaaatgattggcaacatctttacccagcagccttcatattactctgatctggatgagaccttgcctactattctgcaggtattcagcaacatcctgcagcactgtggcttgcagggggacggtgcaaatactacaccccagaagttagaggaaagaggacggttaacgcctagtgacatgcccttactcgagctgaaggacattgttctttacctctgcgatacttgtaccaccctgtgggcttttctggacatatttcccttggcctgtcaaacttttcagaagcacgatttctgttatagacttgcttcattttatgaagccgcaattcccgaaatggaatcagcgatcaaaaaacgcagacttgaagatagcaaactgctgggagacctctggcagcggctgagtcacagcaggaagaaactgatggaaatcttccatattatcctgaatcaaatctgtctacttcccattctggagtcctcttgcgataacatccagggatttattgaggagttcctccagatcttctcctccctgttacaagaaaaaagattcttgagggactacgacgccctattcccagtggccgaggacatttcactcctgcagcaggcatccagtgtgttagacgagactaggacagcttatatcctgcaggctgtggaatccgcttgggagggggtcgaccgtaggaaagccaccgacgccaaggatccctccgtgattgaggaacccaacggtgagcctaacggagttacggtgaccgccgaagccgtcagccaggctagctcccatcctgaaaacagcgaggaagaagagtgcatgggggctgctgctgcagtgggccctgctatgtgcggagtcgagctggattccttgatcagtcaggtcaaggacctgctgcccgatctgggggaggggttcattttggcttgtctggagtactaccactacgatccagaacaggtcattaacaacatcctagaagagcgcctggctccgaccttgtcacaattggaccggaacctggacagagaaatgaagccagatcccacacccctgctgacaagcaggcacaacgtattccagaatgacgagtttgacgtcttctcgagggactcagttgacctcagccgtgtacacaaaggaaaaagtactcggaaggaggagaatacacggtccctgctgaatgacaagcgtgcagtggcagcccagagacagaggtacgagcagtattccgtcgtcgtggaagaagtgcctcttcagccgggtgagtccctgccttatcactctgtgtattatgaagacgagtacgacgacacatatgacgggaaccaggtgggggcaaacgacgctgactccgatgacgaattgatttcccggaggccattcacgattccacaggtgctgcggactaaagttcctcgagagggtcaggaagaggacgacgacgacgaggaggatgatgctgacgaagaagcacccaaacccgaccatttcgttcaggatccggctgtgctccgtgagaaagccgaggccaggcgcatggcatttctggctaagaagggatacaggcacgactcgtcaaccgcagtcgccggttctcctaggggacacgggcagagtcgggaaactacccaagaaagacgtaaaaaagaagccaataaagctacccgagctaaccataacagacggactatggctgatcggaagcgtagcaaggggatgatcccatcttag

SEQ ID NO: 213135 - DNA, 723 bp, Artificial Sequence
  Description of Artificial Sequence: Synthetic coding sequence
atgcctgctctccctctcgaccaactccaaatcacacacaaggatcctaaaacagggaagttgcgaacttcccccgctctgcatcctgagcagaaggccgacaggtacttcgtcctttacaagccaccacccaaggataacattcctgcactggtcgaggagtacctagagcgtgctacattcgtggcgaatgatctagattggctgctcgcactcccccatgacaaattttggtgccaggttatcttcgatgagactttacagaagtgcctggatagttacttgcgttatgtcccacgaaaatttgatgagggggtagcctccgcccctgaggtcgtcgatatgcagaaacgacttcatcgaagtgttttcctgacttttctgaggatgtctactcacaaggaatccaaagaccacttcattagcccttcggcatttggtgaaatcctgtacaataactttttgtttgatattccaaagatactggatttgtgcgttctcttcgggaaggggaacagcccactcttacagaaaatgataggcaatattttcactcagcagccttcatactatagcgatcttgatgagactttacctactatcctgcaggtgttctctaacatactgcaacactgcgggctccagggcgatggggcaaacaccacacctcaaaagctagaggagagaggcaggctcactccctcggatatgccactgctatag

SEQ ID NO: 213136 - DNA, 2046 bp, Artificial Sequence
  Description of Artificial Sequence: Synthetic coding sequence
atgcccgctttgccccttgatcagttacagatcactcataaggatcctaaaactggaaagctgcgcacgtctcccgcactggtaattttcgacgagacgctacagaagtgtctcgactcatacttacggtatgtgcctagaaaatttgatgaaggcgtcgcatctgctcccgaagtggtggacatgcagaaaagattgcaccgttctgtgttcctgactttcctgcggatgagcacccacaaggaaagcaaaatccttgacctttgcgtactttttgggaaaggtaatagccccctgctgcaaaagatgattggtaacatcttcacccaacagccatcctattacagtgatctggatgagacactccccacaatcctgcaggtcttctctaacattctacagcattgtggcctccagggggacggcgctaacaccacccctcaaaagctggaagaacggggtcgcctgacaccctctgatatgccccttttggaactaaaggacatcgttctgtacctgtgcgatacctgcacaacattgtgggccttcctcgatattttccctctcgcctgccaaaccttccaaaagcacgatttttgttacaggctcgcttccttctatgaggcggctatcccagagatggaaagtgcaatcaagaagcgtaggctcgaggattccaaactgttaggcgatttgtggcagcggttgagccacagccgcaagaaacttatggaaattttccatattatccttaaccagatctgtttgctgccaatcctggagagttcctgcgacaacatccagggctttatcgaggagttcctccagatttttagctcactgcttcaggagaagaggttcctccgcgactacgacgcccttttcccggtggcggaggacatcagtctgcttcaacaggcttcatctgtgctggacgaaaccaggacagcctacattctgcaagccgtagagtccgcttgggagggggtggacagacgaaaggcgacagacgccaaagatcccagcgtcatcgaggagcctaacggcgagcccaacggagtcactgtcacagcagaggctgtgagccaagcttcttcccaccccgaaaatagtgaggaagaggagtgtatgggcgctgccgctgctgtcgggccagctatgtgtggcgtcgagctggacagtttaattagtcaggtcaaagatctgttaccagatttaggcgaagggtttatcctcgcttgcctggaatattaccactatgatcctgaacaggtgataaataacattcttgaagagcggctggctcccaccctgtctcagctggaccgaaatctcgacagggagatgaagcccgacccaactccactcctcacctcccggcacaatgttttccagaacgacgaatttgacgttttcagccgggatagtgtggacctatcaagagtacacaaagggaagagcacaagaaaggaggaaaatacacgatcactgttgaacgacaaacgcgctgtggcagctcagaggcagcgctacgagcagtacagcgttgttgtggaggaagtgccattacagcctggcgaaagtcttccctaccacagtgtttattatgaggacgagtacgatgacacctacgacggcaaccaggtgggggcaaatgacgcagactctgacgatgagcttatttcgcggaggccttttaccataccgcaggtgcttcgaactaaggtgcctcgcgagggacaggaggaagatgatgacgatgaggaagacgacgctgatgaggaggctcccaagcctgatcacttcgtgcaggaccccgcagtcctgcgcgaaaaggccgaagcgcgtagaatggccttcctcgcaaaaaaaggatatagacatgactctagtacagcagttgccggatcacccagaggacatggacaatccagggagaccacccaagaacgacgcaagaaggaggccaacaaagccacacgtgcaaaccacaataggcgaaccatggccgaccgaaagagaagtaagggaatgatccccagctag

SEQ ID NO: 213137 - DNA, 531 bp, Artificial Sequence
  Description of Artificial Sequence: Synthetic coding sequence
atggcgctcccccgtcttaccggcgctctgaggtccttttccaacgtgactaagcaggacaactataacgaggaggtcgcagacctaaaaatcaagagatctaagcttcacgaacaagtgctcgacttaggcctgacgtggaagaaaataattaagtttcttaatgagaaactggaaaaatcaaagatgcagtccattaacgaagatctgaaagatatactgcacgctgctaagcagatcgttggcactgataacggaagagaagccattgaatctggtgcagctttcttattcatgacatttcacctgaaggacagcgtgggacacaaagagacaaaggcgataaagcagatgttcggcccattcccgtcatccagcgctacagccgcatgcaatgccacaaacagaataatatctcatttctcacaggatgatttgaccgcgctggtgcagatgacagagaaagagcacggcgacagggtgttcttcggcaagaatttggcctttagcttcgacatgcacgatctgtag

SEQ ID NO: 213138 - DNA, 336 bp, Artificial Sequence
  Description of Artificial Sequence: Synthetic coding sequence
atggcattgcctcggctcacaggcgctctgcgttcgttcagtaatgtcaccaagcaagacaactataacgaggaggtggctgacttaaagatcaagaggtccaaactccacgaacaggtgcttgatctgggcctcacgtggaagaagatcattaagttcctgaatgaaaaactggagaaaagcaaaatgcagagcatcaatgaggaccttaaggacatcctccacgccgctaaacagatcgaggtgaattgtccattccagaaaaggaggctcgacggcaaggaagaagatgaaaagatgagtagggcctcagatcgttttcgaggattgcggtag

SEQ ID NO: 213139 - DNA, 6608 bp, Artificial Sequence
  Description of Artificial Sequence: Synthetic coding sequence
atggcactgccccgattaactggcgctcttaggtccttcagtaatgtgactaagcaggacaactacaacgaggaagttgcggatctaaagattaaaaggtccaaactgcatgaacaggtgctggatttgggcctcacttggaagaaaataatcaaattccttaacgaaaagctggaaaagtcaaagatgcaatccattaacgaagacctaaaggacattctgcacgcagccaagcagattgtcggtaccgacaacggacgagaggccatcgagagcggggcagccttcctctttatgacgttccatctcaaggattctgtgggacacaaggaaaccaaagccatcaagcagatgttcggccctttcccttcctcgtcagcgaccgctgcttgtaacgctacaaacagaatcataagtcatttttctcaagacgaccttacagctctagtccagatgactgaaaaagagcatggagatagggtcttttttggaaagaacctcgccttcagcttcgatatgcacgatctggaccattttgacgaactccccatcaacggcgagacccaaaagaccatctcgctggattacaagaaatttctgaacgagcatctgcaggaagcctgcacacccgagcttaaacctgtcgaaaaaaccaatggtagttttctctggtgcgaagtggagaaatatcttaacagtacattgaaggagatgaccgaggtacctcgagtggaggatctctgttgcacactgtacgacatgttagcctcgataaaatctggggacgagctgcaggacgagcttttcgaattactagggccagagggactggagctgatagagaaactccttcagaacagaattaccatagtcgatagatttttgaacagctcaaacgaccatcgctttcaggcattacaggataactgtaaaaaaattctgggagaaaacgctaaacctaattacgggtgccaggttacaatccaatccgagcaggagaaacagctcatgaagcagtaccgacgagaggaaaagcgcattgctcgtcgcgagaaaaaggcaggagaggatttagaggtaagcgagggtctgatgtgctttgatccaaaggagctgagaatccagagggagcaggccctgctaaacgcccgatcagtacccattttaagtcggcaacgtgacgccgacgttgagaaaatacactatccccatgtttacgactcccaagcagaagcaatgaaaaccagcgcgtttattgctggtgccaaaatgattttgcctgaaggaatacaacgcgaaaacaataagctgtacgaggaggtgcgaattccttacagtgagccaatgccgctgagtttcgaggagaagcctgtgtatatacaagatctggatgagatcggccagctggcctttaaaggcatgaagagactgaacaggatccagagcatagtgttcgaaaccgcatataacaccaacgaaaacatgttgatctgcgcccctacaggtgccggaaagaccaatatcgcaatgctaactgtgcttcatgagattaggcagcactttcagcagggcgtaattaagaaaaatgagtttaaaatcgtatacgtggcccctatgaaggctcttgccgcagagatgacggactatttctccagacggctagaaccactgggcataatagtgaaagaacttacaggagatatgcagttgagtaagagtgagattctgaggacccagatgcttgtaacaacccccgaaaaatgggacgtggtaacaagaaagtcggtaggagacgtcgccctctcccagatagtgcgcctgttgattctggatgaggtccatctgctccacgaggatagggggcctgtgttggaaagcattgttgctcggactctcagacaggtcgagagtacccaatccatgattcgaatcttaggcctgagcgcgactctgcccaattatttggatgtggctacgttcctgcatgtcaatccctatattgggcttttctttttcgacggacgctttcgaccagttcccctgggccaaacgttcctgggcattaagtgcgctaacaagatgcagcaacttaacaacatggacgaagtgtgctatgaaaacgttctgaagcaggtcaaggccggacaccaggtaatggtgttcgtgcacgcgcgaaacgccaccgtgagaactgcaatgtcactgattgaaagagcaaagaattgcggacacatccccttcttttttccgacacagggccacgactatgtgctcgcagaaaagcaggtacagcgaagtagaaataagcaagtcagggaactgttccccgatggcttttctatccaccatgcaggcatgctccggcaggatagaaatctggtcgagaacttgtttagcaacggtcatattaaagtgttggtttgtacggccacacttgcctggggggttaacctgccagcccacgctgtcatcatcaaggggacccagatctacgccgctaagaggggctcctttgtcgacctgggaatcctcgatgttatgcagatcttcggtcgagcgggtcgccctcagttcgacaaatttggcgaagggatcatcattacaacccatgataaactgtcacactatctgaccctgctcactcagcgaaaccctatcgagagccagtttctggagtccctggcagacaatctcaatgccgaaattgcacttgggactgtcaccaacgtggaggaggcggttaaatggatatcctatacttacctctacgtgcgcatgagagccaaccctttagcctatggaatctcacataaggcctaccagatcgacccgacactgcggaagcatcgggagcagcttgtaatagaagtaggacgcaaacttgataaggcgcagatgatcaggtttgaggaacggactggctatttcagttcaaccgacctcggtagaacagcttctcactactacatcaagtataacaccattgaaacttttaatgaactgtttgacgcccataaaacagagggagacatatttgcaatcgtttcaaaagcagaagagttcgatcagattaaggtgagagaagaagaaattgaggaactggataccttgctgtctaacttttgtgagctgtcaactcccggaggggtcgagaacagttatgggaagattaacattcttttacagacttacatctcccggggtgagatggactctttctccctgatcagcgactctgcttacgtggcccaaaatgccgcacgtatagtgagggccttgtttgaaatagctctcaggaagaggtggccgacgatgacataccggttactaaatctatctaaggtaattgataagcgcctctggggatgggccagcccgttaagacagttctcaatccttccacctcacattctgaccagacttgaagagaaaaaactgaccgtcgataagcttaaggatatgagaaaggacgagataggccacatactgcaccacgtgaatatcggactgaaagtgaagcagtgcgtacatcagatcccatccgtcatgatggaggcttcgatccagcccattacaagaaccgtcctccgtgtaaccctctcaatctacgcagatttcacgtggaatgaccaagttcacgggaccgtgggggagccctggtggatctgggtcgaggatccaactaatgatcacatctaccactctgagtactttcttgctctcaagaaacaggtcatctctaaagaggcccagctgcttgtattcacaataccaatctttgagcccctccccagtcaatactacatccgagccgtgtccgacagatggttaggggctgaagccgtctgtattattaactttcagcatctcatattaccagaaaggcatccccctcatacagagctgctggatttgcagcccctgccaattacagctctgggatgcaaagcctacgaggccctgtacaatttcagtcatttcaacccagtacaaacgcaaatcttccacaccctttaccatacagattgtaatgtccttttaggagctccaaccggttccgggaagactgtggctgcagagctggccatcttcagagtgttcaataaatatcccacatctaaagctgtctacatcgctcctttaaaggccttggttagggagaggatggatgactggaaggtgcggatcgaagaaaagctgggaaagaaggtgattgaactcaccggagacgttaccccggacatgaaatctatcgcaaaagctgacctcatagtgaccacccccgaaaagtgggacggggtgtcaaggtcgtggcagaaccggaactacgtccagcaggttacaattctgatcatcgacgaaatccacttactaggcgaggagcggggaccggtgttggaagtaattgttagtagaactaacttcattagctcccatacagaaaagccagttcgtatcgtggggctctccaccgcgttagccaacgctcgcgacctcgccgattggttgaacattaagcaaatgggcctgttcaacttccgcccttcggtcagacccgttcccttagaggttcatatccagggttttcctgggcaacattactgtcccagaatggctagcatgaataaaccagcctttcaggctatccgatcccattcccctgcaaagcccgttcttatttttgtgtcttccaggcgccagaccaggttgaccgccctggagttgatcgccttcctagctacagaggaagacccgaaacagtggctaaacatggacgagagggaaatggagaacattatcgctactgtccgagattcaaatcttaagcttactcttgcttttggcattggaatgcaccacgccggactacacgagagagaccgtaagacggtggaggagctatttgttaactgtaaggtacaggtgctgatcgcaactagcaccctcgcctggggcgtcaactttccggcacacttggtcataattaagggaaccgagtattacgacggtaaaactcgacgctacgtggacttcccaatcacggacgtgctgcaaatgatgggaagggctggaagaccgcagttcgacgatcagggtaaggccgtcatcttagtgcatgacattaaaaaggacttctacaagaagtttttatatgagccattccctgttgaaagcagcctgctgggcgtgctgtcagatcatttgaacgccgagattgccggaggcaccattacctccaagcaagatgcattggactacataacgtggacatatttttttcgcaggctcattatgaatcccagttactataacctgggtgatgtttcacacgattcagtgaataaattcctatcgcatctcatagaaaagtctctcatcgagctggaattgtcttactgcattgagataggggaagataacagaagcatcgaacccctgacttatggcaggatcgcttcctactactacctgaaacaccagactgtgaaaatgttcaaggatagactaaaacccgagtgcagcaccgaggagctgctgtccatactgagcgacgccgaagaatacactgatctacctgtgagacataacgaagatcatatgaacagtgaattggctaagtgcctgcctatcgaaagcaacccccactctttcgacagccctcacaccaaggcccacctgctgttgcaggcacatctcagtcgcgctatgttgccatgtcccgactacgataccgatacaaagactgtcttggaccaggcgttgcgggtttgccaggctatgctcgatgtggcagcgaatcaggggtggctcgtgacagtgctgaacataaccaatttgatccaaatggtaatccagggacgctggttaaaagactcaagtctgcttactcttccaaatatagagaatcaccacctgcacctgttcaagaagtggaagccaataatgaaaggcccacacgccagaggcaggacatccatcgaatctctgccggaactgattcacgcttgcggcggaaaagaccatgtcttcagcagcatggttgaaagtgagctccacgccgctaaaacgaaacaggcttggaatttcctctctcatctacctgtcatcaatgtgggaatttccgtgaaaggcagctgggatgacctggtcgagggtcacaatgaattgagcgtgagcaccttgaccgccgataagagagacgataacaaatggataaaactgcatgcagaccaggaatacgtcttacaggtcagcctgcagagggtccatttcgggttccataagggtaaacccgagtcatgcgcagtgacgccacgtttcccaaaaagtaaggatgaagggtggtttctcattttaggtgaagttgacaagagagagctgatcgctcttaagagggttggctacatccgcaaccatcatgtcgcaagcttgtctttctatacccccgaaatcccaggtagatatatttacaccctgtactttatgtcagattgctacctggggctcgatcagcagtacgacatctacttaaacgtaacacaggcctctttgtcagcacaggtaaatacgaaggtgtccgatagtctgactgacctcgccttgaagta

SEQ ID NO: 213140 - DNA, 816 bp, Artificial Sequence
  Description of Artificial Sequence: Synthetic coding sequence
atggaagacagccacaaatctacaaccagcgagacagccccacagccgggaagtgctgtacagggggcacacatttcccacattgcccagcaggtcagttctctgagcgaatccgaggaaagtcaagactcctccgatagtataggaagcagtcagaaagcccatggcattctggcacgaaggccctcctacagaaagatactgaaggatttgtcttccgaggatactcgcggaagaaaaggcgacggagaaaattccggcgtgagcgctgcagtaacttcaatgtccgtgcctactcctatctaccagacttcatctgggcagtacatcgccattgcccctaatggggcactgcagctcgccagtccagggaccgatggtgttcagggcctccagactctgacgatgacgaactctggctccacacagcagggcacgacaatacttcagtacgcacaaacaagcgacggacagcaaatcctggtgccctctaatcaggtggtcgtccagacagcatctggagatatgcagacctaccagatcagaaccacccccagtgcaacttccttgccacagaccgtggtcatgacttcccccgtcacgttgacatcccagacaaccaagaccgatgacccgcagctgaagcgagagatccgattgatgaagaatcgggaggctgccagagaatgcaggaggaagaagaaggaatacgtgaaatgcttggagaaccgtgtagctgtccttgagaatcagaataagacactcatcgaggaactaaagacccttaaggatctgtacagtaataagagtgtctag

SEQ ID NO: 213141 - DNA, 411 bp, Artificial Sequence
  Description of Artificial Sequence: Synthetic coding sequence
atgaccaattccgggtcaactcagcagggtactacaattctgcagtacgctcaaactagcgatgggcagcagatcctggttccctccaaccaggtcgtggttcaaacagcttccggcgacatgcagacataccagatcaggaccacgccatctgcgacttcccttcctcagactgtggtgatgaccagccccgtgacgctgacttcgcagaccaccaagactgatgatccccaactgaaaagagagattagactcatgaaaaatcgcgaggctgccagggagtgtcgcagaaagaaaaaggagtacgttaagtgcctagagaatcgggtggcagtgctggaaaaccagaacaaaactctgatcgaggaattgaaaactctaaaagacctatattccaataagagcgtatag

SEQ ID NO: 213142 - DNA, 603 bp, Artificial Sequence
  Description of Artificial Sequence: Synthetic coding sequence
atggaagattcacacaagagtacaacctcagagacagctccccagcccggaagcgccgtccagggagctcacatctctcacatcgcccagcaagtgtcttccctgagtgagagtgaagagtctcaggattcaagcgattccataggctctagtcaaaaggcccatggaattcttgctagacggccatcatatagaaaaatactcaaggacctttcatctgaggatacgcgcggacggaagggcgatggggaaaatagcggcgtgagtgccgcagttacctccatgtctgtgccaacacctatctaccagactagcagtggccaatatatagccatcgcccctaatggggcactgcagctcgcgtcccctggcacagacggtgtgcagggtctccagaccctcaccatgacaaacagcggctccacacagcaaggcaccaccattctgcagtatgctcagacgtctgatggccaacagatcctggttccttccaaccaggtcgttgtccaaaccgcctccggcgatatgcaaacctatcagattcggactacgccttcggcaacttctctgccacagactgtggtgatgactagtccggtatag

SEQ ID NO: 213143 - DNA, 513 bp, Artificial Sequence
  Description of Artificial Sequence: Synthetic coding sequence
atggaagactcacacaaatcgactactagcgagacggccccacagcccggatcagcagtgcaaggtgcccacatatcccacatcgcacagcaggtttctagcttatctgaatccgaggagtctcaagactctagtgattccattggcagtagccagaaagcccacggaatcttggcacggagacctagctaccgcaaaatcctgaaggatctgtcatctgaggacacacgaggacgcaagggcgatggtgagaactccggggtctcagccgctgtgaccagcatgagtgtaccaactcctatctatcaaacatccagcggtcagtatatcgctattgctcccaatggcgcactccagttggcctcccccggaaccgatggggtacaagggcttcagactcttaccatgaccaatagtggctcaacacaacagggaaccacgattctacaatacgcccagactagcgacgggcagcagatcctggtcccgtccaaccaggtggtcgtgcagtag

SEQ ID NO: 213144 - DNA, 321 bp, Artificial Sequence
  Description of Artificial Sequence: Synthetic coding sequence
atgatgttgcagcaccctggtcaggtctcggcaagtgaagaagagctcagattcgccatccagaacaaacatttatgccaccgtatgagcagcgctcttgagagtgtgaccgtatcagaccgccctttgggagttagtattaccaaagccgaggtggcccctgaagaggacgaaaggaagaaacgacgcagggaacgaaataaaatcgccgctgctaaatgtcggaacaagaagaaagaaaagaccgaatgcctgcagaagctcccacgcccattctgggtccagaagacttgcatctgggctgtggacagctgcaagtag

SEQ ID NO: 213145 - DNA, 546 bp, Artificial Sequence
  Description of Artificial Sequence: Synthetic coding sequence
atgatgctccaacacccgggacaggtcagcgcgtcggaagtatcagctagtgctattgtgccctgcttgagcccaccagggtcattggtgttcgaagatttcgctaatcttacgccatttgtcaaggaggaattgagatttgccattcagaacaaacacctctgccatcgcatgagctcggccctagagtctgtgacagtgtcggaccgtcctttaggtgtgtctattacaaaagccgaggtggcccctgaagaagacgagcggaaaaagaggaggcgcgagagaaataagatcgccgctgcaaagtgtcggaacaaaaagaaagaaaagactgagtgcttacaaaaggagagcgaaaaactggagagcgttaatgctgagctgaaagcacaaatagaagaactgaaaaacgaaaaacagcacctgatttacatgcttaatttgcacaggcctacatgtatagtccgcgcacagaatggtagaacacctgaggacgagcgcaatttgttcattcagcagattaaggagggcaccctgcagtcttag

SEQ ID NO: 213146 - DNA, 528 bp, Artificial Sequence
  Description of Artificial Sequence: Synthetic coding sequence
atgatgctccagcaccccggtcaagtttcagcttctgaggtgagtgcatcggccattgtgccctgcctgtctccgccagggtccttggtgtttgaagattttgcaaacctcacgccatttgtaaaggaggagctccggttcgcgatacagaacaagcatctgtgccaccggatgtcatccgcccttgagtctgtgactgtctccgaccgccctttgggggtgtcgataactaaggctgaagtggctcctgaagaggacgagcggaaaaagcggagaagggagagaaataaaatcgcagccgcaaagtgtcgcaacaaaaaaaaggaaaagactgagtgtctgcagaaggagtcggagaaactggaatcagtcaacgccgaattgaaagctcagatcgaggagttgaagaacgagaagcaacacttgatttatatgctgaatctgcacagaccgacatgtatcgttagggcccaaaatgggcgtacaccagaggatgagcgcaatctctttatccaacagatcaagtag

SEQ ID NO: 213147 - DNA, 408 bp, Artificial Sequence
  Description of Artificial Sequence: Synthetic coding sequence
atgatgctacaacatcccggtcaggtgtctgcatctgaagtatccgcctccgctatcgttccatgcttaagccctccaggaagcctggtgttcgaagatttcgcaaatcttaccccgtttgttaaagaggagctgaggttcgcaatccagaacaagcatctctgccacagaatgtcttctgcattggaatccgttaccgttagtgatcgcccactcggggtgtctatcaccaaggccgaagtggcacccgaagaagacgaacgaaaaaaacgcaggagggaacgcaacaagattgccgctgcgaaatgccgcaataaaaaaaaggaaaaaacagagtgtctgcagaaattgcctagaccgttctgggtgcaaaagacctgtatttgggcagtggacagctgcaagtag

SEQ ID NO: 213148 - DNA, 375 bp, Artificial Sequence
  Description of Artificial Sequence: Synthetic coding sequence
atgagctctgccctggaatcagtgactgtcagcgacagaccccttggcgtcagcattacaaaggccgaggtcgctccagaggaagatgagcgaaagaagcggaggagagagcgtaacaagatagccgcagcaaaatgccggaacaaaaagaaagagaaaacagaatgcctgcagaaggagtcagaaaagctcgagagcgttaatgctgagctgaaagcacagattgaagaattgaaaaatgaaaaacagcacctgatctatatgctcaatcttcaccggcctacatgcatcgtcagggcacagaacggcagaacccccgaggacgagcgcaacttgttcatccagcagattaaagaaggcaccctacagtcctag

SEQ ID NO: 213149 - DNA, 546 bp, Artificial Sequence
  Description of Artificial Sequence: Synthetic coding sequence
atgatgctgcagcaccccggacaggtttcagcgagtgaggtaagcgcctctgctatcgttccttgtctcagccctcctggctcccttgtatttgaggatttcgccaatcttactccatttgtgaaggaggagctgcgtttcgccatccaaaataaacatctgtgtcaccggatgtccagcgcacttgagtcggtgacagtgtctgaccgaccacttggcgtcagcatcacgaaggccgaagtggctcctgaagaggacgagcggaagaagcgcaggcgcgagcgcaacaaaattgctgcagcaaagtgtcggaacaagaagaaggaaaagaccgaatgtctccagaaggaatcagagaaattggagagcgtgaacgccgaactgaaagcccagatagaggaacttaagaatgaaaagcagcacctcatctatatgctaaaccttcatcgtccaacttgcattgtacgcgcacagaacggccgaaccccagaagacgagagaaacctatttatccagcagattaaggaaggcacactccagtcttag

SEQ ID NO: 213150 - DNA, 408 bp, Artificial Sequence
  Description of Artificial Sequence: Synthetic coding sequence
atgatgctgcagcaccccggacaggtgtctgcctctgaggtgtctgcaagtgccattgtgccctgcctctctcctccgggaagcctcgtgttcgaagactttgctaacctcacaccgttcgtgaaggaagaattgcgttttgccattcagaacaagcatctctgtcaccggatgagctccgccttggaatccgtgacagtgagtgacaggcccttaggcgtgtcgattaccaaggccgaagtcgctcctgaggaagatgagcgaaaaaagagacgtagagagcgaaacaaaatagccgcagctaaatgccgcaacaagaagaaggagaagacagagtgtctgcagaaactgccaagaccattctgggtccagaagacatgtatatgggctgtggactcatgtaagtag

SEQ ID NO: 213151 - DNA, 1056 bp, Artificial Sequence
  Description of Artificial Sequence: Synthetic coding sequence
atgaccgagatgagctttcttagttctgaagtcctggttggcgaccttatgagcccttttgatcagtccgggttgggtgcggaggagtccctcgggttgcttgacgactacttggaggtggccaagcatttcaaaccacatggcttttccagtgataaagcgaaggcaggaagcagcgaatggcttgccgtggacgggctggtgagtccttccaataactcaaaagaggacgccttcagcgggaccgattggatgttggagaagatggaccttaaggaattcgacctcgacgccctgctcgggatcgatgacctggaaacaatgccagatgacctcttaacaacgctcgacgatacctgcgatttattcgcacccctcgtacaggaaaccaacaaacagcctcctcaaactgtgaatcctatcggccacttaccggagtcactgactaaaccagaccaagtcgcaccttttacatttctccagccattgcctctgtcccccggagtgctgagcagcacacccgaccacagtttttccttggagcttggtagcgaggtcgacattacagaaggtgatcgcaaacctgactacaccgcatatgtggccatgatcccccaatgcataaaagaggaagacacccctagtgataacgattcaggtatttgtatgagtccagaaagctatctcggatctccacagcattccccttctacaaggggaagtcccaatagatcactgccctctcccggagtgctgtgtggaagcgcgaggcccaaaccttacgacccacctggcgagaaaatggtcgccgctaaggtgaagggagaaaagctggacaagaagctgaagaaaatggagcaaaataagaccgccgcaaccagataccgtcagaagaagcgggctgagcaagaagccctcaccggcgaatgcaaagagctcgagaaaaagaacgaagccctcaaagagcgcgctgactccctggcaaaggaaatacagtacctcaaggacctcatagaagaagtgagaaaggctaggggaaagaagagggtgccttag

SEQ ID NO: 213152 - DNA, 1056 bp, Artificial Sequence
  Description of Artificial Sequence: Synthetic coding sequence
atgacagagatgagtttcttatcctctgaggtgctggtgggagatttaatgagcccattcgatcagagcggcctcggggctgaagagagcctgggtcttttggacgattatttagaagtcgccaaacatttcaaaccacacgggttttcctccgataaagccaaggccggaagctctgaatggctggccgtggacggcttagtgagcccatccaacaatagcaaagaagatgccttttctggaactgactggatgctcgaaaaaatggacctaaaggaatttgatctcgacgctctgctgggcatcgatgacctcgaaaccatgcctgacgacctgctgaccaccctggatgacacctgcgacctcttcgccccactggtgcaggaaacaaataagcagccaccccagactgtcaatcctattggtcatctgccagaatccctaaccaagcctgatcaggtagcgccatttacattcctgcagccactacctttatccccaggagttctctcttccacccccgatcatagcttctctctggagctggggtctgaggttgacattactgagggagaccggaaacctgattatacagcttacgtcgcaatgatcccccaatgcattaaggaggaagatactccctccgataatgactcgggaatctgcatgtcccccgaatcctacttgggaagcccccagcattctccttccacgcgcggaagtcctaacaggtccctccctagccccggtgtactgtgcggatctgctcggcctaagccatatgatcctcccggagaaaagatggtcgcagccaaagttaagggtgagaagttggataagaagctgaaaaagatggagcaaaataaaaccgccgctacaagataccgccaaaagaagcgcgctgagcaggaggcactcactggcgaatgtaaggagctggagaagaaaaacgaggccctgaaggagagagctgactctctcgctaaagagattcagtacctgaaggatttgatcgaggaagttagaaaggccaggggaaagaaacgagttccttag

SEQ ID NO: 213153 - DNA, 1056 bp, Artificial Sequence
  Description of Artificial Sequence: Synthetic coding sequence
atgaccgaaatgagctttctttccagtgaggtgctggtgggggacctgatgtccccttttgaccaaagcggccttggcgctgaagaatccctggggctgttggacgactatcttgaagtcgcaaagcactttaagccacatggatttagctctgataaggctaaggccggttcatctgagtggctggccgtggatggcttggtctccccgagtaacaactcaaaggaggacgccttctccgggacagactggatgttggagaagatggacctgaaagagtttgacctagatgctctgctgggcatcgacgatctcgagacaatgcctgatgacctactgactactttggacgatacatgcgacttgtttgctccattagtgcaggagacaaataagcagcctccgcaaactgtgaatcccatcgggcatctgcctgaaagtcttaccaagcccgaccaggtcgccccatttacttttttgcaacctttgcctctgtctcccggagtcctttcatctacccccgatcattctttcagtttggaattgggatcagaggttgatataaccgagggcgaccggaaacctgattataccgcttatgtcgccatgattccacagtgcatcaaggaggaagacaccccaagcgataacgactctgggatatgcatgtcccctgaatcctacctcggatccccccaacatagcccaagcactcgcggatcccccaatcggtctttgcccagtccaggcgtcctctgcggatcagcaaggcctaagccatacgatccgcctggcgagaagatggttgccgcaaaggtgaagggcgaaaagcttgataaaaaactgaagaaaatggagcagaacaaaacagcagccaccaggtaccggcaaaagaagcgtgccgagcaggaggcactcacaggggaatgtaaagaactcgaaaagaagaacgaggccctcaaggaacgcgcagacagccttgcgaaagagattcaatacctgaaggacctgatcgaggaagtccgcaaagctcgcggtaagaaacgggtgccatag

SEQ ID NO: 213154 - DNA, 849 bp, Artificial Sequence
  Description of Artificial Sequence: Synthetic coding sequence
atgagcctcctggccacactaggtctcgaactggaccgcgctctactgcctgcctccgggttgggttggttagtggactatgggaaactgcctcccgctcctgcccctctggcgccttacgaggtactgggtggagcgttagaagggggtctcccagtggggggtgagccgcttgcgggagatggattcagcgattggatgacagagagagtggacttcaccgccttgctgcctctcgaaccgcctttgcccccagggacgctgccccaacctagtccgacgcctccagacctcgaagccatggcctccttgctgaagaaggagctggagcaaatggaggactttttcttggacgctccaccactccctcccccatcacctccccctctgccaccgcctccactacccccagcaccaagcctgcccttgtcccttccaagcttcgatcttccccagccccctgttctcgatacactagacttgctggctatctactgtcggaatgaagctgggcaggaggaggtcggtatgccgccattacctcctccacagcagcctcctccgccatcccctccacagcccagcagattggcaccttacccccaccctgccactactcggggagaccgcaaacaaaagaagcgtgatcagaataaatccgcggctctgcggtatcgacagcgaaagagggcagagggtgaggccctagagggggaatgtcagggccttgaagcacgcaatagagaactgaaggagcgggctgaaagcgttgagagggagattcagtacgtcaaagatctactgatcgaggtgtataaggctcggtcccagcgaaccagaagttgctag

SEQ ID NO: 213155 - DNA, 2013 bp, Artificial Sequence
  Description of Artificial Sequence: Synthetic coding sequence
atgggcgaaccagccggagttgccggtacgatggaaagtcctttttctcctggcctgttccatcggctggatgaggactgggacagtgccctgtttgccgaactcggatatttcacggacaccgacgaactgcagttagaggccgcaaacgagacttatgagaacaacttcgataatctagattttgacctggatttaatgccctgggagagcgacatctgggatatcaataatcagatctgtactgtgaaagacatcaaagcagagccccaacctctctccccagcctccagctcctactccgttagcagccctcgcagtgtggacagctatagttctacgcaacatgtgccagaggagctcgacctgagttcatccagccagatgagccctctcagcctctacggtgagaatagtaacagcctctcaagcgccgaacctctgaaagaggataaacccgtcactggcccacggaataagacggaaaatggattaacaccaaagaagaagatccaggtcaactccaagccctcgatacaacccaaacctctactgctccctgccgcacccaaaactcaaactaattcttcggttcctgccaagactattataatccagacagtgcccaccctgatgcctctcgcgaagcagcaaccaataattagcttacaaccagcacccactaagggccagactgtgctgctgtctcagcctaccgtagtgcaacttcaggcccctggagttctgcctagcgcccagccagtgttggcagtagccggtggggtgactcagctgcctaatcacgtggttaacgtagttcctgcccctagtgctaattctccggtcaacggtaagctttccgtaaccaagccagttctgcaaagcacaatgcggaacgtggggtccgacatcgctgtcctgcgacggcagcagcggatgatcaagaatcgggaatccgcctgccagagccgcaagaaaaaaaaggaatacatgctgggtcttgaagcgaggttaaaggctgcacttagtgagaacgagcagctgaaaaaagagaacggaacgttaaagcgccaactggatgaagtagtaagtgaaaatcagcgacttaaggtgccctcacccaagcggagggttgtctgtgtaatgattgttctggcattcatcattctaaactacggacctatgtccatgctggagcaggatagtcggaggatgaacccttcagtgagtcccgcaaaccagaggaggcaccttttggggtttagcgcaaaagaggcccaagacaccagcgacgggatcattcagaagaacagctatagatacgaccactccgtttcaaatgacaaagcacttatggtgctgaccgaggagccactgttatacatcccacccccaccctgtcagccactcatcaatacaaccgagagtctcaggctgaaccacgaactgcgtggctgggtgcacaggcacgaagtagagcgcacaaaaagccgcagaatgacaaacaaccaacagaagacgcggatactccagggcgcactggagcagggctcaaattcacagctgatggcagtgcagtacaccgaaactacttcgtctatctcacgcaattcaggaagtgaactacaggtctactatgcctcacctcgctcatatcaggacttcttcgaagcgattagacgtcggggagatactttctacgtggtctcctttcggagggatcacctcctgctccctgccactacccacaacaaaacaacaaggccgaagatgagcatcgtgctcccggcaatcaatattaacgagaatgtcatcaatgggcaggattacgaggtgatgatgcaaatcgactgtcaggtcatggacacccgaatcctgcacattaagtccagttccgtcccaccatacctcagagaccagcagcgcaatcagacaaacacgttcttcggcagccccccagcagcaactgaggccacacatgttgtctcaactattcccgaatctctgcaatag

SEQ ID NO: 213156 - DNA, 2112 bp, Artificial Sequence
  Description of Artificial Sequence: Synthetic coding sequence
atggccgaacttatgttgttatctgagattgcagaccctacccggttttttaccgacaacctcttgagtcccgaagattggggcctgcagaactctactctgtacagcgggttagacgaagtggctgaagagcaaacccagctgttcaggtgtcccgagcaggacgtgccatttgacggaagtagtctcgacgtgggaatggacgtgtctccttcagagcctccctgggagctcttacccatcttccccgatctccaagtcaaatcagagccctccagcccatgtagcagctcaagcctgtcatctgagtcatccagattgagcaccgagccatcttcagaagccttaggtgttggagaagtgctacacgtgaagactgaaagcctcgcgcctcccctgtgtctgctaggggacgatcctacctcttccttcgaaacggttcagatcaacgtgatcccgactagcgacgatagtagcgacgttcagaccaaaattgaacccgtgagcccttgttcttccgtcaattcagaagcatccctgctcagtgcagattcatcttctcaagcgttcataggggaagaagtgctagaggtgaagacagagtcgctttctccttcaggttgcctgctgtgggacgtgcccgcaccctctttgggggctgtgcagataagcatggggccaagcctcgacggcagctccggcaaggcactgcctaccagaaaacctccactgcagcccaagcctgtagtgctgacaaccgtgcccatgccatcccgggctgtgccgccatcaacaaccgtgctgctgcagtcactggtccaaccacctccggtgagcccggtcgtactaatccagggcgctatcagggttcagccagagggtcccgcaccttcattacctcgcccagagcggaagtcgattgttcctgcccctatgccaggcaactcttgtccaccagaagtcgacgcaaagttgctgaaaaggcaacagcggatgataaagaaccgggagagtgcatgccagtccagacgaaaaaaaaaggagtatcttcaagggctggaggcgagactgcaagccgtgttggctgacaaccagcagctgaggcgggagaacgcggcactccgccgacggctggaagcccttctagccgagaattcagagctgaagttaggaagcggtaatcgtaaggtggtctgcattatggtatttttactcttcattgccttcaatttcgggccagtgagcattagcgagccaccgagcgctcctatctctcccagaatgaacaagggcgagccacaacctcgtagacacctgctgggattcagtgaacaggagcctgtgcagggggtggaaccactgcaaggttcctctcagggacccaaggagccccaaccttcacctactgatcagcctagctttagtaacctcacagcctttccgggtggagccaaagagctcctgttgcgagatctggatcagttattcctcagttccgactgccgccacttcaaccggacagagtctttgcgcctggcagacgagctctcagggtgggtgcaaagacatcagcgaggaagacgaaagatccctcagcgggcacaggagagacagaaatcacagcctcgcaagaagtcaccacccgtcaaagctgtacccattcaacctccgggtccccctgagcgggattcagtagggcagctccaattgtaccgacatccagacaggagtcaaccagcattcctggacgcaatcgacagaagggaggacacattttacgtggtgtccttccgaagggaccatctgctgctacctgctatcagccacaacaagaccagccgaccaaagatgtcccttgtgatgcctgcaatggctcccaacgagacattgtcgggcaggggagcgccaggggactacgaagagatgatgcagatcgagtgtgaagttatggacaccagggtaatccacatcaaaacgtcaaccgtgccccctagtctccggaaacagccctctcctacgccaggcaacgccaccggaggcccactgccggtctccgccgcttctcaggcccatcaggcctctcaccagcccttatacctgaatcacccatag

SEQ ID NO: 213157 - DNA, 669 bp, Artificial Sequence
  Description of Artificial Sequence: Synthetic coding sequence
atggccgaactcatgctcctctcggagattgccgacccaaccagattctttaccgacaacttgctgtccccagaagactggggtctgcagaactccacactgtattcaggcctcgacgaggtcgcagaagagcagactcaactctttagatgccctgagcaggatgttccgttcgatgggagtagcctggacgtggggatggacgtgtctccaacagatcagccaagcttcagtaatctgacagcatttcccggtggcgctaaggagctgctcctaagagatctcgaccagctcttcctgagctctgattgccgacactttaatagaacggagtccctgcgtctggcagacgaactgagtgggtgggtgcagcgccaccagcggggtcgccgaaaaatcccgcagagggcccaggagcgtcagaagtcacagcctcgcaagaagagtcctcctgttaaggcagtgccgattcaacctcctggacctcctgaacgggattccgtgggacaactccagctgtacagacacccggatcgtagccagcctgcttttctcgacgcaatcgaccggagggaggacacattctatgtggtgtcatttaggaggaccacctgttgctcccagccgagcgcaaccactaggccccctggtcccagatgtccctggtag

SEQ ID NO: 213158 - DNA, 2103 bp, Artificial Sequence
  Description of Artificial Sequence: Synthetic coding sequence
atggcagaactcatgctgcttagtgagattgccgaccccaccaggttttttaccgacaatctgctatcaccagaagactgggactcgacactctattcaggacttgatgaagtcgccgaggaacaaactcagctattccgctgtcccgagcaagatgtgccctttgacggatccagcctggatgttggaatggatgtcagcccttctgagcccccatgggaattactccctatttttcctgacttacaagtgaagagcgaaccaagctcaccttgctctagtagtagtctgtcctcagagtccagtagactctcaacagagccgagcagtgaggctctgggtgtaggagaggtactgcacgtcaagaccgagtccctggcacctcccttgtgtctactcggtgatgacccgacatccagcttcgagactgtacagataaatgtgattcccacttcagatgattcctcagacgtgcagactaagatcgagccggtgtctccatgttcctcggttaactctgaagcctctctgctgagtgcagacagtagttcccaggcctttataggggaagaagtgctggaggtgaagacagaaagtctgagccctagtggctgtctgttatgggatgtgccagcgcctagtctgggcgcagtccaaatctctatggggccttctctggatgggtcctccggaaaggccctcccaacacgtaagcccccattgcagcctaaacccgtggttctgaccaccgtgcccatgccctccagggcagtgccacccagcactacagtgctgctgcagtcactggtccagccacccccagtgtcccctgtggtgctcattcaaggagctattcgcgtacagcctgaaggtccggctccatccttgccacggcctgagcgtaagtccattgttcctgctccgatgcccggaaatagctgccctcctgaggtggacgcgaagctgctgaaacgccaacagcgaatgattaaaaaccgcgagtcggcctgtcaaagccggagaaagaagaaagagtacctgcagggtcttgaagcgcgattgcaagccgtgctcgcagataaccagcagctgcgtcgggagaacgcggcattacgcagacgtctagaagctttgttagcggagaattctgagctgaagctgggtagcggcaaccgaaaggtcgtgtgcatcatggtgtttctcttgttcatcgctttcaatttcggcccagtgtcaatcagtgaaccgccttccgcacctatctctcccaggatgaataaaggagagcctcagcctagacggcacctgttgggctttagtgagcaggagccagtccagggcgtggaacctctgcagggatcctcacagggcccaaaagagccccagcctagccccaccgatcagccatctttcagcaacctcacagccttccccggaggcgctaaagagctccttcttcgggacttggatcagctgtttctgtcttctgactgtagacatttcaataggacagagtcactccggctggccgatgagctcagtggctgggtgcaacgccaccagcggggaaggcggaagattccccagcgtgcacaggagaggcagaagagccaaccacgcaaaaagtcaccaccagtgaaagctgtacccatccaaccccctgggcctccagaaagggacagtgtgggacagcttcaattatacaggcatcccgatcgaagtcagcccgctttcctggacgcgatcgatcggagagaggacactttctacgtggtaagcttccggcgtgaccatttgcttctgccggcaatttcacacaacaagacatccaggcccaagatgagccttgttatgcccgcaatggccccaaatgaaacgttatctggccgaggtgcacccggtgactacgaggaaatgatgcagatagaatgcgaagttatggacacacgagtaatccatatcaagacgtctaccgtcccgccatccctccggaagcagccctccccgacccccggtaacgctaccggaggacccctccccgtgtcagccgcatcacaggcacaccaggcatcccatcagcccctatacctgaaccatccatag

SEQ ID NO: 213159 - DNA, 2112 bp, Artificial Sequence
  Description of Artificial Sequence: Synthetic coding sequence
atggcagaactaatgctgttgtccgagatcgctgacccaactcgcttcttcaccgacaatctcctgtcccccgaggactgggggctccagaattccactctgtattctggattggatgaagtagctgaggagcaaacacaactgttccgctgtccagagcaagatgttccattcgatgggtcctctctcgatgtgggtatggacgtttccccatctgagcctccctgggagctgctccccatcttccctgacttgcaggtcaaatctgaacccagttccccttgttccagctccagcctgagctccgaaagttctcggttgtcgacagagccatcaagcgaggcacttggtgtaggcgaagtcctacacgtaaagactgaatccctggcaccccctctgtgcttgctgggagatgatccaacctcatcattcgaaactgtccagataaacgtaattccaacctcggacgattcatcagatgtgcagaccaaaattgagccagtctctccctgttccagtgtgaacagcgaggcatccttgctgtctgcagattcctcttcacaggccttcataggtgaggaggtcctcgaagttaagaccgaaagcctgtcgccctcagggtgcctactttgggatgtaccggctccctccttaggggcagtacagatttcgatgggcccatctctggacggctccagcggaaaggcactgcccacccgtaagcctcccttacagcctaaacccgtagtcttgaccactgtccccatgccatcacgcgcagtacccccaagtacaaccgtgctcctacagtcactagtgcagcctccacccgttagccccgtggtcctgatccagggggcaatcagagtgcagcctgagggtcccgcaccaagtctcccccgaccagagagaaagtcaatagtccccgcacctatgccaggaaactcctgtccccctgaggttgatgcaaaactgctcaagcgacagcagaggatgataaaaaatagagagagtgcatgccagtctcgaaggaaaaagaaagaatatctccaaggactggaggccaggcttcaggccgtattggcagataatcagcaattacgcagggagaacgcagcccttcgtaggcgccttgaagcgctattggctgaaaacagcgaacttaaactggggagtggcaataggaaagtagtctgtataatggtgtttttgctgttcatcgcctttaattttgggcctgtgtccatctcagaaccgccttccgcgcctattagtccacggatgaacaagggcgagcctcagcctagacggcacctgttagggttctctgagcaagaacccgtacagggggtcgaacctctccaggggtcctcccagggcccaaaggaaccgcagccctcccccaccgaccagccttctttttccaatttaaccgcattcccaggaggtgccaaggagctgctgttacgagatctggaccaactcttcctgtctagtgactgtcgccattttaacaggacagagtcccttcggcttgctgatgaactgtcgggttgggtgcagcgccaccagagggggaggcgaaaaattccacaaagggcacaggagcgacagaagagccagcccaggaagaagtctccccctgtgaaggccgtccctatccagcctcctggccctcccgaaagggatagtgtcggacaacttcagttatatagacatccagacagaagtcagcctgctttcctggacgctatcgaccggagggaggacaccttctatgtcgtaagctttagacgcgaccacctgctactccctgccatctcccataataaaacaagtcggcctaagatgtccctggtgatgcccgcaatggctccaaacgagacgttgtctggcagaggggcacctggtgactacgaagaaatgatgcagatagagtgcgaagtaatggatactagagtgatacacataaagacttccaccgtgccacccagcttaagaaagcagcccagccctacacccggaaatgccaccgggggtcctttacctgtgtcagcagcctcacaggctcatcaggcatcgcatcaacctctctacctgaatcatccatag

SEQ ID NO: 213160 - DNA, 2103 bp, Artificial Sequence
  Description of Artificial Sequence: Synthetic coding sequence
atggccgagcttatgcttctgagtgaaattgccgaccccacaaggttcttcactgataatctgctgtctcctgaggattgggactcgaccctgtactctggtctggacgaagtggcagaagagcaaacccagctcttcaggtgcccagagcaggacgtaccgtttgatggcagctccctagacgtcggcatggatgtcagcccgtctgaaccaccatgggagctccttcctatctttcctgacctgcaggtgaaatctgaaccctcctctccatgttctagctcaagcctttcatccgagtcttcccgactgagcaccgaaccatcatctgaagcactcggggtaggggaggtgctccatgtgaaaacagagagtctggcccctccactgtgtctattgggtgatgacccaacttcttcatttgaaacagttcaaattaatgtcatccccacatctgatgatagctcagacgtccagaccaaaatcgaacccgtctcaccttgttcctccgtgaacagcgaggcttccctgctgtccgcagattcttcatctcaggcttttatcggcgaggaggttctcgaagtcaaaaccgagtcattgagtccaagtgggtgcctgctgtgggatgtcccagcccctagccttggggctgtgcagatatctatgggcccatctctggatgggtcttctggtaaagcccttccaacccgaaagcccccattgcagccaaagcctgtggtgctcaccactgttcccatgccctctagggccgtgccaccgtctaccacagttttgctgcagtcactggtccagccccctccggtttctcccgttgtgctgatccagggggctattcgagtgcagccagagggtcctgccccttctctgccgagaccagagcgcaaaagcatagtgcccgctcccatgcctggaaactcttgccctcccgaggttgacgccaaactgctaaagcgtcagcagcgtatgattaaaaatagagagtccgcctgccagtcccgcaggaaaaagaaggagtatttgcagggcctggaggctcgcttacaagccgttctcgcagataaccagcagcttagaagggaaaatgcggcactgaggagacgcttggaggctcttcttgcagagaactcagagcttaagctcggatctggaaaccgcaaggtggtctgtatcatggtgtttctgctatttatagcatttaatttcggaccagtgagcatctccgaacctccttctgcccctattagccccagaatgaacaagggggagcctcagccacgcaggcatcttctgggatttagcgagcaggagccagtgcaaggcgtggagccgcttcaaggctcaagtcaaggcccaaaagaaccacagccttctcccaccgaccaacctagcttttccaatctgacggcgttccctggcggagcaaaagaactgttactgcgggatttagatcaactgtttctgtcctccgattgtcgtcactttaaccgtacagaaagtctcagactggccgatgaattgtctggctgggtgcaaagacaccagaggggccgaaggaaaatccctcagagggctcaggaaagacagaagtctcagccacggaaaaagagcccccctgtcaaagcagtgccaatacagcctccgggtccgccagagagagacagcgttggacagcttcagttgtacagacatccagatagatcccagccagcttttctcgatgccatagaccgcagggaggacacattctacgtggtctcattcagaagagatcatctactgctgccagccataagtcacaacaagacaagcagacctaagatgtccctggtgatgccagcgatggccccaaacgaaacgctgtcaggacgaggagcgcctggcgattacgaggaaatgatgcagatcgaatgcgaggtcatggatactagagttatccacatcaaaacgagcacggtgcctccctctctgcggaagcagccttcccctactccagggaatgccacaggaggtccactgcctgtgtcagccgctagtcaagcccaccaggctagtcaccaacccctctacctgaaccatccgtag

SEQ ID NO: 213161 - DNA, 429 bp, Artificial Sequence
  Description of Artificial Sequence: Synthetic coding sequence
tgacagccatcccctacagaccagcctagctttagcaatctgacggcatttcctggcggagccaaggagttactactacgagacctagaccaactcttcctgagttcagactgtcgtcattttaacagaactgaatccttacggctggccgacgaactgtctggatgggtgcagagacatcaaagagggcgacgaaagattccacagcgtgctcaagagcgacaatctttggataccagcccgtcacgctcattgagtcacggcagatcgcacctacagcttcgtcagtcaccctcaaaccccttggaccctcaaaagggaattctttgggcatcgtgtaattacatcgccacccaaaccgtgcggtctcagcacagttggatgcaattgacagacgggaagactcacttcatgctttccctgtcctag

SEQ ID NO: 213162 - DNA, 429 bp, Artificial Sequence
  Description of Artificial Sequence: Synthetic coding sequence
tgacaaccctcccctacagaccagcccagcttttcaaatctaactgcctttccagggggagccaaagagctactgctccgcgaccttgatcagctcttcttgagctcagattgtcgacacttcaatcggacagagtcactccgcctagccgatgaactcagcggttgggtgcagcgccatcagaggggaaggaggaaaatcccccagcgagctcaagaaagacagtctctcgacacttcccctagcaggagtttatcacacggcaggtcccacctccaactaagacaaagtccctccaaccctttagacccacaaaaggggatcttgtgggcttcctgcaactatatagctactcagaccgtccgatctcagcacagctggatgcagctgaccgacggaaagacccattttatgctctctctcagttag

SEQ ID NO: 213163 - DNA, 2112 bp, Artificial Sequence
  Description of Artificial Sequence: Synthetic coding sequence
atggcggagcttatgctgctcagcgaaatcgcagatcccacacgattctttacagataatctgttgtcaccagaagactggggtctgcagaacagtacactctatagcggccttgatgaagtcgcagaggaacagacacaactgtttaggtgccctgaacaggacgtgccatttgacgggagttccctggatgtggggatggacgtgtctcccagtgaaccgccttgggaactgctgcccatttttcctgatctgcaagtaaagagcgaaccatccagcccatgctcttcgtcttctctctcatccgaatccagtaggttaagcacagaaccgtcatcagaagccctgggtgtcggtgaagtgctgcatgtgaagaccgagtctttggcccctcccttgtgcctgctcggggacgacccaacatccagttttgagaccgtccagataaatgtcattcccacctcagacgattctagcgatgtgcagaccaagattgagcccgtctcaccatgtagttccgtcaacagcgaggcaagtttactgagtgccgatagctcatcacaggcctttatcggtgaggaagtgctggaggtgaaaaccgagagcttgtcaccttctggttgtctcctctgggatgtgccagccccatctctgggcgcagttcagattagcatgggaccaagcctggacggctcttcagggaaagctctccctacaagaaaaccacccctgcagcccaaacctgtagttctgacaactgtgccaatgccatcccgggctgttccaccatccacaacagtgctgctacagagtcttgtccagccccctcccgttagcccagttgtgctgatccagggtgccatacgtgtccagcctgaagggcctgctcctagtctcccccgacccgaacgcaaatccattgttccagctccaatgccaggcaactcatgtcctcccgaggtcgatgccaagctcctgaaacggcaacaacgtatgataaagaaccgagagagcgcatgtcagtctcggagaaaaaaaaaagagtacctccaagggctcgaagcacgtctgcaggccgtgctcgctgataaccagcaactccgaagagagaatgccgctctcaggcgtaggcttgaagccctgctggccgagaattccgagctcaaactggggagtgggaatcggaaggtggtctgtatcatggtctttctcttgttcattgccttcaactttggaccggtgagtatatcagaacctccaagtgctccaatcagccctcggatgaacaaaggcgaaccgcagccaagacggcacctcttggggtttagcgagcaagagcccgtgcagggcgttgaaccccttcaagggtcatcacagggtccaaaagagccccaaccgagtccaaccgaccagccctccttttctaatctcaccgctttccccggaggcgctaaggagcttctcctcagagacctggaccagctgtttctgtctagcgattgccggcactttaatcgtaccgaatccctgcgattggcagatgaattgagcggttgggtacagaggcaccaaaggggcagaaggaagatcccgcagagggcacaggagagacagaaaagccaaccgaggaagaagtcccctcccgtaaaagctgtgccaatccagcctccaggaccgccagaacgggattctgttgggcaattgcaactctaccgccaccccgatagaagtcagcctgcctttttggatgctattgatcgcagggaagacactttttacgtggtgagtttccggagagaccatcttctactgccagccatctcacataacaagaccagccggcctaaaatgtctctggtaatgcctgccatggcaccaaatgaaacactcagcggacggggagcccctggggactatgaggagatgatgcagatcgaatgtgaggtgatggacactagggttatacatatcaagacaagtactgttccacctagtcttcgcaaacaaccaagcccgactcccggtaacgccaccgggggacctcttcccgtgagcgcagccagccaggcccaccaggcgtcccatcaaccattgtacctcaatcatccctag

SEQ ID NO: 213164 - DNA, 2112 bp, Artificial Sequence
  Description of Artificial Sequence: Synthetic coding sequence
atggcggaattgatgctactttcagagatcgccgatcccacacggttcttcactgacaatctgctctctcctgaggattggggtctgcagaattccactctgtactccggactggatgaagtggcagaagaacaaacccagctctttcgctgtccggagcaggacgtcccctttgatggttcctctctcgatgtgggtatggacgtgagcccttcggagcctccttgggaactgttaccaatctttccagatctccaagttaaatctgaaccaagtagcccttgtagctcaagtagcctgtctagtgagagctcccggctcagtactgagcccagtagcgaagcgctgggagttggagaagtgctgcatgtgaagaccgagtcactggctccgcctctctgtcttctgggcgacgaccccacctcctctttcgagacggtccagatcaacgtgattcccactagtgatgactccagcgatgtgcagacaaaaattgaacccgtgagcccttgctcttccgtgaattctgaagcaagcttgctcagcgctgatagtagctctcaggcgtttataggggaagaggtcctggaggtcaaaacagaatccttgtcaccaagcgggtgcctcctctgggatgtgcctgcgcctagcctgggcgctgtgcaaatctcaatgggtccctctctggacgggtctagcggaaaagctctgccaacccgaaagccacccctccagcccaagcccgtggtgctgaccactgtgccaatgcctagtcgcgctgtgcctccttccacgaccgtccttctccaatcgctcgtacaaccccctcctgtctcgcccgtcgttctgattcaaggagccattcgcgtccagccagaaggtccagccccttctctccccagacccgaaaggaaaagtatcgtaccagctccaatgcctggaaattcatgtcctccagaggttgacgcgaagctcttaaagcgccagcaacgcatgattaaaaaccgggagtccgcatgccagagccgtaggaaaaagaaagagtacctgcaaggattagaggccagactgcaggccgtcctggctgataaccagcagttacgcagagaaaatgcagctctacgcaggagattagaagcgctgctcgccgaaaactctgagctgaagctggggtccggtaataggaaagttgtctgtatcatggtgttcctcctctttatcgcattcaactttggcccagttagcattagcgaacccccttcagccccaatctcccctagaatgaacaagggagaacctcaaccgcgacgccatctgctgggctttagcgaacaagagcccgtacagggcgttgagccactccagggaagctcccagggacctaaggaaccccagccgagtcccaccgatcaaccatccttctcaaacttaaccgcattccctggtggcgctaaagagctgctattgagggatctcgatcagctgtttctgtcctccgactgtagacatttcaaccggactgagtcactacggctggctgatgagttgtctgggtgggtccagcggcaccagagggggcgtcgaaagatccctcaaagggcacaggagagacaaaaaagccagcctcgaaagaagtcccctcctgtaaaggctgtacctatccagcccccaggaccaccagaacgggacagtgttggccagctccagctgtatagacatcccgatcgctcacagcctgccttcttggatgcaatagacaggcgagaagataccttctatgtggtgtctttcaggcgcgaccacctgctgctccctgctatctcccacaacaagacctcccgcccaaaaatgtcgctggtcatgccggcaatggccccaaatgagaccctgtctgggcgtggggcaccaggcgattatgaggaaatgatgcaaatagagtgcgaagtcatggacactagagttatccatatcaagacctctaccgtgccaccaagtttgcggaagcagcccagcccaactccgggaaacgcaactgggggacctctccccgtgtctgcagcgtcacaggcacaccaggcctcacatcagcccctgtatttaaaccacccttag

SEQ ID NO: 213165 - DNA, 2103 bp, Artificial Sequence
  Description of Artificial Sequence: Synthetic coding sequence
atggcagagctgatgctgttatccgaaatcgccgatcctactagattctttacagacaatttgctctctcctgaagactgggactctacactctactctgggctggatgaagtggcggaggagcagacccagcttttcagatgccctgagcaggatgtgcccttcgacgggtcttctctcgacgtgggaatggacgtctccccgtctgaaccgccatgggagctcctgcccatttttccagatctacaggtaaaaagtgaaccttcatcaccgtgttcaagctcttccttaagctcagaaagcagtcgtctcagcacggagcctagttctgaagcgttaggcgtgggtgaagttctgcatgtgaaaaccgagagcctggctcccccactctgcctgctgggggatgacccaacctcttcgtttgaaaccgtgcagatcaacgtgatcccaacgtccgacgacagttccgatgtccagactaagatcgagcccgtgtcaccatgtagcagtgtgaattccgaggcctccctcttgtccgccgactccagcagtcaggcatttatcggcgaagaagtgctggaagtgaaaactgagtcactgagtccatccggctgcctcctgtgggacgtccctgccccatctctgggcgcagtgcaaatttccatgggcccaagcctggacggcagtagcgggaaggctctgcccaccagaaagcccccattgcaacccaagcccgtcgtgctgacaacagtgccaatgccaagtagggcggttccacccagcaccacagtgctattacagagcctggtgcagccacccccagtttcacccgtggtccttatacagggagctataagggtgcagcccgaggggcctgcaccttcactgcccagaccagaacgcaagagtatagtccccgctccaatgcccggtaacagttgtccacccgaggtggatgcaaaactgctcaagcgccagcagcggatgattaagaatagagagtcagcctgtcagtcccgaaggaaaaagaaagaatatttgcaaggtctggaggctagactgcaggcggtcttagctgacaaccaacagctaaggcgcgagaatgccgctctgcgaaggcgattggaggccctgcttgccgagaactcagagcttaagctggggagtggcaacaggaaggtcgtgtgcataatggtgttcctcctgttcatcgccttcaactttggcccagtcagtatttccgaaccccctagcgccccaatttccccccgaatgaacaagggggaaccccagcctagaagacatctgctcggtttcagcgaacaggagccagtccagggtgtggagcctctccaaggttctagccaggggcctaaggaaccacagcctagccccactgaccagccctctttctccaacctcaccgccttccctggaggagctaaggagcttctgctcagagacctcgaccagctgtttttaagcagtgattgtcggcactttaacagaactgaaagtctgagactggccgacgagttgtcagggtgggtgcagcggcaccaacgcggtagacgcaagattcctcagcgcgcacaggaacggcagaagtcccagcctcgcaaaaagtcaccacctgtgaaggctgtgcccattcagccccctggacctcctgagagagactcggtagggcagttacagctgtaccggcatccggaccggagtcagcctgcctttctagacgcaatcgacaggagggaagacactttctatgtcgtgtcttttagaagggaccacctactgcttcctgcaattagccacaacaaaacctcacgacccaagatgagcctcgtgatgcctgccatggccccaaacgaaacgctctctggtaggggtgccccaggtgattacgaggagatgatgcagatcgaatgtgaggttatggataccagggtaatacacatcaagactagcaccgttccaccctcactgaggaagcagcctagccccactccaggcaatgctacaggtggccctctacctgtgtctgccgctagccaggctcaccaggcctcgcatcagccactgtatcttaatcacccttag

SEQ ID NO: 213166 - DNA, 429 bp, Artificial Sequence
  Description of Artificial Sequence: Synthetic coding sequence
tgacaaccctctcccactgatcagccatctttctcgaacctgaccgcattcccgggtggagccaaagagctccttctgagggatctcgaccaattattcctgtcatccgattgtcgccattttaatagaacagagtctctgaggctggcagacgagctgagcggatgggttcagaggcaccaaagagggaggcgcaagatccctcagagggcccaggagcggcagtccctggatacatccccttctcgttcgctgagccatggcagaagccacctgcaactgagacaaagcccatcgaaccctctggatccgcaaaaaggcatactgtgggcttcgtgtaattatattgccactcagacagtccggagccaacacagctggatgcagttgaccgatggaaagactcattttatgctgagcttgagttag

SEQ ID NO: 213167 - DNA, 2103 bp, Artificial Sequence
  Description of Artificial Sequence: Synthetic coding sequence
atggccgaactcatgttgttgagcgagattgcagatccaacaagattttttaccgataacttacttagtcctgaagactgggactcaacgttatatagcggccttgacgaagtagctgaagaacaaactcaactctttagatgtccagagcaggacgtgccctttgatggcagtagcctggacgttggaatggacgtcagcccgtccgagcccccatgggagctgctgcccatcttccccgaccttcaggtgaagtccgagccatcttccccgtgtagctcctcttccttaagttccgagtcgagcaggctgtccaccgagccctcctccgaggccttgggcgtcggagaagtgctgcatgtgaaaacagaaagccttgctccgcctctgtgccttttgggagacgacccaacctcgagctttgagaccgtgcaaattaatgtgatcccaacttctgacgactcttcagacgttcagaccaagattgagcccgtgagcccatgctcctcagtgaatagtgaggcttccctgctctcggccgacagctcaagtcaagcattcattggggaggaagtgttagaagtgaagaccgagtccttgtcgcctagtgggtgtctactctgggatgtaccggcacccagcttgggggctgtccagatctctatggggccatctctggacggctcttcaggaaaagcactcccaactaggaagcccccactacagccgaaaccagtggtgctaacaactgtccccatgccttcacgagctgtacctccttccactacagtgctgctacaatccctcgtgcagccgccaccagtgtcacctgtcgtgctgattcagggggctatcagagtccaacccgagggaccagccccttcacttccgcgtcctgagagaaagtccatagtaccagcaccaatgcctggcaatagctgccctcccgaagtggatgcgaaattgctaaagcgacagcaaaggatgatcaaaaatcgggaatccgcatgccaatcgcgacgcaagaaaaaagagtacctccaggggcttgaggccagactgcaagccgttctggctgacaaccagcagcttcgcagagagaatgcagcactgcgcaggagactggaggcccttttggctgagaactctgaactcaaactgggctcaggcaatcggaaagtcgtttgcattatggtttttctgctgttcattgcttttaattttggtccagtcagtattagcgaacctccctccgcaccaatttctcctcgtatgaataaaggtgaaccacagcccaggcggcacctgcttgggttttcggaacaagagccagtgcaaggggttgagccattgcaagggtcttcacaaggtcccaaggagccacagccctcgccaacagatcagcctagctttagtaatctcaccgcttttccaggcggagcaaaagagctattgctgcgtgatttggaccagctgtttctctctagcgactgtcggcacttcaacaggacggagtcattacggttggccgacgagctatcagggtgggtccagaggcatcagcggggacggaggaagatccctcaaagggcacaagagcgccagaaatcccaaccacgcaagaagtccccgcctgtaaaggccgttcccattcagccccctggacctcccgagcgcgactcagtcggacagcttcagctgtatcggcatccagaccggtcacagcctgcttttctcgatgccattgacaggcgcgaggatacattctacgtggtatcctttaggagagatcatctgcttctacccgcaatctcgcacaacaaaacatcccggccaaaaatgtcacttgtgatgccagccatggccccaaacgagaccctcagtggacggggtgcccctggggattacgaggagatgatgcaaatagagtgcgaggttatggacactcgcgtgatccacataaagacatccactgttccaccatcactcagaaagcagccttctccaaccccaggcaatgccaccggcggtcctctgcccgtgtctgccgctagtcaggcccaccaggccagccatcagccactgtacctgaaccacccctag

SEQ ID NO: 213168 - DNA, 429 bp, Artificial Sequence
  Description of Artificial Sequence: Synthetic coding sequence
taacagcccagccccacagaccagccttccttttctaacctaacagcgttcccaggcggtgctaaagagctgctcctgagggacctcgaccagttgttcctatcctcagattgtagacactttaataggactgagtccctccgcctggccgatgaattgtccgggtgggtgcagagacatcagaggggtagacgaaaaatcccacaacgtgcacaggagagacagtcacttgacacatctcccagccggagcctgtcacacggcaggtcccatctgcagctccgacagagtccctctaacccgttggatccccaaaagggcattttgtgggcatcatgtaattacatagctacccagactgtgagaagtcaacattcctggatgcagttaaccgatggcaagacacatttcatgctgtcactgtcatag

SEQ ID NO: 213169 - DNA, 669 bp, Artificial Sequence
  Description of Artificial Sequence: Synthetic coding sequence
atggctgagctgatgttgctttcagaaatcgccgaccctactcgctttttcaccgataatctcctctctcctgaagattgggggttgcagaatagcaccctgtacagtggactcgatgaagtcgcggaagagcagacacagctgttcaggtgtcccgaacaggatgtgccttttgacgggtcttccctggatgtcggtatggacgtatcgccgactgaccagcctagcttttccaatttaactgccttcccgggaggagccaaagaactgttactccgtgatttagatcagctgttcctgtctagcgactgtcgacacttcaaccggactgagagcctgagacttgcagacgagctgtccggatgggtgcagaggcatcagagaggtcgtcggaaaattccacagcgggcacaggagcgccagaagtcgcagccacgcaagaagagccctcctgtcaaagcagtacccattcaacccccaggcccacccgaacgggattcggtggggcagctacagctgtatcgtcatccggacagatcccagcctgcgtttctcgacgctatcgatcggagggaggatactttttacgttgtgagcttcaggaggactacttgttgttctcagccaagtgccactacacgcccacccggtcctcgctgcccatggtag

SEQ ID NO: 213170 - DNA, 669 bp, Artificial Sequence
  Description of Artificial Sequence: Synthetic coding sequence
atggctgagctgatgctactgagtgagattgccgacccaaccagattctttaccgacaatttgctgtcccctgaggactggggcctgcagaattctaccttgtattccgggttggatgaagtggccgaggagcaaacccaactcttccggtgtcccgaacaggacgttccctttgacggatcgagccttgatgtggggatggatgtgagtccaaccgatcagccatctttttctaatctgaccgccttcccagggggtgccaaggaactgctcctgcgagacttagaccagctctttctttcaagtgattgtcggcatttcaaccggaccgagtctctcagactggcagacgagctcagcggatgggtgcaacggcaccagcgcggtcggagaaagattccccagcgtgcccaggaacggcagaaaagccagccacggaagaaaagtccaccggtgaaggcagtgcccatccagcctcccggacctcctgagcgggatagcgtgggacagctccagttgtatagacaccctgacaggagtcagccagctttcctggacgccatcgacaggcgcgaagacaccttttacgtggtatcctttcgaagaactacctgctgctctcaaccttctgccaccacccggcctcctgggccaaggtgcccctggtag

SEQ ID NO: 213171 - DNA, 669 bp, Artificial Sequence
  Description of Artificial Sequence: Synthetic coding sequence
atggcagagctaatgcttctgagcgagatcgccgaccctacccggttctttacagataacctcctaagtcccgaggactggggcctgcaaaactccacactgtatagcgggttagatgaggtggctgaagaacagacccagctgttccgctgtccggaacaggacgtacctttcgatggctcttcactggacgtggggatggatgtttcccctacggatcagcctagtttcagcaacctgaccgcatttcccggaggggctaaagagctgcttctgagggacctcgatcagctgtttctgagttcagactgtcgacacttcaacaggactgaaagtctcagactcgcagacgagctgtccggctgggtgcagcgtcatcagaggggaaggaggaagataccccagcgagcccaggaaagacagaaaagccagcccagaaagaaatctccgccagttaaggccgtgcctattcagcccccaggcccaccggagcgcgacagcgtggggcagctgcagctctacagacaccccgaccggtcgcagcccgcttttctcgacgcaattgaccgccgtgaggacactttttatgtcgtcagctttcggcgtaccacttgttgcagccagccgtccgctacaacaaggccacccggaccaagatgtccctggtag

SEQ ID NO: 213172 - DNA, 924 bp, Artificial Sequence
  Description of Artificial Sequence: Synthetic coding sequence
atgggcgacgaccgaccatttgtttgcaatgctcccggatgcggacagagatttactaacgaagatcacctcgccgtccataaacacaagcacgagatgaccttgaaatttggtcctgcacgcactgattcggtgattatcgctgaccagacacccacccctacgaggtttttgaagaactgcgaggaggtcgggttatttaatgagcttgcctccagctttgagcacgagttcaagaaagctgccgacgaagacgaaaagaaggccgcagcgggaccccttgatatgtccctgccgtctacccccgacatcaaaattaaggaggaggaacccgttgaggtggacagctctcctccagactctcccgcttcctctccctgctcgccacccctgaaggagaaatcacctgcccagccaactccctccactggtggcagaagaaggagaactgtggacgaagacccggacgagagacggcagcgtttcttggagcgtaatagggccgcagcaagccgatgcagacaaaagaggaagctttgggtgagttcactcgagaaaaaagctgaggagctcacaagccagaacatccaactttccaatgaagtaactctgctacgaaatgaggttgctcagctgaaacaactcctgctggctcataaggattgccctgtgactgccctgcagaaaaagacgcagggatacctagagtcccctaaggagagtagcgaacccacagggtcaccagcacctgtaatccagcattccagtgccactgcacccagcaacggactaagcgtccgctccgctgcagaggccgtcgcgacttctgtgctgacccagatggcatcgcagcgaaccgagctgagtatgccaatccaaagtcacgtgattatgactccccagtcccagtcagccggacggtag

SEQ ID NO: 213173 - DNA, 1485 bp, Artificial Sequence
  Description of Artificial Sequence: Synthetic coding sequence
atgggcgacgatcgtccattcgtctgtaatgcacccggatgtggacagcgtttcacaaacgaggatcatttagctgtgcacaagcacaaacacgagatgacattaaaattcggacctgctcgtaccgactcagtgataatagctgatcagactccaactcctacaaggttcctgaaaaattgtgaagaagtaggtctgtttaacgagctagcatcgagtttcgagcacgaatttaagaaagccgcagatgaggacgagaagaaagctagatcacggactgtcgccaagaaacttgttgcagccgcagggcctctcgatatgtccctcccttctactccagacatcaagattaaagaagaagaacccgtggaggttgacagctcaccacctgactcccctgccagcagtccctgcagcccgccactgaaagagaaagaagtaaccccaaagccggtgctgatctcgacccctacgcctacaattgttagaccaggcagccttcctctgcacctgggttatgatcctctgcaccctacacttccatctccgacttccgtgattacccaggccccaccgtccaaccggcagatggggtccccgacgggtagcttgcctctcgttatgcacctcgctaatggacaaactatgcccgtcctgccaggccctcccgtacagatgccttcagtcatatccctagccagaccagtgagtatggtgcccaacatccctggtattcctgggcctccagtgaactccagcggatccatatcacccagtgggcatcccattcccagcgaagccaaaatgcgcctgaaggccactctcacacaccaggtgtcttctattaatgggggttgtgggatggtagttggcactgcatcaaccatggtgactgccaggcctgagcaatcacagatcttgatccagcaccctgatgcacccagccctgctcagccacaggtctcacctgcccagccaaccccaagcacgggcggtcggcgacgaagaactgttgatgaagatccagacgaacggcgacaacggttcctggaaaggaacagagctgccgcaagcaggtgtagacagaagcgcaagctgtgggttagttccctagagaaaaaggctgaggagctgacgagccagaacatacagctctctaatgaggtgacactccttcgtaacgaagtggcacagctcaaacagcttttacttgcgcataaagactgtcccgtcactgcactgcagaaaaaaacccagggctacctggaatctcccaaagaatccagcgaacctacgggctcccctgcccctgtcattcagcactcatccgctactgccccaagtaatggactaagtgtgagaagcgcagcagaagccgtggccacctcggtgctcacgcagatggccagccaacgcaccgagctctcaatgccaattcaaagtcacgttataatgacgccacagagccagagcgcaggcagatag

SEQ ID NO: 213174 - DNA, 1389 bp, Artificial Sequence
  Description of Artificial Sequence: Synthetic coding sequence
atgggcgacgatcgaccattcgtttgcaatgcccctgggtgcgggcagaggttcaccaatgaagaccatctcgccgtccataaacacaagcatgagatgacattaaagtttgggccagccagaaccgacagcgtgattatcgctgaccaaacccccacccctaccagattcttaaagaattgcgaggaggtgggactatttaatgaactggcaagtagctttgagcacgaattcaaaaaagccgctgacgaggatgagaagaaggcggcagccggaccactggatatgagcctgccttcgacaccggacataaaaattaaagaagaagaaccggtggaggaagtgacccccaaacccgttcttattagcactcctactcccaccatcgtgcgtcccggttcgcttcccctgcacctcgggtatgaccccttacacccaaccttgccttctccaacatccgtcatcacccaggcccctccatccaaccgacagatggggagccccactggttcactaccactggtcatgcacttggccaatggccagaccatgcctgtgctcccgggaccgcctgtgcaaatgccttccgtcatttctctggcccgtcccgtatcgatggtgcctaacattcctggaatcccagggcctccagtgaactcctccgggtccatctcccctagcggtcaccccataccctctgaggctaaaatgagactaaaagccactcttactcatcaggtctcttcaatcaatggagggtgtggcatggtcgtggggacagcctccacaatggtcaccgcacgacccgagcaatcccagatattgatccagcaccctgacgcgcctagcccggctcagccacaggtttcacccgctcagccgacaccttcaactggtgggagaagacgaaggaccgtggacgaggacccagatgagcggagacagcgctttctggagagaaatagagccgctgcctctcggtgtcggcagaaaagaaagctgtgggtgtcctctctggagaagaaggctgaggagctcacatcccagaacatacaactgtcaaacgaggttacattgctgcggaacgaggttgcccagctcaagcaactgctgctggctcataaggactgccctgtgacagcactgcagaagaagacccagggctacttggaatcccccaaagaaagcagcgagccgaccggatcgcctgctccagtgatccagcactcgtcggcgacagccccatctaatgggctgtccgtgcgaagtgctgctgaagccgtcgccacttctgttctcacgcaaatggcttcgcagagaaccgagctgagcatgcctattcagtcgcatgtcataatgaccccccagagccagtctgccggtcggtag

SEQ ID NO: 213175 - DNA, 1452 bp, Artificial Sequence
  Description of Artificial Sequence: Synthetic coding sequence
atgggcgatgaccgcccttttgtgtgcaatgcaccgggttgcggtcagagattcactaacgaggatcatttagcagtccacaagcacaaacacgaaatgacactgaaatttgggccagcaaggaccgacagcgtcatcatcgctgaccagacccccacacctacgagatttctaaagaactgcgaggaggtggggctgtttaacgagctcgccagcagtttcgaacatgagtttaaaaaagctgctgacgaggatgagaaaaaagccgcagcgggtccactagatatgagtctgccttcaacacccgatattaagataaaggaggaagagcctgtggaagttgattcttctcctcctgattctcccgcttctagcccttgttcaccacccctgaaagagaaggaggttacacctaagccggtgctcatctctacaccaacacctactattgttcgcccaggtagcctcccgttgcacctaggctacgaccctctgcaccccacactgccaagtcctacttcggtgatcacccaggcacctcccagcaacagacagatgggtagccccaccgggtctctgccgctcgttatgcatctggctaacggccagaccatgcctgttttgcctggacctccggtccagatgcctagcgtaatttctttggcacggcctgtcagcatggttcccaacattcccggaatccccggacccccagtgaatagtagcgggagcatctcaccatctggccaccccatcccgtctgaggcaaagatgcggctgaaggctacactgactcatcaggtgtcctcaattaacggtggatgcgggatggtagtcggtactgccagcaccatggtgacagccagaccagagcagagccagattcttattcaacatcccgatgcaccctcccctgcacagccccaagtctcccccgctcagcctactccttcgacgggcggtcgtcgcagaagaaccgtagatgaagatcctgatgaaagacgccaaagatttctcgagagaaaccgcgcagccgcttcccggtgtcgccagaagcgcaagttatgggttagcagcttagaaaaaaaagccgaggagttaaccagtcaaaacatccagctgagcaacgaggttacactgttaagaaacgaagtcgcacagcttaagcagctgctgttagcacacaaagattgccccgttacagcattacagaagaagacacaaggctatttggaaagtcctaaggagagtagcgagcccacaggttcacctgcgccagtgatacaacattcatctgcgacagccccttccaacgggctgtccgtgaggtccgccgctgaggccgtagccacgtctgtgctgacccagatggctagccagagaactgagctctcaatgccaatccagagccatgtcatcatgacaccacagtcccaatcggccggtagatag

SEQ ID NO: 213176 - DNA, 1452 bp, Artificial Sequence
  Description of Artificial Sequence: Synthetic coding sequence
atgggcgatgataggcccttcgtgtgcaatgccccaggctgcggtcaacgttttactaacgaggatcaccttgcggtgcacaaacacaagcatgagatgacactgaaattcgggcctgcacgaacagattctgtcattatcgccgaccagacccctacacccacccgattcctgaaaaattgcgaagaagtgggcctgtttaacgagctcgctagttccttcgaacacgagtttaagaaagctgcagacgaggacgagaagaaagcggcagccggaccactggacatgtcactgccgtcaacccccgacataaaaatcaaggaggaagagcctgtggaagtggattcttctccccctgattcacctgcaagctctccttgctcccccccactgaaagaaaaggaggtcactcccaaacccgttctgatatccaccccgacacctaccattgtcaggcccggatctctgcctcttcatctcggttatgatcccctgcatcctactctgccttcccccacgagcgtcatcacccaggcccctcccagtaatcggcagatgggtagccctaccggctccctgccattggttatgcaccttgctaacggtcaaaccatgcccgtcctgcctggcccacctgttcaaatgccctcagtcatctctctggcccgtccagttagcatggttcccaatatacctggcatcccagggcctccggttaattctagtggctctatttcccccagtggccaccccatccctagcgaggccaaaatgagactgaaggctacattgacccaccaggtgtcgtctataaatgggggatgcggtatggtggtcggcacggctagcactatggtaacagccaggccggaacagtcacagatcctcattcagcacccagacgcgccatctcccgcacagcctcaggtgtcacctgcacaacctactccaagcacagggggacggagaagacggacggtggatgaagaccccgacgaacgcaggcaaaggttcctggaaaggaatcgagctgccgcttctaggtgtcgccagaagcgaaagctttgggtttctagcctggaaaaaaaagcggaagaactgacatctcagaatattcagctcagtaacgaggtgacacttttacgtaatgaagtcgcccaactgaaacagctgctgcttgctcacaaagactgtcctgtgacagccctgcagaagaagacccagggttacttagaatcccctaaggagtcttccgagcctactggcagccccgctccggtcattcagcactcatccgccacagccccaagcaacggactgtcggtgagaagtgcggctgaagcggttgcaacctctgtgctgacacagatggcatcccagagaactgaattgagtatgccgatccagtcccatgttatcatgactccgcaatctcagagcgctgggagatag

SEQ ID NO: 213177 - DNA, 1485 bp, Artificial Sequence
  Description of Artificial Sequence: Synthetic coding sequence
atgggagatgatagacctttcgtctgcaatgcccctggctgcggtcaacggttcacaaatgaggaccaccttgctgtccataagcacaaacatgaaatgaccctcaagttcgggccagcgagaacagatagtgtgattatcgccgatcaaaccccaacgcccacacggttcttgaagaattgtgaggaagtaggcctattcaacgagctggcttcctcgttcgaacacgaattcaagaaggcagcagatgaggatgaaaagaaggccaggtcaagaaccgtggcgaaaaaattggtagccgctgcgggacccctcgacatgtctctacccagcacaccggacatcaagatcaaggaggaggaacccgtggaggtggacagcagtcccccagactcccccgctagcagtccatgctctcctcctctcaaagagaaagaggtgacacccaaaccggtcctgataagtacccccacccccacaatcgtaaggcctggtagcctcccactccatctcggatacgaccccttgcaccccactttgccttccccgacttcagtgattacccaagccccaccctctaatcgccagatgggatccccaaccggtagcttacctctggtaatgcacctggccaatggccagactatgcctgtgctgcctgggccacccgttcagatgccatccgttatttcactggctagacccgtctcaatggtccctaatatcccgggaatccccggacctcctgtgaactcgtccggatccatcagcccctctggacatcctatcccctctgaggctaagatgaggcttaaagcaaccctcactcatcaggtaagctccattaatggcggatgcggcatggtcgtgggcaccgcttcgaccatggtgaccgccagacccgagcaatctcaaatactcatccaacaccccgatgcacccagccccgctcagcctcaggtatcccctgcccagcctactcctagcacgggcggtagaaggcgcaggacggtggatgaggatccagatgaacggaggcagcgctttctcgagagaaatcgggcagcagcttccaggtgtcgccagaagcggaagctatgggtgtcaagtctggagaaaaaggccgaagagcttacttcccagaacattcaactatccaatgaggttaccctcctcagaaacgaagtcgcgcagctcaaacaactgttgctggcccacaaggactgcccggttactgcattgcagaagaagacacagggctatctggaatctcctaaagagtcttcggaacctacgggaagcccggcacccgttattcagcacagcagtgctactgccccaagcaacggcctttccgtgagatccgctgctgaagcagtcgcaacgtcagttcttacccagatggcaagtcagcgtacggaactgagcatgcctatccaaagccatgtcataatgaccccgcagtcccagtctgccggacggtag

SEQ ID NO: 213178 - DNA, 354 bp, Artificial Sequence
  Description of Artificial Sequence: Synthetic coding sequence
atgggagacgatcgccctttcgtctgcaatgcacccggatgtggccagagatttaccaacgaggaccatctggccgtccataagcacaagcacgaaatgacgctgaagtttggcccagctcgaacagattcagtgataatcgccgaccagaccccgacccccacccggtttcttaagaattgcgaggaggtgggcttgttcaacgaactcgctagttcttttgaacacgagtttaagaaggccgctgacgaggacgagaagaaagctcgtagccggaccgttgccaaaaaactggtggttttccgcccacgattattccttctctgcttcggaatcattttccttattggttag

SEQ ID NO: 213179 - DNA, 354 bp, Artificial Sequence
  Description of Artificial Sequence: Synthetic coding sequence
atgggtgacgatagaccgttcgtgtgtaacgcgccaggctgtggccaaaggttcacaaacgaagatcacctcgcggtacacaaacataaacacgagatgacactgaagtttggcccagctcgcaccgactcagtgatcatcgccgatcaaacccccactcctactcgctttctgaagaattgtgaagaagtggggttattcaacgaactcgcttcttccttcgagcacgaattcaaaaaggctgccgacgaagatgagaagaaagcaagatcacgcaccgtggccaaaaagttggtggtgtttaggccccgtttgttcctcctatgctttggcataatattcctcatcggatag

SEQ ID NO: 213180 - DNA, 3813 bp, Artificial Sequence
  Description of Artificial Sequence: Synthetic coding sequence
atggatagtctcgaagagccccagaagaaggtctttaaagctaggaaaaccatgagagtctcggacagacagcaactggaagccgtttacaaggtgaaggaggaactactgaaaactgacgtcaaattgctgaacgggaaccacgaaaatggagacctggaccccacgagtcctctcgaaaacatggattacataaaggataaagaggaagttaacgggatcgaggagatctgcttcgatccggagggctcaaaggcagaatggaaagaaacgccttgcatcttgagcgtgaatgtcaagaataagcaggacgacgatctaaattgtgagcccctgtcaccccacaacatcacccctgagccggtctcaaagctccccgcagagcccgtatcaggggaccctgccccaggagatctagacgcaggtgacccggcatcaggcgtgctagcttcgggtgactcaacctccggggatccaacttcttcagagccttcctcttccgacgctgcttcaggggatgcaacctctggagatgctcccagcggcgacgtctcccccggtgatgcaacaagtggggacgctaccgcagatgatctatcatccggggacccgacttcgtctgaccctatccctggcgaaccagtgcccgtggaacctatcagcggcgactgtgccgcagacgatatcgcctcctcagaaatcacctcagtagacctagcctccggtgcacctgcatccacggatcctgcctctgacgacctcgcgagtggtgatctttcctccagcgaactagccagcgacgatctagccacaggggaactagcttcagacgagctcaccagtgaatcaacctttgacaggacatttgaaccgaagtccgttcctgtttgcgaaccagttcctgagatcgataacatcgagccatcaagtaataaagacgatgatttcttggagaaaaacggggcagatgaaaagctggaacagatacagtctaaggattcactggacgaaaaaaacaaggccgataacaatattgatgccaatgaggaaactctagaaacagatgatacaaccatctgttctgacaggcctcctgagaatgagaaaaaggtggaggaagacatcatcaccgagttggccctcggtgaggacgccatcagctcctccatggagattgaccagggagaaaaaaatgaggacgagaccagtgccgacctggtggagaccatcaatgaaaatgtcatcgaagacaacaaatccgagaatattctggagaatactgattccatggaaacagacgagattattcccatcttagaaaaactggctccatcggaggatgagctgacatgcttcagcaaaacctctctactgccaatcgacgagactaacccagacctggaggagaaaatggagtcctcgtttggttcaccgtcaaaacaggagtcgtccgagtcactgccgaaagaggcattcttggttctgagtgacgaagaggacatctctggagagaaagacgaaagcgaagtcatcagtcagaacgagacctgtagccccgcagaagtagaatccaatgaaaaagacaacaaaccagaagaggaagagcaagtcatccatgaagatgacgaacgcccttccgagaaaaatgagttctctaggagaaagcgatcaaagtcggaggatatggataatgtgcagtcaaagaggcgcagatacatggaggaagagtatgaagcagagtttcaggtgaagattaccgccaaaggcgacataaaccagaagttgcagaaggtgatacagtggctgctcgaagaaaaactctgtgccttacaatgtgcagtcttcgataaaactctggcggagctgaagacccgggtggagaagattgaatgtaacaaacgtcacaaaactgtactaacagagctgcaggccaagatagcacgactgacaaaaagattcgaggcagccaaggaagaccttaaaaagcgtcatgaacaccctcctaaccccccagtcagtccgggaaagacggtcaacgacgtgaacagcaacaataacatgtcctaccggaacgccggtacggtccgccagatgctggagtcgaaacgcaacgtctctgaaagtgcgccaccttcctttcagacacccgtgaataccgtcagttccacaaacctcgtgaccccacccgctgtcgtctcatctcagcctaagctgcagacccccgtgacgtcgggatcgctgaccgccacaagtgtgctgcccgcacccaacacagcgacagttgtcgccactacgcaggtcccaagtgggaacccgcagcctacaatctccttgcagccactaccagtcatcttgcacgttcccgtcgccgtctcctcccagcctcaactcttgcaaagtcatcctgggacactcgtgactaatcagccaagcgggaatgtcgaatttatatcggtacaatcgcccccaaccgtgtcgggtctcacgaaaaatccggtcagccttccttccctaccaaatcccacaaaacctaacaatgtgccaagtgtgccttctccctccatccagaggaatcctacagcaagcgcagcaccactcggcactacattggccgtgcaggccgttcccaccgcccactccatcgtccaggcaacaagaacctcgctgcccacggtgggcccttctggcctgtactctccttcgacaaaccggggtccaatccagatgaagatacctatcagcgctttctccacctcaagcgccgctgaacagaattccaatacaacaccccgaatcgagaatcagactaacaagactatagatgcaagtgtgtcgaaaaaagcggctgacagtaccagccagtgcggcaaagccacaggcagcgacagctctggcgtgattgacctgactatggacgacgaggagtccggtgcatcgcaggaccctaaaaaattaaaccacacaccagttagtacaatgagctcttcgcagcctgttagccggccattgcagcccatccagcccgcaccacctctccagccaagcggagttcctacatccggcccttcgcagactactattcatttactgccaactgcccctaccacagtgaacgtgacacatcgcccagtgacccaggtgacaacccggcttccagtgcctagagctcctgcaaatcaccaagtggtgtatactactttacccgctcctcccgcacaggcccctttaaggggaaccgtgatgcaagctcctgccgtgcgccaagtaaaccctcaaaactctgtaaccgtgagggtgcctcagacaaccacctacgtggtcaacaatggcctgacactaggctccaccggcccacagctgactgtgcaccatcggccaccacaggtgcacaccgagccccctagacccgtgcatcccgctccactgcctgaggcccctcagccccagcgcctgccaccagaggccgcttctacttctctcccacagaagcctcacttaaaattggcgcgagtgcagagccagaacggcatcgttctgtcttggagtgtactcgaggtagatcgatcctgcgcaaccgtggatagctaccacctttacgcatatcatgaagagccctctgcgaccgtgcccagccagtggaagaagataggcgaggttaaggccttgcctctgcccatggcttgcacactgacacagtttgtctcaggaagcaagtactacttcgcagtccgcgcaaaggatatttacgggcgttttggccctttctgtgatccccagtcaacggatgttatttcgtcaacacagtcgtcatag

SEQ ID NO: 213181 - DNA, 1548 bp, Artificial Sequence
  Description of Artificial Sequence: Synthetic coding sequence
atggatagcttagaggagccccagaagaaagtgtttaaagctaggaagacgatgcgggtgtccgaccgccagcagctcgaggcggtctacaaagtgaaggaagagctacttaagaccgacgttaagctattaaatggcaatcacgagaacggggaccttgacccaactagccccctggagaacatggactacattaaggacaaggaggaagttaacgggatcgaagaaatttgtttcgacccggaaggctcaaaggctgagtggaaagagactccttgcattctgagcgtcaatgtcaaaaacaaacaggatgacgatttgaactgtgaacccctgtcgccccataacatcactccagaaccagtgagcaagctccctgccgagcccgtatctggcgacccggctccgggtgacctggacgcaggcgaccccgctagcggggtcttggcttccggcgactctaccagcggggatcccacttcaagtgagcccagcagcagcgatgccgctagcggcgacgccacttcaggagacgcaccaagtggcgatgtatcccctggggacgcaactagcggagatgccacagccgatgacttaagcagcggagacccgaccagtagcgacccgatccctggagagccagtgccggtcgagccaatttccggcgattgtgcggctgacgacattgccagcagcgaaatcaccagcgtagatcttgcctccggggcacccgcttccaccgaccccgctagcgatgatctggcttctggcgacttgtcaagctcagaattggcctcggatgacttagccaccggggagctggcgtctgatgagttaacgtctgagtctactttcgatcggacattcgagcccaagtctgtcccagtgtgtgagcctgtgccggagatcgacaacattgagcccagttcaaacaaagatgatgacttccttgagaaaaatggcgctgacgagaagcttgaacaaatccagtcaaaggactcgttggatgaaaagaataaggctgacaataacattgacgccaatgaggaaactttggagacggacgatacaacaatttgcagcgatcggcctcccgaaaacgagaagaaggttgaggaagacattataactgagctagctttgggggaagacgcaatttcctctagcatggaaattgatcaaggagagaagaacgaagatgaaactagcgccgatctggtggaaacaattaatgagaatgtgattgaagacaacaagtccgaaaacatcctcgagaatacagacagcatggagaccgacgagattataccaattctcgaaaagctagctcccagtgaggacgagctcacatgtttctcgaaaacatccctgctccctatcgatgaaaccaaccctgacctcgaggagaaaatggaatcttctttcgggtcaccctccaaacaagagtctagcgaaagcctccccaaggaagcgtttctggtgctctctgatgaggaagacatcagcggggagaaagacgaatccgaagtcatcagtcagaacgaatag

SEQ ID NO: 213182 - DNA, 378 bp, Artificial Sequence
  Description of Artificial Sequence: Synthetic coding sequence
atggactcattggaggaaccccaaaagaaggtgtttaaagcccgaaaaacgatgcgcgtctcagatcggcagcagctagaggcagtgtacaaggtgaaggaagagctgcttaaaacagacgttaagttgctcaacgggaaccacgagaatggagatttagaccctacctcacctctggagaatatggattatataaaagacaaggaggaggttaatgggattgaagaaatatgtttcgatcccgagggcagtaaagcagagtggaaagagactccttgtattttgagtgtcaacgtcaaaaacaagcaggatgatgatctgaactgtgaaccactatcaccacacaacatcaccccagagcctgtgagcaagctgtag

SEQ ID NO: 213183 - DNA, 459 bp, Artificial Sequence
  Description of Artificial Sequence: Synthetic coding sequence
atggatagtctcgaggaacctcagaagaaggtgtttaaggccagaaaaacaatgagggtaagcgacagacaacagcttgaagcagtctataaggtgaaagaggagctgctgaaaaccgacgtgaaactgctgaatggcaaccacgagaacggtgacctggaccccacaagccccctggaaaatatggattacattaaagacaaagaggaagtcaatggtatcgaagagatctgcttcgaccccgaggggtcgaaggccgagtggaaggagaccccatgcatcctgagtgttaacgtaaagaataagcaggacgacgacctgaattgcgaacccctcagccctcataacatcactccggagcccgttagtaagctacccgcagagcccgtttccggagaccccgctccaggggacttagatgcgggagatcctgcttctggcgtgctagctagtggatag

SEQ ID NO: 213184 - DNA, 312 bp, Artificial Sequence
  Description of Artificial Sequence: Synthetic coding sequence
atggattctttggaagagcctcagaagaaagtgtttaaggccaggaaaactatgcgggtgtctgatcgtcagcaactggaggccgtttacaaggtgaaggaggagctcctgaagactgacgtcaaacttctgaacggtaaccacgagaacggtgatcttgacccaacctcccccctggaaaatatggactatattaaggataaggaggaggtcaatgggattgaggaaatttgcttcgaccccgaggggagcaaagcagaatggaaagaaaccccatgcattcttagcgtgaatgtaaaaaataaacagtag

SEQ ID NO: 213185 - DNA, 270 bp, Artificial Sequence
  Description of Artificial Sequence: Synthetic coding sequence
atggatagccttgaggagccacagaaaaaggtattcaaggcacggaaaacaatgagggtgagcgatcgtcaacagttagaggctgtgtacaaggtcaaagaagagcttttgaagacggacgtgaagctgctgaacggcaatcacgagaacggagatctggacccaaccagccctctggaaaacatggattatataaaggataaggaggaggtcaatggcatagaagaaatctgcttcgaccctgagggctctaaggccgaatggaaatag

SEQ ID NO: 213186 - DNA, 534 bp, Artificial Sequence
  Description of Artificial Sequence: Synthetic coding sequence
atggattctctggaggagcctcaaaaaaaggttttcaaagctcgaaaaacgatgagagtctctgataggcagcagttagaggcagtgtacaaagtcaaagaagaacttctgaaaacggatgtgaaactgctaaacgggaaccatgagaatggcgacctggaccctacatctcccctcgagaacatggattatattaaagataaggaagaagtgaacggaatcgaagagatctgctttgatccggagggcagtaaggctgagtggaaagaaacaccgtgtattttgagcgttaacgtgaaaaataaacaggacgacgacctgaattgcgagccactcagtccccataacatcacccctgagcctgtgagtaaactccctgctgagcctgtgtcgggtgatccagcgcctggcgatctagacgctggagatcctgccagcggtgtgttggcctccggcgattcaacgtcgggagatcccacgtctagcgaacccagttcatctgatgctgccagtggcgacgccacatccggatag

SEQ ID NO: 213187 - DNA, 3813 bp, Artificial Sequence
  Description of Artificial Sequence: Synthetic coding sequence
atggactcacttgaggagccacagaagaaggtgtttaaagcaaggaagactatgcgagtgagtgataggcagcagctggaagccgtgtataaagtaaaagaggaactcttaaaaaccgatgtgaagcttctcaatgggaatcatgagaatggggacctggaccccactagccctctggagaatatggattacattaaagacaaagaggaggtgaatggcatagaagagatctgcttcgacccagagggctctaaggcggaatggaaggaaacaccttgtatactgtccgtcaacgtgaaaaataagcaggatgatgatctgaactgcgaacctctctctcctcataatatcacccccgagccagtttccaagcttccagccgagcccgtatcaggagacccggcacccggtgatcttgatgcaggtgatcctgctagtggcgtcctggccagcggcgattcaacgtctggagacccaacaagcagtgagccatccagcagtgatgcggcaagcggggacgccacgtccggcgacgcaccaagtggcgacgtcagtccgggtgacgccacctccggcgatgctaccgccgatgacctgagcagtggtgatcccacttccagcgaccccatccctggagagcctgtgcctgtcgagcctatctccggagactgcgctgccgatgatattgcctcctccgagattacttcagtagatctggcaagcggggctcctgccagcacggacccagcttcagacgaccttgcttcaggtgatttgagctcatctgagctggctagcgatgatctggcgaccggcgaactggcgagtgacgaattaacctctgagagtacatttgaccgaacattcgagcccaagagcgtacccgtgtgtgagccagtgcccgaaatcgataatatcgagcccagcagcaacaaagatgacgattttttagagaagaatggcgcagatgaaaaactggaacaaattcaatccaaagactcactggatgagaagaataaagcagacaataacattgatgcaaacgaagaaactctggagacagatgatacgaccatatgcagcgacagacctcccgaaaatgagaaaaaggttgaggaggatataattacggagctggctcttggggaggatgcaatcagcagtagtatggagatcgatcagggcgaaaagaatgaagacgagacgagtgcggatttggtcgagacgatcaatgagaatgttatcgaagacaacaagagcgaaaatatactcgagaatacagacagcatggagaccgacgagattatccccattcttgagaagctggcccctagtgaggatgaattgacatgtttttcaaagacgtctcttctaccaatcgatgagactaatcccgacctcgaagagaaaatggagtcttctttcggctccccctctaaacaggaatctagtgagagccttccgaaagaggccttcctcgtgctgagtgacgaggaggacatctccggcgaaaaagacgaaagcgaggtcataagccagaacgagacatgcagtccagccgaggtcgagagtaacgaaaaggacaataagcccgaggaagaggagcaggtgattcacgaagatgacgagaggccatccgagaaaaacgagttctcccgtcgcaagcggtcaaaatcggaggatatggacaatgtacagtcaaagaggcggaggtatatggaggaggaatatgaggccgagtttcaggttaagattacggcaaagggcgatatcaaccagaaacttcaaaaagttatacagtggctattagaggaaaagctctgcgcgctgcaatgcgctgtcttcgacaagacactggccgagctgaagaccagggtagagaagatagaatgtaacaagcgccacaagaccgtgctgactgagctccaggctaaaatcgctcggctgacaaaacggtttgaagctgctaaagaagacctgaagaaacgtcatgagcacccccctaatcctccagtgtcccctggtaagaccgtcaacgacgtgaattccaataataacatgtcctatcgtaatgctgggaccgtccgacagatgttggaatctaagcgcaatgtctctgagtctgctcctccctccttccagactccagtgaacaccgtgtcatccacaaacttggtcactccacctgcagtagtgagtagtcagccgaaattgcagacccctgtgacttctgggagtctgactgccacatccgtgttgcccgcaccaaatacagccacagtcgttgccactacccaggtgccgtcaggtaatcctcagcctactataagcctgcagccccttccggtaatcctgcacgtcccggtcgctgtctcttctcagccacagttgttgcagtcccatcctggtaccttggtcacgaaccagcctagcggcaatgtggagtttatttcagttcagagtcctcctaccgtctcaggcctgacaaagaaccctgttagtcttccctccctcccaaaccccacaaaacctaacaatgtgccttccgtgccttccccctcaattcaaaggaatcccaccgcatcggccgctccgctcggcaccaccttagccgtgcaggcggtgccgacagcccacagtatcgtgcaggcgacccggacatctctccctacagttggaccgagcgggctatattcgcccagcaccaatagggggcctatccaaatgaagatcccgataagcgccttttcaaccagtagcgctgctgagcagaattcaaacaccaccccgaggattgagaatcagaccaacaagactatcgatgcttcagtttcaaaaaaagccgcagattctacttctcagtgtggtaaagccactgggtctgactcgtcgggggtgattgatcttacaatggacgacgaggaatcaggtgccagtcaagaccctaaaaagctgaatcacacaccggtgtccaccatgagttcttcacagcctgtttccagaccactgcaaccaatccagccagcaccgcctctccaaccttctggagtgccgacctctggcccttcccagacaacgattcacctcctgcccacagcgcctacaacagttaacgtgacccatcgcccagttacccaggtgacaacaaggttgcctgttcccagggcccctgccaatcatcaggttgtttacactactctgcctgcgccacctgcccaagccccactcagaggaacagttatgcaagcccctgcagtccggcaagtgaacccacagaattcggtaactgttagggttcctcagaccacaacttacgtggtgaataatggactgaccctggggagcactggcccacaactcacagttcaccatcgtccccctcaggtgcatacagagcctccgcgacccgtgcacccagcgccactgcctgaggccccacagcctcagaggcttcccccagaagccgcatcaacgagcttgccacagaagccacaccttaaactggctcgcgtgcagagtcagaacgggatcgtcctgagctggagtgtcctcgaggtggaccggtcctgcgctaccgtggacagttatcatctgtacgcctatcacgaggagccttctgccacagtgccaagccagtggaagaagattggcgaggttaaggcactcccactgcccatggcttgcacactgacccagtttgtgtccgggtccaaatactacttcgctgtaagggcaaaagatatctacggccgtttcggtccattttgtgaccctcagagtaccgacgttatctcttctacgcagagtagctag

SEQ ID NO: 213188 - DNA, 510 bp, Artificial Sequence
  Description of Artificial Sequence: Synthetic coding sequence
atggactctctagaagagccacagaagaaagtttttaaagcgagaaaaaccatgcgcgtgagtgatcggcagcagctcgaggcagtgtacaaagtcaaggaggaactgctgaagacggacgtgaagttacttaacggcaatcacgagaacggggatcttgatcccacctctcccctcgaaaacatggattacatcaaggataaggaagaggtcaacggaatcgaggagatctgtttcgatccggagggcagcaaggccgagtggaaggagaccccctgtattctctccgtaaacgtgaagaataagcaggatgacgacctcaactgtgagccactgtccccgcacaacattacgcctgaacccgtgtcaaagctgcccgctgaacctgtgagcggcgatccagcgccaggtgatctcgacgccggtgatcctgcctctggcgttcttgcttctggggactccacgagcggagatcccacatcttctgagcctagctcatccgacgcgtag

SEQ ID NO: 213189 - DNA, 99 bp, Artificial Sequence
  Description of Artificial Sequence: Synthetic coding sequence
atggactcgctagaggagccgcagaaaaaagtattcaaggctcgaaagaccatgagagtcagcgataggcaacaactggaggcagtgtacaaggtgtag

SEQ ID NO: 213190 - DNA, 399 bp, Artificial Sequence
  Description of Artificial Sequence: Synthetic coding sequence
atggattctctcgaagagcctcagaagaaggtctttaaagccagaaagactatgcgggttagtgacaggcagcaactggaagctgtgtataaggtgaaggaggaactgctgaaaactgatgttaaactgctgaacggcaaccacgagaacggcgatctggaccccacttcccccctggagaacatggactatattaaagacaaagaggaggtcaatgggatcgaggagatctgttttgatcctgaagggtccaaggctgaatggaaggaaacaccttgtatcttgtctgtcaatgttaagaacaaacaggatgatgatctgaattgtgagcctctgtcaccacacaacattacaccagagccagtctctaagctgcccgcagagccggtttccggctag

SEQ ID NO: 213191 - DNA, 531 bp, Artificial Sequence
  Description of Artificial Sequence: Synthetic coding sequence
atggactccctggaggagccgcagaaaaaggtctttaaggctaggaagaccatgcgcgtgtccgacagacagcaactcgaagcagtctataaggtcaaagaagaattactcaagaccgatgtcaaacttctgaatgggaaccacgagaatggcgacttggatccaacatcccccctcgagaacatggattacattaaagataaggaagaggtcaacggcatcgaggagatctgtttcgacccggagggttccaaagccgagtggaaggagacaccctgtattcttagcgttaatgtgaaaaataagcaggatgacgacctcaactgcgagccattatcacctcataacatcactcctgagccagtctcaaaactgccggcagaaccagtgagcggcgaccctgcccctggagatcttgacgctggagatccggctagtggcgttttggcctcaggtgattctacttcaggcgaccccacatcttccgagcccagttccagcgatgctgcttccggcgatgcaacctcctag

SEQ ID NO: 213192 - DNA, 180 bp, Artificial Sequence
  Description of Artificial Sequence: Synthetic coding sequence
atggattcactcgaggaaccacagaaaaaggtgtttaaggcccgaaagaccatgagggtaagcgaccggcagcagttagaagcggtttacaaggtgaaggaagaactcctcaagacagatgtgaagttactgaatggtaaccatgagaatggggatttagacccgacgtcacctctgtag

SEQ ID NO: 213193 - DNA, 3318 bp, Artificial Sequence
  Description of Artificial Sequence: Synthetic coding sequence
atggacagcctggaggaaccacagaaaaaggtgttcaaagcaagaaaaactatgagggtatccgaccgccaacagttggaagctgtctataaagtaaaagaagagctgctaaagaccgacgtcaagcttctgaatgggaatcacgaaaatggcgatcttgacccaacgtccccactcgagaacatggactacattaaggataaggaagaggttaatggcattgaagagatttgtttcgatcctgaagggtccaaagcggaatggaaggagacaccctgcatactttccgtcaacgtcaagaataagcaggatgatgatcttaactgtgagcctctgtcccctcataatatcacaccagaacctgtttccaaacttccggctgaacccgtgagcggcgacccagcgccaggcgacctggacgcaggcgaccccgcatctggggttctcgcaagtggagacagtacctccggggacccaacttcttcggaaccaagctctagtgatgcggcatcaggcgatgccacctccggcgacgcaccttctggagatgtaagcccaggcgacgccacctccggggacgcaacagcagacgatctctccagtggtgaccctacgtcatcggatcccattccaggcgagccagtccccgtggaaccgatcagtggtgattgtgctgccgatgacatcgcctcctccgagattacatcagttgatctggcttcaggtgcaccagcaagcaccgacccggcttctgacgatttagcatccggtgacctgtcctccagtgaattggccagcgacgatttggccactggagagctcgcttccgatgagctcacttccgaatccacttttgaccgcacatttgagcctaagagtgtgccggtgtgtgagccagttccagagattgataatatcgagccatcgtctaacaaagacgacgatttcctggagaaaaacggagcagacgagaaacttgagcagatccaaagcaaagattctctggacgagaagaataaggctgataacaacattgacgctaatgaagagacgctggagaccgacgacactaccatttgttccgacaggcccccagagaatgagaaaaaggtagaagaggacatcattaccgagctggctttaggtgaggatgccatttcatcctcgatggaaattgaccagggagaaaaaaacgaggacgagaccagcgccgacctggtcgagacgatcaatgaaaatgttatagaagataacaagagcgagaacatactcgagaataccgatagtatggagaccgatgagataatacctatcttagagaagttggcccctagtgaggatgagcttacctgtttctctaaaacgtctttgctacctatcgatgagaccaacccagatctggaagaaaagatggagagtagctttgggagtccctctaagcaagaaagcagcgagtctctgcctaaagaagcttttctggtgctttcagatgaagaggacatttccggcgagaaagacgagtccgaagtcatcagtcaaaatgaaacctgcagtcctgaggtggagtcaaatgaaaaggacaataaaccggaagaggaggaacaagttatacatgaagacgatgaaaggccgtccgagaagaatgaattctctcgtagaaaacgatccaagtccgaggatatggacaacgtgcaatctaagcggaggagatacatggaggaagagtacgaagctgagttccaggtgaaaatcaccgcaaagggcgacatcaaccagaagttacagaaagttatccagtggttgctggaggaaaagttatgtgccctgcaatgtgcagtgttcgacaagaccctggctgaactgaagacacgggtcgagaaaatcgaatgtaataagagacataaaaccgtcctgaccgaacttcaggctaagatcgcgcgactgactaagcggttcgaagctgctaaggaagacttgaagaagcgccacgagcatccgcctaacccgcctgttagtccagggaagacagtcaatgacgtgaattcaaataacaatatgtcctatagaaatgctggcacagtccgccagatgctcgagtctaaacggaacgtgtcagagagcgcaccccctagcttccaaacacctgttaacacagtaagctcaacaaatctcgttactcctccggcagtcgtgtcctcacaaccgaagctccagacgcctgtgactagcgggagtctgactgctacttccgtcctcccggcaccgaatacagcgactgtggttgctacaactcaagtgccatctgggaatcctcagccaactatctcactgcagcctctccctgttatcctccatgtgcctgtggccgtatcatcgcagcctcagttgctccagagccatccaggcactctggtgacaaaccagccaagcggcaatgtggaatttatcagcgtccagtcccctccaaccgtatcggggctgaccaaaaacccagtgagtctgcctagcttacctaatcccaccaaacccaacaacgtgccttccgtcccttcccctagtatccagaggaacccgaccgcttctgctgccccacttgggaccactctcgcagtacaagccgtgcccactgctcactctatcgtccaggcaacccggacctctcttcccacggtggggccttcaggcctgtattctccgagtacaaacaggggacctatccagatgaaaattccaatatctgcctttagtacttcttcagccgcagagcagaatagtaatactaccccacggattgaaaaccagacaaacaagacaatcgacgccagcgtgtccaaaaaggccgctgacagtacaagccagtgtggcaaggccacaggttcggattcctccggagtgattgatctgaccatggacgacgaagagtctggagcatctcaggacccaaagaagttaaatcacactcctgtcagtacaatgagttcaagccagcctgtgtcccggccactccagcccattcagccagcgccaccacttcaaccaagtggagtcccaacgagtggaccttcacagaccacaatccaccttctccccacggcccctaccacagttaacgtaacccataggcctgtcacccaagtaacgactcggctacccgtcccacgagcccctgctaaccatcaagttgtctacacaactctaccggctcccccagcccaagcgcctctgcggggtactgttatgcaggctcctgcggttagacaagttaatccgcagaacagcaagcggtttttcctctacatggctcctcggtacatgtag

SEQ ID NO: 213194 - DNA, 3837 bp, Artificial Sequence
  Description of Artificial Sequence: Synthetic coding sequence
atgcaccaggatcaaagatttaggatggattccctggaggagccccaaaaaaaagtctttaaagccaggaaaaccatgcgggtctcggatcgtcagcagctcgaggcagtgtataaagtcaaagaggaactcctaaagactgatgtgaaattgctcaatggaaatcacgagaacggcgacctggacccaacctcgcccctcgagaatatggactatatcaaagataaagaggaggtgaatggcatagaagaaatatgtttcgatcctgaaggcagcaaagcggaatggaaagaaaccccgtgtattcttagcgtcaacgtgaagaacaagcaggatgatgatctaaattgcgaacctctctctccacacaatatcacccccgagcccgtatctaagctgccggctgaaccagtgagcggcgatcccgcacccggagaccttgatgctggagaccccgcttctggagtcctcgcaagcggtgactctacctccggcgatcctacttcttctgagccttcaagttcagacgccgcaagcggcgatgccacatctggagacgcccctagcggagacgtgtcgcctggagacgcgacaagcggagatgccacagcagacgacctctcctccggtgacccaacttcctctgatcccattccaggcgaacccgtacctgtcgagcctatcagtggggattgcgcagcggatgatatcgcatcctcggaaattactagcgtggacctagctagcggcgcacctgcgagtaccgacccagcatcagacgacctcgcgtctggagatctgtcctcatccgagttggcttctgacgatttggccacaggcgagcttgcctctgatgagctgaccagcgaatcaaccttcgatcgcactttcgagcccaagtctgtgcctgtctgcgagccagtgcccgagattgataacattgaacctagttctaacaaagatgatgacttcctagagaaaaacggagcagacgagaaactcgagcaaattcaaagcaaagattccctggacgagaaaaataaggccgacaacaacattgacgctaatgaggaaacccttgagacagacgacactactatttgtagcgacaggccccctgaaaacgaaaaaaaagttgaggaggatattatcacagaactagctctaggcgaggacgctataagctccagcatggaaattgaccagggggaaaaaaatgaagatgaaacttctgccgacctggttgagacgatcaatgagaacgtaatcgaggataataagtctgagaatattctggagaataccgactccatggagactgatgagatcatcccgatcttggagaaactcgcgccaagcgaggacgaactcacgtgtttttccaagacgtcgctgttgcctattgatgaaacgaatccagacctggaagagaagatggaatcatcgttcggttctccttctaaacaggaatcatcagaatccctcccaaaagaggcatttctcgtgctgagcgatgaggaagatatatcgggcgagaaggacgaatctgaggtgattagccagaacgaaacgtgttcccccgctgaggttgaatccaacgagaaggataacaaacccgaggaggaggagcaggtgattcacgaagacgatgagcggccttcagagaagaacgagttcagcagacggaagaggtcaaaatctgaggatatggataacgtccaaagtaaacggcgacgatatatggaagaggaatatgaggccgaattccaggtgaagatcactgcaaaaggcgacatcaatcaaaaactccaaaaagttatccagtggcttttggaagagaaattgtgtgccttgcaatgcgcggtgtttgacaagacgttagcagaacttaagacaagagtcgaaaagatagagtgtaacaaacgacacaagaccgtcctcactgaactccaggcaaagatcgctcgactgacaaaaagattcgaagcggctaaggaggacctcaaaaaaaggcacgagcaccctcccaatccacccgtgagtcccggtaagacagttaatgatgtaaattccaacaacaatatgtcttatcggaacgccggaaccgtccgtcagatgcttgagtctaagcggaatgtgtccgaaagcgctcctccttctttccagaccccagtgaatactgtcagttccacaaacctggtcactccccctgccgttgtgtcaagccaacccaaactccagactcctgtgacttctggaagtctaactgccactagcgtgctcccagccccaaatacggccaccgtcgtggccaccactcaggttcccagcggtaacccacaaccgacaatcagcctacagcccctgcctgtcattttacatgtgcctgttgccgtctcgtctcaaccccagttgctgcagagccatcctgggacactcgtcaccaatcagccttctggcaatgtagagtttatcagcgttcaaagtcccccaaccgtctcaggactgaccaaaaatcccgtgtccctgccaagtctgcctaaccctacaaagccgaacaacgtgccaagcgtgccatccccttcgatccagagaaacccgactgcttccgccgctcctctaggcactactctggctgtccaggccgtgccgacagcccacagcatcgttcaggccacccgtacttcactccctacggtgggtcctagcgggctgtactcaccctccaccaacaggggacctatccagatgaaaattccaatttccgcttttagcaccagttcggccgctgagcagaatagcaacacaactccgaggattgagaaccagaccaacaagacaatcgacgcttcagtctctaagaaggctgccgactcgacgtcacagtgtggaaaagcaacgggaagtgacagcagtggtgtgattgacttgacgatggacgacgaagagagtggggcatctcaggacccgaaaaagctgaaccatactccggtctcgacgatgagttccagtcagccagtgtcccgtcccttgcaaccaattcaacccgcaccccctttacagccttccggagtccctacctctggtccgtcccaaactactattcatctgctgcccacggcacccactaccgttaacgtcactcatcggccagttacccaggtcactaccaggttacccgtcccccgagctcctgccaatcaccaagtggtgtacactacacttcctgcgcctccagcccaagctccactccgcggtacagtgatgcaggccccagctgttagacaagtgaatccccagaattccgtgactgtgagggtgccccaaacgacgacatacgtggtcaacaacggtttgactctcgggtccactggtccccaactgactgttcatcatcgtccaccacaggtacacaccgagcctcctaggccagtccatcccgctcctctgcctgaggccccacaacctcagcggctcccgccagaagcagctagcacatcactgccccagaagcctcacttgaagctggcgagagttcaatctcagaatggaattgtactgtcctggtcagtcctggaggtagataggagttgcgctaccgtcgactcctatcacctgtatgcctaccatgaggagccatccgccacggtaccctcccagtggaagaaaattggcgaagtgaaagccctccccctccccatggcttgtacgctgactcaattcgtgagcgggtcaaagtattactttgcggtcagggcaaaagatatttacggcagattcgggccattttgtgatcctcagtcaaccgacgtaatctccagcacccagagcagttag

SEQ ID NO: 213195 - DNA, 510 bp, Artificial Sequence
  Description of Artificial Sequence: Synthetic coding sequence
atggacagcctggaggagccacaaaagaaggtattcaaggctaggaaaacgatgcgcgtgtctgatcgacaacaattggaagctgtctataaggtgaaagaggagctgttgaagaccgatgtgaagctactgaatggcaaccacgaaaatggcgatctcgacccaaccagtcccctcgagaatatggactatataaaggataaagaggaggtaaatggcatagaggagatatgtttcgatcccgagggcagcaaggcagagtggaaggagaccccatgcatactaagtgtcaacgtaaaaaacaaacaggacgatgacttgaattgtgagcctctcagcccccacaacattacacctgagccagttagcaagttacccgcagaacccgtatcgggggatcccgcaccaggtgatttggacgccggagaccccgctagcggggttttagcctctggagatagtactagcggcgaccccacctcatctgagccgtcctcttctgatgcttag

SEQ ID NO: 213196 - DNA, 1632 bp, Artificial Sequence
  Description of Artificial Sequence: Synthetic coding sequence
atggcatcgccagatcgctccaaaagaaaaattttgaaggccaaaaagacaatgccgctgtcatgcagaaagcaggtggaaatgctgaacaagtcgcggaatgttgaggcattgaaaaccgctattggttccaacgttccgtccggcaaccaatcgtttagcccctccgttattacccggactactgagataaccaaatgctcaccatctgagaatggggcaagttctctggacagtaacaaaaactctattagtgaaaagtcaaaggttttcagccagaattgtattaagccggtcgaggaaatcgtccattctgagactaagctcgagcaggtcgtgtgtagctatcagaagccatcccggaccacagagtcgccatctcgagtatttaccgaggaggctaaggatagtctgaacacttccgaaaacgactcagaacaccagacgaatgtcactaggagcttattcgagcatgagggcgcttgctcactcaagagctcatgttgcccaccttcggtgttatcaggagttgtgcagatgcccgagtcaaccgttacatcgacagtaggcgacaagaagactgatcagatggtgtttcacctggagaccaacagtaatagcgagtcccatgacaagcgccagagtgacaacatcctgtgttctgaagactctgggttcgtacctgtggaaaagacaccaaatctggtgaactcggtgacctctaataattgtgctgacgacattctgaagaccgacgaatgttccagaacttccatttctaattgtgagagcgctgacagcacctggcagtctagcctggacacaaacaataattcccattaccagaaaaagcgcatgttttcagagaacgaagagaacgtgaaacggatgaaaacatccgagcaaatcaacgagaacatttgtgtgagtttagagcgccagactgcctttctcgagcaggtcagacacctcatacagcaggaaatttacagtataaactacgagcttttcgacaagaagttgaaagaactgaaccagcgcatcggaaagactgaatgtcgtaataagcacgagggtatcgccgataaacttctggccaagattgcaaagctacagaggaggattaagacagtgctgcttttccagaggaactgtctgaagcccaacatgttatctagcaacggggcatcaaaggtggcgaactcagaagccatgattctggataagaacctggagtccgtgaacagcccaatcgagaaatccagcgtaaactacgagccatccaacccaagcgagaagggatcaaagaagatcaacctcagttcagaccaaaacaagtcggtttccgaaagcaacaatgacgacgttatgctgatttccgtagaaagcccgaacctaactacacccatcaccagtaatcccaccgacacgagaaagattacgagtgggaattcatccaattcccctaatgcagaggtcatgaaggtccagtatccgccatggtctcacattagaaagctgcttcagacacaaagaaagcagcctcactggcataaaatgcagtctagattcttgtctccactcagcacctgccacctgtcccagaatcatcagcatcattacctcaactag

SEQ ID NO: 213197 - DNA, 2049 bp, Artificial Sequence
  Description of Artificial Sequence: Synthetic coding sequence
atggccagccccgaccgctcaaaacgaaagatactgaaagcgaagaaaaccatgccactgtcatgcaggaaacaggtggagatgctgaataagtcccgcaatgttgaagctctcaaaacagccattggttcaaacgtgccgtcagggaatcagtccttctccccgtcagtcatcactcgcacaactgaaattacgaaatgcagtccctcagagaatggggcaagttcactggactcaaacaaaaactctataagcgaaaagtcgaaagtgttttctcagaactgcatcaaaccagtcgaagagattgtgcactctgagacaaagcttgagcaggttgtgtgcagttaccaaaagccaagccgtaccacagaatctccgagccgagtgtttacggaggaggccaaagatagccttaatacctcagaaaacgactccgagcatcagacaaatgttacgcgcagtctctttgagcacgagggggcttgctcactcaaaagcagttgttgccctccttccgtccttagtggcgtggtgcagatgccggagtccactgtcacgagtacggtgggcgacaagaaaaccgaccaaatggtttttcacttggagacaaattctaactccgagtcccatgataagcgccagagcgacaatatcctgtgttccgaggactcaggatttgtgccagttgagaagactccgaacctggtaaactccgtcacatcgaataactgtgcagatgatatcctaaagaccgacgagtgcagtaggactagtatttccaactgcgagagcgctgacagcacgtggcaaagttctttggacaccaacaataactctcattatcagaagaagagaatgttttcagaaaatgaagagaacgtgaagcggatgaagacatcggagcagattaatgagaatatctgcgtttctttggaacgccaaaccgcctttcttgagcaggttcggcatctaatccaacaggagatttacagcattaactacgagctgtttgataaaaagttgaaagagttaaatcagaggatcggtaagacagagtgcaggaataagcatgaaggcatagcagataagctgctggccaaaatcgccaaacttcaaagaaggatcaagaccgtcctgctttttcagagaaactgcttgaagccaaacatgctgtcctctaatggcgcttctaaggtggctaatagcgaggcaatgatcttagataagaatcttgagagcgtcaattctcctatcgagaagtcaagcgttaattacgaacctagcaatccatccgaaaaggggtctaagaagatcaacttgagcagtgatcagaataaatcagtgagtgagtcaaacaacgacgatgtgatgctgatttctgtggagtcccccaatctgactacgcctatcactagtaaccccaccgacacccgaaaaatcacaagcggaaatagcagcaacagcccgaacgccgaggtgatggccgtgcagaagaaattggactccatcatagacctcaccaaagaaggactgtccaactgcaatacagaaagtcccgtctcgccactcgagtcacactccaaggccgcttccaatagtaaggagaccacgccgttagcccaaaatgcagtgcaggttcccgaaagtttcgagcacctgccccctcttcccgaacctccagctccactgcccgaactggtcgataagacacgcgatacattgcctccacaaaaaccagaattgaaggtcaagagggtctttcgaccgaacggcatcgccctgacctggaacattacaaaaattaatcctaaatgtgccccagtggaatcataccatttgttcctgtgtcacgagaacagtaataacaaacttatttggaagaaaattggtgagataaaagcattgccacttccaatggcctgcacgttaagtcagtttctggccagtaaccgatactacttcacggtccagtccaaggatatctttgggcgttatggaccattttgtgatatcaaatctatcccaggcttttctgaaaacctgacgtag

SEQ ID NO: 213198 - DNA, 1632 bp, Artificial Sequence
  Description of Artificial Sequence: Synthetic coding sequence
atggctagtcccgacaggtccaaaagaaagattctgaaggccaaaaaaactatgcctctctcctgtagaaaacaagttgaaatgctcaataagtctcggaatgttgaggctctcaagactgcgattggtagcaatgtgccatcaggaaatcagtcattttctccttccgttatcacccgcactaccgaaatcacaaaatgctcgcccagcgaaaacggcgcttctagcctggatagtaacaaaaactccatatcagagaaatccaaggtgttctcccagaattgtataaaaccagtggaagaaatcgttcattcagagactaagcttgagcaggtggtgtgtagttatcagaagccctcccgtacaaccgagtcaccgagtcgagtttttacagaggaagccaaagactcccttaacacaagcgaaaatgactcagagcaccaaaccaacgtaactagatctctatttgagcatgaaggcgcttgctctttaaagtctagttgttgtcccccttctgtactatcgggggtggtacagatgcccgagtccaccgtcaccagcactgtgggggataagaaaaccgatcagatggtctttcacctggagacgaacagcaattcagagtcgcacgataagcgccagagcgacaatattctgtgttcagaggatagcggatttgtgccagtagagaagaccccaaatctggtcaactctgtcaccagcaataattgcgccgatgacatcttgaaaacggatgagtgttctaggacgtctatttctaattgtgagtcagccgactccacctggcaatcttcgctggatacaaataataactctcactaccaaaagaagagaatgttttccgaaaatgaagagaatgtgaaacgcatgaagacatccgagcagatcaacgagaatatttgcgtgagtctggagcgacagacagcattcttggaacaggttcgccacctcatccagcaggagatctattctatcaactatgagctgttcgacaagaaactgaaggagctcaatcagagaattggcaagacagagtgtcgtaacaaacacgaggggatcgccgacaaacttctcgctaaaatcgctaagctacagcgaaggatcaaaacagttctcctgtttcagaggaactgcctaaaacccaacatgcttagttcaaacggcgctagcaaagtggctaatagtgaggccatgattctcgacaagaatctggaatctgttaacagtccaatagaaaaaagcagcgtcaattatgaaccctccaatccctccgaaaagggatctaaaaaaatcaacttgtcgagcgaccagaacaaatcggtttccgaatctaacaatgatgacgtgatgttaatttcggtcgagagccctaatctgaccacgcccatcacatctaaccctacagatactagaaaaataactagcggaaattcctcaaatagcccaaacgccgaggtgatgaaggtccagtaccccccttggagtcatattagaaagctgttacaaacacagcgtaaacagccacactggcacaagatgcagtccaggtttctctcacccctcagtacttgccacctgagccagaatcaccaacatcactatctaaactag

SEQ ID NO: 213199 - DNA, 2049 bp, Artificial Sequence
  Description of Artificial Sequence: Synthetic coding sequence
atggcatcacccgatcgcagtaagcggaaaattctcaaggcaaaaaagacaatgccactgagttgtcggaaacaagtggagatgcttaataagagccgcaacgttgaggctctgaagactgcgattggctccaacgtgccctctgggaatcagtcgttcagccctagcgtgattaccaggaccacagaaatcactaagtgcagtcccagcgaaaatggcgcaagttctctagattccaacaagaattctatcagtgaaaagagcaaagttttcagccagaattgtataaagcccgtcgaggagattgtccactccgagaccaaactcgaacaggttgtgtgttcttaccagaaaccaagcaggacaaccgagagcccttcccgtgtattcaccgaggaggctaaggatagcttgaacaccagcgagaacgacagtgagcatcagactaatgtgacgcgctctcttttcgaacacgaaggcgcatgttctcttaagtccagctgctgcccaccatccgtgttaagcggagtagtgcaaatgcctgaaagcacagtgacttcaacagtaggcgacaaaaagaccgaccagatggttttccacctggaaaccaacagtaacagcgagagccacgacaagaggcagtcagacaatattttgtgttctgaggatagcggattcgtccccgttgaaaaaacacccaacctcgtaaactctgtgacttccaataattgcgcagatgacattctcaaaactgacgagtgctcacgcacctctatctccaattgcgagtccgccgattctacttggcagtcttcactggatacgaacaacaactcccactaccagaagaagcggatgtttagtgagaacgaggagaatgttaagcgcatgaaaacttctgaacagattaacgagaacatttgcgtttcacttgaacggcaaaccgctttcttggagcaggtgcgccacctaatacaacaagagatttacagcattaactatgagctttttgataagaagttgaaagagctgaaccaaaggatcggcaagaccgaatgtcgtaacaagcacgaaggcatcgccgataagctgcttgccaaaattgccaagctgcagagaaggatcaagacagtactgctgttccagcgtaattgcttgaagcctaacatgctcagtagcaatggtgcctccaaagtcgcaaactccgaagcaatgattttggacaagaacttagaatccgtgaactcaccaattgaaaaatcatcagtaaattatgagccaagcaaccccagtgaaaaaggaagcaagaagatcaacctgtcttctgaccagaacaaatcagtgtccgagagtaacaacgatgatgttatgctgatctcagtagagagtcccaatcttaccactcctatcacgagcaaccccaccgacacacgaaagattacatcgggtaattccagcaacagccctaatgcagaggtcatggctgttcagaagaagcttgactctattatcgacctgactaaggaaggcttgagcaattgtaacactgaatctccagtaagccctctggaatcccactccaaagcagcatccaactcgaaagaaacaacacctctggcccagaacgcagtgcaggtacctgagtccttcgaacacctgccacccttgcccgagccacccgctccactacctgagctcgtagataagacccgagataccctcccccctcagaaaccagagttgaaagtgaagagagtcttccggcctaacggaattgctctgacttggaatatcactaaaatcaatccgaaatgtgcacctgtggagtcctaccatctgttcctttgccatgaaaattcgaataacaaactaatatggaaaaagattggggagatcaaagcattgcccctaccaatggcctgtaccctgtcgcaattcctggcttctaacagatattattttactgtgcagtccaaagatattttcggaagatatgggccattttgtgacatcaaatccatccccggattctctgaaaatctgacttag

SEQ ID NO: 213200 - DNA, 1278 bp, Artificial Sequence
  Description of Artificial Sequence: Synthetic coding sequence
atggcatcccccgacaggagcaaacgcaagattctgaaggccaagaagaccatgcctttgtcctgccgtaagcaggttgaaatgctgaataagtctaggaacgtggaggcattaaaaacagcaatcggaagcaatgtgccctccggcaatcaatccttctctcctagtgtaatcaccaggactactgagataaccaaatgcagccctagtgaaaacggagccagcagtctagactcaaacaaaaactcaataagtgagaaaagtaaggtgttttcccagaattgtataaaaccagtggaagagatagtgcattctgagacaaaactggagcaggtcgtgtgcagctatcaaaagcctagccgaactacagaatccccctctagagtgttcacagaggaagcgaaggactccctgaatacatccgagaatgactctgaacatcagacaaatgttacacgaagtctgttcgaacatgagggcgcttgcagtcttaagagcagttgctgccctccaagcgtcctgtccggtgtcgtgcagatgccagagagcactgtcacctctacagtgggcgacaaaaaaactgaccaaatggtgttccacttagagactaatagtaactcagaatcccacgacaagaggcagtctgataatattctgtgctctgaggactctgggttcgtacccgttgagaagaccccgaacctcgtaaactccgttacttccaataactgtgctgacgatattcttaagactgacgaatgtagccgtaccagcattagtaattgtgagtcggctgatagcacatggcagtcttcattagataccaataacaactctcactatcagaagaaaaggatgttctcagagaatgaagagaacgtaaagcggatgaaaactagtgagcagataaatgagaatatctgcgtgagtctggagcgccagaccgcattcctggaacaggtgcgacatctgatacaacaggaaatttatagtataaattatgagctgtttgacaagaagttaaaggagctgaatcagcggatcggcaaaaccgagtgccgcaacaagcatgagggcattgccgataagctcctggcgaagatcgccaagctgcagcggcgaattaagactgtgttactcttccagcggaattgcctgaagcctaacatgttgtcgtccaacggcgctagcaagatccccgaaaagctccatcaggaaattcttgccatcctgccgatgctgaagctttggctctacaggagaaacctcatcctctag

SEQ ID NO: 213201 - DNA, 681 bp, Artificial Sequence
  Description of Artificial Sequence: Synthetic coding sequence
atgttgatatcagttgaaagcccaaacttgaccacccccattacaagcaatccaacagatacacgcaagatcacatctggcaactcaagtaacagcccaaacgctgaggtgatggctgtccagaagaaactcgattccatcatagacctcaccaaggagggtctcagtaactgtaacaccgagtcccctgtgtcccccctggagagccactccaaagcagccagcaatagcaaagaaacaactccactggctcagaacgcagtccaggttcccgaaagctttgaacatctgccccctctccccgagccccctgcaccgctgccagagctggtggacaagacacgggataccctgccccctcagaagcccgagctcaaggtcaagagagtgttcagaccaaatgggattgcacttacatggaatatcacaaaaatcaacccaaaatgtgctcccgtggagagctaccatctattcctgtgtcatgagaattcaaataataaactcatatggaagaaaattggggagattaaggcactgcctctcccaatggcctgtacgctttcacagtttctggcctcaaaccgttattactttacggttcagagtaaagatatttttgggcgttatggcccattctgtgatatcaaaagtatacctggtttttctgagaacttgacatag

SEQ ID NO: 213202 - DNA, 714 bp, Artificial Sequence
  Description of Artificial Sequence: Synthetic coding sequence
atgactagcgaaatcacctacgctgaggtgaggttcaaaaatgagttcaagagcagcggcattaacaccgcctcttcagccgcttccaaggagcgcactgcaccccataagtcgaatacagggttccccaagctactgtgcgccagccttcttatctttttcttgctgctcgccatatcgttctttatcgcgttcgtgatcttttttcagaaatacagtcagttgctggaaaagaaaaccactaaagaattggtgcacactaccttggagtgcgtgaagaaaaacatgcccgttgaggagacggcctggtcatgttgtcccaagaattggaaaagcttttctagcaattgttatttcattagtaccgagagcgctagctggcaggacagcgaaaaggattgcgccagaatggaggcgcatctgctagttatcaatactcaggaggaacaggatttcatatttcagaatctccaggaggagtctgcttatttcgtgggtctctcagatccggaaggacagcgccactggcaatgggtagatcaaaccccttacaacgaaagttctacgttctggcacccacgggagccctctgatccaaatgaacgatgcgtggtcttgaatttccggaagagcccaaagcgatggggttggaatgacgtgaactgtcttgggcctcagagatcagtgtgtgagatgatgaagatacatctgtag

SEQ ID NO: 213203 - DNA, 2469 bp, Artificial Sequence
  Description of Artificial Sequence: Synthetic coding sequence
atggaggaggaggaagaagccatcggactgcttgataaggtccttgaagatgaagacgtgtttttactcgaagagtgcgaacttggaacccccacctcaccgggttccggcagcccttttcttgtagcagtgaaagtcgaggcgggaaaggggctggaaatgagaaaacttgtgctgagcggttttctggcttccgaagaaatctatattaatcagctggaggcccttttactcccgatgaaacctctcaaagcgaccgccactacctctcaacccgtgttgacaatccaacagattgagactattttttacaaaatccaggatatttacgaaatccacaaagagttttatgacaacctctgtccaaaagtacagcagtgggatagccaagttacaatggggcatctatttcagaagctggcctctcagctgggcgtgtacaaggccttcgtagataattacaaagtagctctagagacggctgagaaatgctcccagtctaacaaccaatttcagaagatcagcgaggaattaaaggtgaagggccctaaggattctaaggacagccacactagcgtaaccatggaggccttactgtataaacccatcgatcgggtcactaggagcacattagtactgcacgatttgctgaaacatacgcctgtagatcaccccgactaccccctcctccaggacgcccttcggatttcacagaactttctgtcatcaatcaatgaggacattgatcccagaagaactgccgtgacaacgcctaaaggtgagactcggcagctggtgaaagacggattcttagttgaagtaagcgagagttcccgaaagctcaggcatgtctttttattcacagatgtgctcttgtgcgcaaagctgaagaaaacgtctgctggcaagcatcagcagtatgattgcaaatggtacattcctctggccgatctcgtctttccttccccagaggaaagtgaggctagcccacaggttcatccttttcctgaccatgagctagaagacatgaagatgaaaattagcgctctaaagagcgaaattcagaaggagaaagctaataaaggccagtcccgcgcaatcgagagattaaaaaagaaaatgttcgagaacgaatttcttctgctcctaaatagcccaactattccgttcaggattcataatcgcaatggtaaatcttatctgttcctcctttctagcgattacgaacgatctgagtggcgggaggccatacaaaaactccaaaaaaaggatttgcaggccttcgtcctttcatcagtcgaactgcaggtgttgactggttcctgctttaaactgcgaactgtacataatatccctgtcacatccaataaagacgacgacgagagtcccggactttatggcttcctccatgtaattgtgcattctgccaagggtttcaaacagagcgccaatctttattgtaccctggaggttgactcttttggttatttcgtgagtaaggccaagaccagagtcttcagagacactgccgaaccgaaatgggacgaagagttcgagattgagctggaggggagtcagtccctgcgaatattgtgttacgagaagtgctatgacaaaactaaagtcaacaaggacaataacgaaatcgttgacaagatcatggggaagggtcaaatacagctggatccacagactgtcgagacaaaaaattggcacactgacgtcatcgagatgaatgggatcaaagtggagttctccatgaagttcacctccagagacatgtccctcaagagaaccccaagcaaaaagcagaccggcgtatttggcgtgaaaatctcggtggtcacaaagcgggagaggtccaaggtaccctacattgttaggcagtgtgtcgaggaggtggagaaacgcggaattgaagaggtagggatctataggatttccggagtggctacagatattcaagccctgaaggccgtcttcgatgccaacaacaaggacatcttgcttatgctctccgacatggatatcaacgcaatcgctggaactttaaagctctacttccgtgagctgccagagcctttgctgaccgacaggctttaccccgcattcatggaaggaatagccttgtccgacccggcagccaaggagaactgtatgatgcacctgctccgctccttgcctgaccctaatctgattacttttcttttcctcctggaacacctgaaacgggtggccgagaaagagcccatcaacaagatgtcgctgcacaacctggcaaccgtgttcgggcctacactgttgcgcccatccgaggtggaatcaaaggctcacttaacctccgctgcagacatttggagccatgacgtgatggcccaggtacaggtattgttatattacctgcagcatccccctatctctttcgctgaactgaaacgcaacactttgtatttctcaaccgacgtctag

SEQ ID NO: 213204 - DNA, 2580 bp, Artificial Sequence
  Description of Artificial Sequence: Synthetic coding sequence
atggagccgcttagccacagaggtctgccgagattgagttggattgatacactctactccaactttagctacggcactgatgagtatgacggggagggcaacgaggaacagaagggcccacctgaggggtcggagactatgccatacattgatgagagtcctacaatgtcccctcagttaagtgcaagatctcagggcggtggggacggggttagccccaccccaccagagggacttgcccctggcgtagaagcaggcaagggactcgagatgcgcaagctggttctgtccggatttttagcctccgaagagatctatatcaaccaactggaggctctgctcttacctatgaagcctctgaaggctactgccaccacgtcacagccggttctaactatccaacagattgaaacaatcttttacaaaatccaggatatttacgaaatccataaggaattttatgataacctgtgtccaaaggtgcagcagtgggatagccaggtgactatgggtcacctattccagaaactggcttcacagctgggggtgtataaagcattcgttgataactataaggttgcgcttgagactgcggaaaaatgtagtcagtcaaataaccagtttcagaagatttcagaagaactcaaggtgaaaggcccaaaggattcaaaagactctcacacgtcagtaaccatggaggctctgttgtataagcctatcgatcgggtaacaaggagcactctggtcctacacgacctgctgaagcacactccagttgatcaccctgattaccccctgctccaggatgccctgcgcatatctcaaaacttcctgtcttccatcaatgaggatatagatccacgtcgcaccgcagtgactaccccgaaaggtgaaactagacaactggtcaaagacgggttcctggtcgaggtcagcgagagcagcaggaagctgcgccatgttttcctgttcactgatgtattactctgtgccaagttaaaaaaaacctccgccggtaaacaccagcagtacgattgcaaatggtacattcccctggctgatctggtgttcccctctcccgaggagtcggaggcatctccccaggtgcaccccttccctgaccacgagctggaagacatgaagatgaagatctctgccctgaagtcagaaatccaaaaagagaaggccaataagggccaatctagggctatagaaagactgaagaagaagatgttcgaaaatgaattcctgctgctgctgaacagcccgactataccgtttcggattcataatagaaatggcaagtcttacctatttctcctttcttccgattatgagaggagcgaatggagagaagcaatccagaaacttcagaaaaaggacttacaggcctttgtgctgtcaagtgtggagctgcaggtgctgactggctcatgctttaagctgaggacagtgcacaatataccggttaccagcaacaaggatgacgatgagtcccctggactctatggcttcttgcacgtgattgtgcatagcgcaaaggggttcaagcagtcagcaaatctgtactgtaccctggaggtcgacagcttcggatactttgtgtcaaaggctaaaaccagagtattcagggatactgctgaaccgaagtgggatgaagagttcgaaatcgaactggagggatcccaatcactaagaatcttgtgttatgagaaatgctacgataagacaaaagtcaacaaggacaataacgagatagttgataagataatgggaaaaggtcaaatccagctggatccacagaccgtcgagacgaagaattggcatacagacgtcatcgaaatgaatggaattaaggtcgagttctccatgaagttcacatcccgcgacatgagtttgaaaagaactccttccaagaagcagaccggcgtgttcggcgtcaagatctcagtagtcacaaagagagagaggagcaaagtaccttatatagtccggcagtgtgtcgaggaggtggagaaacgcggaatcgaggaggtggggatataccggatctccggcgtcgctaccgacatccaagctctaaaagctgtttttgacgctaataataaggacatactgcttatgttgtctgatatggacatcaacgccatcgctggcaccctcaaactatactttagggagctccccgagccgctcctcacggaccgcttgtaccctgcctttatggaaggaatcgccctctccgatccagcggctaaagagaattgcatgatgcacctacttaggtcactgcccgacccgaacctgatcacctttctgttcctgttggagcatctcaaacgggtagctgagaaagagccaattaacaaaatgagtcttcacaatttagcaaccgtgttcgggcctacactgttgagacctagtgaggttgaatccaaagcacatctcacctcagctgctgacatctggagccatgacgttatggcccaggtccaggtgctgctgtattacttgcagcacccaccgattagctttgcagagctaaagaggaatactctttatttttccaccgacgtgtag

SEQ ID NO: 213205 - DNA, 1092 bp, Artificial Sequence
  Description of Artificial Sequence: Synthetic coding sequence
atgaaaccccttaaggccaccgctacaacatcccagcccgtgttgactatccagcaaatcgagacaattttttacaaaatacaggacatttacgagatccacaaggagttctacgacaacctatgccccaaggtgcaacagtgggacagtcaagtcactatgggccatctgttccagaagctggctagccaactcggagtttacaaggccttcgtagataactataaagtggcccttgaaacagctgaaaaatgttctcaatcaaacaaccagttccaaaaaatctccgaagagcttaaagtgaagggacctaaagatagtaaggactcccacacatctgtcaccatggaggctctgctgtacaaacccatcgatagagtgacccgctccactctcgtgctgcacgacttattgaagcacacccctgtggatcatccggactatccgctactccaggacgctctgcgaatttctcaaaattttctgagtagcatcaacgaagatatcgacccaagacgaactgcagtcaccacccccaagggagaaactcgtcagctcgtgaaagacgggtttctggtcgaggttagtgagtcttccaggaaattgagacatgtgtttctatttacggacgtgttactttgcgcgaaactcaagaaaacgagtgcgggaaaacaccagcagtacgattgcaaatggtacatcccactagccgatctggtgtttccgtcccccgaggaaagcgaagcgtccccccaggtgcacccctttcccgatcatgagctcgaggacatgaagatgaagatctcagctctcaagtctgaaatacagaaggaggaggtagaaaagcggggaatcgaagaggtggggatctacaggattagcggggtcgcaacagacattcaggctctcaaagcagtgtttgatgccaacaataaggacatcctcctgatgttgtcagacatggacattaatgccatcgccggaacgctaaagctgtacttcagggaactgccagaacccctgctgacagataggttgtccccatgccccaccccaacttcatctccatccagctcttgttggaacacctag

SEQ ID NO: 213206 - DNA, 1926 bp, Artificial Sequence
  Description of Artificial Sequence: Synthetic coding sequence
atggaaatactgctgattatccgcttttgctgcaactgtacctatgcactgctttacaagcctatcgatagagttacgaggtccacactcgtcctgcatgatcttctcaaacacacgcccgtcgatcatcccgactatcccctgttacaggacgccctgcgtatatctcaaaacttcctgtcatctataaatgaggacatcgatccacggaggaccgctgttactaccccaaagggagagacgagacagctggtgaaggatggattccttgtggaggtgagtgagagctcccgtaagttaaggcacgtgtttctcttcaccgatgtgctcctctgtgccaagttgaagaagacaagtgcaggcaaacatcagcaatatgactgtaagtggtatatccctctcgcggacttggtatttccaagccctgaagaatctgaggcaagtccacaggtgcatccgtttccagatcacgaactggaagacatgaagatgaaaatttccgctctcaagagtgaaattcagaaggaaaaggccaataaaggtcaaagcagggccatagaaagactgaagaagaagatgttcgaaaacgagttcctgctgctgctgaacagccctacaatccctttccgaattcataatcgtaatgggaagtcttatctatttcttctgagttctgattatgaaagaagtgagtggagagaggccatacagaagcttcaaaaaaaggatcttcaggcctttgtgcttagttctgtcgaattacaggtgctaaccggctcctgctttaagctgcgtaccgtgcacaacatacccgtgacatcaaataaggacgacgatgagagtcccggtctgtacgggttcctgcacgtgattgtccactcagccaaaggcttcaagcagagtgctaacctttactgcactctggaagttgattcttttggatactttgtttctaaggcaaaaacccgcgtcttccgcgataccgcggaacctaaatgggacgaggagtttgagattgagctcgaggggtcccagtcgttgagaatactctgctatgaaaagtgttatgacaaaacgaaggtcaataaagataataatgagatcgtggacaagatcatgggaaaggggcaaatacagctggatccccaaacagtagaaaccaaaaactggcatactgacgtaattgaaatgaacggaattaaggtggagttctcaatgaagtttaccagccgcgatatgtctctcaagcgtacgccaagcaaaaagcagactggtgtattcggggtcaaaatttcagtagtgaccaaaagagaaaggagcaaggtgccatacatcgtgagacaatgcgtagaagaggtggagaagcggggtatagaagaggtgggcatttacaggatctcaggggtggcaacagatattcaggctttgaaagcagttttcgacgcaaacaacaaggatatccttttgatgctgtccgacatggatattaacgcaattgccggtaccctgaagctgtactttagggagttacccgagcccctcctgaccgataggctgtatcctgcctttatggaaggtatcgccctgagcgaccctgcagctaaggaaaactgcatgatgcacctgcttagatctcttccggaccccaatctcattacctttctgtttctgctggaacacttaaagcgcgttgcggaaaaggaaccaatcaataaaatgtctctgcataaccttgccactgtcttcgggccaacacttcttaggccctcagaagtcgaatccaaggcccatttgacctcagctgccgacatctggtcccacgatgtgatggctcaagtgcaggtcctgctatattacctgcagcatcccccaattagcttcgcagaacttaaacgtaacaccctctatttctcaaccgatgtttag

SEQ ID NO: 213207 - DNA, 933 bp, Artificial Sequence
  Description of Artificial Sequence: Synthetic coding sequence
atgactgacgtgctccctcaacctgattgcagcccgaaagctggacgggagcctcttgcactggaggaatccggttccaagagacccccaaataccggcgcacgactgtggggcagagttaggaacaagttactacgaaacaagctagatccccagactgtggagactaagaattggcacaccgatgtcattgaaatgaatggcataaaggtggaattcagcatgaagtttacctctcgagacatgagtcttaaacgcacacccagcaaaaagcaaacaggcgtatttggtgtcaagattagcgtcgtgactaagcgcgagaggtcgaaagtcccttacattgttagacaatgtgtggaagaagtggaaaagagggggatcgaagaagtcggtatttatagaatatccggggtggccacagacatacaggccctgaaagccgtgttcgacgccaataacaaggacatcctgctgatgctgagcgatatggacataaatgccatcgccggtactctgaaactgtatttcagagagttgccagagcccttgctgacagacagactctaccctgcttttatggagggaatagctctcagcgatcctgccgctaaggagaactgcatgatgcacctgctgcggagtctgcccgatccgaacttgataacctttttgttcttattggagcaccttaagagggtggctgagaaggaacccattaacaagatgagcttgcataacctggctacggtgtttggccctaccttgctacgcccatctgaagtggagagcaaggcacatttgacctctgccgctgacatatggtcccacgacgtcatggctcaggtacaggtcttgctttactatctgcaacatccccctatctcgttcgccgagcttaagcgcaacaccctgtacttttccactgatgtctag

SEQ ID NO: 213208 - DNA, 2442 bp, Artificial Sequence
  Description of Artificial Sequence: Synthetic coding sequence
atgccctacatagatgagtcacccactatgtccccacagctgtccgccaggtctcagggaggcggtgatggcgtaagtcccactcccccagagggtctggcccctggtgtcgaggctggaaagggtctggaaatgcgaaagttagtcctgtctggatttcttgcaagtgaggagatatacattaatcagctcgaagctctgcttctccctatgaagcccttgaaggcaactgcaaccacgtctcagccagtattgacaatccagcagatcgagaccattttctacaagatccaggacatctacgaaatacacaaagagttttatgataatctatgtcccaaggttcagcagtgggactctcaagtgacaatgggccatcttttccaaaagttggcttcacagcttggcgtttataaggcctttgtggataactacaaagttgctcttgaaactgctgagaaatgctctcagtctaataaccagtttcagaagatcagcgaggagctcaaagtgaaggggccaaaagattctaaagattctcacactagtgttacaatggaggcattgctatacaagcctatagacagggtgactcgctcaactctcgtcctgcacgatcttttaaaacatacccccgtggatcaccccgattatcctctcctgcaggacgctctgcgaatttcacagaactttctgtcctcaattaacgaagacattgaccctagacgaacggcggtgacgacgcctaagggggaaactagacagctggtaaaagatggttttctggttgaagtctccgaaagttccaggaagctgagacatgtgtttctcttcaccgatgttctgctgtgcgccaagctcaaaaagacaagcgcagggaaacaccaacagtacgactgcaagtggtatatacccttagccgacctggtctttcccagcccggaggagtctgaggcttctccccaggtccatccctttcctgatcacgagctggaggacatgaaaatgaaaatttctgcactcaagtcagaaatccagaaagagaaggcaaacaagggacaatcgcgggctattgagagattgaagaagaaaatgtttgaaaacgaattcctgctgctgctgaacagtccaacgatccccttccggattcataatcggaacggcaagagctacctattccttttgtcctctgactatgagagatctgagtggcgggaagcgatccaaaagctgcaaaagaaggatctgcaggcctttgtgctttcctccgttgagctgcaagtccttactggctcttgtttcaagctgaggacagtccacaacatccccgtcacctccaacaaagacgacgatgaatctccaggactctacgggtttttacacgtgatcgtgcactcagctaagggctttaaacaaagcgccaacctgtactgcacgctggaagtcgatagcttcggttacttcgtaagcaaggccaaaacaagagtgtttagagacactgctgaaccgaagtgggacgaggaattcgaaatcgaacttgagggttcccagagccttcgcatcttatgttatgagaagtgttacgacaagaccaaggtgaataaagataacaatgaaatagtggacaaaattatgggtaagggacaaatccagctcgatccgcaaacagtggagacaaagaattggcataccgacgtgattgaaatgaacggcatcaaggtcgagtttagtatgaagtttactagccgcgacatgagccttaaacgcacaccatctaagaagcaaactggtgtgttcggcgtcaagatatcggtcgtgactaaacgagaaagatccaaagtcccctacattgtgagacagtgcgtcgaagaggtcgagaaaaggggcatcgaagaggtgggcatttaccggatttcaggagtcgctaccgacattcaggccttgaaagccgtttttgacgccaacaataaggatatactgttaatgctatctgacatggatattaatgccatcgctggaacgttgaagctgtattttcgcgaactcccagagccattgctcacagatagactctatcccgctttcatggaagggatcgcactatccgaccctgccgcaaaggaaaactgtatgatgcacctgctcagatccctaccagatcctaatcttattacatttctatttctgctggaacacctgaaacgagtggcggagaaggagcccattaacaaaatgtcactgcataatctcgcaaccgtgttcggcccaacactcctgcggccaagcgaagtggagtccaaggcccacttgacctccgctgcggatatctggtctcatgacgttatggctcaggtccaggtgttgttatattatctgcagcaccccccaatatcttttgcggaactaaagcgcaacacattgtatttttccacggatgtgtag

SEQ ID NO: 213209 - DNA, 1332 bp, Artificial Sequence
  Description of Artificial Sequence: Synthetic coding sequence
atgctgacgaacggaaaggagcaagtgatcaaaagctgtgtgtctttgcctgaattgaatgcgcaagtgttctgccattccagtaataatgtgaccaagacagaatgctgctttaccgacttctgcaataacatcacactccacttgcctacagccagtccaaatgctccaaaactcggacctatggagctcgcgattatcatcactgtgcctgtttgcctgctgtcaattgccgcaatgctgacagtctgggcatgccaaggcaggcaatgtagctatcgtaaaaaaaagaggccaaacgtggaagagccacttagtgagtgcaatctggtgaacgcaggcaaaacactcaaggacctgatttatgacgtcacagcatctggatccggctctggactgccccttctggtgcagaggactattgccagaactatagtgttgcaggagatcgtgggaaagggtcgcttcggcgaggtgtggcacggcagatggtgcggcgaggatgttgcagtgaagatattttcttcccgggacgagagatcttggttccgagaagccgaaatctatcagaccgtaatgctccgacacgagaacatcctgggttttatcgccgcagacaataaagataatggtacctggacccaactgtggctagtttctgaatatcatgagcaaggcagcctgtacgattacttaaatcggaatatcgtgaccgtggcgggaatgatcaaactggccttgagtattgcctctgggctagcccatctccatatggagatcgtggggacccagggcaagcccgctattgcccatcgggacatcaaatctaaaaacattctggtgaaaaaatgcgagacttgcgcaattgccgaccttgggttagcagtgaagcatgacagcatcctgaatacaatcgacatccctcagaacccgaaggtcggaaccaagcgatatatggccccagagatgttagatgataccatgaacgttaacatcttcgagtcattcaagcgggctgatatctactctgtgggcctggtgtactgggagatcgccaggcgctgttctgttgggggtatcgtggaggaatatcagctgccctactacgatatggtcccctctgaccctagcatcgaagagatgagaaaggtggtgtgtgaccagaagtttaggccctcaatccctaatcaatggcagtcatgcgaggcccttcgagtcatgggacgtattatgagggagtgctggtatgcaaatggagcagcacgtcttaccgcgcttcgaattaagaaaactatcagccagctctgcgtaaaggaagactgtaaagcatag

SEQ ID NO: 213210 - DNA, 1512 bp, Artificial Sequence
  Description of Artificial Sequence: Synthetic coding sequence
atgaccctgggttcccctcggaagggacttcttatgctgctaatggccctcgtgacccagggcgaccccgtaaagccatcccgagggccactggtcacctgcacttgtgagtcgccacattgtaagggccctacctgtcgcggagcttggtgcacagtggtgctcgtccgcgaggaaggtcgtcacccacaagaacaccgaggatgtggtaatcttcatagagaactctgtcggggacgccctacagagtttgttaatcattattgctgcgattcgcacctgtgtaatcacaacgtttcgctggtgcttgaggccacccagcctccatcggaacagcctggcacagacgggcagctcgctttgatccttgggcctgtcctggccctgcttgctcttgtggctctaggtgtcctagggctgtggcacgtcaggagacgccaggaaaagcagcgagggttgcacagcgagttgggtgagagtagcctgattctgaaggcatccgagcagggcgacagtatgttaggcgatttgctggactctgactgcacgaccggtagcggctctgggttgcctttcctggtgcaaagaaccgttgcacgacaagtcgctctggtcgagtgcgtcgggaagggccgatacggggaggtgtggaggggcttgtggcacggcgagagtgtggctgtcaagatattcagctcgcgcgacgaacaatcatggttccgggagaccgagatttacaataccgtgttgcttcgtcatgataatattctgggatttatcgcttccgacatgacgagccgcaatagcagcacacaactgtggttgatcacacattaccatgagcacggatctctttacgacttcctccagaggcagaccctggagcctcacttggcgctgcgacttgccgtatctgcagcatgtggactggcgcatctccacgtggaaattttcggcactcagggcaagccggcaatcgcccaccgagattttaagagccggaacgtcctggtaaaatcgaatttacagtgttgtatagccgacctcggattagccgtgatgcattcccaaggttctgattacctcgatattggcaataatcccagagttggcacgaagagatacatggctcctgaggtcctcgacgagcaaatccggaccgattgtttcgagtcttacaaatggaccgatatttgggcctttgggctggtcctgtgggagatcgccagacgcactattgtgaacggtatcgtagaagattatagacccccattttatgatgtggtaccaaacgatcctagtttcgaggatatgaagaaggttgtgtgcgtggaccagcaaactccgacaatacccaaccgcttggccgcagaccctgtcctgagtggtctggcacagatgatgcgtgagtgttggtacccaaatccctcagctcgtctgacagctctgaggatcaaaaaaaccctgcagaaaatctctaattcccccgagaaaccaaaggttattcagtag

SEQ ID NO: 213211 - DNA, 1512 bp, Artificial Sequence
  Description of Artificial Sequence: Synthetic coding sequence
atgaccctgggctcccccaggaaggggctgcttatgctgcttatggctctagtgactcagggcgatcccgtgaagccttccagaggacctctggtgacctgtacctgtgaaagtccccactgtaaaggacccacatgcagaggcgcatggtgcaccgtcgtgctggtccgagaggaagggaggcaccctcaagagcaccgaggatgtggcaacctacatcgcgagctgtgtagggggcgtcccacagaattcgtgaatcactactgctgcgattcccacctctgcaatcacaacgtgtctctggtgctggaggccacccaacctccctctgagcagccaggtactgatggccagcttgcccttattctgggaccagtgttagcactgttggcactggtggccttaggtgtactgggcctctggcatgtcaggaggagacaggaaaaacagcgtggtctgcacagtgagctcggggagtccagcctgatacttaaagcctctgagcagggggattctatgttgggagacctgctggactcagattgcactactggatcaggctctgggctgccatttctggtacagcgtaccgtagcaagacaggtcgctctggtggagtgtgtaggtaaaggtagatacggtgaggtgtggagaggactgtggcacggtgaatctgttgcagttaagatcttcagctctcgggatgaacagagttggtttagggagactgaaatttataacactgtgctgctgcgccacgacaacatcctgggatttatagcctccgatatgacctctcgcaattcaagcactcagctctggcttataacacattaccacgaacacgggagcctgtatgactttcttcagcgccagaccctcgaacctcatcttgccctgaggctggctgtgagtgctgcttgcggcctcgcccatctgcacgtcgagatctttggtacccaggggaagcccgcaatcgcacaccgtgatttcaagtcgcggaacgtcttagttaagagtaacctgcagtgctgtatcgccgacttaggactggccgttatgcattcccagggtagcgactacctggatattggcaataatcccagggtgggaactaaaagatatatggccccagaagtgttggatgagcagataagaacggattgtttcgagtcctataaatggacggatatttgggcattcggtctggtgttatgggagatcgctcgcagaacgattgtcaatggcatcgtggaagattaccggcctccgttttacgatgtcgtgcccaacgacccctcatttgaagatatgaaaaaggtggtctgcgtggatcaacagaccccaaccatcccaaataggttggcagctgaccccgtgctgtcagggctcgctcagatgatgcgcgaatgttggtatccgaaccccagcgcaaggttgactgccctacgcatcaagaaaactcttcaaaaaatttcaaacagtccagaaaaaccgaaggtgattcaatag

SEQ ID NO: 213212 - DNA, 990 bp, Artificial Sequence
  Description of Artificial Sequence: Synthetic coding sequence
atggctctcacaccccctctccttcttttatctgctggcacgatgacacttggtagccctagaaaggggttgttgatgctactcatggcattagtcacacaaggcaaaggtaggtacggggaggtctggcgcggtttatggcacggggagagtgtcgccgtgaagatcttctcttcacgcgacgagcagagttggttcagagaaacagaaatttacaacacagtgctgctgcgccatgacaacatcctgggtttcattgcgtctgatatgacaagtagaaattcctccacgcagctgtggctgatcacccattatcatgaacacggctctctctatgacttcctgcagcggcagacactggagccccaccttgctcttcgcctggccgtgagtgcagcctgcggacttgcccatctgcacgtcgagatatttggcacacaagggaagccggcaatcgcccatcgcgactttaagagtcggaacgtgctcgtcaaatcgaacctccagtgctgtattgcagatctgggccttgcggtgatgcattcccaaggcagcgattacctggatataggcaacaatcccagggtcggaacgaagcgttacatggcaccagaggttctcgacgagcagatcaggacagattgtttcgagagctataaatggacagacatttgggccttcggactggtgctgtgggagatcgcccgacggacgatagtgaatggaatagtcgaggactatcgtcctccgttttacgacgttgtgcccaacgatcctagctttgaggacatgaagaaggtggtttgcgtagatcagcaaacccctactatcccaaatagattggccgctgatcccgttttaagcggcctggctcagatgatgagagaatgctggtaccccaatccatccgctcgacttaccgccctacgcattaaaaaaactctacagaagatatctaatagtccagaaaaacctaaggtgatacagtag

SEQ ID NO: 213213 - DNA, 480 bp, Artificial Sequence
  Description of Artificial Sequence: Synthetic coding sequence
atggccttaacaccacctttgctcctactaagcgcaggaacaatgactctgggatcgcccagaaagggcctcctgatgttgctgatggcgttggtgactcagggtgatccggttaaaccatcccggggacccttagtaacatgcacctgcgaatctccacattgtaagggacccacgtgcaggggtgcctggtgtaccgtggttctggtacgcgaagaaggccgtcatcctcaagagcacagaggctgcggcaaccttcaccgagagctgtgccgagggcgacccaccgagttcgtgaaccactactgttgtgattcccatttgtgtaatcacaacgtgagcctggtgctcgaggggaaaggcagatacggggaagtctggcgcggactctggcacggggagagcgtcgccgtgaagatcttttccagccgcgacgagcaaagctggtttcgcgagacagaaatttacaacacggtatag

SEQ ID NO: 213214 - DNA, 1554 bp, Artificial Sequence
  Description of Artificial Sequence: Synthetic coding sequence
atggctttaactccaccattactccttctttctgcagggacgatgacattaggcagtcccaggaaaggactgctcatgctgctgatggcactggtgacgcagggtgaccctgtgaagccttctagagggcctctggtgacttgcacctgtgagagcccacactgtaagggacctacttgccgaggggcatggtgtacggtggtcttggtgcgggaggaaggcagacacccacaggaacatcgcggttgcggcaatttgcaccgggagctgtgtaggggcaggccaacggaatttgtgaatcattattgttgcgacagccacttgtgtaaccataatgtgagtctcgtcctggaggccactcagcccccttctgagcagcccggaacagacggccagctggcgctgattttgggccctgtgctggcactgcttgccctcgtcgcccttggcgttctggggctctggcatgtgcgccgtaggcaggaaaagcagcggggtttgcattcggagctgggagaatctagcctgatccttaaagcctccgagcagggcgactcaatgctgggagacctcctcgatagcgactgcaccactggtagcgggtcaggtctgcctttcctggtgcagaggactgtcgccagacaggtggcactggtcgaatgcgttggcaaggggagatacggtgaggtgtggaggggattatggcacggggagagcgttgctgtaaagatatttagttcacgagatgagcagtcttggttccgcgaaacggagatttacaacaccgtgttgctccgccatgataatatactaggtttcatagcatccgatatgacatcaaggaactcttcaacacagttgtggctgattactcactatcatgaacatggctctctttatgattttctgcagcggcaaacgctggagccacatctggccttgaggctggccgtgtcagctgcatgcggcctcgcccatcttcacgtggagatctttggtacacaaggaaaacctgcaattgcacatagggactttaagagccgcaatgtcctggtgaagagtaaccttcaatgctgtattgcggatctgggcctcgcagttatgcactcccaagggtctgactacctagatatcggcaataacccacgagtggggacaaagaggtatatggcacctgaagtcttggacgaacagatccggacggattgctttgagtcatataagtggacagacatctgggcattcggactcgttctttgggaaatagctagacggaccattgtgaacggtatagtggaagattacagacctcccttctatgatgtagtacccaatgaccctagcttcgaagacatgaagaaagtggtctgtgtggatcagcagactccgaccattcctaataggctagcagcggatccagtgttgtccggactggcacaaatgatgcgggagtgctggtaccccaatccctcagctcgactgacagccctgcgcattaaaaagacactgcagaaaatttctaactcccctgagaagccgaaagtgattcagtag

SEQ ID NO: 213215 - DNA, 1530 bp, Artificial Sequence
  Description of Artificial Sequence: Synthetic coding sequence
atggttgacggcgttatgattctgcccgtgcttattatgattgctctgccatcgccatcgatggaggatgaaaaacccaaggtgaatcctaagctctatatgtgtgtttgtgaaggattatcttgcggaaacgaagaccactgcgaaggacagcaatgtttttccagcctgagcatcaatgacgggttccatgtctaccaaaagggatgcttccaggtctacgagcaggggaagatgacatgcaagacacccccaagtccaggccaggcagtggagtgttgtcagggggattggtgcaacaggaatataactgctcaactgcccacaaagggcaagagcttccccggtactcagaacttccacttagaggtagggctcatcatcctgagtgtagttttcgccgtgtgcctgctggcatgtctgttgggggtggctctccgcaagtttaagagaagaaaccaggagcggctaaatccgagagacgtcgaatacgggaccattgagggcctgataacgaccaatgtgggagactcaactttagcagacttgcttgatcacagttgcaccagtggctctgggtcggggctgccattcctcgtgcaaagaactgttgccagacagatcaccctcttggaatgcgtcggcaagggcagatatggtgaggtctggcgtgggtcatggcagggggaaaacgtggcagtgaaaattttttcaagtcgagacgagaaaagttggttcagagagaccgagctatacaacaccgtcatgctacgccacgagaacatcctgggcttcattgcaagcgatatgacatctagacattcctccacacagctttggttgatcactcactaccacgagatgggttcattatacgactacctgcagctgacaacacttgatacagttagttgtctacgaatagtgctaagcattgcctcagggctggcacatttgcatatcgagatctttgggactcaggggaagccagccatcgcccaccgcgacctgaagagcaagaatattctcgtgaaaaagaacggccaatgttgtatcgccgatctgggattggctgtcatgcactcgcagtcaacaaaccaactggacgtaggaaataaccccagggttggaacgaagaggtatatggcccctgaggtcctggatgagaccattcaagtggactgttttgatagttacaagcgcgtggatatttgggccttcggcttggtgctgtgggaagtcgcaagacgcatggtgtctaatgggatcgtagaagattacaaaccacccttttacgacgtggttccaaatgatccgagtttcgaagacatgcggaaggtcgtctgcgtagaccagcaacggcctaacatccccaataggtggttcagtgaccccactctgacaagcttggctaaacttatgaaagagtgttggtaccagaatccatctgccaggttgaccgctctgagaatcaaaaaaactctcacaaagatcgacaattccttagacaagctaaaaacggactgctag

SEQ ID NO: 213216 - DNA, 1530 bp, Artificial Sequence
  Description of Artificial Sequence: Synthetic coding sequence
atggtcgatggggttatgatcctgcctgttctgatcatgatagcactcccctctccctccatggaggacgaaaagccgaaggttaatcctaagctgtatatgtgcgtctgtgaaggcctttcctgtggcaacgaagatcactgtgaaggccaacaatgcttttccagcctcagcatcaatgatggatttcatgtgtaccaaaaaggttgtttccaggtgtatgagcaaggtaaaatgacgtgcaagacccccccttcaccagggcaagctgtcgagtgctgtcaaggcgattggtgcaaccgcaacattaccgcacagctccctaccaaaggaaagtcttttcccggaacccagaactttcatctggaggtggggctgatcattctgtctgtggtctttgccgtatgtctgctcgcctgcctcttgggcgttgccctccgaaaatttaagaggcgaaaccaggaaagactgaatccgcgtgacgtggaatacgggactatcgaggggctgatcacaaccaatgttggtgattccactctggctgacctgctggatcactcttgtacatccggctcggggagtggcctcccctttctggttcagcgaacagttgctcgtcagattactcttctggagtgtgttgggaagggcaggtatggtgaggtttggcgagggtcctggcagggggaaaacgtcgcagttaagatcttcagctctagagacgaaaaaagttggttccgggaaactgagctttacaataccgttatgctgcgacatgaaaatatcttaggcttcatagcttccgatatgaccagtagacactctagcactcagctgtggctcattacccactaccatgagatgggctctttgtatgactatttgcaactgaccactctggacactgtttcctgtctgagaatcgtgctgtctatagcctccggcctggcgcacttgcatatcgagattttcggcacgcagggcaagccggcaatcgcccatcgtgatctcaagagcaaaaatatcctggtgaaaaaaaacgggcagtgttgcatagcagatcttggcctcgccgtcatgcatagtcagtctactaatcaactcgatgtgggaaataatcctagagtaggaaccaagaggtacatggcccctgaggttttagacgaaactatacaggtggattgttttgattcgtacaagagggttgacatctgggcatttggccttgtgctatgggaagtggcgaggcggatggtaagtaacggcatcgtggaggactataaaccgccattttatgatgttgtaccaaacgatcccagctttgaagacatgaggaaggtggtgtgtgttgatcagcagagaccgaatattccaaatcgttggttttcggatcctacattaacatctctggccaaacttatgaaagaatgttggtatcagaacccttctgctaggctgaccgcgctgcgaatcaaaaagactttaactaaaatcgataactctctggacaaactgaagacagattgttag

SEQ ID NO: 213217 - DNA, 1530 bp, Artificial Sequence
  Description of Artificial Sequence: Synthetic coding sequence
atggtcgacggagtgatgatcctgcctgttctcatcatgatagccctgcctagcccctccatggaggacgagaagcccaaggtgaaccccaagctgtatatgtgtgtctgcgaagggttatcctgcggtaacgaggaccattgtgagggccagcaatgttttagttcactgtccatcaacgacggtttccacgtctaccagaaaggctgttttcaggtatacgaacagggcaagatgacatgcaaaacccctccatcgcctggccaggccgtcgaatgctgtcagggtgactggtgcaatcgtaatataactgcccaactgcccacaaagggcaagtctttccccggaactcagaacttccatctggaggtcggcctgattatcctgagcgtggtgttcgccgtctgtctgctggcgtgtctgctgggcgtcgcgcttcgaaagttcaagcgcaggaatcaggaacggctcaacccgagagacgtcgagtacggtacaatcgaggggctgattacaaccaatgtgggagactccactctggctgatctgctggaccacagctgcacatccggtagcggctctggtctcccatttctggtacagcggacggtggccaggcagatcactctcctggaatgcgtggggaaaggaaggtatggggaagtatggaggggcagctggcagggtgagaacgttgccgtcaagatattctctagccgtgacgagaaaagttggtttcgggaaacagagctctacaatactgtgatgctcaggcacgagaacatccttggcttcatagccagcgacatgacttcacgccatagcagtacgcagctctggctcatcacacactatcatgagatgggatcactttacgattatctgcagctgactaccctagacaccgtctcctgcttgcgcattgtgctgagtatcgcctctgggttagcacatctacacatcgagatctttggtactcagggcaaacccgctatcgcccatcgggatttaaaaagcaaaaatattttggtgaaaaaaaacggccagtgctgtattgctgatctggggctcgccgtcatgcacagccaaagcaccaatcaactggatgtgggcaacaaccccagggtgggcaccaagcgatacatggcccctgaggttttagacgagaccatccaggttgactgcttcgatagctataaaagggtggatatttgggctttcggattggtactatgggaggtggcccgtaggatggtgagcaacggcattgtggaagactacaagcccccattttatgatgttgtcccgaacgatccctcattcgaggatatgagaaaagtagtgtgcgttgaccaacagaggcctaacattcctaatagatggttttcagacccaaccctgaccagtcttgcaaaactgatgaaggagtgctggtatcaaaacccttcagctagattaacggctcttcgaatcaaaaagaccctcacgaaaattgacaatagcttggacaaactaaaaaccgattgttag

SEQ ID NO: 213218 - DNA, 264 bp, Artificial Sequence
  Description of Artificial Sequence: Synthetic coding sequence
atggtggacggagtcatgatcttgcccgtcctcatcatgattgcgttgccctctccaagcatggaggacgaaaaacctaaagtcaaccccaagctgtatatgtgtgtgtgtgaggggctctcatgtggtaacgaggatcattgtgaaggacagcagtgtttttcaagcttgtccattaacgacgggtttcatgtctaccagaagggttgcttccaggtttatgaacagggcaagatgacatgcaaaacaccccctagtccatag

SEQ ID NO: 213219 - DNA, 66 bp, Artificial Sequence
  Description of Artificial Sequence: Synthetic coding sequence
atggtggacggagtgatgatcctaccagtgcttattatgattgctttgccctccccttcgatgtag

SEQ ID NO: 213220 - DNA, 216 bp, Artificial Sequence
  Description of Artificial Sequence: Synthetic coding sequence
atggtggacggagtgatgattctgccagtgctgattatgattgccctgcctagtccatctatggaggacgaaaagccaaaggtcaatccaaagctttatatgtgcgtatgcgaaggactttcctgcggcaatgaagaccattgcgaaggacaacaatgtttctcctcgttgagtataaatgacggatttcacgtgtaccagaaagggtgcttttag

SEQ ID NO: 213221 - DNA, 1530 bp, Artificial Sequence
  Description of Artificial Sequence: Synthetic coding sequence
atggtggatggggtgatgatcctgccagtactgatcatgatcgccctgccgtctcccagcatggaagacgaaaaacccaaagtgaacccgaaactatacatgtgtgtctgtgagggtctgagctgtggcaatgaagaccattgcgagggccagcaatgtttttcaagcctctctattaacgacggcttccacgtgtatcaaaaggggtgttttcaggtttacgagcaggggaagatgacttgtaagactcccccatcgcctggacaggccgttgagtgttgccagggagactggtgtaatcgaaatatcacagcccagctccctaccaaaggaaagtccttccctgggacgcagaatttccatctggaagtcggtctcatcatcttaagcgtcgtcttcgcagtgtgcttgctggcgtgcttactcggagtcgcacttcgaaaatttaagcgaagaaatcaggagcgcctcaaccccagagatgtagaatatggcactatagagggcctgattacaactaacgtgggcgattccactctggcagatctcctggaccactcatgtacctccggcagcggttccgggctcccgttcctggtgcagcgcaccgtagctcgacagatcaccctgctcgagtgtgttggaaagggcaggtatggggaagtgtggagagggagttggcagggagaaaatgttgccgtgaagattttcagctcgcgggacgagaaatcttggtttagagaaactgaactgtacaacaccgtgatgttacgtcacgagaatatcctcgggttcattgcatccgatatgactagcaggcacagcagcacccagctgtggctcatcacacattaccacgagatggggagtttatatgactacctgcagttaacgactctggataccgtgagttgtttacggatagtgctgtctatcgccagcgggctcgcacatctccatattgaaattttcggcacacaagggaagccagctatagcacacagggatctgaaaagcaagaacatcctggtaaagaaaaacggccagtgctgtatagccgatctcggcctcgccgtgatgcattctcagtccaccaatcagcttgacgtgggaaataacccacgagtcggtacgaagcgatatatggcaccagaagttctggatgagactatccaggttgactgctttgactcatataagagagtggacatttgggcgttcgggctggtcttatgggaagtggcaaggcgcatggtgagtaacggaatcgttgaagattataagccgcctttctacgatgtggtgcccaacgaccctagctttgaggatatgcgaaaagtcgtctgcgtggatcaacaacgaccgaacatccccaaccgatggttttcagatcctaccctgacctcactagcgaagttaatgaaagagtgttggtaccagaatcccagcgctagattaactgctctgagaatcaaaaaaacattgaccaagatcgataacagcctggataaattaaaaactgactgctag

SEQ ID NO: 213222 - DNA, 264 bp, Artificial Sequence
  Description of Artificial Sequence: Synthetic coding sequence
atggtcgacggggtgatgattctacctgtgttgatcatgattgctctaccatcaccctcaatggaagacgaaaagcccaaggtgaaccctaagttgtacatgtgcgtgtgtgaggggctcagctgcggcaacgaggatcactgcgaaggtcagcagtgcttctcaagtctctctataaatgatggcttccacgtataccagaaaggatgtttccaggtatacgagcagggaaaaatgacatgcaagacaccgccttccccctag

SEQ ID NO: 213223 - DNA, 222 bp, Artificial Sequence
  Description of Artificial Sequence: Synthetic coding sequence
atggtggatggtgtgatgatcctacccgtgttgatcatgatagccctcccttctcccagcatggaagacgaaaaacctaaagtgaatccaaaactctatatgtgcgtgtgcgagggcttgagctgtggaaacgaagatcactgtgagggccaacagtgtttcagtagcttatccatcaatgacggttttcatgtgtatcagaagggctgcttccaggtctag

SEQ ID NO: 213224 - DNA, 1518 bp, Artificial Sequence
  Description of Artificial Sequence: Synthetic coding sequence
atggcagagagcgccggagcaagtagtttcttccctctggtggttctgcttcttgccggttctgggggttcaggacctagaggagtacaggccctgctatgcgcttgtacgagctgtttacaggcaaattatacctgcgaaactgacggagcctgcatggtgtcgatttttaatctggacgggatggagcaccatgtgcggacatgcatcccaaaagtggagttggttcccgctggaaagccattttattgcctttccagcgaggacctacgaaacacccactgctgctatacagactactgcaaccgaatagacctgcgggtgccaagcggccacctaaaggaacccgagcatccctctatgtggggccctgtggagcttgtgggcatcattgccggacctgtctttttgctttttctgatcataatcatagtcttccttgtcattaactatcatcaaagggtttatcacaatcggcagcggctggatatggaagatccctcctgcgaaatgtgcttgtcaaaagacaaaaccttgcaggaccttgtgtacgacctgtctacgagtggctctgggagtggactccccttattcgttcagaggactgttgccagaacaatcgttttacaagaaatcatagggaaaggcagatttggtgaagtttggcgcggtcgatggcgcggtggcgacgtggctgtcaagattttcagctccagagaggaacgatcatggttccgggaagctgagatttatcagacggttatgctgaggcacgagaatatcctggggttcatcgcagccgacaataaggacaatggaacgtggacccagctctggctagttagtgactaccatgagcacggtagcctgtttgactatttaaaccgctacaccgtgaccatcgaaggaatgattaagttagctttgtccgccgcatcgggcctcgcccacttacatatggagatagtggggactcaaggaaagcccggtatcgcccaccgagatctgaaatcaaagaatatcctggtgaaaaaaaacgggatgtgtgctatcgcggacttgggactggccgttagacacgacgcagtaacagatacaattgatattgcacccaatcagagagttggtaccaagagatacatggcacctgaggtgctcgacgaaacaataaatatgaagcacttcgatagtttcaagtgcgctgacatctatgctttgggactcgtgtactgggagatcgccagaaggtgcaactccggaggagtccatgaggaataccaactcccgtattatgatcttgtcccatccgatccaagtatagaggagatgagaaaagtggtgtgcgatcagaaactacggccaaatattccgaactggtggcaaagctacgaggcactgagagtaatgggaaagatgatgagagagtgctggtatgccaatggagcagcgcgactgacggcgttacgaataaagaagaccctctcacagttgagtgttcaagaggacgtgaagatctag

SEQ ID NO: 213225 - DNA, 1464 bp, Artificial Sequence
  Description of Artificial Sequence: Synthetic coding sequence
atggcagagagtgcaggtgcaagcagttttttccccctggtagtgctgctcttggcaggatccggcggatcaggacctaggggcgttcaggccctgctgtgcgcttgcacctcctgtctccaggctaattacacatgcgaaactgatggtgcctgtatggtttcgatctttaacctggatggtatggagcatcacgtaaggacttgcattcccaaggttgaactggtgccggcaggcaagcctttctattgtctttcatccgaggatctgcgaaacactcattgctgttacactgactattgcaatcgcatcgatttgcgggtgccgtccggccatctgaaagagccagaacatccttccatgtgggggccagtcgaattggtgggaatcatcgcaggtcccgtgttcttgctgtttttaatcattattattgtatttctggtcattaactaccaccagcgggtctatcacaaccggcagaggctggatatggaggatccaagctgcgagatgtgcctgagtaaagacaagactctgcaggatttggtttacgatctcagtacgtccgggtcgggctccggtctacctctgtttgttcagaggacagtagccagaacaatcgttttacaggaaatcatcggcaaaggtagattcggcgaggtttggcgcggtcggtggagaggaggggatgtggccgtgaaaatttttagtagccgtgaggaacgcagctggtttagagaggcagaaatctaccagactgtgatgctgaggcacgaaaacatcctggggttcatcgctgccgataataaagacaatggcacatggacacagctatggctcgtgtccgattatcacgagcatggttctttatttgattatttgaataggtatacggtcaccatcgaaggtatgataaaactggcactgtccgcagcgtcgggcttagcccacctgcatatggagatagtggggacccagggtaagcctggcatcgcccatagggatttaaagagtaagaatattctcgtcaaaaaaaatggcatgtgcgccatcgctgacctcggccttgcagttagacacgacgccgtgactgacaccatagacatcgcaccgaatcagcgagtgggcaccaaaagatatatggccccagaggttcttgatgagactataaatatgaagcatttcgactcttttaagtgtgctgatatttacgccctgggccttgtatattgggagattgccagacggtgcaattccggagggacttttttgttttgcttgtgtagttatctcccattccaggatgccggatcacccaaagctgtgctgcttccaccatttttcctgcaacctgttggttgtctgctccccgaaccggaatctagcttcaaggtggccataaagggggtggaagtggccgtgctcagggtccgtctgttcttcagagaccaatttgtggagtag

SEQ ID NO: 213226 - DNA, 1431 bp, Artificial Sequence
  Description of Artificial Sequence: Synthetic coding sequence
atggcggagtccgcgggtgcctcctcattcttcccactggtggtcctactgctggcgggaagtggaggatcaggccctagaggggtgcaagctctcctgtgcgcttgcaccagctgtctgcaggcgaactatacctgcgaaacagacggggcttgtatggtaagcatttttaacttggacggtatggagcaccatgtaaggacctgtatcccaaaagtcgaactggtgccggctggcaagccattctattgcctctcttctgaagacttacgcaatacacactgctgctataccgactattgcaacaggattgatctccgcgtgccttccggccacctcaaggagcccgagcacccctctatgtggggaccagtggagttggtgggcatcattgcaggacccgtttttctgcttttcttgatcatcattattgtgttcctggtgattaactaccaccagagggtctatcacaacaggcagagacttgacatggaagacccctcttgtgagatgtgcctgtcaaaggataaaacgcttcaggatttagtgtatgatctgtcaactagtggatcagggagcggactgccactgttcgtgcagaggaccgtggctagaaccatcgttctgcaggagatcattggtaaaggcagatttggagaggtttggagaggcagatggcggggtggcgacgtagctgtgaaaatattctcatccagagaagaacgctcttggttccgggaggcggagatctatcaaactgtgatgctgaggcacgagaacatcttgggatttattgccgctgataataaggataacgggacgtggacgcagctgtggctcgtgtccgattaccacgagcatggtagcctttttgactacttaaatcgttatacggtaacaatcgaaggcatgatcaaactggcactgtcagccgcatccggcctagcccatctgcatatggagattgtgggcacacagggcaagccaggaatcgcacaccgtgatctcaaaagcaaaaacatcctggtcaagaagaatggtatgtgcgccatcgccgatctcgggctggctgtgagacacgacgctgttacagataccattgacattgccccaaaccagagagtggggacgaaaagatatatggcgccagaggtcctcgatgagaccattaatatgaaacactttgactcattcaaatgcgccgacatctacgctcttgggcttgtatactgggaaatagccagacgatgcaacagcgggggtgtccacgaagagtatcagttaccctactatgatctcgtgccaagcgaccctagtattgaagagatgcggaaagtagtgtgtgaccagaaactgaggcccaacattcctaactggtggcaatcatacgaggtgagaagctggccacctgccgcattccccagcgcctag

SEQ ID NO: 213227 - DNA, 1641 bp, Artificial Sequence
  Description of Artificial Sequence: Synthetic coding sequence
atggccgagagcgcaggagcttcatcctttttcccgttggtcgtcctgcttctggctggcagcggagggtctggccctcggggagtgcaggcgttgctctgtgcgtgcacttcatgcttacaagccaactacacttgtgagaccgacggtgcctgcatggtgtccatatttaatctcgatgggatggaacatcacgtgcgcacctgcattcccaaggtcgaactggtgcctgccggtaaacccttttactgtctgtccagcgaagacctcaggaacacacactgctgttatacagactactgcaaccggattgatctgcgggtgcctagcggccatctgaaggagccagagcacccttctatgtggggcccagtggagctcgtgggcataattgcgggacccgttttccttctttttttgattatcattattgtattccttgtaatcaactaccaccagagggtttaccacaataggcaacggctggacatggaagatccttcttgtgagatgtgtctgtctaaagacaaaacgctgcaagatctagtctatgacctgagtacgtccggcagcggcagtggcctgcctctcttcgtacaacgaacggttgcaaggacaatagtgctccaggagattatcggaaaaggtcgattcggggaggtgtggagaggtagatggagggggggtgacgtggccgtaaaaatttttagtagccgggaggagagaagctggttccgagaagcagagatctatcagaccgtaatgcttaggcacgagaatatcctgggcttcatcgctgctgacaacaaagctgactgcagtttccttaccctgccctgggaagttgtgatggtgagcgctgctcccaagttaaggagcttgagactccagtacaagggtggaagaggcagggctagattcttgttccccctgaataacggaacatggacacagttatggttggtaagcgattaccatgagcacggtagcctcttcgactatctgaacaggtataccgtgaccatagaaggtatgataaagctggcgctgtcagcagcaagtgggctcgcacaccttcatatggagatcgtcggcacccaggggaagcctggcatcgctcatcgggatctgaagagcaaaaatatcttggtcaaaaaaaatggtatgtgcgccattgctgaccttggcctggctgttagacacgacgccgtcactgacacgatagatattgcacccaatcagcgtgtcgggaccaagcgctatatggccccagaagtactggacgaaacaataaatatgaagcactttgactcattcaagtgtgccgacatatatgccctgggtttggtctattgggagatcgcacggaggtgcaatagtggcggagtccacgaggagtaccaattgccatattatgatctcgtgccatcagacccaagcattgaggagatgcgaaaggttgtgtgtgatcagaaattgaggcccaacatcccgaactggtggcagtcctacgaagcgctacgcgtaatgggtaagatgatgagggagtgttggtacgcaaacggtgctgcacgcttgacagccttgcgcatcaaaaagaccctgtctcagttatccgtccaagaggatgtcaaaatatag

SEQ ID NO: 213228 - DNA, 1362 bp, Artificial Sequence
  Description of Artificial Sequence: Synthetic coding sequence
atggtgagtatctttaatctggatggaatggaacaccatgtgcgcacatgtattcctaaggttgagctcgtcccagcaggaaagcccttctattgcctgtcctcggaggatctgagaaacacacattgctgctacaccgattattgcaataggattgacctgagagtaccctcagggcacctgaaagagcccgagcacccatccatgtgggggcctgtggaactcgtcggcataatcgcgggaccagtcttcctgctttttctgattatcattattgtcttcctcgtgattaactaccatcagcgcgtttaccacaacaggcagagattggatatggaagatccttcttgtgaaatgtgcctgagcaaggataagacactacaggatctggtctatgacctgtccacgtccggaagcggcagcgggctgcccctcttcgtgcagaggaccgtcgctcgcacaattgtgctgcaggagatcatcggaaaagggaggttcggcgaagtgtggagggggagatggagaggtggtgacgttgcagtgaagattttcagctcacgcgaggagaggtcctggtttcgcgaagctgagatctatcagacagtcatgctccgccacgagaatattctcggcttcatcgccgcagacaacaaggataatggaacatggacacaactctggctggtgtcagactatcacgagcacgggtctctgtttgactatctcaatcggtatacagtaacgattgaaggcatgataaaactggctcttagcgcggcaagcggattagcgcatctgcacatggaaatagtcggtacccagggtaagccaggtattgcccaccgcgacctgaaatctaaaaatatcctggttaagaaaaatggcatgtgcgcaatcgcagatttgggcctggctgttcgtcacgatgctgtgactgatacaattgatatcgcgccaaaccaacgggtgggcaccaagcgttacatggccccagaggtactcgatgagacaataaatatgaagcatttcgactccttcaaatgcgcggatatctacgcgctgggcctagtgtactgggagatcgctcggaggtgtaactctggcggtgtgcacgaggagtatcagctcccatattacgatctggttccctctgacccctctatcgaagaaatgcgtaaggtggtgtgcgatcaaaagctgagacccaacattcccaactggtggcagtcctatgaggccctgcgagtcatgggcaagatgatgcgggaatgttggtacgccaacggggcagccagactgacagcactgcggatcaaaaaaactttatcccagttaagtgtgcaggaagatgtgaaaatttag

SEQ ID NO: 213229 - DNA, 1482 bp, Artificial Sequence
  Description of Artificial Sequence: Synthetic coding sequence
atgaccagggctctgtgtagcgccctgcgccaggcactgctgctcctcgctgccgctgcggagctctcacctggactgaagtgtgtttgcctgctatgcgactccagcaattttacatgtcaaacagagggggcttgttgggccagtgttatgctgaccaacggaaaggagcaagtgattaaatcttgcgtgtctctaccagaactgaatgcccaggttttctgccacagcagcaataacgtgaccaagactgagtgttgctttacggatttttgcaataacattaccttgcacttacctacagcatctccaaacgcacctaaactcggcccaatggaactagcgatcattatcaccgttcctgtgtgcctgctctcgatcgccgcaatgttgactgtctgggcctgtcaggggagacagtgctcttacaggaaaaagaagcgccctaacgtagaagagcccctctcagaatgtaatttggtcaacgcaggaaagacactgaaggacctgatatatgacgtgactgctagcgggtctggctccggtctgcccctcctcgtgcagaggaccatcgccaggaccattgttctccaagagatcgtgggcaagggcagattcggtgaagtctggcacgggcgatggtgcggcgaagatgtcgccgtgaagatcttctccagtcgcgatgaacgatcttggtttagagaggcagaaatttaccagacagtcatgctgcgacacgagaatatacttggctttatcgctgcagacaataaggacaatgggacctggacacagctgtggctggtttccgaatatcacgaacagggtagcctttatgactatctgaataggaatatagttactgtggccggaatgattaagttggcgctgagcatagccagcggtctggcccatctgcacatggagatagtcgggacacaaggcaagcctgcaatcgcgcatagagacatcaaaagtaaaaacattcttgtaaaaaagtgcgagacctgcgccattgcagacctaggactcgccgtgaaacacgactcgatcttgaacacaattgatataccccaaaaccccaaggtcgggacaaaaaggtatatggctcccgagatgctggatgacacaatgaatgtaaacatttttgaaagctttaaaagagccgacatttactccgttgggctcgtttattgggagatcgcacgccgttgtagtgttggcggaatcgtggaagaatatcaactaccatactatgatatggtaccctcagatccctctattgaggagatgagaaaggtcgtttgcgaccaaaaattccgaccctctattcctaaccagtggcagtcctgcgaggcactgagagtgatggggagaatcatgcgagaatgctggtacgcaaacggggctgctaggctcacagcgcttcggattaagaagacgatcagccagctgtgcgtcaaagaagattgcaaggcatag

SEQ ID NO: 213230 - DNA, 1242 bp, Artificial Sequence
  Description of Artificial Sequence: Synthetic coding sequence
atgactcgcgctctgtgcagcgccctgcgccaagcccttctactgctcgccgctgccgcagagctgtcccccggactgaagtgcgtgtgtctgctgtgcgattcctccaacttcacttgccagaccgaaggcgcttgttgggcatccgtgatgctcacaaatggcaaggagcaggttatcaagtcttgcgtcagcctgcccgaactcaacgcacaggttttctgtcactctagtaacaatgtaaccaagacagagtgttgcttcacagatttctgtaataatatcacgctgcatctaccaaccggactgcctctcctggttcagcgtaccatcgctcgaacaattgtgctccaagaaatcgtcggaaaaggcagatttggcgaggtgtggcacggacgatggtgtggagaggatgtcgcagtgaagatatttagctcacgtgatgaacgctcatggttcagagaggctgagatttatcaaaccgttatgcttaggcacgaaaatattctgggcttcatcgcggctgacaacaaagataacgggacatggacgcaactttggctcgtgtcagagtatcacgaacaaggcagcctgtacgattacctgaacaggaatatcgtcaccgttgcaggcatgattaagctcgctctttcaattgctagcgggctcgcgcacctgcatatggagattgtaggaacgcagggaaagcctgccatcgcccatcgggacataaaatctaagaatattctggtcaaaaaatgtgagacctgtgccatagccgacctgggactggcagtcaagcacgatagcatccttaacactatcgatataccccagaacccaaaggtcggcaccaaaaggtatatggcaccagagatgctggatgacactatgaatgttaacatatttgagtctttcaagagggccgatatctatagcgtaggcctggtttactgggaaatcgcacgcagatgtagtgtaggcggaatcgtggaggagtaccagctgccttattacgatatggtgccgagcgatcctagcatcgaggagatgagaaaggtagtttgtgaccagaaattccggccttcgatcccaaaccagtggcaatcctgcgaggcactgcgagtaatgggaagaataatgcgggagtgttggtatgccaacggagcagctaggctaacggccctccgaatcaaaaagaccatcagtcagctatgcgttaaagaagattgtaaagcttag

SEQ ID NO: 213231 - DNA, 1011 bp, Artificial Sequence
  Description of Artificial Sequence: Synthetic coding sequence
atgacgagggctttgtgctctgcactgcgtcaggctctgctcttgctggcggcagcggctgagctgagtcccggactgaagtgtgtctgcctcctgtgcgacagttcaaacttcacttgccagactgagggagcctgctgggcttcagtgatgctcactaatggcaaggagcaggtgattaagagctgcgttagcctgccagagttgaacgctcaggtcttctgccactcctccaataacgttacgaagaccgagtgctgttttaccgacttctgcaacaacatcacactgcacctgcccaccgacaacggcacatggacccagctgtggctggtgagcgagtatcacgagcagggttctctctatgattacttaaatcggaacatcgtgactgtggctggaatgataaagttggctctttccatagcctccggcctcgctcacttgcacatggagattgttggaacacagggtaaaccagccatcgctcacagagacataaagtccaagaacatcctcgtaaagaaatgcgaaacctgtgctatcgcagacttggggcttgcagttaagcatgacagcattcttaataccattgatatcccacagaaccccaaagttggcaccaagcgctatatggcccctgaaatgctggatgacacaatgaacgtcaatatcttcgaaagttttaagcgtgcagatatatactctgttggcctggtctactgggagattgctcgaaggtgttccgtgggtggaatcgtggaagagtaccaactaccctattatgatatggtaccgtccgacccaagcatcgaagaaatgcgtaaggtagtctgtgaccagaagttccggccatcaatacctaatcagtggcagtcttgcgaggccctacgtgttatgggcagaatcatgagggagtgctggtatgcaaacggcgcagccaggctaaccgcccttcggattaagaagaccatctcccaactatgtgtgaaggaggattgcaaggcttag

SEQ ID NO: 213232 - DNA, 1542 bp, Artificial Sequence
  Description of Artificial Sequence: Synthetic coding sequence
atgggggctgccgctaagcttgcatttgccgtcttcctgatctcctgctcctccggggcaattctaggcagatccgaaacgcaggaatgccttttcttcaatgccaattgggaaaaggatcgtacgaaccagaccggcgttgagccatgttatggggacaaagataaacgcagacactgttttgctacatggaagaatatcagcggctcaatagaaatagtcaaacaaggttgctggttggatgatatcaattgttatgatcgtaccgactgcgtcgagaagaaagactccccggaagtgtacttctgctgctgcgaaggcaacatgtgcaatgaaaagttttcttatttccctgaaatggaggtaacacaacctacttccaaccctgtgacaccaaaaccgccttactacaacatcctcctttatagcctagtccccctcatgctcatcgctggaatcgtgatctgcgctttttgggtttatcgccaccacaaaatggcatacccccctgtgctcgttccaacacaggatcccggtccaccccctccatccccactgttggggcttaagcccctccaactcctggaagttaaggcacggggacgatttggatgtgtttggaaggcccagctgctcaatgaatacgtggcagtgaagattttcccaatccaggataaacagtcctggcagaacgagtacgaggtatatagcctgcccggaatgaaacacgagaatattctgcagttcatcggggcagagaaacggggaactagcgtcgacgtggatctctggctgattacagcctttcacgaaaagggctccctttctgatttcttgaaagccaatgtggtctcatggaacgaattatgccacatcgccgagaccatggccagaggtctcgcttacctccatgaagacatcccagggcttaaggatggacacaaacccgcaatttcccatcgggatattaagagcaaaaacgtactgttgaagaacaacctgacagcctgtatcgcggactttgggctggctttgaagtttgaagccggaaagtccgccggagacacacacggtcaggtcggaactcgcagatatatggcgcctgaagtgcttgagggtgcaattaatttccagcgtgatgcattcctgagaatcgatatgtacgcgatgggcttagtgttatgggagctggcgtcaaggtgcactgccgctgatggacctgtagatgaatatatgctgcccttcgaagaggagattgggcagcacccatccctcgaagatatgcaggaggtggtcgttcacaagaagaaacgcccagtattgagagactattggcagaagcacgcagggatggcgatgctttgcgaaaccatcgaagagtgttgggaccacgatgcggaggctcggctgagtgccggttgcgttggagaacgaataacccaaatgcagcggttgacaaacatcattaccactgaggatatcgttacggtggtaacgatggtcaccaatgtggacttcccacccaaggaatcttctctgtag

SEQ ID NO: 213233 - DNA, 1542 bp, Artificial Sequence
  Description of Artificial Sequence: Synthetic coding sequence
atgggcgctgcagcgaaactggccttcgcagtgttcctgatctcctgctccagcggggcaattctcgggagatctgagactcaggaatgtctgttttttaacgctaactgggaaaaagatcgtactaaccagacgggggtggagccctgttatggtgacaaagataagagaaggcactgctttgccacctggaaaaatatttccgggtcaatcgagattgttaagcagggctgctggctggatgacatcaactgttatgacaggacagattgtgtggaaaaaaaagactcacctgaagtctacttctgttgctgtgaagggaacatgtgtaatgagaaattttcctacttcccggagatggaagtgacacagcccaccagtaaccccgttacccccaagcccccttactacaacattcttctgtattcactcgtgccgctgatgctgatcgcgggtatcgttatctgtgccttctgggtgtatcgtcatcataagatggcctatccaccagttttagttccaactcaagacccaggcccaccacccccatctccattgctcggcctcaagccgctgcagctccttgaagtcaaggcgagggggcgattcggatgtgtctggaaggctcagttactgaacgagtatgtggccgtgaaaatcttcccaatccaggataagcaatcctggcaaaacgaatacgaggtttatagcctgcctggcatgaaacacgaaaatatcctgcaattcattggagctgagaagaggggaacgtctgtggatgtcgacctgtggttgatcacagcgttccacgaaaaaggctcgctaagtgactttctgaaagctaacgtcgtgtcctggaatgagctctgtcatattgcagagaccatggcccgtggtctcgcctacctgcatgaggacatccctggcctcaaggatgggcataagcccgctataagccatcgagatattaagtcgaaaaatgttctccttaaaaataatttaacagcttgcatcgccgattttggactggcgcttaaattcgaggcaggcaaaagcgctggggatacccacggtcaggttggcacccggcgttatatggctccagaggttttagagggagccataaattttcagcgggatgctttcctgcgtattgacatgtacgccatgggattggtgttgtgggaactggcctcacgatgcacagccgcagatggacccgtggatgaatacatgttaccatttgaagaagaaattggtcagcatccatcactggaggacatgcaagaagttgtggtgcacaagaaaaagcggccagtcttacgggactactggcaaaagcatgccggtatggctatgctttgcgagactattgaggaatgctgggatcatgatgccgaggccaggctgagcgctggctgtgtgggcgaacggataactcagatgcagagacttacaaacattattactaccgaggatatcgtgaccgtcgtgactatggtcacaaacgtggacttcccacctaaggaaagctcactgtag

SEQ ID NO: 213234 - DNA, 1218 bp, Artificial Sequence
  Description of Artificial Sequence: Synthetic coding sequence
atgtgtaacgagaagttttcatatttcccggaaatggaggtgacccagccaacctcaaaccccgtgacccccaagcctccctattacaacatactgctatatagtctggtcccgctgatgcttatcgctgggatcgtaatctgtgcattttgggtgtatcgtcaccataaaatggcctatcctccagtcttggtgcccacacaagaccctggtcctccacctccaagtcccctcttggggctgaagcccctgcagttgctcgaggtgaaagcaaggggtaggttcggatgcgtttggaaggcccagctactcaatgaatacgtggctgtcaagatctttccaatccaggacaagcagagttggcagaatgaatacgaagtttattctctccctggtatgaagcatgagaatatcctgcagttcatcggagccgagaagaggggaacatccgtcgatgtcgacctctggctgataactgccttccacgagaaagggagccttagcgatttcctgaaggctaacgtggtaagctggaatgagctgtgtcatattgccgaaactatggctagaggcctggcatacctacacgaagacatcccaggactcaaggatgggcataagccagccatctcccatagagacattaagagcaaaaacgtcctcctcaagaacaacctgaccgcatgcattgcagacttcggacttgccttgaagttcgaagccggtaaatctgccggtgacacacacggtcaggttggaacacggaggtatatggcgccagaggtactggaaggcgctataaacttccaacgagatgcattcctgcgaatagatatgtatgcgatgggattagtgttgtgggaacttgcgtctcggtgtaccgccgctgacgggcctgttgacgaatatatgctgccatttgaggaggagatcggtcagcacccctcccttgaggacatgcaggaggtggtggtacacaaaaagaagcggcctgtgcttcgagattattggcagaagcacgcaggcatggcaatgttgtgtgaaaccatcgaggaatgctgggaccacgatgccgaggccaggttgagtgccggatgtgtcggggagcgtattacgcaaatgcagcgcttaactaatatcatcacaactgaagacatcgttaccgtggttaccatggttactaatgtcgactttccgccaaaagagagcagcctgtag

SEQ ID NO: 213235 - DNA, 1539 bp, Artificial Sequence
  Description of Artificial Sequence: Synthetic coding sequence
atgacagcgccatgggtcgcactggcgttgctgtggggaagcctatgtgccggtagcggccgtggcgaagcggaaacacgcgagtgtatttactataacgccaactgggaactcgagcgaacaaatcagtctggcctggagcgctgtgagggcgaacaagacaagaggctacactgttatgccagttggaggaatagcagtggcactatagaattagtcaaaaaggggtgttggctagacgactttaactgctacgatcgacaagaatgcgtagccaccgaggaaaatccccaggtgtatttctgctgttgcgaaggcaatttttgcaacgaacgtttcactcacctgccagaagccggtggtcccgaagtcacatatgaaccccctcctacagcacctaccttgctcaccgtgctggcttattcactgctgccaatcggcggattgtctctcattgttctgctcgctttctggatgtaccgacacaggaagcccccttacggccatgtggacatccacgaggacccgggacctccacccccttcccccttagtaggcttaaagcccctacagttactagagatcaaagcaagaggacgctttggatgcgtttggaaggctcagttaatgaatgacttcgttgcagtcaagatcttcccactccaggataagcagtcctggcagagcgagcgcgaaatcttttcaacccctggaatgaagcacgagaatctgttgcagtttatcgctgctgagaaaagggggagcaaccttgaggtagagctatggttgataacggcttttcacgacaaagggagtctcactgattatcttaaaggcaatatcattacatggaacgagttgtgtcacgtcgcagagaccatgagcagaggtttatcttacctgcacgaggacgtcccttggtgcagaggcgaaggccataagcctagcattgcccacagagacttcaaatctaaaaacgtgttgttgaagagtgatttgacagcagtgctggctgattttgggctggccgtgcggtttgagcctggcaagccaccaggtgacacacacggtcaggtcggaactcgaaggtacatggcccctgaagttcttgagggggctataaacttccagagggacgccttcctacgaatcgacatgtacgctatgggccttgtgttgtgggagctggttagccggtgcaaagccgcagatggccctgtggatgagtacatgctacctttcgaggaggaaatcggtcagcacccttctttggaggaactccaagaggtcgtcgtgcacaagaaaatgaggcctactatcaaagaccattggttgaagcaccctggcttagctcaactgtgcgtgaccatagaggagtgctgggatcacgacgcagaggcacgcctgtccgcaggatgcgtggaagagagggtttctctgatcagacgctccgtcaacggtactacatccgactgtctagtgtccctcgttacttccgtgaccaacgtcgacctcccccctaaagaatcttccatttag

SEQ ID NO: 213236 - DNA, 1191 bp, Artificial Sequence
  Description of Artificial Sequence: Synthetic coding sequence
atggaactcgaccatcggacctcaggaggccttcacgcgtatcccggtccaagaggcggacaggtggccaagcctaacgttatccttcagattggaaagtgtcgagctgagatgctagagcatgtccgcaggacacatcggcacctgctggcggaagtttccaaacaggtggagcgagagttgaaaggattacaccgatcagtgggcaagttagagtccaaccttgatggctatgtgcctacaagcgactcacagcgctggaaaaagtccatcaaagcctgtctgtgccgttgtcaggagactatcgccaatttggaacgatgggtgaaacgtgagatgcacgtgtggcgtgaagtgttttacagattagagcggtgggcagaccgactggagagtaccggtggtaagtatcccgtgggaagtgaatccgccagacacaccgtcagtgtgggagtcggtggcccagagtcctattgccacgaagctgatgggtatgattatacagtctctccttatgccataactccccctcctgcagcaggcgagttgcctggtcaagagccagcagaagcccagcagtaccagccctgggtgcctggcgaagacggtcaaccatcacctggcgtggatactcagattttcgaagacccgagggaattcctgtcccatcttgaggaatatctcaggcaggtgggcggatcagaagagtattggctgtcgcagatccagaatcatatgaacgggccagctaagaaatggtgggaattcaagcaagggtctgtgaaaaattgggttgagtttaagaaagagttcctccagtatagcgaggggacgctgagccgggaggctattcaaagagaactggatctcccccagaagcagggcgaaccgctggaccagtttctgtggcggaaacgagacctctaccagactttatacgtcgatgctgacgaggaggagatcatccagtacgtcgtggggaccctgcaaccaaagctcaagaggtttcttagacatcccttaccaaaaacactggagcagctgatccaacgcggtatggaggtccaggacgacctcgaacaggccgcagagcctgccggaccccatctccccgttgaggatgaggccgaaactctcacccccgcacccaattccgagtcagtggcttccgataggacacaacccgaatag

SEQ ID NO: 213237 - DNA, 1587 bp, Artificial Sequence
  Description of Artificial Sequence: Synthetic coding sequence
atggccgctgtgctgaacgcagaaaggcttgaggtcagcgttgacggactcaccctgtcgccggatcccgaggagaggcctggtgccgagggggcacccctgctgccccctcccctgccgccacccagccccccaggctcagggcgaggacccggtgcctccggtgagcagcctgaacctggggaggccgctgccggtggtgcagcagaggaggctaggcgcctcgagcagcgctggggctttggacttgaagagttatacgggctagctctgcgcttttttaaagaaaaagacgggaaggcattccatcccacctatgaggaaaagctaaaactggtcgcactacataaacaagtgttgatgggaccttataatcccgacacgtgtcccgaagttgggttcttcgacgtgctgggcaatgaccgcaggagggaatgggctgccctgggaaatatgagtaaggaggatgccatggtggagtttgttaagctgctaaacaggtgttgtcacttgttttctacctacgtagccagtcataagatcgagaaagaagagcaggagaagaaacgcaaagaagaggaagagagacgtcggcgagaggaggaagaacgcgaacgtttacaaaaggaagaggaaaaacgaaggcgggaggaagaggagcgcttgcgcagggaggaagaagagaggagacggattgaggaggagcgactacgattggaacagcagaaacaacaaatcatggcagcactcaactcccagacggccgtgcagttccagcagtacgcggcacaacaataccccggaaattatgagcagcaacaaatcttgattcggcagctccaagagcaacattaccagcagtatatgcagcaattgtaccaagtccaactggcccaacagcaagcagctttgcagaagcagcaggaagttgtagtggccggatcctcactccctaccagcagcaaagttaatgcaacagttccctctaatatgatgagcgtgaacggacaggcaaaaacgcacaccgattcttccgaaaaggagttagaacccgaggccgctgaagaggcccttgaaaatgggccaaaagagtctctgccagtcattgccgctccttcgatgtggaccagacctcagattaaagactttaaagagaagatccaacaggatgcagatagcgtgataactgtaggaagaggggaagttgttaccgtgcgggtaccgactcacgaggaaggtagctatctgttttgggagtttgcgacagataattacgatatcgggtttggggtgtacttcgaatggactgactcacctaacaccgccgtgtccgttcatgtctcagagagctccgatgacgacgaggaggaggaggagaacatcgggtgcgaagagaaagcaaagaagaacgctaacaagcccctgttggatgagattgtgccagtctatcgtcgcgattgccacgaggaagtgtatgccggatctcatcagtaccccggtcggggtgtttatctcctcaagtttgacaactcttacagtttgtggcgcagtaagtcagtgtactatagagtatattatactcgatag

SEQ ID NO: 213238 - DNA, 2343 bp, Artificial Sequence
  Description of Artificial Sequence: Synthetic coding sequence
atgaagccgggtgctacaggggaatccgacctggctgaggtcctaccccaacacaagttcgacagcaaatccctggaagcctatctgaaccagcaccttagcggcttcggcgctgaacgggaggccacactcaccatcgcgcagtaccgtgcaggaaagtcaaatcccaccttctacctgcagaaagggtttcagacctacgtgctgcggaaaaaaccacctggatcactactgcctaaggcacaccaaatcgaccgagaatttaaagttcaaaaggctctgttttccatcggcttcccagttccaaagcccatattgtactgctctgatacttcggtgatcggaacagagttctatgtgatggaacacgtccagggtcgcatcttcagagatctgacaatacccggattgtcacccgctgagcgctccgccatatacgtggcgacagttgaaaccctcgctcaactgagatctcttaatattcagagccttcagcttgagggctatggcattggtgcaggctattgtaaacggcaagtaagcacgtggactaaacagtatcaggcggcagcccatcaggatattcccgctatgcagcagctgtccgagtggctgatgaaaaacctgccagacaacgacaacgaggaaaatctgatccatggcgactttcgcctggataatatcgtctttcatcccaaagagtgcagagtaatagctgtgctggattgggagctctccacgattggccaccctttatccgacttggctcacttcagcttgttttacttttggcccagaacggtacctatgatcaatcagggatcatattcagaaaactccgggatcccatcaatggaggagctgatttctatctattgccgctgtaggggaatcaattcgatcctgccgaactggaattttttcttagcccttagctacttcaaaatggcagggatcgcccaaggcgtttattccaggtatctgctaggaaacaattcctcagaggactcgtttctcttcgctaatattgtgcaacctcttgctgaaactgggctccaattgtccaaaagaacattcagtacagtactcccacaaatcgatactactggacagctgttcgtgcagacaagaaagggtcaggaagtcctcattaaagtgaagcactttatgaaacagcacattctgcccgctgaaaaagaggttacagagttctatgttcagaatgagaactctgtcgacaaatggggaaagcccttagtaatcgacaaactcaaggagatggccaaagtggagggtctctggaatttgttcttgcctgccgtgagcggcctaagccatgttgattacgcccttatcgcagaggagaccggaaagtgtttctttgccccagacgtgttcaattgtcaggcaccggatactggtaatatggaggtgctccacctttacggctccgaagagcagaagaagcagtggctcgaaccccttcttcagggaaatattacatcttgcttctgtatgaccgagcctgacgtcgcctcaagtgatgcaaccaatattgagtgttccattcaacgggacgaagattcctatgtcattaacggaaagaaatggtggtcctcgggcgctggtaaccctaagtgtaagatcgccattgtgttggggagaacacagaacaccagtctcagtcggcataaacagcatagcatgattcttgtccctatgaataccccaggggttaagatcatccgcccactatcggtctttggctatacagacaattttcatggaggtcactttgagatccactttaaccaggtgagagttcctgccacaaaccttattctgggggaagggagaggttttgaaatttcacaggggcgactaggcccagggagaatacaccactgtatgcgcacagtgggtctcgcagaacgtgccttacagatcatgtgcgagcgggcaacgcagaggatcgcctttaaaaagaagctgtatgcacatgaggtggtggcgcattggatcgctgaatcccggatcgctattgaaaagatccgcctgcttacgctcaaggctgcccactctatggacaccctaggcagcgcgggtgccaaaaaagagatagccatgatcaaagtggccgctccacgggcagtctctaaaatagtcgattgggcgattcaggtgtgcggtggagccggagtgtctcaggactaccccctggcaaacatgtacgcgataaccagagtactgagattggcagacggacctgacgaagtccacttatcagcaatcgccactatggagcttcgagatcaggccaagcgactgacggccaagatctag

SEQ ID NO: 213239 - DNA, 2031 bp, Artificial Sequence
  Description of Artificial Sequence: Synthetic coding sequence
atgaaaccaggtgctactggggagtcagacctggcggaagtacttccacagcacaaattcgactctaagtccttagaagcctatttaaatcaacacctctccggtttcggagcagagcgagaggccactctgacaatcgcccagtacagagcaggcaaatccaaccctacattttacctgcaaaagggatttcagacctacgtcctgcgcaagaaaccacctggaagcttgctgcccaaagcccatcaaatcgaccgcgaattcaaggtccagaaggctctgttcagtattggttttcccgtcccaaaaccaatcctctactgctcagatacatctgtgattgggacagagttttacgtgatggaacacgtgcagggcaggatttttagagacctaacaatccccggtctctcgccagcagaaaggagcgctatctacgttgctactgtggagacattagcccagcttcgatccttgaacatccagagtctgcaactagagggctacgggatcggcgctggatactgcaaaagacaggtgagtacgtggaccaagcagtaccaggctgcggctcaccaggatattccagcaatgcagcaactgtcagagtggttgatgaaaaacctacccgataatgacaacgaagagaaccttatccacggcgactttcggctggacaacattgtgttccaccctaaggaatgccgcgtcatcgccgtactggattgggaattgagcaccattggacaccctctgtcagatttagcccatttcagtctcttctacttctggccgaggaccgtacccatgatcaatcaggggagttatagtgagaactctggcatacccagtatggaagaactgatttcaatctattgcaggtgcaggggtataaatagtattttgcctaactggaatttcttcctggctttgagttactttaagatggccggaatcgctcagggtgtatacagccgctatctgctgggtaacaactccagtgaggattcttttctcttcgctaatattgtgcaaccgttggctgaaacaggtttgcagttatcgaagcgtaccttctccacagttctgcctcagattgacactacaggccagttgtttgtacagaccaggaaggggcaggaagtgctgatcaaggtgaagcactttatgaagcaacatattctgccggcagaaaaagaggtgacggagttttatgttcagaatgaaaactccgttgataagtggggaaaaccactcgttatcgacaaactgaaggagatggcgaaagtcgaggggctttggaacttgttcttgcccgctgtgagtgggttgagccacgtcgattacgccctcattgctgaagaaacaggtaaatgcttctttgcccctgatgttttcaattgtcaggcgcctgacacaggcaacatggaagtcctgcacctctatgggagcgaggagcagaagaaacagtggctggaacctcttctgcagggaaacatcacatcatgcttctgcatgaccgaacctgacgtggcatcgtctgacgctacgaatattgagtgttccattcagcgtgacgaggacagttacgtgattaacggaaaaaaatggtggtcatcaggggctgggaaccctaagtgcaagatcgccatcgttcttggcaggactcagaatacatcgctgagccgagaagtggtcgcccactggatcgccgaatccagaatcgcaatagaaaaaatcagattactgactcttaaagcagcccatagcatggataccctgggcagtgctggtgccaagaaagaaattgctatgattaaagtagccgcaccgcgtgccgtgtcaaagattgtagactgggcaatccaggtctgtggaggggctggagtttctcaagactacccgctcgctaacatgtatgccatcacccgggtcctacgcctggctgacggccctgacgaagtgcacttaagcgcaatcgctacaatggaattaagagatcaagccaaacgcctcactgcgaaaatttag

SEQ ID NO: 213240 - DNA, 918 bp, Artificial Sequence
  Description of Artificial Sequence: Synthetic coding sequence
atggaggtgctccacctctacggctctgaagagcaaaagaagcagtggctggagccgttgctccaagggaacataacatcatgtttttgtatgacagagcctgatgtggcctcctccgatgctaccaacatcgagtgcagtatccaacgtgatgaggatagttatgttatcaacgggaagaaatggtggtctagcggtgctggcaatcctaagtgcaagattgccattgtcctggggcgaacacagaatacttccttgagtcgacataaacagcattctatgattctggtgcccatgaatactcccggtgtgaaaatcatacgccctctgagtgtgtttggatacacagataacttccatgggggacattttgaaattcattttaatcaggtgcgcgtgcctgctaccaacttgatcctcggagagggacggggattcgagatttcacagggacgtcttgggccaggccgaattcaccactgcatgcgaaccgtgggacttgcggaaagagctctgcagattatgtgcgaaagggctacgcaacggatcgctttcaagaagaagctgtacgcccatgaggttgtggctcactggatagccgagtctcgcatcgccatcgaaaagattagacttcttacactgaaggcggctcattctatggataccctggggtctgccggtgcaaaaaaagagattgccatgatcaaagtagcagccccaagagctgtctctaagattgttgactgggccatccaagtgtgtggtggcgctggggtgtctcaggactaccctctggcaaatatgtacgctattacccgggtactccgtctggcagacgggccagacgaagtgcacctgtccgcaatcgcaacaatggaattacgcgatcaggccaagagactcacagctaaaatatag

SEQ ID NO: 213241 - DNA, 1248 bp, Artificial Sequence
  Description of Artificial Sequence: Synthetic coding sequence
atgctgtggagtggctgtcggagatttggagccagactcggatgcctccccggtggtctgcgtgtccttgtacaaactgggcacaggtcgctgacctcatgtatagacccatctatgggcctgaatgaggagcagaaggagttccagaaagtggcgttcgactttgccgctcgggagatggctccaaatatggcagagtgggaccagaaagagctcttccctgtggacgttatgagaaaggccgcacaattggggtttggcggagtttacattcagaccgacgtcggcggttctggacttagccgccttgacacctccgtgatcttcgaggccctggctacgggttgcacatctactacagcctatattagcatacacaacatgtgcgcctggatgatcgactcattcggcaatgaggagcagcgccacaagttctgcccccctctttgtaccatggagaagtttgcctcatattgccttactgagcctggatccggctcagatgccgcttcgctgctgacctcagcaaagaagcagggagatcactacattttgaacgggtcaaaagctttcatatccggtgctggcgagagcgatatttatgtggtcatgtgcaggactggtggccctggaccaaagggcatcagctgcatagtcgttgagaaaggcacccctggattgtctttcggcaaaaaggaaaaaaaagttggctggaacagtcagccaactagggccgtaattttcgaggattgcgcagtccccgtggccaaccgaatcggttccgaagggcaaggttttctgatcgcagtccgcggactcaacgggggaaggattaacattgcttcatgttccctgggggctgcacatgcctcagtgattctgacccgtgatcatctcaacgtaaggaaacagttcggggagcccctcgcatcgaatcagtatctccagtttaccttggcagacatggctacaagattggttgccgcacgtctcatggttagaaacgcggcagtagctttgcaggaagagaggaaggacgcagttgctttatgctctatggcaaagttattcgccacagacgagtgttttgctatctgtaatcaggccctgcagatgcatggagggtacggttacttgaaagactatgccgtacagcagtatgttagggactctcgggtacatcagatcctggaaggatctaatgaagtcatgcgtatactcatctccaggtcccttctgcaagaatag

SEQ ID NO: 213242 - DNA, 1074 bp, Artificial Sequence
  Description of Artificial Sequence: Synthetic coding sequence
atgcgaaaagcagcccagttgggatttgggggagtatacatccaaactgatgtggggggttcaggtctgtcccgacttgacacctcggtcatcttcgaggcactggccacaggctgcacctccaccaccgcctacatctctatccacaatatgtgcgcctggatgatcgacagttttggcaatgaagagcagcgacacaaattctgtcctccgctgtgcaccatggagaaattcgcatcctattgcctaaccgagcccggaagcggctctgatgcagcctcccttttgactagcgctaaaaagcagggcgatcattacatcttgaatgggagtaaagctttcattagcggtgcaggagagtctgacatctatgtagtgatgtgtaggaccgggggtccgggtcctaagggcatttcctgcattgtggtggagaaaggtacccctgggctctcttttggaaagaaagagaagaaggttggatggaatagccagccaactcgcgcagtcatcttcgaggactgtgcagtcccagtggccaaccggatcggctccgaaggtcaggggttcctgatagcggtgcgtgggctcaatgggggacgaatcaatattgcttcctgcagtttaggcgcagctcacgcctctgtcatcctgaccagagatcaccttaacgtcagaaaacagttcggagagccgctggcttccaatcagtatttacagtttaccctcgctgatatggccaccagactggtggcagcccgattgatggtgagaaatgccgctgttgctctacaagaggagagaaaagatgccgtagcgctgtgtagcatggctaagctatttgcaaccgacgagtgttttgccatatgcaatcaggcattacagatgcacgggggttacggctatctgaaggattacgctgtgcagcagtatgtccgtgacagccgggtccatcagattctggaggaactgttctggcaaggccctggggttcaaagccgcagttttgttcctttcggcggtcctcaaatcgcactcctgttaccatttagttcgggcgatctgagggaggggtag

SEQ ID NO: 213243 - DNA, 819 bp, Artificial Sequence
  Description of Artificial Sequence: Synthetic coding sequence
atgggactgaacgaggagcagaaagaatttcagaaggtggcttttgattttgccgctcgggagatggcacccaatatggcggaatgggatcagaaagaactcttcccggttgatgtgatgcgaaaggccgctcagctcggattcggtggtgtctacatccaaactgacgtgggcggaagcgggctgtcacgcctcgatacatctgtgattttcgaggccttagccactggctgcacatcgacaactgcatatattagcattcataatatgtgtgcctggatgattgattcctttggcaatgaagaacagcgccataagttttgcccacccttatgcaccatggaaaagtttgcatcctactgcctcacggagcccggttcaggatctgacgctgcctctctcctgacttctgcaaagaagcagggggaccattatattctcaatggtagcaaggccttcatttcaggagctggcgaaagcgatatttacgtggtgatgtgccgaactgggggacccggacccaagggcatatcatgtattgtagtagaaaagggaacgcccggactgtcattcggcaagaaagagaagaaggtgggctggaacagccagccaacgagagccgtcattttcgaggactgtgctgtgcccgtggccaataggatcggctccgaaggtcaggggttcctgatagctgtcaggggactcaatgggggacgcattaacatcgctagttgttcacttggatgtccacgcctgtgccacccgcacccaagaccccctcagtgccctgaggctgtttggagagcaagcggacaatag

SEQ ID NO: 213244 - DNA, 681 bp, Artificial Sequence
  Description of Artificial Sequence: Synthetic coding sequence
atgaagtcccgaaagaatttcaagaagtggcccttgacactgctgcctgaacggtggctgcagatctggcagtctggtacccggtccatgtgcgcttggatgatagactcgtttggaaacgaggaacagcgccacaaattctgcccccctctctgcactatggagaagttcgcaagctactgcctgacagagccaggctcagggtcggacgctgcttccctgctgacttctgccaagaaacaaggcgaccattacattctcaatggctctaaagcctttatctcaggggctggagaaagcgacatctatgtggtgatgtgtcgcaccgggggacccggacccaaaggcatcagttgtatcgtcgtcgagaaaggcacccctggcctgtcttttggaaaaaaagaaaaaaaagtgggctggaacagtcaacccactagggccgtgatctttgaagactgcgctgtgcccgtcgctaatcggatcggctctgaaggtcagggatttctgatagctgtaagaggcctgaacggcggaagaattaacatcgctagctgttcacttggggcagcccacgcatcagtgatcctgacgagggatcatctaaacgttcgcaagcagttcggggagccgctggcatctaatcagaaaaagcaggaaacactcaaattgtggattacatag

SEQ ID NO: 213245 - DNA, 1866 bp, Artificial Sequence
  Description of Artificial Sequence: Synthetic coding sequence
atgagcgggtgcggcctctttctgaggaccacagccgcagctcgggcttgcaggggactcgtagtgagtacggcaaaccggaggctcctccgcacctccccaccagttcgcgcatttgccaaagagctttttcttggcaaaataaagaaaaaggaggtgttcccctttccagaggtgagtcaggacgagctgaacgagatcaaccagtttctgggaccagtggagaaatttttcacagaggaggtcgacagtagaaagattgatcaggagggaaagatcccagacgagactctggagaagctgaaatcgctgggtctgtttggtctgcaggtccccgaggaatacggcggtctgggtttttcaaatacaatgtactccaggctgggcgagattattagcatggacggcagtattaccgtgaccctggcagcacaccaggccattggcttaaagggcattattctcgctgggaccgaagaacagaaggcaaagtacctgcctaaattggcttcaggggaacacatcgcagccttctgcctgaccgaacctgcctcaggttccgatgcggcttccatcagaagtcgcgcaactcttagtgaggataagaagcattatatcctaaatggttctaaagtttggataacaaacggcggtctggctaacattttcaccgtgtttgccaaaactgaagtagtcgatagcgatggaagcgtgaaggataagatcactgcattcatcgtggaacgggattttggcggagtgaccaacggtaagccagaggataaactgggtatacgtggcagcaacacatgtgaagtgcacttcgaaaatacaaaaatccctgtggaaaacatcctgggtgaggtcggggatggctttaaagtcgccatgaatatccttaacagcgggagattctcaatggggtccgtcgtggccggacttcttaagaggttgatcgagatgaccgctgagtacgcgtgtacccggaagcagtttaataagagattgtctgagttcggactgattcaggaaaaattcgcactgatggcccagaaggcttacgtgatggagtctatgacttacctcacagctggcatgttggatcagcccggattccctgattgttccattgaggctgcaatggtgaaggtgttttcctccgaagccgcttggcagtgcgtgagtgaggctctgcaaattctcggtggtcttggatatactagggactatccttacgagaggatccttagagacaccaggatactgctcatcttcgagggcaccaatgaaatcttacgtatgtatatagcactcactggcctgcagcacgccggaagaatcttgaccacgaggatccacgagctgaaacaagccaaggtaagtacagtgatggacacagtcggcaggcgactgcgcgacagccttggacggactgtggatctcggtctaactggcaatcacggtgtagtgcacccctctctggccgatagtgccaataagttcgaagagaatacctattgctttggcaggacagtggagacactactgctgcgatttggaaaaactattatggaggagcagctcgtacttaaaagagtggctaatatcctgatcaatctctacggcatgacagctgtgctcagtagggcttcacgaagcataagaatagggctgagaaaccacgatcacgaggtcctgcttgctaataccttctgcgttgaagcctacctccagaatctgtttagcctcagccagctggacaagtatgcaccggagaatcttgacgagcagattaaaaaggttagccagcagattcttgagaaaagagcttatatttgcgcccatcccctggaccggacgtgctag

SEQ ID NO: 213246 - DNA, 1467 bp, Artificial Sequence
  Description of Artificial Sequence: Synthetic coding sequence
atggatggatccatcacggtcacgctggctgctcaccaagctataggcttgaagggcattatcctagcgggtactgaggaacagaaggcaaaatatctcccgaagctggcctctggcgaacacatcgccgcattctgcctgacagaacccgcatccggaagtgatgcggctagcattaggagtcgggcaacactttccgaggataagaaacactacattctcaatgggagtaaagtctggataacgaatggcggtctggctaatatatttaccgttttcgccaaaacagaggtggtggactccgatgggtcagtgaaggataaaatcaccgccttcatcgtcgaacgcgacttcggcggtgtaacgaacgggaaaccagaagacaaactgggcattcgaggctccaatacctgtgaggtgcatttcgagaacacgaaaattcccgtcgaaaacatccttggggaggttggggatggcttcaaagtcgcaatgaatattctgaactcagggcgtttttccatgggatctgttgtggcgggactgcttaaaaggttgatcgaaatgaccgccgaatacgcgtgcacaaggaaacagtttaacaaaaggttgtcagagtttggcctgattcaggagaaattcgcccttatggcccagaaggcctacgtaatggaatccatgacctatttgacggcgggaatgctcgaccaaccagggttcccagactgttctatcgaggctgcaatggtcaaagtgttttcttcagaagccgcatggcagtgcgtctcagaggccctgcagatcctcgggggtctcggctatacaagagattacccatacgagcgtatccttcgcgacacacgaatcctgctgatattcgaaggaacgaacgagatattgcggatgtacatagcccttaccggtctacaacatgcagggagaatcctcaccacgcggatccatgagttgaagcaggccaaagtgtctacagttatggacaccgtcggtagacggttgcgagatagcctgggaagaactgtggatttaggacttacagggaaccatggagtagtgcatccatccctcgccgactcagcaaacaagtttgaggagaacacttactgcttcgggagaacggtggagacccttctactgcggttcgggaagacaatcatggaggagcagctggtactgaagagagtggcaaacatcctgattaatctatacggcatgacagctgtgctctctagggcttcacgctctatcaggattggcctgaggaatcacgatcacgaggtactgctggcgaataccttctgtgtagaagcatatctgcagaacctgttctctctttcccagctggacaagtatgcccctgagaacttggacgaacagatcaaaaaggttagccagcagattctggagaaacgcgcttatatttgtgcccacccattagaccgaacatgttag

SEQ ID NO: 213247 - DNA, 507 bp, Artificial Sequence
  Description of Artificial Sequence: Synthetic coding sequence
atggaggaacagctggtcctgaagggcggacaacatccccatcagccagtctggcatgacggtcgggctgtcgccggtcagccattacaccctcattgggcgccacagccaagacccaggggctcactcggtcagcaccttctgcgagggagcctcctagcagaatccctacagcctctgagcgctggtcaggtttgctcacgtaaaccgaggagcaggctacggaaatgtccaagccgctcactgaggagtgaaccaatcagcgtcccaactctgtggactggccatgctgagcgaggacaatgccccctcctgccgccagcaccgacccacgggcctctccttgatgactgctattctttcttcagaaggctcggattgtcccaggttaaaccatttgtccccaggttacacctaaagggatgtagattagcttgggagtccctattccaggtccttacctgtcgccagtgttccttgacgggcccttctcagttgctcaactag

SEQ ID NO: 213248 - DNA, 1239 bp, Artificial Sequence
  Description of Artificial Sequence: Synthetic coding sequence
atggcagcagcacttcttgctcgtgccagtggccctgctcggcgtgctttgtgcccccgagcttggcgacagctccataccatatatcagagtgttgaactgccagaaacccatcaaatgctgctacagacatgtcgggatttcgcagaaaaagaactttttccaattgcagcccaggttgataaagagcacttgtttcctgcggcacaggtgaagaagatgggtggactgggactcctagctatggacgtgcctgaggaactggggggagctggcttggattacttagcctacgccatcgccatggaagaaatttctcgcggttgcgcttccaccggagttatcatgagcgttaacaactcgctttacctgggacccatattgaaattcggctcaaaagagcaaaagcaggcttgggtaacaccattcactagcggcgacaaaatcgggtgtttcgcgttgagcgagcctggaaatgggagtgatgcgggagccgcaagcacgaccgccagagctgagggtgactcatgggtgcttaatggaacaaaggcatggatcaccaacgcttgggaggcaagcgcagctgttgttttcgcatccaccgaccgggcactgcagaataaaggaattagtgcctttctggtgcccatgcccacgccgggattgactcttgggaagaaagaagataaacttggaatccgcggaagctccactgccaacttaattttcgaggattgtcgcattccaaaggactctattctaggggagcctggaatgggctttaagatcgctatgcagaccctggacatgggacgaattggaatcgctagccaagccttggggatcgcccagaccgctctcgactgtgctgtgaactacgccgagaatcgcatggcctttggagccccactgactaaactgcaggttattcaattcaaattggctgatatggctctagcactggagagcgccagattgctaacgtggcgggctgcaatgcttaaagacaacaagaagccctttatcaaggaggcggcaatggccaagttggccgctagcgaggccgcaacggcgataagtcaccaggccatccaaattctcgggggtatgggatatgttaccgaaatgccagcagaacggcattacagagacgctaggatcacagagatctacgaggggaccagtgagatacaacggctcgtcattgccggtcaccttttgcgctcatacaggtcatag

SEQ ID NO: 213249 - DNA, 1365 bp, Artificial Sequence
  Description of Artificial Sequence: Synthetic coding sequence
atggcggctggttttgggagatgctgtagggtccttcgctcaatttccaggttccactggcgctcgcagcataccaaggcaaaccgccagcgagagccagggctggggttctcttttgaatttaccgagcaacagaaagagtttcaggccacagctaggaaattcgcccgagaggagattatcccagttgctgcagagtacgacaagactggtgagtacccagtgcccctcattagaagggcttgggagctgggtctgatgaacactcatatccctgagaactgcgactacagcgtatgtcctctactggaggcatgtacactctatctcgatgcattttttctccttctgactggcagcaaccttaacctacaccttaatctgggcggattggggttggggacttttgatgcttgtctcatttctgaagaactggcctatggctgcactggggtgcaaaccgcgatcgagggcaactcccttggccagatgccaattattattgcgggtaatgaccagcagaagaaaaaataccttggacggatgaccgaagaacctttaatgtgcgcttattgcgtcactgagcctggcgctgggtctgacgttgccggaattaagaccaaagccgagaaaaaaggggatgagtacatcattaacgggcaaaagatgtggatcacaaatggcggaaaagctaattggtacttcctgttggccagaagtgatcccgaccccaaggctccagccaataaagcttttaccggcttcattgtagaggccgacacgcccggtatacagatcggacgaaaggagttgaacatgggtcagagatgcagtgatactagaggcatagtatttgaggacgtaaaagtaccgaaagagaacgtactgatcggcgacggagcgggattcaaggtagcgatgggcgcttttgataagacgcgccctgtcgtggctgccggagccgtcggcctggcccagcgggctctggacgaggccacaaaatatgctctggagcgcaagacctttggaaagctcttagtggaacatcaggctatcagctttatgctcgccgagatggctatgaaggtcgaactggcacggatgtcatatcagagagcggcatgggaggtggacagcggaagacggaatacctattacgcctctatcgccaaagcgttcgccggagacattgccaaccagctggccacagatgccgtccagatcctcgggggtaacgggtttaacaccgagtatcccgtagaaaagctcatgcgcgacgctaagatctatcaaatttatgaaggcacctctcagatccaacgtctcatcgtggcaagggagcacatcgataagtataaaaattag

SEQ ID NO: 213250 - DNA, 1266 bp, Artificial Sequence
  Description of Artificial Sequence: Synthetic coding sequence
atggcagccggttttggccgttgctgtcgagtccttcgtagcatcagcagatttcactggaggtcacagcacacgaaggccaacagacagagggaacctgggcttggcttttcatttgaatttacggaacagcagaaagaatttcaggcaacggccaggaaatttgctcgcgaggaaattatccccgttgcagcggaatatgataagactggagagtatccggtacccctcatacggagagcgtgggaactcggcctgatgaacacccacatacccgaaaattgtgggggactcgggttagggacctttgatgcctgcctcattagtgaagagctagcctatggatgtacaggcgttcagacagcaattgaaggaaactcactcggtcagatgccaataatcattgcaggaaacgaccaacagaagaaaaaatatttaggacggatgactgaagaaccactcatgtgtgcttactgtgtgaccgaaccaggcgctggtagcgacgttgccggtatcaaaaccaaagcagaaaagaaaggagatgaatatatcatcaatggtcaaaagatgtggatcaccaacgggggaaaagctaattggtatttcctgctggctagatcggaccccgacccaaaggcccctgccaacaaagcttttaccggttttatcgtcgaggccgatacacccggtatacagattggacgaaaggaattaaatatggggcagaggtgctccgacacaagagggattgtatttgaggatgtcaaagtgcccaaggagaacgtgcttatcggagatggcgctggatttaaggtcgccatgggtgcttttgacaagacaagacctgtagtggccgctggggcagtcggacttgctcaaagagccctggacgaggctactaagtacgccctggaacgcaagaccttcggcaaactcctcgtagaacaccaggctattagttttatgttggcagagatggccatgaaagtggagctggcacgaatgagttaccagagggccgcttgggaggttgatagtgggcgtcgaaacacatactacgcttccatcgccaaagcttttgccggagatatcgccaaccagctggcaaccgacgctgtgcaaatcctcggagggaatggattcaatacagagtatcccgtggaaaagctcatgcgcgacgccaagatttaccagatctacgagggaacttctcaaattcagaggttaattgttgctcgggagcacatcgataaatataagaattag

SEQ ID NO: 213251 - DNA, 1278 bp, Artificial Sequence
  Description of Artificial Sequence: Synthetic coding sequence
atggcggctgggtttggcagatgctgtcgatgttcattacaggtgttgcgatccatctcacgtttccactggcgatctcagcatacgaaggcgaatagacagcgcgagccaggcctgggattctcatttgagtttacggagcaacagaaagaatttcaagcaacagcaaggaaattcgcccgagaagagatcattcccgtggccgctgagtacgataagactggtgagtatccggtgcccctcataaggagggcatgggagctcggcctcatgaacacacacatccccgaaaactgcggtggactgggccttggcacttttgatgcctgtctcatatctgaagagctcgcgtacgggtgcaccggggtacagactgccatcgaggggaatagccttggacagatgcccattatcatagccggaaacgaccaacagaaaaaaaagtaccttggacgcatgacagaagagcccctgatgtgcgcttattgcgtcaccgagcctggagcagggtcggacgttgccggaatcaagactaaggccgaaaaaaagggtgacgaatatattatcaatgggcagaagatgtggatcaccaatgggggaaaggccaattggtattttttgctggcaagatctgaccccgatcctaaggcgccagctaacaaagcgttcacaggctttattgtggaggctgacacccccggaatccagataggccgtaaggagttaaacatgggccagcggtgtagtgacacacgaggcatcgtgttcgaagatgttaaggtgccaaaggagaatgttctgatcggagatggagctggcttcaaagtggcaatgggggcattcgacaaaacaaggcccgtcgtggccgcaggtgctgtgggtctggcccagagagcactggatgaggcgacaaaatacgcactcgagcggaaaactttcggtaaactgttggtcgagcaccaggcgatctccttcatgttggccgagatggccatgaaggttgagctcgctcgaatgagctaccagagggccgcttgggaagtcgactcagggaggaggaatacctattacgcttcaatcgcaaaggcctttgccggagatatcgccaaccagttggcaactgacgcggtgcagattttaggcggaaatggatttaatactgagtatcctgtggaaaaactgatgagagacgctaaaatctatcagatttacgaaggtacgtcacagattcagagattaatcgtcgctcgcgaacacattgataaatataaaaactag

SEQ ID NO: 213252 - DNA, 1158 bp, Artificial Sequence
  Description of Artificial Sequence: Synthetic coding sequence
atgttgcaggagtttactgaacaacagaaagagtttcaggccaccgccaggaaattcgctagagaggagattatacctgtggctgccgagtacgataagaccggagagtaccccgttcctttaatccgtcgcgcttgggaactggggttaatgaacacgcacattccagaaaactgcgggggactggggttaggcaccttcgatgcatgtctcataagtgaggagctcgcctatgggtgtacaggtgtccagacggctatcgagggtaactcgctcgggcagatgccgattatcattgcaggaaacgaccagcaaaagaagaaatacctgggccgtatgacagaggaaccccttatgtgcgcttactgtgttaccgagcctggcgctggtagcgatgtggctggtatcaaaacaaaagccgagaaaaaaggtgacgagtatataattaatggacaaaagatgtggattacaaacgggggtaaagccaattggtacttcttattagctagaagcgatcccgatcccaaggcgccagccaataaggcctttaccggattcatcgtggaggccgataccccagggattcagatagggaggaaggaattgaatatgggccagcgctgctccgatacacggggaatcgttttcgaggatgtgaaagtgcccaaggagaatgtgttgatcggtgacggtgccggtttcaaagtggctatgggggctttcgacaagaccaggccggtggtggcggcaggcgctgtcggcctcgctcaacgagcattggacgaggctacgaaatacgcactagaacgtaagactttcggcaaacttttggtggaacaccaggccatctctttcatgctcgccgaaatggccatgaaggtggaactggcacgcatgagctaccagcgagccgcttgggaggtggacagcggacgacgcaacacctattatgcctccatcgctaaagctttcgctggcgacatcgccaaccagctcgccactgacgccgttcagatactgggcggtaacggattcaacacagagtatccagtggaaaagctgatgagggacgctaagatttatcagatatatgagggcaccagccagatacagaggcttatagtggcacgggaacacattgacaagtataaaaactag

SEQ ID NO: 213253 - DNA, 699 bp, Artificial Sequence
  Description of Artificial Sequence: Synthetic coding sequence
atgtggataactaacggcggtaaagcgaattggtactttctgctggccaggagcgatcctgacccaaaagccccagcaaataaagctttcaccgggtttattgttgaggctgatacccctggaattcaaatcggcagaaaagagcttaacatgggacaacgatgttctgatacacgaggaatagtgttcgaagacgtgaaggttccaaaggaaaacgtcctgattggggatggcgctggtttcaaagttgctatgggagcgtttgataaaacccgacccgtggtggccgctggggctgtagggctcgcccagcgcgcattggacgaggcaaccaagtacgccctcgaaagaaagacgtttggcaaactgcttgtcgagcaccaagcaatttcttttatgctggccgagatggcaatgaaggtagagctcgcacgcatgtcctaccaacgggcagcctgggaggtggactccggtcggcgtaacacatactatgcatccatagcaaaagctttcgccggagacatcgctaatcaacttgccacggacgccgtgcagattctcggaggaaatggttttaatacagaatatccagtggaaaagctgatgcgcgatgctaagatttaccagatctacgaaggaaccagtcagattcagcggctgattgtggccagagagcatatcgacaagtacaaaaactag

SEQ ID NO: 213254 - DNA, 1446 bp, Artificial Sequence
  Description of Artificial Sequence: Synthetic coding sequence
atggatggggctgttatggaaggccctttgttcctccagtctcaaagattcgggacgaagaggtggcgcaagacctgggccgtgttatacccagcctccccgcatggggtagcgagattggaatttttcgaccataaaggctcatctagcggagggggtagaggctcctcccgacgcctcgactgcaaggtgatccggctggctgaatgcgtaagtgtagccccagtgactgtggagacgcctccggagcccggtgcaactgcttttcgccttgacacagctcagaggtcccacttgcttgcggctgacgcgccatcctcagcagcgtgggttcaaacgctctgcaggaatgcgttccccaagggcagttggacactggcgccaactgacaaccccccaaaacttagtgccctagaaatgctggagaatagtctctattccccaacctgggaaggaagtcagttttgggtaacagtacagcgtactgaggcagccgaacgatgcggactgcacggctcctacgtactgagggtggaggccgagcggctcacactactgaccgtaggtgcgcagtctcagatcctggagcccctgctatcttggccttatactctgctgcgccgttatggacgggacaaagttatgttttctttcgaggcaggcagaaggtgcccttccgggcctggtacattcactttccagaccgcccaggggaacgatattttccaggccgtcgaaacggccatccaccgacagaaggctcaagggaaggccggacagggtcacgatgtattgcgagccgatagtcacgagggcgaagtcgccgagggtaagttgccatcaccacctgggcctcaagaactcctcgactctcccccagcattatacgctgagcctttggacagtttgcgtatcgctccatgcccatcacaggattctctgtacagcgaccctctggactcaactagcgctcaggccggagaaggcgtgcagcgcaaaaaacctctctactgggacctttacgagcacgctcagcaacagctacttaaggccaagcttaccgatcctaaggaggatccgatatatgatgaaccagaagggctcgccccagttcctccgcaggggctgtatgatctgccgagagagcccaaggatgcttggtggtgccaggctagagtgaaggaggaaggctacgagctgccatacaacccagcaacagacgactacgccgtgcccccacctagatcaaccaagcctcttcttgcgccaaaaccccagggccctgcttttccagaacctgggactgcaaccggcagtgggatcaaatcccacaacagcgctctgtacagccaggtgcagaaatctggagctagcggttcctgggactgcggcctctcgcgcgtcgggacagacaaaactggcgtaaaaagcgaaggaagcacctag

SEQ ID NO: 213255 - DNA, 1299 bp, Artificial Sequence
  Description of Artificial Sequence: Synthetic coding sequence
atggaagggctcgccgttagattgctgagaggaagccggctgctgcgtagaaacttcttgacttgcctgtcgtcctggaagattccgcctcacgtgagtaaaagtagtcagtccgaggctctgctaaatataaccaacaacggtatacacttcgcccctctccagacctttacggacgaggagatgatgattaaatccagcgtgaaaaagttcgcccaggagcaaatcgcccctctcgtcagtacgatggatgaaaactcgaaaatggaaaaatccgtgatacaggggttatttcagcaagggctgatgggcatcgaagtcgatccagagtatggcggtaccggagcttcgttccttagtactgtcctcgtgatagaggaactcgcaaaagtcgatgcaagcgtagccgtcttctgtgagattcaaaatactctgataaacaccctgatacggaaacacggcacagaggaacagaaggctacatatctgccccagttgacgacagagaaagtaggctcgttttgtctttccgaagcaggggctggtagtgacagtttcgccctgaagactagagcagataaagaaggcgattattatgtgctgaatgggtcaaagatgtggatttcctctgcggaacatgccggactgtttctggtcatggcgaatgtggatccaacgattggctataagggaatcacctcattcctggtcgacagggacactcccggtctgcacatcggtaagccggagaataagctgggcctgcgggcaagtagcacttgccccctgacttttgagaacgtcaaggttcccgaggccaacatcctgggacagattgggcatggctataaatatgccattggtagtttgaatgagggacggatcggcatcgctgctcagatgcttggactcgcccagggttgcttcgattacaccatcccctatattaaagagaggatccagttcggcaaacgactgttcgacttccaaggactgcaacatcaagtcgcgcacgttgccacccagttagaggccgctaggctcctgacttataacgctgcccgtctgctcgaggccggtaaacccttcataaaggaggcgagtatggcgaaatattacgctagcgagattgccggtcaaacgacttctaagtgtatagagtggatgggcggtgtaggctacacgaaggactaccccgtcgagaagtatttccgtgacgctaagataggaaccatctacgagggtgccagtaatatccagcttaacaccatcgccaaacacatagatgccgaatattag

SEQ ID NO: 213256 - DNA, 993 bp, Artificial Sequence
  Description of Artificial Sequence: Synthetic coding sequence
atgggcattgaggtggatcctgaatatggtgggaccggtgcttcattcctgagcactgtgctcgtaatcgaagaactcgcaaaggttgatgcatccgtcgccgtcttctgtgagatccagaatacactcatcaataccctgatcaggaaacacggaactgaggagcagaaggccacttaccttccccagctgacaacagagaaggtggggagtttctgtctgtccgaagccggagccggatccgactccttcgctctgaagactcgggcagataaggaaggggattactacgtcttaaatgggtctaaaatgtggatctcgtctgcagagcacgccggtctgttcctagtgatggcaaacgtcgaccccacaatcggctacaaagggatcacctccttcttagtagatcgggatacccccggactgcacatcggaaaaccagaaaacaagctgggactccgtgcaagctccacctgccctctcacatttgagaatgtaaaggtgccagaggcaaatatactgggacaaattgggcacggctataaatacgcaattggcagcctaaatgagggacgaattggtatagcagcccaaatgttgggattggcccaaggatgctttgattacactatcccgtacatcaaggaacggattcagtttggtaagcgccttttcgactttcaaggacttcaacatcaggttgctcacgtcgccacgcagctggaagccgctcgcctcctgacctataacgccgcacgactgttggaggcgggtaagccttttatcaaggaagcctcgatggctaaatactatgcttcagagatagcgggacagacgacgagcaagtgcattgaatggatgggaggggtgggctatacaaaggattacccagttgagaagtacttccgggatgcgaaaatcggcaccatttacgagggcgcaagtaacatccagctcaacaccattgccaaacacatcgatgctgagtactag

SEQ ID NO: 213257 - DNA, 1968 bp, Artificial Sequence
  Description of Artificial Sequence: Synthetic coding sequence
atgcaggcagccagaatggcagcatcgctggggcgtcagcttcttaggctgggaggtggctcctccagactgactgcactgttgggccagcctcgaccgggacctgctagaagaccctacgctgggggtgcagcccagctggcattggataagtctgacagccatccatccgacgcactaactagaaaaaagcctgccaaggcagaatctaagagctttgccgttggaatgttcaaaggccagctcacaaccgatcaggtattcccataccctagtgtcctcaacgaagagcagacacaattcctgaaggagttggtcgagcctgttagtagatttttcgaggaggttaacgatccggctaaaaatgatgcactggagatggtggaggaaactacctggcaagggctgaaggaactgggcgcttttggcctgcaggtgccttcggagctgggaggcgttggcctgtgtaatactcagtatgccaggttggttgagattgtcggtatgcacgatctaggcgtgggcattaccctcggcgctcaccagtctattggtttcaaagggatcctgttgttcggtactaaggcccaaaaagaaaagtatctgcccaaacttgccagtggcgagactgtggccgctttctgcttgaccgagccctcttccggcagcgacgccgctagcattcgaacatcggccgtaccatccccttgcggcaagtattatacactgaatggttccaagctatggataagcaatgggggtctcgccgatatcttcactgtattcgctaaaacacctgttacagaccccgctacgggagccgtcaaggagaagattactgcttttgtggtggagagggggtttggtggcattacccacggaccccctgaaaagaagatggggataaaggcctcgaatacagctgaggtattctttgatggcgtcagggtaccttctgagaacgttctgggggaggtgggctctggatttaaggtggccatgcacatcttaaacaatggaaggtttggcatggctgcagccctggcaggcaccatgcgcggaattatcgcaaaggctgtggatcacgcaactaatcggacacagtttggagaaaaaatccacaatttcggcctcatccaggagaaactggccagaatggttatgctgcagtacgttacagaaagtatggcatatatggtcagtgcgaatatggaccagggcgctacagacttccagatcgaagccgctatctccaagatatttggttccgaagccgcttggaaagtgacagacgagtgcatccagatcatgggcggtatgggctttatgaaagagccaggggtggagcgtgttctgcgcgacttaagaatatttcgaattttcgaggggacgaacgacattctaaggctgttcgtcgcgctgcagggctgcatggacaaagggaaagaactcagtggtttgggatccgccttaaagaatcctttcggtaatgccggactcctcctaggagaggccggtaaacagctgagacgcagagccggactaggctcgggcctgagcctcagcggccttgtgcatccggagctctctagatcgggagagctagctgttcgggcactggaacagttcgccaccgtagtggaggcaaagctgatcaaacacaaaaagggcattgtcaacgaacaattcttgctccagcgcctcgccgatggtgccattgacttgtatgcaatggtcgttgtgttaagtcgagcgtctagatccttgagcgagggccaccccacggcccaacacgagaaaatgctgtgcgacacttggtgcattgaggccgctgctcggattcgagaggggatggcagccctacagagtgatccttggcagcaagagctctacaggaacttcaagtctataagtaaagcactcgtggagcgcggtggcgtggtgacttctaaccctctgggattctag

SEQ ID NO: 213258 - DNA, 1902 bp, Artificial Sequence
  Description of Artificial Sequence: Synthetic coding sequence
atgcaggcagctcggatggcagcctctctgggccgtcagctcctccggctcggagggggatctagtcggctgactgcactgctgggtcagcctcggcctgggcctgctcgcagaccttacgccggtggcgctgcccaggagtctaaaagcttcgccgtaggcatgttcaaaggacagttgacaaccgaccaggtgttcccatacccgagcgtgttaaacgaagaacagactcagtttctcaaagagcttgtcgaacctgtttctcgattctttgaagaagtaaacgacccagcaaagaatgatgcactggaaatggtggaggagaccacctggcagggcctgaaggaattgggcgctttcggtctgcaggtgccatccgaactgggaggggtgggactgtgtaatacacagtatgccaggttagtggaaatcgtggggatgcacgacctgggcgtgggcatcacattaggggctcaccagagcattggatttaaaggaattctgttgttcgggaccaaagcacagaaggagaagtacctgcctaaactggccagtggtgaaaccgtcgccgctttttgtctgaccgaaccatcctctggtagcgatgctgcaagcattaggacctctgcagtccccagcccttgcggcaagtactacaccctgaacggctccaagctatggatatcgaatgggggacttgctgacatctttacggtcttcgccaagactcctgtgaccgatcctgcaaccggtgccgtcaaagagaagatcaccgcgtttgtagttgaacggggattcggaggcatcactcatggcccaccagaaaaaaaaatgggaatcaaggcatccaacaccgccgaggtgttcttcgacggagtaagagtcccctcagagaatgtgttgggagaggtgggcagcggattcaaggtcgctatgcatatactgaacaatgggagattcggcatggcggctgcgctggcaggcacgatgagagggattatcgcaaaggctgtggatcacgcgacgaacaggacccagttcggggaaaaaatccacaacttcgggctgatccaggagaagctagccagaatggtgatgctacagtatgtgaccgagtctatggcgtacatggtgagtgccaacatggatcagggagctaccgacttccagatcgaggccgcaattagcaaaattttcgggagtgaagcagcttggaaggtgaccgatgagtgtatccagattatgggcggaatggggttcatgaaagagcctggggtagagcgtgtgttgcgagacctccggatttttaggatatttgaagggaccaacgacatcctcagactatttgtggcactccaaggctgcatggacaaaggcaaggaactgtcagggctaggaagcgccctaaagaatcctttcggaaatgccggtctattgctaggtgaagcaggcaagcagctgaggcgtcgcgcaggattgggttcaggcttgagtttgtcgggcctggtgcaccccgagctgtccaggagcggagaacttgcagtgcgcgctctcgaacaattcgcaacggttgtggaagccaaactgattaaacacaaaaagggcattgtaaatgaacagtttctgctacagaggttggccgacggtgcaatcgacctgtatgctatggtcgtggttctttctcgcgcttcccggagtttatctgagggccatcctacggctcaacacgaaaaaatgctttgtgacacatggtgcattgaagccgctgctaggatacgtgagggtatggccgcactccagagcgacccgtggcagcaagagctctaccgcaatttcaaaagcatctctaaggcactggtcgaaagagggggagtcgtgacctccaatccacttggcttttag

SEQ ID NO: 213259 - DNA, 2106 bp, Artificial Sequence
  Description of Artificial Sequence: Synthetic coding sequence
atgcctagaggtcctcaaccaagtgcagctagatgtacagttgatgatgaaagtggccttggcgcaccgggacgcggaagggctggtcggcagtcctgggtcagagcaagagcaagcggagcccgacgagactctgagatgcaggctgccagaatggcagccagccttggcaggcaactcttgaggttaggaggtggctcctccagactgacagctttactgggtcagccgcgtcccggacctgcaaggcgcccatatgctgggggagccgctcaattggccttggataagtctgactcacacccatctgatgctcttacgagaaagaagcctgccaaggcagagtcaaagtcctttgcggtgggcatgttcaagggccagctcacaacggaccaggtgttcccctaccctagcgtgcttaacgaggaacagacacaattcctgaaagagctcgtcgaaccagtcagtcggtttttcgaggaggttaacgaccccgcaaagaatgacgccctggaaatggtggaagaaaccacctggcagggactcaaagaacttggagcttttggactgcaggttccatccgaacttgggggagtgggcctttgtaatacacagtacgctcggcttgttgagatcgtgggcatgcacgatctgggagtggggatcaccctgggggcacaccaatcaattggttttaaaggcattttgctattcgggaccaaggcacagaaggagaaatatctgccaaaactggcatccggggaaacagtggccgctttttgcctgactgagccttcctcaggaagcgacgcagcatccatcaggaccagcgccgttccttctccatgtggcaaatattacacccttaacggctctaagctatggatcagcaatgggggtctggccgacatctttaccgtgttcgctaaaactcctgtgactgatccagctaccggcgctgtaaaggaaaagatcactgcgtttgtggtggagcggggatttggcggaattacgcacggacccccagagaaaaagatggggataaaggcttccaataccgctgaagtatttttcgacggcgttcgggtcccatctgaaaatgtgctcggcgaggtcggttctggttttaaagtagccatgcatatactaaacaatggacggttcggcatggcagctgcactggcaggaacaatgcgaggaatcatcgcaaaggctgttgaccacgccacgaaccgcacccagtttggggagaagattcacaactttggcctgatacaggagaagctggctagaatggtgatgcttcagtatgtgaccgaatctatggcttatatggtgagcgctaatatggatcagggagcaaccgatttccagattgaagccgcaatatctaagattttcggttccgaagctgcatggaaggtgactgatgaatgtatacagatcatgggagggatgggatttatgaaagaacccggtgtagaacgggtactgagagatcttcgcattttcaggatattcgagggcactaacgacatcctgcggctgttcgtcgcactccagggatgtatggacaagggaaaagagctcagcggactgggtagtgccctgaaaaatccattcggtaatgctggcctgctactgggtgaggccggaaagcagctgagacgacgagccggactcgggagtggcctgtcgttatctggattagtgcacccagagctatcccgctccggtgaactcgcagtgcgcgctctggagcaattcgccaccgtagttgaagccaagctgattaagcacaaaaagggcatcgtgaacgaacagtttctgttacagcgcttggccgatggcgctatcgacctgtatgctatggtcgttgtgcttagcagggcttccaggagcctttccgaggggcatccaactgcccagcatgaaaagatgctgtgcgatacttggtgcattgaagcagccgctaggatccgtgaaggtatggccgcactccagagcgatccctggcagcaggagttgtaccgaaactttaagtctatcagtaaagccttagtggagcgagggggagtggtcacatccaacccattaggtttttag

SEQ ID NO: 213260 - DNA, 2106 bp, Artificial Sequence
  Description of Artificial Sequence: Synthetic coding sequence
atgccacggggtccccaaccctccgccgcacgctgcacagtggatgacgagtctggtttaggcgctcctggacggggaagggccggacgacaaagctgggtcagagcaagagctagtggcgctaggagagattctgaaatgcaggctgcccgtatggctgcctctttggggaggcaactgcttaggctgggcggaggcagttccagactcaccgctctgttggggcagcctcgcccaggccctgctaggaggccttatgccggaggagcggctcagctcgctctcgacaagagcgactcacacccaagtgatgctctaacgcgtaagaaacccgcaaaagcagaatccaagtccttcgctgtcggaatgtttaaaggtcagctgacaaccgaccaggttttcccttacccttctgtccttaatgaggagcagacgcaattcctcaaggaattggttgagcctgtgtccaggtttttcgaggaggtgaatgatccagctaagaatgacgcccttgagatggtggaggaaactacctggcagggattaaaagagctgggagccttcggcctgcaggtgcccagtgagcttggcggtgtaggactttgtaacactcaatatgcaaggcttgtagaaatcgttggcatgcacgacctgggcgtgggtataaccctcggagcacaccagagcatagggttcaagggcattttgctgttcggcaccaaggcccagaaagaaaagtatttacccaagctcgcatctggcgaaactgttgcagccttctgtctaaccgaaccaagctccggctctgacgcagctagcatccgaactagcgcggtgccatccccctgtgggaagtactacactctgaacggatcaaaactgtggatctctaatggcggactggcagacatttttaccgttttcgctaagacccctgttaccgacccagcaaccggggctgtgaaggaaaagatcacggcctttgtcgtggagagagggttcgggggtataacccacggcccacccgaaaaaaagatgggaattaaagcgtccaacacagccgaggttttcttcgacggggtgcgtgtgccaagtgaaaatgtgcttggggaagtcggctccggctttaaggtggctatgcacatattaaacaacggtcgatttggtatggcagccgctctggcaggtactatgcgcggaataatagccaaagccgtggatcacgccacaaaccgcacgcagtttggggagaaaatccacaatttcggccttatccaagaaaaattggcgagaatggtaatgttgcagtacgtgactgagtcaatggcctacatggtgtccgcgaacatggaccagggcgcaacagacttccagattgaagccgctatctctaaaatttttggatctgaggccgcttggaaagtaaccgacgagtgtatacagataatgggaggcatgggcttcatgaaagagcccggtgtggagcgagtcctaagggatctgcgcatattcaggattttcgaggggaccaatgatattctgaggctgttcgtagctctgcagggttgcatggacaaaggcaaggagctgagcggcttgggcagcgccttaaagaatcctttcgggaatgccggactgctcctgggagaggccggaaaacagcttcgccgaagagctgggctcggcagcggactatctttatctggtcttgtgcatcccgagctgtcccgcagtggggaattggctgtccgggctctggaacagttcgccacagtcgttgaggccaagctcatcaaacacaagaaggggattgtgaatgagcagtttctgttgcagcgcttagccgatggagcaatcgacttgtatgccatggtggttgttttgtcccgcgcatcaaggagtttatctgagggtcatccaactgcccaacacgaaaaaatgctctgcgacacgtggtgcattgaggctgcagcaaggattcgcgagggaatggccgctctgcaatctgatccatggcagcaggagttgtatagaaatttcaagtccatttccaaggcactggttgagcgcggaggggttgtgaccagtaaccctctgggattttag

SEQ ID NO: 213261 - DNA, 2037 bp, Artificial Sequence
  Description of Artificial Sequence: Synthetic coding sequence
atgctgggcggtctggcagccgctgctgggacaaggattatgggaaaagagattgaggctgaggcgcaacgccctctgcgacagacctggcggccaggacaacccccagccatgacagccaagaccatgtccagcagactgaccgccttgctaggacaaccgcgacccggacccgctagaagaccttacgccggtggtgccgctcagttggctctggataaatcagattcccacccaagtgacgccctgacccgaaagaaacccgcaaaggccgaaagcaaatccttcgccgtcggaatgtttaaaggacaattgacaaccgatcaggtcttcccttacccctcagtccttaacgaagagcagacccagtttctgaaggaattggttgagcccgtgtcacgatttttcgaggaagttaacgaccccgctaaaaacgacgctcttgagatggttgaagagaccacttggcagggcctcaaagaactgggcgcattcggactgcaggttccgtccgaactaggcggagtggggctgtgtaacacacagtatgcgcgactcgtcgagatagtggggatgcacgacctcggcgtaggaattactcttggcgcacatcaaagtatcgggtttaaagggatcctgctgttcggcacaaaggcccaaaaggaaaaatatcttcctaagctcgcatcaggtgagactgtggccgctttctgtctgaccgaaccaagttccggcagcgatgcggcatctattaggacttctgccgtcccctccccttgtggaaaatattacacattaaacggaagcaagctgtggattagcaacgggggtctcgccgacattttcaccgttttcgctaagacacctgtcacagacccggcaaccggggctgtgaaagagaagataacggccttcgtcgtcgagagaggattcgggggtatcacacatggccctccagagaaaaagatggggatcaaagcatcgaataccgccgaggtattcttcgatggagttcgcgtaccatctgaaaacgtcctcggcgaagtcggcagcggctttaaagtcgccatgcatatactgaacaatggtcggtttgggatggccgcagcacttgcgggtacaatgaggggcatcatcgccaaggcagtcgaccacgcaacaaatcgcacgcaattcggggagaaaattcataatttcggactgatccaggagaaactcgcaaggatggtaatgctacaatacgtcacagagtctatggcatatatggtgagcgctaacatggaccagggtgccacagactttcagattgaggccgcaataagcaaaatatttgggtcagaagctgcttggaaagtgaccgatgaatgcatccagattatgggaggaatgggttttatgaaggaaccaggagtcgaacgcgtactgcgtgatcttagaatttttaggatcttcgagggcactaacgatatcctgcggctttttgtcgccctgcagggctgtatggacaaaggcaaagagcttagtggtctgggctcagcgctcaagaacccttttggtaacgccggtttactacttggcgaagctgggaagcagctgcgcagacgagctggactgggaagtggcctctctcttagtggtctggtgcatccggagctcagccgatctggagagctggctgtgcgtgccttggaacagtttgcaactgttgttgaggccaagctcatcaaacataagaaggggatcgttaatgagcagtttttactgcagcgactcgccgacggggcaatcgacttgtatgcgatggtggttgtcttgagtcgggcaagccgctcactgtcagaaggccatccaaccgctcagcacgagaagatgctctgcgacacatggtgtattgaagctgcagcaagaatcagagaaggcatggccgctctgcagtcagatccttggcaacaggagctgtacagaaactttaaatctatatcaaaagccctggtggagcggggaggcgtggtgacatctaaccctcttggcttctag

SEQ ID NO: 213262 - DNA, 1983 bp, Artificial Sequence
  Description of Artificial Sequence: Synthetic coding sequence
atgaatccagatctgcgcagagaaagagattctgctagctttaatcccgagctgttgactcacattctggatggcagcccagagaagaccagacggaggagagagattgaaaacatgatcctcaacgatcccgacttccagcatgaggacttgaattttctcactagatcacagaggtatgaggtggctgtgcggaagagcgctattatggtcaagaaaatgcgagagttcggtatagctgaccccgatgagattatgtggttcaaaaacttcgtgcatcgtggcagaccagagcccctggacctgcatttggggatgtttctgcccaccctgctccatcaagcgaccgctgagcagcaggaacggtttttcatgccggcttggaacctggagatcatcggcacgtatgcacagaccgagatgggccatggtacacacctgcgcggactcgagacaactgcgacgtacgatcccgagacccaggagttcatcctaaatagcccaaccgtgacctcaatcaagtggtggcccggagggctgggaaagacttccaaccacgccatcgtcttggcgcagctgattacgaagggaaagtgctacggactccatgccttcattgtgcccattcgggagattggtacccacaagcccctccccggaattactgttggtgatatcgggccaaagttcggatatgatgaaatcgacaacgggtacttgaaaatggataatcatcgcattcctagagagaatatgctgatgaagtacgcgcaggtgaagcctgacgggacctacgttaaaccactgtccaacaaactgacgtacggaaccatggtgtttgtgagatcctttctggtgggcgaagcagcacgagccctcagtaaagcttgtaccatagccattaggtatagtgcggtaagacatcaatcagagataaaaccaggtgagccagagcctcagatactggattttcaaactcagcagtacaaactgttcccacttctggccactgcctacgcattccagtttgtgggcgcttacatgaaagagacttaccacaggattaacgagggaatcggtcagggcgatctgtccgagttacctgagttgcatgctctgacggcagggctcaaggccttcacatcctggaccgctaatactggcatagaggcctgccgaatggcatgcggaggtcacgggtatagccactgctccgggctccctaacatctatgtaaattttactccaagttgcaccttcgaaggcgaaaatacagttatgatgttacagaccgcaagatttctcatgaaatcctatgatcaggtgcactccgggaagctggtgtgtggcatggtttcttatctgaacgatctgccatcccaacggatccaaccacagcaggtggcagtgtggccgaccatggtggatattaattccccagagagccttaccgaggcttataagctccgcgctgcacggttggtggagatcgccgcaaaaaacctgcaaaaggaggtcattcatcggaagtctaaggaagtggcatggaacctcacatccgttgatctggtgcgtgcctctgaggctcactgtcattatgtggtcgtcaaactgttcagtgagaaactgctaaagattcaggacaaagctattcaggcagtgctcaggagcctgtgcctcttgtattctctttatggcatttcccagaacgccggagacttcctgcagggaagtatcatgacggaaccacagattactcaagtcaaccagcgcgtcaaagagctgcttaccttaatccgctcagatgcggtggctcttgtggacgcgtttgacttccaggatgtcaccctcggatccgtcctgggcagatacgacggtaacgtttacgagaacctctttgagtgggccaaaaattcaccactcaacaaagcagaagtgcatgagagctataaacaccttaagagtctgcagagcaaactgtag

SEQ ID NO: 213263 - DNA, 1983 bp, Artificial Sequence
  Description of Artificial Sequence: Synthetic coding sequence
atgaaccctgatctgaggcgagaacgcgattctgcctcattcaatcccgagcttctcacccacattcttgacgggtctcctgagaagacacgcagacggagggagattgaaaacatgatccttaatgaccctgatttccaacatgaggacttaaattttctcaccaggagtcaaaggtacgaggttgctgtgcggaagtcagcaattatggtcaagaaaatgagagaatttggcattgcagacccagatgagatcatgtggtttaagaagttacacctggtgaatttcgtcgagcccgtcggccttaactattcaatgtttattcctacacttctgaaccagggcacgacagctcagaaggaaaagtggttactcagcagtaagggcctgcagattattggcacctacgcccagacagaaatggggcatggaacccacctcaggggcctcgaaaccacagccacctatgatccggagacacaggagttcatcctaaacagtcccactgttacttcaatcaagtggtggcccggtggactcgggaaaactagtaaccatgccatcgtcctcgcccaactgataaccaaaggcaagtgctatgggctgcacgcctttattgttcccatccgggagattgggacacacaaacccctgccgggtatcaccgtgggcgacataggcccaaaattcggatatgacgagatcgacaacggatatctgaagatggacaaccatcggatacctagagagaacatgctcatgaagtatgcgcaggtgaagccagatggtacgtatgttaagccgctgagcaataaactaacatacggcaccatggtgtttgtgcgttccttccttgtgggtgaagcggctcgggcactgtccaaagcatgtacaatcgcaattagatactccgccgtccggcaccaaagtgagataaaacctggcgagccggagcctcagattctagacttccagacacagcaatataagctctttcctctactggccaccgcttacgcatttcagtttgtgggtgcctatatgaaagaaacctaccataggatcaatgaaggcataggacaaggggacttgtcagagctgccagaactgcatgccctgaccgccggtttgaaagctttcacatcttggactgctaacactggcatagaagcatgtaggatggcgtgcggcggacacgggtactcgcactgctcaggcttacctaacatttatgttaattttacaccctcctgtaccttcgagggagagaacactgtgatgatgctgcagacagccaggttcctcatgaagagctacgatcaggtccacagcggaaagttagtttgcggaatggtgtcttatctgaatgaccttccctcacagcgtattcagccacagcaagttgcagtctggccaactatggtggacatcaatagcccagagagtctgactgaggcatataagctgcgggctgctcggcttgtggagatcgccgctaagaatctccaaaaggaggtgattcatcgaaagtccaaggaagtagcatggaatcttacaagtgtggatctggtgcgggcttccgaggcacactgtcactacgtggtagtgaagctcttcagtgaaaagctgctcaaaatccaagacaaggcaatccaggcagtactacggagtctttgtttgctgtacagtttatatggcatttcccagaatgccggtgactttctccaggggagcatcatgacagagcctcaaattacccaagtcaatcaacgtgtcaaagagctgcttactctgattcgcagcgatgcagtagccctggtcgacgcctttgatttccaggatgttactctgggatccgtgctcggcagatatgacggaaatgtctacgagaatctatttgaatgggccaagaactctcctctgaacaaggctgaggtccatgaatcctacaagcacctgaagtccctgcagtcgaagctgtag

SEQ ID NO: 213264 - DNA, 1869 bp, Artificial Sequence
  Description of Artificial Sequence: Synthetic coding sequence
atgattctgaatgatcccgatttccagcacgaggatctcaacttccttaccagatcccaaagatacgaggtcgccgtccgcaaatcagccatcatggtgaagaaaatgagggagttcgggatagcagatcctgacgagattatgtggttcaagaattttgtacacaggggacgacccgagcccttagacctgcacctgggaatgtttttgcctaccctgctgcaccaggcgacagctgagcagcaagagcggttcttcatgcctgcatggaatttggagattataggaacatacgctcaaaccgagatgggacatggaacccacctccgtggcttagaaactacagctacttacgaccctgaaacccaggaattcatccttaactcccccacagtaacatccattaaatggtggcccggagggcttggtaaaaccagcaaccatgcaattgtccttgcacagttgattacaaagggtaaatgctacggacttcacgctttcattgtgcctattagggaaatcggtacacacaagccgctcccagggatcacagttggcgatatcgggccaaaatttggatatgacgagattgataacggatacctgaagatggacaaccacagaatcccacgcgagaacatgctcatgaagtatgctcaagttaagccagacggcacctatgtgaaaccacttagcaacaagttaacatacggtactatggtcttcgtgaggagctttttggtgggagaagctgccagggctctgtcgaaggcttgcacaatagcaatccggtactcagccgtgaggcaccagtcagaaatcaaaccaggcgaaccagagccacaaattttggacttccagactcagcagtataaactgtttccactcctcgctacagcctacgcctttcaatttgtgggggcatacatgaaggagacatatcataggatcaacgagggaattggacagggggacctaagcgaactgcccgagctgcacgccttgacagccggacttaaggccttcaccagttggacggcaaacaccggcatagaagcatgtcggatggcttgcggcggtcatggttacagtcattgtagtgggctccctaatatttatgtaaatttcaccccctcatgcacttttgagggggagaacactgtgatgatgctgcagacagctcgatttctgatgaaatcctacgatcaagtgcacagcgggaagctcgtgtgcggaatggtatcctacctaaacgatttgccttcccaacggatccaaccacaacaagtggcggtgtggcccactatggtcgacatcaattctccggaaagtctcacagaggcgtataagctgcgggcagcacgcttggtcgaaattgctgccaagaacttgcagaaggaagtgattcatcgcaagtccaaggaagtggcatggaacctaacatccgtggacctcgtgcgcgcttcggaggcccattgccactacgttgtagtcaagttgtttagcgagaaacttttaaaaatacaggacaaagctattcaggccgtgctgcggtctctgtgcctgctatacagcctatatgggatctcccagaatgccggtgactttctgcaaggctccattatgacagagccacagattacacaggtgaaccagcgggttaaggagttgttaaccttgattcgtagcgatgcggtcgcattggtggacgcgttcgacttccaggatgtaaccctgggttctgtcctggggagatacgatgggaatgtctatgagaacctgtttgaatgggcaaagaacagccccctgaacaaagctgaggtccacgaatcctacaagcatctcaagtcactacagagtaagttatag

SEQ ID NO: 213265 - DNA, 1779 bp, Artificial Sequence
  Description of Artificial Sequence: Synthetic coding sequence
atggccgctttcatccagaggactccggataactggcacctgagacccgatggcaatggtccgaggttcgttcatagaggacggccagaacccctagatctgcatttgggtatgtttcttcccaccctgctacaccaagctacagcagagcaacaagaaagattcttcatgcctgcgtggaatctggaaataatagggacctatgcccaaactgaaatgggccatggcacacacctccgaggactggagacgaccgccacttatgacccggagacccaggagttcatactgaactcacctactgtcaccagcatcaagtggtggccaggcggactgggaaaaacgtccaatcatgcaatcgtgttggcacaactgattactaaggggaagtgctatggacttcacgcgttcatagtacccattcgcgaaattggtacccataaacctctgccaggaatcacagtgggtgacattggtcccaagtttgggtacgacgaaatcgataacggctacttaaaaatggacaaccaccgcatccctagagagaatatgctaatgaaatatgcccaggtcaagccggatgggacttacgtaaagccgctctcaaataagctgacctacgggacaatggtgttcgtgaggtccttcctagtgggggaggcagccagggccttatccaaggcatgcacaatagccatccggtactcagccgttcgccatcaatctgagataaagcccggtgagccagagccccagatattggactttcaaacccagcagtataagctgttccctttgctggcaactgcttacgcttttcagtttgtgggtgcttacatgaaagagacttaccacaggataaatgaaggtattggtcaaggtgacttgagtgagctaccagaattgcacgcgctgacggctggactcaaagcttttactagttggaccgccaacactggcatcgaagcctgcagaatggcttgtggtggacacggctactcccattgttctggtttaccaaacatatacgttaactttacaccctcttgcacattcgaaggagagaatactgtgatgatgctgcagactgctagatttctgatgaaaagttatgatcaggtgcattccgggaagctggtgtgtggaatggtgagttatctcaacgaccttccctcacagcgcattcagccacaacaagtcgcagtatggccaaccatggtggatataaattcaccagagtcactgactgaggcgtataaacttagggctgcgagactggtagagattgctgccaagaatttgcagaaggaagtgatacatagaaagtctaaagaggtggcttggaacctcacttcagtggatcttgtaagggctagtgaagctcattgtcattacgttgtggtgaagctctttagcgaaaaactcctgaagattcaggacaaagctatccaggcagtactccgctctttgtgcttgctgtatagcctttatggaataagccaaaatgctggcgattttctgcagggaagtattatgacggaaccacagattactcaggtgaaccaacgtgtaaaggagctacttaccttgattcgctctgacgccgtggcattagtcgacgcctttgacttccaggacgtcaccctagggtccgtgctcgggagatacgacggaaatgtctacgaaaatctgttcgaatgggctaagaacagtccccttaataaggcggaggtgcacgagtcatataagcatctgaaaagtcttcagagcaaactgtag

SEQ ID NO: 213266 - DNA, 1983 bp, Artificial Sequence
  Description of Artificial Sequence: Synthetic coding sequence
atgaacccggacctcagacgagagagagacagtgcaagctttaaccctgagctcctgactcacatcttggacgggagccctgagaagactcgtagaaggcgggaaatcgaaaacatgattttaaacgatccagattttcagcacgaagaccttaatttcctaactaggagtcaacggtatgaagtcgcagtacgtaagtcggccatcatggtgaaaaagatgcgggagtttggaatcgcagatccagatgagatcatgtggtttaagaatttcgtccatagaggcaggcctgagcccctggacctgcatctgggcatgttcttacctacgctgctgcaccaggctaccgcggagcagcaggagcgtttttttatgcccgcatggaatcttgagatcataggcacctacgctcagactgaaatgggccacggaactcatctacggggactggaaacaactgctacatatgaccccgagactcaggaattcatcttgaattctcctaccgtcacttccatcaagtggtggcctgggggacttgggaagacctcgaatcatgccatcgtcctggcgcaattgattacgaaaggtaaatgctacggactacacgcatttattgtcccaattcgggaaataggaacacacaaacctctccctggtattaccgttggggacatcggacccaaatttggatacgacgagatcgataacggctatctcaaaatggataaccacaggatccctcgggaaaacatgttgatgaaatacgcccaagtcaaacccgatgggacctacgtgaagcccttatccaacaagttgacgtatggaaccatggtgttcgtaagatcattcctagtgggagaagcagcaagggcgctgtccaaggcttgtactatcgctataaggtatagtgcagtacgccaccaaagtgagattaaacccggtgaacccgagcctcagatcctcgactttcagactcagcagtacaaactatttcctctgctcgctactgcctacgcatttcaatttgtaggcgcttacatgaaggagacttatcatagaattaacgaaggtatcggacagggcgacctcagcgagctgcccgaattacacgccctgaccgcaggactgaaggcctttacttcctggactgctaacaccggtatcgaggcctgtaggatggcatgcggtggccacggttattcccactgttctggtctgcccaatatctatgtgaattttactcccagttgcaccttcgaaggggaaaatacggttatgatgctgcagacagcacgatttctaatgaaatcctacgaccaggtgcacagcggaaaattagtgtgtgggatggtgtcctacctcaatgacctgccgagtcagaggatccagcctcagcaagttgctgtgtggcctacgatggttgatataaactcacctgagtcactgacagaagcctataaactcagagctgccaggctcgttgaaatcgccgcaaagaatttacagaaggaggtgatccacaggaaaagcaaggaggtagcctggaatctcaccagtgtggatctggtgcgcgcaagcgaagcacactgtcactacgtggtggtaaaattattctcagaaaagcttctcaaaatacaggataaagccatacaggccgtcttgagaagcctatgcctgctgtactcactgtacggtatctcacagaatgccggagacttcttgcagggctcaatcatgactgaaccacagattacacaggtgaatcagcgggttaaagaactactgactctgatccggtcagatgcagtggccctggttgacgcatttgacttccaggatgttaccctaggatcagtcctcgggcgatatgacggcaacgtgtatgaaaacctctttgagtgggccaaaaattctccactgaataaggccgaggtgcacgaatcttacaaacacctcaaatcgctccagagcaagctgtag

SEQ ID NO: 213267 - DNA, 2046 bp, Artificial Sequence
  Description of Artificial Sequence: Synthetic coding sequence
atgggatctccagtacaccgggtcagcttgggcgacacctggtccagacagatgcacccagatatcgagagcgagcggtacatgcaaagttttgatgttgagagactgactaacattctggacggaggggctcagaataccgctctgaggcgaaaggtcgaatccatcatacattcataccccgaattcagttgtaaagacaactacttcatgacccagaacgaacgatacaaggctgccatgcgtcgggcttttcacattagacttattgcaagacgtctagggtggctcgaggacggcagggagttaggctacgcttaccgtgctctctcaggagatgtggccttaaacatccaccgcgtgtttgtgcgggctctcagatctctgggcagcgaagaacagattgccaagtgggatccactctgtaagaacattcagattatagccacctacgcccagactgaactggggcacggtacctatcttcaggggctagagactgaggccacatatgacgccgctacgcaggagttcgtgattcacagtccgaccctcaccgcgacaaaatggtggccaggcgaccttggtagaagtgccacccatgctctggtgcaggctcaactcatatgctcaggtgctcgcagagggatgcatgccttcatagttccgattcgctctctgcaggaccacacacctctccccggaatcatcattggagatataggccctaaaatggactttgaccagaccgacaatggctttttgcagctgaatcacgttagagtacccagagaaaatatgctcagcaggtttgctcaggtgctgccggatgggacctatgtgaaactgggaactgctcagtctaattatctgccgatggtggtggtacgtgtggaactcctgtctggggaaatcctacctatcttgcagaaggcgtgcgtgatcgccatgagatattctgtgattcgtcgacagagccgcctgcggcctagtgaccctgaagccaaggtgttagactaccaaactcagcaacaaaaactattcccacagctggccatttcctacgcttttcatttcttagctgtgtcactgctggaatttttccagcacagctacacggccattttaaatcaggatttttcctttctgccagaactgcacgcactgtcaaccgggatgaaagctatgatgtccgagttctgcacccagggggctgagatgtgtcgaagggcctgcggaggccatggttacagcaagctgagcggcttgccaagcttggtgacgaagctctcagcatcttgcacgtacgaaggcgaaaacactgtgctgtacctgcaggttgcacgctttctagtgaagtcctacctccaaacccaaatgagtccagggtctaccccacagcggagcctgtcaccttctgtggcatatctcacagctcccgatctggccaggtgtcccgctcaaagggctgctgactttctgtgccccgagctctacaccactgcctgggcgcatgtagccgttcgcctcattaaagatagtgtgcagcacctccagactctcactcagtccggcgcagaccagcacgaagcttggaaccagactactgtgatacatctccaggcagctaaagtacactgctattacgtcacggtgaaaggttttacggaagccttagaaaagctggaaaacgagcccgcaatccaacaggttctgaaacggctgtgtgatctgcatgcaattcatgggatcctgacaaactccggcgattttctccacgacgcatttctttcgggggctcaagtcgatatggcacgaactgcctatcttgacctgctgcgcctcattaggaaggacgccatcttactgacggacgcctttgactttactgatcagtgcctcaacagcgccctcggctgctatgacggtaacgtttacgagcgcctttttcaatgggcccagaaatcccccaccaacactcaagagaaccctgcatacgaggaatacatccgacccctgctacagtcatggaggtccaagctgtag

SEQ ID NO: 213268 - DNA, 516 bp, Artificial Sequence
  Description of Artificial Sequence: Synthetic coding sequence
atgggcagtcccgtacaccgagtgtctctcggagacacctggtccaggcagatgcatccagatattgagtctgagaggtatatgcagtcttttgacgtcgagcggctcactaatatcctggacggcggtgctcagaatacggcgcttcgacgtaaagtggaaagcatcattcacagctacccagaattctcttgcaaggacaattactttatgacacaaaatgaaaggtacaaggcagctatgcgccgagcgttccacattcgcctcattgcaagacgactgggctggctggaggacgggagggagctgggctatgcttatcgcgctcttagcggagacgtggctttgaatatccaccgggtctttgtccgggcattaagatcattgggatcggaagaacagattgcaaagtgggaccctctgtgtaagaacatccagataattgcgacctacgctcaaactgagctgggacacgggacctatctccagggcttggaaactgaagccacctactag

SEQ ID NO: 213269 - DNA, 2103 bp, Artificial Sequence
  Description of Artificial Sequence: Synthetic coding sequence
atggcaagcactgtggagggcggtgatacggccctgcttcctgagttcccacgagggcctttggatgcctatcgggcacgagcttcattctcctggaaggagctcgctcttttcaccgagggagaaggaatgctgaggttcaagaagaccatcttctcagctctggaaaatgatcccctgttcgctcgctctccaggggcagatctgtccctggaaaagtatagggagctgaactttctgaggtgcaaacgcatattcgagtatgattttctatctgtcgaggacatgtttaagtccccactgaaagtaccagccctgatccagtgtcttggaatgtacgattcctctctagctgccaagtacttattgcacagcctggtgtttggctctgccgtgtattccagcggatccgagagacatttgacctatattcaaaaaatctttagaatggagatcttcggctgcttcgccctaaccgagctatcacatggctcaaacaccaaggccattaggactactgctcactatgaccctgccactgaagagtttatcatccattcaccggacttcgaagccgcaaaattttgggttggcaatatgggtaagactgcaacacatgcagtggtcttcgcaaaattgtgcgtcccaggtgatcaatgccacgggcttcacccatttattgtgcagatacgcgatcctaaaacattgctgccaatgccgggtgttatggtcggagacatcggaaagaagcttggccaaaacggactcgacaatggcttcgccatgtttcacaaagttcgggtcccacgacagtccctcctgaacaggatgggagatgtcacgcccgagggaacctatgtgagccctttcaaagacgtacggcagaggtttggggcatccctgggctcactgtcaagcggaagagtgtccattgtttccctggccatcttgaatctcaaattggctgtggctatcgctctccggttctctgctacccgcaggcagttcggcccaacggaggaagaggaaattccagtgctggaataccccatgcagcaatggcggctactgccttaccttgctgcagtttacgcactcgaccatttctccaagagcctgttcctcgatttagtcgaactgcaacggggactggctagcggagataggtctgccaggcaagctgaattggggagggagatccatgctctcgcctccgcctccaagcccctggcatcatggaccacacagcagggcatccaggaatgtcgagaggcatgcggtggtcacggctacttggctatgaacaggttgggggtgctcagagatgacaatgaccctaactgcacttatgagggagataacaatatcttactccaacagacctctaactacctgctgggacttttggcacatcaggttcacgatggtgcttgtttcagatccccattgaagtcagtggatttcctcgatgcatatccaggaatactggatcagaagtttgaggtgtcctcagtggcagattgcctcgattccgcagtcgctttagccgcttacaagtggctggtgtgttatctgctgagggaaacctatcaaaaactgaatcaggagaaaaggagtgggtcctccgacttcgaagcccgaaataagtgccaggtgtcccacgggcgacctttggctctggcctttgtcgagctgactgtggtccagagatttcatgaacatgtccaccagcccagcgttccacccagtttgcgcgcagtgttggggagactctcggctctttatgctctctggtctctatctagacacgccgcactcctttacagaggaggttatttctcaggcgagcaggctggggaagtgctggaaagtgctgttcttgccttgtgttcccagctgaaagatgacgccgttgcattggtcgacgtgatcgcacctcccgacttcgttcttgattctcccattggcagagccgacggcgagctctacaagaatctgtggggagccgttctgcaggagtctaaggtgctcgagcgggctagctggtggcctgagttttctgtgaacaaacctgtgattggctcgctgaaaagtaagctgtag

SEQ ID NO: 213270 - DNA, 1875 bp, Artificial Sequence
  Description of Artificial Sequence: Synthetic coding sequence
atggccagcacggttgaaggtggggataccgcgctgttaccagagttccctagggggccactggatgcataccgcgcaagagcctcattcagctggaaagaactggcacttttcactgagggagaaggaatgttgagattcaaaaagaccatcttttctgcactggaaaatgatcctttgtttgcaagatctccaggagccgatctttccctggagaaatacagagagctcaattttctccgctgcaagcgaattttcgaatacgattttctttccgtggaagacatgttcaaaagccctcttaaggtgcctgcccttatccagtgcctcggcatgtatgactcctctctggcagcgaagtatctgctccactcgctcgtgtttggaagtgctgtttacagtagcggctccgagaggcacttgacctacattcagaagatattccggatggaaatcttcggctgttttgcccttactgaactgtcgcacggaagcaataccaaagctattcggaccacagcccactatgatcccgctaccgaggaattcatcattcattcaccagatttcgaggccgcaaagttttgggtggggaacatgggaaaaactgccacacacgctgttgtgtttgctaagctctgtgtgcccggtgaccaatgccacgggcttcaccctttcatcgtgcagatccgcgatccaaagaccctcctgcctatgccaggcgtgatggtcggtgacatcggaaaaaaactaggacaaaacggactggataatgggttcgctatgtttcacaaagtgcgggttcctcgccagtcattgctgaatcgtatgggcgatgtaactccggagggaacatacgtctctccctttaaggatgttcgccagagatttggcgcttctcttggaagtttatcctctggacgagtaagtatagtgagcctggcgatcctcaacctgaagctggctgttgccatcgcactccggttctcagccacacggagacagttcggacccaccgaagaagaagagattccagtcctggagtatcccatgcagcagtggaggctcctgccctatctggcagccgtgtacgccctggatcacttttctaagagtctatttttggacctggtggagcttcagcggggtttagccagtggcgatcgttctgctcggcaagccgagctgggtcgagagatccacgccctggcctctgctagcaaacctttggcaagctggaccacgcaacagggaatacaagagtgtagggaagcctgcggcggacacgggtatttggctatgaaccgattaggcgtgttacgagatgataatgatcccaactgcacatatgaaggtgacaataatatcctgctacagcagacctcaaattatcttctgggacttctcgctcatcaggtacatgatggcgcttgcttcagatcacctttaaagtccgttgatttcttggatgcttaccccggaatcctggatcagaaattcgaggtcagctctgtcgctgattgcttagacagcgcagttgccctggcagcttataaatggttagtctgctacctgttacgggagacttatcaaaagctgaaccaagaaaaaaggtccgggtcttcagacttcgaagctagaaataagtgccaggttagtcacggcaggcctcttgccctggccttcgttgagttaactgtcgtccaacggttccacgaacatgttcaccaaccctccgtaccgcctagcctgcgagccgttctgggcaggctgtctgccctttacgccctgtggagtctatcccgccacgcagcccttttgtacagagctgaaaggaggtgtagctgccctggaaggcgggacagaagcagctag

SEQ ID NO: 213271 - DNA, 2103 bp, Artificial Sequence
  Description of Artificial Sequence: Synthetic coding sequence
atggcttcaaccgtagagggcggtgataccgcactgctgcccgaatttcctagaggtcccctcgacgcatacagagccagggctagtttcagttggaaggaactggccttgttcacagagggtgagggaatgttgagattcaagaagacaattttctcggcactcgagaacgacccacttttcgctcggtcccctggggcagacctgagtctcgagaagtacagagaactcaatttcttgcgatgcaagcgcatcttcgagtacgactttctatctgtggaagatatgtttaaatcaccactgaaagtgccggctctgattcagtgtctcggcatgtacgacagcagtctcgccgctaagtatctgctgcacagccttgttttcggcagtgccgtgtactcctctgggtccgagagacacctgacctacatacaaaagatcttccgaatggaaatctttgggtgcttcgctctgaccgaactatcacacggcagcaatacaaaggctatccgcacaacagcccactacgaccctgccacagaggaatttatcatacattcccctgacttcgaggccgcaaagttctgggtgggcaacatgggtaagactgctacccatgcggtggtgttcgcaaaactgtgtgttccaggtgaccagtgccacggcctgcatccattcatcgtgcagatacgggatcctaagactctcctgccaatgccgggagtcatggtgggagacatcggtaaaaagttgggtcagaacggcctcgacaacggctttgctatgttccacaaagtgagagtgcctaggcagtccctactgaatcgcatgggtgatgtgactcctgagggcacctatgtgagcccattcaaagacgtcaggcagcgcttcggggcttcccttggtagcctaagtagtggtcgcgtaagtatcgtctctttggcaatcttaaacctcaaacttgcggttgccatcgcattgcgattttcggcaactcgcagacagtttggcccaaccgaggaggaggaaattcccgtgcttgagtacccgatgcagcaatggcgacttctgccctatctggccgctgtgtacgcgttagaccatttctctaaaagcctgtttctggacttggtggagctgcagcgaggcctggcaagtggggacagaagcgcacgccaggcggagctggggagagagatacacgcgctggcaagcgcaagcaagccactcgcttcttggaccacacaacaaggtatccaggagtgccgcgaggcctgtggagggcacggatatctggctatgaatcggctgggggtcttgcgggatgacaacgaccccaattgcacctacgagggggataataatattttgctgcagcagactagcaattacctccttggactgttggcccaccaggtccatgacggtgcatgctttcggtcacccttaaaatcagtggacttcctcgatgcatatccgggaattcttgaccagaaatttgaggtgagctcagtggccgattgtctggattccgccgtcgcgctggcggcttataagtggctggtgtgctacctgctgagagaaacctaccaaaagctgaaccaggaaaaaaggtcaggttcctcggacttcgaagctcgcaataagtgccaagtgagccacggcaggccactggctctggcctttgtggagctcacagtggtccaaagattccatgagcacgtgcaccagccctccgtaccacccagcttgcgggctgtgctgggcagactgtccgctctgtacgcactgtggtccctcagcagacacgctgcactcctgtaccgtggaggatacttcagcggtgagcaggctggggaagtgttggaaagtgccgtccttgctttatgttcccagcttaaagacgacgctgtggccctggtcgacgtgatcgcccctccggacttcgtgctggatagccctataggacgcgcagacggagaactgtataagaacctgtggggagccgtcctccaggaaagcaaggtgctggagcgcgcatcttggtggccggagttctctgtaaacaaacctgtgattggttcactcaagtcaaagctttag

SEQ ID NO: 213272 - DNA, 2175 bp, Artificial Sequence
  Description of Artificial Sequence: Synthetic coding sequence
atgccccgtaattcgggggcaggctatggctgtccacacggtgacccatctatgctcgacagtcgggaaacgcctcaggagagtcgccaggacatgatcgtcaggacgacgcaggagaaacttaagaccagctccttgactgacagacagcccctcagtaaggaatccctaaatcatgcgctggaactgtctgtgccagagaaagtgaacaatgcccagtgggatgctcccgaagaggccctttggaccacacgggcagacggtagagtacggttgcggatcgacccgtcatgtcctcaactgccttacactgttcatcgcatgttctacgaggcacttgacaagtacggtgatcttatcgcactgggcttcaaaagacaggataagtgggagcatatcagctacagccagtactatctgctcgccaggagggccgcaaagggattcctgaaactcggtttgaagcaagctcacagcgtggccattctcggctttaactctcccgagtggtttttctccgcagtcggcacggtattcgcaggcggtattgtgacgggcatttataccacctccagtcccgaggcatgccagtatatcgcttatgattgctgcgccaacgtgatcatggtggatactcagaagcagctcgaaaaaatccttaaaatttggaaacagctcccacaccttaaggcagtggtgatatacaaggagcctcccccaaacaaaatggccaacgtctatactatggaggaattcatggaactgggcaatgaagtgcctgaggaagcgcttgacgccatcatagacacacagcagcctaatcagtgttgcgtgctcgtgtacacctccggcactacagggaaccccaaaggtgtgatgctgtcccaggataacatcacatggaccgccaggtatgggtcacaagcaggagacatccggccagcagaggttcagcaggaggtggttgtatcctatctgccactgagccacatcgctgctcagatctatgatctgtggactggcatacagtggggcgcacaggtttgctttgcagaacccgatgccctaaaaggctctttggtgaatactctgagggaggtggagcctaccagccatatgggtgtgccacgcgtgtgggagaagataatggagcgcattcaggaggtggccgcacaaagcgggtttatcaggagaaagatgctgttatgggccatgagcgttactctggaacagaacttaacttgccccggttccgatctcaagccctttactacaaggctggccgactatctagtactggccaaagttagacaggccctggggttcgctaaatgccaaaagaacttctacggggcagcacctatgatggccgaaacccagcacttcttccttggcctgaatatcagactgtacgcaggctatggcttgagcgagacctccggacctcattttatgtctagtccctacaactatagactgtatagctcaggcaagctagtcccaggctgtagagtgaaacttgtgaatcaagacgcagagggaatcggggagatttgtctgtggggtcggacaatttttatggggtacctgaacatggaggataagacgtgcgaggccattgacgaagaaggatggttacacacaggagacgcaggaaggctggacgctgacggctttctgtatattaccgggagactaaaggaacttatcatcaccgcaggtggtgagaacgtcccacctgtgcccatagaggaggcagtgaaaatggagctgccaatcatctcaaatgcaatgctgatcggtgaccagagaaagtttttatccatgctcctcacactcaaatgcactctggatccagatactagcgaccagaccgacaatctgaccgagcaagcgatggagttttgtcagagagttggcagtcgcgcaactactgtttcagaaatcatcgaaaaaaaggatgaggccgtgtaccaggctatagaagagggaatcagaagagtgaacatgaacgcagccgctcgcccataccatatccagaaatgggcgattctggaaagggatttctctatttccggaggggaactgggccctacaatgaagctgaagcgactgacagtgctggaaaaatataaaggtataatagacagcttttatcaagaacagaagatgtag

SEQ ID NO: 213273 - DNA, 1449 bp, Artificial Sequence
  Description of Artificial Sequence: Synthetic coding sequence
atggcgaatgtgtatacaatggaggaatttatggaattgggtaacgaggtgcctgaggaagccctagatgcgatcattgacactcagcagcctaatcagtgctgtgtcttggtttatactagtggcactactggcaatccaaaaggagtcatgctctcccaggataacattacatggacagccaggtacggaagccaggcaggagacatccggccagctgaagtgcagcaggaagtcgtagtgtcttatttacctctctcccatattgctgcacaaatctatgatctttggacgggcatccagtggggtgcgcaagtgtgctttgcagaacctgacgctttgaaaggctcactggttaacacattaagggaggttgagcccaccagtcacatgggagtgccgcgagtctgggagaagatcatggagagaatccaggaggtggctgcccagagcggcttcatccggagaaagatgctgctgtgggcaatgagcgtgacactggagcagaacctgacctgcccaggctcagacttgaagccattcacaactcgactcgccgactaccttgttctggcaaaagtacggcaggctcttggcttcgctaaatgtcagaagaacttctacggggctgcccctatgatggctgagacacagcacttctttctaggactgaacatcagactttatgctgggtacggcctgtctgagacaagcggaccacatttcatgtcctcaccatataattaccgtctgtacagttccgggaagttagtgccaggttgccgggtgaagctggtgaatcaggacgctgaggggataggagaaatctgtctttgggggagaactatcttcatgggttacttgaacatggaggacaagacttgtgaagccattgatgaagagggctggctgcatactggtgatgctggtcgtctcgatgctgatggattcttatatattaccgggaggctgaaggagcttattattaccgccggaggcgagaacgtgcctcccgttcccatagaggaagctgtcaaaatggaactgcccattatctccaatgcaatgctgatcggcgaccagcgaaaatttctttccatgcttctgactctcaaatgtaccctcgatcccgacactagcgaccagacggataatctcactgaacaggccatggagttctgtcaaagagtcggatccagggctacgacagtttcagagattatcgaaaaaaaggacgaagctgtgtatcaggctatcgaagaaggaatccgcagagtgaatatgaacgctgcagcgaggccgtaccacattcaaaaatgggccatcctagagcgtgacttctctatctcaggcggtgagttaggacctacaatgaagctcaagcgactcaccgtgctcgagaaatacaaaggaatcattgacagcttctaccaggagcagaagatgtag

SEQ ID NO: 213274 - DNA, 2001 bp, Artificial Sequence
  Description of Artificial Sequence: Synthetic coding sequence
atgaccgggaccccgaaaacacaagaaggcgctaaggatctggaagtcgatatgaacaaaacggaggtcacacctcgcctgtggactacctgcagggatggggaagtgcttctgcgtctatctaagcatggacctggccacgaaactcccatgacaataccggaattttttcgggagtcagtgaaccgcttcgggacttatcccgcattggcaagtaaaaacgggaagaaatgggaaatcctgaatttcaaccagtattatgaggcatgccggaaggccgcaaagtcattaatcaagctgggactggagagattccatggcgtcggcattcttgggtttaatagcgcagaatggtttatcaccgccgtaggggcaatcttggctggcggactgtgcgttgggatttacgccaccaactctgcggaggtatgtcagtacgtgatcacgcatgctaaagtgaacatcttgctcgtggaaaacgatcaacagttgcagaaaatccttagcataccccagtcttcactggaacctcttaaagctattattcagtacaggctacctatgaagaaaaacaacaacctgtatagctgggatgatttcatggagctcggacgcagcattcccgatacgcagttagagcaagtaatagaaagccagaaagctaaccagtgtgctgtcttaatttatacatcagggactaccggcattccaaaaggtgttatgctgtcgcacgataatattacatggatagcaggagcagtcacaaaagacttcaaactcacggacaagcacgaaacagttgtaagctatctgcctctttctcatatagcagcccaaatgatggacatttgggttcctatcaagattggagccctgacttactttgcccaggcagacgccctgaaaggcacgttggtgtcgaccttgaaggaggttaagccgactgtgtttatcggggtcccgcagatttgggagaagatccacgagatggtgaaaaagaatagcgccaagagcatgggactcaagaagaaggcttttgtttgggctcgcaatattggctttaaagtaaactctaagaaaatgctcgggaagtataatacccctgtgagctataggatggccaaaacactggtgttcagtaaagtgaaaacttctttgggactggaccactgtcattcctttatttccggcactgcccctcttaatcaggaaacagcggaattcttcctgtccttggatatacccattggcgagctctatggactgtccgaatccagcgggccacatacaatctccaatcagaacaactataggcttctgtcttgtgggaagatcttgaccggttgtaagaacatgttgttccagcagaataaggacggcataggcgaaatctgcctctggggcagacacatttttatgggatatttggagtccgaaacagagacgacagaggctattgacgatgagggatggctgcattccggcgacctcggccaactggacggattgggattcctgtatgtaacggggcatataaaggagattctcattacggcgggtggggaaaacgtgccccctatcccggtcgagaccttggtgaagaagaaaattccaataatctccaatgccatgctggtcggggacaagctgaagtttctgagcatgctactcacgctgaaatgcgagatgaatcagatgagcggcgagcccctggacaagcttaatttcgaagcaattaatttttgtagaggacttggatctcaggctagcacagtgaccgaaatcgttaaacagcaggatccacttgtttataaggcaatccagcaggggattaacgcagtgaaccaggaggccatgaataacgcacaaagaattgaaaagtgggtcatactggaaaaagatttttccatctacggaggcgaactcggtcctatgatgaaacttaagagacacttcgtcgcgcagaagtataagaagcaaatagaccatatgtaccattag

SEQ ID NO: 213275 - DNA, 1848 bp, Artificial Sequence
  Description of Artificial Sequence: Synthetic coding sequence
atggccgtttacgttggcatgttgaggctgggacgcttgtgcgccggatcgtccggagtgcttggcgcacgggctgctctgtcacgcagttggcaggaggcacgcttgcagggggtcagatttctgagtagcagggaggtggataggatggtgagcactccaatcggcggtctctcgtacgtgcaggggtgcactaagaagcacctgaatagcaagaccgtgggacagtgtctggaaaccaccgcgcagagggtcccggagagagaggcactggtggtactgcatgaggatgtgcgtctgacattcgctcaattaaaagaagaggtggacaaagcggcatcaggcctgctctccatcggcctgtgtaagggtgatcgcctgggaatgtggggaccgaatagctacgcctgggtgcttatgcagctggctaccgcacaggcaggaatcattctcgtgagcgttaatcccgcatatcaagcaatggagctggaatatgtgctgaagaaagttggctgtaaggccctggtgttcccaaagcagttcaagacacagcagtattacaatgtgctgaaacaaatctgtccagaggtggagaacgcccagcccggagctctgaagagccagaggttgcccgaccttacaacggtgataagcgtcgacgccccactcccgggaacgctactgctggacgaggtggtcgccgcaggcagcacacgtcagcatctcgaccaactgcagtataatcagcagtttttgtcatgtcatgatcccattaacatccagtttacttcagggaccaccggttcccccaagggcgctacactctcacactataatatcgtcaataattctaacattttgggagagcgcctgaaacttcatgaaaaaacacccgagcagttgagaatgatcctgccaaatcccctgtaccattgcctcgggtctgtggcaggtaccatgatgtgtttaatgtatggggcaactcttattctcgccagtccgatttttaacggcaagaaagcactcgaggctatatctagagaacggggtacttttctgtacggcactccaactatgttcgtcgatatcctgaaccaaccagacttcagttcttacgatatctccaccatgtgcggcggtgtgattgccggatccccagctcctccagagctcattcgggcaatcatcaataagatcaatatgaaggacttggtagttgcttacggtaccacggaaaactctcctgtcacttttgcccattttcccgaggataccgtagaacagaaggcggaatccgtggggagaattatgccacacaccgaagctcgtattatgaacatggaggctggcaccctggccaagttaaacacacctggagagctctgtattcggggttattgcgtaatgctgggctattggggtgagccccagaaaacagaagaggctgtcgatcaggacaagtggtactggaccggcgacgtggccactatgaatgagcagggcttttgtaagatcgtagggcgatcaaaggatatgatcattcgcggaggcgagaacatctatccggctgaattagaagatttctttcacacccatcccaaggttcaggaggtacaggtggtgggcgtgaaagatgaccgcatgggagaggaaatttgcgcatgcatcaggttgaaagacggggaagaaacaaccgtggaggagatcaaggccttctgtaaaggaaaaattagtcacttcaaaattccaaaatacatcgtttttgttacgaattacccactgacaatctccggaaaaatccaaaagtttaagctgcgcgaacaaatggaacggcaccttaatctgtag

SEQ ID NO: 213276 - DNA, 1923 bp, Artificial Sequence
  Description of Artificial Sequence: Synthetic coding sequence
atggcagtctacgtcgggatgctgcgactcgggaggctctgcgcgggtagctccggtgtcctgggggcacgggcagccctgtctagaagctggcaagaagcgagattacaaggagttcggttcctgagtgcccgaggcggaatggaagcgggtcgccaaaggatttccgtgccgtctagttttaccgcctctgcggctgctcattcccgagaggtagacagaatggtgagtacacctattgggggattatcctatgtgcaagggtgcacgaagaagcaccttaacagtaagaccgtgggccagtgcctggaaacaaccgcacagcgggtgccggaacgggaggccctcgtcgtgctacacgaggatgttcggctgaccttcgcccagctgaaggaggaagttgacaaagccgcttccggtcttctgtctatagggttgtgtaagggcgataggctgggcatgtggggacctaactcctatgcctgggttcttatgcaattggcgacagctcaggccggtattattctcgtgtctgtgaatcccgcttatcaggcaatggaactggagtacgtccttaagaaggttggctgtaaggctctagtgtttcccaagcaatttaagacacaacagtactacaatgtgctgaagcagatctgtcctgaagttgaaaatgcgcagcccggtgcccttaaaagtcagcggctccccgacctcactaccgttatctcggtggatgcaccactcccaggaactctactgctcgacgaagttgtcgccgcagggagcacacgccagcacctggaccagctgcagtataaccaacagtttttatcttgtcacgatcccataaacatacagttcacttcaggtacgacaggaagccccaaaggagccactttgtcccattacaatattgtaaataattctaatatcctgggggaaagacttaaactacacgagaagacacctgagcagctgaggatgatcttaccaaaccccctgtaccattgtctagggagcgtcgcgggaaccatgatgtgcttaatgtatggggcaaccctcatcctggcttcgcctattttcaatgggaagaaagctctggaagccattagccgagaacgtggcactttcctgtatggaacccccacaatgttcgtggacatccttaatcaacctgacttctcatcatacgacatttcaactatgtgtggcggagtcatcgctggatctcccgctcctcctgagcttattcgcgcaatcatcaataaaatcaatatgaaggatctggtggtcgcatacggaacaactgagaactcgcctgttacctttgcccacttccccgaagatacagtggaacaaaaggctgagtctgtgggacgcatcatgcctcatactgaagccaggatcatgaatatggaggcaggtacgctagcaaagctgaacaccccaggcgagctgtgtattcgtgggtattgtgttatgctgggatattggggggagcctcagaagaccgaagaggcggtagaccaggataagtggtactggactggtgatgtagctaccatgaacgagcagggtttttgcaaaatagttggtagaagcaaagacatgattatccggggtggagagaacatctacccagccgaactggaggacttttttcacacccaccctaaggtccaggaggttcaggtagttggagtgaaggacgatcgcatgggagaagaaatttgtgcttgcatacggctgaaagatggggaggagacaacagtggaggagatcaaagcattctgcaagggcaaaattagccatttcaaaattcccaaatatattgtttttgttactaattatccactaaccatcagcgggaaaattcagaaattcaaactgcgggagcagatggaacgtcacctcaacttgtag

SEQ ID NO: 213277 - DNA, 1809 bp, Artificial Sequence
  Description of Artificial Sequence: Synthetic coding sequence
atggcagtgtacgtgggcatgctgcgcttgggtaggctgtgcgccggaagctccggcgtcctcggggcacgtgctgccctcagccggagttggcaggaggcaaggctgcagggcgtgaggtttctatcttcccgagaggtggatcgaatggtttcaactccaatagggggtctttcctatgtccagggatgtaccaaaaagcatttgaacagtaagaccgtgggacaatgcctagaaaccaccgcacagagggtgccggagcgcgaggctctggtggttctgcacgaggacgtgcgtcttacctttgcacagctcaaagaggaagtggataaagccgcttctgggttgctgtctataggattgtgcaaaggcgaccgactcgggatgtgggggcctaactcttacgcctgggtgctcatgcagctggccacagcgcaggcaatggaactggagtacgtgcttaaaaaggtggggtgcaaagccctggtctttcctaaacaatttaaaactcaacaatattataacgtgctgaagcagatttgtcccgaggtcgagaacgcccagcctggagctctgaagtcacagcgattaccggaccttactaccgtgatttccgtggatgcacccttaccgggaacgctgttactggatgaagttgtcgcagcgggatcaactcgtcagcatcttgatcagctgcagtacaatcaacagttccttagctgccacgaccccatcaatatccagttcacctctggcactactggttcgcctaagggcgctacactgtctcactacaacattgtcaataactctaatatacttggcgagaggctgaagttacacgagaaaacacctgagcagttacggatgattctgcccaatccactctaccattgtttaggatcggtggccggtactatgatgtgtttaatgtatggtgccaccctgattctggccagtcccatcttcaacggcaaaaaagccctggaagcaatctccagagagcgcggtaccttcctctacggcacacccaccatgttcgtggacatcctgaaccaaccagacttctcttcttatgacatcagtactatgtgtgggggagttatcgctggaagccccgctcctccggagctgatccgggctatcattaacaagattaatatgaaagacctagtcgtagcttacgggacgactgagaattcgcctgtgacgtttgcacacttccccgaagacaccgtggaacagaaggccgaaagcgtcgggcgtattatgccccacaccgaggccaggatcatgaacatggaggccggaacactggccaaacttaacactccaggcgaattatgtatacgcggatactgtgtgatgctgggttactggggggaaccccagaaaaccgaagaagccgtggaccaggataaatggtattggacgggtgacgttgccactatgaatgaacaggggttttgcaaaattgttggaaggtctaaagatatgattattcgcggtggcgaaaacatctatcctgccgaactggaggactttttccacacccacccgaaggttcaggaagtccaggtggttggggtaaaagacgatagaatgggagaggagatctgtgcctgcataagattgaaagacggggaagaaacgactgtagaagagataaaagcgttctgtaaagggaaaattagccattttaagatccctaaatacatagtgttcgttacaaattacccactcactatctctggaaaaattcaaaaatttaagctgcgggaacaaatggagagacacctgaacctgtag

SEQ ID NO: 213278 - DNA, 1719 bp, Artificial Sequence
  Description of Artificial Sequence: Synthetic coding sequence
atggccgtctatgttgggatgctccgactgggcagactctgtgccggttccagcggcgtccttggggctcgcgctgctcttagcaggtcctggcaagaggccaggctccaaggagtgaggttcctctctagccgggaagtcgaccggatggtgtctactcccatcggcggattgtcctacgttcaggggtgcactaaaaagcatttgaacagcaagaccgttggacagtgcctggagaccacggctcagcgggtgcctgagagagaggccctggtcgttctgcacgaagatgtccggcttacttttgcacagctgaaggaggaagtcagcgtgaatcctgcctatcaggccatggagctggagtacgttttaaagaaggtgggatgcaaagcgctcgtgtttcctaagcagttcaagacccaacagtactataacgtgttaaagcaaatctgtcccgaggtggagaacgcacagcccggtgccctcaaaagccagaggttgccagatcttaccaccgtgatctccgtggacgcccctctgccaggaaccttgctgttagacgaggttgttgctgctggatcaacgcgccagcatcttgaccagttgcagtataatcaacagtttttgtcatgccacgaccctataaatatccagtttactagtggtacaacgggcagtccaaaaggagcaaccctttctcattacaacattgtgaacaatagcaatatcttgggcgagagactgaaacttcacgagaaaacacccgaacaactgaggatgatattacccaacccgttgtaccactgtttgggctcagtggcagggactatgatgtgtctgatgtatggcgcaactctcattctggcatccccaatcttcaatggaaagaaggccctggaggcaatctcgagggaacggggaacatttttatacggaactccaactatgttcgtagacattcttaaccaacccgacttctcttcgtacgatatctcaacaatgtgcggaggcgtgatcgctggatcgcccgctccccctgagttgattcgagctattataaataaaatcaacatgaaagacctcgttgttgcttatggtacaactgaaaattccccagtgacattcgcccacttcccagaagatactgtagaacagaaagcagaatctgtcgggcgaatcatgcctcatacagaagccaggatcatgaatatggaagccggaacactggcaaaactgaatacgcccggagagctgtgcattagaggctattgtgtgatgttaggctactggggagagcctcagaagactgaggaggccgtagatcaagataaatggtattggaccggagacgttgccaccatgaatgaacaggggttttgcaaaatagtcgggagaagcaaagatatgattattcggggaggtgaaaatatctaccccgctgagctcgaggatttttttcacacccatcctaaggtccaagaggttcaagtcgtgggtgtcaaggacgatcggatgggagaggagatctgtgcctgcatacggctcaaagacggggaagaaacaacggtagaagagatcaaagccttttgcaagggcaaaatctctcacttcaagattccgaaatatatcgtgttcgtcaccaactaccccctgactatctcaggcaagatccagaagttcaaactgcgagagcagatggagcggcatttgaacttgtag

SEQ ID NO: 213279 - DNA, 1368 bp, Artificial Sequence
  Description of Artificial Sequence: Synthetic coding sequence
atggagctggaatatgttctgaagaaagtgggctgcaaggcacttgtctttcctaagcagttcaaaactcagcagtattataatgtcctgaaacagatctgtcctgaggtggagaatgcccagcctggggctcttaaaagtcagagattgccggatctgactacagtcatctcagtggatgcacccctgcccggaacactgctgttagacgaagtcgtggccgcaggctccactcgccagcacctggaccagctccagtacaaccaacagttcctctcatgccacgacccgatcaacattcaatttacgtctggaaccacaggctctcccaaaggtgccacactgtcacattataacattgttaacaactcaaatattctgggtgagcgactgaagttacatgaaaagactcctgaacagctgcggatgattctgccaaacccactgtaccattgtctgggaagtgtcgcaggcacaatgatgtgcctcatgtatggagcgacactcatcctcgcctcaccgatatttaatgggaaaaaggccctggaagccatctccagggaaaggggaacctttctgtatggaactcccacaatgttcgtggatatcctgaaccagcccgacttttcctcctacgatatatcgactatgtgcgggggagtgattgctggcagccctgcgcctccagagctgataagagctatcattaacaaaatcaatatgaaagatctggttgttgcctacgggactaccgaaaatagccccgttacttttgctcattttcctgaggacacggtggagcagaaagccgaaagtgtgggacgcataatgccacacacggaggcaaggataatgaacatggaagcaggtaccctggccaagctgaacacacctggtgagctatgtatccgtggatactgcgttatgctgggatactggggggagccacagaaaacggaagaggccgttgatcaggacaagtggtactggacaggtgatgtggccaccatgaatgaacagggcttttgcaaaattgtcggcaggagcaaggatatgattatcaggggcggtgagaacatctatccagcggagctggaggattttttccacacgcacccaaaagtccaggaggttcaagtggttggggtgaaggacgatagaatgggggaggaaatttgtgcatgcatcaggctcaaggacggagaagaaacaacggttgaggagattaaagcattctgcaaggggaagatcagccactttaaaatccctaaatacatcgtttttgtgactaattatcccctcactatcagtggtaagatccagaagttcaagctccgggaacaaatggagaggcatctcaacctgtag

SEQ ID NO: 213280 - DNA, 1731 bp, Artificial Sequence
  Description of Artificial Sequence: Synthetic coding sequence
atgcttcctcatgtagtgttgaccttccggagactggggtgcgcccttgcaagctgccggctggccccagctagacaccggggtagcggcctgctgcataccgccccagtcgctcgtagtgatcgatctgccccagtatttaccagggctctggccttcggagataggatcgcccttgtggatcagcacggcaggcacacatatcgcgaattatacagtagaagcctgagactttcccaggaaatttgccgactttgcggctgcgttggcggagatctgagagaggagcgagtttcatttctgtgcgccaatgacgccagctacgtcgtggcacagtgggctagttggatgtcaggcggagtagccgtgcccctgtatcggaaacacccagccgcacaactcgaatacgtgatctgcgactctcagtcttccgtggttctagcaagccaagagtacctggagttactgagtccagtggtgcgtaaactcggagtccccctcctgccccttacacctgccatttatactggtgccgttgaggagcctgctgaagtacctgtgcccgaacagggatggcgaaacaagggggctatgatcatctataccagtgggactacaggacgcccaaaaggggtcctgtctactcatcagaatatccgggcagttgtgacgggactcgttcacaaatgggcctggacaaaagatgacgtgattttacatgtcctgccacttcatcacgtgcatggggtagttaacgcactgctgtgtcccttatgggtgggggctacttgcgtgatgatgcccgaattttccccccagcaggtgtgggagaaatttctctcaagcgagactcccagaattaatgtgttcatggctgtccctaccatctatacaaagctgatggagtactatgacaggcacttcacacagcctcatgctcaggactttctccgcgctgtgtgtgaggagaagatccgactaatggtgagtggatccgcggcactgcctctgcctgttctcgaaaagtggaaaaacattacaggccacactctgctcgagcggtatggcatgacagagatcggaatggcactaagtgggccactgacaacagcggtccggctcccaggttctgtcggaacgccactccccggtgtgcaggttcgaatcgtcagtgagaaccctcagcgggaagcatgttcctatactattcacgccgaaggtgacgagagaggaactaaagttaccccagggtttgaggagaaagaaggcgaattgctggtgaggggaccatctgtgtttagggagtactggaataaacctgaagagacgaagagcgcttttacgctggatggctggttcaaaaccggggacaccgtcgtgttcaaggacggacagtattggatcagaggacggacctctgttgatatcataaagaccgggggatacaaggtgtccgcgctagaggtggaatggcaccttcttgcccatcccagcataacagatgtcgcagtcattggcgtcccagatatgacctggggccagcgggtcacagctgtagtgaccctgcgggagggccacagcctgtcccacagagagctcaaagaatgggcccgaaacgttttagccccttatgccgtccctagcgagttagtcttggtagaggaaatacctcgcaaccagatgggaaagatagataagaaggctctgatccgtcactttcacccttcctag

SEQ ID NO: 213281 - DNA, 1731 bp, Artificial Sequence
  Description of Artificial Sequence: Synthetic coding sequence
atgctgccccacgtcgtgctgacttttcgccgactggggtgcgcactcgcttcatgccggttggccccagctcgacatcgaggttcaggcctcctgcatacagcaccagtggcgaggagcgaccggtctgccccagtgttcactcgggctctagcattcggcgataggatcgctctggtggatcaacacggcaggcacacctatcgcgaactgtatagcagatccctgcgtctcagccaagaaatttgtcggctgtgtggctgcgtgggcggagacctccgggaggagcgggtgagcttcctgtgtgctaatgacgcatcctatgtggtggcccagtgggcctcctggatgtccggcggtgtagccgttccattatatagaaagcatccggcagcccagcttgaatatgtcatctgcgattctcagagcagcgtagtgttagctagccaggagtacctcgagctgctgtcaccagtagttaggaaactcggtgtgccacttctgcccttgacccccgcaatttacacgggggcagtcgaggaaccagcagaggtccccgtgcccgagcagggttggaggaacaagggcgctatgattatctatacttccggaaccacgggacgacctaagggtgtgctgtccactcaccagaacattcgagctgtcgtaacagggttggtgcacaaatgggcctggacgaaggacgacgtgattcttcacgttctaccgctccaccacgttcacggagttgtcaacgctttgctttgcccactgtgggttggcgcaacctgcgtaatgatgccggaattcagccctcagcaagtctgggaaaaatttttaagctccgagaccccaagaatcaatgtatttatggcagtccccactatctacaccaagctgatggagtactatgataggcactttacccagccacatgcccaggatttcctgagagcagtgtgcgaggagaagatcaggttgatggtgagcggctccgcagcccttccactacccgtcctggaaaaatggaaaaacatcacagggcacacccttttagagcgctatggcatgactgagatcggcatggccctctccggccctctcaccaccgccgtgagacttcccggatcagtggggaccccactgcccggtgtgcaagtaaggatagtgagtgaaaacccccagagggaggcatgttcgtacactatccatgcagaaggcgatgaacgtggaactaaggtgactccaggtttcgaagagaaggaaggagagctgttagtcagaggtccttccgtgtttcgagagtattggaacaaacccgaagaaaccaagtccgcattcactctagatggctggttcaaaacgggggacaccgttgtgtttaaagacggccaatattggatccggggaagaacatctgtggatattattaagaccgggggatataaagtgtcagctctggaggtagagtggcacctgctggcccatccttcaatcaccgatgtagccgtgatcggggtgccagatatgacatggggacagagagtgacagccgtcgtaaccctccgggaaggacacagcctgagccaccgagagctgaaggaatgggctcggaacgtactggccccttatgctgtcccttctgagctagtcctggtggaagaaatccccaggaatcaaatgggcaagatcgacaaaaaagccctcatccgccacttccatcccagttag

SEQ ID NO: 213282 - DNA, 714 bp, Artificial Sequence
  Description of Artificial Sequence: Synthetic coding sequence
atgctgccccacgtggtccttacctttcgtcgcctaggctgtgctttggcgtcttgtcgcctggcgcctgcccgacaccgtggcagcggtttgttacacaccgcgcctgtagcgagatctgaccgatccgcacctgtattcacaagagcgctggcctttggcgatcgtatcgcattggtggatcagcacggcaggcacacttatcgcgaactctatagccggtccctccgactgagccaggagatatgcaggctctgtggctgcgtagggggtgacctgagagaggaacgcgtgtcctttctctgcgcaaatgatgcgtcctatgtagtggcccagtgggcctcgtggatgtcaggaggagtcgctgtcccactgtaccggaagcatccagcggcacagctggagtacgttatttgtgattctcagtcatcagtcgtccttgcaagtcaggaatatttggagctgctttcccctgtcgtgcggaagctgggagtgccccttctgcctctgaccccagccatctacaccggtgccgtcgaggagcctgccgaagtgcctgtccccgagcaaggctggcgcaataagggtgccatgattatatatacatccggcacaacaggacgacccaaaggcgtactcagtacccatcagaacattagagccgtggtcactgggcttgtgcacaagtgggcttggacaaaggacgacgtgtag

SEQ ID NO: 213283 - DNA, 2097 bp, Artificial Sequence
  Description of Artificial Sequence: Synthetic coding sequence
atgcaggcccacgagttgtttagatattttaggatgcctgagcttgttgactttcggcaatatgtaaggaccctcccaaccaacaccctgatgggatttggggcttttgccgcactgactactttctggtacgctaccagacctaagccgcttaaaccaccttgtgatttatcgatgcaatccgtcgaagtggccggaagcggcggagccagacgcagcgccctactagactcagacgagccccttgtgtatttctatgatgatgtcaccacgctgtacgagggctttcagcggggaattcaagtgtcaaataatgggccatgcctcggatccagaaagccggaccagccctatgagtggttatcttacaagcaggtcgcagagcttagtgagtgcatcggcagcgccctgatccaaaaggggttcaagactgcccctgaccaatttattgggatctttgcccagaaccggcctgaatgggtgatcattgaacaggggtgcttcgcttactctatggtcattgtgcccctctatgacactctgggcaatgaggccattacctatatcgtgaataaagctgagctgtccctagtcttcgttgacaagccagaaaaggccaagcttcttttagaaggcgttgaaaataagctgattcccggactcaaaatcatcgttgttatggatgcctacggtagtgagctcgtggaacgcggtcagcgatgcggcgttgaagtcacctcaatgaaagccatggaagatctaggacgtgccaaccgcagaaagcccaaacctcctgcaccagaggatctggcagtgatatgttttacaagcggtacaaccgggaatccaaagggtgctatggtgacccatagaaatattgtgtctgactgtagcgcctttgtgaaagccaccgaaaacactgtgaatccttgtccagacgataccctgatcagtttcctaccacttgcacacatgtttgagcgcgttgtggaatgcgtgatgctttgtcacggcgcaaagattggattcttccagggagatatacgcctgttgatggatgaccttaaggtgttgcagcctaccgtgttccctgttgtgcctagactcctcaacagaatgttcgacaggatatttggacaggctaataccacactgaagcgatggctgctggacttcgcatcgaaaagaaaagaggcagagttaagatcgggaataattcgcaacaattcattgtgggaccgcctgatatttcataaggtacaaagctcactcgggggaagagtgcgcctgatggtcacaggagcagcaccggtgagtgctacggtactgactttccttagagcagcccttggttgtcaattctatgagggctacggacagactgagtgcactgccggatgctgcttaacgatgccgggagactggacagcagggcacgttggagcccctatgccttgcaacttaattaagttagtggacgtagaggaaatgaattatatggccgcagagggcgaaggcgaggtgtgtgtcaagggcccaaacgtgttccaaggttacctgaaagatcccgctaagaccgctgaagcactagacaaagatggatggctgcacacaggggacatcggaaagtggttgcctaatggcacgcttaaaattatagatcgaaaaaagcacatcttcaagctagcgcagggggaatatatcgctccggagaaaatcgaaaacatctacatgagatcagagcctgttgcgcaagtctttgtgcacggagagagtctccaagcatttctaatcgccattgtcgtgcccgatgtggaaactctgtgctcatgggcccagaaacgcggtttcgagggtagtttcgaggaattatgccgaaataaggacgtaaagaaggccattttagaggacatggtgagattaggcaaagatagcggcctcaagccttttgagcaggttaaagggatcactctacaccccgagttgtttagtatagataacggactgttgactcccacaatgaaggccaaacggcctgagttgcgcaactatttccgaagtcagatcgatgatttgtactccaccatcaaagtctag

SEQ ID NO: 213284 - DNA, 1584 bp, Artificial Sequence
  Description of Artificial Sequence: Synthetic coding sequence
atggtcatagtgccactgtacgatacgctggggaacgaggcaatcacatatatcgtgaacaaagctgagttaagcttagtgtttgtggacaagcccgagaaggctaagctcttacttgagggggtggagaataagctcataccaggcctaaaaatcatcgtagtgatggacgcctacggctcggaattagtggaacggggacaaaggtgtggggtagaggtgaccagtatgaaggccatggaagacttgggaagagcaaacagacggaagcccaagccccctgcgcctgaggatttagcagtgatttgcttcacatctggaacaacaggaaaccctaagggagcaatggtaacgcatagaaacatcgtgtccgattgcagtgccttcgtgaaggctaccgagaatacagttaatccatgtcccgatgacaccctaatctcctttctccctttggcgcacatgtttgagagagtggtcgaatgcgtgatgctttgccatggagccaaaattgggttctttcagggggatattcggttgctaatggatgacctcaaagtccttcagccaaccgtattcccagtagtgcctcgcttgctgaataggatgttcgatagaatttttggacaagctaacaccacgttgaagaggtggctgcttgacttcgcttcaaaaaggaaggaagcagaactcaggagcggcataattcgaaataatagcttgtgggatcgtcttattttccataaggtccagtcttctttagggggacgcgtgcgtttgatggtgaccggcgctgccccagtgtcggcaactgtactgacgttcctgcgcgctgcccttggatgccaattctacgagggatatggccagacagagtgtaccgcagggtgttgcctgacgatgcctggcgactggacagccggtcatgtcggggcacccatgccatgtaacctcattaaactcgtggatgttgaggaaatgaactacatggcagccgagggagagggcgaagtatgcgtcaagggcccaaatgtgttccagggatacctgaaggatcctgctaagactgcagaggccctggacaaagacggatggctgcataccggcgatattggcaagtggctcccaaacgggacattgaaaatcatcgatagaaagaaacacatttttaaactggcacagggcgaatacatcgctcctgagaagatcgagaacatttacatgcggagcgagcccgtggcccaggtctttgtacatggggaatccttacaggcctttctcattgcaatcgtggtgcctgacgttgagaccttatgctcatgggcccaaaaacggggttttgaagggtccttcgaagagctctgccggaacaaggatgtaaagaaggcaatcctggaagatatggtaagactgggaaaagactctggcctgaagccgttcgagcaggtcaagggaataactctacaccccgaacttttctcaatagataatgggctgctcacgccaactatgaaggcaaagcggccagagctcaggaactattttcgctcacagatcgacgatctttactccactatcaaagtctag

SEQ ID NO: 213285 - DNA, 1584 bp, Artificial Sequence
  Description of Artificial Sequence: Synthetic coding sequence
atggtgatcgttccactctacgatacgttgggaaacgaagcaattacttacatcgtgaacaaggcggagttgtcattggtgttcgttgacaaacctgagaaggcaaaactgctgttagagggggtcgagaacaaactcatccctggcctgaaaattatagttgtgatggacgcatatgggtctgaacttgttgagcggggtcagagatgcggggtggaggtcacttccatgaaggctatggaggacctcgggcgagctaaccgccgaaagcccaagccccctgcaccggaagacctggcagtgatctgcttcacctctggcactacgggcaacccgaagggggcaatggtgacccaccggaacattgtgtctgattgctctgcttttgtgaaggccactgagaacacagttaacccatgcccagacgacactctcatctcttttcttccactggcacacatgttcgaaagagttgtggaatgcgtgatgttgtgccacggagccaagatcggattttttcagggtgacatccgtctcttgatggatgacttgaaagtcctccaaccaaccgtttttcccgtcgtgcctcggctgctgaaccgaatgtttgaccgtattttcgggcaggcgaacactacgctgaagagatggttgcttgacttcgcatccaaaagaaaagaagccgagcttcggtcaggcataatcagaaacaacagtttgtgggatcgcctcatttttcataaagtccagagcagcctcggtgggagggtgaggctgatggtcacgggggctgcacctgtgtccgccactgtgttaaccttcttgagagccgctttaggatgtcaattttatgaagggtacgggcagaccgaatgcactgctggctgctgtctgaccatgccaggagattggaccgccggacatgtcggtgctcccatgccatgcaacctaattaagcttgtggatgtggaagagatgaattacatggccgctgaaggcgaaggcgaggtgtgtgtcaaggggcctaatgttttccagggttacctgaaggatccagctaagaccgctgaagccctcgacaaggatggctggctgcatacaggagatattggcaagtggctaccaaatggcacactgaagattattgatcggaaaaagcatatttttaagctcgcacagggagagtacattgctccggagaagattgagaatatttacatgagatccgagcctgtggcccaagtgttcgtgcatggcgagagcctacaggccttccttatagcgattgtggtcccggatgttgagacactttgtagttgggctcagaaacgtggctttgaaggtagctttgaagaattatgtcgcaataaagatgtgaaaaaagccattttagaagatatggttcggctcgggaaggactcgggccttaaacctttcgagcaggtgaagggcatcaccttgcatcctgaactgttttccatagacaacggcctcctcactcctacaatgaaagccaaacgccctgagttgcgcaactactttaggagccagatcgacgacctgtattcaactataaaggtctag

SEQ ID NO: 213286 - DNA, 2097 bp, Artificial Sequence
  Description of Artificial Sequence: Synthetic coding sequence
atgcaggcccacgagctctttagatactttcgtatgcccgagctggtggacttccggcagtacgtgcggactttgccaacaaacacacttatgggattcggagcattcgcggcactcacaaccttctggtacgctactagacctaagcctctgaaacctccctgtgacctctcgatgcagtccgtggaagtagctggcagcggaggcgcaagaagatctgctctcctcgactctgatgagcctctggtatacttttatgacgacgtcacaactttgtatgagggatttcagcgcggaatacaggtgtccaacaatggcccatgtttgggcagtagaaagcccgatcagccttatgagtggctttcgtacaagcaagtggcagagctgtctgagtgcatcggatccgcgctgatccagaaaggctttaagaccgccccagaccagttcattgggatcttcgcacaaaataggcctgagtgggtgatcatagaacaagggtgcttcgcatactcaatggtaattgttccactgtacgatacgctggggaacgaagctattacgtacatcgtcaataaagcagagctcagcctcgtttttgttgataaacctgagaaggccaagctcctcctggaaggtgttgagaataagctgattcccggacttaaaattattgtggtcatggacgcctatgggtccgagcttgttgaacgaggccagcgctgtggagtggaagttacctctatgaaggcaatggaggacctgggccgagctaacagacggaagcccaaacccccagcacctgaagacctcgccgtaatttgtttcacatcagggacaacaggaaatccaaagggagcgatggtaacacaccggaacattgttagcgactgttccgcattcgtgaaagccactgaaaatacagtcaacccgtgtcccgatgatactttgatcagcttcctccccctggctcacatgtttgaaagggtcgttgagtgcgtgatgctctgtcatggggctaagatcggtttttttcagggggatattagactcttgatggacgacctgaaggtgcttcagccaactgtcttccctgtagtgccacggctgctcaaccggatgtttgatcggattttcggccaggcaaacacaactttgaaaaggtggcttctcgattttgcttccaagcggaaggaagctgaactccggagtgggatcattcgtaataactctctgtgggatagactcatctttcacaaagtgcagagttccctcgggggtcgtgtaaggctgatggttaccggggctgcgccagtatccgctaccgtgctaaccttccttcgcgctgccctggggtgccaattctacgaaggctatggccagacagagtgtacggccggttgctgcctcactatgccgggtgactggacagccggtcacgtaggcgctccaatgccgtgcaatcttatcaagctggtcgatgttgaggagatgaattacatggccgcagagggagaaggggaggtgtgtgtgaagggcccaaatgttttccaggggtatctgaaggaccccgctaagaccgccgaggccttagataaagacggatggttgcataccggcgatatcgggaaatggttgcctaacggcacacttaaaatcatcgatcggaagaaacatatcttcaagcttgcacagggcgaatacattgccccagagaagatagaaaacatttatatgaggtccgaaccagtagcccaagtcttcgtgcatggggaaagcctccaggcctttctaattgctatcgttgtccctgatgtggagaccctgtgctcgtgggcccagaagcgagggtttgagggaagttttgaagagttgtgtcgaaacaaagacgtcaagaaagctattcttgaagacatggtccgcctcggaaaagattctggccttaagccctttgagcaggtgaaggggattactctacacccagaacttttcagcatcgataacggcttgctcacaccaaccatgaaggcgaaaaggcctgagctccggaattattttcggtcccagatagatgatctctactccaccataaaggtatag

SEQ ID NO: 213287 - DNA, 1995 bp, Artificial Sequence
  Description of Artificial Sequence: Synthetic coding sequence
atgcaggcccatgagctgttccggtatttccggatgccagaactggttgacttcaggcagtacgtgcgcacattgcccactaacaccctcatgggatttggcgcattcgctgcccttacgaccttctggtatgctaccaggccaaaacccctgaagcctccttgcgacttgtccatgcagtctgtagaggtggccggttccggtggcgctagacggtcggctctgttggacagcgatgaacctctagtttatttctatgatgacgtcaccactttatatgagggatttcagaggggaatccaggtatcaaataacggcccatgccttggatctaggaaacctgatcagccatacgagtggctgagttacaaacagtgggtgatcatagagcaaggttgttttgcctactcgatggtcatagttccgctgtatgacacactgggaaacgaagccattacctacatcgtcaataaagctgaactgagtttagtgtttgttgataagccagagaaggctaaactccttctcgaaggggtggaaaataagctgatcccaggtttaaaaataatagtcgtaatggacgcatatgggagcgaattggtggagcgcggtcaacggtgtggagtcgaagtcacttccatgaaggccatggaggatttgggacgtgcaaacaggagaaagccaaagcctcctgcacccgaagacctcgcagttatctgttttacttcgggtacaacaggaaatccgaagggggcaatggtaactcaccgtaacatcgtgagcgactgtagtgcatttgttaaagcaaccgagaacaccgttaacccctgccccgatgatactcttatctcctttctgccactggcccacatgttcgagcgcgtggtggagtgtgtaatgctgtgtcacggcgctaagatcggatttttccagggtgacataagactactgatggatgatctcaaagtgctgcagcccacagtgtttccagtggtcccccgattgttaaaccggatgttcgataggatctttggacaggcaaatactacgttaaaacgttggctcctcgacttcgctagcaaaagaaaagaggccgagctaagatcagggattatcagaaataatagcctgtgggataggctaatcttccacaaagttcaatctagcttgggcggaagagtgaggctgatggtgaccggagccgcaccagtaagcgccacagtgctgacattcctgcgggctgccttgggatgtcagttctatgagggatatggtcagactgaatgtaccgcgggttgctgcttgactatgccgggtgactggacagctggccacgtgggggctccgatgccgtgtaacctgattaagctggtcgacgtggaggaaatgaattacatggctgccgagggtgagggggaagtttgcgtcaaggggcctaacgtatttcaaggatacctgaaagacccggcaaagacggcagaggctctggacaaagacggatggctgcatacgggagatatcggtaagtggctccctaacggaaccctgaagatcattgatcggaagaaacatatattcaaattggcacagggagagtacatcgccccagagaagattgaaaatatttacatgaggtccgaaccggtggcgcaggtgttcgtgcacggggagtctttgcaggcctttctgattgcaatcgtagtgcctgatgtggagactttgtgttcctgggcccagaaaagaggttttgagggaagtttcgaggagctgtgccgcaataaagacgtgaagaaagcaatcttggaggacatggtgagactcggcaaggatagtggacttaaaccgttcgagcaagtcaaaggcatcacccttcatcctgagctgttttcaatagacaacgggctattaaccccaactatgaaagctaaaaggcccgaattgaggaattactttaggtctcagatcgatgatctgtacagcactattaaagtttag

SEQ ID NO: 213288 - DNA, 2097 bp, Artificial Sequence
  Description of Artificial Sequence: Synthetic coding sequence
atgcaagcgcacgaactgtttcggtacttcaggatgccagaattggttgatttcagacagtacgtaagaacactacctacaaacacgctcatgggattcggcgcttttgctgcccttacaaccttttggtatgctactcggccaaaacctctgaagcctccttgcgacctaagcatgcagtccgtggaagtggctggtagcggcggtgcgaggcgctctgcactactggacagcgatgaacctttggtgtatttctacgatgacgtcactacgctgtacgagggctttcagagggggattcaagtgtccaataatgggccatgtctcggctcaaggaaacctgaccagccctatgaatggctgtcttacaagcaggtggcggaactgtcagagtgtataggctctgccctcatacagaagggctttaaaacagcccctgaccagttcatcgggatttttgcccaaaacaggcccgagtgggtgatcatcgagcagggctgtttcgcctatagcatggtgatcgtccctctttacgacacgctcgggaatgaggctatcacatatattgtaaacaaagcagagttatccttggtgtttgtagataaaccagaaaaggccaaactgctgctcgaaggcgtcgaaaacaagctgataccgggtttgaagataattgtggtgatggatgcctacggctccgagctcgtcgaacgcggacagcggtgtggcgtggaagttacaagtatgaaagccatggaggatttaggcagagctaatcgcaggaagccaaaaccccctgcccctgaagacctggccgtgatttgtttcacctccggtacgacaggaaaccctaaaggagcaatggtcacccaccgcaatatagtatctgactgctctgcattcgtgaaggcgaccgagaatacagtgaacccatgccccgacgataccttaatcagtttcttacctctcgcacacatgtttgagagagttgtggaatgcgttatgctctgccatggcgctaaaatagggtttttccagggagatatccgcctcctgatggacgatctgaaggttcttcagcccaccgtttttcccgtcgttcctcgattactaaaccgcatgttcgaccggatcttcggccaggctaacacgaccctgaagcggtggttactggacttcgcatctaagaggaaagaggctgagctgagatcaggtatcattcgcaacaactccctctgggacaggctgatatttcacaaggtgcagtcgagcctaggcggaagggtgcgactgatggtgactggggcagcccctgtatccgctacagtgctgacttttctccgtgcagctttggggtgtcagttttacgaaggatatggacagaccgagtgcacagcgggatgctgtttaacaatgcccggagattggactgccggacacgtcggcgcaccaatgccctgtaatctgataaaactggtggatgtcgaggagatgaattatatggcagctgaaggcgagggcgaggtgtgcgtcaaaggtccgaacgttttccagggataccttaaggaccccgcaaaaacggccgaggctcttgacaaagacggctggctacatacaggggatatcggcaaatggctgcctaatggtacactgaagatcattgatagaaaaaaacacatttttaagttggctcagggggagtatattgccccagaaaagatcgagaacatttacatgcgtagcgaaccagtggcacaggtgttcgtgcacggagagtcacttcaggcttttttgattgctatcgttgtacctgacgtggagacgttatgttcttgggcccagaagcgagggttcgagggaagctttgaggagctttgccgaaacaaggatgtgaagaaagcaatacttgaggacatggtccgcttggggaaagattctgggttaaaacccttcgagcaagtgaaaggtattacgttgcaccccgagttattctccatagacaatggcctgctgacccctactatgaaggccaaacgaccagaactgcgaaactactttagaagccagatcgatgatctgtacagcacgatcaaagtgtag

SEQ ID NO: 213289 - DNA, 2163 bp, Artificial Sequence
  Description of Artificial Sequence: Synthetic coding sequence
atgaataatcatgtgtcgagcaagcctagcactatgaagctcaagcatacgatcaatccaatccttctttactttatccactttctgatcagcttatacaccatcctaacctatatacctttttatttttttagtgagagccgacaggaaaagagtaaccgcattaaagccaagcccgtgaacagcaaaccggatagcgcctaccgctccgtgaactctctggacggactggcatccgtgttataccccggatgtgataccctcgacaaggtgttcacatatgccaagaacaaattcaaaaacaaacgcctcctcggcacacgcgaagtcctgaatgaggaggacgaagtccagccaaacgggaaaatcttcaagaaagtaatactggggcagtataactggttgagctacgaggatgtgtttgtaagagcctttaacttcggcaacggcctccaaatgctgggtcagaagcccaagactaacattgcaatcttctgcgagactagagccgaatggatgatcgctgcacaagcgtgtttcatgtacaacttccagctagtcacattgtatgcgacgctcggcggaccagccattgtgcacgcactgaacgaaacggaagttacaaatattattacttccaaggagctgctccagaccaaactgaaggacattgttagtctggttcctcgactgaggcacattatcaccgtcgacggtaaacctcccacgtggagtgaattccctaaggggatcatcgtccacaccatggcagccgtggaagcactgggcgcaaaggcctccatggagaatcagcctcacagcaaaccactgccatctgatatcgctgtgatcatgtatacctccggtagcacaggactacctaaaggagttatgattagccactctaatatcatcgctggcattacaggaatggcagaaagaatcccagaactgggggaagaggatgtgtatatcggctatcttccactggcacatgtccttgagttaagtgcggagcttgtctgccttagccacgggtgtcgcataggatattcgagcccacaaactcttgctgatcagtcttcaaagatcaaaaaaggctcaaaaggggataccagcatgctgaagcctacactgatggctgccgtccctgagatcatggaccgaatttataaaaacgtcatgaacaaggtgagtgagatgtctagctttcagcggaatctgttcattttggcgtacaactacaagatggaacaaatatcaaaggggagaaatacccccctctgtgattccttcgtattccggaaagttcgcagcctgctaggcggtaacatccgcctgctcctgtgcggcggtgccccactctcagccaccactcagaggttcatgaatatttgcttctgttgtcccgtcgggcaagggtatggtctgaccgaatccgctggcgctgggacaatctccgaggtgtgggattacaacacgggtagagtcggcgcaccattagtctgctgtgaaataaaacttaagaattgggaagaagggggatacttcaacaccgacaagcctcacccaaggggtgagatcttgattggtggacagtccgttaccatgggatattataaaaatgaggccaagaccaaagccgacttcttcgaggacgagaacggccagagatggctgtgtacaggcgacataggggagtttgaacctgatggctgtctgaagatcatagacaggaaaaaggaccttgtcaagctgcaggcaggggagtatgtgagtctgggaaaagtcgaggcggctctgaaaaacttgccattggtggataatatctgcgcctatgcaaatagctaccacagctatgtcatcgggtttgtagttcccaatcaaaaagagctgaccgagctggctagaaagaaaggtttgaaagggacatgggaagagctgtgcaactcatgtgagatggagaatgaggtcctgaaagtgcttagcgaggcagcaatcagtgcctctctcgaaaaattcgagatccctgttaagattagactttcacccgagccttggacaccagaaacgggcctggttactgacgcgttcaagctgaagcgcaaggagctgaagacgcactaccaggctgacattgaacgcatgtatggcaggaaatag

SEQ ID NO: 213290 - DNA, 2163 bp, Artificial Sequence
  Description of Artificial Sequence: Synthetic coding sequence
atgaataaccatgtttcttcaaaaccatctacaatgaaactaaaacacaccatcaatcctatactcctgtacttcatccacttcctgatctcactgtatacgatcctgacctacatcccgttctactttttctccgagagtagacaggagaaatctaatcggatcaaggccaagcccgttaacagcaaacccgattcagcgtatcggtctgttaacagtctagacggtctcgctagcgtcctgtaccctggttgtgataccttggacaaagtatttacctacgccaagaacaagtttaagaacaagcgactcctgggcacacgcgaggtgttgaacgaggaggacgaggttcagccaaatggcaaaatatttaaaaaagttatcctggggcagtacaactggctctcatatgaggacgtattcgtgagagcgtttaattttggcaatggccttcaaatgcttggacagaaacctaaaaccaatatcgcgattttctgcgagactcgcgctgagtggatgatcgcagctcaggcctgctttatgtataatttccagctagtcacattgtacgcgactcttggagggcctgccattgttcacgccttgaatgagacagaggtgaccaatattatcacctctaaagaactgttacaaaccaagctgaaggatatcgtgtcactcgtccccagacttcgtcatataataaccgtggatggcaagccaccaacctggtcagaattccccaaaggcattatcgtgcataccatggcggcagtggaagcactaggtgccaaggctagtatggagaatcagccccattctaaaccgctgccgagcgacatcgccgtgattatgtatacgtctgggagcactggcctgccaaaaggcgtcatgatttcccattcgaatataatagcgggaatcactggcatggctgagcgtatcccagagctaggtgaagaggacgtatacatcggctacctacctctggcccatgtgctggagctgtctgccgaactggtttgtctcagtcatggatgccggattggatatagctcacctcaaactttggctgaccaatcaagcaagatcaagaagggatccaagggtgacaccagtatgctgaaacccactttgatggcagctgtacccgagattatggaccggatctacaagaacgtcatgaacaaagtgagcgagatgagcagttttcagcggaatctgtttattttggcatacaactataagatggagcagatttcaaagggcaggaacactcccctgtgcgattcgttcgtctttagaaaggtccgatccctcctggggggaaatattaggctgctgctgtgcggcggagcccctctctctgctacaacccagagatttatgaacatttgcttctgctgcccagtgggccaggggtacgggctgacagagagcgctggcgctggtaccatctcagaggtgtgggattataacacaggcagagtgggagctcctcttgtgtgttgcgaaattaagctgaaaaattgggaggagggcggatattttaacaccgataagcctcacccgcgtggggaaatacttatcggcggtcagtctgtcactatggggtactataaaaacgaagccaagaccaaagccgacttcttcgaggatgagaatggccagaggtggttgtgtactggcgatattggggagttcgagccagacggctgccttaagatcatcgaccgtaaaaaagacctggtcaaactgcaggcaggagaatatgtctctctcgggaaggtggaagctgcgttgaagaatctgccattggtagacaacatttgcgcgtatgccaattcctaccattcttacgtaatcggatttgtggtacctaaccagaaagagcttaccgagcttgcacggaaaaaaggcctcaagggtacctgggaggagctttgcaattcctgcgagatggagaacgaagtgttaaaggttttaagcgaggcagcaattagcgcgagtctcgaaaaattcgagattcccgtgaagatacgactcagtcccgagccttggaccccagagacaggtctagtcacggatgcattcaagttgaaacggaaggagcttaaaactcactatcaggctgatatcgaacgcatgtacggtcggaagtag

SEQ ID NO: 213291 - DNA, 267 bp, Artificial Sequence
  Description of Artificial Sequence: Synthetic coding sequence
atgaataatcatgtttctagtaagccttcaactatgaagcttaagcataccattaatccaatcctgctgtacttcatccacttcctgatctctctctacaccattcttacctacattccgttctactttttttccgaatcacgacaggaaaaatccaatcgaataaaggccaaaccagtgaacagcaagccagattccgcctatagatccgtcaattctctggacgggctggcctcagtactgtatccagggtgcgacaccctctag

SEQ ID NO: 213292 - DNA, 288 bp, Artificial Sequence
  Description of Artificial Sequence: Synthetic coding sequence
atgaataaccacgtctccagtaagccttccacaatgaagctgaagcacaccatcaatcccatcctcttatacttcatccattttctcatttcgctttacacaattttgacatatatacccttttactttttcagcgaaagtagacaggagaaatccaaccggattaaagcaaaaccagtgaatagtaaaccagacagcgcctataggagcgttaacagtctggacggcctggcctccgtcttatatcctggttgcgacacgctggacaaagtgtttacctacgcgtag

SEQ ID NO: 213293 - DNA, 2052 bp, Artificial Sequence
  Description of Artificial Sequence: Synthetic coding sequence
atgctgttcatcttcaacttcctcttctctcccctcccgacgcctgctttgatctgcatcttgacgtttggtgctgccatcttcctgtggcttataacccgccctcagcccgttctgccactccttgatttgaataaccagtccgtgggaatcgagggaggggctcgaaaaggagttagccagaagaataacgacctgacatcctgttgcttctcggacgctaagactatgtacgaagtgttccaacggggtctggccgtctcagacaatgggccttgtcttggctatagaaagcctaatcagccctaccggtggttatcatataagcaagtttccgatcgcgctgagtacctggggtcctgtctgttacataaagggtacaagtccagcccagaccagtttgtgggaatcttcgcccagaaccggccagagtggatcatcagcgaattggcgtgctacacatactccatggtggcagtgcccctctacgatactctcggacctgaagcaattgttcatatcgtaaacaaggcggacattgcgatggtgatctgcgatactcctcagaaggcactcgtgctgattggtaacgttgaaaaagggttcaccccatccctgaaggtgattattctgatggatccctttgacgatgacttgaagcaacggggagagaagtcgggaattgaaattctgtctctgtatgacgcagaaaacttaggtaaagaacactttagaaagcccgtgcctccgagcccggaggatctctctgtcatttgcttcacctcagggacaacgggagatcccaaaggagcaatgattacccatcaaaatattgtcagcaatgccgcagcatttctgaagtgcgtggagcacgcttacgagcccacacccgacgatgtggccatttcctatctgccgctcgcacatatgttcgagcgaattgtgcaagctgtggtctatagctgcggtgccagagtcggcttctttcaaggggacataagactgctggcagacgatatgaaaaccctgaagcctaccctgtttcccgctgtgcctcgcttgctaaaccgcatctatgataaggtacagaacgaggctaaaactccattgaagaagtttctcctgaagcttgccgtgtctagcaagttcaaggagctccaaaaaggaattataaggcatgacagcttttgggacaagttaattttcgctaaaatccaggatagcctcggtgggagggtacgagtcatcgtaactggagcggctcctatgtccacaagtgtgatgaccttttttagagccgctatgggctgtcaggtgtatgaggcgtatgggcagaccgagtgcacagggggttgcacattcacgctgcccggagattggaccagtggccatgtgggcgtgccactggcctgcaattacgtaaagttagaagacgtggctgatatgaattactttactgttaataatgagggcgaagtgtgtatcaagggcaccaacgtcttcaaggggtatctgaaggacccggaaaaaacccaggaagccctggacagcgatgggtggctgcacactggtgatatcgggaggtggttgcccaacggaactttgaaaatcatagacaggaagaagaatatcttcaagttggcacagggcgagtacatcgccccagaaaaaattgagaatatatacaatcgcagccagcccgtgttgcagattttcgtacatggagaatcgctgcgctcctcactggtcggcgtggtggtgccggatacagacgttctcccatcattcgcggctaagttgggcgttaaaggctctttcgaagagctgtgccagaatcaagtggtgcgcgaggctatcttggaggatctgcaaaaaatcggaaaggagtctggtcttaagacgttcgagcaggtaaaagccatctttctgcacccagaacccttctctattgagaacgggctcctgactcctactttaaaggcaaaaaggggagagctgtccaaatacttccgcacacagatagattcgctgtatgagcacattcaggattag

SEQ ID NO: 213294 - DNA, 2052 bp, Artificial Sequence
  Description of Artificial Sequence: Synthetic coding sequence
atgctgttcattttcaatttcctgttttcccccctgcccacccctgctcttatctgcatcctaacctttggagcagccattttcctctggttgatcaccaggccccagcccgtcctaccattgctggatttgaataatcagtcggtcggcattgaagggggtgctcgcaagggtgtctctcagaagaacaacgacctcactagttgttgcttctccgacgcaaagactatgtatgaagtatttcagcgagggctggcggtatccgataatggcccttgtttgggctatcgcaagccaaatcagccttatagatggctgtcctataagcaagtgtctgacagggcagaatatctgggctcctgcttattgcataaaggttacaagtcctcccctgaccagttcgtgggaatctttgcgcagaatcgcccagagtggattattagtgaacttgcttgctatacctatagcatggtagcagttcccctctatgatacgctcgggccagaggcaattgtccacattgtcaacaaggctgacatcgctatggtgatctgcgataccccgcaaaaggccctcgtgttgatcgggaatgtggagaaaggttttacacccagcttaaaggtgattatcctgatggacccgtttgacgacgatctgaagcagcgaggagagaaatctgggatcgagattctgagcctctatgatgctgagaatctgggcaaagagcactttcgtaagcctgtgcctccaagccctgaggacttgagtgtgatatgcttcacttcaggtaccacaggtgatcccaaaggagccatgatcacccatcagaacatcgtctctaacgctgccgcttttctgaagtgtgtcgaacatgcatacgagcctacgccagacgacgtggcaatcagctatctcccactcgctcacatgtttgagcgcatcgtgcaggctgttgtatactcctgcggcgctcgtgtgggatttttccagggtgacatcagactcctcgccgacgatatgaagactcttaagccaacattatttcccgcagtgccgagactcttaaatcgcatatacgataaggtccaaaatgaggccaaaacacctttaaagaaattcttgctaaagctggcagtgagtagcaagttcaaggagctccaaaagggcatcatcagacacgattcgttctgggacaagctgatcttcgccaaaatccaggactctctggggggacgcgtgcgtgtgatagttactggcgctgcaccaatgagcactagtgtgatgacctttttccgggctgccatgggatgtcaggtgtatgaggcatacggacagactgagtgtaccgggggttgcacattcacgttaccaggtgactggacctcggggcatgttggtgtgccactagcgtgtaactatgtcaaattagaggacgtcgccgacatgaactacttcaccgtgaataacgagggcgaggtatgcataaaaggcactaacgtgtttaagggctatctgaaagaccccgaaaagacccaggaggccctggatagcgacggatggctacatacaggcgatattggcaggtggctgcctaacggcactttaaagattatagatcggaaaaagaacatattcaagctggctcagggagagtatattgcgcctgaaaagattgaaaacatatacaataggtcacagcccgtactccagatcttcgtccatggagagagcctgagaagcagtctggtgggagtagtagtaccagacacagacgtgttgccctcctttgccgctaagcttggagtaaagggaagcttcgaggagctatgtcaaaaccaggtggtgagagaagctattctggaggacttacaaaaaattggcaaagaatcagggctgaaaacattcgaacaagttaaggccatattcctgcaccctgaacccttcagcatagaaaatggtttgttgacccccaccctgaaggcgaaacggggagaactgtcaaagtactttagaacacagattgattcactgtacgaacatatacaggactag

SEQ ID NO: 213295 - DNA, 2220 bp, Artificial Sequence
  Description of Artificial Sequence: Synthetic coding sequence
atggacgcgctgaaaccgccatgtctctggcgaaatcacgagagaggaaaaaaagatcgagatagctgcggcaggaagaatagtgagcctggctcgccacattcccttgaggcacttcgtgacgcagcacccagccaaggactgaattttttgcttctattcacaaagatgctgttcatatttaacttcctgttttcaccactaccaactccagcgctcatctgtatactcaccttcggtgctgctatttttctgtggcttattacgcgtccgcagcctgtgctacctctgctggaccttaataaccagagtgtcggcattgaggggggtgcgcgaaaaggcgtgtcccaaaaaaacaatgacctgacctcctgctgctttagcgacgctaagactatgtatgaggtgttccagcgtggcttggccgtttccgacaatgggccatgcctagggtataggaaacccaatcagccttatagatggctgtcttacaagcaagtctcagaccgggcagaatatctgggctcatgcctgctgcataaaggatataagtcaagccccgaccaatttgtggggattttcgcacagaaccgccctgagtggataatttctgagctcgcctgctatacctactccatggtggctgtcccactgtatgacactttagggcctgaggccatagtccatattgtgaacaaggcggacattgccatggtgatctgtgacactccgcagaaggctttggtgctaattggaaatgtcgaaaaaggattcactccatccttaaaggttatcattttaatggacccgtttgacgacgatctcaagcagcggggagagaagtctggaatagagattctgtccctctatgatgcagagaacctcggtaaagagcactttcgcaagcccgtgcctcccagccctgaagacttgagtgtaatttgtttcacttctgggactaccggagaccccaagggcgcaatgattactcaccagaacattgttagtaacgcagctgcttttctgaaatgtgtggagcacgcctatgagccgacacccgacgacgtggctataagctacctgccactagctcacatgtttgagcggattgtgcaagcagtcgtatactcgtgtggtgccagagtggggttcttccagggcgacatacgcctcctggcagacgacatgaaaaccctgaagcccaccctgtttccagcagtgcctcggcttctgaaccgaatttatgataaggtgcagaatgaggccaagacaccgctcaagaaatttctgctaaagctagcagtgtcatctaagttcaaggagcttcagaagggtataatccggcacgactctttctgggataagctcatctttgctaaaattcaagactcacttgggggtcgtgtgagggtgattgtcactggggctgcccctatgagcacaagcgttatgacatttttccgcgctgccatggggtgtcaggtgtacgaggcttacgggcagaccgagtgcaccggcggatgcaccttcaccctcccaggggattggacaagcggacacgtcggcgttccactcgcatgcaactatgtaaagctcgaggatgtggctgatatgaattactttacagtgaacaatgaaggcgaagtctgcattaagggtactaatgtttttaaaggctacctgaaagatccggaaaagactcaagaggctctggacagtgatggctggttacacaccggagacataggacgctggcttcccaacggaaccctgaaaatcattgatagaaagaaaaacatcttcaaactggctcagggggaatatatcgccccagaaaaaatcgaaaacatatataatcggtctcagccagtacttcagatcttcgtgcatggcgaatcactgcggtcatcgctggtgggagttgtagtgcccgataccgatgtactgcctagttttgctgctaaactgggggtcaagggtagctttgaggagctgtgccagaatcaggtggtaagggaggccatcctggaggatctgcagaagattggcaaggagtctggtttgaaaactttcgaacaggtaaaagccatcttcctgcatccagaacccttcagcattgaaaatggtttgctgactcctacgctgaaggcgaagcggggagaactgagtaagtacttccgcacgcagattgactcactgtacgaacatattcaggattag

SEQ ID NO: 213296 - DNA, 1398 bp, Artificial Sequence
  Description of Artificial Sequence: Synthetic coding sequence
atgctttttccaggagcatccatagtgccagagtgttggttgcttgtgctcattcagaatctgggcaaagaacattttaggaagcccgtgcctccttcccccgaggacttgtcagtgatctgtttcaccagcggcactaccggagaccccaaaggagctatgatcacccatcagaacatcgtctccaacgccgctgcattcctgaaatgcgttgaacacgcttacgaacctactcccgacgacgtcgctattagctacctgcccctggcacatatgtttgagcggattgtccaggctgtagtttactcatgtggagcaagggtcggtttcttccagggtgacatccggctcctcgccgacgacatgaagacactgaagcccaccctattcccggcagtccctcgcttattgaacaggatatatgataaagttcagaacgaagccaagaccccactgaagaagttcctgctgaagcttgctgtcagtagcaagttcaaggagctgcagaaaggaatcatcagacatgattcgttctgggataagctgattttcgccaagattcaagactctctggggggacgcgtgcgcgtcatcgtgacgggggcagccccaatgtcaacatcagtgatgacattctttagagcagcgatggggtgtcaggtgtatgaagcttatggacagaccgagtgcaccgggggatgcacatttactttaccaggagattggacgagcgggcatgttggagtgcccctggcctgtaattatgttaagctcgaggacgtggctgatatgaactatttcacggtcaataacgagggcgaagtgtgcataaagggtactaatgtctttaagggttatctcaaggaccctgagaaaacccaggaagctctggactccgacgggtggcttcacaccggcgacatcggacgctggctacctaatggtacgctcaaaatcattgacaggaagaagaatatttttaagcttgcacagggcgagtatatcgctcccgagaaaattgaaaatatttacaaccgcagccagcccgtactccagatttttgttcacggtgagtctttgaggtcatctctcgttggggtggtggttccagatacagacgtgctgcccagcttcgccgcaaagctgggagtgaaaggcagcttcgaggagctgtgccaaaaccaagtcgtgcgggaagcaatcctggaggatctgcagaaaatcgggaaagaaagcggactcaagacatttgaacaagtgaaagccattttcttgcacccagaaccattttcgattgagaatggactgctaacacccaccttgaaggcgaaaaggggcgagctaagcaaatatttccgtacccaaatcgactctctttatgagcatatccaggattag

SEQ ID NO: 213297 - DNA, 2052 bp, Artificial Sequence
  Description of Artificial Sequence: Synthetic coding sequence
atgctgttcattttcaactttttgttctctcccctgcccacacctgccctgatttgcatcttaactttcggcgcagcaatattcttgtggctcatcacccgacctcagcccgtgttgcccctcctcgatctgaataaccaaagcgttgggatcgaggggggtgccaggaaaggtgtttcgcagaaaaacaatgatctgacctcctgttgttttagtgatgctaaaacaatgtatgaagtcttccaaaggggtctagctgtgagtgataacggcccatgcttaggctatcgtaagccaaatcaaccctatcgctggctgagctacaaacaagttagtgatcgcgcagaatacctgggttcttgtctgctgcacaaaggctataagtcctctccagatcagtttgtggggattttcgcgcagaatcgacctgagtggatcatttccgagcttgcctgttacacctattctatggtggccgtcccactctatgatacactaggccctgaggctattgtccatatcgtgaataaagccgatattgcaatggtcatttgtgacacaccacagaaggcactggtcctcatagggaacgtggaaaagggattcacccctagcctgaaggtaatcatactgatggatccctttgacgacgacctcaagcagcggggagagaagagcggcattgagatcctgtcactatacgacgctgagaacttgggcaaagaacacttcagaaaacccgtgcctcccagtccagaggatttgagtgtgatatgctttacatctggaaccacaggagatccgaaaggcgcaatgatcacacaccaaaacatagtcagcaatgccgcagctttcctcaaatgcgtcgaacatgcatatgaaccgaccccagatgacgttgcaattagttatctcccccttgctcatatgtttgaaaggatagtacaggctgttgtgtactcttgcggcgcaagagtgggcttcttccaaggagacattagactgttagcagatgacatgaagaccctgaaaccaaccctgttccccgctgtgccccgactgcttaatagaatttatgacaaagtgcagaacgaggccaaaaccccgttgaaaaaattcttactaaagctagcagtctcgagcaaattcaaggagctgcagaaaggaattattcgacacgactcgttttgggacaaattgatcttcgcgaaaatacaagacagcctgggcggacgggtgcgcgtcattgtgacaggtgcagctccgatgtctacttcagttatgaccttttttcgcgcagctatgggctgtcaagtctatgaagcgtatggacaaactgagtgcaccggaggatgcaccttcactttacctggagactggacaagcgggcacgttggagttcctttggcgtgcaattatgtgaagctcgaggatgtggcagacatgaattacttcaccgtcaataatgaaggggaagtgtgcatcaaaggcaccaatgtgtttaaaggctacctcaaagaccctgaaaaaacacaggaagccctggatagcgacgggtggcttcacaccggggacataggtaggtggctgccaaatgggactctgaagattatcgatagaaaaaaaaatatctttaaactcgcacaaggagaatatatcgcgcctgagaagattgaaaatatctacaatcgcagccagcctgtgcttcagatcttcgtgcacggagaatcgttgcgctccagcttggttggcgtggttgtgccagataccgacgtactcccctcatttgccgcaaaactcggggtgaaggggtcatttgaagagctgtgccagaaccaggtcgtgagggaggcgattctcgaggatctacaaaaaattgggaaggagagtggtctcaaaacatttgagcaggtgaaagcgatcttcctgcatcctgagccgttctcaatagagaatggcctgctcaccccaacactgaaggccaagagaggagaactttcaaaatatttccggacccagatagacagcctctacgagcacattcaagattag

SEQ ID NO: 213298 - DNA, 1980 bp, Artificial Sequence
  Description of Artificial Sequence: Synthetic coding sequence
atgttgtttatttttaatttcctgttttctccactgccaacccccgcattgatctgcatattgacattcggggctgccatttttctgtggcttattacaagaccacagccagtgttgcctctactggatcttaacaaccagagcgtggggatagaaggcggtgcaaggaagggagtttcacaaaagaataatgatctgacctcatgttgtttctctgatgctaagactatgtacgaagtcttccagcggggactggcggtgagcgacaatggtccatgcctgggctaccggaaaccaaatcagccctataggtggctgagttataagcaggtgtccgacagagcagaatacttgggtagttgtctgctccacaagggctacaaatcaagtccagatcagtttgtgggcatcttcgcccaaaacaggccagaatggatcatctctgaactggcatgttatacttactcaatggttgctgttccactgtacgacacgctcggcccagaagccatagtccatatagtgaataaggctgatatcgcaatggtaatctgcgacacaccacagaaagcactggtcttgatcggcaatgttgaaaaagggttcaccccaagcctgaaggttatcatccttatggatccgtttgatgacgacctgaagcagaggggcgaaaagagcggaatcgaaatcctttccctctacgacgcagaaaacctaggcaaggaacacttccgcaaacctgtgccgccatccccggaagatctctccgtcatatgctttacatctgggacaaccggagatcctaagggcgctatgatcacccatcaaaacatagtcagtaatgccgctgcgtttctcaaatgcgtcgagcacgcctacgaaccaaccccggatgatgtcgctatctcctacctgcctcttgcccacatgttcgagaggatcgtccaagccgttgtgtacagttgcggcgcacgcgtaggattctttcagggggacattcgccttctagcggatgacatgaagacgttgaaaccaacactcttcccagcagtgccacgtctgctgaaccgcatctacgacaaagttcagaacgaagctaaaacccccttaaagaagttcttgctgaaactcgctgtgtcgtcaaagtttaaggagctgcagaaagggataattcgtcacgacagcttctgggataagctgatcttcgcaaagatccaggacagcctcggcggtagggtgcgagtgatcgtcacaggggctgctccgatgagtacaagcgtcatgacattctttagggctgctatgggatgccaagtgtacgaagcttatggacagacggagtgcacgggaggctgcacattcaccctgcctggagactggacgtctgggcacgtgggtgtaccgttggcttgcaattacgtcaaacttgaggatgtcgctgatatgaattattttaccgtgaacaatgagggggaagtgtgtatcaagggtactaatgttttcaagggctatctaaaagatcccgagaagactcaagaagctctcgactcagacgggtggctccacaccggagatatcgggcgatggctacccaatggaacactcaagataatcgacaggaaaaaaaacattttcaaacttgcccaaggggagtacattgcccctgagaagatagagaatatttacaataggagtcagcctgtgttacagatctttgtgcacggcgagtccctccgcagtagcttggtcggagtcgtcgtgcctgatacagacgtcttaccttccttcgccgctaaactcggggtcaaggggagctttgaggaattgtgtcagaatcaggttaaagccatcttcctccatcccgagcctttttcaattgagaatggcttgttaacacccaccttgaaagctaagcggggtgaattgtcaaaatatttccgaacacaaatcgatagtctctatgaacacattcaggattag

SEQ ID NO: 213299 - DNA, 2169 bp, Artificial Sequence
  Description of Artificial Sequence: Synthetic coding sequence
atgctgactttttttctagtgagcgggggatcgctatggctcttcgtagagttcgtgttaagcctactcgagaagatgcagacccaagagatattgcgcatcttaagattgcccgagctcggcgatctcggacagttctttcgatctctgtcagcgaccaccctagtgtccatgggcgcactcgccgcaatccttgcttattggtttacgcaccggcctaaggccctgcagcccccttgcaatttgctaatgcaatctgaggaagtggaggacagtgggggagctagacggtctgtgattggcagcggaccacagctactcacacattactacgatgatgctagaacgatgtaccaggtttttcgtcggggactgtccatctctggcaatggaccatgcctcgggttccgtaagcccaagcagccctaccagtggctgagctaccaggaggtggccgaccgggctgagttcctgggctccgggctgctgcagcacaactgtaaagcatgtactgatcagttcatcggcgtgttcgcccagaatcgccctgagtggataattgttgagctggcgtgttacacctattcaatggtggtcgtccccctgtatgacacactgggccctggggctatacgatatatcattaacaccgccgatattagcactgttatcgtggacaagccgcaaaaggccgtgctgctcctggagcacgtggagcgaaaggaaactccgggactgaaactgatcattcttatggaccccttcgaggaagctctgaaggagcgaggacagaaatgcggcgtagtgatcaaaagcatgcaggcagttgaggactgtggacaggaaaatcaccaggccccagtaccgccacagcctgatgatctatccatcgtttgcttcactagtggaacaacaggtaatcctaagggtgcgatgttaacacacggaaatgtggtggctgatttttccggctttctcaaggtgactgaaagtcagtgggccccaacgtgcgctgacgttcacattagttacctccccctcgcccacatgtttgaacgcatggtgcagtcggtagtctactgtcacggaggtcgcgtgggcttctttcaaggagatataaggttgttgtctgatgacatgaaagccctttgccccacaattttcccagtggtgcctagacttctgaaccgcatgtacgataagatttttagtcaggcaaacacaccccttaagaggtggcttctcgaattcgccgcaaaacgaaagcaggctgaagtgcggagcggtattataagaaacgactccatctgggatgagctgttcttcaataagatccaggcctccctcgggggatgcgtgaggatgattgtgacgggagctgcccctgcctccccgacagtgctggggttcctgcgggctgcactgggatgtcaagtgtatgaaggctacgggcagaccgagtgtaccgccggttgtacttttactacacccggagattggacgagcggtcacgttggcgcacctctgccgtgcaaccatatcaaactggttgacgtcgaagaactgaactattgggcgtgtaagggggagggcgagatctgcgtgagaggaccaaatgtcttcaagggatatctgaaagaccccgatcggacaaaggaagcactcgattccgacggctggctccacaccggagacatagggaagtggcttccagccggaacccttaaaatcattgacaggaaaaaacacattttcaaactggcccagggcgaatacgtggcccctgagaagattgaaaatatttatatccggagccaacccgtggcccagatctacgtccatggggatagtttgaaggcattcctcgtaggaatcgtggttcccgaccccgaggtgatgccttcatgggcccaaaaacggggaatagaaggtacctatgccgacttatgtacaaacaaggatcttaagaaggcaatacttgaggacatggtgaggctgggcaaggagtccggtctccactccttcgaacaagttaaagccattcacattcacagcgacatgttctctgtgcagaacggcttgttaactccaacactaaaagccaagaggcctgaattgcgtgagtatttcaaaaagcagatcgaggagctttactccatatccatgtag

SEQ ID NO: 213300 - DNA, 1869 bp, Artificial Sequence
  Description of Artificial Sequence: Synthetic coding sequence
atgcagacacaggaaatattgcggattctaagactgcccgagctcggggatctcgggcagttcttcaggtcattgtctgccactacgctggattcaggcggtgcaaggaggagtgtcattggatccggtccccagttgttaacacattactatgatgacgctcgcactatgtatcaagtcttcagacggggactatcgataagcggaaatggaccctgtctcggattccgcaaacctaagcagccgtatcaatggctctcctaccaggaagttgccgatcgggcagaatttctcggatccggccttctccagcataactgtaaagcctgcaccgatcagttcataggggtgtttgctcaaaacagaccagagtggattatcgtcgaactggcctgctatacatactccatggtagttgtccccctgtacgataccttggggcctggtgctatcagatatattattaacaccgctgacatcagcacagtcattgttgataaacctcaaaaggccgtgcttctgctggagcatgttgagcgaaaagagactccagggctcaagctgattattttgatggaccctttcgaggaggctctcaaggagaggggacagaaatgtggggtcgtgataaaaagtatgcaggcagtggaagactgtggtcaagagaatcaccaggccccagtgcctccgcagcccgacgacctatccatagtgtgtttcacaagcggaacgaccgggaatccaaagggcgcaatgcttacacatggcaacgtcgtggcagacttctctggattcctgaaagtgacagaaggcgacatccgactgctgagcgacgacatgaaggccttgtgccctactattttccccgtggtaccgcgactgctcaataggatgtacgacaagatattcagccaagccaacacccccttgaagcgttggttactcgagttcgccgcaaaacggaaacaggccgaggtgcggagcggcattatcaggaacgattccatttgggacgaactgttcttcaataagattcaggcctctctaggaggatgtgtgcgcatgatagtgactggggctgccccagcgagtccaacggtgctagggtttttgagagctgccctggggtgccaggtgtacgaaggctacggtcagacagagtgtacagctggatgtaccttcacaacacccggagactggacctcaggccacgtaggcgcacctttaccttgtaatcatatcaagctcgtggacgtggaggagctgaattactgggcatgcaaaggagagggtgaaatctgtgtgaggggccctaatgtatttaagggttatttgaaggaccccgaccggacaaaggaggcattggactctgacggatggctgcacactggggacatcggcaagtggttgcccgcaggcacattgaaaataatcgaccgtaagaagcacatatttaaattggctcaaggagagtacgtggctcctgaaaagatcgagaatatttacatacgctcccagcctgtggctcagatatacgttcacggggatagcctcaaggcatttttggtgggcatagttgtaccagatcccgaagtcatgcccagctgggctcagaagagaggtatcgaaggaacatatgccgatctgtgtacaaataaagatctcaagaaggcgatactagaagacatggtcagactgggcaaggagtcgggattgcacagtttcgagcaggttaaggctattcatattcattcagacatgtttagcgtgcagaacggactcctgactcctacgctcaaggctaagcggccagagttgcgcgagtactttaagaagcagattgaggagttgtactctataagtatgtag

SEQ ID NO: 213301 - DNA, 2094 bp, Artificial Sequence
  Description of Artificial Sequence: Synthetic coding sequence
atgcagacccaggagatcttaaggatcctaagactgcctgaactgggtgatctgggtcagttcttcagatcgttatccgccacaacactcgtttcaatgggtgcacttgccgcaatactggcatactggtttacacatcgacccaaggccctacagccaccttgcaacctcctgatgcagtcagaagaagttgaagatagcggaggtgccaggcgctctgtgatcggaagcggccctcagctgctgacccattactacgatgatgcaaggacaatgtaccaggtgttccgacgtggattgtcaatttcgggtaacggaccatgcctgggcttccgaaagccaaaacagccttaccaatggctgagctatcaggaggtcgctgatcgcgctgaattcctggggtctggacttctccaacacaattgtaaagcctgcaccgaccagtttatcggtgtcttcgcacagaatcggcctgaatggataatcgttgagttggcctgttacacatattctatggtggtggtgcccctgtacgacactttgggccctggagccattcgttatattattaacaccgcagacattagcaccgtgatcgtggataagcctcagaaagctgtgctgctgctggaacacgtggagcgtaaagaaacacccggtctgaaattgatcattctgatggacccatttgaggaagctctaaaggagaggggacagaagtgtggagttgtcattaaatccatgcaagcagtagaagactgtggccaggaaaatcatcaggcccctgtgccgcctcagccagacgatctcagtatcgtgtgtttcacttcggggacgaccggaaatccaaagggggctatgctcacacacggtaacgtggttgctgacttcagtgggtttctcaaggtaaccgaaaaggtgatctttccacgtcaggatgatgttctgattagctttctgccattagcccacatgttcgaacgtgttatacaatcagtggtgtattgtcacggaggcagggtagggtttttccagggcgatatccgcctcttgtcagacgatatgaaggcactgtgccccaccatattccctgtggtgccacgcctgttgaaccgtatgtatgacaagattttctcccaggccaatacaccactgaagagatggctcctggaattcgccgcaaaaaggaagcaggccgaagtgcgtagtggcataatcaggaatgattcaatctgggatgagctgttcttcaacaaaatccaggcaagcttgggcggatgcgttaggatgattgtgacaggagctgcacctgctagccctaccgttctagggtttttgcgagctgcacttggttgccaagtttatgaaggctacggacagactgaatgtacagccggatgcaccttcacgactcccggtgactggactagcgggcatgtgggcgctccactcccatgtaaccacatcaagttggtggatgtggaagaattgaactattgggcctgcaaaggagagggtgagatctgcgtgcgcggaccaaacgttttcaaagggtatctgaaagacccggaccgaactaaggaggctcttgatagcgatgggtggctgcataccggtgatatcggaaagtggctccccgcagggactcttaagatcattgatcgtaagaagcatatatttaaacttgcccaaggcgaatatgttgcaccagagaagatagagaacatctatatcagatcccagccagtagctcaaatctacgtccacggggattcccttaaggctttcctggttggcatcgttgtacccgatcctgaagtgatgcccagttgggcccagaaacgtggcatagaaggtacctatgccgacctctgtacgaataaggacctgaaaaaggcaatattggaagacatggtgcgcctcgggaaggagtctggcttacattccttcgaacaggttaaggcaatccatattcactcagatatgttttcggtgcagaacggattactcacccctacgctcaaagctaaaagacccgaactcagagagtactttaagaagcaaatcgaggaactttactccatttccatgtag

SEQ ID NO: 213302 - DNA, 2094 bp, Artificial Sequence
  Description of Artificial Sequence: Synthetic coding sequence
atgcagacacaggaaattctgcgaatcttacgcctgcccgaactgggcgatctgggccaattctttagatcccttagcgctaccacactggtgtccatgggggcactagctgccattctcgcatattggtttacacatcgaccaaaagctctgcagccgccttgcaacctgttgatgcaaagtgaagaggtcgaagacagtgggggagccaggcgctcagtgattggcagtgggccacaactgctcactcattactacgacgatgcaaggaccatgtaccaagtctttcggaggggactgtctatttcaggcaacgggccatgcttaggctttcgcaaaccaaagcaaccttaccaatggctgtcctaccaggaagtggctgacagagcagagtttctgggatctggattgcttcagcataattgcaaggcttgtactgaccaatttattggggtgttcgcgcagaaccgtcccgagtggatcatcgtggaactggcgtgctacacctacagcatggtggtagtgcctctgtacgacacactgggcccaggagccatccgatacataattaataccgcggatatctccacggtcatcgtggataagccccagaaagccgtgctcctgctggagcatgtagaacgcaaggagacacctggtcttaaacttattatcctaatggacccttttgaggaagccttgaaagagagaggacaaaaatgtggggtggttatcaagagtatgcaggctgtggaggactgcggccaggaaaatcaccaggctcccgttccaccacaaccagacgatctcagcatcgtctgctttacctctggcaccactggaaatccaaagggggctatgctgacccacgggaatgtggtggctgatttttcaggttttctcaaggtcactgagagtcagtgggcacctacttgcgctgacgtgcatattagttatcttcccctcgctcacatgttcgaaaggatggttcagtccgtcgtgtattgccatggtggaagggtcggattctttcagggggatatcaggctcctcagtgacgatatgaaagctctctgccccactatttttcccgtcgtgcccagacttttgaaccgaatgtatgacaaaattttcagccaggccaacaccccccttaagaggtggctgcttgaattcgctgccaaaaggaagcaggctgaggtccgttcaggtattatcaggaacgactccatttgggacgagttattcttcaacaaaatccaggcatctctgggtggttgcgtgcgcatgatcgtgacaggtgcagctcctgcatcaccgactgtcctgggctttctgcgcgctgcactagggtgtcaggtgtacgagggatatggccagacggaatgcacagcaggctgtacctttaccacccccggagactggacctctggacatgttggggctccactgccatgcaaccatattaagctggtggacgtcgaggagctgaactactgggcgtgtaagggggagggcgagatctgtgtgcgcggtcccaacgtcttcaagggctacctgaaggaccctgacagaacaaaggaagctctggactcagatgggtggctgcacacaggggacattggcaagtggctgccggcaggaaccctgaagattattgacaggaaaaagcacattttcaagcttgcccaaggcgagtatgtagcaccagaaaagatcgagaatatctatattagatctcaacccgttgcgcagatttacgtccatggcgattccctgaaagcgtttctagtcggcattgtggtcccagatccagaggttatgccatcctgggcacagaaaagaggcatcgaagggacgtatgctgatctctgcacaaacaaagacctgaaaaaagctattttggaggacatggtgaggctcggtaaggagtctggcctgcacagcttcgagcaggtgaaagccatacacattcacagcgatatgttcagtgtccagaacggcttgttaacgcccaccttgaaggccaagaggcctgaactgcgcgagtatttcaaaaaacagatcgaggaactttactcaatttccatgtag

SEQ ID NO: 213303 - DNA, 2127 bp, Artificial Sequence
  Description of Artificial Sequence: Synthetic coding sequence
atgcccgaatttgtgctgagcctgctggaaaagatgcagacccaggagatcctgagaatattgcgactgccagagttgggcgatctcggccagttctttcgatccctgagcgctacaactctggttagcatgggagctctcgcagcaattttagcatactggtttacacatcgcccaaaggcattacagcctccgtgcaatcttctgatgcaatctgaggaggtcgaggactctggtggggctcgtaggagtgtgattggttccggccctcaacttctcactcactactacgacgacgccagaacaatgtaccaagtgttccggagaggtctatccatcagcggtaacggtccatgtttgggcttccgaaaacccaagcagccttaccaatggctgagctatcaggaggttgcagatcgcgctgagttcctaggttcagggctgctgcagcacaactgcaaagcctgcactgatcaatttataggagtattcgcccaaaaccggccagaatggattatcgttgagcttgcgtgttatacctatagcatggtggtggtgccactgtacgacaccctgggccctggagcaattagatacataatcaacacagccgatattagcactgttatcgttgacaaaccacagaaagctgtcttgctcctggaacatgtggaacgtaaagaaaccccgggtctgaagctgatcatactgatggatccgtttgaagaggctcttaaggaacgaggacaaaaatgcggagtggtgatcaaatctatgcaagccgtggaagactgtggacaggaaaatcatcaggcacctgtcccaccccagcctgatgacttgagcatcgtttgctttacgtccggcactacaggtaatccaaaaggggcaatgctgacacacgggaacgtcgtagccgacttctccgggtttctgaaggtcacagagaaagtcatcttccctcggcaggacgacgtcctcattagttttctccctctcgctcatatgttcgaacgcgtcatccagtctgtcgtttattgccacgggggtcgggttggtttctttcaaggcgacatcaggctcctgtccgacgacatgaaagcactgtgcccaactattttcccagtggttccaagactacttaaccgcatgtacgacaaaatcttctcacaggctaacacacctttgaagagatggctccttgaattcgccgctaaacgcaagcaagccgaggtgaggtccggaatcatccgaaacgattccatttgggacgaacttttcttcaacaaaatacaggcctcactcggaggatgcgtgcgcatgattgtgacgggagccgctccagcatcaccaacggttctgggctttctgcgggcagccctggggtgtcaagtatacgagggctacggccagacagagtgtaccgcgggatgcacgttcactacacctggggactggacctctggccacgtgggggcacctctgccttgtaatcatattaagctggtggatgtagaagagctgaactattgggcgtgtaaaggagagggggagatttgtgtcaggggcccaaacgtctttaaggggtatctcaaggatcctgaccgtactaaagaggctctggacagtgatggttggctccacacaggggacatcgggaaatggcttcctgcaggtacactcaaaattattgatagaaagaaacatatttttaaattggcacaaggcgagtatgtggcacccgagaagatcgaaaacatctacatccgatcccagcctgtggcccaaatctatgtccacggcgatagtctcaaagcgttcctggtggggattgtcgttcccgacccggaagttatgccctcttgggcgcaaaaacggggtattgaaggcacttacgccgacctgtgtacgaacaaggatttaaaaaaagctatactagaggacatggttcggcttggcaaggaaagcgggttgcactcctttgaacaagttaaggcaatccacattcactcagatatgttcagcgtgcagaacgggctcctgaccccaacactgaaggctaaaagaccagagctgagggagtatttcaaaaagcagatcgaggaactgtactctattagcatgtag

SEQ ID NO: 213304 - DNA, 2004 bp, Artificial Sequence
  Description of Artificial Sequence: Synthetic coding sequence
atgcagacacaggaaatcttgcgaattctgagattgcccgaactgggggacctcggccagttctttcgctccctatcagccactaccctggtctctatgggagccctggccgcaattttagcctattggttcacacaccgtcctaaagcgctgcaacctccttgtaacctcttgatgcagagcgaagaagtcgaagactcaggtggagctcgacgctccgtgattggttctgggccacagcttctgactcactactatgatgatgcacgcactatgtatcaggtcttccggcgtgggctatcaatctccgggaatggcccatgtttggggttccgcaagcctaagcagccttatcaatggctgtcataccaggaagtggctgatagggccgagtttctagggtctgggctcttacagcacaactgtaaggcctgtaccgatcagtttatcggcgtgttcgctcagaaccggcctgagtggattatcgtcgaactagcctgctacacttatagtatggtggtggtgcctttatatgacactcttggtcctggtgcaataaggtacatcatcaacaccgccgatatctccacagttatcgtggataagccgcagaaggcagtactgctcttggaacacgttgagcgcaaagagacgcctgggcttaagctcattatcctgatggatccctttgaggaagcactgaaggaacggggacagaaatgtggcgtggtgatcaaaagcatgcaggccgtagaagattgtggccaggagaaccatcaagcaccagtgcctcctcagcccgacgacttgagtatcgtatgtttcacctcaggaactacaggcaatccaaagggggctatgcttacccatggaaacgtcgtggccgacttttcaggcttcctcaaagtcacagaaagccagtgggcccctacgtgcgctgacgtccacatttcttacctgcctcttgcgcatatgtttgagcggatggttcagagcgtcgtttactgtcatgggggacgggtaggcttttttcagggtgacatcagactcctttcagacgacatgaaggccctgtgtccaacgatttttccagtcgtccctagactgctgaatagaatgtatgacaaaatcttctcccaagccaatacacccctcaagcgatggctgctggagtttgcagccaagcgaaagcaggctgaggttagaagcggcataatccggaacgatagtatttgggatgaactgttctttaataagatccaagccagtctgggcggatgtgtgcgcatgattgtgaccggagctgcccctgcctcacccacagttctcggtttccttagagcagcgctcgggtgccaagtatacgagggttatggccaaacggaatgtaccgcaggctgcacctttacaaccccaggcgactggacatctggacatgtgggcgctccgctcccttgcaaccacattaaactggtcgatgtggaagagttgaactactgggcatgcaaaggcgagggtgagatctgcgtgagggggcctaacgtgttcaaaggctacctcaaagatcccgaccgcacgaaagaggctctggacagtgatggttggctgcacaccggcgacattggtaaatggctgcctgcaggcactctgaagatcatcgatagaaaaaagcacatttttaaactggcgcagggagagtacgtcgcccctgagaagatagaaaatatatatattagatcccaacctgtggctcagatatacgtccacggcgactcattgaaggcttttctggtgggaatcgtcgtgccagatccagaagtgatgccttcctgggcccagaaacggggaatcgaaggcacatacgcagatctttgcaccaataaggacctgaaaaaggctatcctcgaagatatggtgagacttggcaaggaatccgggctccactccttcgaacaagacctcccccaatgcctgattcagatcaaagtgttcagcaaatattag

SEQ ID NO: 213305 - DNA, 2169 bp, Artificial Sequence
  Description of Artificial Sequence: Synthetic coding sequence
atgctgactttttttctcgtttctggtggtagtctctggctgtttgttgagtttgtgctatctctccttgaaaaaatgcagacccaggagattctcagaatccttcgcctcccagagctcggcgatcttgggcaattcttccggagtctatccgcgaccaccttggtctctatgggggcactggcagcgattcttgcttattggtttacgcatcgacccaaggccttacagcccccatgtaatctcctgatgcagtccgaggaggtggaagatagcgggggagcgaggcgatccgtcatcgggtccggccctcagttgttgacacattactacgacgacgcccgaactatgtatcaggtgtttaggagaggcttatctattagcggcaacggaccctgtcttggctttcgcaaacccaaacagccctaccagtggctcagctaccaggaggtggccgaccgcgcagaattcttggggagtggtctgttgcagcacaattgtaaggcttgtacagaccagtttatcggagtctttgcccaaaacagaccggagtggatcattgtggagctcgcatgctacacgtactctatggtggtcgtgcctctgtatgatactctcgggcctggggctattagatacatcattaacacagcggatatatctaccgtcatcgtagataaaccccagaaggccgtgcttttactcgaacacgtagagcggaaagaaacaccaggcctgaaattaatcatacttatggatcctttcgaagaggcgctcaaagagaggggacagaaatgtggcgtcgttattaaaagcatgcaggccgtagaggactgtggtcaggagaatcatcaagcccctgtgcctccccaaccagatgatttgtcaatagtgtgtttcacctcggggacgaccggcaatcccaaaggggctatgcttacccatggcaatgtggttgcggacttctccggctttcttaaagtaactgagaaagtcatcttccctagacaggacgacgtgctcatttcttttctgcctctggctcatatgtttgaaagagtcatccagagcgtcgtgtattgccacggcggtcgcgtaggcttcttccaaggcgacataagattacttagtgacgatatgaaggcactatgtcctactatttttccagtggtgccacgcctgcttaacagaatgtatgacaagatctttagtcaagccaacactccccttaagaggtggcttcttgaatttgctgcaaagaggaagcaggccgaggtaaggagcggaattattcgcaacgactccatctgggatgaactgttttttaataagattcaggcctccctcggcggatgtgtgcggatgattgtgacgggtgctgcgccagcttcccctactgttctcggttttcttagagctgcccttggttgccaagtgtatgagggctacggacagactgagtgtacagctggttgtacattcaccaccccaggtgactggacatctgggcacgtgggcgctcccctcccctgtaatcatattaagctcgttgacgttgaagagctaaactattgggcttgcaagggcgagggagagatctgcgtcagaggaccaaatgtctttaagggataccttaaggatcccgataggacaaaagaggcactggatagcgacggatggctgcacactggagacataggaaaatggcttccagccggtaccctgaagatcatcgatcgcaagaagcacattttcaaacttgcgcagggcgaatatgttgcccctgaaaaaattgaaaatatctacatcaggtcacagcccgtcgcgcagatttatgtacatggcgattctctgaaggcttttcttgttggaatcgtggttccggatccggaagttatgcccagttgggctcagaagagaggtatagagggtacctatgctgatctttgcactaacaaggatctcaagaaagccatcctagaggatatggtgaggttggggaaggagagcgggctgcactcctttgaacaagtcaaggcgatacacattcactcagatatgttttctgtgcagaatggcctgcttacaccaacgctgaaggctaaaaggcctgaactaagggaatactttaaaaagcaaatcgaagaattatactctatatccatgtag

SEQ ID NO: 213306 - DNA, 2139 bp, Artificial Sequence
  Description of Artificial Sequence: Synthetic coding sequence
atgcagacccaggagatcttacgtattttgcgcctaccagaattgggagatctgggacagtttttcaggagtctctctgcaactactcttgtttccatgggcgcactcgctgccatcctcgcttactggtttactcaccgccctaaggctttacagccgccatgcaatctgctgatgcagagcgaagaagtggaggatagcgggggagctagaaggagcgtgatcggttcaggccctcaacttttaacccattattacgacgacgccagaacaatgtaccaggtgttccgcaggggtctgtcgattagcggaaacggcccttgccttggattccgcaagcccaagcagccatatcaatggttgagttatcaggaagtagccgacagagccgagtttctgggctctgggctgttgcagcataattgcaaggcctgcaccgatcagttcattggagtgtttgcgcagaaccggcctgaatggatcatcgtcgaattggcatgttatacttacagcatggtggttgtccccctttacgacaccctgggtccaggagccatcagatacatcatcaacaccggtctgagttgtcaggaaggtgcctccgccacagcctccacccaggctgacatttctactgtgatcgtcgacaaaccgcagaaggctgtgctgctccttgagcatgttgagcgaaaagaaacaccagggctcaagttaatcatactgatggatccatttgaggaagctctgaaagaaaggggccaaaagtgcggagtggtaattaagtctatgcaggcagtggaagattgtgggcaggaaaaccaccaagcccctgtccctccacaacctgatgatttgtccattgtatgtttcaccagtggtaccactggtaatcctaagggggcaatgctgacacacggtaatgtcgtggcggacttctcgggattcctcaaagtgacggaaaaggtaatcttcccaagacaggacgacgtccttatatcatttctccctcttgctcacatgtttgagagggtgattcaatccgtcgtctattgtcacggcggaagagtgggatttttccagggggacattagactgctgtcagacgacatgaaggccctgtgccctaccatattccccgtggtgcctcgcctgctcaataggatgtatgacaagatcttcagtcaggccaacactccactcaagcgttggcttctggagttcgcagcaaagcgcaaacaagccgaggtcaggagtggaatcatccgtaacgactcaatatgggacgaacttttctttaataaaatccaggcctctctcggtgggtgtgtccggatgatcgttaccggcgctgcccctgcgagtcccaccgtgcttggttttcttcgggctgccctcgggtgccaagtgtacgaaggctatgggcagacagaatgtacagctggatgcaccttcacgacccccggtgactggacgtccggccatgtaggggctccgttaccctgtaaccacattaagctggttgacgtcgaagaacttaattattgggcctgcaaaggggaaggtgaaatttgcgtgcggggacccaatgtgtttaaagggtacctgaaagaccccgatagaacaaaggaagcactggatagtgacggctggctgcatacgggagacattggtaagtggttacctgccggaaccctgaaaatcatcgaccggaaaaagcacatattcaagctggcacaaggcgagtatgtggcgcctgaaaaaatagaaaatatttacattcgcagccagcccgtagcccagatttatgtgcatggagactctttaaaggccttcctcgttgggatagtggtgcctgatccggaggtgatgccctcttgggcacagaaacgtggcattgaaggtacttatgccgacctatgtaccaacaaggatctcaagaaggcaattctggaggatatggtccgactgggtaaagagagcgggctgcacagcttcgagcaggtcaaggctatccacattcacagcgatatgttttccgtgcagaacgggctattgacacctactctgaaagctaagcggccagagttacgggaatatttcaaaaaacagattgaggagctgtattcgatctctatgtag

SEQ ID NO: 213307 - DNA, 2094 bp, Artificial Sequence
  Description of Artificial Sequence: Synthetic coding sequence
atgcaaacccaagagatactgcggattctgcgtctgccggaactgggcgacctcggacaattttttcgatctctgagcgctacgacactggtgtctatgggagccttggctgccattctggcatactggtttacgcacagacccaaagcactccagccaccttgtaacttgcttatgcagagtgaagaggtcgaggactccggaggtgctcgacggagtgtgattggcagcgggccacagctgctgacccactactacgatgacgcgagaaccatgtatcaggtctttaggagaggactctctatctctggcaatggcccatgtcttgggttccggaagcccaagcagccttatcagtggctgtcgtaccaggaggtggccgatcgagccgaatttctgggcagcgggctgctacagcacaattgtaaagcctgcactgatcagtttatcggagtgtttgcacagaacaggccagaatggattattgttgagctcgcctgctacacgtactctatggtcgtcgtgccactctatgatacactcgggccaggcgctattcgttacattatcaatactgctgacatctcaaccgttatcgtggacaagccgcaaaaggccgtgctgctcctggagcacgtagaacgtaaggagactcctggtttgaaacttatcatattgatggaccccttcgaggaagcactcaaagagagggggcagaaatgtggggttgtgataaaatcgatgcaagccgtggaggactgcggtcaggagaaccatcaagcaccggtacctccccagcctgatgatctgagtatcgtctgtttcacatcaggtactacgggcaaccctaagggagctatgctgacccacggcaatgtggtagcagacttcagcggatttttgaaagtcacagagagccagtgggctccgacttgcgccgatgtacacatatcttatttgcccctggcccacatgtttgagcgcatggtgcagtccgtcgtgtattgtcacggtggacgcgtgggcttctttcagggtgatatcaggctgctatctgatgatatgaaagccctgtgtccaacgatttttcctgttgtgccaagattgctcaatcgcatgtacgataagatcttttcccaggctaatacccctctcaaacgatggctgttggagttcgctgcaaagaggaaacaggcagaagtcagatcgggcattatacgtaatgattcaatttgggatgaattatttttcaataaaatccaggcaagcctgggcggatgcgtccgcatgattgtgacgggcgctgcacctgcatcgcctaccgtccttggattcctgcgggctgccctcgggtgccaggtttacgagggttacggccagactgaatgcacagcaggttgtacctttactacacctggcgattggactagtggccacgtgggggcacctctgccttgtaatcatatcaagctcgttgatgtggaggaactcaattactgggcgtgcaaaggcgaaggggagatctgcgtgagaggtccgaacgtgtttaaaggttatctcaaggatccagaccggaccaaggaggctctcgatagcgatggctggctccatacgggggatattggaaagtggctgccggctgggacactcaaaattatagataggaaaaagcacatattcaagctggctcagggggaatatgtagcgcctgaaaagatagagaacatttatataagatcccagccggttgcacagatttacgtgcatggagattcgctgaaggcttttcttgtagggatcgtggtacccgatccagaggtgatgccaagttgggcgcaaaagagggggatcgagggtacatacgcggacttatgcaccaataaagacctgaagaaggcaattctagaggatatggtcaggcttggtaaggaatccggactccattctttcgaacaggtcaaagcaattcacatccattcggacatgttttccgtgcaaaacggacttctgacacctaccctgaaagccaagcgccctgagctgagggaatactttaagaaacagattgaagagttatatagcattagtatgtag

SEQ ID NO: 213308 - DNA, 1821 bp, Artificial Sequence
  Description of Artificial Sequence: Synthetic coding sequence
atgtaccaggtgtttcggaggggactgtctattagcggaaatgggccttgtttaggcttcagaaagcccaagcagccatatcaatggttaagctaccaggaggtggccgacagggctgagttcctcggcagcggactgcttcagcacaattgcaaggcttgcaccgatcagttcatcggtgtctttgcacagaatagacctgagtggattattgttgagctagcatgctatacctacagtatggtcgtcgtgccactgtacgacactttaggcccaggggctattagatatattattaataccgcagacatcagcacagtcattgtcgacaagccccagaaagccgtccttctgttggaacacgtggaacgcaaagagacacctgggctgaaattgatcatacttatggatccattcgaggaagcactgaaggagagaggacagaagtgcggcgtcgtaattaagtcaatgcaggctgttgaggactgcggccaggagaaccatcaggccccagtgccaccccagcccgatgacctctccatcgtctgttttacctcaggaactaccgggaacccaaagggcgctatgctgacacatgggaatgttgtggcggatttctcgggctttctcaaggtgaccgaaaaggtcatctttcctaggcaagatgacgtgctcatatcattccttcctctggcccatatgttcgaacgtgtaatccaatctgtcgtttactgccatgggggtcgtgtgggcttctttcagggcgacatccggctcctatcagatgacatgaaggctctctgccctacaatcttccctgtcgtgcccagactcctcaatcgtatgtacgataaaatcttctctcaggccaatactccccttaagaggtggctgctcgagtttgccgctaagcggaagcaggccgaggttcggtcaggaatcattcgaaatgactccatttgggatgagctcttctttaataagattcaggccagtttagggggttgcgtgcggatgattgtgactggagcagcacctgcaagcccaaccgtcctggggtttctcagggctgctttaggctgtcaggtttacgaagggtatggccagaccgagtgcactgcagggtgtactttcactactccaggggactggaccagcggacatgtgggggctcctttgccctgtaatcacattaaacttgtcgacgtggaggaactcaattactgggcctgtaagggcgagggtgagatctgcgtgcgtgggccaaacgtgttcaagggttatttgaaggatcccgataggaccaaagaagccctcgactcagatggatggctgcacaccggggacatagggaaatggctccccgcagggaccctgaagattatcgacaggaaaaagcacattttcaaactcgcacaaggagagtatgtagcgcctgagaagatagaaaatatctatattcgctcacagcctgttgctcagatctacgttcacggagacagcctgaaggcattcctcgtgggcatagtggtgcctgacccagaggtcatgccctcatgggcacagaagcgaggaatcgaaggcacctacgccgatctgtgcaccaacaaagatctgaagaaagcaattcttgaagacatggtgcgcctgggcaaggaaagtggacttcatagcttcgaacaagttaaagctatccacatccattccgacatgttcagcgtgcaaaatgggctgttgacgcctaccttaaaggccaaacgacctgaactaagggagtacttcaaaaaacagatagaggagctctacagcatctccatgtag

SEQ ID NO: 213309 - DNA, 1386 bp, Artificial Sequence
  Description of Artificial Sequence: Synthetic coding sequence
atgtcccgccaagtggtcagatccagtaaattccgacatgtatttgggcagccagctaaggccgatcagtgctacgaagacgtgagagtctctcagacaacatgggatagtggcttttgtgccgtcaacccgaagtttgtggcccttatctgtgaggcctctggaggaggcgctttcttggttttgccactgggcaaaacagggagggtggacaaaaacgccccaacggtgtgtggtcacaccgcccctgtacttgacatcgcctggtgcccccataacgacaacgtgatcgcatcaggtagcgaggattgtacagttatggtgtgggaaattcctgatggaggattgatgctgcccctgcgggagcccgtcgttaccttggaggggcatacaaaaagggtcgggatagtagcatggcacacaaccgcacaaaacgtactgctctcagccggatgcgataatgttatcatggtctgggatgtcggcacaggagccgcaatgcttacattaggtcctgaggtccatccggacacaatttatagtgtcgattggagtcgggatggaggcctcatatgtacgagttgccgtgataagcgggtcaggattatcgaaccaagaaaggggacagtggtcgcagagaaagaccgcccacacgaaggtacgagacctgtgagggctgttttcgtgtccgaggggaagattttgacaactggattctctaggatgtcagagcggcaggtggccttatgggacacgaaacacttagaggagccactcagtttgcaggagttggataccagctccggagtcctgctgcctttttttgatcctgacaccaacatagtgtatttgtgcgggaagggggatagttccatccggtactttgagatcacttctgaggcaccatttctgcattacctgtctatgttttccagcaaggagagtcaaaggggcatgggctacatgcccaaacggggactggaagtgaataagtgcgagattgctagattttataagctgcatgaacgacgctgtgaaccaatagccatgactgtcccaaggaaatctgacctgtttcaggaggacttgtaccccccaacggctggaccagatcccgctctcaccgccgaggagtggctaggagggcgtgatgccggacccctgttaataagccttaaagacggctacgtgccacccaaatcaagagaactcagagtgaaccggggattagatacggggagaaggagggctgccccagaagcctctggcacacctagttctgacgctgtgtccaggcttgaggaggagatgcgcaaactgcaggccaccgtacaggaactccagaaacgcctcgatcgcctggaagaaacggtgcaagcgaaatag

SEQ ID NO: 213310 - DNA, 1734 bp, Artificial Sequence
  Description of Artificial Sequence: Synthetic coding sequence
atgcagtggctaatgaggtttaggaccttgtggggcattcataagtcttttcacaacattcaccccgctccatcacagcttagatgtaggtcactgagtgagtttggcgctccgaggtggaatgactatgaggtgcccgaggaatttaactttgcctcttacgtcctcgattactgggcccagaaagagaaagagggaaaaagaggacccaacccagccttctggtgggtaaacggacagggagacgaagttaaatggagcttccgggaaatgggggatcttacacgcagagtcgcgaatgtcttcacacaaacctgcggactgcagcagggcgatcacctggccctgatgctgccgagggtgcctgaatggtggctggtggctgtggggtgcatgagaaccggcataatattcatcccggctactatcctgctgaaggctaaggacattctgtatagattgcagctgagcaaggcaaaaggaatcgtgactattgacgcccttgccagcgaagtggactcaattgctagccagtgcccttctctgaaaacgaagctgctcgtgagcgaccacagtcgggaagggtggcttgattttcgcagtctggtgaagtccgcatcaccggagcacacatgtgtgaaatcaaagacactcgacccaatggtgatcttctttacatccgggacaaccggattccctaagatggctaagcatagtcatgggctcgccctccagccatcattcccgggttctcgaaagctccgtagcctgaagaccagtgatgtgtcctggtgtctcagtgacagcggatggattgtggctaccatctggacactggtggaaccctggaccgccggttgtactgtctttattcaccatcttccacagttcgatacaaaggtgatcattcagaccttgctgaagtatccaatcaatcacttttggggcgtgtccagcatttacagaatgattcttcagcaagacttcacctctattcgcttcccagccctcgagcactgctataccggcggagaagtcgtcctcccaaaagaccaggaagaatggaagagaagaaccggtctgctgctctacgaaaactatggtcagagcgagaccggcctaatctgcgctacttactggggtatgaagatcaagccaggcttcatgggaaaagccacacccccttacgatgtgcaggtgattgatgataagggaagcatcctgcctcctaatactgaagggaacatcggaattcggattaaacctgtgcgaccggtctccctctttatgtgttacgaaggggaccccgagaaaactgccaaggtcgaatgcggcgatttttacaacacaggcgataggggaaaaatggacgaagaaggctatatctgttttctcggtcgatctgatgacattattaacgcctcaggctatcgaataggccctgcggaggttgaatctgccctggtcgaacacccagcagttgcagagagcgcagtggttgggtctcccgatcctatccgaggggaggtcgtcaaggccttcattgtgctgaccccacagttccttagccacgataaggaccaattgacaaaggagctacagcaacacgtgaaatcagtgaccgcaccatataagtatcccaggaaagtggagtttgttagtgagcttcctaagactatcactggaaaaattgaaagaaaagagctgagaaagaaggaaaccggacagatgtag

SEQ ID NO: 213311 - DNA, 1734 bp, Artificial Sequence
  Description of Artificial Sequence: Synthetic coding sequence
atgcagtggttgatgaggttcagaacactgtggggaattcataagagctttcacaacatccatcctgccccatcacagctgaggtgtcggtctctgtccgaattcggtgcaccacgttggaatgactatgaggtgcccgaagagttcaactttgcatcttatgtgttagactactgggcgcagaaggagaaagaagggaaaagagggccaaaccctgccttctggtgggtgaacggccagggcgacgaggtgaaatggtcgttcagagagatgggagatctcacgaggcgggtggcgaacgtgtttacccaaacctgtgggctccagcagggagatcacctcgccctgatgctaccaagagtcccggaatggtggttggtcgcagtgggatgcatgaggacaggcatcatctttattcctgccactatcttgctcaaggctaaggacatattgtacagactacagctttctaaggctaagggcatcgtcactatcgacgccctggcctccgaagtagactctatcgcttcacagtgccccagtttgaagacaaaactgttggtctcagaccactcacgggagggttggctcgactttaggagcctcgtcaagtctgcctcacctgaacacacttgtgtgaagagtaaaaccctggaccccatggtcatcttctttacaagcgggactactggatttcctaaaatggccaagcactcccacggactggcattgcagccatcattccccggtagcagaaagttgaggtccctgaagaccagtgacgtcagctggtgtctctccgatagcggctggatcgtggccacaatttggactctggtggagccctggaccgcaggctgtacagtcttcattcaccatctcccccagttcgacaccaaagtgatcatccagactttactgaaataccctattaaccatttctggggcgtgtccagcatttaccgtatgattctacagcaggacttcacttccatcagatttccagctttagagcattgctacactggcggagaagtggtactgcctaaggaccaggaggaatggaaaaggcgcactggacttctactgtacgagaactatgggcaaagcgaaacaggtctgatctgcgccacgtactggggaatgaagataaagcctggcttcatgggcaaagcgactcccccatacgatgtccaggtgatagacgataaaggtagtattttgcctcccaatacagaagggaatatagggatcagaatcaaaccagtccgtcctgtctcccttttcatgtgttacgagggcgaccccgagaagacagcaaaggtagagtgtggagatttctacaacaccggggaccgcggtaagatggacgaggaaggatatatatgctttctgggccgttcagacgacatcatcaacgcttctggatatcggattgggccagcagaggttgagtctgccttagtggagcatcctgcggtcgcagagtctgccgtcgttggaagcccggaccctatccggggagaggtggtgaaggcttttatcgtgttaacccctcaatttctaagccacgataaggatcagctgaccaaagagttacagcagcacgttaagtccgtaaccgccccttataagtatcctcggaaggtcgaattcgtgtctgaactaccaaaaacgatcaccggcaagatagagaggaaggagctgcgaaagaaagaaactggacagatgtag

SEQ ID NO: 213312 - DNA, 465 bp, Artificial Sequence
  Description of Artificial Sequence: Synthetic coding sequence
atgcagtggcttatgagattcaggaccctttggggcattcataagagctttcataacatacatcctgccccaagccagcttcggtgtcgctccctgagcgagtttggcgcacctcggtggaacgattacgaggtccctgaggagttcaactttgctagctatgtattggactattgggcccaaaaagaaaaggaagggaagcggggtcccaatccagccttttggtgggttaacggtcaaggagacgaggtgaagtggagctttagagagatgggcgacctcacccggcgtgtggcaaacgtcttcacacaaacatgcggccttcaacagggtgaccacctcgcactgatgttgccccgtgtgccggagtggtggctcgtggccgtcggttgcatgcgcactggcattatctttatccctgctacgatcttgctcaaagcaaaagatattctgtacagattgtag

SEQ ID NO: 213313 - DNA, 1533 bp, Artificial Sequence
  Description of Artificial Sequence: Synthetic coding sequence
atgcgacccggtctaagctttctcctggcactgctgttcttcctggggcaggcagctggcgatctcggtgatgtcgggccacctataccatcgcccggattctcttcattccctggcgtggattcatcaagttccttttctagcagcagccgatccggttccagcagttcacggtctctgggatctggcggtagcgtgtcacagctcttttcaaacttcacagggagcgtggacgatcgtggcacgtgtcagtgctcagtctctttgccggatacgacctttcctgtggatagggttgaaagattggagttcacggcccatgtgctctctcaaaaattcgaaaaagaactctctaaggtgagagagtacgtacagctgatctcagtgtatgagaagaagctgctgaatctcaccgtccggattgatattatggagaaggacacaatatcttatactgaactggatttcgagctgatcaaggtggaagtaaaggaaatggagaaactcgtcatccagttgaaagaaagtttcggagggagcagtgaaattgtcgatcaacttgaagtagaaatacggaatatgactctgctggtcgagaagctcgagaccttggacaaaaataatgtcttagccatccggagagagattgtagcactgaaaacaaagttaaaagagtgcgaagcatcaaaagatcaaaacacgccagtagtccacccaccccctacccccggttcctgcggtcacggtggggttgtcaatatcagcaaacctagcgttgttcagcttaattggcgcggattttcttacctgtacggcgcttgggggagggattactccccacagcatccgaataaaggactgtattgggtggccccactgaacaccgacggacgccttctcgaatactatcgtttatataatacactggacgatctcctgctgtacattaatgccagagagttgcggatcacatatggccaggggtccgggaccgcggtgtacaacaacaacatgtacgtgaacatgtataacacgggtaacattgcacgggttaacttgaccaccaatacaatcgccgtgacccagacactgcctaatgctgcgtataataaccggttttcctacgctaatgtggcttggcaggacattgactttgctgtggacgagaacggactgtgggtcatatattccactgaggcttctacgggaaacatggtaatatccaaactgaatgatacgaccttacaggtgctcaacacctggtacacgaaacagtacaagcctagcgcgtcaaacgcatttatggtgtgcggagtcctgtacgcaacccgcactatgaacaccagaactgaagagatcttttattattacgataccaatactggtaaagagggcaagctggatatagtgatgcacaagatgcaagagaaggtgcagagcataaattacaacccgtttgaccagaaattgtatgtctataatgacggttatctactcaactacgacctctccgtgctgcagaagccgcagtag

SEQ ID NO: 213314 - DNA, 1734 bp, Artificial Sequence
  Description of Artificial Sequence: Synthetic coding sequence
atgcactggctgcggaaagtccagggcctgtgtaccctttgggggacccaaatgagctcccgtactctgtacataaattctcgccagttggtgtctctgcaatggggacaccaagaggtgcctgccaaatttaacttcgccagcgatgttttagatcattgggctgacatggaaaaagctggtaagaggctgcccagccccgctctctggtgggtgaacggcaagggcaaggaactgatgtggaactttcgcgagctgtctgaaaactcccagcaagcagcaaacgtgctttcaggagcatgcggattacagcggggagacagggtagccgtggtactgcctagggtgccagagtggtggttagtaatcttgggctgtatccgcgcaggtctgatcttcatgccaggcaccatccaaatgaagtctaccgacatcctctaccggctgcagatgtctaaagcaaaagctattgtggcgggagacgaagtgatccaggaggttgacaccgtggcatcagaatgcccttctctgaggattaagctgctggtttctgaaaagtcatgtgacggttggcttaatttcaagaagcttcttaatgaggcctccaccacccaccactgtgtggagacaggatctcaggaagcaagcgcaatctacttcacatctgggactagcgggctgcctaagatggccgagcacagctattcgtccttgggtctgaaagcaaagatggacgcgggttggacaggactgcaggcttctgatattatgtggactatcagcgacactggctggatactgaacattctgtgcagcctgatggagccttgggcgcttggcgcatgtaccttcgtccacctcctgccaaaatttgaccctctcgttattctcaagacactgtcctcttaccctatcaagtctatgatgggtgctccaatcgtctatagaatgttgctgcaacaggaccttagtagttacaaatttcctcacctccaaaattgcgtgacagtcggagagagcctgttgcccgaaacgctggagaattggcgcgcacaaactggcctggacattagggagtcctatggccagacagagacggggctgacatgcatggtatcaaaaaccatgaagatcaaacccggatatatgggcacggctgcctcttgttatgatgtgcaaatcattgatgacaagggcaatgtcctccccccaggcactgagggggatattggcatccgggttaaaccaataaggccaataggcatttttagtgggtatgtcgacaatcctgataaaactgcggctaatatcaggggcgatttttggctactgggtgatcggggtatcaaggatgaggacggatactttcagtttatgggtagggcaaacgacattatcaacagtagtggatacagaattggtccttccgaggttgagaacgcactcatggaacacccagctgttgtagaaacagctgtgatctcgtctcctgatccagtaaggggagaagtggtgaaagcgtttgtcgtgctggcgtcacaatttttaagccatgatcccgagcaacttaccaaggagctgcagcagcatgtgaaaagcgtcaccgctccatacaaatacccacggaaaatcgagtttgtgttaaacctgcccaagacggtaaccggaaaaatacaacgtgcaaagttgagggacaaagagtggaaaatgagtggaaaagctagggcacagtag

SEQ ID NO: 213315 - DNA, 1497 bp, Artificial Sequence
  Description of Artificial Sequence: Synthetic coding sequence
atgtggaactttagggagctgagcgagaattcccaacaggcggcaaacgttctgagcggagcctgcgggctgcaaagaggggaccgcgtggccgtggtgctgccacgggtgccagagtggtggctggtaatactcgggtgcattcgcgctgggctaattttcatgcctgggacaatccagatgaagagcactgatatactgtatagattgcagatgtctaaagccaaggcaatcgtggcgggtgatgaggtcatccaggaggtggataccgtggcttctgagtgcccaagtctgcgcatcaagctgttggtcagcgaaaaaagctgtgatgggtggctcaattttaaaaagctgttgaatgaggcaagtaccactcatcactgcgtcgaaactggatcccaggaagctagcgccatatacttcactagcggaacatccggacttcctaagatggctgaacatagctacagctctctggggcttaaagccaagatggatgctggatggacaggcttgcaggcctctgacatcatgtggactatttctgacacaggatggatcttgaatattctgtgttcactcatggagccctgggctctgggcgcttgtactttcgtgcatctgctccctaaatttgaccctctcgtgattctgaagaccctgtcctcctaccccatcaaaagcatgatgggcgctcctattgtctaccgcatgcttttacagcaggacctatcaagttataaatttccacacttacagaattgcgtgactgtgggtgaaagcctgctccccgaaaccctggaaaactggcgggcacagacaggtttagatatcagggagagctacggccagactgaaaccgggttaacctgcatggtttcaaaaaccatgaagataaagcctgggtacatgggaacagccgctagttgctatgatgtccagattattgatgacaaggggaacgtgttgccaccaggaactgagggtgatattgggatcagagttaagcctattcgtccaattggaattttttcaggctacgtagacaaccctgacaaaacggccgctaacattaggggagatttctggctgctcggtgacagaggaatcaaggacgaagatgggtacttccagtttatgggacgggctaatgacatcatcaattcttccggctatcgcattggcccaagcgaagtggagaatgctctgatggaacatccagccgtggtcgagacagctgtaatctcttctcccgatcccgtcaggggcgaggtggtaaaggccttcgtggttctggcctcgcagttcttatcacatgatccggagcagcttaccaaagagttacagcagcatgtgaagagcgttaccgcaccatacaagtatccccgaaagatcgaattcgtcctcaatctgcccaaaacggtgaccgggaagatccagagagccaaattacgcgataaggagtggaagatgtctggtaaagccagggcgcagtag

SEQ ID NO: 213316 - DNA, 627 bp, Artificial Sequence
  Description of Artificial Sequence: Synthetic coding sequence
atgcactggctgagaaaagtgcagggcctgtgcaccctttgggggacccaaatgtcgtccagaacgctctatattaattcaaggcagctagtctcccttcagtggggccatcaggaggtaccagctaagtttaatttcgcctccgatgtgctcgaccattgggccgacatggagaaggctggcaagagacttccaagtcccgctctctggtgggttaacgggaaaggcaaagagcttatgtggaattttagagaactcagcgaaaactcccagcaggccgctaatgtcctttccggagcttgcggtctgcagcgaggagatcgggtagctgtagtgctccccagggtccccgagtggtggctagtgattctgggttgtattagagccggactgatttttatgccagggaccatccaaatgaaatctacagatattctgtaccgcctgcagatgtccaaagccaaggccattgtggctggggacgaagtgattcaagaagtggatacagtggcaagcgaatgtccaagtctgaggatcaaactgttggtatcagagaagtcatgcgacggatggctcaattttaagaagttactgaagtataaagtccgacacagagacgtgaagtag

SEQ ID NO: 213317 - DNA, 1050 bp, Artificial Sequence
  Description of Artificial Sequence: Synthetic coding sequence
atgcgtcatccacccctcataacagtgtggcgattggaagctaagatggacgcaggctggacagggctgcaagctagcgatatcatgtggactatctccgataccgggtggatcctgaacattttgtgtagtttaatggagccctgggctcttggggcttgtacattcgtccacctgctgcctaagttcgaccccttggtaattctgaaaactctaagttcctatccaattaagagtatgatgggcgctcctatagtatataggatgttactgcagcaggacttgtcttcctataagtttccccacctccagaattgcgtgactgtgggagagtctctacttcctgagaccctggagaactggcgtgcacagactgggctcgacatccgggaatcatacgggcaaaccgaaaccggactgacatgcatggtttccaagacaatgaaaatcaaacctggatacatgggcaccgcagcttcatgttatgatgttcaaatcatcgatgataaaggcaacgtcctccctcccggtaccgaaggtgatattggcataagggtgaagcctatcagaccaattggaatcttttcaggctacgtcgataatccagataagactgcagcaaacatcaggggggatttctggctcctgggagatcgcggaatcaaggacgaagatggctattttcaatttatgggcagggccaatgacatcataaacagctctggctaccggatcggtcccagtgaggtcgagaatgctctgatggagcacccggctgtcgtggagacagctgtgatctcatctccagatccagtgcgcggtgaggttgttaaggcctttgtagtattggcatctcaatttctctcccatgaccccgaacagctcacgaaagagttacaacagcacgtcaagtctgtcaccgccccatacaagtatccacggaagatcgagttcgtgttaaacttgcccaagactgttactggcaagatccagcgagctaaactcagagataaagagtggaaaatgtcaggcaaagctcgcgctcagtag

SEQ ID NO: 213318 - DNA, 1734 bp, Artificial Sequence
  Description of Artificial Sequence: Synthetic coding sequence
atgcactggttaagaaaggtccagggcctctgcaccttatggggcacacagatgtcttcccgcaccctgtatatcaactctaggcagcttgtatcattgcagtggggccaccaagaagtgccggctaagttcaatttcgcgagtgatgtcttggatcattgggccgatatggaaaaagctggcaagagactcccatcacctgccctctggtgggtgaacgggaagggtaaagagctgatgtggaatttccgggagctcagtgagaacagccaacaggcagccaatgtgctcagtggtgcgtgcgggttgcaacgaggcgaccgcgttgcagtagtcctgccaagagtccccgaatggtggttagtcatcttgggctgcatacgggctggcctaatctttatgccagggacaatccaaatgaaaagcacagacattctgtatcgcctgcaaatgtcgaaggccaaagccattgtggcaggcgatgaagtaatccaagaagtcgacaccgtagccagtgagtgcccaagcctgcggatcaagctgctcgtgtctgagaagtcctgcgacggttggctcaattttaagaaactgctgaatgaagctagtacaactcaccattgcgtcgaaacaggctcccaagaggcatcggctatctatttcactagcggaacatcaggcctgccaaaaatggctgagcattcttatagttctctggggctcaaagccaaaatggacgcgggatggactggtttgcaggcatcggacattatgtggaccattagtgacacaggatggatactgaatatactctgtagcctcatggagccctgggccctcggggcttgtacgtttgtccacctcctgcccaagtttgaccccttagtgattcttaagacactgagcagttaccccattaagtctatgatgggagcacccatcgtgtatcgaatgctgctgcaacaggatctgagtagctataagttcccgcacctgcaaaactgcgtcactgtgggcgagtctctgcttcctgaaacactagagaactggagagcgcaaaccgggcttgacattcgggagagctacgggcagactgagacaggcttgacctgtatggtgagcaagaccatgaaaataaagccaggatacatggggaccgccgcatcctgctatgatgtgcagatcatcgatgataaggggaatgtgctaccccctggcaccgagggcgacatagggatccgcgttaagcctattaggcctattggcattttctcaggatatgtggacaatcctgacaagacagctgctaatattaggggcgatttctggctgcttggagatcgagggatcaaagacgaggatggttacttccagtttatggggcgtgccaatgacatcattaactcttctggctatagaatcgggccatcagaagttgaaaacgccctaatggagcacccagccgtcgtggaaacagccgtcatcagtagcccagatccagtgagaggggaagtagtaaaggccttcgtggtcttggcctcccagtttctgagccacgatcccgagcaattaaccaaagaattgcagcagcatgtcaagtccgtgactgcaccatacaaatacccaagaaagattgagtttgtgctaaatttaccaaaaacagtgactggtaaaattcagcgagcaaaacttagagataaagaatggaagatgagcgggaaggcgcgtgcccagtag

SEQ ID NO: 213319 - DNA, 1734 bp, Artificial Sequence
  Description of Artificial Sequence: Synthetic coding sequence
atgcattggctgaggaaagtgcagggactttgtaccctgtggggcacacagatgagcagtcgcactctctacattaatagccgtcagctggttagcttgcagtggggacaccaggaggtgccggcaaaattcaatttcgccagcgatgtgttggaccattgggcggatatggaaaaagcgggtaaacgcctcccaagtcctgcgttgtggtgggtcaacgggaagggtaaggaactgatgtggaactttagagagctttctgaaaactctcagcaagcagccaacattttatcaggcgcatgtgggctgcagcgaggcgacagagtggccgtgatgctcccgagagtgcccgagtggtggttggtgatcctgggctgtattcgagccggactgattttcatgccaggtactatacaaatgaagagtaccgatattctgtaccgcctgcagatgtcaaaggctaaagccattgtcgcgggtgacgaggtgatccaggaggtggacacagtcgcgtcagaatgtcctagcctcagaatcaagttactagtgtccgagaagagctgcgacggctggctgaattttaagaaactgctgaacgaagcctccaccacccaccactgtgtggaaacaggctctcaggaggcatctgccatctacttcacatctggcactagcggtctccccaaaatggctgagcactcttactcgtctctcggactcaaagccaagatggacgccggatggaccgggctacaggcgtctgacataatgtggaccatcagcgacacagggtggatcttaaatatacttggttccctcctggagtcatggactctcggggcttgcacattcgtgcatttgctgcccaaatttgaccctctggtcattctcaaaactctttccagttatccaattaagtcgatgatgggcgctcccattgtgtatcgaatgctccttcaacaggatctctcttcatataaatttccgcacctacagaattgcctcgcaggtggtgagtctttgctccccgaaactctggagaattggcgtgctcagactggtctggatatcagggagttttatggccagaccgagaccggcctgacctgtatggtctccaagacgatgaagattaagccaggctacatgggaacagctgcgtcctgctacgatgtgcaggtgatcgacgacaaaggcaatgttctgccacccggaacagagggagatataggcatcagggtcaaacccattagacccataggtatattttccggctatgttgaaaaccctgacaagaccgctgccaacatccgaggagatttttggctcttgggcgatagggggatcaaggacgaagatgggtatttccagtttatgggtcgagccgatgatatcatcaactcgagtgggtacagaattggcccttccgaggttgagaacgccctcatgaaacatcctgccgtggttgaaacagctgtgatcagcagtcccgatccagtccgaggtgaggtggtgaaagccttcgtaattctggcgtcccagtttctgagccatgatcccgagcagttgaccaaagaactgcaacagcacgttaaatctgtaaccgcaccttataagtatccacgtaaaatcgagtttgttctcaacctccccaagactgtgacaggaaaaattcaacgcaccaagctgagggataaagaatggaagatgagtggaaaggctcgggcacaatag

SEQ ID NO: 213320 - DNA, 627 bp, Artificial Sequence
  Description of Artificial Sequence: Synthetic coding sequence
atgcattggttgcgaaaggtgcagggcctttgtaccctttggggaacacagatgagttcacggactctgtacatcaacagccgacaactggtcagccttcaatggggacatcaggaggtgcccgctaagttcaacttcgcctcagacgtcctggaccactgggctgacatggaaaaggctggaaagagactcccttccccggcactgtggtgggtcaatgggaagggcaaagaactaatgtggaactttagggagctatccgagaactctcagcaggccgcaaatattctcagtggagcctgtggcctgcagaggggtgacagagtggccgtcatgctgcctagggtcccagagtggtggctggtgatcttaggatgtatacgggcaggtctgatctttatgccgggaactattcaaatgaagtccactgatatcctgtaccggcttcagatgtccaaagcgaaggctatagtggcaggtgacgaggtgatccaagaagtggatacagttgcgtccgaatgtccttccctgcgcatcaaactcctggtgagtgaaaaaagctgcgatggttggctcaatttcaagaaactacttaagtacaaggtgcggcatagggaggtgaagtag

SEQ ID NO: 213321 - DNA, 1761 bp, Artificial Sequence
  Description of Artificial Sequence: Synthetic coding sequence
atgcttgctagggtcaccagaaagatgttgagacatgcgaaatgcttccagagactggccatctttgggtccgttagagccctccacaaggacaacaggacagccaccccacagaacttcagcaactatgaaagtatgaagcaggattttaagttgggaatcccagagtatttcaacttcgccaaggatgtgctcgatcagtggaccgataaagaaaaggcgggtaaaaaaccgagtaatcctgccttttggtggataaacagaaatggcgaagaaatgaggtggagctttgaggaactgggttcattgagccgcaagttcgcgaacattctgagtgaggcctgcagcctgcagcggggagaccgcgtgattctaatcctcccgagggtccctgaatggtggctggctaacgtggcgtgtctccggaccggcaccgttctgataccaggcacaactcagctgacacagaaggacatcctgtacagactgcagagtagcaaggccaactgcatcataactaatgacgtgctagctcccgctgtggatgcagtggccagtaaatgcgagaacctgcactccaaactgattgtttctgagaacagtcgcgaggggtggggtaacctcaaagagctgatgaagcacgcgtccgatagccatacatgtgtaaaaaccaaacacaatgaaatcatggccatcttctttacatctggcacttcgggctatcccaagatgactgcccatacccactctagctttggactgggcctgtccgtgaatggccgtttttggcttgacctgacgcccagcgacgtaatgtggaacacgtctgacacgggatgggcaaagtccgcctggtccagcgtattcagcccctggatccagggtgcttgcgtgtttactcaccatcttccacgcttcgagcccacatctattttacagacgctttccaagtaccctatcacagttttttgcagtgctcctactgtttacaggatgctggtgcagaatgacattacctcgtataagtttaagtccctgaagcactgtgtgagcgccggagagccaatcactcctgatgttacggagaaatggcggaacaagacggggcttgacatatatgagggatacggtcagacggagaccgtgctaatctgtggtaacttcaagggcatgaagatcaagcccggatccatggggaagccctcccccgcattcgacgtgaaaatcgttgacgtcaacgggaacgttctccctcctgggcaggaaggggatatcggcatccaggtgctgcctaatcggcctttcggattgtttactcactacgtggacaatccttccaaaacagcatccaccctccgcggaaatttttacatcacgggcgatcgcggatatatggataaagatggctacttttggttcgtggccagagccgacgacgtgattctcagcagtgggtacagaattggacccttcgaggtagagaacgctctcaatgaacaccccagtgtggccgaaagcgctgtggtcagtagcccagaccctataagaggcgaggtagttaaggcatttgtcgtattgaatccagattataagtcccatgatcaggaacagctgatcaaggaaattcaggaacacgtgaagaaaactactgccccttacaagtacccgagaaaagtagagttcatccaggagttaccaaagacaatcagcggcaaaaccaaacgaaacgagctccggaagaaggagtggaagacaatctag

SEQ ID NO: 213322 - DNA, 1317 bp, Artificial Sequence
  Description of Artificial Sequence: Synthetic coding sequence
atgcttgccagggtaactcggaaaatgttgaggcacgcgaaatgctttcagcggctcgctattttcggtagtgtgcgtgccttacacaaagataatcggactgccaccccccagaacttttccaactacgaatccatgaaacaggattttaagctgggaatccctgagtattttaacttcgcaaaggatgtgctggatcagtggaccgataaagaaaaggctggcaaaaaaccctcgaaccctgccttttggtggattaaccgaaacggggaggagatgagatggtctttcgaggagctcgggtccctttcccgcaagttcgctaacatcctcagtgaggcttgttccctgcaacgcggagaccgcgtgattctgatactgcctcgagtaccagagtggtggctggccaacgttgcctgcctgcgaacagggaccgtgctgatccctgggactacacaactgacgcagaaagatattctctatcggctgcaaagttccaaggccaactgcataataacaaatgacgtgttagcccctgcagtggatgcagttgcgagtaagtgcgagaatcttcatagcaaactgattgtgtccgagaactcccgcgaaggttggggtaatttgaaggagctcatgaagcacgcttcggattcacacacatgcgtaaagactaagcacaatgagataatggccatcttcttcacaagtggcacgtcaggctaccctaagatgaccgcccacacacattcaagctttgggcttggactgtcagtcaatggcagattctggttagacctcaccccctcagacgttatgtggaatacatcagataccggatgggcgaagtcagcttggtcaagtgtcttttcaccttggatccagggagcatgtgtgtttacacatcacttgcctagatttgagcccacctcgattttgcagacccttagcaagtatccgattaccgtgttctgtagtgccccaactgtctaccgaatgctggtccagaatgacatcacctcttataaatttaagtcattaaagcattgcgtgtctgcaggcgaaccaattacaccagatgtgacggaaaaatggcgcaacaagaccggcctggacatttatgaaggttatggccaaaccgaaaccgtgctcatctgcggcaattttaaagggatgaaaattaaacccggatccatgggtaaaccgtctccggcattcgatgttaaagtgtgcacctcccctagtaggcgaatgtttaacaacccaatctgcaccctcccaacctaccggctgccgccttacaagctgtcattactgtag

SEQ ID NO: 213323 - DNA, 1737 bp, Artificial Sequence
  Description of Artificial Sequence: Synthetic coding sequence
atgaaacaagatttcaagctgggcattcctgagtattttaattttgcaaaagatgttctggatcagtggaccgacaaggagaaggctggcaagaaacccagcaacccggctttctggtggatcaatcggaacggcgaggagatgcggtggtcttttgaggaattgggtagtttgtcccggaagttcgcaaacattctctctgaggcttgttctcttcaacggggagacagggtaatcttaatcctacctagagtgcccgagtggtggctcgccaacgtggcttgtctgaggaccggaactgtgctcatccctggaaccacgcagctgacccaaaaagacatcctgtatagactccagtcttccaaagctaattgcatcattaccaacgatgttctggcccctgctgtggacgcagtggccagcaagtgcgagaacctccattctaagttgatcgtgagtgagaacagccgcgaaggatggggcaatctgaaggaactgatgaaggtgtttctgtgccacccgggttggagcaccgtcgcccgatcatggctcacagccacaagcacctccctggtccaggcgattctctcattactttcctcttgggattaccggcacgcttccgattcccatacatgtgtgaagaccaaacataatgagatcatggcgattttctttacaagtggtacctcagggtacccgaaaatgaccgctcacacccacagctcttttggcctgggtctgtccgtgaacggcagattttggctggatttaactccatcagatgtgatgtggaacactagcgatacagggtgggcaaaatccgcgtggtcaagcgtgttctcaccttggattcagggagcctgcgtcttcacccaccatcttccgaggttcgagcctacttctattctacagaccctttctaaatacccaatcaccgtattctgttccgcacccacggtctaccggatgctagtgcagaatgatatcacctcttacaagtttaagtcactgaaacattgtgtttcagccggtgaacctatcacaccggacgtaactgagaagtggcgcaacaagactgggctagacatttacgagggctacggccagactgagactgtactcatctgcggaaactttaaaggcatgaagattaaacccggatccatgggtaagccgagtccagcctttgacgtgaagattgttgatgtaaatgggaatgtgcttcctccagggcaggagggagatatcggcatccaggttctacccaacaggccctttggcctattcacacattatgttgacaacccctctaagacggcatccacactcagaggcaacttttatatcaccggagatcggggatacatggacaaggacggctacttctggtttgtggcgcgagccgatgacgtgatcctcagctccggctacaggattgggccttttgaggttgaaaatgcgcttaacgaacacccgagtgtagcggaaagcgcagtcgtctcaagtcccgaccccattcgcggagaggttgtgaaggcttttgtggtcctgaatccagattacaaatctcatgatcaggagcagcttattaaagaaattcaggagcatgttaagaagaccaccgcaccctacaagtaccctcgcaaagttgagttcatccaggagctccctaagaccatctccgggaaaactaaaagaaatgaacttcggaagaaggagtggaaaacaatttag

SEQ ID NO: 213324 - DNA, 1740 bp, Artificial Sequence
  Description of Artificial Sequence: Synthetic coding sequence
atgcggccttggctcaggcatctggtgctgcaggctctgaggaactcaagggccttctgtgggagtcatggcaaaccggctccactcccagtccctcagaagatcgtggcaacatgggaggccatctcactcgggagacaattagtgcctgagtatttcaattttgcccacgacgtacttgacgtttggtctcgtctggaggaagcgggtcaccgtcctcccaacccagctttctggtgggtcaatgggacaggggctgaaatcaagtggtccttcgaggaacttggaaagcagtctcggaaggctgccaatgtgctcggcggagcatgcgggctgcagcccggagacagaatgatgctcgttctgccaagactgcctgaatggtggcttgtttctgtcgcttgcatgcgaactggcactgttatgattcccggagtaacccagctgacagagaaagacctgaagtatagactgcaagctagtcgggcaaagtcgattatcacatctgattccctggccccacgcgtggacgctatctccgctgaatgtcccagcctccagacaaaactgctcgtttcggacagttcacgccctggatggctgaatttccgcgaattgctgagggaggcatctacagagcacaattgtatgcgaacaaagagcagagatcccttggccatctacttcacctccggaaccacaggtgcacccaaaatggttgagcactcacagagtagttacggtttgggatttgttgcgagcgggcgacgatgggtcgctctaaccgaatcagacatcttctggaataccacggacaccggctgggtcaaagcggcttggaccctattttctgcatggcccaatggatcatgcatcttcgtgcatgagctacccagagtagatgcaaaggtgatcctgaatacactgagcaagtttcctatcactactctgtgttgcgtgcccacaattttcagactgctcgtgcaagaggaccttacccggtatcaatttcagtctcttcgacattgtctaaccggaggtgaagctctcaatccagacgtgcgcgagaagtggaagcatcagacaggtgtcgagctctacgaagggtacggacagagcgagacggttgtcatctgtgctaatccgaaagggatgaagattaaatcaggatctatgggaaaagcatcaccgccttatgacgtccaaattgttgacgacgagggtaacgtgctcccaccgggagaggaggggaatgtggccgttcggatacgcccaactcggccattctgcttttttaattgttacctggataaccctgaaaagacagccgcatctgagcagggcgacttctatatcacaggggatagagcaagaatggacaaagatggctacttctggtttatgggaagaaatgatgacgtaatcaactcctcctcctataggattgggccagtcgaggtggaaagtgcactggccgagcatcctgcggtcctcgaatcagccgtggtatcctcaccagatcccatccggggagaggtagtgaaagccttcatagtgctcaccccggcttacagcagccacgaccccgaagccttgacccgggagctccaggaacacgtgaaaagggttacggccccatacaaataccctcgcaaagtggcatttgtgtccgaactgccaaagactgtgtccggtaagattcaacgctccaagctgcgctcccaggagtggggaaagtag

SEQ ID NO: 213325 - DNA, 2070 bp, Artificial Sequence
  Description of Artificial Sequence: Synthetic coding sequence
atggcagccaggaccctgggaaggggggtaggcaggcttctaggctcgctgaggggactgtccgggcaacccgctagacccccatgtggagtaagcgccccaaggcgggcagctagcggaccaagtgggtccgccccagcggtcgcggctgccgctgcacagcccggatcttacccggcactgtctgcccaggccgcaagggaacccgcagcattctgggggcctttggccagggatacactggtgtgggacaccccctaccacaccgtgtgggattgcgactttagtactggtaagatcggctggttcttggggggacagctgaacgtctcggtgaattgtctggaccagcatgtaagaaagtctcccgaaagcgtcgccctgatctgggagagagatgaacccggtactgaggtgcggatcacttatcgcgagctgcttgaaacaacatgtagactagccaacacattgaagcgccacggggttcacagaggagatcgggttgcgatttatatgcccgttagccccttagctgttgccgcaatgctcgcttgcgctcgaattggggcagtacataccgtcattttcgctggcttttccgccgagagtttggcaggccgaatcaacgatgccaaatgcaaggtcgtgatcactttcaatcagggcctccgcggaggccgagtggtcgagctgaagaaaatcgttgacgaggctgtgaagcattgtcctaccgttcagcacgtattagtagcccatcgtaccgataacaaggtacatatgggggacctcgacgtccctttagagcaggaaatggcaaaagaggatcccgtttgcgcccctgagtccatgggtagcgaagacatgctgttcatgctctacacttccggctcgacaggaatgcctaaaggaatagtgcatactcaggccggatatttactgtacgcagccctcacccataagctagtattcgaccatcagcctggcgacatattcgggtgcgtcgcagacatcggctggatcacgggccattcctatgtcgtttacggccctctgtgtaatggtgcgaccagcgtgcttttcgagtctacacccgtgtatccgaacgcgggacggtactgggaaaccgttgagcggcttaagattaatcagttctatggagcccctaccgcagtgagactgttgctaaagtatggtgacgcatgggtaaaaaagtatgacaggtcctcccttcggaccttaggctccgtgggcgaacccattaactgcgaagcatgggaatggctccacagagtggtcggggattccagatgtactctggttgacacctggtggcagaccgagaccggtggcatctgtattgctccaagaccttccgaagaaggagctgagatcctgccagcaatggcaatgaggccattcttcggaatcgtcccggtcctgatggacgagaagggctccgttgtggaaggaagcaatgtttcaggggctctctgcatcagtcaggcctggccagggatggccagaaccatttacggagaccaccagagatttgtagatgcatacttcaaggcataccctgggtactatttcacaggcgatggggcatacagaaccgaagggggatattatcaaattacgggaaggatggatgatgtgattaacataagcggacacagactaggtacagccgagatcgaggacgccatagctgaccaccctgctgtacccgagtcggccgttatagggtacccccatgacattaaaggcgaagctgcattcgctttcatcgtcgtgaaagattctgccggtgattccgatgttgtcgtgcaggaactcaaatctatggtcgcaactaaaattgccaagtatgcagttcctgacgagattttagtggtgaagagactgccaaaaacacgctcagggaaggtgatgcgccgactattacgcaagattatcacaagtgaggctcaagaattaggggataccacgactctcgaagacccatctataatcgctgagattctttctgtgtaccaaaagtgtaaggacaagcaggctgctgctaagtag

SEQ ID NO: 213326 - DNA, 462 bp, Artificial Sequence
  Description of Artificial Sequence: Synthetic coding sequence
atggcagcgagaacactgggcaggggagttgggaggctcctgggctccctgaggggtctcagtggacaacctgcacgcccaccatgtggggtctcagcgcctcggagagctgctagcggaccttcaggatctgcccctgccgttgctgctgccgctgcgcagccagggtcttatcctgcactctcagcgcaagctgcgagggaacctgctgccttttggggacccctagccagggacaccctcgtatgggataccccctaccatacagtttgggattgcgacttttcgactggaaagattggttggttccttggaggacaacttaacgttagcgttaactgtctggaccagcatgttcgcaaatcaccggagagcgtggccctgatttgggaacgcgacgaacccggtacagaggtccggatcacatattccccgtggctacagatgccctgcggcccatag

SEQ ID NO: 213327 - DNA, 1455 bp, Artificial Sequence
  Description of Artificial Sequence: Synthetic coding sequence
atggcagccaggactctgggaagaggcgttgggagattgctggggagtctgagagggctttcgggacagcctgccaggcctccctgtggtgtcagcgcgcctagaagagccgcttccggaccatccggctccgcccctgcagtcgctgccgctgcggctcagcccggaagctacccagccctgagcgcccaggcggctcgagagccggcagccttctggggacctctggccagagatacactcgtgtgggataccccctatcatacagtgtgggactgcgatttcagcacaggtaaaatcggctggttcctaggaggccagctaaatgtctccgtgaattgtctggaccagcacgttcggaaatcaccagaatctgtggctcttatttgggaacgcgatgagccgggaacagaggttcgcattacctaccgggaactccttgagaccacctgtagactggcaaacacactgaaacgccacggcgtgcatcggggagatcgggtggcaatctatatgcctgtatcccccctggcagttgcagcaatgttggcttgtgcccgtatcggagcagtgcacaccgtgatcttcgccggtttctctgccgaatcactggcgggtcgaataaacgatgtgggggaacccattaactgcgaggcctgggagtggctgcatcgagtggtgggggatagtcggtgtactcttgtggacacttggtggcaaactgagacaggcggtatctgcatcgcccctcgcccttctgaggaaggtgctgagatcctccccgcaatggccatgagaccgttcttcggaatcgtgcccgtgctgatggatgagaaaggcagcgtcgtcgagggatcaaatgtgtccggcgctctttgcatatcccaagcctggcccggtatggctaggacaatatatggtgaccatcagcgcttcgttgacgcctactttaaggcctaccccggttactatttcacaggcgacggggcttatcggaccgagggaggctactaccaaataacggggagaatggatgatgttattaacataagcggtcacagactgggcactgccgagatagaagatgccatcgcggaccatcctgcagtaccagaaagcgctgttattgggtacccccacgacataaagggagaagctgcatttgcctttattgtggtcaaagattccgccggtgattccgacgtggtggtccaggagctcaagagcatggtagctactaaaattgccaaatacgccgtccctgacgaaatcctggtagtaaaaaggctccctaaaacccggagcggaaaggtgatgcggaggctgctcagaaaaattatcacgtcggaggcacaggaattaggcgatacaacaaccctcgaggacccatcgatcattgctgagattctctctgtgtatcagaagtgcaaggacaagcaagcagccgctaaatag

SEQ ID NO: 213328 - DNA, 1728 bp, Artificial Sequence
  Description of Artificial Sequence: Synthetic coding sequence
atggcggctaggactctcgggcgtggagtggggcgactgctgggcagcctgaggggcctgagcggacagccggcaagacccccatgcggggtctctgcccctcgtcgggctgcgtcaggcccatcagggtcggccccagccgttgcggcagcagcagcccaacctggctcttatcctgctcttagcgcgcaggcagccagagaacccgctgctttctggggccctcttgcgagggatactctagtctgggacactccttatcataccgtctgggactgtgacttcagcaccggtaagattgggtggtttcttggtggacagctgaatgtcagcgtgaattgtctggatcaacacgtgcggaagtcccccgagtccgtggctcttatctgggagagagacgaacccggtacagaggtgcgtatcacttaccgagaactgcttgagacaacctgcagactggcaaacaccctgaaaagacacggagtgcaccgaggagacagagttgccatctatatgccagtgagtcctcttgctgtagccgcaatgctggcttgcgcccgaatcggcgctgttcatactgtcatttttgcgggattctcggctgagtcactcgcgggaagaattaatgacgcaaaatgcaaggttgtgatcacctttaaccagggactgagggggggtagggtcgttgagctcaaaaaaatcgtcgacgaggccgtcaagcattgcccgaccgtgcagcacgttctggtggcacaccgtaccgacaacaaagtgcatatgggggacctggatgttcctctcgagcaggaaatggccaaggaagacccagtctgtgcacctgagtccatggggagcgaggatatgttgttcatgttatacacctccggctccaccggtatgcccaagggcattgttcacactcaggccggatacctcctgtacgccgcacttacccacaagttggtgttcgaccaccaaccaggcgatatcttcggctgtgtagccgatatcggctggattaccgggcacagctatgtggtgtatgggcctttgtgcaacggagccacaagcgtgttatttgagtcaacccccgtctatccgaatgctggcaggtattgggagacagtcgagcggctgaaaattaatcaattctatggcgctcctaccgcggtgagactgctgctcaaatacggtgacgcgtgggtcaagaagtacgaccgtagtagcttgcgaaccctcggatccgtgggagaacctattaattgtgaagcctgggaatggttgcatagggtcgtaggcgacagtcggtgtacactcgtggatacctggtggcaaacagaaaccggtggaatttgcatcgctcctcggccatcagaggagggggctgagatcctccctgctatggctatgcggccatttttcggaatcgtaccggtgctcatggacgagaaggggagtgtggtcgaggggagcaacgtctcaggggcactttgtatttctcaagcgtggccaggcatggctcggactatttatggagatcaccaacggtttgttgacgcatattttaaggcctatcccggatactacttcactggcgacggcgcataccgcacagaaggagggtactaccagataacagggagaatggacgatgtgattaacatcctccagattgtgggatttttccgagaggccattagaaattcaggcgatctcctagagcattag

SEQ ID NO: 213329 - DNA, 1821 bp, Artificial Sequence
  Description of Artificial Sequence: Synthetic coding sequence
atgctgaaaacctttctcttcctcgagaaatatttcccctgcatcaagtattcttcggcctgtttccccggaactggtctggacgtgtacgacatcaagtttgctgtcctcttgcatcctcaaaccgccttgcattttggaccaccaccgtccctaatggccttttcctctctttgctgtcgcgaactgttagaaacgacctgcaggctggccaacactttaaaaaggcatggggtccatcggggagaccgcgttgccatctacatgccagtgtctccacttgccgtggcggcaatgctcgcatgcgcccgtatcggcgctgtccacaccgtaattttcgccggattctcagccgaatccctggctggcaggatcaacgatgctaagtgtaaagtggtgatcacgttcaatcaagggctgcggggtggcagagtcgttgagctgaagaagatcgtggacgaggctgtaaaacactgccccactgtgcagcacgtactggtagcccataggaccgataataaggtgcacatgggggatctggatgtcccgctggaacaagaaatggccaaggaagaccctgtgtgcgctcccgagtcgatgggctctgaggacatgctattcatgttgtacacctcaggttctacaggtatgccgaaaggcattgtgcatacgcaggccggttacttgttgtatgcagccctgactcataagctggtattcgaccatcagccgggtgacatttttggctgtgtagctgacatcggctggataacggggcattcatacgtggtttatgggccactttgcaatggagctacatccgttctgttcgaatcgacacctgtctatccaaacgccggacggtactgggaaaccgtagagcggctgaaaattaaccagttctacggagctccaaccgccgtgcggctgcttctaaaatacggcgacgcctgggtcaaaaagtacgacagaagctctttacggactttgggatcagtcggagaaccaatcaattgtgaggcttgggagtggctgcaccgagtggtgggcgacagtaggtgcacattggtggatacgtggtggcagactgaaactgggggaatatgcatcgccccacggcctagtgaagaaggcgcagaaatcctgcccgctatggcaatgcgccctttctttggcattgtgcccgtgttaatggacgaaaagggttctgtggtggagggctccaatgtgtctggcgctttatgtatcagccaggcctggcctggcatggccaggacaatctacggagaccaccaaagatttgttgatgcctactttaaagcatatcctggttattacttcacaggtgatggcgcttacaggactgagggcggatattatcaaatcacagggagaatggacgacgtgattaacatctcgggccatcgcctggggaccgcagaaattgaagacgccattgccgatcatccagctgtcccagagtcagcggtgattggatacccacacgacatcaagggggaggccgcttttgcattcatcgtggtaaaagattcggcaggggactccgacgtggtggtccaggaactcaaatccatggtggcaactaagatcgccaaatatgcggtcccggatgaaatcctcgtggtgaaacggttgcctaaaacgcgttcaggaaaggtcatgcggcgactccttaggaaaatcatcacctctgaggctcaagaattaggagacacaactaccctggaagatccatctataatagccgaaattttgagtgtttatcagaaatgcaaggataagcaggcagccgcaaagtag

SEQ ID NO: 213330 - DNA, 1707 bp, Artificial Sequence
  Description of Artificial Sequence: Synthetic coding sequence
atgaggagacgaaaagagcggcagccctgggataggttccattttttgcactttgccccacacggacgcgagctcctggagaccacttgccggctggcaaacacgctaaaacgccacggggtacatcgaggcgaccgcgtggccatttatatgcctgtttctcctctcgcggttgctgccatgctggcctgcgcaaggatcggagccgtccacaccgtaatctttgccggattttccgcagaatccttagctggcaggattaacgacgccaaatgtaaagtagtgattacgttcaatcagggcctgaggggaggaagggtagtggagcttaaaaagatagtagatgaggctgtgaagcactgccctacagttcagcacgtactagttgctcacagaacagacaataaagtccatatgggcgatctggacgttccactggaacaagagatggctaaggaggatccagtgtgcgcgccagaatcaatgggatcagaggacatgttgtttatgctctacacgtctggttcaactggaatgcctaagggcatcgtccatacacaggccggttacttactctatgcggctctcacacacaagctcgttttcgaccatcaacccggagatatcttcgggtgcgtggccgatattggttggatcaccggacacagctacgttgtgtacggccctctgtgcaacggtgccaccagtgtactgtttgagagcactccggtgtatcccaatgcgggacgttattgggagaccgtggaaagactgaagatcaatcagttctacggggctccaaccgccgttagactcctcttgaagtatggcgacgcttgggtcaagaaatacgaccggagctccctcagaactcttggatctgttggggagcccattaattgcgaggcctgggagtggttgcatagggtcgtgggagacagccgttgcactctcgtagatacttggtggcagactgagaccgggggaatttgcattgcccctcgcccatcagaggagggggctgaaatcctgcccgctatggctatgaggccattttttggcatcgtaccggtgttgatggacgagaaggggtccgtggtcgaagggtctaacgtcagcggcgctttgtgcatctcacaggcctggcccggaatggcacgaaccatctacggagaccatcagcggtttgtagacgcctactttaaggcttaccccggatactattttaccggagacggcgcttaccgcacagagggcggatattatcaaatcacagggagaatggacgatgtgatcaatatatcaggccatagacttggcaccgccgagattgaagatgctattgctgaccacccagcggtgcctgagagtgctgtcattggttatccccacgatatcaaaggcgaggccgcttttgcattcattgtggtgaaggattccgcgggtgatagtgatgtggtagtgcaggaactgaaaagtatggtggcgactaaaatcgctaaatacgctgtacccgatgagatccttgtggtgaaaaggctgcctaagacacgttccgggaaggtaatgcgacgcctattgcgcaagattatcacaagtgaggcacaggaactcggggataccacaactctagaagatccttctatcattgccgagatactttcagtctatcaaaaatgtaaggacaaacaagccgctgccaaatag

SEQ ID NO: 213331 - DNA, 2145 bp, Artificial Sequence
  Description of Artificial Sequence: Synthetic coding sequence
atgggactgccagaggaacgggtgcggagcggatctgggagtaggggccaggaagaagcaggcgctggcggacgggctcggagctggagtccccctccagaggtttcacgtagcgctcacgtccctagcctgcaacgttaccgggagttacacaggaggagtgttgaagagccacgagagttctggggcgacattgcaaaggaattctactggaaaactccctgcccaggtccctttttgagatataactttgatgtgactaagggcaagattttcattgagtggatgaaaggggcaaccaccaacatttgctataatgtgctcgatagaaacgtccatgaaaaaaagctcggcgacaaagtggcgttctactgggagggcaatgagccaggcgaaaccacccagattacttatcaccaactcctggttcaggtgtgccagtttagcaacgtcctcagaaagcaaggaattcagaagggagatagagttgccatttatatgcccatgatcccggagctggtggtggcaatgctggcctgtgcacgcatcggggcactgcattctatagtctttgccggatttagtagcgagtcgctctgcgagcgcatcctggacagtagttgcagccttcttataacaactgatgctttttaccggggagagaagctggtgaaccttaaagagctcgctgacgaggccctgcagaaatgtcaggaaaaaggcttccccgtgcgatgttgtatcgtcgtcaagcacctaggcagggcagagctggggatgggcgattcaacaagccagtctccacctatcaaacggtcatgccctgacgtgcagggcaaactgaaggaaaagtcaaaacgcgtgcagccgcaaatttcctggaaccaaggcattgacctgtggtggcatgagctgatgcaagaagctggagacgagtgcgagcctgaatggtgtgatgcggaggaccccttattcattttgtacaccagcggctccacaggcaagcctaagggcgttgtacacacagtcggagggtacatgctctacgttgcgaccacatttaagtacgtatttgattttcatgcggaagacgtgttctggtgcaccgctgacattggatggatcactggacatagctacgtgacctacggtccactcgccaatggggcaaccagtgtgttgttcgagggaatccctacgtatcccgacgtgaatagactgtggagcattgttgataagtacaaagtgactaaattctacactgccccaactgcgataagacttctgatgaagtttggggacgagcctgtgaccaagcactccagggcttccctccaagtgttgggaaccgttggcgaaccgattaacccggaggcctggctgtggtaccaccgagtagtgggcgctcagaggtgtccaattgtggacactttctggcagacagagacaggcggacacatgttgacccctttgcctggtgctactccaatgaagcccggttcggccacttttccattcttcggcgtagccccagccatcctgaatgaatccggggaagaacttgagggggaggcagagggttacttagttttcaaacagccctggcccggaataatgaggacagtgtacggaaaccacgagagattcgagacaacttacttcaagaagttccctggatactatgtgacgggagatggatgtcagcgcgaccaggacggctactactggattacaggccgaatcgacgacatgttgaatgtcagtggccaccttctatccacagccgaggtggagtctgcgctagttgaacacgaagcagttgccgaggctgcagtggtaggccatcctcacccagttaaaggcgagtgcttgtactgttttgtgaccttgtgtgacggccacacatttagtcctaagctgacagaggaactcaagaagcagattagggagaaaataggacctatcgctacccccgattatatccagaatgcccctggcttgccgaagacccgcagcgggaagatcatgagacgggtgctgaggaagatcgcccagaacgaccatgacctcggggatatgtctacggtggccgatccctccgttatctcgcaccttttctcccatcgctgcctgactatccagtag

SEQ ID NO: 213332 - DNA, 1956 bp, Artificial Sequence
  Description of Artificial Sequence: Synthetic coding sequence
atgatggtacgttgggccttgctgtgcgagttctggggggacattgccaaggaattctactggaagactccatgcccgggaccatttctccgctacaattttgatgtgactaagggtaaaatatttatagagtggatgaaaggcgcaactactaacatttgctacaatgtgctggaccgaaacgttcacgaaaagaagttgggcgataaagtggctttctactgggagggtaacgagcctggcgaaaccacccagattacctaccaccaactcctggttcaggtgtgtcagttttccaacgtcctgcgtaaacagggaattcaaaagggcgatcgagtggcaatctacatgccaatgatccccgagctcgtggtggcgatgttggcatgcgcaagaatcggagccctccattctattgtctttgcgggatttagtagcgagtctctttgtgaacggattctcgactcaagttgttctctgctgattaccactgatgccttctatcgcggtgagaagctggttaatttaaaggagctcgccgacgaggcgctacagaagtgtcaggagaagggtttcccagtgcgatgctgcatagtagtgaagcacctgggaagagcagagctcggcatgggggactctaccagccaatccccacccatcaagcggtcctgcccggacgtgcagatcagctggaaccagggcattgatctatggtggcacgagttgatgcaggaagccggagacgaatgcgagcctgaatggtgcgatgccgaagaccccctcttcatcctgtacactagtgggtctacaggtaagccaaagggggttgtgcacacggtggggggatacatgctttatgtcgcaactacatttaagtacgtgttcgatttccacgccgaagacgtgttctggtgcaccgccgacattggctggatcaccggtcactcatacgtgacctacggcccactggcgaatggagccacctccgtcctattcgagggcattccaacataccccgacgtaaatagactgtggtccattgtcgataaatacaaggtgacaaagttctacactgcccctacggcaataagactcttgatgaaatttggagacgagccagtgacaaagcactccagagcttccctccaagtgttgggaaccgttggggaacccattaaccctgaagcctggctttggtaccatagagtggttggggcacagcgttgccctattgtagacaccttttggcagaccgagaccggcggacacatgctgactcccctgcccggagctacaccgatgaagccgggatccgcaactttcccattctttggcgttgcacccgcaatccttaacgagtctggagaggagctcgagggagaggccgaggggtacttagttttcaagcaaccatggcccggtatcatgcggacagtctacgggaatcacgagcgtttcgagaccacttactttaagaagttcccaggatactatgtaacaggtgacgggtgccagcgcgatcaagacggctactactggatcaccgggaggatcgacgacatgctcaatgtgtcaggtcacctcctgtcaactgccgaggtagagtccgccctcgtggagcacgaggctgtggcggaggctgccgtggtggggcacccgcaccccgtaaaaggggaatgtctgtactgttttgttacgctctgcgatggccatacgttcagccctaagctgaccgaagagctgaagaagcagatccgggagaaaattggccctattgccacgcctgactatatccagaacgcccctgggctacctaagacacgttccggcaaaatcatgaggagggtactacgcaaaatcgctcagaatgaccacgaccttggagacatgtctaccgtggccgacccttctgtcatatctcacctgttttcacacaggtgccttaccattcagtag

SEQ ID NO: 213333 - DNA, 2106 bp, Artificial Sequence
  Description of Artificial Sequence: Synthetic coding sequence
atgggattacctgaggagcgtgtgaggtccggttctggatcccgcggtcaagaagaagccggagccggaggcagagctaggtcctggtccccaccaccagaagtgtctcggtctgcccatgtgcccagcctccaaagatatagggagttgcaccgccgttctgtggaggagccacgagagttctggggcgacatagcgaaagaattttactggaagaccccttgtcccggtcccttcctgcgatacaatttcgatgtgaccaaaggtaagatattcattgagtggatgaagggggcaactacaaacatctgttataatgtgcttgaccgcaacgtgcacgagaagaaacttggcgacaaggtcgctttctattgggagggaaacgaacccggagagaccacacaaattacctaccaccagctgctcgtacaggtctgtcaatttagcaatgttctgcgcaagcagggcatccagaagggggatcgcgtggccatctatatgccaatgatcccagaactggtagttgcgatgcttgcctgcgccagaataggcgctcttcatagtatcgtgttcgctggcttttcgtctgaatccttgtgcgaacgcatcctcgactcctcttgtagcctattaattactactgacgccttctaccgcggtgagaagctggtcaacttgaaagagttggcagatgaggcgctgcaaaaatgtcaggaaaaggggttccctgtgcgatgctgtatcgttgtgaagcatctggggcgtgccgagttgggaatgggcgactctaccagccagagtccgccaataaagcgctcttgtcccgatgtgcagatttcctggaatcaggggatcgacctgtggtggcatgagctgatgcaagaagccggagacgaatgtgaacccgagtggtgcgacgccgaggaccctcttttcatcctctacaccagcggatccactgggaagcccaaaggagtggtgcataccgtaggaggctatatgctgtacgtggctacaacatttaaatacgtgttcgatttccatgccgaagacgtattctggtgcacagccgacattggatggataactggccacagctatgtcacatacggcccactggccaatggcgctacttctgttctgttcgaggggattcctacttacccagacgtgaatcggctgtggtccattgtggacaaatataaagtaacgaagttctacaccgcccctaccgctattcggctgctgatgaagttcggggatgaacctgtgacaaagcactcacgagcctcgctccaggtgctcggtaccgtgggggaaccgattaacccagaggcgtggctttggtatcatagagtcgtcggtgcacagcgctgtcccattgtagataccttctggcagaccgaaaccgggggacatatgctgactcctttgcccggagccaccccgatgaagcctggcagcgccacattccccttctttggcgtggccccagcaattctaaacgagtcgggcgaggaattggagggcgaagctgaggggtatttagtgttcaagcaaccatggccaggcatcatgaggacagtgtacgggaatcacgaacgctttgagacgacctacttcaaaaagtttccaggttactacgtaaccggagatggatgtcagagggaccaggacggctactactggattacaggtcggatcgacgacatgctcaatgtgtctgggcatctcctctctaccgccgaggtggaaagtgcgctagtagagcacgaggccgtggccgaggctgctgtggtggggcacccacacccggtcaagggcgagtgtttgtattgttttgtcacgctgtgcgacgggcatactttttctcccaagttgaccgaggaacttaagaagcaaatccgggagaaaattggtcctatcgccacgccggactacattcagaacgctcctggactgccaaaaactcggagcggcaagatcatgcgaagggtgctccggaaaatcgcacagaatgatcatgatctcggggatatgtcaactgttgccgacccatctgttatctcccatttattttcccatcggtgtctcacgatccaatag

SEQ ID NO: 213334 - DNA, 2100 bp, Artificial Sequence
  Description of Artificial Sequence: Synthetic coding sequence
atgggacttccagaggaacgcgtgcgctcaggttctgggagcagaggtcaagaggaagctggagctggaggcagggccagaagttggtcaccccctcccgaggtttcgaggtcagctcacgtcccttcacttcagaggtatcgggagctccatagaaggtctgtcgaagaaccacgtgagttttggggagatatcgcaaaggagttttattggaaaacaccgtgtccgggaccattcctgagatacaactttgacgtgacaaaaggcaagattttcattgagtggatgaaaggcgctacaaccaatatatgctacaacgtccttgatcgcaacgtgcatgaaaaaaaactgggggacaaagtagctttttactgggaggggaacgagcccggagagacgacccagatcacctaccaccagttactggtccaggtgtgccagttcagcaacgtgcttaggaagcaaggtatacaaaagggtgatcgcgtggctatatacatgcccatgattcccgagttggtggtggctatgctggcctgcgctcgcattggggcactgcactccatcgttttcgcaggtttttctagcgaaagtctgtgtgagagaattttggatagctcttgctcccttctgattaccacagatgccttctaccgtggagagaaattggtgaacctgaaggaactggctgatgaggccctgcaaaagtgccaggaaaagggcttccccgttcgctgttgtattgtggtaaagcacttagggagagccgaattagggatgggagatagtacatcgcagtccccgccaatcaaaaggagctgtccggacgtccaaatttcctggaatcaagggatcgatctgtggtggcacgagctgatgcaggaagcaggtgatgagtgtgagccggagtggtgcgatgcagagcatagtagctcgtgcactcccgtagctcctcaagccaaccccagagtctggtttacgcagctcggggctacgtgctatgtggcgaccacattcaagtatgtctttgacttccacgccgaagatgtattttggtgtacggctgacattggatggataactgggcacagctatgtcacatacgggccacttgccaacggtgccacgagcgttctttttgaggggattcccacctaccccgatgtgaacaggctttggagcattgtcgacaagtataaggtgacaaagttttataccgcccctaccgcaatcagattactgatgaaatttggagatgaacctgtgaccaaacattcacgggctagcctacaagtgctgggaaccgtgggcgagcccattaacccagaggcttggctctggtaccaccgggttgttggggcacagaggtgtcctatagtggacaccttttggcagactgaaaccggagggcatatgctcacccccctcccaggggctacccctatgaaaccaggcagcgcaacctttccattttttggggtggctccagcaatcctcaatgagagcggtgaagaactggagggcgaagctgagggctatctagttttcaagcaaccctggcccggaattatgcggaccgtatatggaaaccatgagaggttcgagaccacctactttaaaaagtttccaggatattacgtgacaggagacgggtgtcagagagaccaggatgggtattattggattactggcagaatcgacgacatgctgaatgtatccgggcacctgttgagcaccgcggaggtggagtccgccctggtagaacatgaagctgtggcagaggcagctgtcgtgggacatccccaccccgttaaaggggagtgcctgtattgcttcgtgacgctatgtgacgggcatacattcagccctaagttgactgaggaacttaaaaagcagattagggagaagattggacctattgcaacccccgattatatccaaaatgcccctggcctgccaaagacaagaagcggtaaaattatgcggagggtactgagaaaaatcgctcaaaatgaccacgaccttggagacatgagcactgtggccgatccttcggtgatttctcatctcttctctcatcggtgcctgaccatacagtag

SEQ ID NO: 213335 - DNA, 1230 bp, Artificial Sequence
  Description of Artificial Sequence: Synthetic coding sequence
atgcaagaggctggcgatgaatgcgaacccgagtggtgtgatgccgaggatcctctgttcattctgtatacatcaggcagtacaggtaagccaaaaggggtcgttcatacagtgggaggctatatgttatacgtggccactacatttaagtacgttttcgatttccatgccgaagacgtgttctggtgcacagctgatatcggctggattaccggacactcatacgtgacctacggtcctctcgctaacggcgcaacctctgtattgtttgaagggatccccacgtaccctgatgtcaacaggttatggagcatcgttgacaagtataaggtgactaaattttacacagcccctaccgccattcgtcttctaatgaagttcggggacgaaccggtcactaagcactcccgcgctagcctgcaggtgctcggcaccgtcggtgagcctatcaatcctgaggcctggctctggtatcatcgggtcgtgggcgctcagcggtgccctatcgtcgacactttctggcaaaccgagaccggaggccatatgctgactccccttcccggagccacaccaatgaaacctggcagcgccacgtttccctttttcggagtagccccagccatcctcaacgagagcggcgaagagctcgaaggcgaggctgaaggatatcttgtatttaaacagccatggccaggtattatgcgcactgtgtacggaaaccacgagcggttcgagacaacctacttcaaaaagtttcctggctattacgtaactggagatgggtgtcagagggaccaagatggatattattggattaccggccgaatcgatgacatgttaaacgtcagcggacacctgctgtcaaccgctgaagtcgagtcagccttggtagagcatgaggctgtcgctgaggccgctgttgtcgggcacccacaccctgttaaaggcgagtgtctatactgcttcgtgactctgtgtgatggacacactttttcccctaaacttacagaagaacttaagaagcaaattagagagaagattggacccatagccacacccgactatatccaaaacgcacccggacttccgaagaccaggagcggtaagatcatgcgtagagtgttgaggaagatagcacagaatgaccatgatttgggagacatgagcacagtggccgacccttcagtgatcagccaccttttttctcaccgatgtctcactatccagtag

SEQ ID NO: 213336 - DNA, 114 bp, Artificial Sequence
  Description of Artificial Sequence: Synthetic coding sequence
atgatggttcgctgggctttgctgtgcggcgaatgtagaatactgggaaggcattgccaggggatcttgctggaagattctatgccgtggcctatacctagcgtccaactgtag

SEQ ID NO: 213337 - DNA, 2061 bp, Artificial Sequence
  Description of Artificial Sequence: Synthetic coding sequence
atgaagccatcttggctccaatgtcggaaagtgacaagcgctggcggactgggcggacccctaccaggatcttcacctgccaggggtgccggtgctgcattacgggctttagtcgtacccggaccccgtggtggcctggggggacggggatgcagagcacttagtagcggatctgggtctgagtacaaaacccacttcgccgctagtgtcacggatcctgaaagattctggggcaaggctgctgagcagataagctggtacaaaccctggaccaagaccctggaaaataagcactccccctctaccagatggtttgtcgagggcatgctaaacatctgttataacgcggtggataggcatattgagaacggtaaaggtgacaagatcgccatcatttatgattcacccgtgactaatactaaggcaacttttacatacaaagaagttttggaacaagtaagcaaactcgcaggagtgctggtcaagcacggtatcaagaagggcgacactgtggtgatttacatgcctatgataccacaagcaatgtacaccatgcttgcatgcgcgagaatcggcgctatccattctctgattttcggcggattcgcgtcgaaagagctcagctcccgtatcgaccacgtcaaacctaaggtagtcgttacagctagcttcgggatcgagcccggaagacgggtggaatacgtccccctcgtggaggaggccctcaagatcggccagcataagcctgataaaattctgatctacaacaggccaaatatggaggccgtcccgcttgccccaggaagagatctggactgggacgaggaaatggcaaaggctcagtcccatgattgtgttcctgttctgtcagaacacccactgtacatactgtacacgagcggtacaacaggcttaccaaaaggcgtgatacgaccaaccggaggttacgccgtaatgctacattggtctatgtcatcaatatatggcttgcaaccaggggaggtgtggtgggctgcttccgatctaggctgggtggtgggccactcttacatttgctacggacccctactgcatggcaataccaccgttctgtacgagggaaaaccagtgggaacccctgatgcaggtgcctactttcgtgttcttgcagagcatggcgtggccgcattgtttacagctcccactgccataagggccatcagacaacaggacccaggagccgctctggggaagcagtacagtctaacccgcttcaagaccctttttgtagcaggtgagcgctgcgacgtggagacccttgaatggagcaagaatgtgttccgagttccagtcctcgaccattggtggcagactgaaaccggctcccccattacagcatcctgcgtcggcctgggaaattccaaaacccctccccctgggcaagcgggaaaaagtgtgcccggatacaatgtaatgatactggatgacaatatgcagaagttgaaagcacgctgccttggtaatatcgtcgtgaagctgcctctgccccctggggcattctcaggcctttggaagaatcaggaggcctttaaacatctgtatttcgagaaattcccagggtactatgacactatggacgccggatatatggatgaggaaggctacctctacgtcatgagccgagtggacgacgtgatcaacgtcgctggccacaggatttcagcaggtgcgattgaggagagcattctgtcccatgggacagtggccgattgtgctgtggtcggcaaggaggacccactgaagggacacgtccccctggccttgtgtgtgctccggaaggacatcaatgccacggaggagcaagttttagaagaaatcgtcaagcatgttagacagaatattggccctgtagctgcatttcgcaatgcagtctttgtcaagcagttgccaaagacccggagtgggaagatcccgaggagtgctctgtcggctattgtgaatggaaagccctacaaaatcacctccaccatcgaagacccttctatcttcggccacgtggaggaaatgctcaaacaagcatag

SEQ ID NO: 213338 - DNA, 1107 bp, Artificial Sequence
  Description of Artificial Sequence: Synthetic coding sequence
atgcttcattggtcgatgtcgtccatttacggcctccaacctggcgaagtctggtgggccgcatcggatctcggatgggtggttggccacagttacatctgctacggtcctctgctccacggaaacacaaccgtcctgtatgaaggaaagcctgtcggaacgcctgacgccggagcctactttagagttttggctgaacacggggtagcagcgctgtttacggctcccaccgccatccgcgcaatcaggcagcaggatcccggagctgcgttaggcaaacagtacagcctgacacgctttaaaacacttttcgttgcgggagaaaggtgtgatgtggagaccctggagtggtccaagaatgtttttcgggtccccgtgcttgatcactggtggcagacagagaccggaagcccaatcactgccagctgcgtgggactgggaaactcgaaaacgcccccacccggacaagccggaaaatccgttcccggatataacgttatgatactggacgacaatatgcagaagttgaaagcacggtgcctcggaaatattgttgtgaaactgccattgcctcctggggcatttagcggcctatggaagaaccaggaggcgttcaaacacttgtatttcgagaagttccccggatactatgatactatggacgctggatatatggacgaggagggttatctctacgtgatgagtagggttgacgatgtgatcaacgtggcgggtcatcgcattagcgccggagcaattgaggagtcaattctgtcacatggtaccgtggctgattgcgccgttgtgggaaaagaagaccccctgaaagggcatgtgcccctcgcactctgtgttctgaggaaggatatcaacgcgaccgaagagcaagttctagaggaaatcgtgaagcacgtacggcagaacattgggcctgtggcagcatttcggaacgccgtgtttgtgaagcaacttccgaagacacgctccggcaagattccaagaagcgctttgtctgcaatcgtgaacggaaaaccctacaagattaccagtaccatcgaggatccatccatttttggccacgtggaagaaatgctgaagcaagcttag

SEQ ID NO: 213339 - DNA, 1266 bp, Artificial Sequence
  Description of Artificial Sequence: Synthetic coding sequence
atggcggctactctgattctggaacccgcaggcaggtgctgttgggatgagccagtgcggatcgcagtgcgcggtctggccccagaacagcccgtcaccctcagggcctcactgcgggacgaaaaaggtgcactgttccaggcccacgccagatacagggctgacactctgggagaactggatttggagcgggcacccgctctgggcggatccttcgccggactagaacccatgggcctgctctgggccctggaacctgaaaagccccttgttagattagtgaagcgtgacgtccgtaccccactcgctgttgagctggaggtgttggacgggcatgaccctgatcctggccgacttctgtgtcgggtgcgccacgaacggtatttcctaccaccgggagtaagacgcgagcccgttagagcaggccgtgttaggggcactttattcctgcccccagaaccaggtcccttccccggaatcgtcgacatgttcggcactgggggaggcctactggagtaccgagcctctttgctggccggaaaagggttcgctgtgatggcactggcttattataactatgaggacctgcctaagacgatggagaccttgcatcttgaatactttgaggaggcagttaactacctactttcccacccagaggttaagggccctggggtgggactgcttgggatatctaaggggggtgagctctgcttgtctatggctagcttccttaaaggcattacggccgcagttgtgatcaacggttcggtggccaacgtcggagggactttaaggtataaaggggagacattgccccctgtgggagtgaatcggaatagaataaaggtaaccaaagatggatacgccgatatcgtcgatgtgcttaactccccactcgagggtcccgatcagaagtctttcattcccgtcgagcgcgctgagagtacattcctgtttctggttgggcaggacgaccataactggaaatccgagttttacgcaaatgaagcttgtaaaagactgcaggcccacggaagacgcaagcctcagatcatttgctatccagagacgggtcattatatagagcccccatacttccctctttgtcgtgccagcctccacgccctggtgggaagccccattatttggggaggtgagcctcgggctcatgccatggcgcaggtggacgcttggaagcaactgcaaaccttcttccacaaacatctgggcggtcatgagggcaccatcccttctaaagtatag

SEQ ID NO: 213340 - DNA, 1785 bp, Artificial Sequence
  Description of Artificial Sequence: Synthetic coding sequence
atgattcagaatgtcggcaatcaccttcgtcggggactcgcttcagtgttttccaaccgcacttcccggaaaagcgctctccgcgcaggcaacgactccgcgatggctgatggagaaggataccgaaatcccacagaagtgcagatgtctcaactggtgctgccctgtcacaccaatcagcggggagagctgagcgttggacagctgctgaaatggatcgataccacagcttgtctctctgcagagcgccatgccggttgcccttgcgtgacagccagcatggatgatatatactttgagcacactataagtgtgggccaggtggtaaacattaaggctaaagtgaacagagcatttaacagctctatggaggtggggattcaggtggccagtgaggatctttgcagtgagaagcaatggaacgtctgcaaggccttggctactttcgtggcccgtcgagaaattacaaaagtgaaactgaagcagattactccaagaaccgaggaggaaaagatggaacactcagtcgcggcagagaggaggagaatgaggttagtgtatgccgacacaatcaaagatttactggctaactgtgccattcagggggatttggagagccgggactgctcgagaatggtgcctgcagagaaaaccagggtcgagtctgttgagctggtgctgccaccacatgcaaaccaccagggcaacactttcggcggacagattatggcctggatggaaaatgttgcaactatcgcggcatctcgcctgtgcagagcccatcctaccttaaaggcgattgagatgttccatttcagaggtccatctcaggtcggggaccggttggtgctgaaggcaatcgttaataatgcatttaaacattccatggaggtaggcgtgtgcgttgaagcgtatagacaggaagctgagacacatcggaggcatataaactctgccttcatgaccttcgtggtgctggatgctgacgatcaacctcagttgctgccatggatccgtccccagcctggggatggtgaacgccgataccgggaagccagtgcgcgaaaaaagattcggttggaccgcaaatacatcgttagttgtaaacagacagaagtcccattgagtgtaccctgggacccatcaaatcaagtgtatctatcatacaataacgtatcctcattaaaaatgttagttgctaaagacaactgggtcctcagcagcgaaatctctcaggtccgtctctacacattggaagatgacaagttcctgtcctttcatatggagatggtggtccacgtggacgctgcacaggccttcctcctactgagtgacctacgacagagaccggaatgggacaaacactatcgctccgtggaattagtgcagcaggtggatgaggacgacgcaatataccatgtgacgtccccagccctcgggggacataccaaaccccaggatttcgtaattttggcatctcgcaggaagccgtgtgacaacggggatccttacgtcatcgctttaagaagcgtgacgttacccacgcatcgggagaccccggagtatcgaagaggggagacgctttgctccggattctgcctctggagagagggagaccagctgaccaaagtgtcatattacaaccaagccacccctggggtgcttaattatgtgactactaacgtggctggattgtcgtcagaattctacaccactttcaaagcatgcgaacagtttttgctggataacaggaatgacctggcaccctcattacaaactctgtag

SEQ ID NO: 213341 - DNA, 1824 bp, Artificial Sequence
  Description of Artificial Sequence: Synthetic coding sequence
atgattcagaatgtcgggaaccatttgagacgcggactggccagtgtattcagcaaccgtacctctagaaagtctgccctccgcgcaggcaacgacagtgcgatggcggacggcgaggggtacagaaaccctaccgaggtgcaaatgtcacagctagtcctcccctgtcacaccaatcagcgcggtgaactgtcagttggacaactgctgaaatggatcgataccaccgcttgccttagcgccgagcgccatgcaggctgtccttgcgtgacagccagtatggatgacatctacttcgaacataccatttctgtggggcaggttgtgaatataaaggcgaaagtgaatagagcattcaattcttccatggaggtcgggatccaggtggcgtctgaagatctatgctccgagaagcagtggaatgtgtgtaaggcgctggccacatttgtcgctcggcgagagataacaaaagtaaaattgaaacagatcacacctcggactgaggaagagaaaatggagcactcagtagccgcagagcgacgcaggatgcgcttggtctacgccgacaccatcaaggatctgttggccaactgtgcaatccagggggatttggagtcacgggactgctcccgcatggtccccgcagagaagacccgcgtggagagcgtggagctggtcttacctccccatgctaaccaccaagggaatactttcgggggacagatcatggcctggatggaaaatgtagccacaatagccgcttctcgactgtgccgcgcacatccgactcttaaagccatcgaaatgttccattttcgcggaccttcccaagtgggagatagactggtgctgaaagccatcgtgaacaatgccttcaaacattctatggaagtcggggtctgcgtggaggcctacaggcaagaagccgaaacccaccgaaggcacattaacagcgcatttatgacctttgtggtgttggacgctgacgatcaacctcagctgctgccgtggatccggccacagcctggagatggagagcggaggtaccgtgaggctagcgctcgcaagaagattaggttggatcgcaaatatattgtgtcctgtaaacagactgaggtgcccctgtcggtgccttgggacccctctaatcaagtgtatctctcctataataacgtgtcttctctgaaaatgcttgttgctaaagataactgggtgctttcctcagaaatatcccaagtgcgcttgtacaccctagaggacgataagttcttatcctttcatatggagatggtggtacatgttgacgctgcacaggcctttctgctcctctcggatctcaggcagaggcccgaatgggacaaacactaccggtctgttgaactagtgcagcaggtcgacgaagacgacgcaatctaccacgtgaccagccccgctctgggcggacacaccaaaccccaggattttgtgattctagctagtcggagaaagccatgcgacaacggggatccttatgtgattgccctgcggtctgtgaccctcccaacgcaccgggagaccccagagtacagacggggagaaaccctttgctctgggttctgtttatggcgggagggcgatcaattaacaaagtgttgttgggtgcgtgtaagccttacagaactggtgagcgcgagcggcttttattcatggggccttgaatctcggtccaaagggaggcggtctgatggttggaacggcaagctagccggtggacacctgtccaccctgaaggccatccctgtggccaaaattaacagtcgcttcgggtacttacaggacacctag

SEQ ID NO: 213342 - DNA, 1668 bp, Artificial Sequence
  Description of Artificial Sequence: Synthetic coding sequence
atggagagaccggcacccggtgaggtggtcatgtctcaggccatccagccggcacatgctaccgctagaggtgaattatcggctgggcaattgctgaagtggattgatacaacagcgtgccttgccgctgaaaagcacgctggcgtgtcctgtgtcactgcttccgtggatgacatccaatttgaggagacagctcgagtaggacaggtcattaccataaaggctaaggtgacccgcgcatttagtacctcaatggagatcagcattaaggtgatggtgcaggatatgcttactggtatcgaaaagttggtgtcagtggccttctctacgttcgtggctaaacccgtcggcaaagaaaaaattcacctgaagccagtcactctgctgaccgagcaggatcatgtcgagcataacctcgccgctgaacggcgaaaagtgcggctgcagcatgaggacacatttaataacctcatgaaggagagttctaagtttgatgatcttatattcgatgaggaggagggggctgtgagtacccgcggaacatctgttcagtctattgagttagttctcccaccccacgccaatcaccacgggaatacctttgggggtcagatcatggcctggatggagacagtagcaacgattagcgccagtcggctctgctgggcacatcccttcctaaagtccgtcgatatgtttaagttccgcggaccttccaccgtgggcgatcggctggtatttacagccatagtgaacaatacttttcaaacctgtgtggaggtgggagtccgagtggaggcctttgactgtcaggaatgggcagaaggtcggggtagacatattaacagcgcatttctgatatataatgccgctgacgacaaggagaacttgattacttttcctagaattcaacctatttcaaaagatgatttccgcaggtatcgaggcgcaatcgccagaaagaggatacgcttgggcagaaagtacgtgatctcccacaaagaggaagtgccactttgcatacattgggacatctcgaaacaggcgtccctgagcgactctaacgtagaggcactcaaaaagctggctgcaaagagaggttgggaagtgacatctactgtggagaaaattaagatttatactcttgaggaacacgacgtcttgtctgtgtgggttgagaagcacgtcgggagccctgctcatttggcatatagacttctgtctgacttcactaaaagaccattatgggatcctcacttcgtgtcatgcgaggttatagattgggtgtctgaagacgaccagctgtaccacatcacttgtccaatcctgaatgacgataagccaaaggatcttgtcgtcttagtgtctcgtcgtaaaccgctgaaggacgggaatacatacacagtggctgttaagtcagtgattctgccttccgtacccccatctccccaatatattcggtccgagatcatttgtgctggttttctgatacatgcgattgacagtaattcctgcatcgtgtcatacttcaaccacatgtcagcctctatcctgccttacttcgccggaaatctcggcggttggagtaaatccatcgaagagacggccgctagttgtattcagtttctggaaaacccaccagacgatggctttgtcagcacattttag

SEQ ID NO: 213343 - DNA, 1452 bp, Artificial Sequence
  Description of Artificial Sequence: Synthetic coding sequence
atgtccaataaactcctcagccctcacccacactcagtggtcctgagaagcgagtttaaaatggcatccagcccggcagtgctgcgagcctcccggctctatcagtggtccctaaaaagctcagcccaattcttggggtctccccagctcagacaggtgggtcagattattagggtgcccgcacggatggcagccacgctgattctggagccggctgggagatgttgctgggacgagccagtacgcatcgcggtccgtggactcgctcccgaacagcccgtcacgctgcgggcttccctccgggatgaaaaaggagccctcttccaggcacatgccaggtaccgggcagataccctgggcgaactagacctggaacgtgctcctgcccttgggggaagtttcgcaggcctggagccaatggggcttctttgggcgctagaacccgagaagcctctggtgaggctggttaagagagacgtgcggacaccactggctgttgaactggaagtgcttgatggccacgatccagaccccggacgcttattgtgccagacaagacacgagcggtacttcctgcctcccggagtgcgacgagagcctgtccgcgtgggcagggttcgcggaacactcttcttgccacccgagccaggtccctttccaggcatagtggatatgttcggaacggggggaggactcctcgagtatcgtgcctctctgctggccggaaaaggtttcgcagttatggccttggcctattataactatgaggatctgcccaagacgatggaaaccttgcacttagagtactttgaagaagccatgaactatctgctgtcacacccggaggtgaaaggcccaggcgtgggcctgctgggcatcagcaaaggcggtgagctctgtctttccatggcatcttttttaaaggggattactgctgccgtggtgattaacggcagcgttgcaaacgtgggcggtaccctgcactacaagggggaaacgctaccacctgtcggggtaaatcggaaccggattaaagtgacgaaggacggctacgcggatattgtcgacgtgcttaactccccactggaaggcccagaccagaaatctttcattccggtcgagcgagccgaaagcaccttcctttttctcgtgggacaggatgatcataattggaagagcgagttttatgcaaatgaggcttgtaaaagactccaggcgcacggcaggcgaaagccacagatcatttgttatcctgaaacggggcattacatcgaaccaccatatttccccctctgccgagcctccctccatgcactagtcggcagccccatcatctggggcggagagccgagagcacatgccatggcccaagtggacgcgtggaaacagttacaaaccttttttcacaagcatctcggtggccatgaggggacgattcctagcaaggtgtag

SEQ ID NO: 213344 - DNA, 1266 bp, Artificial Sequence
  Description of Artificial Sequence: Synthetic coding sequence
atgagtgctacgctgatccttgaacctcctggccgatgttgctggaatgagcctgtgagaatcgcggttcgtggactggctcccgagcaacgtgtgaccctgcgtgccagcctgcgagacgaaaagggtgccctgttcagagcccacgcgaggtattgtgctgacgcgagaggtgagctggaccttgagcgtgcgccagcattaggcggaagttttgccggtctggagccaatggggctgttatgggccttggaaccggaaaaacccttttggaggtttcttaagcgggatgtccagataccctttgttgtagaattagaggtgttagatggccatgatcccgagcctggcagactgctgtgccaagcccagcacgagcggcatttcttaccccctggcgtgagaaggcaaagcgtgagagctggaagagtgagagcgacactgttcttgcccccaggtcctggtccctttcctggaataatcgacatctttggtattggaggcggtctgttggaatacagggcctccctgctggccggtcacggctttgctacgcttgctttggcatactacaattttgaagatctgccaaacaacatggacaatatcagtttggagtacttcgaagaggccgtatgctacatgcttcagcacccacaagtgaaaggcccaggaatcggcctcctggggatcagcctgggggctgacatttgtctaagtatggcctctttcctcaagaatgtgtccgcaactgtgtctattaatggttcgggaatatccggcaataccgccatcaattacaagcattcaagtattccccctttggggtacgatttgagacggatcaaggtagcttttagtggcctggttgacatagtggacatcaggaatgccctggtggggggatacaaaaacccatctatgattccaatcgagaaggcacagggtcccatacttttgattgtaggacaggatgatcataactggcgaagcgagctatatgcacagactgtctcagaacgccttcaagcccatgggaaggaaaagccgcagattatctgttacccaggcacaggtcattatattgagccaccctattttccactatgccccgcaagcctgcaccgcctccttaataaacacgtgatctggggcggagaacccagggcacactccaaggcacaagaggacgcatggaagcagatcctggcgtttttttgtaagcatctgggcggaacccaaaagaccgctgttccaaagctttag

SEQ ID NO: 213345 - DNA, 624 bp, Artificial Sequence
  Description of Artificial Sequence: Synthetic coding sequence
atgctccagcatcctaaagttaagggacccagtattgccctgctaggtttcagtaagggaggggacctgtgcctttcgatggcctcgttcctaaagggcatcaccgctacagtcctgatcaacgcctgtgtggctaacacagtcgctccactgcattataaggatatgataattcctaaactggtagacgaccttgggaaggtgaagattacaaagtcaggtttcctgactttcatggatacatggagcaaccctctggaggagcacaaccatcagagcctggttccactggaaaaggcgcaggtcccattcttattcatcgtcggcatggacgatcagtcttggaaaagtgaattctacgcacaaatcgcttccgagcggctgcaggctcatgggaaggagaggccacaaataatctgctatcccgaaaccggtcactgcatcgacccaccctacttccccccttctcgggcaagcgttcatgctgtgttgggggaagcaattttctatggtggtgagccgaaagcccactccaaagcccaggtcgacgcttggcagcagatacagaccttcttccacaagcacttgaacggcaagaaatcagtgaagcatagcaaaatttag

SEQ ID NO: 213346 - DNA, 507 bp, Artificial Sequence
  Description of Artificial Sequence: Synthetic coding sequence
atgctccagcacccaaaagtgaagggaccctctatcgccctcctcggcttcagcaagggaggggacctatgtttatccatggcatcatttctaaaaggcatcaccgccacagtcctcatcaatgcttgtgtggctaatactgttgcccctttacattacaaagatatgatcatcccgaagctcgtagatgacctggggaaggtgaaaataaccaagtccggttttttgacattcatggacacttggagtaaccccctagaggagcataatcaccagtcactcgttcctctggagaaagcccaggtaccctttctgtttattgtaggaatggatgatcagagctggaaatctgaattttacgcccagattgcctctgaaagactgcaggcccacggtaaggagcgcccacagattatctgttatcctgaaaccgggcactgtatagatccaccgtattttcctccaagcagagctagcgtccatgccgtgttgggcgaggcaatttag

SEQ ID NO: 213347 - DNA, 1113 bp, Artificial Sequence
  Description of Artificial Sequence: Synthetic coding sequence
atggcaagacctggcctgatccacagcgcccctgggctgcccgacacctgtgccctgctgcagcccccagccgcttcagcagctgccgcaccttctatgagcgggcctgatgtggagacaccaagcgctatccagatttgcagaattatgagacccgatgacgccaacgtcgcagggaatgtgcacggaggcactattctaaaaatgatagaagaggccggagccatcatttccacccgccattgtaacagtcaaaacggagaacgctgtgttgcagccttagcacgagtagagcggacagacttcctctctccgatgtgcatcggagaagtggcgcatgtttcagctgagattacctatacctcaaagcactcagtcgaggtccaagtgaatgtaatgtccgagaatattcttacgggcgctaagaagttgaccaacaaggcaacattgtggtacgtacccttgagcttgaaaaacgtcgataaggtcctggaggtcccacctgttgtctactctaggcaagaacaagaggaggagggcaggaagagatatgaagcgcaaaaactggagaggatggaaacaaaatggaggaacggcgacatagtgcagcccgtgctgaacccggaacctaacaccgtgtcgtacagccagagttcattaatccatctggtaggcccatcagattgtacactccacggattcgtccacgggggagtcaccatgaagcttatggatgaagtggcgggaattgttgccgctcgacactgtaagactaacatcgtaaccgcaagcgtggatgccatcaatttccacgacaagattagaaagggatgtgttattaccataagcggcaggatgacatttaccagcaacaagtctatggagatcgaggtcctggtggatgctgaccccgtggttgatagcagtcaaaaacgctatagggccgctagcgcattttttacttacgtgtctttgtcacaggaagggagatccctacccgttccccagttggtgcctgagacagaggatgaaaagaagcgcttcgaggaaggaaaggggcgttaccttcagatgaaagcgaaacgccaagggcacgcggagccccagccatag

SEQ ID NO: 213348 - DNA, 990 bp, Artificial Sequence
  Description of Artificial Sequence: Synthetic coding sequence
atggctttccagttatcacgtatcatgcgccctgacgatgccaacgtggctggaaacgtccatggcggaactattcttaagatgattgaagaagccggagcgatcatatccacaagacactgcaatagccagaatggtgaaaggtgtgttgcagctctggcacgtgttgaacgcaccgacttcctttcaccgatgtgtatcggtgaggtggctcatgtgagtgcagagatcacgtatacgagcaaacactctgtggaggtccaggtcaacgtcatgtccgaaaatattctgaccggcgcaaagaaactcacaaataaggctaccctgtggtatgtccccctcagtctgaaaaacgtggataaggtcctggaggtgcccccagtcgtttacagccgacaagagcaagaagaagaagggcgtaagaggtacgaggcacagaagctggagcgtatggagaccaaatggcgaaacggggatatcgtgcagccagttttaaatccagagcctaacacggtgtcttactctcaaagctctctgatccacttagtagggccaagcgactgcacattgcatggcttcgtccatggcggtgtcacaatgaaactgatggacgaggtagctgggatcgtggctgcaaggcattgcaagaccaatattgttacggcaagcgtggacgccatcaattttcatgataagattcgcaagggctgcgtgatcacaatctcaggaaggatgaccttcacctcaaataaatccatggagatcgaggttctggtggacgcagaccccgtcgtcgacagtagccagaaacggtaccgggcagcatctgcctttttcacctacgtcagcctgtcacaggaggggagatctctacctgtgcctcagctggtgcccgaaacagaggacgagaaaaaacgatttgaagagggcaagggtagatatctgcaaatgaaggcgaagcgccaggggcacgcagaaccacagccgtag

SEQ ID NO: 213349 - DNA, 1053 bp, Artificial Sequence
  Description of Artificial Sequence: Synthetic coding sequence
atgctcctgctgagacggagtctgtctctgaacgttctgagaaaggaggtggacagagcctgctttggcgagaaggctaaacaaatcatgagacctgacgacgctaacgtcgccggtaacgtacatggaggcacaatcctgaaaatgatcgaagaagcaggtgccattattagcacacgtcattgtaattctcagaacggagagcgatgcgtagcagcgctggctcgggtggagcggacggatttcttgagccctatgtgcatcggcgaggtggctcacgtgtccgctgagataacgtacaccagcaagcactctgttgaagtgcaggtcaacgtcatgagtgagaacattctaacaggtgccaagaaactaaccaacaaggcgaccctctggtatgtgcctctctccctcaagaacgtagacaaggtccttgaagttccacctgtggtgtacagcaggcaggagcaggaggaagaggggaggaagcgctacgaggcacagaagctggagcgtatggagacaaaatggcggaacggtgacattgtgcagcctgtactcaatcctgagccgaacaccgtgtcctactctcaatcctccctcattcatctagtggggccatcagattgcacactgcatggtttcgtgcatggaggcgtgaccatgaagttgatggatgaggtcgcaggcattgtggcagccaggcactgtaaaactaacattgtgacagcctccgttgatgctatcaattttcatgataaaatcagaaaaggatgcgtcattaccatctccggtcgcatgacatttacttcgaacaagtctatggaaattgaagttctggtggacgcggatcccgtggtagacagctcccagaaaaggtatcgggcagccagtgcattcttcacatatgtatcactttcacaggaaggcagaagtctgcccgttccgcagttggtgcccgagactgaggatgagaaaaagagatttgaagaaggcaaaggcagatacctgcagatgaaggccaagcgccagggccacgccgagcctcagccctag

SEQ ID NO: 213350 - DNA, 1143 bp, Artificial Sequence
  Description of Artificial Sequence: Synthetic coding sequence
atgaaactgctagctcgagccttacgcctgtgtgagttcggcaggcaggcaagctcccgtcggctggtggccggtcaaggctgcgtgggccctcgacggggttgctgtgcccctgtgcaggtggtgggtcctagggccgacctccccccatgtggggcatgcatcacagggcgaataatgcggcctgatgacgcaaatgtggcgggaaatgtgcacggaggcacgatactcaaaatgattgaggaagccggagcaatcatttctactcggcactgcaactcacagaatggcgagcgctgtgtggcggctcttgcacgagtggaaaggactgatttcttaagtcccatgtgtatcggagaggttgcccatgtgtcagctgaaatcacatacacatcgaagcacagcgttgaagttcaggtaaatgtcatgtcagaaaatatcctgactggagccaagaaattgaccaacaaagccacactgtggtacgtgcctctctcgctgaaaaatgtggacaaagtgctggaggtaccacctgtcgtttattctcgccaggaacaggaagaggagggaagaaaaaggtacgaggctcagaaactcgagaggatggagaccaagtggcggaatggcgatatagttcagccagtgctcaatcccgagccaaacacagtttcctattcccagtctagtctgatccatctggtgggcccttccgattgcaccctccacggattcgtgcacgggggagtcacaatgaaattgatggacgaagtggctggaatagtggccgcacgtcattgtaagaccaatatagtgacagcctccgtggacgctattaacttccatgataagatccggaaggggtgcgttatcactataagcggacggatgacatttacatccaacaaaagcatggaaatcgaggttcttgtcgacgccgacccggtggtcgattcctcccagaaaagatatcgtgctgcaagtgcattctttacttatgttagcctgagtcaagaaggaaggtcattgcccgtgccccagctcgtgcctgagaccgaggatgaaaagaaaaggttcgaggaaggaaagggtaggtacctacaaatgaaggcaaaacggcagggtcatgctgaaccccagccttag

SEQ ID NO: 213351 - DNA, 672 bp, Artificial Sequence
  Description of Artificial Sequence: Synthetic coding sequence
atgctgctcctgcgtaggtcactgtctctcaatgtgctgcgaaaggaagtggacagagcttgctttggcgaaaaggcaaaacagattatgcggccagacgacgctaatgtagccggaaacgtacatggaggaactattctcaagatgatcgaggaggcaggtgcgatcatttccactcggcattgcaactctcagaatggtgagaggtgtgtggctgccctcgcacgggtcgaacgaacagactttctgtcgcctatgtgtatcggcgaagtcgcccacgtgagtgcggaaatcacatatacctcaaagcactccgttgaggtccaggtcaacgttatgagcgaaaacatcctaaccggggctaagaaactgactaacaaagctaccctttggtatgtgcctctcagtcttaagaatgtggataaggtgctagaagtgccgccagtggtctacagccggcaggagcaggaggaggagggtagaaagcgctacgaagcccagaagctggagcgcatggaaaccaagtggagaaacggagatatagtccagccagtgctcaatcctgaacctaatacagtcagctacagtcagtcctctttaattcacttggtgggacccagcgattgtactcttcacgggtttgtgcatggcggtggcgtcgactttcactag

SEQ ID NO: 213352 - DNA, 798 bp, Artificial Sequence
  Description of Artificial Sequence: Synthetic coding sequence
atgtgcattggagaagtggcgcacgtgagtgcagaaatcacatacacatctaaacatagtgtagaggtgcaggtaaatgttatgtccgagaatattctcacgggcgcaaaaaagctcaccaacaaggccacgctgtggtacgtgcctctgtctctgaagaacgtggataaagtacttgaagttcctcccgtcgtgtattcgcgtcaggagcaggaggaagaaggacggaaaagatatgaggctcaaaaattggaaagaatggaaaccaaatggaggaacggggacatcgtgcagccagtcctgaatccggagcccaacactgtgtcttacagccaaagtagcctcattcacctggtgggaccaagtgactgtacattgcacgggtttgtgcacggaggggtcaccatgaagttaatggacgaagtggccggtatcgtggctgccaggcactgtaaaacaaatatagtgaccgcctcggtcgacgctatcaattttcatgacaagattcggaagggctgcgttataacaatctccggaaggatgactttcacgtccaataaatctatggagattgaagtgctcgtggatgccgatccagtggttgacagcagccagaagagatatcgtgctgcgagcgcttttttcacttatgtctcactgtcacaagagggcaggagcctacccgtgccccagttggtgcctgaaaccgaagatgagaagaaaaggttcgaagaggggaagggaaggtacctgcagatgaaagccaaaagacagggacacgcagaaccgcaaccctag

SEQ ID NO: 213353 - DNA, 1308 bp, Artificial Sequence
  Description of Artificial Sequence: Synthetic coding sequence
atggctgcacccttggtattggtgctggtggtggcagtgaccgtccgagctgctctatttaggtcatcactagctgagttcatctcggaacgggtggaggttgtcagtcccttgagctcatggaagagagttgtggaaggacttagcttgctggatcttggcgtgtcgccttactcgggggcagtatttcacgagactcccttaatcatctatctgttccattttctaattgattatgctgagcttgtgtttatgatcacggatgccctcacagcaatagcgttatatttcgctattcaggacttcaataaagttgtcttcaagaagcagaagctcttactagagcttgaccagtacgcccctgatgtggcagagctcatccgaactccaatggaaatgcggtacattcctttgaaagtcgccctgttttatctccttaacccctacaccattctgtcttgcgtggccaaatcaacctgcgccatcaacaatactctcatcgcctttttcatcttgaccacaatcaagggttcagcctttttgtcagcaatctttcttgcacttgcaacatatcaatcactgtaccctctgacgctctttgttccaggactgctttacctgttgcaaagacaatatattccagtgaaaatgaagagcaaagcgttctggatattctcatgggaatatgcaatgatgtacgtgggcagtctggtagtgattatctgtctttcatttttcctcctgtcctcttgggatttcatccccgcagtgtacggatttatcttgagtgtaccggatctgacaccgaacatcggactgttctggtactttttcgccgagatgtttgaacatttctccctgttttttgtatgtgtctttcaaattaatgtgtttttttacactatcccattagccatcaaactgaaagaacatcctatctttttcatgttcatccagattgctgtcatcgcaatctttaaatcctatcccaccgtgggcgacgtggccctgtatatggcattcttcccagtctggaaccacctttaccggtttctccgcaacatcttcgtactaacgtgtatcatcatcgtgtgttccctcttatttccagttctctggcatctctggatctacgctggcagtgccaacagcaactttttctacgctatcaccctgaccttcaatgtgggccagatcctgttgataagcgattatttttacgcttttctgagacgtgaatactatctgacccacggtctgtacttgacggccaaggatggtaccgaagccatgttagtgctaaagtag

SEQ ID NO: 213354 - DNA, 342 bp, Artificial Sequence
  Description of Artificial Sequence: Synthetic coding sequence
atgagctcaccccaggcccctgaggatggccagggatgcggcgataggggcgacccacctggtgatctgagaagcgtcctggtcaccactgtcctcaaccttgaaccgctggatgaggacctgttccgcggacgacactattgggtgcccgctaaaaggctcttcggcggacaaattgttggtcaagctctggttgccgctgctaaatctgtgagcgaggatgttcacgtacactctctgcactgttactttgttcgagccgaacagatgccatcttgtgttctaaggagaagtcccgctgaaaagagcctgtggacattcacagtttgcgacctctactag

SEQ ID NO: 213355 - DNA, 1320 bp, Artificial Sequence
  Description of Artificial Sequence: Synthetic coding sequence
atgcggagggccgcattaagactatgcgccctgggcaaaggacagctgacacccggtcgagggttgacccagggaccccaaaaccccaaaaagcagggaatctttcacattcacgaagtacgtgataagctcagagagattgttggcgcatctacaaattggagggaccatgtcaaggccatggaggagcgcaaactccttcattcattcctggccaagtcccaggacggtttgccccctaggaggatgaaggacagttacatcgaggttctcctcccattgggctccgaaccggagctgcgggagaagtacctcactgtgcagaacactgtgcgctttggaagaatcctcgaggacctggacagcctcggggtgctgatttgttatatgcacaataagattcattccgcgaagatgagtcctctgagtatagtcacggctctggttgataagatagatatgtgcaagaagtccctgtcacctgaacaagacatcaagttctctggtcacgtctcctgggtagggaagacatccatggaagttaagatgcaaatgttccagctgcacggcgacgaattttgcccagtcctggacgccacctttgttatggtcgcgcgagacagcgagaacaaaggaccggctttcgttaaccccctgatccctgagagccccgaagaagaagaactgtttcggcagggggaattaaataaggggagacggattgccttcagttcgacctctctactcaagatggcaccttccgctgaagagagaacaactatccacgaaatgtttctatcaaccttggatccaaagacaatctcctttaggtcccgggtcctaccctcaaacgcagtctggatggagaattcaaagctcaaatctttggagatatgccaccctcaggagaggaacatctttaacaggatttttggcggttttctcatgcggaaggcctatgagctcgcttgggctaccgcctgttccttcggagggtcccggcctttcgtcgtcgctgtggacgacatcatgttccagaaacctgtagaggtcgggtccctgctgttcctgtcctcccaggtctgctttacccaaaataactacatccaggttagggttcatagcgaggtcgcttcccttcaggagaaacaacatactactaccaatgtgtttcactttacattcatgtctgaaaaggaagttcccctggtctttccaaagacgtacggtgagtctatgttgtatctagatggccagcgacactttaattccatgagcggtcccgcaacactgagaaaggattatctggtcgaaccatag

SEQ ID NO: 213356 - DNA, 1140 bp, Artificial Sequence
  Description of Artificial Sequence: Synthetic coding sequence
atggaggagcggaaattactgcattctttcttggctaaatctcaggacggccttccaccacgccgtatgaaggacagctatatcgaggtgctgctgccactgggttccgagcctgaacttcgagagaagtaccttaccgtgcagaacacagtacggtttgggcgtatactcgaggatctagactccctcggcgtgctgatttgctacatgcacaataaaattcatagtgccaagatgtctcctctgtcaatcgtgactgcgctagtcgataaaatcgacatgtgtaagaagtccctctctcccgagcaggatataaaattttcaggccatgtctcgtgggttggtaaaacgagcatggaagtaaaaatgcagatgtttcagttgcacggggacgaattctgcccagtactggatgctacttttgtgatggtcgcccgagacagcgagaataagggcccagcctttgtcaacccattgataccggaaagcccagaggaagaggagctgtttcgccaaggggaactgaataaggggcgacgcattgctttttccagtacctccctactcaaaatggccccatccgctgaagaaaggacgactatccacgagatgtttctatccacactcgatccaaagaccattagtttccggagccgtgtgctgccaagtaacgccgtctggatggagaactcaaaactgaaaagcctagaaatttgccacccgcaggagagaaatatttttaatcgtattttcggcggatttttgatgaggaaggcctacgaactggcttgggctaccgcgtgttccttcggagggtccaggccgtttgtcgtggcagtggatgacatcatgtttcaaaagcctgttgaagttggaagcctcttattcctgtccagccaggtgtgttttacccagaacaactacattcaggttcgcgtgcactcagaggtggccagtctgcaggaaaagcagcacaccaccacaaatgtgttccattttactttcatgagtgaaaaggaggtcccgctggttttcccgaaaacttacggcgaatctatgctctaccttgatgggcagagacactttaatagcatgagcggccctgccactctcaggaaagactatctagtcgagccctag

SEQ ID NO: 213357 - DNA, 1347 bp, Artificial Sequence
  Description of Artificial Sequence: Synthetic coding sequence
atgcggcgtgctgcccttaggctgtgtgcgcttggtaaaggtcagctgacaccaggacggggtttaacccagggtcctcaaaatccgaaaaagcagggtatattccacattcatgaggcctgctcaagcattcacgtaaaccatgttagggacaaattgcgggagatcgtgggtgcctctactaattggagagatcatgtgaaggccatggaggagcgcaaactattacatagctttttagccaaatcccaggatggtctccccccacggcgaatgaaggatagttacatcgaggtgctgcttcctcttggttccgagccggaactgagagagaagtacttaactgttcagaataccgtgcggtttgggagaatcctggaggatctggactcccttggggtcctgatctgttatatgcataacaaaatccactcagctaaaatgtccccactgagtatagtgacagccctggtggacaaaatagatatgtgtaagaaaagcctgagtccagagcaggacatcaagtttagtggccatgtaagctgggtggggaaaacaagcatggaggtcaaaatgcagatgtttcagctccacggcgacgagttctgcccggttttggatgctacattcgtcatggtggctagagactcagagaacaaaggacccgcatttgtgaaccctctaatccctgagagcccagaggaagaagaactgtttcggcagggagaattgaataaaggccgtcgtattgccttcagttccaccagcttactgaagatggccccatcagcggaggaaagaacaaccatccacgagatgttcctatctaccctggatccaaaaactatctcttttagatcccgggtactgccctctaatgccgtctggatggagaactccaagttgaaaagcttggagatctgtcatcctcaggaaagaaacatcttcaataggatctttggaggctttctgatgcgcaaggcttatgagctggcctgggccactgcatgctcttttggtggctcacggccatttgtagttgccgtggatgatataatgttccagaaaccagtcgaagtgggttccttactgttcctctcctcacaggtgtgtttcacccaaaacaactatatccaggttcgggtgcatagtgaggttgcttccctgcaagagaaacagcacacaacaacaaacgtctttcatttcacctttatgtcagagaaggaagtgccactcgtcttccctaagacttatggggagtcaatgctctatctggacggccagcgccactttaattccatgtcaggccctgcaactttaagaaaggattacctagtggagccctag

SEQ ID NO: 213358 - DNA, 1269 bp, Artificial Sequence
  Description of Artificial Sequence: Synthetic coding sequence
atgacagtttttttcaagaccctcaggaaccattggaaaaaaaccaccgcaggactctgtctgttgacctggggtgggcactggttatacggcaagcactgtgacaacttgttgaggagggcagcctgtcaagaagcacaggtttttgggaaccaactcataccccctaacgcccaggtaaaaaaagccacagtcttcttaaacccagctgcatgcaaaggtaaggctcgcactctgttcgagaagaacgccgcacctatactgcacctttccgggatggatgtgaccattgtcaagaccgattatgaggggcaggccaagaagctgctggagctgatggagaacaccgatgtgattatagtagcaggaggcgacggcactctgcaggaagtggttacaggcgtactcagacgtacagacgaggcaacattttccaagattcctattggctttattccactcggagagacgtcatccctgagtcacacactgttcgccgaatccggcaacaaggttcagcatatcactgatgctacactggccatagtgaagggggaaaccgttcctttggatgtgctccaaattaaaggtgagaaagaacagccagtctttgcaatgactggtctccgatgggggtcctttcgcgacgcaggtgttaaagtgtccaaatactggtacctggggcctctaaagattaaggctgcccacttcttcagtacgctgaaggagtggccacagacacaccaggcatctatctcttacactggcccaacagagcggccacctaacgagcctgaagagacccctgtgcaaaggccatccctgtatcgtagaatactccggaggctggccagctactgggcacagccgcaagacgcattgagccaggaagttagtccagaggtctggaaggatgtccagctgtctactatcgaactgtctataactacccgaaacaatcaactggaccctacatctaaagaggacttcctgaatatttgcattgagcctgacactatctcgaaaggagattttatcaccattggcagccgcaaggtgcggaacccaaaactccacgtggaaggaacagaatgtctgcaggcaagtcagtgcacgctactaattcctgagggggcaggtgggtcatttagcattgactcggaagaatatgaggccatgcccgtggaggtcaaactgttgccgcgtaaactgcagttcttctgtgacccaaggaagcgggagcagatgctgacaagcccgacccagtag

SEQ ID NO: 213359 - DNA, 198 bp, Artificial Sequence
  Description of Artificial Sequence: Synthetic coding sequence
atgacggtatttttcaaaacactgagaaatcattggaagaagacgactgctggactgtgcctgctgacctggggaggacactggctgtacggtaagcactgtgataatctgcttagaagggcggcttgtcaagaagcacagcactaccaagacgaaagcagatgggaacccactttgagtcggaccccagggtcatag

SEQ ID NO: 213360 - DNA, 198 bp, Artificial Sequence
  Description of Artificial Sequence: Synthetic coding sequence
atgactgtgttctttaaaactttgcggaatcactggaagaagaccactgctggcctttgcctgctcacctggggcggtcattggttgtacgggaaacattgcgacaacctactgcgcagagccgcatgtcaggaggctcagcactaccaggacgaaagcaggtgggagcccacattgtcccgcactcctggatcttag

SEQ ID NO: 213361 - DNA, 735 bp, Artificial Sequence
  Description of Artificial Sequence: Synthetic coding sequence
atgacagtcttttttaagactctacgcaaccactggaagaagacaacagcgggactatgcctgctgacgtggggaggtcactggctgtatggaaagcactgcgacaatctattacggagagccgcttgccaagaggcccaggtgttcggcaaccagcttatccccccaaacgctcaggtgaagaaggccaccgtattcctgaaccccgctgcctgcaagggcacgctattcgaaaagaacgccgctcctatcctacatctatctggcatggacgtgactatcgtcaaaactgactatgagggccaggctaagaagctgttggaactgatggaaaacacagatgtcatcatcgttgccggaggcgacggaactctgcaggaggtcgtcacgggggtgctccggaggacagacgaagccacatttagcaagatacctatcggatttatcccacttggtgagacctccagtctgagccacaccctgtttgccgagagcggcaacaaggtgcagcacatcaccgatgcgactctcgccatcgttaagggtgagacagtccctctggacgtgctgcaaatcaaaggtgagaaggagcagcccgtcttcgccatgaccggacttcggtgggggagctttcgcgacgccggtgtgaaagtgagcaagtattggtacctgggacccttaaaaattaaggctgcccattttttttctactctgaagccctttcccaagagatag

SEQ ID NO: 213362 - DNA, 1728 bp, Artificial Sequence
  Description of Artificial Sequence: Synthetic coding sequence
atgcagtctccttggaaaatactcacggtcgcaccactgttccttctgctgagcctccagagctctgcgtcccctgccaacgacgaccagtctcgcccttccctgtctaacggacatacctgcgtaggttgtgtactagttgtgtcggttatcgagcagctcgctcaggtgcataactccaccgtacaggcgtctatggaaagactctgtagctatctgcccgagaaattgtttctgaaaacaacgtgctaccttgtgatagataaatttggatccgatatcatcaagctcctcagcgcagacatgaacgcggatgtagtgtgtcatactctggagttctgcaaacagaacacggggcagcctttatgtcacctttatccattgccaaaagaaacctggaaatttaccctccagaaagcaaggcagatcgtgaaaaagtctcctattctaaagtatagccggagtggttcagatatctgtagtcttccagttctggccaaaatatgccagaagattaagttggcaatggagcaaagtgttccattcaaagacgtcgattccgacaaatattcagtattccccacacttaggggctaccactggagaggcagagattgtaacgacagtgacgaaagcgtgtaccccggacgcagacctaacaactgggacgtccaccaagattccaattgtaatggtatttggggcgtggacccgaaggacggcgtgccctacgagaagaaattttgcgaaggctcccagccacggggtatcatcctcctgggagattctgctggcgctcactttcacatatcacctgagtggatcacagcctcccagatgtctctgaacagtttcattaacctgccaacggctctgactaacgaattagactggccccagctaagcggggcaacaggattcctcgactctaccgtcggtataaaggaaaaatccatatacctcaggttgtggaaaagaaaccattgtaaccatcgcgactaccagaacatctcccgtaacggggcttctagtaggaacctgaagaagttcattgagagccttagtcggaataaagttttggattaccctgcaatagtaatctacgccatgatcggcaacgacgtgtgttcaggaaaatccgatcccgtgccggctatgaccacaccagagaaactgtacagcaacgtcatgcagactctcaagcatttaaattcacacttgcctaatggttcacatgttatcctgtatggtctgccagacggaacgttcttgtgggacaatctacataaccgttaccaccctctagggcagcttaacaaagatatgacatacgcgcaactgtatagctttctaaactgcctgcaggtgtcgccatgtcacggttggatgtcctccaataaaactctgcgaactctcacctcagagcgggctgaacagttaagtaatacactgaaaaaaattgccgcatcggagaagtttaccaacttcaacctgttttacatggactttgcattccatgagatcatccaggagtggcagaagagaggagggcagccttggcaactcattgagcccgtggatgggttccatcctaacgaagtagctttgctgctgttggctgatcatttctggaagaaagtacaactccagtggccccagatcctgggcaaggagaatccctttaacccacagataaaacaggtcttcggagaccaggggggtcactag

SEQ ID NO: 213363 - DNA, 1632 bp, Artificial Sequence
  Description of Artificial Sequence: Synthetic coding sequence
atgcaatctccttggaaaattcttactgtggctcctttgtttctgctcctgtctttgcagtcatccgccagtccagcaaacgacgaccaatctagaccatcactcagtaatggacatacttgcgtggaaaagcttttcctgaaaactacatgctatctcgtgattgacaagtttggatcagacattatcaagcttttaagtgccgatatgaacgcagacgtcgtttgccatactttagaattctgtaagcagaataccggacagcctctttgccacctctatcctctgcccaaggagacttggaaatttacgctgcagaaagccaggcagattgtcaaaaaatctcctatcctcaaatacagccgtagtggtagtgacatctgcagtctgcccgttttagccaaaatttgtcagaaaatcaagttagccatggaacagtccgttccatttaaagatgttgattcggataagtacagcgtcttccctactctgcgcggataccattggcggggaagggattgtaacgattctgacgagtctgtatatcctggaaggaggcccaataactgggatgttcatcaggactcaaattgtaacggcatttggggtgtggaccccaaggatggagttccatacgagaagaaattttgcgagggatcccagccgagagggattatcctgttgggagattctgccggtgcccatttccacatttcccccgaatggatcactgcctcacagatgagtctgaacagtttcatcaacctccctacagcattaaccaacgaactcgattggcctcaattgtctggagccacagggtttctggatagtactgtcggtatcaaagagaagagtatatacctgcggttatggaagaggaatcactgtaaccaccgggactaccagaacattagcagaaatggggcaagtagcaggaacctcaaaaaattcatcgagtccctgtccaggaacaaggtcctggactaccctgctattgtgatctacgcaatgatcgggaatgacgtctgtagcggaaagtccgatcctgtgcccgcaatgacaaccccagaaaagttgtattcaaacgtgatgcagactctgaaacacctaaactcgcacctcccgaacggatcccacgtgatcctgtacggtctcccagacggcacattcctttgggacaacttgcacaatcgctaccatcctctagggcagctaaacaaggacatgacatatgcacagttatacagcttcctgaactgccttcaggtctccccttgtcatggctggatgagctccaataagaccctgagaacccttacttctgaaagagctgagcaacttagcaatacattgaagaaaatagccgcttcggagaagttcacaaatttcaatcttttttacatggatttcgcttttcacgagatcatccaggaatggcaaaagaggggcggacagccatggcagctgattgaacccgtagatggctttcatcctaacgaagtcgctctgctcttactcgccgatcacttctggaaaaaggtgcagctgcagtggccccaaatactcggcaaagagaatcctttcaacccacagattaaacaggtttttggggaccaaggaggacattag

SEQ ID NO: 213364 - DNA, 894 bp, Artificial Sequence
  Description of Artificial Sequence: Synthetic coding sequence
atgaaactgaaaaacagttttattaacttaccaaccgcactaacgaatgagctggattggccgcagctcagcggggctacaggctttctagattcgactgtgggcataaaggagaaatcaatctacttaaggctgtggaaacgtaaccactgtaatcaccgagactatcagaatatttcacgaaatggcgcttccagccggaacctgaagaagttcattgagagtttgagcagaaataaggtgctcgactaccctgccatcgttatttatgccatgatcgggaatgatgtctgcagcggcaagagcgaccccgtccctgctatgactacgccggaaaagctgtactcaaatgtgatgcaaactctgaagcacttgaattctcatctgccaaatggcagccatgtaatcttgtacgggttgccagatggtacttttctatgggacaatctccacaatcggtatcacccccttggacaactcaataaggatatgacatacgctcagttatactcctttctgaattgcctgcaggtctctccttgtcatggatggatgagtagtaataagaccctgcgaaccctcaccagtgaacgtgctgagcagctgtcaaacactctgaaaaaaattgccgcttctgaaaagtttactaatttcaatctgttctacatggatttcgcttttcatgagatcattcaggagtggcagaagaggggcggtcagccctggcagctgatagaaccagtggatggatttcacccaaatgaagtagctctgctgcttctggctgaccacttctggaagaaggtgcagctacagtggcctcagatcctgggaaaagagaatccgtttaatccgcagatcaagcaggtgttcggcgatcagggtggtcactag

SEQ ID NO: 213365 - DNA, 2061 bp, Artificial Sequence
  Description of Artificial Sequence: Synthetic coding sequence
atgcaatcgccttggaaaatcctcaccgtggcaccccttttcctcctgcttagcttgcagtcctctgcctctcctgcgaatgacgaccagagccggccatctctgtcaaacggtcacacctgcgttgggtgcgtgctggtggtgagcgtaattgagcagttagcgcaggtccataacagcactgtgcaggcatccatggagcggttatgttcatacctgccagaaaaactgtttctgaaaacgacctgctatttggtgatagataagttcggctcggatataatcaaattgctcagcgcggacatgaatgcagacgtcgtatgccacacattagaattttgtaaacagaataccggccagccactttgccatctgtacccactgcccaaagagacgtggaagtttaccctccagaaggctcgccagatcgtgaaaaaaagtccgatcctgaagtattcgaggtcaggatctgacatttgttccttacccgtcctcgccaaaatctgccaaaaaatcaaactggctatggagcagagtgtcccctttaaggacgtggatagcgataaatactcagtttttcctacgctgagagggtatcattggcgtggaagagattgtaatgacagtgacgaaagtgtttaccccggtaggagaccgaacaactgggacgtgcatcaggattccaactgtaacgggatctggggagtggaccctaaggacggcgtcccttacgaaaagaaattctgtgagggttcccagcccaggggaattattcttctcggagatagtgccggagcccacttccatattagtcctgagtggataaccgccagtcagatgagcctgaacagttttattaatcttcccaccgctctcaccaatgaactcgattggcctcagctctcaggtgcaacaggattcctggacagcactgttggaatcaaggaaaagtccatttacctgcggctgtggaagcgtaaccattgtaatcacagggactaccaaaatatcagcagaaatggtgcctctagtcgcaacctgaagaaattcatcgaatccttatcacgcaacaaagtactggactatccagcaatcgtgatctacgctatgattggtaatgatgtttgctctggcaaaagtgatccggtcccggctatgaccacacctgaaaaattgtattctaacgtgatgcagactctcaagcacctcaattcccacctcccaaatgggagccacgtgatcctatacggactgccagacgggaccttcctttgggacaatctgcataatcgctatcatcctctgggtcagctgaataaagacatgacatacgctcagttatacagcttcctgaactgtctgcaggtttccccttgccacggctggatgtcttctaacaagacactgcggacgctgacatcagagagagccgagcagctgtcaaacacactgaagaagatcgcagcttcagagaagttcactaatttcaatttgttttacatggacttcgcgtttcatgagatcatacaagagtggcagaaaaggggaggtcaaccttggcagctgatagaacccgtcgacggcttccaccctaatgaacgcaagtcaatcctgctcaaagggatcctgatgacatcccagactttagacaatcaggaatggacacagttgacaagctggataaagggcaatcttacgtgtgactcccggaccagagagtggctgtgttgctgttggaggatcatctctggaaaacgatgttcatcctcaggcccaaaatcatgggagagacgcatccggagcacccctagacttaatcgctgtcttgagacaaaggcaggcactgagccgttgaggtccatgcacccatggggggctcaaggtggccgaggacttggtaagcttattccgcagctctggggcctccctagacacagacctaagggccttttcttcagctcgatttttaaatgtttgtcacttaatgaagagcacatctggaccaccgtccagtgctgcgtgctacccggatccgtgacgctgccactgttcctcaaatag

SEQ ID NO: 213366 - DNA, 1992 bp, Artificial Sequence
  Description of Artificial Sequence: Synthetic coding sequence
atgcagtccccctggaagattctgaccgtggctcccctgtttctgctgctttcgctgcagagcagcgcgtctccggctaacgacgaccagtccagaccaagtctaagcaatggccacacatgcgtcgggtgcgtgctagttgtgagtgtaatcgagcagctcgctcaggtccacaattccaccgtgcaggcaagcatggagaggctttgctcttaccttcccgagaagctgtttcttaaaaccacatgttacctagtgattgataaattcggaagtgacattatcaagctgctctcagccgacatgaatgctgacgttgtgtgccacacgctggaattctgcaaacagaatactggccagcctctgtgtcatttgtaccccctcccgaaggaaacttggaagttcaccctacagaaagcacgacagatcgttaagaaatctccaattttgaaatacagccgttccggaagcgacatctgtagtctccctgtgctggctaagatctgtcagaagattaaactggccatggaacagagtgtgcccttcaaagacgttgacagtgacaagtatagcgtcttccctacgctgagaggataccattggcggggacgcgattgtaacgatagtgatgagagcgtgtatcctgggcgacggccaaataactgggatgttcatcaggatagcaactgcaatggcatttggggggtggatcctaaggatggagttccatacgaaaagaagttctgtgagggcagccaaccacgcggaatcatcttgctgggcgactccgcgggagcccactttcacataagtccagaatggataaccgcctcccagatgagtttgaatagctttattaatttgcccaccgctttgactaacgagttagattggcctcagctgtccggtgccacaggttttctcgactctaccgtcggtattaaggaaaagtcgatttaccttagattatggaaacgcaatcattgcaatcacagagactaccagaatatctcacggaacggggcatctagccgaaatttaaagaagtttatcgaatctctctcccgcaacaaagtgctggactatcccgcaattgttatttatgcaatgatcggcaacgatgtctgtagcggtaaatcagaccccgtgcccgcaatgaccaccccagagaagttgtacagcaatgttatgcagaccctgaaacatctaaactcccaccttcccaacggctcacacgtcatcttatacggactgcctgacggaacctttctctgggacaacctgcataatcggtatcatcccctggggcagctgaacaaggatatgacatatgcgcagctatactcttttctcaattgcctgcaggtgagtccttgccacggctggatgagctccaataagaccttgcgcactctcacttcggaacgggcagaacaattgtcgaataccctcaagaaaatcgctgcgagtgaaaaattcaccaactttaacttgttctacatggatttcgcttttcacgagataatccaggaatggcaaaagagaggaggacagccatggcagttgatagagcccgtggacggattccatcccaatgaaagaaagtccatccttcttaaagggattctgatgacctcccagaccctcgacaatcaagaatggactcagctgacttcctggattaagggtaaccttacctgtgacagcagaacccgagaatggttgtgttgttgttggagaattatttccgggaaaagatgttcttcttctggaccgaaatcttgggagcggaggatacggtctacccctcgcctgaacaggtgcttggagacaaaagccggtaccgaacctctgcgatcaatgcacccttggggagcccaggggggaagaggactcggaaaattgatcccgcagccctatggcggatgtcacgtcaccggaccaaaggactctagctctgcagcctccctccagatgtcgttcagtcagtag

SEQ ID NO: 213367 - DNA, 300 bp, Artificial Sequence
  Description of Artificial Sequence: Synthetic coding sequence
atggctgagggtaacactctcatttcagtcgattatgaaatctttggcaaggtacaaggcgtattcttccgtaaacatacacaggcggagggtaaaaaactgggattagtgggctgggtacagaatacagatcgcggaaccgttcaaggacagttgcagggtccgatttcaaaggtgaggcacatgcaggagtggctggagactcggggtagcccaaaatcgcatatcgataaggccaattttaataatgaaaaagtgatcttgaaattggattactcagacttccaaatcgtcaaatag

SEQ ID NO: 213368 - DNA, 168 bp, Artificial Sequence
  Description of Artificial Sequence: Synthetic coding sequence
atggctgaaggtaataccctcatctcggtcgattatgagatctttggtaaggtgcagggcgtgttttttcggaagcatactcaggagatgacagtcgaaaatcgaattgccgaaacccacagcaagtcatgtgtgcctgtgtccttcgctacgagctacgctggatag

SEQ ID NO: 213369 - DNA, 300 bp, Artificial Sequence
  Description of Artificial Sequence: Synthetic coding sequence
atggcggaggggaacaccctgatttccgtagattacgagatttttgggaaagtgcagggggtgtttttcagaaagcacactcaggcagaagggaagaaactgggcctggtgggttgggttcagaacacagatcgagggacagtgcagggccaactccaaggcccaatcagcaaggttcgacatatgcaggagtggctggagacccggggtagtcccaagagccacatcgacaaagccaactttaacaatgagaaggtcattctgaagctggactattctgacttccagattgtcaaatag

SEQ ID NO: 213370 - DNA, 300 bp, Artificial Sequence
  Description of Artificial Sequence: Synthetic coding sequence
atgtcaactgcccagagcctgaaatctgtggactacgaggtgttcggcagggtgcagggcgtgtgcttccgaatgtacaccgaggacgaggcccgtaagatcggcgtggttgggtgggttaagaacacgagcaaaggaaccgttacaggacaagtgcagggcccagaggataaggtgaacagtatgaagagttggctgagtaaggtgggcagtccctcctcaagaatagacagaaccaattttagcaatgaaaaaacaataagcaaactagaatattctaattttagcatcagatattag

SEQ ID NO: 213371 - DNA, 294 bp, Artificial Sequence
  Description of Artificial Sequence: Synthetic coding sequence
atgtgtcctctgcccttagcagctgcagccgtggcagcgcctcgtgccccacttagattactgaatcgtggcctggctgcggcaatgagcaccgcccagagcctgaagtctgtcgactatgaggtgtttggcagagttcagggggtctgttttcgaatgtacactgaggacgaggcccgaaaaattggtgtggtaggttgggttaagaacacttccaagggcaccgtgacagggcaagtgcaagggccagaagacaaagtgaattctatgctcgaatgcagcggtttaatttag

SEQ ID NO: 213372 - DNA, 2247 bp, Artificial Sequence
  Description of Artificial Sequence: Synthetic coding sequence
atggtgctcctccgcgtcctcatcctgctcctgtcctgggctgcaggaatgggagggcagtatggaaatcctctgaacaaatatattaggcactatgaaggtctgtcgtataatgtggatagcctccaccagaaacaccagcgcgcaaaaagagctgtgtctcacgaagaccaatttttgcgactggattttcacgcgcatggacgtcattttaatctcagaatgaaaagggacacttccttatttagcgatgaatttaaagtggaaacgtctaataaggtgctggactatgatacatctcacatctacaccggtcatatctatggagaggaggggagtttctcacacggctcagtgatcgacggcagattcgagggttttattcaaactagaggcggaaccttctatgtggaacctgccgagcgatacataaaggaccggaccctgccgttccatagtgtgatctatcatgaggacgatataaattacccccataaatatggtccccaggggggttgcgcagaccactccgtattcgaaaggatgcgcaagtatcagatgacgggagtagaagaagttacccaaattccacaggaagaacacgccgcaaatggcccagagctcttaaggaagaaaaggactaccagcgccgaaaaaaatacctgtcagttgtatatacaaacagaccacttattcttcaagtactatggcacccgggaggccgttatagcccagatctccagccacgtgaaggcaattgacaccatctaccagaccacggatttctccgggatcagaaacatttccttcatggtaaagcggatccgcattaatacaaccgccgatgaaaaagatcccacaaatccattccggttcccaaacattggggtggaaaagttcttagaactaaatagcgagcagaatcacgacgattactgtctcgcctacgtattcaccgaccgcgatttcgatgacggagttctgggcctcgcttgggtcggagccccatctggcagcagcggcggaatttgcgagaagtctaagctgtatagcgatggcaaaaaaaaaagtctgaatactgggattattactgtgcagaactatggctcccacgttccgcctaaggtaagccacatcactttcgcacacgaggtaggacataactttgggagcccccacgatagcgggaccgaatgtaccccgggtgagtctaagaacctgggccagaaagaaaatggtaactatatcatgtatgctagagcaacctccggtgacaagctgaataacaacaagttctctctatgtagcatacgcaatatctcccaggtcctagaaaaaaagcggaacaactgtttcgtcgagagtggacagccaatttgtggaaatgggatggtggagcagggggaagaatgcgactgtggttactctgatcagtgtaaggacgaatgctgcttcgacgccaaccagcccgaaggtagaaagtgtaagctgaagcctggaaaacagtgcagcccctcacagggcccatgttgcacagcgcagtgtgcttttaagtccaagagcgagaagtgccgagacgacagtgattgcgcccgtgaaggaatctgtaacggctttaccgccctttgccccgcaagcgaccccaaacctaactttaccgactgtaatcgacatacacaagtatgcattaacggccagtgtgcaggctctatctgcgagaagtacggcctcgaggaatgcacctgcgcctcctccgacggcaaggacgataaggagttgtgccatgtctgttgcatgaagaaaatggacccaagcacttgcgccagtactggtagtgtgcaatggagtcggcatttctcaggcagaaccataacactgcagccgggatcaccctgtaacgattttagagggtactgtgatgtcttcatgcggtgcaggctggtggacgccgatggccctctggcaaggctgaaaaaggctatcttttccccagaattgtacgaaaacattgccgaatggatagtcgcccattggtgggctgtcctccttatgggcatagccctgattatgctgatggccggttttatcaagatttgttcagtccataccccctcctcgaatcccaagctgccaccccctaaaccacttcctgggactctgaagagacggagaccgcctcagcccattcagcagccacagcggcaaagaccaagagaatcctatcaaatggggcacatgaggcggtag

SEQ ID NO: 213373 - DNA, 1344 bp, Artificial Sequence
  Description of Artificial Sequence: Synthetic coding sequence
atggtcctccttagagtgctgattctgctgctgtcatgggctgctggtatgggcgatagagactttgacgacggggttctcggactggcctgggtcggagctccctctggcagctccggtggcatttgcgagaaatcaaagttgtactcagacggcaaaaagaaaagtttgaataccgggataataacggttcagaactatggctcacacgtgccacccaaagtgagccatatcacgtttgcccatgaggttggccataatttcgggtccccccacgatagcggaaccgaatgcaccccaggcgagtctaaaaatttgggtcagaaggagaacggcaattacataatgtatgctcgcgctactagtggtgacaaactaaataataacaaattcagcctttgctccatacgaaacatcagtcaagttcttgaaaagaaaagaaataactgcttcgtcgaaagtggacagcccatttgtggtaatggcatggttgaacagggcgaggaatgtgactgtggctacagcgaccagtgcaaggatgaatgttgctttgacgccaaccagcccgagggacgtaaatgcaaactgaagcctggcaagcagtgcagtccatcgcaaggaccgtgttgtacagctcaatgtgcattcaaatccaagtctgagaagtgcagagatgactccgactgcgctagggagggtatatgtaatgggtttactgcactgtgccctgctagtgatcccaaaccaaattttacagattgtaacaggcacacgcaggtttgtataaacggacagtgcgcaggcagcatctgtgagaaatatggcctagaggaatgcacgtgcgcctcctccgatggaaaagatgataaggagctctgccacgtttgttgtatgaagaaaatggatccctccacttgcgcatctaccgggagtgtgcagtggagcagacatttcagcggaaggactatcactcttcagcccggaagcccgtgtaatgacttccgtggctattgcgacgtgttcatgagatgccgattggtggatgcggacgggccactggctagattaaaaaaagccatcttctcccccgagctttatgagaatatcgcagagtggattgttgcccattggtgggccgttctactcatggggatcgcattaattatgctaatggcaggattcatcaagatttgttcagtgcatacacccagtagcaaccccaaacttcctccaccaaaacccctcccagggacgctcaaacgcagacgcccaccccagccaattcagcagccacagcgtcaacgtcctagggagtcttatcaaatgggtcatatgcggagatag

SEQ ID NO: 213374 - DNA, 2310 bp, Artificial Sequence
  Description of Artificial Sequence: Synthetic coding sequence
atgaggcttctgagacgatgggctttcgccgcactcttactctccctgctgccaactccaggtctgggtactcagggtccagctggagccctcagatgggggggtctgcctcaactggggggtcccggtgccccagaggtaaccgaaccctcccggcttgtgagagagagttcaggtggtgaagttcgcaaacaacaactggacacccgagtgcgtcaggaacccccaggaggtcctcccgtacacctcgctcaggtttctttcgtgatccccgcattcaatagcaacttcaccttagatcttgagctcaaccaccatttactctccagccaatatgtagagaggcatttcagccgcgaaggcacaacacaacacagcacgggcgctggcgaccattgctactaccaaggcaagttaagagggaacccacactcattcgccgcactcagcacgtgtcaaggactgcatggtgtgtttagtgatggtaatctcacgtacattgtggagcctcaagaggtcgctgggccatggggagcaccacagggacccttgccacacctgatataccgcacaccactgctgccagatcctttaggttgcagagaacccggttgtctgtttgcagtgccggcacagagcgcaccgccaaatcgcccaagactcagacgcaagagacaggtccggagaggacacccaacagtgcactcggaaacgaaatacgtcgaactgatagtgatcaacgaccaccagctgttcgagcaaatgaggcagagtgtggttctgacatccaacttcgccaaatcagtggtcaatctcgccgacgtgatctataaggaacagctgaatacgcggattgtcctggtcgctatggaaacctgggccgacggggataaaattcaggtccaagacgatctccttgagaccctcgcgcgacttatggtctatcgaagagagggtctgcccgaacctagcgacgccacccacctgttttccgggcgaactttccagtctaccagttcgggagcagcgtatgtgggaggtatctgcagtctatcccatggaggtggtgttaatgaatacggcaatatgggggcaatggccgtcaccctcgcccagaccctgggtcaaaatctcggtatgatgtggaataagcatagatctagtgcaggagattgcaaatgtccagacatttggctgggctgcatcatggaagataccggattttacctgccacgaaaattttctaggtgttctatcgatgagtacaatcagtttctccaagagggaggaggatcttgtttgtttaacaagcccctgaagctgctcgaccctccagaatgtggcaatggatttgtggaggccggagaggaatgcgactgtggctccgtgcaggaatgtagccgggctgggggaaactgctgcaagaagtgcaccctgacacatgatgctatgtgttcagatggactgtgctgccgcaggtgcaaatacgagcctcggggtgtttcctgtcgtgaggctgtcaacgagtgtgacatcgctgagacttgtactggagacagttcgcaatgcccccctaatctgcataagctggatgggtactactgcgaccacgagcaaggccgttgctacgggggtcgctgcaaaactcgcgaccggcagtgtcaggtgctgtgggggcacgccgctgccgatagattctgctacgagaagctgaatgtggagggcactgagcgtgggtcctgtggcagaaagggctctggatgggtgcaatgttccaagcaagacgttctttgtgggtttctgctttgtgtcaacatttccggagccccacgtttgggtgatctggttggcgatatttcctccgtcacgttttaccatcagggcaaggagctggactgccgcggagggcatgttcaactagctgacgggtccgacctgtcttacgtcgaagacgggacagcgtgcggacccaacatgttgtgcctcgaccataggtgcctccctgcttctgcattcaatttcagcacgtgcccgggaagcggagagcggaggatttgctctcaccatggcgtctgtagcaacgagggcaagtgtatttgccagcctgactggacagggaaagactgtagtatccacaatcctcttccaacgagccccccaaccggtgagacagagcggtataaaggcccttccggtacgaacattatcatcggctccattgcaggagccgtgctggtggctgcaattgttcttggagggaccggctggggttttaagaatatccgacggggaaggagtggaggagcttag

SEQ ID NO: 213375 - DNA, 1572 bp, Artificial Sequence
  Description of Artificial Sequence: Synthetic coding sequence
tgctggggaagcgggcatcttctgagcagtcagtacgtcgagcgccactttagcagagaaggaactacccaacacagtaccggcgctggcgaccattgttattaccagggaaaattaagaggtaacccccattcttttgccgctttgtccacctgtcaggggctgcatggcgtattttcggacgggaacctgacttacattgttgaaccacaagaagttgcgggtccctggggagcgcctcagggaccattgccccacctcatctaccgaactcccttgctgcctgatccactgggatgtcgcgagcccggatgtctgttcgctgtcccggcacagtccgccccacctaatagacctcggttaaggcgtaagagacaggtccgcagagggcatcccaccgtacactccgaaacaaagtatgtcgagctgatcgtcattaacgaccaccaacttttcgagcagatgcgccaatcggtggttctcaccagtaatttcgctaaaagcgtggtgaatttggcggatgtgatttacaaggaacagctaaacacacgaatcgtccttgtggccatggagacttgggctgatggggataagatacaagtgcaggacgacctcttggaaaccctggccagacttatggtgtatagaagagaggggctgcccgagccaagtgatgctacccacctcttttccgggaggaccttccagtcaacgtccagcggggcagcctatgtagggggtatatgcagtctcagtcacggagggggagtcaatgagtacggcaacatgggcgctatggcggtgacactagctcagacactcggccagaacctcggaatgatgtggaataaacatcgaagctccgccggagattgtaagtgccctgatatttggttgggatgcatcatggaagacacaggcttctacctgcccaggaaattctcaaggtgcagtatcgacgaatataaccagttccttcaggaaggaggaggttcctgcctctttaataaaccgctgaagctgttggaccccccagaatgtggaaatggctttgttgaggcaggcgaagagtgcgactgcgggtctgttcaagaatgcagtagagcgggaggaaattgttgtaagaagtgtacattaacacacgatgcaatgtgctcggacggcctatgttgcaggagatgtaagtacgagcctaggggtgtgtcctgtagagaggcggtcaatgaatgtgatatcgccgagacctgtaccggagatagcagtcagtgccctccaaacttacacaagcttgatggctattattgcgatcatgagcagggtcgatgttacggaggaagatgtaagactagagatagacagtgtcaagttttatggggccatgccgcagccgacaggttctgctacgaaaagctaaacgttgagggaactgaacgcggttcttgcggcaggaaaggatcaggttgggtgcagtgttccaaacagccccagcagggccgagctgtgtggctcccaccattatgccagcacctctggtcgagctctgcaaggggccctggagggcgacatcagtag

SEQ ID NO: 213376 - DNA, 1710 bp, Artificial Sequence
  Description of Artificial Sequence: Synthetic coding sequence
atgcaaggtacaaggttacccgtctgttgcgcttgccccgtggggtcttcgaagcctgctgaggctgagaaggagaaagtgcgcaggggccacccgaccgtgcactccgagaccaagtacgtagagctgatcgtgatcaatgaccatcagctgttcgagcagatgcgtcagtccgtggttctgacctcaaactttgcaaaaagcgtggtgaacctggcggatgtgatctataaggagcaactaaacactagaatcgtactagtagccatggagacatgggctgatggcgacaaaatccaggtccaagatgatctgctggagacattggctagattaatggtgtatcggagagagggtttgccagagccctccgacgccacacatctgttttctggcagaacatttcagtccacctcctccggcgctgcatacgtcgggggtatatgtagtctcagccacgggggtggggtgaacgagtacgggaatatgggcgctatggcagtgacactcgcccaaaccctgggccagaatctgggcatgatgtggaataagcaccgctcctctgccggagattgtaaatgtccagatatctggctggggtgcatcatggaggatacagggttctatcttcctcgtaagttcagtcgatgcagcatcgatgagtacaaccagtttttgcaagagggcggagggtcctgtctgttcaataagccccttaaattactggatcccccagagtgcggcaatgggtttgttgaagctggcgaagagtgtgattgtggctccgtgcaggagtgctcacgcgctggagggaactgttgcaaaaagtgcacgctgacacatgatgccatgtgtagcgatggcctgtgctgtcgacgatgcaaatacgaaccacgaggggtgtcctgcagggaagctgtgaacgagtgcgatattgcagagacctgcaccggagactcttcgcaatgcccaccgaacctgcacaaactcgatggctactactgtgaccatgaacagggaagatgttatggagggcgttgcaaaactcgcgaccgacagtgccaagtcctgtggggccacgccgctgccgacaggttctgctacgaaaagttaaacgtggaaggaaccgagcggggtagttgcgggagaaagggctctggttgggtgcaatgctctaagcaagacgtgctctgcgggttccttttatgcgtgaacataagcggtgctcccaggcttggagacctagttggagatattagttctgtgactttttaccatcaaggtaaagaactggattgccggggaggacacgtacagctcgcagacggaagtgatctgtcatacgtggaggacggaactgcgtgcgggccaaatatgctgtgtttggaccaccggtgtctacctgcatccgctttcaacttttccacctgtccaggcagtggagagcgacgcatctgttctcaccatggggtctgctccaatgagggaaagtgtatctgtcagcctgattggacaggcaaggactgcagtattcataatccactccccacatccccacctactggcgagacagagagatataagggaccctccggtacaaacataataatcggctctatcgcaggtgcggtacttgtggcggctattgtgttgggagggactggatggggattcaagaatattcgacggggacgcagtggcggagcatag

SEQ ID NO: 213377 - DNA, 2217 bp, Artificial Sequence
  Description of Artificial Sequence: Synthetic coding sequence
atggccgcacgaccgctgcctgtctctccagccagggcccttctccttgcgttggctggagcactcctggcaccctgtgaggccagaggtgtctctctttggaaccaagggcgagctgacgaagtggtgtccgcctctgtcgggagcggggatctgtggatccccgtgaaaagctttgactccaagaaccatccggaggtactgaacattagactgcagcgggagtccaaggagctgattataaacctggaacgcaacgaagggctcatagccagtagtttcacagagacacactaccttcaggacggaactgatgtctcacttgctagaaattataccgtgattctgggtcactgctattatcacggtcacgtgagaggctatagcgactccgctgtctctctcagtacatgttctgggctccgcggtcttatcgtgttcgaaaatgagtcatatgtgctggagcctatgaagtcagccaccaatagatataagcttttccccgctaaaaagcttaaaagcgtgagaggctcgtgcgggtcacaccataatactcccaatctagccgctaaaaatgtgttcccgcctccttcccagacctgggcccgacggcacaaaagagagaccctgaaagcgacgaaatatgtcgaacttgtgattgtggccgataatcgggagtttcagagacagggaaaggacctcgagaaagtcaagcagcgcctcatcgaaatcgcaaatcacgtggacaagttttatcgtcctttgaatatccgaattgtgttagtgggcgtggaagtgtggaacgacatggataagtgctcagtgtctcaggatccctttaccagcttgcacgagtttttggattggagaaagatgaaactgctccctcgcaaatctcatgataatgcacagctggtctccggagtctatttccagggtacaactattggcatggctcctatcatgtccatgtgcaccgcggaccagtcaggcggaatcgtgatggaccactctgacaaccctttgggtgccgctgttacgctagctcacgagctgggccacaactttgggatgaaccacgatacactcgacagaggctgttcgtgtcagatggcggtggagaaaggcggttgtataatgaacgccagcaccggataccctttccctatggtgttctcaagctgctcccgaaaagacttggagacgtcccttgaaaaaggaatgggagtctgtctattcaatctgcccgaggtaagggaatcttttggtggacaaaaatgtggaaatcgcttcgttgaggagggtgaagagtgcgactgcggggaaccagaagaatgcatgaatcgctgctgtaacgcaacgacgtgtacattaaagcccgacgccgtgtgtgctcacgggctgtgctgtgaagattgccagctaaagcccgctggcacagcctgccgggatagttcgaactcctgcgacctgcctgaattctgtaccggggcttcgccacattgcccggcaaacgtctatctgcacgacggccacagctgtcaggatgtggatggttactgttataacgggatctgccagacacatgaacagcagtgtgtcaccctatggggcccaggcgctaagccagcccctggcatttgtttcgagagggtcaacagcgcgggtgacccctatggcaactgcgggaaggtctcaaagtcttcattcgcaaaatgcgagatgcgagacgcaaagtgcgggaagatccagtgtcagggcggagcctctagacccgttattgggacaaatgctgtgtctattgaaaccaacatccctctccagcaggggggacggattttgtgtcgtgggacacacgtctatttgggcgacgatatgcctgatcccggattggttctggccggaacaaaatgcgcagacggcaaaatctgcctcaaccgtcagtgccaaaatatatccgtcttcggagtccacgaatgcgcgatgcagtgccacgggaggggggtctgcaacaaccggaagaattgtcattgcgaagcccattgggcccctcccttctgcgacaaatttgggtttggcggttcaactgattccgggccaatcagacaggccgaagccaggcaggaggctgccgaaagcaaccgggagagaggacagggccaggagcccgtggggtcccaggaacacgcttctacagcgtccctgacgttaatctag

SEQ ID NO: 213378 - DNA, 2730 bp, Artificial Sequence
  Description of Artificial Sequence: Synthetic coding sequence
atggcagcacgacccctaccggtttccccggcaagggcgctgctgctggctctggcaggcgctctcctggctccatgcgaagccagaggagtctctctttggaaccagggcagggctgatgaggttgtgtcagcctctgtgggttctggggacctctggatcccagttaagagcttcgattccaagaaccatccggaagtgcttaatatacgtctgcagagggaatctaaggaactgattatcaacctagaacgaaacgagggactgatagcatcatcgttcactgaaactcactatctacaagacggtactgacgtgagtctcgcccgaaattataccgtcattttgggacactgttactaccacggccacgtgcggggatattctgactccgctgtgagcctgtcaacttgctcaggattgcggggactgatcgtttttgaaaacgagtcctatgtgctagaaccaatgaaatcagccaccaacaggtataagttattcccagcaaagaaactgaagtccgtccggggaagctgcgggagccaccataacacacccaacctggcggcaaaaaatgtctttccaccaccgtctcagacatgggctcggaggcacaaacgagagacacttaaagctaccaaatacgttgaactggtgatagtggccgacaaccgcgaattccaaaggcaggggaaggacctggaaaaggtcaaacagcgacttatcgaaatagcaaaccacgtggataagttttataggcccttgaacatccgcatcgtacttgtaggcgtagaggtgtggaacgatatggacaaatgttcagtgagccaggatccatttacgagcctgcatgagttccttgactggcgaaagatgaagcttctgccacgcaaaagccatgacaacgcccagcttgttagcggtgtttatttccaaggaacaacaatcgggatggcccctatcatgtccatgtgtaccgcagatcagagtggtggcattgtgatggaccacagtgacaacccattgggagcagccgtcacactggcacacgagctgggccacaacttcgggatgaaccacgacacattggataggggatgcagctgccaaatggccgttgagaaaggcggatgcataatgaacgcgtcgactgggtaccctttccccatggtgttttctagctgctccagaaaggaccttgagacaagcctagaaaaggggatgggggtctgtctattcaatctgccagaagtccgcgaatcttttggcggacagaagtgcggcaaccggttcgttgaggagggagaggagtgcgactgcggggaaccggaagagtgtatgaatcggtgctgtaatgccacaacctgtactctgaaaccggatgcagtgtgcgcacatggactgtgctgcgaggattgccagctgaagcccgctggaactgcctgccgtgattcgagcaattcctgcgacctcccggagttttgtactggtgcaagcccccactgtcccgctaatgtgtaccttcacgacggtcacagctgtcaggacgtcgacggctactgctacaacgggatctgccaaacacatgagcagcaatgcgtaacactctggggccctggagctaagccagcacctggcatttgcttcgagagagtgaatagcgcaggagacccctacggaaactgtgggaaggtctccaagtcatcattcgcaaagtgcgagatgagggacgccaagtgcggaaagatccagtgccaagggggtgcctctagacctgtgatcggcacaaacgccgtatctatcgaaacaaatattccacttcagcaaggtggtaggatcctgtgtcggggtactcacgtgtacttgggggacgacatgccagatcccggactggtgctggccggtacaaaatgcgccgatggcaagatctgcctgaacagacaatgtcagaacatatccgtgtttggggtgcatgagtgcgccatgcagtgccacgggaggggcgtctgtaacaaccgcaaaaattgccactgtgaagcccactgggcccctcccttttgcgataaatttggctttggtggctccactgactccggacctatacgacaagccgataaccagggactcaccatcggcattttggtgacgattctttgtttgctcgcagccggattcgtggtatatcttaagcgtaagactttgattagattactgttcaccaataagaaaacgacgatcgagaagttaaggtgcgtaagaccctccaggccccctaggggatttcagccatgtcaggcccaccttggacacctgggaaaaggcctcatgcggaagcccccagactcttatccccctaaggacaaccccaggagactgttgcaatgccagaacgtcgacattagcagacctctcaatggactcaatgtaccacagcctcagtccacacaacgagtacttccccctttgcaccgtgcgccacgggctcctagcgtgccagcaaggccactgcctgctaagccggcactccggcaggctcaaggcacttgcaaacctaacccaccacagaagcctctgcccgctgacccgttggctcggactacgagactgacacatgcactggcacggacacccggacagtgggagactggccttcgcctggccccactgaggccagccccacaatacccccaccaggtcccacggagtacacacaccgcctatataaagtag

SEQ ID NO: 213379 - DNA, 837 bp, Artificial Sequence
  Description of Artificial Sequence: Synthetic coding sequence
atggcagcccgtcctctgcctgtgagccccgctagagctctcctgttggcactggctggcgcattactcgctccatgtgaggcgcgtggtgtgagtctgtggaaccagggtcgggctgacgaggttgtgtcggcctcagtgggctccggcgatctctggattcctgttaagtccttcgactctaagaatcaccccgaggtcctgaatatccgcttacaacgcgaatctaaagagctgattatcaacctggagagaaacgagggcctgatcgctagttcattcacggaaacacactacttacaggacggtacagacgtctcactggcgaggaattacaccgggcactgctactaccacggccacgtgagaggctactctgacagcgccgtaagtctttctacttgttcaggtctccggggactgattgtgtttgaaaatgaatcttacgtccttgagccaatgaagagcgccactaataggtacaaattgttcccagccaaaaaacttaagagcgttcgagggtcttgtggatctcaccacaacacacctaacttggccgctaagaatgtatttccccctccctcgcaaacttgggcaagacgacacaagagggagacactgaaagctactaagtatgtggagttggtgattgtggccgataacagggaattccaacggcaaggcaaggatcttgaaaaagtgaagcagcggctgatcgaaattgctaaccatgtcgacaaattttatagaccactgaacattcgaatagtgctcgtaggagttgaggtgtggaacgacatggataagtgctcagtttcgcaggaccccttcacctag

SEQ ID NO: 213380 - DNA, 2445 bp, Artificial Sequence
  Description of Artificial Sequence: Synthetic coding sequence
atgagactggccctcctttgggccctagggctgttgggggcagggtcaccactccctagctggccactccctaacatcggcggtacagaggagcaacaggctgaatctgaaaaggcacccagggagcccctcgaaccacaggtcctgcaggacgacctacccatatctttgaagaaggtgctccagacatccctccctgagccactgcgaattaagctggagctggatggcgatagtcacatcttggaactcctgcagaatcgcgagctcgtgcctggcagaccaacactggtctggtaccagcctgatggcacccgtgtggtgtccgaaggacacaccttggagaattgctgttaccagggacgcgtgagggggtatgcaggcagctgggtttcaatatgtacctgttccggacttcggggactcgtcgttctgacaccagagcggtcatacacccttgagcaggggccaggcgacctgcagggcccaccaattatttcacgcatacaagacctgcacttgcctggccatacctgcgcattatcatggcgtgaaagtgtccacacgcagaagcctccagagcacccactggggcagcgacatatacgaagacgaagagacgtggttaccgaaaccaagaccgtggaactggttattgtagccgatcatagtgaagcgcaaaaatatcgtgacttccagcacctgctgaataggaccctagaagtggctcttcttctggacacattcttccgcccactgaatgtccgggttgcgctggtgggcttagaagcctggacgcagcgcgacctggtcgagatctccccaaatccggctgtcacactcgaaaattttctgcactggagacgcgctcatttgctgcccagacttccgcatgacagtgcccagctcgtgacaggtaccagcttctctggcccaacagtgggcatggctatccagaattctatctgctctccagacttctccggcggagtgaatatggatcatagcacttctatcctgggtgtggcctcaagtatcgcccatgagctggggcacagtttaggtctcgatcatgatctcccagggaatagctgtccctgcccaggtccagcccctgcgaaaacatgcatcatggaggcatctactgacttcttgccagggctgaacttctccaactgtagccggcgtgccctggaaaaagctttgcttgacggtatgggatcctgtctgttcgaaaggcttccctccctacccccaatggctgcattttgcggcaacatgttcgtcgaacctggggagcagtgtgactgtggctttttggatgactgtgtggatccatgctgcgacagcctgacatgccagcttcgaccgggagcccagtgcgcaagcgacggcccatgttgtcagaattgccaattaaggccttctggctggcagtgtcgacctacccgcggagattgcgatcttcccgaattctgtccaggggattcaagtcagtgcccccctgacgtgtccctgggtgatggtgaaccttgcgcaggaggtcaggctgtgtgcatgcatgggaggtgtgcctcctatgcacagcaatgtcaatctttgtggggcccaggcgctcagcccgcagcaccattatgtctgcagactgcaaataccaggggtaacgcattcgggagctgcggacggaatccttccggctcttacgtgagttgcacgccccgagatgccatatgcgggcagttgcagtgccagacaggccgaactcagccactgctgggatcaatccgcgaccttctgtgggagaccatcgatgtaaatgggacagaattaaactgcagttgggtgcaccttgatctgggtagcgacgtcgcccagcctctgctgacgctgcctggaaccgcttgtgggccagggctagtctgcatcgaccatagatgtcaacgagtggacctcttgggcgctcaagagtgtcggagcaagtgccatggtcacggagtgtgcgatagtaatagacactgctactgcgaagaaggatgggccccaccagattgcactacacaactgaaggctacgtcctcgctgaccacaggccttctcctgtcattgctggtattgttggtgttagtgatgctgggtgcctcttactggtatcgggcaaggttgcaccaaagactttgtcagctgaaagggcctacatgtcaatatcgcgcagctcagtctggcccttccgagcgccctggcccaccacagcgggcactcctcgctcggggaacaaagagtcagggaccagcgaagccccctccaccacggaagcctctgccagccgatccacaaggaagatgtccgtccggcgacttaccaggacccggagccggaattcccccactcgttgttcctagtcgcccagctcctccccctccaaccgtctcttcgctatatctgtag

SEQ ID NO: 213381 - DNA, 2520 bp, Artificial Sequence
  Description of Artificial Sequence: Synthetic coding sequence
atgaggctggccttactctgggcccttggcctgctaggagctggatcccccctccccagctggccactcccgaacattggcggtactgaagagcaacaagccgagtccgagaaagcccctagagagccactcgaaccacaggtcttgcaggatgacctgcctatcagcctcaaaaaggtgttacagacatccctgcccgaaccactgcggatcaagctggagctggatggggactctcacatactcgaactgttgcagaatagagaactggtgcccggtcgacctaccctagtgtggtatcaacctgatggcaccagggtagtgtctgaagggcacacattagaaaactgttgttatcagggccgagtccggggatatgccggttcctgggttagtatttgcacttgctccgggctgaggggtttagtggtgctgacaccggaacgttcatacactctggagcaaggccctggcgatctccaaggacccccaatcatctccagaattcaagaccttcacctgccaggacacacttgcgccctctcttggagggaatcagtccacacacagaaacctcctgagcatccccttggacaacgacacatacgacgcaggcgcgacgttgtgacagaaacaaagactgtggaactggtcatcgtggccgaccactctgaggcacaaaagtaccgggacttccagcacctcttgaaccggacactggaagtcgctctgctcctggacacgttttttcggcctttgaacgtgcgcgttgcacttgtcggtctcgaggcgtggacccagcgcgatctggtggaaatttcccccaacccagctgttacactggaaaacttcctgcattggagacgcgctcatctactcccccgtttgcctcatgattcagctcagctggtgacaggtacatctttcagtggtccaacagtgggaatggcaattcagaatagtatctgctctccggacttcagcggcggagtgaacatggatcactctacgtctatactgggagtggcgtcctctatcgcccacgaacttggccacagcttgggccttgatcacgacctgcccggtaactcatgcccttgtcctggtcccgctcccgctaagacctgtatcatggaggcctctacggacttcctccctggcctgaacttctcaaactgttccagaagagcactggagaaagccctgttggacggaatgggaagctgtctgttcgagaggctgccgtctttgccaccaatggctgcattttgcggcaatatgttcgtggagcctggggagcagtgtgactgcggatttttggatgactgtgtggacccctgttgcgattccttgacatgtcagctgcgtccgggagctcagtgcgcttcggatggcccttgttgtcagaattgtcaactgcgaccctcggggtggcagtgtaggcccacccgcggtgactgcgacctccctgaattctgcccgggagattcctcccagtgtcctcctgatgtctccctgggagacggcgaaccatgcgcagggggtcaggctgtgtgcatgcacggcagatgtgcatcttacgcccaacagtgtcagtccctctggggtccgggagcacagccagcagcacctctctgcctgcaaactgccaatactcgagggaacgcctttggttcctgcggcaggaatccatccggatcatacgtgtcttgtacacccagagacgcgatctgcggccagctccagtgccaaaccggccgtacccagcccctcttgggatctatcagggacctcctttgggaaacaatcgacgtcaatggaacagagctaaattgttcttgggtacatctggacctggggtccgatgtggcacagcccttactgacactcccgggtacagcctgcgggccaggcctcgtatgcatcgaccatagatgccagcgagtggacctccttggggctcaggaatgccgctcaaagtgtcacggacacggcgtctgtgacagcaaccgtcactgttattgtgaggaagggtgggcccctcccgattgtaccactcagctaaaggccacctcctctctgaccacaggtctactgctgagtttactggtcttgctggttctggtcatgttgggggcttcctattggtatcgcgcaaggctgcatcagcgcctctgccagctgaagggtcctacctgccagtatagagcagcccagtccgggccatccgagagacccggtcctcctcagagagctctgcttgcccgaggtaccaagcaggcatccgctctgtcctttccagctcctccttcccggccattgccacctgatccagtttctaagcggctacaaagccaggggccagctaagcctccccctcccaggaaacccctcccagccgacccacaaggcaggtgtcccagtggggacctccctggtcctggggctgggattccccctctggttgtcccgagtcggccagctccccctcctcctactgtttcctcattgtatttatag

SEQ ID NO: 213382 - DNA, 2592 bp, Artificial Sequence
  Description of Artificial Sequence: Synthetic coding sequence
atgagattggcgctgctatgggcccttggcctgctcggcgctgggagcccactgccatcctggccactgcccaatattggaggcacagaagagcagcaggcagaatcagagaaagcgcctcgcgaacctcttgaaccccaggtgctgcaggatgacttacctattagcttgaagaaggtgctgcagacctccctccccgagcctttaaggatcaaactcgaacttgatggcgactcgcatatactagagctactgcagaatcgcgagttggtccccggaagacctaccctcgtgtggtaccagccggacggaactcgggtcgtctctgaaggccacacgctcgagaactgttgctaccaaggacgtgttcgtgggtatgcagggtcatgggtcagtatttgcacgtgtagcgggcttcgagggctcgtcgtgttgacccccgaacgctcctacacactggagcagggacctggcgatctgcagggcccaccaattattagtaggattcaggacttacatttacctggacacacctgtgcactttcatggcgggaaagcgtgcatactcagaagccaccagaacatcccctgggccaaagacatattcgcagacggcgagatgttgtaaccgaaaccaagaccgttgaactcgtgatcgttgcagatcacagcgaagcgcaaaaatatcgggactttcagcaccttttaaatcgaaccttggaggtggcccttcttctggatacgttcttccgcccactcaacgtccgggtagccttggtgggcctggaggcttggactcagcgggatctggtagagatatcacctaacccagcagtaacactagaaaactttctgcattggcggagggcccacttgctgccacgcttaccacacgatagcgctcagctagttactgggacttccttctcaggaccgacagtcggaatggctattcagaattccatctgctcccccgacttctccggcggtgtgaacatggaccactccacttcaatcctgggcgtggcctcatcaatcgcgcacgaactgggccattctttggggctggaccatgacctccctggcaatagctgtccttgccccggtcccgctcctgccaagacctgcattatggaagcgagcactgactttctgcccggactcaacttttccaattgtagtcggagagccctcgaaaaggccctgctcgatggcatggggagttgccttttcgaaaggctgccttcgttgccccctatggctgctttctgtggaaatatgtttgtcgagcctggagagcagtgtgactgtggcttcctagacgactgcgttgatccatgttgcgacagccttacatgccagctgcggcctggtgcccagtgtgcaagcgacgggccatgttgtcagaattgtcaactgcgccctagcggttggcagtgtcggccaactcgtggggactgcgaccttccagagttttgtcctggagactcgtcacagtgtccaccagacgtatccctgggcgatggcgagccctgtgcaggtgggcaggccgtgtgtatgcatggacgttgcgcctcttatgctcagcagtgccagtctctgtggggacccggtgcccaacctgcagcgcctctgtgtctacagacggcaaatacccggggtaacgccttcggctcctgtggccgaaatccctctggctcctacgtatcatgcacccctagagatgccatttgtggtcagttacagtgccagacagggaggacccagccgctgctgggttccattcgggacctcctctgggagacgatcgacgtcaacggcacggagcttaactgttcgtgggttcatctcgatcttggctccgatgtggcccaacctctgctaactctgcccggaactgcctgtggacctgggctcgtgtgcatcgaccatcggtgtcaaagagtggacctgctgggtgcccaggagtgtagatccaagtgtcacggtcacggcgtctgtgactcaaaccggcactgttattgcgaagaaggctgggctcctcctgactgcaccacccagctgaaagcaacgagttcactcaccacggggttgctgctgagcctcctggtattgcttgttctcgtcatgctcggggcatcttattggtaccgggctaggttgcatcagagattatgtcaactcaaggggcctacctgccagtacagagcagcccagtcaggcccttccgaacgccctggcccaccgcagcgggctctccttgcacggggaactaagcaggcttctgctctgtcgttccccgcaccaccaagcagaccacttcctcctgatcccgtgagtaagcgcttacaggccgagctcgccgacaggcctaacccgcctaccagaccccttcccgcagatcctgtcgtgcggagccccaaaagccaggggcctgctaaaccccctccaccacggaaaccccttccggctgaccctcagggcaggtgtccaagcggtgatctgccaggccctggggcaggcatcccacctctggtcgtccctagtagacccgcaccaccaccccctaccgtgagttctctttatctatag

SEQ ID NO: 213383 - DNA, 2517 bp, Artificial Sequence
  Description of Artificial Sequence: Synthetic coding sequence
atgagactggccttgttgtgggcccttggcctgctcggtgctgggtctccactcccctcctggcccttgcccaacatcggaggcacagaggagcagcaagcggaaagcgagaaagcgcctcgggagcccctcgagccacaggtcttgcaggacgatttgcccatctcactcaagaaggtgcttcagacctctttgccagagcccttgagaatcaaacttgaattagatggtgactctcatatcttggaactcctgcagaaccgggagttggtgcccggacggccaaccctggtttggtaccagccagacgggacaagggtggtgtccgaggggcacaccttggaaaactgttgctaccagggacgtgtcagggggtacgctggcagctgggtctctatctgcacttgtagcggactgaggggtctggtggtccttactccagagagaagctatactcttgagcagggaccaggtgacttacagggaccacctatcatctcacggattcaggatctgcatctgcccggacacacttgtgctctgagctggcgcgagagcgttcatactcagaagccgccagagcatccgctgggacagaggcacatacgaagacgccgtgacgtcgtaacagagaccaaaacggtggaactggtcatcgttgcagatcattctgaggcgcaaaaatacagagacttccagcatttgctgaatcgcactctggaggtcgccctcttactggacactttttttcggccattaaacgtgcgagtagctcttgtcggcctcgaggcctggacccagagagatcttgtcgagatttctccgaatcccgctgtgacactggaaaactttctacactggcgcagggcccacttgctccccaggctgcctcacgacagtgctcaactggtgacagggacaagttttagcggacccacagtcggcatggctatccagaattctatctgctcacccgatttttcgggtggcgtaaatatggaccatagtacaagtatattaggcgtggcaagcagcattgcacacgagcttgggcactcactcgggttggaccacgaccttcctggcaactcgtgcccttgtccagggcctgctcctgccaaaacatgtattatggaagcatcaactgatttcctgcctggcctcaacttttctaactgctccaggagagctcttgaaaaggctctgctcgacggcatgggcagctgccttttcgagagactgccgtcacttcctcctatggcagctttctgtggcaacatgtttgtggagcctggcgagcagtgcgattgcggcttcttggatgactgtgtcgatccgtgttgcgacagcctgacttgccaactgcgcccaggggctcagtgcgcaagcgatggtccttgctgccagaattgccaactcagaccaagtgggtggcagtgccgaccaactagaggcgattgtgaccttcccgagttttgtcccggagactcctcgcaatgtcctcccgacgtatcactgggggatggggaaccttgtgctggaggccaggccgtgtgcatgcacggtagatgcgcctcatacgctcagcagtgccagagtttgtggggacccggagctcagcctgctgccccactatgcctacaaaccgccaacacccgcggaaatgctttcggatcatgcgggcgaaaccctagcggtagctacgtgagctgtaccccacgggacgcaatatgtggtcaactgcagtgccagaccggcaggacccagccgctgcttgggagtattcgcgatctgctttgggaaactatcgacgtgaacgggacagagctgaactgctcatgggtccacttagatctgggttccgatgtggcccagcccctcttgactctgcccggtactgcatgtggccctggccttgtgtgcatcgatcatcgatgtcagcgagtggatctgctgggcgctcaggagtgcaggagcaagtgccatgggcatggcgtctgcgatagtaacagacattgttactgtgaagagggctgggctcctccagactgcaccacacagctgaaggcaacctcttctctaaccacgggactcctgctctctcttcttgtacttttggtgctcgtcatgcttggagcctcctattggtatcgcgcacggctgcatcagcgtctctgtcagctgaagggacctacttgccagtaccgcgcagcccagtctggcccttcggaacgccctggccctccccagagggcactgctggcaaggggcactaaagccgaactcgccgaccggccaaacccccctacacggccactgcctgcagacccagttgttcggtcccctaaatcacaggggccagcaaaacccccaccaccgagaaagcctctgcccgctgatccacaggggagatgtccaagtggggatcttcctggccctggggcaggaattccacccctggtggtgcctagtcgacctgctccccctcctccaactgttagctccctatatctgtag

SEQ ID NO: 213384 - DNA, 2319 bp, Artificial Sequence
  Description of Artificial Sequence: Synthetic coding sequence
atgcggttagcactgctgtgggcactcggcttgctgggcgctggctctccactgcctagttggcctcttccaaatatcgggggaaccgaggaacagcaggccgagagcgaaaaagcccctagagagcctttagaaccgcaggttctgcaggacgatctgcctatatcccttaagaaagtattgcagacgtctctacctgaacctttaaggattaaactagagttagacggggacagccacatactggaactcctgcagaatagggaactcgtgcccggtcgcccaaccctggtgtggtaccaaccagatggaacgagagtggtctctgagggacatactctggaaaactgctgctatcagggaagagtgaggggatatgccggaagttgggtcagtatctgcacttgttccggcctaaggggtctagttgtgttgacacccgagaggtcatacactctggagcaggggccaggggatctgcagggccctccaatcatatcccgcatacaggacctccacctgcccggtcacacctgcgccctgagctggcgggaaagcgtgcatacacagaaacccccagagcacccacttgggcaacgccatattcgcaggcgcagggacgtagttaccgaaacaaaaacagtcgagctggttattgtcgcggatcactctgaagcacagaaatatcgcgattttcagcaccttctcaacagaacacttgaagtagcactgttgctggacaccttcttcaggccgttaaatgtccgggtagccttagtgggcctggaagcatggacccagagagacctggtagagatcagccccaatcctgcagtcaccctggagaacttcctgcactggagaagggcccatttactgccccgtcttccgcacgacagcgcgcagctcgtcaccggaacttcttttagtggacccacggtgggcatggcaatacagaattccatctgcagccccgacttctctggaggggtgaacatggaccattcaaccagcattctgggcgtagcctctagcattgctcacgaactcggccacagcttaggactggaccacgacctgccaggtaacagttgcccgtgtcccggaccggctccagctaagacatgcattatggaggcgtctaccgactttctgcccggactgaattttagtaattgctctaggcgcgcactggagaaagcgctgctggacggcatgggctcttgcctttttgaacgtctccccagtcttccccctatggccgcattttgcggcaacatgttcgtggagccaggcgagcaatgcgactgtggctttctggatgactgcgtcgatccatgttgcgatagcctgacgtgccagttgagaccaggcgctcagtgcgcctcagacggtccttgttgccagaactgtcagctcagaccttcaggatggcagtgtcgacccaccaggggagattgcgacctcccagagttttgcccaggcgactcctcacaatgtcccccagatgtctctctcggtgacggagagccatgcgccggaggtcaagctgtctgtatgcatggcaggtgcgccagttatgcccaacagtgtcagtcgctctggggacccggtgctcagccagcagcaccactctgcctgcagacagctaacaccagggggaatgcgtttggatcatgtggcaggaacccttctggcagttatgtgtcgtgtacacccagagatgcaatctgtggtcagctccaatgtcaaaccggtcggactcagccactgctggggagtatccgtgacctcctctgggagaccattgacgtcaacggaaccgagttgaattgttcctgggtccatcttgatctcgggtctgatgtggcccaaccactcttgaccctgccagggactgcttgcggcccaggattagtttgtattgaccatagatgtcagagagttgatctcctgggggcacaggagtgcaggagcaagtgtcacgggcatggagtttgtgattccaatagacactgttactgcgaggaaggctgggcccctcctgactgcaccactcagctgaaggccaccagttcccttacaactggactccttttgtcactgctggtgttactcgttctggttatgctgggtgcctcctattggtacagagccagacttcaccagcgcctctgtcagctgaagggtcccacctgccagtatagtctcagaggacaaccctccccccatcctcagggatcccattgtctgcctacacccagggcaggtgcccaccgagtaacctgccctgctcagggactcgaatctcgcccttag

SEQ ID NO: 213385 - DNA, 1563 bp, Artificial Sequence
  Description of Artificial Sequence: Synthetic coding sequence
atgaggctcgcactgctgtgggcccttggtctgctaggagccggttcgcccctgccctcatggcccttgcctaacatcggcggtaccgaagaacagcaggcggagagcgagaaagcccctcgcgagcctctggagccgcaagtgctacaagacgacctgccaatcagtctgaaaaaagtattgcagacgagcctccctgagcctctgagaataaagctggagctggacggagactctcatatcctggaacttctacagaaccgaagcttcttgccgggactgaatttcagcaactgttcacggagagccctggaaaaggccctactggacggaatgggatcctgtctgtttgaacgcctgcccagcttgccaccaatggccgctttctgcgggaacatgtttgtggaacccggtgagcagtgtgattgtgggttccttgatgattgcgtggacccctgctgtgactctttaacatgccagctccgtcccggagcgcagtgtgcatccgacgggccatgctgtcagaattgccagctcagaccatctgggtggcagtgccgcccaacacgaggagactgcgacctacctgagttctgccctggggattcttcacaatgtccgcctgacgtgtctcttggagatggcgagccgtgtgccggtgggcaggctgtgtgtatgcatggtcgctgcgccagctatgctcagcagtgtcagagcctttggggaccaggtgcacagcccgcagccccactgtgcctccagacggccaacactagggggaacgcttttggaagctgtggacggaacccttctggaagctacgtgagctgcacacctcgcgatgctatttgcggacagttgcagtgtcaaaccggacgcacacagccactcctggggtcaatccgagatctcctttgggagactatcgatgtcaacgggacggagctgaactgtagctgggtgcacctcgatctgggaagcgatgtcgcccagcccctactgactctgcctggtaccgcatgtggaccgggattggtgtgcatagaccatcgttgtcagagagtcgaccttctgggggcacaagaatgccggtctaaatgccacggccacggagtgtgtgactctaatagacattgctactgtgaggagggctgggctccacctgactgcacaacccagctgaaggctacctctagcctgaccactggacttctgttgtctctcctcgtgctgctggtgctggtgatgttgggagcaagctactggtaccgggctcggttgcatcagaggctgtgtcagcttaaaggacctacgtgtcagtacagggcggcacagagcggaccaagcgagagaccaggcccaccccagcgagctctgctcgccaggggcacaaaatctcaaggtcccgcaaagcctccacctccccgtaaaccacttcctgctgacccacaggggaggtgtccatccggtgacttgccgggacccggtgcaggaatccctccattggtggtccccagtcgtcccgctccgcctcctcccactgtaagtagcctttatctgtag

SEQ ID NO: 213386 - DNA, 2589 bp, Artificial Sequence
  Description of Artificial Sequence: Synthetic coding sequence
atgaggttggcactgctgtgggccctggggctcttgggcgcaggctcaccgctgcctagctggcctcttcctaacattggcggtaccgaggagcagcaggcggagagtgagaaggctccaagggagccattggaaccacaggtgctgcaagacgacctcccgatctctctcaagaaggtcttgcagaccagcttacccgaacctctgaggatcaagttggaattagacggagactctcacattctggagctgctacagaacagggagcttgtgcccggtcggccaacacttgtttggtaccagccagacggaaccagagtagtttctgaagggcatacgcttgaaaactgctgttatcaaggcagagtgagaggatacgccggatcttgggtaagtatctgcacctgctctggcttacgcggtctcgtagtactcaccccagagaggtcatatactcttgagcaaggcccaggtgaccttcaggggcctccaataattagccggatacaggacctgcacctacctgggcacacatgcgctctttcttggagagagtccgtccacactcagaaacccccagagcatccactggggcagaggcacatccggcgtcgccgtgacgtggtgactgaaaccaagaccgtggagctcgttatcgtcgctgaccatagcgaagcccaaaagtatagagacttccaacacttactgaacaggaccctggaggtagcgctactcctggataccttcttcaggcccctcaacgtgagagttgcgcttgttggtctcgaggcttggacacagcgggacctggtggagatctcacctaaccccgctgtcacactggaaaactttttgcattggagacgggcacacttgctgccccgtctgccacacgattctgctcagctggtcactggaacatcgttctccgggccaaccgtgggcatggctatccaaaactcaatttgcagtccagacttcagtggtggggtgaatatggatcattctaccagtatccttggcgtggcttcttccattgcacacgagctgggacatagtctgggcctagatcatgacttgccgggaaacagctgcccctgtcctggcccagctccagccaaaacttgtatcatggaggcgagcaccgactttctgcccggattgaatttctctaactgctcacggagggccctagagaaagcccttctcgatggtatgggaagttgcctgtttgaacggctaccttcactccccccaatggctgctttttgcggaaatatgttcgtcgagcctggggaacagtgcgattgcggattcttagacgactgcgtagacccttgctgcgacagcctgacttgccagctccggccaggggcacagtgtgcctctgacggtccttgttgccagaattgtcaactgagaccctcaggctggcagtgtaggccaacaaggggagactgcgaccttccggagttctgccccggtgacagctctcaatgcccgcctgacgtcagtctaggagacggcgagccttgcgccggtggccaggccgtctgtatgcatggcagatgcgcctcctacgcccaacagtgtcagtcactctgggggccaggcgcacagccagccgctccactgtgcttacagactgccaatactcggggtaatgcattcgggagctgcggacgcaatccatctggatcttacgtgtcttgtacccctcgggatgcaatctgcggccagctccagtgccaaaccggacgcacgcaaccgctgttaggttctatcagagacttgctctgggaaacaatcgatgtcaatggaactgagctgaactgtagttgggtgcacttagaccttggtagcgatgtggcccagccgctgctgaccttaccaggcactgcatgcggtcctggactggtgtgcatcgaccaccggtgccagagggtcgatctgctgggggctcaggagtgtagatcaaagtgtcatgggcacggggtatgcgacagcaaccggcactgttattgtgaggagggttgggccccaccagattgcaccacacaacttaaagcgacctcttctcttacgaccggtctcctgctctcactgctggtcctcctagtactggtcatgctgggtgcttcatactggtatcgcgctagactacaccagcgcctgtgtcagctgaaaggacctacttgtcaatatcgcgctgcccagtctggtccatccgagcgacctggcccaccacagcgcgctttgctcgccaggggcaccaaggccagcgccctgagctttccagcccctccatctaggcctctgccacctgatcccgtgtctaaacgactccaggccgagttggcagaccgtccaaatccgcctacccgaccgctcccagctgaccctgtcgtgagatcccctaaaagccaggggccagcaaagcctccaccccctagaaagcctctgcccgcagacccacagggtcgctgcccgagcggtgatctcccgggacctggtgccggtattcctcctctcgttgtgcctagtcgccctgcacctcctccgccaacggttagctctttgtacctctag

SEQ ID NO: 213387 - DNA, 2391 bp, Artificial Sequence
  Description of Artificial Sequence: Synthetic coding sequence
atgcggctggctctcttgtgggcactgggattgctgggcgcaggctccccccttccatcctggcccctaccaaatatcggcggaaccgaagagcaacaggccgagagcgagaaggcaccgagagaacctctggagccgcaggtgcttcaagatgacctgcctatctccttaaagaaggtactccagacatcccttcccgaaccccttaggattaagctcgaactggacggcgactcccatattctagaactgctgcagaatagagagctcgtgccaggacgacccaccctggtgtggtaccaacccgatggtactcgtgtggtgagcgaaggccataccctcgagaactgctgttaccaggggagagtgagaggctatgccggttcctgggtctctatttgcacttgcagcggtttgcgaggactcgtggtccttacccccgagcgaagttacaccctcgagcaagggccaggagacctgcagggtccccctatcatcagccggatccaggatctgcacttacctgggcacacctgcgcgctttcgtggagggagtccgtgcacacccaaaagcctcccgaacaccctctggggcagcgacatatcagacggcgacgagacgtagttaccgagacaaagacggtcgagctggtcatcgttgctgaccatagtgaggcccaaaagtatcgcgatttccagcacctgctgaatcgaacactagaggttgcacttctgttagatactttcttccgccctctgaatgtccgagtggccctggtcggcctggaggcatggacgcaaagggatttagttgaaatctctcctaatcccgcagtgacactggagaacttcctccactggcgaagagcccacctgttgccaaggcttccccacgacagcgcacagcttgtcacaggaaccagtttctctggaccaaccgtcggcatggctatccagaattctatctgttcgcccgacttttctggcggtgtcaatatggaccattcaacaagcattttgggagtcgctagcagcattgctcacgaacttggccactctctaggccttgatcacgatctgcctggcaatagctgcccttgtcccggtcctgcccctgctaaaacatgcatcatggaggcatccaccgacttcctccctggtctgaacttctccaactgtagccggagagctttagaaaaggccttactggacggcatgggtagttgtctgtttgagcgccttccgagtctaccacctatggctgcattttgtggaaatatgtttgtggaacctggcgagcaatgtgattgcgggtttctggacgattgcgtagacccttgttgcgatagtctgacctgccagctgcgtcccggtgcacagtgtgcatctgacggcccttgctgtcagaactgccagctgcgaccaagcggctggcagtgccggcctacccgcggagattgcgacctgccagagttttgtccaggtgatagctctcagtgcccccctgacgttagccttggggacggcgaaccatgcgctggagggcaagccgtctgcatgcatggcaggtgtgcatcttacgcccagcagtgtcagtcactgtgggggcctggcgcacagcctgcagcccctctatgtctgcagacagccaacacacgaggcaatgcgttcggatcctgtggacggaaccctagtggctcctatgtgagctgtaccccccgtgacgccatttgtgggcaacttcagtgtcagacaggaaggacgcagcctctgctggggtcgatccgggatctgttatgggagactatagatgtgaatggaaccgagctcaattgctcttgggtccacttggatctcgggtcagacgttgcccagcctttactgaccttgcccggtaccgcctgtgggcctggactggtctgtattgatcatcggtgtcagagagtggacctgctgggggctcaagagtgcaggagcaagtgccatggccacggagtgtgcgatagtaatcggcactgctactgtgaggaagggtgggctccccctgactgcactactcaactaaaagctactagctcccttacaacgggactgcttctgagcctgctggttctgctggtgcttgtgatgttgggcgcaagctactggtacagagctaggcttcatcagaggctgtgccagctaaaggggccaacgtgccaatataggctggtcttgagtgcaagcaggcccccactgcccggaagatgccggctgaccttatgccccagagattccagccttcgagggcagccttccccccacccccaaggcagccactgccttccaacaccccgagctggagcccatagagtgacttgccccgcacaaggtttggaatcccggccatag

SEQ ID NO: 213388 - DNA, 2475 bp, Artificial Sequence
  Description of Artificial Sequence: Synthetic coding sequence
atgagacttgccctcctgtgggcgctagggctcctgggcgctggtagcccacttccttcctggcctctccctaatatcgtcttgagctggggcgtcctgggacctgctgggggtacagaggagcagcaggccgaatcagaaaaggcacctcgggagccactggaacctcaagtcttgcaggacgatttgccaatcagcctgaaaaaagtgctccagacctctctgcctgagcctctccggatcaagctggaactggatggagatagccatatcctcgaactgctacagaatcgcgagctggttcctggcaggcctactctggtgtggtatcagccggacgggaccagagtagtttcagaggggcacaccttagaaaactgctgctatcaaggccgtgtgaggggatatgctggcagttgggtgtcgatctgtacttgcagcggcttacgtggccttgtggtgctgacgccggagaggagctacaccctcgagcagggtccaggggacttgcagggaccaccaatcatatccaggatacaggacctccacctgccaggacatacctgtgctctttcctggagagaaagtgtccatacccagaaaccacccgagcatccgctggggcagaggcacattagacgcagacgcgatgtggtgacagagacgaaaacagtggagctggtgatcgtagctgaccatagcgaggcccagaaatatagagactttcagcacctgctgaaccgcactctcgaggtcgcattacttctcgatacattttttcgtccattgaatgtgcgggtggcactcgtcggtctggaagcctggacacagagggacctggtggagatctctcccaatccggcagtgactctggagaactttctgcactggcggagagcacacctgctgcccaggttgcctcatgattctgcgcagttggtaaccggaacctctttctctggacctactgtcggtatggcaatccagaatagcatctgctccccagacttctcagggggtgtgaatatggaccactcgacatccatactcggcgtggccagcagtatcgcccacgagttgggacattccctcggcctagaccacgatttaccaggcaactcatgtccctgtccgggaccagctcctgcaaaaacctgcattatggaagcctcaacagattttctccctggcttaaatttcagtaactgctctcggagggccctggagaaagccctgctagatggcatggggagctgtctcttcgagcggctccctagcctcccgcctatggctgctttttgcggcaacatgttcgtcgaaccaggcgagcagtgcgactgcggcttcctggatgactgcgtggatccttgctgcgacagcctaacctgccagttgcgacccggagctcagtgcgcaagcgatggcccatgctgtcaaaactgtcagttgcggccatctggctggcaatgtcggcctactcgaggggactgcgatctgcctgagttttgccccggagactcatcccaatgccctccagacgtgagtctgggcgatggcgagccgtgcgctggaggacaagccgtatgtatgcacggacgttgcgcctcatacgcccaacagtgtcagagcctttggggtcctggcgctcagcctgccgcaccactgtgcctgcagacggctaacaccaggggcaacgcgtttggaagttgtgggagaaacccctcaggctcttacgtctcctgcaccccccgagacgccatctgcggacagctacagtgccagaccggccgaacacagcccctcttggggtcaatacgggacctgctctgggaaacaatcgatgtcaatgggaccgaacttaattgtagttgggtgcatctggatcttggttctgatgtggctcaacctctgctgaccctccctggaaccgcctgcgggcctggcctcgtttgtatcgatcacagatgtcagcgcgtggacctcctgggggcacaggaatgccgctccaaatgccacggccatggcgtgtgtgacagtaacagacattgctattgcgaagaggggtgggctcctcccgattgtactacacaactcaaagctacaagctcactgaccacgggattgcttctgagtctgctcgtgttactggtcctggtgatgctgggcgcttcttattggtaccgggctcggctgcatcagcggttgtgtcagctgaaaggccctacatgtcaatatagagccgcacaatccggcccttcagagagacccggaccccctcagcgagcgcttctggctaggggcaccaagagtcaggggcctgctaaaccaccacctccgagaaagcccctccctgcagacccgcagggcagatgcccaagcggagatcttccaggccctggggctggcatcccaccactcgtggttccaagtcggccagcaccaccgccaccaaccgtgtcatctctttatttatag

SEQ ID NO: 213389 - DNA, 2757 bp, Artificial Sequence
  Description of Artificial Sequence: Synthetic coding sequence
atgccaggcggagcgggagctgcgaggctgtgtctcctcgcattcgctcttcagcctttgcgacctcgagccgcacgcgaaccgggttggactcgcggttctgaagaaggatcacccaaactgcagcatgagctgataatcccgcagtggaagacgtctgaatctcctgtccgggagaagcacccactgaaggccgagctgcgtgtcatggccgaaggcagggagctaatcctcgatctcgagaagaacgaacaattgttcgctccatcttacactgagacccactacacctcctctggaaaccctcagacaacaacccgcaagctggaagaccattgcttttaccacggaacagttagagaaaccgaactgagctctgtgacactgtctacctgtagaggaatccgcggactgattactgtgagtagtaacctgagttacgtgattgagcctctgccagattctaagggtcagcacctgatttacagatctgaacatctcaaacccccacccggaaattgcggcttcgagcactcgaagcccacaactagagattgggccctgcaattcacacagcagacaaagaaacggccacgccgaatgaaaagagaggacctaaacagcatgaagtacgtggagctctacctggttgccgactaccttgaattccagaaaaataggagggatcaggatgctactaagcacaagctgatcgagatcgcgaattacgtggataaattttaccgctctttgaatatacggatcgcccttgttggactcgaggtctggacacacggaaacatgtgcgaggtgtcagagaacccttattccactctctggtctttcctctcatggcgtcgcaaactgcttgcgcagaagtaccatgataatgcccagttgatcacaggtatgtctttccatggcaccaccatcggtctcgcaccattaatggctatgtgcagcgtgtaccagtctggtggagttaacatggaccattcagaaaatgcaatcggcgtggcagctacaatggcacatgaaatgggccacaactttggaatgacccacgattctgcagattgttgcagtgcctctgctgcagacgggggatgcatcatggctgccgctaccgggcacccgtttcctaaggtcttcaacggttgtaatcgcagagagctggatagatatctgcagagtggcggagggatgtgtctctccaacatgccagatacgagaatgctgtatggcggacggaggtgcgggaacggctatctggaagacggcgaagagtgcgactgtggcgaggaggaagagtgtaacaacccctgctgcaatgcctctaattgcacacttcgtcccggtgcggagtgtgctcacggtagctgttgtcatcagtgcaagctgttggcacccggaaccctctgccgtgagcaggcgagacagtgtgatctgcccgagttctgcaccggtaagtctccccattgtccaacaaacttctaccagatggatgggaccccttgcgaaggcggtcaggcttattgctacaatgggatgtgcctgacctatcaggagcaatgtcaacagctttggggcccaggagccagaccagcacctgatttgtgttttgaaaaggtgaatgttgccggagacacttttggtaactgcggaaaagatatgaatggagagcacaggaagtgcaatatgcgcgacgccaagtgcggaaaaatacagtgtcaatctagcgaagccagaccgctggagtccaatgccgtcccgatcgatactacaataatcatgaacgggcgtcagatccagtgcagaggtactcatgtatatcgaggaccggaagaggagggcgacatgctcgaccctgggttggtcatgaccggcaccaaatgtggatacaaccacatatgcttcgaaggccagtgtcgcaacacctccttttttgaaacagaagggtgcggcaaaaaatgcaatggccatggggtctgcaacaacaaccagaactgtcactgtctgccgggttgggctccccctttctgcaacacgcctgggcatggaggttccattgatagtggcccaatgccccctgagtccgtagggcctgtagtggccggagtgttagtggccatccttgtccttgccgtcttaatgctaatgtactactgttgcaggcaaaacaataagctgggacaactgaaaccatctgccctgccatcaaagctgaggcagcaatttagttgtcccttccgagtctcccagaattccggaacaggccatgcaaacccgacattcaagctccagaccccacagggcaagcggaaggtgattaacactccagaaattttgcgcaagccgtcccagcctccaccgaggcctccccctgactatctccgagggggaagcccgcctgcgccactgcccgctcatctctcgagggcagccagaaatagccccggtcctgggtcgcaaatcgagaggacagaatcttctcgtcggccaccaccgagccgcccaatccccccagccccaaactgtattgtatcacaggatttcagccgtccccgaccaccacagaaggctctacctgccaatcctgtacccggaaggagaagcttacctagacctggaggcgcatctcctcttcgccctcctggcgctgggccacagcagtcgcgccctcttgcagctctggctcctaaatttcccgagtatcgttctcagagggctggcggaatgatctcttctaaaatctag

SEQ ID NO: 213390 - DNA, 2763 bp, Artificial Sequence
  Description of Artificial Sequence: Synthetic coding sequence
atgcctgggggtgccggagcagctcgtttgtgcctgctggctttcgccttacaacccctgcgcccacgtgcagcacgcgagcccggatggaccatctctaggggatctgaggagggcagccccaagctgcagcatgaactgattattccgcaatggaagaccagcgagtcgcccgtgcgggagaaacatcctcttaaggcggagctgagggtgatggcagaagggagggagctgatccttgacctggaaaagaatgagcagctgtttgccccttcttatacagaaacgcattataccagctcaggcaatcctcagactactacgagaaaactggaggatcattgtttttaccacggtaccgtccgcgaaacagagctgtcttccgtgactctgtcaacctgtcgcggtatccgcggtttaattacagtgagtagtaacctatcctacgtgatagaaccactcccagattcaaaaggacagcacctgatctatagaagcgagcacctaaagcccccacccggaaactgcggtttcgaacattctaagccaactactagagattgggctttgcagtttacccaacagacaaaaaagcgtcctcggagaatgaaacgggaggatcttaatagcatgaaatacgtcgagctgtacctagtagctgactacctagaattccagaaaaatcggagagaccaggatgcaaccaaacacaagttaattgaaattgctaactatgtggataagttctatagatctctcaacatccgtattgctcttgtgggccttgaggtgtggacccatggaaatatgtgtgaagtttcagagaacccctattccacattgtggtctttcctgagttggagaaggaaactgcttgcccaaaagtatcacgacaatgcacagcttattaccggaatgagttttcatggcaccaccatcggcttagctcctctcatggccatgtgtagtgtttaccagtcaggcggtgttaacatggatcacagcgaaaatgcaattggggttgcggctacgatggcccatgagatgggccataacttcggaatgacccacgattcagcggactgctgctcagcttcggcagcagacgggggatgcatcatggctgcagcaaccggacatccttttcccaaggtgttcaatggatgtaacagaagagagttggaccggtacctgcagagcggaggcggaatgtgtctctcaaatatgccagacacgcgtatgctgtacgggggacggcgttgcgggaacggatatctggaggacggggaggagtgcgattgcggggaagaggaggagtgtaacaacccctgctgcaatgcatcaaattgtactttacggccaggcgcagagtgtgcacacggttcttgctgccaccagtgtaagctcctcgcaccaggcaccctgtgtcgagagcaggccagacaatgcgatctccccgagttttgtacgggcaagagcccccattgccctaccaacttctaccagatggatggcacaccgtgtgaggggggacaggcttactgttacaacgggatgtgcctaacatatcaggagcagtgtcaacaactgtggggcccaggtgctcggcctgcccctgatctgtgctttgagaaggtcaatgtggccggagacacgttcggtaattgcgggaaggacatgaacggggagcaccggaagtgtaatatgagagacgcaaagtgcggcaagatacagtgccagtccagcgaagcccgacccttggagtcaaacgcagtacccattgataccacaatcataatgaacggaaggcagattcaatgccgcggaactcacgtgtacagaggcccagaggaagagggcgacatgcttgatcccggactggtgatgactgggacaaagtgtggttacaatcatatctgcttcgaagggcagtgccggaatacgtctttcttcgagacggaggggtgcggaaaaaaatgcaatggtcatggtgtctgcaataataaccagaactgccattgtctccctggttgggcgcctcccttctgtaacacacctggacacggtggctccatcgattccggcccaatgccccctgaatcagtggggcctgtggtggccggtgttcttgtcgccatactagtgctggcggtcctcatgctcatgtattattgttgccgacagaataacaaactgggccagctcaaaccatccgctttgcccagcaaactccggcagcagttcagctgccccttccgcgtgtcccagaatagtgggactggtcatgccaatcctacatttaagctgcagactccgcagggcaagcgcaaagtgattaatacccctgagattctgcgcaagccctctcagccacctccacgaccaccacctgattaccttcggggtgggtctccacccgctcctctcccagcccacctatcccgggctgctagaaatagtcccggaccagggtcccagattgagagaacagaatcctcgcgacgcccaccacccagcagacctatcccacctgcgcctaattgcatagttagtcaagacttttcccgaccccgacccccacagaaggctctccccgctaaccccgtgcctggaaggcgctccctaccgaggcccggaggtgcttccccgctgcgaccccctggcgctggtccacagcaatctcggcctctcgcggctctggcacctaagttcccagagtaccggtcgcaaagagcgggtggcatgattagctcaaaaatatag

SEQ ID NO: 213391 - DNA, 1917 bp, Artificial Sequence
  Description of Artificial Sequence: Synthetic coding sequence
atgtgtgaagtgtccgaaaacccgtactccacattgtggtcattcttatcgtggcggaggaagctgcttgcccagaagtaccacgataatgcccagctcatcacaggaatgagcttccacggcacaacaatcggcctagcgcctctgatggcgatgtgttctgtgtaccagagtgggggagtgaacatggatcattcggagaatgcaatcggagtcgcggctactatggctcatgagatggggcacaacttcggaatgacacacgattccgcagactgctgttccgcttccgcggctgacgggggatgtattatggccgctgctactggccaccctttccctaaggttttcaatggctgtaaccgaagggagcttgaccggtatctacaatctgggggaggaatgtgcttgtctaacatgccggacacccggatgctgtacggcggacgcaggtgcggtaacggttacctcgaggacggagaagagtgcgattgtggcgaagaagaagaatgcaataacccgtgctgcaatgcctctaactgcaccctgcgccctggagctgagtgcgcacacggttcatgctgtcaccaatgtaaacttttggcgccaggcactctctgtagagaacaggccaggcagtgcgatctcccggagttttgtacagggaaaagtccacactgtcccactaatttctatcaaatggacggcacgccatgcgaagggggacaggcctattgttacaacggcatgtgtttgacctaccaggagcagtgccaacagctctggggtccaggggctcgtcccgctcctgatctctgcttcgaaaaggtaaacgtggcaggcgatacattcgggaattgcggcaaggacatgaatggggagcacagaaagtgtaacatgcgggatgccaagtgcggcaagatccagtgccagtcctccgaagcacgccctcttgaatccaacgctgtgcctatcgacacaaccatcatcatgaatggacggcagattcagtgtcggggaacacacgtgtacaggggacctgaggaagagggtgatatgctggacccaggtttggtgatgacaggcactaagtgcgggtacaaccacatctgctttgagggacagtgtcggaacacctcctttttcgagaccgaaggttgtggtaaaaaatgcaacggtcatggggtctgcaacaacaatcagaactgccactgccttcccggatgggctcctcctttttgcaacacacccggtcacggcggaagcatcgatagcggcccaatgcctcccgaatctgtgggcccagtcgtcgccggagtcctcgtggccattctggttcttgcagtgctgatgttaatgtattattgctgccgacaaaataacaaacttggacaactcaaaccttcagcgctaccttctaagctgaggcagcagttctcctgtccatttagggtctctcagaatagtggcacaggccatgccaacccgacctttaagctccagaccccccagggtaagagaaaggtgataaacacacctgaaatcctgaggaagccttctcagccccctcccaggccacctcctgattatcttagaggcggaagtccccctgcccctctgccggcacatctgagccgggcagctaggaactcccctggaccaggttcccagatagaacgaactgagtcatccagaagacctccgcctagtagaccaatccccccagcgccaaactgcatagtgtcccagaaatgtttattgcccccagccatgattctccgggcaccccaaccttctggaaccgtggtgtgccttgtgatttctttcaatatggctttctaccggtcaatgaggatccgcatcgagcccggaattaaaactaaattactggtcttactggtctggaaacagttctag

SEQ ID NO: 213392 - DNA, 2868 bp, Artificial Sequence
  Description of Artificial Sequence: Synthetic coding sequence
atgcccggaggtgccggagctgctcggttatgtctgctcgccttcgccctgcagccactaagacccagagctgcaagggagcctggctggactcgcggttctgaggagggcagccctaagctacaacatgaactgataataccccagtggaaaacctccgaaagccccgtccgcgagaagcacccattgaaggctgagctaagggttatggcagaagggagggaattgatactggaccttgagaaaaacgagcagctgttcgccccatcctacaccgagacccactatactagcagcggcaacccacaaaccaccacccgcaagctagaggaccattgcttttatcacgggaccgtcagggaaaccgaactgagctctgtgactctgagtacctgtcggggtatacgcggactcatcactgtgtcgtccaacttgtcatatgtgattgagccactcccagacagcaagggacagcatctgatttataggtcggaacatcttaaaccaccccctggaaactgcggttttgagcatagcaagccaacaacgcgggactgggcccttcagtttacacagcagaccaagaaacgccctagaaggatgaagcgggaagacttgaattccatgaagtatgtggagctatatctggtggcggattatctggaattccaaaaaaaccgccgagatcaggacgcgactaagcacaagcttatcgaaatcgctaattatgtcgataaattttatagatctttgaatattaggattgccctggtggggttggaggtctggacacacggcaatatgtgcgaggtgagcgagaacccctactcaactctgtggagttttctatcttggcgaaggaaattgctggcacagaagtaccacgacaacgcacagttgattactggcatgtcctttcatggaacaaccatcggccttgcccctcttatggctatgtgtagtgtctaccagagcggtggagtgaacatggatcattctgaaaacgctatcggagtagccgctactatggcccacgagatggggcacaatttcggtatgacccacgacagcgccgattgctgcagcgctagtgccgcagacggtggatgcatcatggctgcagccacgggacacccgtttccaaaagtgttcaatgggtgcaatagacgcgagctagacaggtacctccaaagcggcggaggaatgtgcctctctaacatgcctgacaccagaatgctgtatggcggtcggaggtgcggtaatggctatttggaggacggtgaagaatgcgattgtggcgaagaagaggaatgcaacaacccatgctgtaatgcatccaactgcacactgcgcccaggcgctgaatgtgcccatggcagttgttgtcaccagtgcaagctcctcgcgcctggaaccttatgtcgagagcaggccaggcagtgcgacttgcctgaattctgcacaggaaagagcccccactgtccaacaaacttttatcagatggacggcaccccctgtgaaggtggccaggcttactgctataatgggatgtgtctgacctatcaggagcagtgccaacagttgtggggtcctggcgctcgccctgcccctgatctatgctttgagaaagtgaatgtggctggcgacacattcggcaattgtggcaaggatatgaacggtgaacaccgcaagtgcaacatgagggacgccaaatgcgggaaaatccaatgccaatcatctgaggccaggcccctggaatctaatgccgtgccgatcgataccactatcatcatgaatggtcgtcagattcaatgccgaggaacacacgtgtaccgcggacccgaagaagagggcgacatgctcgaccccggactggtcatgactggaacgaaatgcggctataatcatatctgttttgaaggacagtgtagaaacacctcattcttcgagacggaggggtgtggtaagaagtgcaacggacatggggtgtgcaacaacaaccagaactgtcattgtcttccaggttgggcccctccattctgtaatactcctggtcacggaggctcaatcgactctgggccaatgcccccagaatctgtaggacctgtagtagccggagtgctggtggcaatcctggtacttgcagtattaatgctgatgtattattgctgtcggcagaacaacaaactcggtcagctcaaaccctcggcactgccaagtaaattgcgtcagcaattctcttgcccattcagggtctcacagaattccggaaccggtcacgctaatcctaccttcaagctgcagacaccacaagggaaaagaaaagtgataaacacccccgagattttgaggaagcctagccaacctccacctcgccctcccccagattacctgcgaggcggttctcctccagcaccactaccggcacatctgagtcgggctgctcgcaattcccctggtccaggaagtcagatcgagaggacagaaagcagccgacggcctccgccatcgcgtcccattcccccagcgccaaattgcatcgtttcccaggacttctcccgccctcggccacctcagaaagcgcttccggctaatcctgtgccgggaagacgtagtctacctaggcccggaggagccagtccattacggcctcctggagccggaccccaacaaagtaggccacttgcagccttggcaccaaaggtgtccccaagggaagctctgaaggtgaaggcagggactagagggctgcagggaggacgctgtagagttgagaagaccaagcagtttatgctgctggtggtctggaccgaactcccagagcaaaaaccaagagccaaacattcctgcttcttggtgccagcctag

SEQ ID NO: 213393 - DNA, 2208 bp, Artificial Sequence
  Description of Artificial Sequence: Synthetic coding sequence
atgtggcgcgtcctctttctgctctcaggacttggaggcctgagaatggactctaattttgactctcttcccgtgcagatcaccgttccagagaagatccgctccatcatcaaagaggggatcgaatcccaggcctcctataaaatcgtcatcgaaggtaaaccttacactgtcaatctgatgcagaaaaattttcttccccataatttcagagtctactcatattctggaacaggcatcatgaaacccctggatcaggatttccagaatttctgccactatcagggctatatcgagggctatcccaagtccgtagtgatggtgagcacttgtactggactgcgaggcgttctgcagttcgagaacgtgagttacggaatcgaaccactcgagtccagtgtgggcttcgaacatgtgatataccaggtaaaacataaaaaagccgacgtaagcctgtacaacgagaaagacattgagagcagagacctctcatttaaactccaatctgtggagccacagcaagactttgccaaatatatagagatgcacgtcatagtggagaagcagctctacaatcacatgggttcagacacgacagtagtagcccagaaagtttttcaactgatcggcctgacgaacgctatcttcgtctctttcaacatcacaattattctatctagtctggagctttggattgatgagaataagatcgcgaccacaggggaggctaatgaacttcttcacaccttcctaagatggaaaacgagctatctagtgctgcgcccacacgatgtagcattcctgctggtatacagagaaaaatccaactacgtaggcgcaacttttcaaggtaagatgtgtgatgcgaactacgcaggcggagttgttttacaccccaggacaataagcctcgaaagtcttgcagtgatattagctcagctgctgagcctgtcgatgggtatcacctacgatgatatcaataaatgtcagtgcagtggcgctgtatgcataatgaatcctgaagccatccacttttctggggtgaagatcttttcaaactgcagctttgaggactttgcgcactttatctccaaacaaaagtcccaatgcctacataatcaaccacgactcgatccgttcttcaagcagcaagctgtgtgtggcaacgcaaagttagaggccggtgaggagtgcgactgtggcactgagcaggattgtgcgctcattggcgaaacctgctgcgacatcgccacatgcaggttcaaggccggtagcaattgcgcagaaggcccttgctgtgaaaactgtctattcatgtctaaggagcgcatgtgtaggccaagcttcgaggagtgcgacctaccagaatactgcaatgggtcttctgcctcttgtcctgaaaaccattatgttcaaacagggcatccatgcggcctgaatcagtggatctgcatcgatggcgtgtgcatgagcggcgacaaacaatgcacggatactttcggaaaagaggtcgaatttggcccatctgagtgttactctcatcttaactctaagaccgacgtgtccggtaactgcggaatctcagattccggctacacacagtgcgaagccgataatctccagtgtggcaagctaatttgcaagtacgtaggcaaattcctgctgcaaattccaagagcaaccatcatctacgctaatatttcaggtcacctttgtatagccgtggagtttgcctccgaccacgctgattcacagaagatgtggatcaaagacgggacatcctgtggcagtaataaggtgtgtcgcaatcagcgctgcgtgtcttcaagctacctcggatatgactgtactaccgacaagtgtaacgacaggggcgtgtgcaataataagaaacattgtcactgttctgcaagctatctgcccccagattgcagcgttcagtccgatctatggccaggaggttccatcgattcagggaattttcccccagtggctattcctgcacggttgccggaacgcaggtacatagaaaatatctaccactccaagccaatgcgctggccattctttctattcatcccattcttcatcatcttctgtgtgctgattgccatcatggtgaaggtcaatttccagcggaagaaatggagaacagaggactattcaagcgacgaacaacctgaaagcgagtcagaacctaaggggtag

SEQ ID NO: 213394 - DNA, 2151 bp, Artificial Sequence
  Description of Artificial Sequence: Synthetic coding sequence
atgtggcgggttctcttccttctgagcggtttaggcggattgagaatggatagcaacttcgactccctgcctgttcagattaccgtccccgaaaaaatcaggtctatcattaaggaaggcatagagtctcaggcgtcatacaagatcgttattgaaggaaagccctacacagtgaaccttatgcagaaaaatttcctccctcataactttcgcgtttactcctacagcggaacaggcatcatgaagcccctggatcaggacttccagaatttttgtcactaccaagggtatatagaaggctaccccaaatcagtggtgatggtcagcacctgtactggactgcgcggagttctgcagttcgaaaacgttagctatggcatagagcccttagaatcctccgtcggctttgaacatgtcatttatcaggtgaagcacaagaaggccgatgtgagtctctacaacgaaaaggacatcgagagccgcgacctgtcatttaaactgcagtccgtggaatacaatcatatggggagcgacactaccgtcgtggcccagaaagtattccaattgatcggcctcacgaacgcaatttttgtttccttcaacattacaatcattcttagctcccttgaattatggattgatgagaataaaatagctactacaggagaggccaacgagctcttacacacattcctgcgttggaagaccagttacctcgtcctcaggccccatgatgtggcttttttactcgtgtatcgagaaaagtcaaattacgtgggggcaacatttcagggtaagatgtgtgatgccaactacgctggcggagtggtgctccacccgagaaccatttctctggagagcctcgctgtgatcctggcacagctgctctcattaagcatgggaatcacatatgacgacatcaataaatgccagtgctccggcgctgtttgcatcatgaacccagaagcaattcacttcagcggagtgaaaattttttccaactgtagtttcgaagactttgcacatttcatatccaagcagaagtcccaatgcctccataaccagccacgtctggacccgttttttaaacagcaggctgtctgcggcaacgccaaattagaagctggagaggagtgtgattgcggtacagaacaggactgtgccctgattggggagacctgctgtgacatcgctacgtgccgttttaaagctggcagtaactgcgccgaagggccatgttgtgagaattgtctgttcatgagcaaagaaaggatgtgtcggccaagctttgaagaatgcgacttacctgaatactgtaatggatcaagcgcgtcatgtcctgagaaccattatgtgcagaccggccacccctgcgggctaaaccaatggatctgcatagatggggtgtgcatgtccggggataagcagtgtaccgatacgtttggcaaagaagtggagttcggcccaagcgaatgctactctcacctaaactcgaaaaccgatgtgtcggggaactgtgggatctcagactctgggtatacacagtgcgaagcagataatctccagtgcggtaagctgatctgcaagtacgtgggaaagttcctcctgcagatccccagggccacaatcatctacgcaaatatctctggccacctctgcatcgcagttgaattcgcgtccgaccacgcagattctcagaagatgtggatcaaggatgggacatcttgtggctccaataaagtgtgtcggaatcagcgatgcgtaagcagcagctacttaggatatgattgcacaacagacaaatgtaacgatagaggagtgtgtaataacaaaaaacactgtcactgttctgcttcttacctaccccctgactgctccgtacaatccgacttgtggccaggaggttctattgattcaggaaattttcctccagtggccatccccgcaaggctccccgagcgacgttatatcgagaatatctaccattcaaaaccaatgcggtggccttttttcttattcattccgttcttcatcatcttttgcgtcctgattgctatcatggtaaaagtgaactttcagcgaaagaagtggcgaactgaggattattcctccgacgagcaaccagaaagcgaaagtgagcccaaaggatag

SEQ ID NO: 213395 - DNA, 2331 bp, Artificial Sequence
  Description of Artificial Sequence: Synthetic coding sequence
atggtgcaactccaccaagacactgatccacagatccctaaaggacagccctgtaccctgaattccagtgagggaggggctcggcctgccgtacctcacactctcttttcatcagcacttgataggtggttgcataatgacagttttatcatggccgtcggggaaccactagtgcatatcagggttaccctgctgcttttgtggtttggcatgttcctttcaataagcggacatagccaggccagaccgagccagtatttcacctcccccgaggtcgtgataccactgaaggttatatcccgaggcagaggggcaaaggcccctggttggcttagctattctctgcgatttggaggccagcgctacatagtgcacatgcgcgtgaataaattgctcttcgcggcacatctgccagtcttcacatatactgagcagcacgccctccttcaggatcagccatttattcaggacgactgctattaccatggctatgtggaaggtgtgcccgaaagtctcgtggcgctgagtacttgcagcggcggatttctgggcatgctccaaatcaatgatctcgtatacgagataaagccaatttccgttagcgctactttcgagcacttagtgtacaagattgactccgatgacactcagtttccacccatgaggtgcggcttgacagaagagaagatcgcccaccaaatggaactgcaactctcctataattttactttgaagcagtctagcttcgtgggctggtggacccaccaacgtttcgttgagctggtggtggtagtcgacaacatcagatatctcttctcccaatccaatgctacaaccgtacaacacgaggtttttaacgtggtgaacattgtggacagcttctaccatcctttggaggtggacgtgatcctcaccgggattgatatttggaccgcaagcaaccctctcccgacatccggcgacttggacaacgtactggaagacttctccatttggaaaaattacaacctcaacaatcgactgcagcacgatgtggctcatctttttattaaggatacacagggtatgaaactgggcgttgcatacgtgaagggtatttgccagaacccattcaacaccggtgtggatgtgtttgaagacaataggctggttgtcttcgccatcacacttgggcacgagctgggccacaatctgggaatgcaacacgatacacagtggtgcgtatgcgaacttcagtggtgcattatgcacgcgtatcgaaaggttaccactaagttcagtaactgctcttacgcacagtactgggattccacaatctcttccggactctgcattcagcctcccccttaccccggtaacattttcagactgaagtactgcggcaacctggttgtagaagagggcgaggaatgtgactgcggtactatcagacagtgtgcaaaggatccctgctgcctgttgaattgtaccttgcacccgggtgctgcctgcgcgttcggaatttgttgtaaagactgcaagtttctaccgagcggcaccttgtgtagacagcaggtcggagaatgtgatctgcccgagtggtgcaacgggaccagccaccagtgccccgacgacgtgtacgtccaggacggaatcagctgtaatgttaatgcattctgctacgaaaaaacgtgtaataaccacgatatccagtgcaaagagattttcggtcaggacgccaggtcagccagtcagagctgctaccaggaaatcaacactcaaggcaatcggttcggccactgcggcatcgtaggcacaacatacgtcaagtgctggacacccgatatcatgtgtggccgtgtacagtgcgaaaacgtgggcgtgattccgaatcttattgaacactcaacagtgcagcagtttcatctgaatgacactacttgctggggcactgactaccatctgggaatggctatccccgacataggagaggtcaaagacggaaccgtttgcggtcccgaaaaaatctgtatccggaagaagtgtgcgagcatggttcacctgagccaggcctgccagccaaaaacctgcaacatgaggggcatctgtaacaacaaacagcactgccattgtaaccacgagtgggctcccccatattgtaaagataaggggtatggtgggagtgccgattcgggcccaccgccaaagaacaatatggaaggacttaacgttatgggaaagcttcgatacctgagcctcttgtgtctccttcctctggtggcttttctcctgttctgcctgcatgtgctgttcaaaaagagaactaagagcaaggaagatgaagaaggctag

SEQ ID NO: 213396 - DNA, 2169 bp, Artificial Sequence
  Description of Artificial Sequence: Synthetic coding sequence
atggcggtggatggaacgttggtctacatacgagttaccttgctgctgctgtggctgggggtgtttttgtcaatttccggatactgtcaggccggtcccagtcagcatttcacgagcccggaggtcgtgatacctttaaaagtgatcagtagaggcaggagtgccaaagccccaggctggctgtcatatagcctgcgcttcggcggacagaaacacgtagtacacatgagagttaagaaactcctggtatcccgacacctgcctgtatttacatacacagatgaccgagctcttctcgaggaccagttattcatccccgacgattgctactaccacgggtacgtcgaagcggcacctgaatcgctcgtcgtgttctcagcctgtttcggcggattccgcggagtcctgaagatttccggcctgacatacgaaatcgaacccattcgacactccgcaacatttgagcacctggtctacaagattaatagcaatgagacacagttccccgcaatgcgctgtgggctgacagagaaggaagttgctcgccagcaacttgagttcgaggaggccgagaacagcgccctggagccaaagagtgctggtgactggtggactcacgcctggttcctggagctagttgtggtggtaaaccatgacttttttatctattcccagtcaaacatctccaaagtacaggaagacgtgtttctcgttgtgaacattgtggatagtatgtataagcagctaggtacctatattattcttatcggaatagagatttggaatcaggggaacgtgtttcctatgacatccatagaacaggttctgaatgatttcagccagtggaaacagatttccctgagccagttacagcacgacgccgctcatatgtttattaagaatagcctaattagtatcttgggtctcgcctatgtggccggtatttgtagaccaccgatcgactgcggcgtagacaactttcagggtgatacatggtccctatttgcgaacactgttgcccacgaactgggacacacccttggcatgcagcacgatgaggagttctgcttctgcggcgagcgaggctgtattatgaacacttttcgtgtacctgctgagaaatttacaaactgttcctatgctgactttatgaaaacaacactcaatcaaggctcctgtctgcataatccacccaggctgggtgaaattttcatgctgaaacgctgtggcaatggcgtggtcgagcgggaggagcagtgtgactgcggttcagtacagcaatgcgagcaggatgcatgttgtttactgaattgtacattgagacctggcgctgcctgtgcttttggactgtgctgtaaagattgcaaatttatgccctctggagaactctgtcgacaggaagtgaatgaatgtgacctgcccgagtggtgtaacggaacatcccaccagtgtcccgaagatagatacgtacaagatggaatcccttgctcggatagcgcttactgttatcaaaaacgatgtaataaccacgaccagcactgccgggagatttttggaaaagatgccaagagcgcttctcagaattgctacaaagagattaattcgcagggtaaccggttcgggcattgcggaattaatgggacaacatacctgaagtgccacatatctgacgtattttgcggtcgtgtacaatgcgaaaatgtcagagatattcccctgctgcaggaccactttaccttgcagcacacacacatcaacggtgtgacttgctggggtatagattaccacttgcgaatgaatatctccgacatcggagaggtgaaggacggaacggtttgcggcccaggtaaaatttgtatccacaagaaatgtgtgagcctgtcagtcctgtcacatgtgtgcctacctgagacttgcaatatgaaagggatttgcaataacaaacaccactgtcactgcggatatggctggtctccaccgtattgtcaacatcgagggtatggagggagtatcgacagtggcccagcatcggcaaagcgaggcgtctttttgcccctgattgttataccaagcttgtctgtactgacattcctgtttaccgtaggattgttaatgtatctgcgtcagtgctcagggcctaaagagactaaggcgcacagttccggctag

SEQ ID NO: 213397 - DNA, 2721 bp, Artificial Sequence
  Description of Artificial Sequence: Synthetic coding sequence
atgcaggcagccgtcgctgtatccgttccattcctgctgctgtgcgtgttgggtacttgtcccccagcacgttgcggacaggcgggtgacgcatcactaatggagctagagaagcgtaaagagaatcggtttgtagaaaggcagtccattgtgccactccggctaatctataggagtggcggagaagacgaatcacggcacgacgcactcgacacacgcgtgcgcggtgatctgggcggaccccagctcactcacgtggaccaggcttctttccaagtagatgcctttgggactagttttattctggatgttgtgctgaaccatgatcttctgagctctgaatatattgagagacacatcgaacacggcggaaagaccgtcgaagtgaagggaggggagcattgctactaccagggacacatcagaggaaatcctgactcattcgtggctctgagtacgtgccatggactccatgggatgttctatgatgggaatcacacctacctcattgaacctgaagagaacgatacaacccaggaggattttcattttcactcagtgtataagagcaggctgtttgagttttctctggacgatctgcctagcgagttccagcaggtcaatattacaccgagcaagtttattctcaagccacgacccaagcgctccaagaggcaactgcggaggtatcctagaaatgttgaggaagagaccaagtacattgagctgatgattgtaaatgaccaccttatgttcaagaaacaccgtctgagtgtagtgcatacgaacacctacgccaagtctgtagtaaacatggcagatctcatttacaaggaccagctgaagacccggatcgtgctggtggctatggagacatgggcgacggataacaagttcgccatctcggagaatcccctgatcactctccgggaattcatgaagtatagacgagactttatcaaagagaagtccgatgccgttcacctatttagtgggtcccaatttgagagctccaggtcaggcgcagcctatatcggcggtatttgtagtttactcaaaggcggaggagttaacgagttcgggaaaaccgaccttatggccgtcaccctggctcaaagcctagctcacaatatcgggatcatctcggataaacggaagcttgcgagtggagaatgtaaatgcgaggacacctggtcaggttgcattatgggagatactgggtattacttgcctaaaaagttcacccagtgcaatattgaggaataccatgacttccttaattccggcggaggcgcatgcctctttaacaagccttccaagctgttagacccaccagagtgcgggaatggcttcattgagacgggcgaagagtgtgactgtggcacaccggcagaatgcgtattggaaggagccgagtgctgtaaaaagtgcacactgacacaggattcccagtgttctgacggcttatgctgtaaaaagtgcaaattccagcccatggggaccgtgtgccgggaagctgtcaatgattgcgacatacgcgaaacatgtagtggaaactcctcccagtgtgccccaaatatccacaagatggatggatactcttgcgatggcgtccaaggtatatgctttggaggcagatgcaaaacaagagatcgacagtgcaagtacatatggggtcagaaggtcacagcctccgataagtattgttacgagaagttgaacatagaaggtacagagaagggcaactgcgggaaagacaaggacacctggatccaatgtaacaagcgcgacgttctgtgtggctacctgctgtgtaccaacattggaaatatccccaggctgggggagctggacggagaaataacctccactctggtggtgcagcagggcaggactctgaactgttctggaggacacgtcaagctggaggaggacgtagatctcggctatgtggaggacggaacgccttgcgggcctcaaatgatgtgcttggaacaccgctgccttccagtggctagtttcaatttctctacgtgcctcagctccaaggagggtacaatatgcagcggcaacggagtttgcagcaatgagcttaaatgcgtgtgtaaccgtcactggatcggctccgattgcaatacctattttcctcataatgatgatgctaagactggcatcacactcagtgggaacggcgtggcgggtacaaacatcatcattgggataattgctggcacgattttagttctggctcttatcctgggcatcactgcctggggctataaaaactacagggaacagcgacagttgcctcagggagattatgtgaagaagcctggcgacggcgattcattctacagcgatattcctccgggagtgagtacaaattcagcctccagctccaaaaagcgtagcaatgggctgtcgcactcctggagtgagcgcatcccagataccaaacacatctccgacatctgcgagaatgggcgtccacgaagtaacagctggcaggggaacttgggcggtaataagaagaagatccgtggcaagagattcaggccgaggtcaaacagcacagaaaccctgtcccccgctaagagcccttcaagcagcaccggcagcatagcctcgtctaggaagtatccctatcccatgccgccacttcctgatgaggacaaaaaagttaaccgccagtcagctagactgtgggaaacttcaatctag

SEQ ID NO: 213398 - DNA, 2700 bp, Artificial Sequence
  Description of Artificial Sequence: Synthetic coding sequence
atgcaggctgctgtggccgtgtccgtcccttttttattgttatgcgtactgggtacgtgcccaccagcgaggtgtggccaggccggagacgcttcgcttatggaactggagaagagaaaggagaacaggtttgtggagcgtcagtcaatcgtccctctcagattaatttatcggtccggaggtgaggacgagtcaaggcacgatgctttggacacacgcgtgaggggcgacttggggggaccgcagctgactcacgtggaccaggcaagctttcaggtggacgctttcgggacttccttcatcctagacgttgtcctgaatcatgacctacttagctctgaatatattgaacgccatatcgagcacggaggcaagactgtggaagtgaaaggaggagaacattgctactaccaggggcacattagaggaaaccctgacagtttcgtagcactgtccacctgtcatggcctgcatggaatgttttatgatggcaaccacacctacttgatcgagccggaggaaaacgacaccacccaggaggactttcactttcactccgtatataaaagccggctgtttgagttttcccttgacgatcttccctcagagttccaacaagttaatataacaccttcgaaatttatcctcaaacctagacctaagcgctcaaaacgccagttgcggaggtatcctcggaatgtggaagaggagactaaatatattgagcttatgattgtgaacgatcacctcatgtttaagaagcacagactgtctgtggtgcatacaaacacttacgctaaatccgtggttaacatggccgatttaatctataaggaccagttgaagactaggatagttctggtcgccatggaaacatgggccacagacaacaaatttgccatttcagagaaccccttgatcaccttgcgcgagtttatgaaataccgcagggactttattaaggaaaagtcggatgctgtacacttgttctcggggtcacagtttgaatcttcacgctccggcgctgcctacataggcggtatttgtagtttactgaagggcggtggcgtgaacgagttcggcaagactgatctcatggctgtaacactggcccagagccttgcccacaacataggcataatctctgataagagaaagctggcctccggggaatgtaagtgtgaggacacctggagcggctgtattatgggtgacactgggtactacctgcctaaaaaattcactcagtgcaacattgaggaataccatgactttctgaactccggaggcggagcctgcctgttcaacaagcctagcaaactcttggaccccccagagtgcggcaacggatttatcgaaacaggcgaagagtgtgactgcggcaccccagcagaatgtgtcctggaaggggcagagtgctgtaaaaaatgtacactgacccaggacagccagtgctccgacgggctctgttgcaaaaaatgcaaatttcaacccatggggacagtatgccgagaggctgttaacgactgtgacatacgggaaacatgcagtgggaatagtagtcagtgcgctcccaatatccacaaaatggatggttattcttgcgacggcgtgcagggaatttgttttggcggaagatgtaagacccgcgatcgacagtgcaagtacatttggggccaaaaggttacggctagcgacaagtactgctacgagaagctaaatatcgaaggaaccgagaaaggcaactgcggcaaagacaaagatacgtggattcagtgtaataagcgagatgtgctgtgcggctatctgctttgcaccaatattggcaacattccaaggttgggtgagttggacggcgaaatcacttccaccctggtcgtgcagcaggggagaacccttaattgcagcggcggtcacgtgaagctagaagaagacgtagacctgggctatgtcgaggatggaacgccgtgcggaccgcaaatgatgtgtttggaacacagatgcctccctgtggcctcctttaatttttccacatgtctgagttcaaaagagggtacaatttgctctgggaatggagtgtgcagcaatgaactcaaatgcgtgtgcaatcgtcactggatcgggtccgattgcaacacctattttccacacaatgacgacgccaaaaccgggattacgctctcaggcaacggcgtcgctggcacgaacatcattattgggatcattgccggaaccattctggtgcttgcccttatcctcgggataaccgcatggggctataataacatctttaactttcgcagcaatggcctgagccatagctggagtgaacggattccagatactaaacatatttccgatatttgcgagaatggccgtcccagatctaactcctggcagggaaacctgggaggcaacaaaaaaaagataagaggtaaaaggttccgacctaggagtaattctaccgagtatctgaatccctggtttaagagagactataacgtcgcaaaatgggtggaggatgttaacaagaatacagagggtccatatttcaggacactcagtcctgccaaaagcccatctagcagcactggtagtattgccagcagccggaagtacccctaccccatgccgcctctcccagatgaagacaaaaaggttaacagacagtcagctagactttgggaaacttccatctag

SEQ ID NO: 213399 - DNA, 2580 bp, Artificial Sequence
  Description of Artificial Sequence: Synthetic coding sequence
atgcaggcggctgtggccgtcagtgtgcctttcctgctgttatgcgtgctgggtacctgtccaccggctagatgtggtcaagctggagacgccagcctcatggagttagagaagcggaaggagaatagattcgtggagcgacaatccatagtgcctctgcggttaatctatcggtcaggaggagaggatgagtccagacatgatgccttagacactcgtgttcggggtgaccttggcggaccccaactgacccacgtcgaccaggcttcatttcaagtagatgcctttggaacctcattcattcttgatgtggttctcaatcacgaccttctttcgtccgaatacatcgagaggcatatagagcacggtgggaaaactgttgaagtaaaagggggagagcattgttactatcaaggtcacatccggggaaatcctgactctttcgtagcattgtccacctgtcacgggttacacgggatgttttacgatggaaaccatacttatctgattgaacctgaggagaatgacacaacacaggaagactttcattttcacagcgtgtataaatcacgcttgttcgaatttagtctggatgacctgccttctgagttccagcaggtaaatataacaccttcaaaatttatcctcaaacccaggcctaagcgttccaagagacagctcagaagatatcccaggaacgtggaagaagaaacaaaatatatcgaacttatgatcgtaaacgatcacctgatgttcaagaagcaccgtctgtctgttgtgcacacgaacacgtatgccaagtctgtggtgaacatggctgacttaatttataaagaccagttgaagaccaggattgtgcttgtagcgatggaaacctgggccaccgataataaatttgcgatctccgagaaccctctcatcacactcagagaatttatgaagtaccggagagatttcattaaggagaaaagtgacgctgtgcatttgttttctgggtctcagttcgaatcatccagaagcggggctgcctacataggcggtatctgctccttgctgaagggaggcggagtaaatgagtttggtaaaaccgacctcatggccgtgaccctagctcaatcactggcgcacaacatcggtataatctcggataaaagaaagttggctagtggcgagtgtaagtgcgaagacacctggtcaggctgtatcatgggcgatacaggctattatctgcccaagaaatttacccagtgcaatattgaggaataccacgattttctgaacagcgggggtggcgcttgcctattcaataagccatccaaactgctcgatcctccggagtgcgggaatggatttatcgagaccggagaggagtgcgattgtggtacacctgctgaatgcgtgctcgagggcgctgaatgctgtaaaaagtgcacattaactcaagactcccaatgcagtgacggactctgttgtaaaaaatgcaaattccaacccatgggaacagtttgtcgtgaggctgtgaatgactgtgatatccgtgaaacctgtagtgggaactcctcccaatgcgcacccaacattcataagatggacggttattcatgtgacggcgtccagggcatctgcttcggcggtaggtgcaagacccgcgatcgccaatgtaagtacatctggggccagaaagtgactgcctccgacaaatactgctacgagaagctgaacattgaaggaaccgaaaagggcaattgtggcaaagataaagacacgtggatccagtgcaataagcgcgatgtcctgtgtggttatctcctgtgcacgaatattggtaatatcccccgacttggagagctagacggagagattacatccacgctggtcgtccaacaggggaggacccttaactgtagtggcggacacgttaaactggaggaagatgtggaccttggctacgtggaggacggtactccgtgcggtcctcaaatgatgtgccttgagcaccgctgccttcccgtggcttccttcaatttctcaacttgcttgagcagcaaggaggggactatttgcagtggaaacggggtgtgctctaatgagctcaagtgcgtttgcaaccgccactggattggttcggattgcaacacgtatttcccgcataacgacgatgctaagaccggtatcactttatctgggaatggcgtggccggaactaacataatcattgggataattgcaggcacaattctggtgctcgcactgatcttgggcattacggcctggggatacaagaattaccgtgagcagcgccagctccctcaaggcgactacgtgaaaaagccaggtgacggcgattctttttactccgacatccctcccggagtgtccacaaattctgccagtagctctaaaaaaagaagcaatggactgagtcattcatggagcgagaggatacccgacacaaaacatatctcagatatctgtgagaacggcaggccaagatccaactcctggcagggcaatttagggggaaacaagaaaaagatcagagggaagcggtttaggcccaggtcaaatagtactgaatag

SEQ ID NO: 213400 - DNA, 2613 bp, Artificial Sequence
  Description of Artificial Sequence: Synthetic coding sequence
atgcaggctgcagtggccgtgagcgtgccatttctgctgctgtgtgttctggggacatgtccaccagcacgctgcggacaagcgggagatgcttcactcatggagttggaaaaaagaaaggaaaatcgctttgtggagcggcagtcaatcgtgccattaaggctgatctaccgcagcgggggagaagacgaaagtaggcatgacgcactagacaccagagttaggggggacctgggcggaccacagttgactcacgtggatcaggcctcgttccaggttgatgccttcggtactagtttcatcctcgatgtggtgttaaaccacgacctcctttctagtgaatacattgaaagacacatcgaacacggaggtaagaccgtggaagtgaaggggggtgaacactgttactaccaaggacatatccgcggaaaccctgacagctttgtcgccctgagcacttgccacggacttcatggcatgttttatgacgggaatcacacatatctgattgaaccagaagagaacgataccacacaggaggacttccattttcattccgtgtacaagtccagactgttcgagttctccctggacgatctgccctctgagtttcaacaggttaatattacccctagcaagttcatcctcaagcctcgcccaaagcggagcaagagacagctgaggagataccccaggaatgtggaggaagaaacaaaatatatcgaactgatgattgtcaacgatcacttgatgtttaaaaagcaccgcctgagcgtcgtgcataccaatacttatgctaagtccgtggtgaatatggccgatctcatctacaaggatcagttaaagacaaggatcgtcttagttgctatggagacatgggctaccgataacaagtttgctatttccgagaatcctctgattaccttgcgtgaattcatgaagtacagacgcgattttattaaggaaaaatccgacgcagtgcacctgttttcaggatcccagttcgagtctagtagatcaggagctgcatatattggtggaatatgttccctcttaaaaggcggaggcgtaaatgaatttggcaagaccgatctgatggctgtgacactggcacagagtctcgcccataatattgggatcattagtgataaaagaaagttggcctcaggagaatgcaaatgcgaggacacctggtccggctgtatcatgggagacaccgggtactacttgcctaagaagtttacacagtgcaacatagaggagtatcacgatttcctgaatagcggcggaggagcctgtctgttcaacaagccctctaagctcctggatccacctgaatgcggaaacggcttcatcgagaccggagaggagtgcgattgcggaacgcccgctgagtgtgttctcgagggagccgagtgctgtaagaagtgtaccttgacccaggactctcagtgttcagatggcttgtgttgcaaaaagtgcaagtttcagccaatgggtacagtgtgccgagaggccgtgaacgattgcgatatcagggagacctgtagcggcaattcctcacagtgtgccccaaacatccacaaaatggatgggtacagctgcgatggcgtccagggtatctgctttggaggccgttgcaagacacgtgaccggcagtgcaaatacatatggggtcagaaggtaaccgcatccgacaaatattgctacgaaaagctaaatattgaaggaacggagaaagggaactgcggcaaggataaggatacttggatccagtgtaataagcgtgatgttctgtgcgggtacctgctctgtaccaacattggaaatattcccaggctcggggagctcgacggtgagataaccagcaccttagtggtgcaacaaggcagaacactcaactgttctggtgggcacgtcaagctcgaggaggatgtggacctgggctatgtggaggatggcactccatgcggccctcagatgatgtgcctggaacatcggtgcctccctgttgcatcatttaactttagtacctgcctatctagtaaagagggaaccatttgttccggcaacggcgtctgttcaaacgagttgaaatgcgtctgtaatcgacactggattggaagcgactgcaacacttacttcccacataatgatgacgctaaaaccggaattaccctctctggcaacggggtggctggaaccaatataataataggcattatagccggtacaatcttggtgctcgctctaatcctgggaatcaccgcctgggggtacaagaattatcgggagcagcgaagcaacgggctgtctcactcctggagcgagcgtatcccggatacgaagcacatttcagacatttgcgagaacggaaggccgaggagtaacagctggcaggggaatctaggtggtaacaaaaaaaagatcagaggcaaacggttccggccacgcagcaacagtactgaaactcttagcccggctaagagccctagttcctcgactggttcaatcgcttcatccaggaaatacccttacccaatgcctccactgccagacgaggacaaaaaggtgaataggcaaagcgctaggctatgggaaacaagcatttag

SEQ ID NO: 213401 - DNA, 2700 bp, Artificial Sequence
  Description of Artificial Sequence: Synthetic coding sequence
atgcaggcagctgttgccgtgagcgtaccgttcttacttttgtgtgtgttgggaacttgccccccagctcggtgtgggcaggcgggtgatgcttcgttaatggagctcgaaaagcgaaaagagaaccggttcgtggagcgccagagtattgtacccctgcgtctcatatatcggtctggcggtgaagacgaatcgcgccatgatgccctcgacactcgggtgcggggagatttaggcggacctcaacttacccatgtcgatcaggcatcattccaagtagacgcgtttgggacctccttcattctggatgtcgtgctgaaccatgatctcctatcctccgagtacatagaacgacatattgagcatgggggaaagacagttgaagtgaaaggaggggagcactgctactatcagggccacatccggggtaaccccgactcctttgttgcactcagcacgtgtcatgggttgcatggcatgttctacgacggaaaccacacctaccttatcgagccagaagaaaacgacactacccaggaggatttccacttccacagcgtatacaagtcacgactctttgaattctccctggacgatctccccagtgaattccagcaggtaaacatcacaccctccaaatttattctaaagccccgacccaagaggagtaagcgccagctgcggaggtacccccgtaacgtggaagaagagacaaagtatattgagctgatgatcgtgaatgatcacttgatgtttaaaaaacaccgcctatcggtcgtccacacgaacacctacgccaaaagcgttgtgaatatggctgatttaatttacaaggaccagctgaagactcgcatagtgctggtggcaatggagacttgggcaacggataataagtttgcgattagcgaaaacccactgatcacactgagggagtttatgaaatatagaagggacttcatcaaggagaaatcagatgccgttcacctcttctccggtagccagtttgaatcctcccgatccggcgcagcttatattggagggatttgttccctgttaaagggcggaggcgttaatgagtttgggaaaacagacctgatggccgtgaccctggctcagagtctcgcacacaacattgggattatctcagataaaagaaagcttgcctccggagaatgtaagtgtgaagacacatggtccggatgcataatgggggatacgggctactatttgcctaaaaaatttacccaatgtaatatcgaggaataccacgacttcttgaattccggtgggggtgcctgcctttttaacaagccaagcaaacttctggatcctccagagtgtggcaacggcttcattgagacaggcgaagagtgtgattgcggtactccggctgaatgcgtgcttgagggagcggaatgctgcaaaaagtgcactcttacccaggactcacagtgctcggatggcctgtgctgcaagaaatgcaaattccagccaatggggactgtttgtagagaagctgtgaatgattgcgacattagggagacctgttctgggaatagcagtcagtgtgcccctaatatccacaagatggacggctactcctgtgatggcgtgcaagggatttgcttcggcggtagatgcaaaacacgggaccgccagtgcaaatacatatggggacagaaagtgaccgcgtctgacaagtattgttatgaaaagcttaatatcgagggcaccgagaaagggaattgtggtaaggacaaggacacttggatccaatgcaataaacgggatgttttatgtggctaccttctgtgcacaaacattggcaacatcccacgcctcggagaactcgacggagaaattacaagtaccctcgttgtgcagcagggaagaaccctgaattgtagcgggggacacgtcaagctggaggaagacgtggaccttgggtacgtggaggatggtactccctgcggaccacagatgatgtgcttggagcacaggtgtctgcccgtggcctcatttaacttttctacctgcctttcctccaaggaagggacaatttgcagcggtaatggcgtatgctccaacgaattgaagtgcgtgtgcaatcgccactggattggtagcgactgcaatacctattttcctcacaacgacgatgccaagacaggtatcacactcagtgggaacggggtggctggcaccaatatcataatcggaatcatcgcaggaactatcctggtcctagccttaattctaggcattaccgcatgggggtataaaaattatagggaacagcggagcaatggacttagccattcatggtctgagcggataccagatactaagcatattagtgatatatgtgaaaacggccgtcctcggtcgaactcatggcagggaaacctcgggggaaacaagaagaagattcggggaaaacggtttcggcctcggagtaattctaccgagtatttgaatccttggtttaagcgcgattataacgtggcaaaatgggtggaagatgtgaacaaaaacactgaaggcccttatttccggacacttagccccgcaaaatccccctcctcctccacaggctccattgctagtagtcgcaagtatccatatccaatgccacctctcccagatgaggacaaaaaagtcaatcgacaatccgctcgcctgtgggaaacctctatttag

SEQ ID NO: 213402 - DNA, 2328 bp, Artificial Sequence
  Description of Artificial Sequence: Synthetic coding sequence
atgctccaggggctccttcccgtgtcactgttgctctcggtagctgtgtcagctattaaggaactccctggagttaaaaaatacgaggtggtgtatcctatacggttgcaccccctgcacaagcgagaggccaaggagccagaacagcaagaacaatttgagacagagctcaaatacaagatgactatcaacgggaaaattgcagtactttatttgaaaaagaacaagaatctcctggcccctggatataccgaaacctattacaacagcaccggaaaagaaattacaacctctccccaaatcatggacgattgctactatcagggccatattttgaacgagaaagtttctgatgctagtatatctacctgcagaggtttgagaggatacttctctcagggggaccagcgttacttcatagaaccactgagcccgatccaccgcgacggccaagagcatgcgctgtttaagtacaaccctgatgagaaaaactacgactcgacgtgcggcatggatggagtgctgtgggctcacgacttgcagcagaatatagctctgccagcgacaaaactcgttaagctgaaggataggaaggtccaggaacatgagaagtacatagagtactatctcgtcctggataacggggaattcaagagatataacgagaaccaggatgagattcgaaaaagagtctttgagatggctaactacgtgaacatgctctacaaaaagttgaatactcacgtggcactggtcggcatggagatttggaccgataaggacaaaataaagatcacccctaatgcttcgttcacccttgagaacttctctaaatggcgaggctccgtcctgtctagaagaaaacgccatgacatcgcccaactgatcactgcaactgagctggccggtaccaccgtaggactcgctttcatgtcgactatgtgctcaccatactctgtgggtgtcgttcaggatcacagtgataatctcttaagagtcgctggtaccatggctcatgagatgggtcataactttggtatgttccatgatgattacagttgcaaatgcccctcaactatttgcgtgatggacaaggcgttatccttctatattcctactgacttctcaagctgctccaggctctcttacgataaattcttcgaagacaagctttcaaactgtttgttcaatgcgcctttacctacagacatcattagcacccccatctgcgggaatcagctggttgagatgggtgaggactgtgactgcgggaccagtgaggaatgcaccaacatctgctgcgacgcaaaaacctgtaagattaaggccacctttcagtgcgcccttggggagtgttgtgaaaaatgccagttcaagaaggctggcatggtatgtcgacccgctaaggacgaatgtgatttgcccgagatgtgcaacgggaagagcggaaactgtccagacgaccggttccaagttaatggatttccatgtcatcatggaaagggacattgcctgatgggcacctgtcccactttgcaggagcagtgcacggagctttggggtcctgggactgaagtagcagacaaatcttgttacaaccgaaatgaaggcggatcaaagtacggctactgtaggcgcgtcgatgacacactgataccatgcaaagccaatgacactatgtgcgggaaactcttctgtcagggtggatccgataatctaccatggaaaggacggatagtcaccttcttaacgtgcaagaccttcgaccccgaggatacaagtcaagagatcgggatggtagcaaacggtaccaagtgcggggataacaaagtctgcataaatgcggaatgcgtagatattgagaaagcttataaaagcaccaattgtagtagcaagtgtaaaggccatgcggtatgcgaccatgagctgcaatgccagtgcgaagagggatggatcccccctgactgcgacgattcctcagtggtgttccacttctctatagtggttggagttctgtttcctatggccgttatcttcgtagtggtcgctatggtcatcaggcaccagtctagtagagaaaaacagaaaaaagaccaaagaccactttctactacagggacccgtcctcacaaacagaagcgcaaaccccagatggtcaaggcggtgcagccccaagagatgtcccagatgaagccccatgtgtacgatctacccgtagaaggaaatgagccacccgcatctttccataaagacacaaatgcgctccctcccacggtgtttaaggataatccagtgtccacgcctaaagacagcaacccaaaagcttag

SEQ ID NO: 213403 - DNA, 1452 bp, Artificial Sequence
  Description of Artificial Sequence: Synthetic coding sequence
atggaaatttggactgataaagacaaaatcaaaattactccaaacgcttctttcactcttgaaaacttttccaagtggcggggatccgtcctgagcagaaggaagcgccacgatattgcacaacttattacagccacggagctggccggaactactgtggggctcgccttcatgtccaccatgtgttctccctatagtgtgggcgtcgtgcaggaccacagcgacaatctgctaagagtcgctggcactatggctcacgaaatgggacacaacttcggaatgttccacgacgattactcctgcaagtgcccctctacgatctgcgttatggataaggctctttcattctacattccgacagatttctcttcttgctcgcgattgtcctacgataagttctttgaagataagctgtccaattgtctcttcaacgccccactcccaaccgatataatctcaacacccatctgcgggaaccaacttgtggagatgggtgaggattgtgattgcgggaccagtgaggagtgtacaaacatttgctgcgacgcaaagacctgtaagataaaggcaactttccagtgtgcactgggcgagtgctgtgagaagtgtcagtttaagaaggctggcatggtgtgccgaccagctaaggatgagtgcgatttacccgaaatgtgcaacgggaaatccggaaactgtccagatgatagatttcaggtgaacgggtttccatgtcaccatggcaagggccattgtctgatgggcacatgcccaacactgcaagagcaatgtacagagctgtgggggcctggcaccgaggtggctgacaagtcttgctacaataggaatgagggaggtagcaaatacggctactgcaggagggtggatgacaccctcatcccttgtaaagctaacgataccatgtgtggaaagttgttctgccagggaggatcagacaaccttccgtggaaaggcagaattgttaccttccttacatgtaaaactttcgatcccgaagatacgagtcaggagatcgggatggtggcaaatggtaccaaatgcggcgataacaaggtttgtatcaatgctgaatgtgtggacatagagaaggcctacaaaagcactaactgttctagcaagtgcaaaggacacgctgtgtgcgatcacgagctccagtgtcagtgtgaggaggggtggattccaccggactgcgacgattcttcggttgtgttcaggcgattactccactgtgggtggggcgctgtccccaatggcggtcatttctgcggtggttgctacggcaatccagctccagaactgcagcgcaaagctgaagagcggtctgaggccactatttaccactggcaccaagctacacagaccgaggaagaaaccccagacggaaaggggtgctctacacctcgagatgagtccgacgaagcaccatgtgtgtag

SEQ ID NO: 213404 - DNA, 1623 bp, Artificial Sequence
  Description of Artificial Sequence: Synthetic coding sequence
atgttgcagggcctgcttccagtgagcctcctgttgtccgtggccgtcagtgctatcaaggagctgccaggcgtaaagaagtatgaagtggtctacccgatccgcctgcaccctctgcataagcgggaggcaaaagagccagaacagcaggagcagtttgagacggaactgaaatacaagatgaccattaacgggaaaattgccgtcctgtacctaaagaagaacaagaacctgcttgcaccaggttacaccgagacatattataatagcactggaaaagagattactacaagcccccagataatggatgactgctactaccaaggccacattctgaatgagaaggtaagcgacgctagcatctcaacttgtcggggtctgagaggatatttcagtcagggggaccagcgctatttcattgaacccctatcacctatccaccgggatggccaggaacacgccctgtttaaatacaaccccgatgagaaaaattacgactccacatgcgggatggatggcgtgttgtgggcccacgacctgcagcagaatattgcgctacctgccacaaagctggtgaagctaaaggacaggaaggtacaggaacatgagaaatatattgagtattatttggtgctggacaatggcgaattcaaaagatacaacgagaaccaagacgaaattaggaagagggtgtttgaaatggctaattatgtgaacatgctatacaaaaaattgaacacccacgtggccctggtcggcatggagatctggaccgacaaggataagatcaaaattactcccaatgcatcattcacgctggagaacttcagcaaatggcggggaagcgtgctcagccgaagaaaacgacatgacatcgctcagctaatcacagcaactgagttggccggtacaactgtcggtctggccttcatgtccacaatgtgcagcccatactccgtgggagtggttcaggaccattcagataaccttttgcgagtggccggaacaatggcgcatgaaatggggcacaacttcggcatgtttcacgatgattacagctgcaaatgtcctagcaccatctgtgtgatggacaaagcactttctttttatataccaacagacttctcatcatgtagccgattaagctacgataagttcttcgaggacaagctgtccaactgtctttttaacgccccactccccactgatataatttccacacctatctgcggaaatcagcttgtggagatgggcgaagattgtgactgcggcacttctgaggagtgcactaatatctgctgcgatgcgaaaacatgcaagatcaaagctaccttccagtgtgccctcggcgagtgttgtgagaagtgccaattcaagaaggcaggaatggtgtgccggcctgccaaggacgaatgtgatctcccagagatgtgcaacggcaagtccggaaattgtcccgatgaccgtttccaggtgaatgggttcccatgtcaccacggaaagggacactgcctaatgggcacgtgccccacattacaagaacagtgcacagagctgtgggggcctggacgtcgcacaaaccctttcccttgcgcatgcgctaaggagaaccactttaggtag

SEQ ID NO: 213405 - DNA, 924 bp, Artificial Sequence
  Description of Artificial Sequence: Synthetic coding sequence
atggcaaactatgtgaatatgctttataagaagctcaacacccatgtcgccctagttggtatggaaatttggacggacaaggataagataaaaatcacccctaacgcaagtttcaccctggaaaatttcagcaaatggcgcggatcagtgttgtctcgcagaaaaaggcacgacattgctcagctaatcactgccactgaattggccggaacaaccgtgggcctggcatttatgagtactatgtgctcaccttattcggttggcgtggtgcaggatcatagcgacaatctattgcgggtggcaggtactatggcccacgagatggggcataactttggaatgtttcatgacgactacagttgtaaatgcccttccaccatttgcgttatggataaggctctgagtttctacatcccaacagacttcagttcatgcagcaggctgagctacgataaattctttgaggataaactcagcaattgtctgttcaatgcgccattaccgacagacatcatcagtactccaatatgcggcaatcagctcgttgagatgggcgaggactgtgactgcggtacgtctgaagagtgcactaatatctgctgtgatgcgaagacgtgcaagattaaggccacttttcagtgcgctttaggtgagtgctgcgagaaatgccagtttaaaaaagctgggatggtgtgtcgtccagctaaggatgagtgcgatctcccagaaatgtgtaacggcaagagcggcaactgtccagatgatcggtttcaggtcaacggttttccctgccatcacggaaaaggccactgcttgatgggcacttgcccaacccttcaagaacagtgcaccgagctgtggggacctggccgacggactaacccgttcccctgtgcgtgtgccaaagagaatcatttccgctag

SEQ ID NO: 213406 - DNA, 2463 bp, Artificial Sequence
  Description of Artificial Sequence: Synthetic coding sequence
atgaaaatgctgctacttctccactgtctgggagtatttctcagctgttcgggccacatccaagacgaacacccgcagtaccactctccccctgatgtggtgattcctgtgaggatcacgggaaccacgcggggaatgacaccgccaggttggctctcatatatccttcccttcggcggtcaaaagcatattatccacatcaaagtgaaaaaactgctgttttcaaaacacctacctgtgttcacatatacagaccaaggagcgatcctggaggatcagccttttgtccagaataattgctattatcatggctacgtcgaaggagatcctgagagcctggtgagcctgagtacatgtttcggcggatttcaggggattctacagatcaacgacttcgcttatgaaatcaagccactcgcgttcagtaccacctttgaacaccttgtctacaagatggactctgaggagaagcagttctccacgatgaggtcggggttcatgcagaatgaaattacgtgcagaatggaattcgaagaaattgataacagcacacagaagcagagtagctacgttggatggtggatccactttcgtattgtggagatcgtggtggtcattgataattatctgtatatcagatatgagcgcaacgacagtaaattactggaagacctgtatgtcattgtgaatattgtggactccatccttgacgtgataggcgttaaggtgctgctgtttgggctggaaatctggactaacaagaaccttatcgtggtggatgacgttcggaagtctgttcacctgtattgcaagtggaagtccgagaacatcaccccgcgaatgcaacatgatacttctcatttgtttactaccctgggtttacgaggcctgtcaggtataggtgctttcaggggcatgtgtactcctcacaggtcctgcgccatcgtcaccttcatgaacaaaacactcggcactttttctatcgcagttgctcatcacctaggccataacctgggaatgaatcacgacgaagatacttgcagatgttcccagcctaggtgcatcatgcatgaaggtaacccacccataaccaagttcagtaactgtagctatggcgacttctgggagtatactgtagaaagaactaagtgcttattagaaaccgtgcacaccaaggacatttttaacgttaaacgctgtggcaacggagttgtcgaagagggagaagagtgtgactgcggacctctaaaacattgtgccaaagatccctgctgtttatccaactgcacgctgaccgacggctcaacctgcgcctttgggttgtgctgtaaggattgcaagttcctgccttctggaaaggtgtgcagaaaagaggtcaacgaatgcgacttgcccgagtggtgcaacggcacgtctcataagtgtccggatgatttttatgtggaggacgggattccttgtaaggagagaggatattgctatgagaagtcttgccatgacaggaatgaacagtgcagaaggattttcggggctggtgctaataccgcctccgagacatgctataaggagctgaataccctaggcgaccgagtaggccactgtggtataaaaaatgctacttatatcaagtgcaatattagtgatgtccagtgcgggaggattcagtgcgagaatgtcacagaaatccccaacatgtcagaccacaccactgtgcattgggcgcgttttaacgacatcatgtgctggagtacagattaccatctcggcatgaaaggtccagatatcggcgaggtgaaagacggcacagaatgtgggattgaccacatctgcattcaccggcattgtgtccatatcaccatcctaaacagcaattgtagccctgctttctgtaacaagcgcggtatctgtaataataaacaccactgccactgtaactacctgtgggaccctcccaattgcctgattaagggctacggtggcagcgtggattctggaccaccacccaagcgaaagaagaaaaaaaagttctgctacctgtgcattctgctcctgatcgtcttgttcattttactgtgctgtttgtataggctgtgtaagaaatctaagccaatcaaaaagcagcaggacgtgcaaactccaagtgccaaggaggaagagaagatccagcgcaggccccatgaattacccccacagagccaaccatgggttatgcctagccagagccagccgccagtaacgcctagccagagtcatccacaagttatgccttctcagtctcaacctcctgtgaccccatcccagagccaaccacgtgtgatgcccagccagtcccagccacccgtcatgccctcccaatctcacccccagctgactccgtcccagagtcagccacctgtgacaccgtcacaacggcagcctcagctgatgccgtcccagagccagccacctgtcaccccctcttag

SEQ ID NO: 213407 - DNA, 2463 bp, Artificial Sequence
  Description of Artificial Sequence: Synthetic coding sequence
atgaaaatgttactccttctgcactgtctgggagttttccttagctgttccggtcatatacaggatgagcatccgcagtatcacagtccacccgatgtcgtcattcctgtccgtatcaccgggaccacccgaggtatgaccccccctggatggttaagttatattctgcctttcggcggacagaagcacattatccatattaaagttaagaaactcctgttcagtaaacatttgccagtctttacttacaccgatcagggcgcaattctggaagaccagcctttcgtccagaataactgttactaccatggctatgtggagggcgacccagagtctctggtctcgctgtccacatgtttcggtggcttccagggtatcctccagattaacgacttcgcttacgagattaaaccactggctttcagcacgacctttgagcacctggtttacaagatggatagcgaagaaaaacagttttctactatgaggtcaggcttcatgcagaatgaaatcacttgccggatggaattcgaggaaatcgacaacagtacccagaagcagtctagctatgtgggatggtggatccacttccgaatcgtggaaattgtggttgtgatagacaattatctgtacattagatacgagcgaaatgactctaagctgctcgaagacctctacgtgatagtgaatatcgttgatagtatactggatgtgatcggcgttaaagtgcttctgttcgggttggagatctggactaacaaaaacctgatcgttgtcgacgatgttcggaaatctgtccacctgtattgcaaatggaaatccgaaaatataacgcccagaatgcaacacgatacttctcacctgttcacaaccctaggactaaggggtctttcaggtattggggcattccgcggaatgtgtactccgcaccggtcctgtgctatcgttacttttatgaacaaaactttgggcactttctcgatcgccgtcgcacatcatttgggccataacctcggaatgaaccacgatgaggacacgtgtaggtgtagtcaaccacggtgtatcatgcacgaaggcaacccaccgattacaaagttctcaaactgctcttatggggatttctgggaatatactgtggaaaggactaaatgcttactggaaacggtgcatacaaaagacatctttaatgtgaagcgctgcggaaatggagtcgtggaggaaggcgaagaatgtgattgtgggccattgaaacactgcgctaaagatccatgctgcctgagcaactgtacgttgaccgacggctctacttgcgcctttggactgtgttgcaaagattgtaaatttctcccatccgggaaagtgtgccgaaaggaagtgaatgaatgcgacttgccagagtggtgcaacgggaccagccataagtgtcccgacgacttctacgtggaggatggtattccttgtaaggaacgcggttactgctatgagaagagctgccacgaccgaaacgaacaatgtaggcgaatttttggagcaggggctaacaccgccagtgaaacctgctataaggagctgaacacactgggggatagagtgggccactgcggcattaagaacgctacctatatcaagtgcaatatatccgacgttcagtgcggcaggattcagtgtgaaaatgtcaccgagatccctaatatgtcagatcataccactgttcattgggccagattcaacgacattatgtgctggtcaaccgattatcatctcgggatgaagggccctgatatcggggaggtgaaggacggcacagagtgcgggattgaccatatctgcatacacaggcactgcgttcacatcacaatactgaactccaattgctctcctgccttttgtaacaagcgcggtatatgtaacaataaacatcattgtcactgtaattatctgtgggatcctcccaattgtctgatcaagggctacggaggttctgtggattctggacccccacctaagaggaagaagaaaaaaaaattctgttacttgtgcatactactgctgattgttcttttcattcttctgtgttgtctttaccgattatgcaaaaaaagtaagcccatcaaaaagcagcaggacgtgcaaacaccgagtgccaaagaggaggagaagatccaacgccgtccgcatgagctccctccacagtcacagccttgggttatgccgtcacagtctcagcccccagtgacgccgtctcagagtcatcctcaagtgatgccaagtcaatcccaaccgcctgttacacctagtcagagccaaccacgcgtcatgcctagccagagtcagccaccagttatgccctcccagagtcaccctcagttaaccccctctcagagccagccccctgtgacaccttcccagagacagcctcagctcatgcccagccagtcccaaccaccagtcacaccttcttag

SEQ ID NO: 213408 - DNA, 2463 bp, Artificial Sequence
  Description of Artificial Sequence: Synthetic coding sequence
atgaaaatgttgttgctgttgcactgcctaggagtgttcctctcctgctcaggtcatatccaggatgagcatccgcagtaccactcgcccccagatgttgtgatcccagtgcgtatcacaggcacaacacgtggcatgactcccccaggctggcttagttatattctcccattcgggggacagaagcatattatccatatcaaagtcaagaagttgctgttttccaaacatctccctgtgttcacatacaccgatcagggggcaatcctggaggatcagcctttcgttcaaaacaactgctactatcatggctacgtcgagggagaccccgagagcctggtatctctgtccacttgtttcggaggttttcagggaattctccaaattaatgacttcgcatatgaaataaaaccattagcattcagtaccacattcgaacacctggtgtacaagatggacagcgaggagaagcagtttagcaccatgagatccgggtttatgcagaatgagattacttgtcgaatggaattcgaggagatcgataattccacgcagaaacagtcatcttacgtgggctggtggatacactttaggatcgtggaaatcgtggtcgtaatcgacaattatctttacataaggtatgaacgaaacgattccaagcttcttgaggacttgtatgtcattgtgaacatcgtggattcgatacttgatgttatcggtgttaaggtccttctatttggactcgaaatttggacaaacaagaacctaatcgtggttgatgacgtgcggaagtctgtccacttgtactgtaagtggaagtctgaaaatattacccctagaatgcagcatgatacatcgcaccttttcaccactctgggcctccgaggcctgtcagggatcggagctttcaggggaatgtgcacaccccatcgatcctgtgctatcgtcaccttcatgaataaaacgctcggaacgttttccatcgcagtggcacatcatctgggccataacctcggcatgaaccatgatgaggatacctgtcggtgtagtcagcctcggtgcattatgcacgaaggcaaccccccaattacgaagttcagtaattgctcttacggtgatttctgggaatacacagtagaaaggactaagtgtctgctggagaccgtgcataccaaagatatttttaatgtaaagagatgcgggaacggagtcgttgaggagggagaggagtgcgactgtggacccctcaagcactgtgcaaaagatccgtgctgtctttcaaactgcactcttactgatggatctacctgcgctttcgggctgtgttgtaaagattgcaagtttctccccagcgggaaggtttgtaggaaagaggtgaatgaatgtgacctccccgaatggtgcaacggaacctcacacaagtgtcccgatgacttttatgtggaagacgggatcccctgtaaagagcgcggatattgctacgaaaaatcctgccatgatcggaatgaacagtgcaggcgcatttttggcgcaggtgctaatacagcctccgaaacttgttataaggaactgaatacgctgggcgaccgagtgggacattgtggaatcaaaaacgctacatatatcaagtgcaacatcagtgacgtccaatgcggaagaattcagtgcgagaatgttaccgagattccgaatatgagcgatcacacaacggtgcattgggcaaggtttaatgacattatgtgttggagcaccgactaccacctcggcatgaagggaccagatatcggggaggtgaaggacggaaccgagtgtggtatcgatcacatttgtattcacaggcactgtgtgcacataacgattctgaacagtaattgcagtcccgctttctgcaataagaggggcatctgcaacaataagcaccactgccattgcaattacctctgggatccccctaattgtctcatcaaagggtatggtgggtccgtcgactctggacctccccctaagcgaaagaaaaaaaaaaagttttgctacctctgtattcttctgctgatagtgcttttcatcctactctgttgtctgtaccggttgtgcaagaagagcaaacccatcaagaagcaacaagatgtacagacacctagcgccaaagaggaagagaaaattcaacgcagaccacacgagttgccaccccaaagtcagccctgggttatgccctcccaaagtcagcctcccgttacacccagccagtcgcatccccaggtgatgccatctcagtctcagccacccgtcaccccttcccaaagccagccccgtgtcatgccttcacagtctcaacccccagtgatgccatcccaatcacatccacagctcactccttcccagtcacagcctccagtgacaccgtcccagcgccagccacagctgatgccttcccagagccagccacctgtcactccaagttag

SEQ ID NO: 213409 - DNA, 135 bp, Artificial Sequence
  Description of Artificial Sequence: Synthetic coding sequence
atgaagatgttgctcttacttcactgtttgggagtcttcctgagctgcagtgggcatatccaggacgaacacccacaataccatagcccacctgacgtggtgatccctgtgcgcatcacagggacaacccgttag

SEQ ID NO: 213410 - DNA, 273 bp, Artificial Sequence
  Description of Artificial Sequence: Synthetic coding sequence
atgaagatgcttctccttttacattgtcttggggtcttcctgagctgcagcgggcacattcaggacgagcacccccagtatcattccccccctgacgtggtaatccccgtgaggatcacggggaccactagaggaatgactcctcctggttggctgagttatatcctccctttcggtggccaaaaacatattattcacattaaggtgaagaagctgttattctcgaaacatttgcctgtcttcacatataccgaccagggcgctatactatag

SEQ ID NO: 213411 - DNA, 45 bp, Artificial Sequence
  Description of Artificial Sequence: Synthetic coding sequence
atgaaaatgctcctgctcctgcattgcctcggagttttcctttag

SEQ ID NO: 213412 - DNA, 2463 bp, Artificial Sequence
  Description of Artificial Sequence: Synthetic coding sequence
atgaaaatgctcctccttctccattgcttgggtgtgtttctatcatgctcgggccacattcaggacgagcacccacagtaccactcgcctcccgacgtcgtgatccccgtacggattacagggaccacccgcggaatgacgcctcctggatggctcagctacatattgccatttggaggtcagaagcacattatccatataaaagtgaagaagctattattcagcaaacacctgcccgtgtttacctacacggaccagggggcaattctcgaagaccagcccttcgtccagaacaattgctattaccacggatatgttgaaggagacccagagtctcttgtctctttatctacttgtttcggcggatttcagggaattctgcaaatcaatgacttcgcgtacgaaatcaaacctttggctttcagtacgacctttgagcatctcgtctacaaaatggactcagaggagaaacagtttagtacaatgcggagcggctttatgcaaaacgaaatcacgtgtcggatggaattcgaagagatcgacaatagcacccagaagcagagttcttacgtgggatggtggatccacttcagaatagttgaaatcgtggtggtcattgacaactacctgtacattcgatacgagcgcaatgattccaaactgttagaggacctgtatgtaatcgtcaacattgtggactccatccttgatgtgattggtgtaaaggtcttactgttcggccttgaaatatggactaataaaaacttgatcgtggtagacgacgtacggaagagcgtgcacttgtactgtaagtggaaatccgagaacatcactcctcgaatgcagcacgatactagtcatttgttcactactctcgggctccgaggccttagcgggatcggcgctttcaggggcatgtgcacgccacacaggagttgtgcaatagtgacgtttatgaacaagactctgggcaccttctccatagccgttgcccatcacttagggcacaacctcggaatgaaccacgacgaggatacctgtagatgctctcaacctaggtgcatcatgcatgaaggaaatccccctatcactaagttttcgaactgctcctacggggacttctgggaatacaccgtggaacgcacaaagtgcctgttggaaacagtccacacaaaagacatttttaatgtgaagagatgtggaaacggggtggtggaggagggcgaggagtgtgactgcggcccactgaaacattgcgcaaaagatccgtgctgcctgagcaactgtaccctgaccgacggaagtacttgcgcttttggcttgtgctgtaaggactgcaagttcctaccatcaggtaaggtgtgccgcaaggaggtgaatgagtgtgatctgcccgaatggtgtaacgggacatctcacaagtgccccgatgacttctacgtagaagacgggatcccctgcaaggagagaggctactgttacgagaagtcgtgccatgataggaatgagcaatgcagaagaatcttcggcgcaggcgctaacaccgcttcagaaacatgttacaaggagctcaatacgttgggagatcgcgtcgggcactgtggtatcaagaatgcgacttacattaagtgcaatatctctgacgtacagtgtggacgcattcaatgcgagaacgttacagaaatcccgaatatgagcgaccataccactgtccactgggccagattcaacgacatcatgtgttggagcactgattatcatctgggcatgaagggtccggacatcggggaagtgaaagacgggaccgaatgcggcatcgatcatatctgcattcaccggcactgcgtccacatcactatcttgaactctaattgctcccccgcattctgtaacaaacgcggtatctgtaacaacaaacaccactgtcattgtaattatctttgggacccgcctaattgtctcatcaaaggttacgggggatccgtggacagtgggcctccacccaagcgcaaaaagaaaaagaaattctgctacctgtgcattctgcttctgattgtgctcttcatcctgctttgctgtctgtacagactctgcaagaagagcaaacccatcaagaaacagcaagacgtgcaaactccttcggcaaaggaagaggagaagatccaaaggagaccccacgaactaccaccgcagtcacagccctgggtaatgccctcccagagtcagccacctgtgaccccctcacagagtcatccccaagtgatgccatcacagagccaacccccagtgacccctagtcaatcacagcccagagttatgcctagccagtctcaacctcctgtgatgccatcccagtcccatccccagctgacacccagccagagccagcctccggtaaccccttcccagcgccagcctcaactgatgcccagtcagtcccagcccccagtaacccccagttag

SEQ ID NO: 213413 - DNA, 2373 bp, Artificial Sequence
  Description of Artificial Sequence: Synthetic coding sequence
atgcgctcagttcagatatttctgtcccagtgtaggttgttactcctgttggtacctacgatgctcctgaagtccttgggtgaggacgtaatctttcaccctgagggtgaatttgactcatatgaggtcactataccagaaaaactgtcatttcgcggagaggtgcagggcgtcgtgagcccggtcagctatttactgcagctgaaggggaagaaacacgttttgcatttgtggcccaagcggcttcttctgcctcgccacttgagggtgttctctttcacagaacatggcgaactgctcgaggatcacccatacattcccaaggactgcaattatatgggcagcgtgaaggaatccctggacagcaaggcgaccatctcgacttgcatgggcggactgaggggagtcttcaatattgatgccaagcattaccagattgagccactcaaagccagcccatcctttgaacatgtcgtgtatttgctaaagaaggagcagttcgggaatcaggtgtgcggcctgtccgatgatgagatcgagtggcaaatggcaccctatgaaaataaagcccgactgagggattttcccggatcttacaagcatcctaaatacttggagctgattctccttttcgaccaatccagataccgattcgtgaataataatttatcccaggtcattcacgacgctatcctcttaactggcattatggatacttacttccaggacgtgaggatgaggattcatcttaaagctcttgaagtctggacagactttaataagattagagtgggttacccagagctcgctgaggtactgggacgcttcgtgatttacaagaagtcagtgttgaatgctcggctgagtagtgactgggctcacctttacttgcaaaggaagtacaatgacgcattggcctggagtttcggcaaagtgtgttcgctggagtatgccggatccgtttctacactgcttgatactaatattctagcccctgcaacctggtctgctcacgaactggggcacgcagtgggcatgtctcacgatgagcaatactgccagtgtcgcggtcgactcaattgtatcatgggcagcggcagaaccggattctccaattgttcctacattagcttcttcaagcatatctcgtcgggagcaacatgcctgaataacatccccggattaggttatgtactgaagcggtgcggaaacaagatcgtcgaggataacgaggaatgcgattgtggatctacggaagagtgtcaaaaagaccggtgttgtcagagcaactgtaagctccaaccgggtgccaactgtagtattggactatgttgtcatgattgtcggttccggccttccggctacgtctgccggcaggaaggaaatgagtgcgatctggcagagtattgtgacgggaattccagcagctgccctaacgatgtgtacaagcaggacgggactccttgcaagtatgagggtcgctgcttcaggaaggggtgtaggtcacggtatatgcaatgtcaatccatctttggcccagacgctatggaggcgccatcagagtgctatgatgcggtaaacctgattggagatcagttcggcaactgcgaaattactggcatccgtaactttaaaaagtgtgagtccgcgaatagcatctgtggcaggctccagtgtattaatgtggagactatcccagaccttccagagcacactactatcattagcacgcatctccaggccgagaaccttatgtgctggggaactggctaccacctgtctatgaagcctatgggaatccccgatttggggatgatcaatgatggtaccagctgtggggagggtagagtgtgcttcaagaagaattgcgtaaatagcagtgtgctgcagtttgactgcttacccgagaagtgcaacactcgcggagtgtgcaacaatcggaaaaattgtcactgcatgtatgggtgggcacctccattttgtgaggaagtaggttacggaggatccattgatagcggaccacctggcctgcttagaggagcgatcccttctagtatttgggtcgtatctattatcatgtttaggctgatccttctgattctgtccgtggtgtttgttttctttcgacaggtcatagggaaccatctaaaacctaaacaggaaaagatgcccctgtctaaagcaaaaactgagcaggaggagtcaaagactaagactgtgcaagaagagtctaagacgaaaaccggccaagaggagtccgaggcaaagacagggcaagaggagtccaaggctaaaacaggacaggaggagtccaaggccaacatagagtcaaagaggccgaaggcaaagagcgtcaaaaagcaaaaaaaatag

SEQ ID NO: 213414 - DNA, 2346 bp, Artificial Sequence
  Description of Artificial Sequence: Synthetic coding sequence
atgaggtccgttcagattttcctctcacaatgtcgtctcctcctgctgctggttcctaccatgttgcttaagagcctgggtgaggacgtcatttttcatcccgagggcgagttcgattcctacgaagtgacgatcccagagaagctgagctttcgtggcgaggttcagggagtggtgtctcccgtgagttatctccttcagcttaaaggtaagaaacacgtgttgcacctctggcccaagaggcttttactgccacgccacctccgcgtatttagttttacagaacacggtgaactgctggaggaccacccctacatccctaaggattgcaactacatgggatcggtgaaagagtctctcgatagtaaggccacgatcagcacctgtatgggtggtttacgtggagtctttaatatcgacgccaagcactatcagattgagccactgaaggcatctcccagctttgagcatgttgtgtacctgctcaagaaggagcaatttggcaaccaggtgtgcggtctgtctgacgatgagattgagtggcaaatggctccatatgaaaacaaggcacggctgcgggattttcctgggtcttataagcaccctaaatatcttgagctaatcctattgttcgaccagtcacgctatcgtttcgttaataacaacttaagccaagtcattcacgatgccattctgctgaccgggatcatggatacctacttccaggacgtgcggatgaggatacatctgaaagccttagaagtgtggaccgatttcaacaaaatccgggttgggtaccctgaactggctgaggtgctgggacggtttgtgatctataaaaagtctgtgctgaacgccaggctatccagcgattgggcccatctgtacctgcagcgaaagtacaacgatgctctggcctggagcttcgggaaggtctgttcgctggagtacgcgggatctgtctccactctccttgacacaaatatactcgcacctgctacatggtctgcccatgagctgggtcatgcagtgggcatgtcacatgacgaacagtactgccagtgccggggacggcttaattgcatcatgggcagtggcaggacgggctttagcaattgttcatatatctcctttttcaaacacatcagttccggtgctacatgtcttaacaatatccccggactgggctacgtgctcaaacgctgcggcaacaagatcgtcgaggacaacgaagagtgtgactgcgggtcgaccgaagagtgtcagaaagacagatgttgtcaatctaactgcaagctgcagcctggggcaaactgtagtataggcctgtgctgtcacgattgcaggtttaggccaagtggttatgtgtgtagacaggaaggaaacgagtgcgacctggcagaatattgcgatggaaatagcagttcctgccccaatgacgtgtacaagcaggacggcacaccctgtaagtacgaggggagatgtttccggaaaggctgtaggtcacggtatatgcagtgccagtccatcttcggaccagacgccatggaagctccctctgagtgctacgatgcggtgaacctaatcggcgatcagttcggcaattgtgagataacgggcatccggaacttcaaaaagtgtgaatccgccaactccatctgcgggagattgcagtgcataaacgtggagacgatccccgatcttccggaacatacaaccattatttccacccaccttcaggccgaaaacctcatgtgctggggcaccgggtaccacctgagcatgaagccgatggggatccccgacttggggatgattaatgacggtacttcctgtggggagggcagagtatgcttcaagaagaattgcgttaacagttccgtactccagtttgactgtcttcctgagaagtgcaatacccggggagtttgtaacaatagaaaaaactgtcattgtatgtacggatgggcacccccattctgtgaagaggtgggttatggcggatctatcgacagcggccctccagggctgcttcgcggagccatccccagtagcatttgggtagttagtattatcatgttccgcctcattttacttattttgtcagtcgtgttcgtgttcttccgccaggttattggcaaccacctcaagccgaagcaagaaaagatgcctctgagtaaggccaagactgaacaggaggagtcgaagacgaagaccgtgcaagaggaatccaagaccaagactggccaggaggaaagcgaggcgaagacaggacaggaggaaagcaaggcaaatatcgaatctaaacggcctaaggctaagtccgtaaagaaacagaagaaatag

SEQ ID NO: 213415 - DNA, 540 bp, Artificial Sequence
  Description of Artificial Sequence: Synthetic coding sequence
atgggttggagacctcgtagggccagagggaccccgctcttgctattgctgctgctgttattattgtggcctgtcccgggagctggcgtgcttcaaggacacatccctggacagcctgtgacaccacattgggttttggacggccagccatggagaaccgtgtcccttgaggagccagtgagcaaaccagacatgggactcgtggctctcgaagcagaggggcaggaattgctgcttgaactcgaaaagaaccagcttctggctccaggctatatcgagacacattacggtcctgacggtcagcctgttgtgctcgcgccaaaccataccgtccgttgtttccatggtctgtgggacgctccacccgagggtcgcagggaggcgcgacgcacgagaaaatacttagaactgtacattgtggccgaccatacactgttcttgacccgacatcgcaatctaaatcacacgaagcagaggctgctggaagtggctaattatgtggaccaggttgtgaactcagccggtgacgcccatgggtag

SEQ ID NO: 213416 - DNA, 336 bp, Artificial Sequence
  Description of Artificial Sequence: Synthetic coding sequence
atgggatggcgccctcgacgcgctcgagggacgccattgcttctgctcctccttttactgctcctctggcccgtaccaggcgctggtgtgctgcaaggccatattccaggtcaacctgtgacgccacactgggtcttagacggacagccctggcgtaccgtatccctagaggaacccgtctctaaaccggatatgggccttgtggccttggaagctgaaggccaagagcttctcctcgaactggagaagaaccagctgttagctcctggctatatagaaacccattatgggccagcccaggagtgcagagacctttgttgcttcgcccacaattag

SEQ ID NO: 213417 - DNA, 2364 bp, Artificial Sequence
  Description of Artificial Sequence: Synthetic coding sequence
atgggatggagacccaggcgggctcggggtacacctctgctcctgctactgctcctgctgctcctctggcctgtgcccggtgctggcgtcctccaaggtcacatccccggacagcccgtgaccccacattgggtgctggacgggcagccctggagaactgtgagccttgaggagcccgtatctaagccagatatggggctggtcgccctggaggccgagggtcaggaattgctgctcgaacttgagaaaaaccaccgacttcttgctccgggttatattgaaacgcactacggaccggacggccaacctgtagtcctagcccctaatcacaccgaccactgtcactaccaagggagggtccggggattcccagactcatgggtggtgctttgcacttgttctgggatgagtggtctgattacacttagtcgaaacgcttcctattatctaaggccgtggccacctaggggcagtaaggatttctcaacccacgaaatatttagaatggagcagttgttaacatggaaagggacgtgtggacaccgggatccaggtaataaggcaggcatgacttctctgcccggaggtccccagtctcgtggacgcagagaggccaggcgcacaagaaagtatttggagctgtacatcgttgcagatcacaccttattcttaacgcggcatagaaaccttaaccatacaaagcagaggctgctggaggtcgctaattatgtcgatcagctgctgcgaaccctggatatacaggttgcactgactgggctcgaagtctggacagaacgagacaggtccagggtgacccaggacgctaatgcaacgctgtgggcatttctccaatggaggagaggcctatgggcccagcggccacatgacagcgcgcagctgctgactggaagagcatttcaaggtgcaacagtggggctcgcacccgttgagggaatgtgtcgcgcagagtcctctggaggcgtcagtactgaccactcagagctcccgatcggtgctgcagcgaccatggctcacgagattggccacagtctgggattatctcacgacccagatggctgctgcgtggaagccgctgcggaaagcggcggatgcgttatggccgctgctactggccatccattcccccgtgtcttttcagcttgttcacggaggcagctccgcgcatttttccgaaagggagggggagcctgcctgtcgaacgctccagacccagggctgccagtaccacccgctctatgcgggaatggatttgtggaggccggagaagagtgtgattgcggccctggacaggaatgtagagacctgtgttgtttcgcccataactgctcactgcgacccggagcacagtgtgcccacggcgactgctgtgtgcgctgtctactgaagccagccggagccctctgcagacaggccatgggagattgtgacctgccggagttctgtacgggaaccagttcccactgccccccagatgtttacctgctggacgggtccccctgtgctcggggaagcggatattgctgggacggagcctgccccaccttagagcagcaatgtcagcagctgtggggacccggatcacacccagccccagaagcttgcttccaggttgtgaactccgctggagatgctcacggaaattgtgggcaagatagtgagggacatttcctgccctgcgcaggtcgggacgcactctgcggcaagttacaatgccaggggggtaagccatctttactggcgccacatatggtccctgtggactcgaccgttcatcttgatggccaggaggtgacttgcagaggggctcttgcccttccatctgcccaactcgatctcctggggcttgggctcgtcgagcccggtacccaatgtggccctcgcatggtgtgcaactccaatcacaactgtcactgcgcccctggctgggcccctcctttttgtgataagccaggcttcgggggtagtatggactcagggccagtgcaagccgaaaatcatgacacctttctgctggcaatgctgctgtctgtgctgctcccactgctcccaggcgctggcctagcctggtgctgttatcggttgcctggcgctcacttgcagagatgctcatggggatgcagaagggatcctgcctgctctgggcctaaggacggcccacatcgagaccacccattgggtggcgtccaccccatggagctgggccctaccgcaaccgggcagccatggccgctggaccccgagaactcacatgaacccagctctcaccctgagaaacctctaccagccgtttctccagaccctcaggcggatcaggtacagatgccccgatcatgcctttggtag

SEQ ID NO: 213418 - DNA, 2442 bp, Artificial Sequence
  Description of Artificial Sequence: Synthetic coding sequence
atgggctggagaccgcgaagggcaaggggaacaccactcctgcttctcctcctactcctgctcctgtggcctgttccaggcgcaggagtgctccaggggcacatccccggacagcctgtgactccacactgggtgttggatgggcaaccatggcgcactgtctctctcgaggagcccgtgtccaaacctgatatgggtttggttgccctggaggcagagggtcaggagctcctgttagagctggagaaaaaccacagactcctcgcacctggatacatagagactcattacgggccagacggtcagcctgtagtcttagcccctaaccatacagaccactgtcactaccaaggcagagttcgcggattccctgattcatgggtggtgctgtgcacatgttctgggatgtcgggcctgataacactgtccagaaacgcgtcctattatctgagaccttggccacccagagggagtaaagacttcagcacccatgaaattttccgcatggagcagctgctcacatggaaggggacatgcggccatcgagatccagggaacaaagccggtatgacgagcctgcccggtgggccacagagccgcggacgacgggaagcccgtcgcactcggaagtatctggaactgtacatcgtggccgatcatacattattcctgacaaggcaccggaatctgaaccataccaagcagcgcctgctggaggttgcaaactatgtggatcagctgctgaggactctggatattcaggttgctttaacaggactcgaagtgtggactgagagagatcgcagccgtgtgactcaggacgccaatgctaccctctgggccttcttgcagtggaggaggggcttatgggcccaaagaccgcacgattccgcccagttgctaaccgggagggccttccaaggcgcaacggtggggctcgcacctgttgagggcatgtgtcgagccgaaagtagcggaggcgtctccacagaccactccgagttgcctattggcgctgcagccacaatggctcacgaaattggccacagcctgggtctgagtcacgaccccgacggatgttgcgtggaagctgctgcagagtccggcggatgcgtgatggccgcagccactggccacccctttccacgcgtattttcagcctgcagccgacgccagctccgcgctttcttccgaaaggggggaggcgcttgtcttagcaacgcaccagaccccggactccccgtgcccccagcactgtgtggtaacggttttgtggaggcaggcgaggaatgtgattgtggccctggccaggaatgtagggacctctgctgctttgcgcataattgttcactccgcccaggagcccagtgtgcccacggggactgttgcgtgaggtgtcttctaaaacccgctggggctctgtgccggcaggcaatgggagattgtgaccttcctgagttctgtacaggtacctcttctcattgccccccagacgtatatctgcttgacggttccccatgcgctcgaggcagcgggtattgctgggatggcgcttgtccgaccctggagcaacagtgccagcagctgtgggggcctggaagccaccctgctccagaggcatgctttcaggtcgttaactccgcaggagatgctcacggtaactgtgggcaagattcggagggccatttcctgccttgcgcagggagggacgctctctgtggcaagctacagtgccagggaggcaaaccaagcctgcttgcgccacacatggtgcctgtcgactccacagtgcacctagatggtcaggaggtgacttgcagaggtgcgctggctttgcctagcgcacagctggacctgctgggactgggtcttgtcgagccgggtacacagtgtggaccgaggatggtgtgccagagtcggaggtgtagaaaaaacgcattccaggagctccagaggtgtctgaccgcctgtcattctcatggcgtgtgtaattctaatcacaactgccattgtgctccaggctgggcgcctccattctgtgataagcccggtttcggtggcagcatggactcaggacccgtccaagcagaaaatcatgatacattcttattggccatgttactgtccgtgttattgcccttgctgccaggagctgggctcgcctggtgttgctacagattgccaggagcacatctacagaggtgttcttgggggtgtagacgggaccccgcttgcagcgggcctaaggacgggcctcatagggatcatcctttgggtggagtgcatccgatggaattggggcctaccgctaccggacagccttggcccctcgacccagaaaactcccacgaacccagcagccatcccgaaaagccactacctgctgtgagccctgacccgcaagccgaccaggttcagatgccacgaagctgtctgtggtag

SEQ ID NO: 213419 - DNA, 417 bp, Artificial Sequence
  Description of Artificial Sequence: Synthetic coding sequence
atgggatggagacccaggcgggcaagaggcacccctctgctgctgctactgttgctcctgctactctggcctgtgcctggagctggcgtgctccaggggcatattcccggacagccggtgacaccacactgggtcctggatggccagccatggcgtaccgtgagcttggaggaacctgtctccaaacccgatatgggtttagtggctcttgaggctgagggccaggaactgctcctggaactcgaaaaaaatcaccgactcttagcgcctggctacatcgagactcactatggccctgatgggcagccggtggtcctggcccctaaccataccgtgcggtgcttccacggcctctgggacgcacctcccgaggtcccaccccaccatagctacccctatagttctctgcattcatag

SEQ ID NO: 213420 - DNA, 543 bp, Artificial Sequence
  Description of Artificial Sequence: Synthetic coding sequence
atgggatggagacctagaagagccaggggtactccgctgttgctgcttctgcttctgctcctgctgtggcctgtgccaggggcaggcgtgctgcaaggccatatccctggccagcctgtgacaccacattgggtgctggatgggcaaccttggaggacagtgtctcttgaagagccagtttcaaagccagacatgggcctggtggctctggaagccgaggggcaggagctacttctcgaactggagaagaatcagctgttggctcctggttatatagaaacccactacggacccgatggtcaacccgtagtcctggcacctaaccatacggtgagatgcttccatggattgtgggatgcacccccagagggtcgccgagaggccaggcgcacacgaaagtacctcgagctgtatatcgtggccgatcacactcttttcttgactcggcacaggaacctgaaccacaccaagcaaagactcttggaagtggccaattacgtggatcaagagtgccgcgacctgtgctgctttgcacacaactag

SEQ ID NO: 213421 - DNA, 2439 bp, Artificial Sequence
  Description of Artificial Sequence: Synthetic coding sequence
atgggatggcgcccacgcagggcacggggtacaccactgctgctgctgttgctactgctgcttctgtggcccgtgcccggtgcaggggtgctgcaagggcatatccctggacagccggtgactccccactgggtattggacggccagccttggcggacagtttctcttgaggaaccagtatccaaaccagatatgggacttgtggcgctggaggccgaagggcaggagctcctgctggagctcgagaagaaccacaggcttctggccccaggatatatcgagacccattacggtcctgacggccagcccgtagtgcttgccccaaaccataccgaccactgccactatcaaggaagagtccggggttttccagatagctgggttgtcctgtgtacctgctccggtatgagcgggttgatcaccctcagccgcaatgcttcatactaccttaggccgtggccgcctcggggatccaaggatttcagtacacatgaaatctttcggatggagcaactgttgacttggaaagggacatgtggccatcgcgaccccggtaataaggcaggcatgacgtcactacccggtgggcctcaatcccggggtcgtcgggaggcccgacgaaccagaaagtacttggagctctatatcgtagctgatcacactctgttccttacacggcatcgcaacctgaaccacacaaagcagcgactcctggaagtcgctaactacgtggaccagctcctgcgtacgctggacattcaggtggcgctgacaggactcgaagtgtggacagagcgggacagaagtcgagttacccaggatgccaatgccactctttgggccttcctgcagtggagaaggggcctttgggctcagaggcctcatgacagcgctcagctgttgaccggccgagcattccagggtgcaaccgtcggcctcgcacccgtggaggggatgtgccgtgccgagagctctggtggggtgagcacagatcatagtgagctcccaataggggcagcggctaccatggcccacgaaatcgggcacagtttggggctgtcacacgaccctgacggctgctgcgtggaagccgctgctgaaagtggaggctgtgtgatggccgcagccaccgggcatccatttccgagagtcttctctgcctgcagcagacgtcagctgagggcctttttcaggaaggggggaggggcatgcctcagcaatgctcccgaccccggtctgccagtccctccggctctttgtgggaatgggtttgttgaggccggtgaagaatgcgactgtggcccaggccaggagtgtcgcgacctctgctgctttgcccataattgtagcctacggccaggagcccaatgcgcccacggggactgttgtgttcggtgcctcttgaaacccgctggggctctctgccggcaggccatgggcgattgcgacttaccggagttttgcactggtactagttctcactgtccacctgacgtgtaccttctagacggctcaccctgcgctaggggatcaggttattgttgggacggcgcttgccccaccctcgaacagcagtgtcagcagctgtggggcccaggttctcatcctgcacccgaggcatgctttcaggtggtcaactcggccggagatgctcatggtaattgcggtcaagacagcgagggacacttcttaccttgcgcaggcagagatgcgctctgtggcaaactacagtgtcagggcggaaaacccagtctgctggctccacacatggttcctgtggactctaccgtgcatctggacgggcaggaagtaacttgcagaggggctctcgccctgccctcggcccagctggacttgcttgggctggggctggttgagccaggtactcagtgtggacctcgcatggtgtgccagagccgcagatgtcggaagaatgccttccaggagctgcaaaggtgtttgaccgcttgtcattctcacggagtgtgcaactccaatcacaactgtcactgtgccccagggtgggccccacccttctgcgataaacctggattcggaggtagcatggactccggtcccgtgcaggcagagaaccacgacacctttctgttggccatgctgctgtcagtcctgctgcctctcctgcccggtgcgggtttagcttggtgctgttaccggcttcccggagctcatctgcagcgatgttcatggggttgcagaagggatccagcctgctcaggccctaaggatggccctcatagggaccaccctctcgggggtgtccaccccatggagctgggcccaacagctacaggccaaccatggcctctggaccccgagaacagccatgagccatcaagtcatccagaaaagcctctaccagcagtatcccctgatcctcaggatcaggtgcagatgccgaggtcttgtctttggtag

SEQ ID NO: 213422 - DNA, 456 bp, Artificial Sequence
  Description of Artificial Sequence: Synthetic coding sequence
atggggtggaggcctaggcgtgccaggggtacccccctgttgctgctgctgctattactgttattatggcccgtaccgggtgccggtgtgctgcaaggccacatccctggtcaaccggtaaccccacattgggttctcgacggacaaccctggcgcacagtttctctggaggaaccagtgagcaaacctgatatgggcctggtggccttagaagctgaaggtcaggagctgctgttggagctcgagaagaaccaggacgccctgtgtggaaaattacagtgtcaggggggaaaacccagcctcctggctccccacatggtgcctgtcgacagcaccgtgcacctcgatgggcaagaggtgacttgcaggggggcactggccctgcctagtgcccagctggacctcttgggacttggattggtcgagcccggaactcagtgtggaccgaggatgtag

SEQ ID NO: 213423 - DNA, 2079 bp, Artificial Sequence
  Description of Artificial Sequence: Synthetic coding sequence
atggggtggcgaccgagacgggctagaggaaccccactgttattactgttactgcttctcctcttatggcccgtccccggagctggggtgcttcaaggccacattccaggacagccagtcaccccccactgggtcttggacggccagccttggagaactgtgtccttggaggagcccgtgtctaaacccgatatgggtctcgtggctcttgaagctgaggggcaggagctcttgttggagctagaaaaaaatcacaggttgctggctccgggatatattgagacccactacggacccgacgggcagcctgtggtgctggcgcctaatcacactgatcattgccactaccagggcagggtaagaggtttccccgactcctgggttgtcttatgtacctgctctggaatgtccggactaattaccctctcccgcaacgcaagttattacctgaggccttggcctccaaggggatctaaggactttagcacacacgaaattttccgcatggagcagctgctgacctggaaaggaacgtgtggccacagggatcctggcaacaaggcaggcatgacttcactcccaggcggtccacagtcgcgcggacggcgagaggccagaaggacccgcaaatatttagaattgtacattgtggcagaccacaccctgtttctgactagacataggaaccttaaccacaccaagcagcgcttgctggaggtggctaattacgtggaccagttacttcgcaccctcgacattcaggtggcattaaccgggcttgaggtgtggacagaaagggaccgctcgcggcgtcaattgcgcgcttttttccggaaaggcggtggagcctgtctgtccaacgcccctgatccaggcctgcctgtccctccagcactttgcggcaatggtttcgtagaggctggcgaggagtgcgattgcggtccaggtcaggaatgcagggatctctgctgtttcgcacacaactgctcactacggcctggagcacagtgcgcacacggggactgctgtgtccgttgtttgttgaagcctgcgggtgccctgtgtcgccaagcaatgggtgattgcgacctgcctgaattttgcacaggtacttcttcacactgcccacctgacgtgtacttgcttgatggctccccgtgtgcaaggggtagtggttattgttgggacggagcatgtcctaccctcgagcagcagtgccaacagctctggggcccaggtagccaccccgctcccgaggcctgtttccaagtggtgaacagtgccggtgacgcgcacgggaattgcggccaggattccgagggacacttcctaccctgcgctggccgtgatgctttgtgcggaaagctgcagtgccaggggggtaaaccatcccttctggcaccccatatggtgccggtggattctacggtccacctcgacggtcaagaggtaacttgtagaggggctctcgccctcccgagcgcccagcttgatttgcttggtctggggctggtagagccaggcacccagtgtgggcctaggatggtctgtcaaagccggagatgcagaaaaaacgcctttcaagagttgcagcgttgcctgacggcctgccactcgcacggcgtctgcaacagcaatcataattgccactgtgcgcctggctgggcgccaccattttgcgataaaccaggattcggcggtagcatggactcaggtccagtacaggctgagaatcatgacacgtttctgctggccatgctgttaagtgtcttgctccctttgctcccgggagccggacttgcatggtgttgttataggctgcctggcgctcatctgcaacgctgctcttggggctgtcgcagggacccagcatgtagcggccctaaagatggtccacacagagaccatcctctgggcggagtccacccaatggaattgggtccaaccgccactgggcagccttggcccctggatcctgaaaactcccatgaaccctcatcccaccctgagaaacctctccccgctgtttcccccgatccccaggatcaggtgcagatgccaaggtcatgcctgtggtag

SEQ ID NO: 213424 - DNA, 522 bp, Artificial Sequence
  Description of Artificial Sequence: Synthetic coding sequence
atgggttggaggccaaggcgcgctaggggaacccctctgttgctgctgcttcttctgctgctgctttggcctgtgcccggtgccggagtgctgcagggtcacattcctggacagcccgtcacccctcattgggttctcgatggccagccttggaggactgtttctctggaggaaccagtctctaaaccagatatgggccttgttgcgctagaagcagaggggcaggaactgttactagaattggagaaaaaccatcgactgctcgcaccaggatacattgaaacccattacggcccagacggtcaaccagtggtcctggctcctaaccacacggtgcgatgctttcacgggctatgggacgcccctcctgaagatcactgccactatcagggcagagtccggggattccctgatagttgggtggtattatgtacttgctccgggatgagagccggtgagaagcgtgccggacccggttccacttggaactgcaccctgtggcagacgaccccatgctcatag

SEQ ID NO: 213425 - DNA, 291 bp, Artificial Sequence
  Description of Artificial Sequence: Synthetic coding sequence
atgggctggaggcccagacgcgctcggggtacgcctttgctcctgctgctcctgttgctgctgctctggcccgttccaggtgccggagtcttgcaggggcacatcccaggccaacctgtgactccacactgggttctggatggtcagccttggcgaactgtgtctcttgaagaacccgtcagcaaaccagacatgggtctagtagctctggaagcagagggacaagaattgctgttggagctagaaaagaaccaatttgcgatcgccaccataaccgccacagtactttag

SEQ ID NO: 213426 - DNA, 2265 bp, Artificial Sequence
  Description of Artificial Sequence: Synthetic coding sequence
atgctcccagggtgcattttcttgatgattcttctgatcccccaagtaaaggagaagttcattttgggagttgagggacagcaactggtgcgccctaagaaactccctctgattcagaagcgcgatactggccacacacacgacgatgatattctgaagacttacgaagaagagctcctttacgaaattaaactgaatcgaaaaacgctagtgctgcacctgctccggagccgagaattcctaggctcaaattattctgaaactttttactctatgaaaggggaagcttttaccagacatccacaaattatggatcactgtttttaccagggaagcatagtccacgagtacgattcggccgcttccatatccacttgcaacgggctgaggggctttttccggattaatgaccagcggtacctgattgagccagtgaagtatagtgacgaaggagaacatctggtctttaagtacaatctgcgagtaccatatggtgctaattactcatgtacagaactgaatttcacaagaaagactgtgcctggggacaatgaaagcgaagaggacagcaagatcaaaggcatccacgacgagaaatatgttgaactattcattgtagctgacgataccgtatacagaaggaatggacacccccacaataagttgaggaaccgaatatggggtatggtaaatttcgtgaatatgatatacaaaactctgaatattcacgtcaccctagtcggcatcgagatttggacccacgaggacaaaatcgaactgtacagcaacattgaaactacccttttacgattttcattttggcaggagaagatcctgaaaacccggaaggatttcgaccacgtcgtcctgctttctggtaaatggctgtatagtcatgttcagggaatatcttacccgggaggcatgtgtctgccctattattccacatcaatcattaaagacctgctgccagacaccaatatcattgcgaacaggatggctcatcagctgggccataatctgggcatgcagcacgacgaattcccctgcacatgtccgagcgggaaatgcgtgatggattcggacggctctattccagcattgaaattctctaagtgctctcagaatcagtaccaccagtatctcaaggattacaaacctacctgcatgctgaatatcccctttccttacaacttccatgactttcagttttgcggcaacaagaagctggatgaaggcgaagaatgtgactgtgggccagctcaggagtgcaccaacccatgctgcgacgctcacacttgcgtgctaaagccgggtttcacatgcgcagagggtgagtgttgcgagtcatgtcagatcaaaaaggccggttcgatttgtcgacctgctaaagacgagtgtgacttccccgaaatgtgtaccgggcacagtcccgcttgtcctaaggatcaattccgagtgaacggctttccgtgcaagaactccgaaggatactgctttatgggaaagtgccctacccgcgaagaccagtgctctgagctgttcgatgacgaagcgatcgaaagccacgacatttgctataaaatgaacacaaaaggcaataaattcggatattgcaagaacaaagaaaaccgattcttgccttgtgaagaaaaagatgttcggtgcggaaaaatttactgtacaggcggtgagctatcctcgctgctgggagaggataaaacgtaccacctgaaggatccacagaagaatgcaaccgtcaagtgcaagacgatattcctctaccacgacagcaccgatatcggacttgttgcttccggtaccaagtgtggcgaggggatggtgtgtaacaatggcgagtgcctgaacatggaaaaagtgtatatctcgaccaactgcccatcccagtgcaacgagaatcccgtggatggacacggcctgcagtgtcactgtgaggagggccaggccccagtggcttgtgaggagaccctgcacgtcaccaatattacgatcctcgtggtggtgttggtcttggtcatcgtcggcatcggcgtcctgattcttctggtcagataccggaaatgcattaaactgaaacaggtacagtcgcccccaactgagaccctgggggtagagaacaagggctatttcggcgatgaacagcagattaggaccgaaccaattctgcccgagatacactttctgaacaagcctgcgtctaaggattcccgcggaattgcagatccgaaccaatccgcaaagtag

SEQ ID NO: 213427 - DNA, 1656 bp, Artificial Sequence
  Description of Artificial Sequence: Synthetic coding sequence
gtctgtcccagaagttattttctcgaagggagaggatcctattctttcctttcccttttcagcactagtcctgcaccatacaggcgcaacggtcatccccacaataaattaaggaaccggatttgggggatggttaatttcgtgaatatgatttataagacattgaacatccacgtcaccctcgttgggatagagatctggacacacgaggataagatcgagctgtatagtaatatcgaaacgaccctcctgcgattcagtttctggcaagagaagatcctcaagaccagaaaggacttcgaccacgtcgtcttgctcagcggcaaatggctctattctcatgtgcaaggaattagctacccaggcggtatgtgcctaccatattactccaccagcatcattaaagacctacttccagacaccaatattatcgctaatcggatggcccaccaactcggccacaacctcgggatgcagcacgacgaattcccttgcacctgcccatctgggaagtgtgtgatggacagtgatgggtccatacccgcattaaaattcagcaagtgcagccagaatcagtatcatcagtatctgaaagactacaagcctacttgtatgctgaacatcccctttccgtacaactttcacgacttccagttctgtggaaacaagaaactcgacgaaggcgaggaatgtgattgtggcccagctcaggagtgtacaaatccatgctgcgacgcacacacatgcgtgctcaagcctgggtttacgtgtgcagaaggggaatgttgcgaaagttgccagataaagaaggcaggatcaatttgcagacccgcaaaagatgaatgcgacttcccagagatgtgtaccggtcactcgccggcatgtccaaaagaccagtttcgagtcaatgggtttccctgcaagaacagcgagggatattgttttatgggcaagtgtccgactagagaggatcaatgctccgagttgtttgatgacgaagctatcgagtcccacgatatctgctacaaaatgaatactaaaggtaacaaatttggctattgtaaaaataaggagaatcgtttcctcccatgcgaagaaaaagacgttcggtgtggcaagatctattgcaccgggggtgaactgagcagtctcctaggtgaggacaagacatatcacctaaaggacccccagaaaaacgctactgttaaatgtaaaactatattcctgtaccatgacagtaccgatattggactggtggcatcaggaaccaaatgcggggagggaatggtttgtaacaatggggagtgtctaaacatggaaaaggtatatatttccacgaactgcccatctcagtgtaatgagaatccggttgatggccacggcctccagtgccattgtgaagaagggcaagcacctgtggcatgtgaagagacacttcacgtgacaaatataaccatcctggtggtggtacttgttctagtgatagtcggaattggggtgctgatcctgctcgtgcggtataggaaatgtatcaaacttaagcaggttcagtctccacctacagagaccctgggggtggaaaacaagggctatttcggagacgaacagcagatccggacagaacccatattgccagagattcacttcctgaattag

SEQ ID NO: 213428 - DNA, 2475 bp, Artificial Sequence
  Description of Artificial Sequence: Synthetic coding sequence
atgcgcggacttggcctgtggctgctaggggctatgatgctccccgcaatcgctccaagccgaccttgggccttgatggagcagtatgaagtagttctcccctggaggctgcccggtccacgagtgcggagggctctcccttctcatttggggctgcatccagaaagagtaagctatgttcttggggctacaggacacaactttacactgcacctgagaaagaacagggacctcctcggcagtggctacacagagacatatactgccgctaacgggtcagaagttactgagcagcctagaggtcaggaccactgcttctaccaaggccacgttgagggctaccccgacagcgcagcatcactgagtacctgtgcgggactcagaggattctttcaagttggaagcgacctacatctgattgagccactggacgaaggcggagagggtggcaggcacgccgtgtaccaggctgaacatctgctacagacagctggcacatgcggcgtcagcgatgattccctcggcagtctgcttggtcctcggaccgcggcagtgttccgccctagacccggtgacagcctgccctcacgcgagactcgatacgtcgagctatacgtcgtcgtcgataatgccgagttccagatgctcggcagtgaagccgctgtccggcatagagtcctagaagttgtgaaccacgtagacaagctgtaccagaaactgaacttccgcgtggtcctagtcggcttggaaatctggaactcacaagatcgcttccacgttagtcctgacccctccgtcacactagagaatctgttgacgtggcaggcccgtcagcggaccagaaggcatctgcatgacaacgtccagcttattaccggcgtggactttaccggcaccactgttgggttcgctcgggtctctgccatgtgctcccatagctcgggggcagtcaaccaggaccactctaagaatcccgtgggggtggcctgtactatggctcatgagatgggccataacctcggtatggaccatgacgaaaacgtgcaaggatgtcggtgtcaggaaaggtttgaggcaggaagatgtatcatggcagggtctatcggttctagcttccctagaatgttttcagattgttcacaggcttacttagagagctttctcgagaggccgcagagtgtttgtttggccaacgcaccagacctaagccatctcgttggcggacccgtgtgtggtaacctatttgtcgagcgcggagaacagtgcgactgtggaccacccgaggactgtcgcaaccgctgttgcaactccaccacatgccagctcgcagagggtgcccagtgcgctcacgggacatgttgccaggaatgtaaggtgaagcctgccggagaactctgcaggccgaaaaaagatatgtgtgatttggaagaattttgcgatggcagacacccggaatgcccggaggatgctttccaggagaatggcacaccctgctccgggggatactgttacaacggagcatgccccactctggctcagcaatgccaggccttttggggaccagggggtcaggctgctgaagaaagctgcttctcctacgatattctgcctggctgcaaagcgtcgaggtaccgagccgatatgtgcggcgtgctgcaatgcaaggggggtcagcagcctcttggtcgagccatttgtatcgttgacgtgtgtcacgccttgacaacggaagacgggaccgcgtacgagcctgtccccgaaggaacccgttgtggtccagagaaggtgtgctggaaaggtagatgtcaagacctgcatgtgtatcggtcctcgaattgtagcgctcaatgccataaccacggagtctgcaaccacaagcaggaatgccactgccacgcagggtgggctccaccacattgtgctaagctgctgacagaggtccacgccgcaagtgggagcctccctgtcttcgtagtagtagtacttgtcttactggctgtggtgcttgtgactctcgcgggtatcatcgtgtataggaaagccaggtctcgcatcctgtcccgcaacgttgctcccaagaccacgatgggtagatcaaaccctttgttccatcaggctgcatctcgagtcccagccaaggggggagcaccagctccatcgcggggacctcaggagctggtgccaactacccaccctggacagcctgccagacatcccgcttcaagcgttgccctgaagcgacccccaccggcacctcccgtgacagtgtcatctccaccctttcctgtgccagtgtacacacgacaggccccaaaacaggtgatcaaaccaaccttcgcaccacccgtgccccctgttaagcccggagccggagctgccaatcctgggcctgcagaaggggctgttggacccaaggtggctcttaagccacccatacaacggaagcagggtgccggagctccaaccgcaccttag

SEQ ID NO: 213429 - DNA, 2202 bp, Artificial Sequence
  Description of Artificial Sequence: Synthetic coding sequence
atgaggggtttgggcctctggctcctgggagcgatgatgctgccaggcccagctcctagagagggggaacttagaccatggggccatcgcgctcagttgcatccccctcctgcagaggaacagggacccgcaggtctccgtctccacagggacctgtacggttgtcagtggctgaggggcgacggagcggcaagtagagccggtccactgctgctgccgggacccagacgcggagtcccaggactttcaaggcagccacagcatctatgtcggcctcaggtaggatctgatctgcacctcatagagcctctggacgagggaggagagggcggtaggcacgccgtgtaccaggcagaacacctcctgcaaaccgccggtacctgcggtgtgtcagatgactccctaggctcgctcctaggacccagaacagcagccgtttttcgccctagaccaggcgatagtttgcccagtagagaaacacgctacgtggagctgtacgtcgtggtagataacgccgagtttcagatgctcggatccgaagctgcagtgagacaccgggtgttagaagtcgtgaatcatgtggacaaactgtaccagaaactgaatttcagggtcgtgttagtaggcctcgagatctggaatagccaggatcggtttcatgtgtcaccggatccttcagtgacgctggagaacctcctgacgtggcaggccaggcagcggacccggaggcatctacatgacaacgtccaactgatcaccggcgtggactttactggcacgaccgtgggcttcgcccgagtttccgctatgtgttctcacagctccggggctgtcaaccaggaccattcgaagaatcccgtgggtgtggcatgcaccatggctcacgagatgggccataatctgggcatggatcatgatgagaacgtacaaggctgtagatgtcaggaacgattcgaggccggacggtgtataatggccggttccattgggtcttcatttccccgtatgttttccgattgttcccaggcttatctggaatcgttcttagaaagacctcaaagcgtatgtctggcgaatgccccagatctgagccaccttgtgggtggacccgtttgtggtaacctgtttgtggagagaggcgagcagtgtgactgcgggccacctgaggactgcagaaaccgttgttgcaacagtaccacgtgtcagttggctgaaggggctcagtgtgctcacgggacatgttgtcaggagtgtaaagtgaaacctgcaggtgaactgtgcagacccaagaaggatatgtgtgatttagaggagttttgcgacggtcgccaccctgaatgtcccgaggacgcgttccaggagaacggcaccccttgcagcggaggatactgctacaacggtgcttgtccgactctggctcagcagtgccaggcgttttgggggccagggggacaggccgcagaggagagttgtttttcctatgacatcctgccagggtgtaaggcttcccgatacagagctgacatgtgcggagtcctacagtgcaaaggcggtcaacagccattgggaagagctatctgtatcgttgacgtctgccatgccttgacgacggaagatggcactgcgtatgaacctgttccagagggcactagatgcggaccagagaaggtttgcaaccataaacaggagtgccactgccacgccggatgggcgcctcctcactgcgccaaactgctgaccgaggtgcacgccgcttccggcagcctgcctgttttcgtcgttgtcgtgctggtgctccttgccgtggtgctggtcaccttggccggaataatcgtatatcggaaggctaggagcaggatcctgtcaagaaatgttgccccaaagacgacaatgggcaggagtaacccactgtttcatcaggctgccagccgcgtccccgcaaaggggggtgcccctgctccttcccgcggaccgcaagaattagtccccaccacgcacccaggacagcccgcaagacatcccgcttcctccgtggcccttaagaggccccctcctgcacctcccgtcaccgtgtcatctcccccatttccggtgcctgtttacacacgacaggctcccaagcagggggctgtcggaccgaaagtggctctcaaacccccaattcagcgaaagcaaggcgctggagcacctacggcaccctag

SEQ ID NO: 213430 - DNA, 2229 bp, Artificial Sequence
  Description of Artificial Sequence: Synthetic coding sequence
atgcgaggactcgggctgtggctattaggagccatgatgttacccgcaatagctccatctcgcccatgggcacttatggagcagtacgaggtcgtgctgccttggagattgcccggaccacgtgttcgcagggccctgccatcccatctgggattgcatcccgagcgggtgtcgtatgtgctcggggcaaccggtcataacttcactttgcacctcaggaaaaatcgagatctgcttggcagcggttacactgagacttacacagccgctaacggcagcgaagtgacagaacaaccacgagggcaagaccattgtttctaccaggggcacgtggaaggttaccctgactctgccgctagcttaagtacgtgcgctgggctgcgaggttttttccaggtgggctccgacctacacctgatcgaacctctcgatgaagggggagagggcggacgccacgccgtgtaccaggccgaacatctgctacagactgcaggtacgtgcggcgtatctgatgatagtttggggagtttgcttggacccaggacggcggctgttttccgcccaagacctggggactcgctgccttctcgcgagacgagatatgtggaattgtacgtcgttgtagataacgccgaatttcagatgctggggtcagaggcagcagtgcgacacagggtgctggaagtggttaatcatgttgacaagctctaccagaagctcaattttcgagttgttctcgtgggtctcgagatatggaatagtcaggacaggtttcacgtgtccccggatccatcagttacactggagaacctgctaacatggcaggctcgccagagaacgaggagacatctgcatgataacgtccaactgatcaccggagtggactttactggcactaccgtggggttcgcaagagtcagcgccatgtgttcacacagctcaggggcagtgaaccaagatcatagtaagaatccggtcggggtggcttgcaccatggcccatgagatggggcacaatttgggtatggaccatgatgagaatgtgcagggttgcagatgtcaggaacgctttgaagcaggcaggtgcataatggcgggttcaatcggtagttccttccccagaatgttctctgattgctcccaagcttatctggagtcattcctggaaagacctcaatccgtgtgcctggccaacgccccagacctgagccacctcgttggtggacctgtttgtggcaatctcttcgtcgagcggggtgaacaatgcgattgcggcccaccagaagattgtaggaatcgatgttgcaattctacaacatgccagttagccgagggagcacaatgcgcccacgggacgtgctgccaagaatgtaaagtgaaacctgcaggcgagctgtgtcgacctaaaaaggatatgtgtgacctggaggagttttgtgatggtcggcaccccgagtgtccggaggacgcctttcaggagaatggcacaccctgttcagggggatattgctacaatggtgcttgtccaacactggcccagcagtgccaggctttctgggggccaggcggtcaggcggctgaggagagctgtttttcgtacgatattttacccggttgcaaagcttcaagataccgagccgacatgtgcggtgtcctgcagtgcaagggcggtcagcagccactgggacgtgctatttgtatagtcgatgtttgccacgctcttactacagaggatggaactgcttacgagccggtgccagagggcacacgatgtggccctgagaaagtgtgttggaagggcaggtgccaggacttgcatgtctaccgatcttctaattgctccgctcagtgccacaatcacggggtctgcaaccataagcaggaatgccactgtcatgcaggctgggcccctccacactgtgctaaacttctgactgaggtccacgcgggatgtcagccgagagccggacagggcagaggcagcagtccgatccagggacctcctcgcgctggccctcaccatcctcccggtcctgcccgtcctaccccaggtctgttaggaggttcagaggaagccgctccttgctcatccggtcactgtgtgcagccgacactgccctcttcatgcctgcacccagccggaactaaagccggacatcaggctaacgtgcgcacaccttcagctcccagtcaaaccaggggctggtgtgggcaaccatggagcagctag

SEQ ID NO: 213431 - DNA, 2460 bp, Artificial Sequence
  Description of Artificial Sequence: Synthetic coding sequence
atgggatccggagctcgctttccctctgggacactcagagttcggtggctgttgctgctcggactagtggggccagttctcggcgcagcccgtcccggtttccagcagacctcacacctatctagctatgaaattataacaccatggcgtctcacgagggaaaggcgggaagcccctagaccctattcaaaacaggtgtcttatgtcatccaggcagagggaaaggagcatatcattcacttagaaagaaacaaagacctgcttccagaagattttgtggtgtacacatacaataaagagggtacactcataaccgaccacccaaacatccagaaccactgtcattaccggggttatgttgagggggtgcataactcttccatagcactcagcgactgcttcggtttgaggggcttattgcacctggagaacgcatcctatgggattgaaccgctgcagaatagcagccacttcgaacacatcatctataggatggatgacgtctacaaggagcccctgaaatgtggggtgtccaacaaggatatcgagaaggagacagctaaagacgaagaagaagagcctcccagtatgacccagctgcttaggcgtagaagagccgtcctgccacagacccgttacgtggagctcttcatcgtcgtagataaagagcggtatgacatgatgggtcgtaaccaaacagcagtgagggaggaaatgatattactcgcaaactatcttgattccatgtacatcatgttgaacatccgcatcgtcctggttggcctggaaatttggacaaatggcaatctcatcaatatcgttgggggtgctggcgacgtgttgggaaatttcgtgcagtggagggaaaaattcctgataacacggcgacgacacgacagcgcccaactggtcctgaaaaaaggttttggcggtactgctggtatggcctttgtgggaactgtgtgctcccggagccatgcaggcggaattaatgtattcggccagattaccgttgagaccttcgcatccattgtagcacacgagttgggacataatctcggtatgaatcacgatgacggcagggactgttcctgcggggcaaaatcttgcatcatgaattctggggcttcaggctcaaggaacttttccagctgctccgctgaagattttgaaaagctgacgctcaataaaggagggaattgtctcctcaacatacctaagccggatgaagcgtatagcgcgcctagctgtggcaataagttagtcgatgcaggagaggaatgtgattgcggcacgccaaaagagtgtgagctggacccatgctgcgagggctcaacatgtaagttaaaaagcttcgccgaatgcgcatatggcgactgctgcaaggactgtcggttcctgcccggaggcactctctgtcgaggcaaaacatcggaatgcgacgtgcctgaatattgcaacggaagctcccagttctgtcagccggatgtgtttattcagaatggttatccatgccaaaacaataaggcttactgctataatggcatgtgtcaatattacgacgctcagtgtcaggttatttttggcagtaaggctaaagcagcgcctaaagattgttttatagaggtaaactccaagggcgaccgatttggcaactgtggctttagtggtaacgagtacaagaaatgtgcaaccggcaacgctctctgcggcaagctgcagtgtgagaacgtacaggagatacccgtctttggcatagttcccgctataatccagacaccctcgcgcggaactaaatgctggggggtcgacttccagctgggttcagatgtgccagaccctggcatggtcaatgagggaactaagtgtggggctggcaaaatctgtcggaacttccaatgcgttgacgcctcggtgctgaactatgattgcgacgttcagaagaaatgccatgggcacggcgtgtgcaattctaataagaattgtcactgcgagaatgggtgggccccaccaaactgtgaaaccaaagggtacggagggtccgttgattccggacccacatacaatgagatgaatactgccttgcgggacggattacttgtttttttttttttaatcgtgcctctcattgtgtgcgcaatttttatcttcataaaaagagatcaactctggagaagttactttcgaaagaagagatcccagacttacgaatctgacgggaaaaatcaggccaatcctagtaggcagcccggaagcgtgccaagacacgtgtcacctgtcacgccgcctcgagaggtcccaatttacgctaaccgcttcgctgtccccacttatgcggctaaacagccccagcagttccctagccgtccaccccctcctcagcccaaagtgtcatcacagggcaacttaatccctgcaagacctgcccctgctccacctctgtactcctccttaacctag

SEQ ID NO: 213432 - DNA, 2904 bp, Artificial Sequence
  Description of Artificial Sequence: Synthetic coding sequence
atgcagagagccgtaccagagggtttcgggcgtcggaagcttggtagcgatatgggtaatgcggaaagagcgcctgggtcacggtcttttggccctgttcccacactcttgctcctcgctgcggcattattggcagtctcagacgccctgggacgaccttccgaggaagacgaagagctcgttgtgccagaattggaacgggctcccggtcatggaacaacgagactcagattgcacgcctttgaccaacagctggacctcgagctgcgtccagattctagcttcctggccccaggattcactcttcagaacgttggaagaaaaagtggttcagaaacccccttgcccgagacagacctggctcactgtttctacagtggcactgtaaacggagacccctcttcagctgcagcattgtccctttgtgagggggtgaggggagctttctacttgctcggtgaggcttacttcatacagcctctgcctgcggcatccgaaagacttgctaccgcagctcccggtgagaagcctcctgcacccttgcaattccacctgttgcgccgaaataggcaaggagacgtgggcggaacatgcggcgtcgtggacgatgaaccacgacccacaggaaaggcagagacagaggatgaagatgaaggcacagaaggagaagacgagggcgctcagtggagccctcaggatcccgcacttcagggagtcggccaacctacaggcactgggagtataagaaagaaacggttcgtttcttcacacagatacgtcgaaacaatgcttgttgctgatcagtcaatggctgaattccatggatccggcctgaagcattacctgcttactctgttttctgtcgccgctcggctctacaagcatccctccattagaaactctgtgagccttgttgtggtgaagatcctggtcattcatgacgaacagaaggggcctgaggtgaccagcaatgccgctctgaccttacggaatttctgcaactggcaaaaacagcataacccaccatctgaccgcgacgccgagcattacgacacggcaattttatttacacggcaggacctttgcgggtctcaaacatgtgacacactgggcatggccgacgtggggactgtgtgtgatccaagccgctcttgttctgtaattgaagacgacggcctgcaggccgcatttaccacagcgcatgaactcgggcatgtattcaacatgcctcacgacgacgccaaacagtgcgcgagcctaaacggtgtcaaccaggatagccacatgatggcttctatgctaagcaatttggaccactcccagccttggtcaccttgctctgcttacatgattacgagtttcctggataatggacatggagagtgcttaatggacaaaccgcagaatcctatccaacttcctggcgacctgcctggtacctcatatgacgccaaccgacagtgtcagttcacatttggagaggatagcaagcactgccctgacgccgcatcaacatgctcaactctttggtgcacgggtactagtggcggtgttttggtgtgccagaccaagcattttccgtgggctgacggcacgtcctgcggggagggcaaatggtgtatcaacggtaaatgcgtgaacaaaaccgacagaaaacacttcgatacaccctttcacggctcgtggggaatgtggggaccttggggagattgctccagaacttgcggagggggagtgcaatacactatgcgagaatgcgacaatcctgttccgaagaatggcggtaagtattgcgagggaaaacgcgtccggtatagaagctgcaatctggaagactgcccggacaacaatggaaaaacatttcgcgaagaacaatgcgaagcacacaatgaattctccaaggccagtttcggatctggtccagccgtcgagtggatcccaaaatatgctggcgttagtcccaaggaccggtgcaagctgatttgtcaggcaaaaggtatagggtatttttttgtcctccagcctaaggtggtagacgggaccccatgcagtcccgacagcacttcggtctgcgtgcaaggccagtgtgtgaaagccggttgtgaccggatcattgactcaaagaaaaagtttgataagtgtggagtatgtggtgggaatggttcaacctgcaagaaaatatcaggttccgtaaccagcgccaagcctggataccatgatattataacgatccctaccggcgctacaaacatagaagtcaagcagagaaatcagcgaggaagtaggaataacggaagctttctagccatcaaggccgctgacggcacctacattctcaatggcgattacacactgtccactcttgagcaggatattatgtataagggggttgtgctccgatacagcggctcctctgccgcactcgaacggatccgttctttcagtccactgaaagagccattaactatccaggtactgacagtggggaatgcgttaagaccgaagattaaatacacatatttcgtgaagaagaagaaggagagttttaacgccatacccacattctccgcctgggtgatcgaagagtggggtgagtgcagtaagtcctgcgagcttggctggcagcgaaggctggtggagtgtcgggacattaatggacagcccgcatcagaatgtgctaaggaggttaagcctgccagcactaggccctgtgctgaccatccctgcccacaatggcagttgggggaatggtcaagctgctctaagacctgcggcaaaggttacaagaaacggtcactcaaatgcttgtcccacgacgggggagttctctcccatgagagctgtgatccattgaagaagcctaaacactttatcgatttttgtaccatggccgagtgtagttag

SEQ ID NO: 213433 - DNA, 3312 bp, Artificial Sequence
  Description of Artificial Sequence: Synthetic coding sequence
atggcgccagcctgtcaaattctccggtgggccctggcgcttggcctggggctaatgtttgaagtgacacatgcattcaggagccaggatgaattcctctcctctctggaaagttacgagattgccttccccactcgcgttgaccataacggcgcactactggcattctcgccccctccacctagacgtcaaaggagagggacgggtgctactgcagagagtcgcctcttctataaggtggcgagcccatcgacccactttctcttgaacctgaccaggtcttcgaggttgctggctggtcatgtgtctgtggaatattggactcgggaaggcctggcatggcagcgggcagcccgaccacattgcctctacgccggacacctccagggtcaggccagcacgtctcatgtagccatatctacctgtggaggtctgcacgggctgattgtggccgacgaagaagagtatttaatcgagcctcttcacgggggtccaaaaggatcccgtagccccgaagagagcggcccacatgtcgtatataaaagaagcagcctgaggcatccccacctggatacagcttgcggcgtacgcgatgagaagccctggaaaggccgaccttggtggctaagaaccttaaagcccccaccagcgaggccattaggaaatgaaaccgagagaggtcaacctgggttgaaacggtctgtctcaagagaaagatatgtggagactctggtggtagcggacaagatgatggttgcctaccatggccgacgagacgttgagcagtatgtcctcgccatcatgaacatcgtcgccaagctgttccaggattcatctctgggctccacagttaatatcttggtcaccagactcatactgctgactgaggatcagcccactctcgaaataacacaccatgcgggaaaatccctggatagtttctgcaaatggcagaaatccatcgtgaaccacagcggacacggaaatgctattcctgagaatggtgttgctaaccatgatactgccgtgctgataaccaggtatgacatctgcatctataaaaataagccttgtggaaccctgggattggctcccgttggcggaatgtgcgaaagggagcggtcttgctcagtgaacgaggacataggccttgctacagctttcacaattgcgcacgagataggacatactttcgggatgaatcacgacggagtgggaaattcatgtggagcgagaggacaggacccagctaagctcatggcagcccacatcacaatgaagaccaatcctttcgtctggtcttcttgttcccgcgactacattacatccttcttggattctggtctgggcctatgtctgaacaatcggccacccaggcaagacttcgtctatccaactgtggccccaggtcaggcttacgatgccgatgaacagtgccgcttccaacatggcgtgaagagccgccagtgcaagtatggtgaagtgtgctcggaactgtggtgcctgagcaagagcaataggtgcattacaaacagcatcccggctgccgagggcacactgtgccaaacacatacaatagataaaggatggtgctataagcgcgtatgcgtgccgttcggttcccggccagaaggagtggacggcgcatgggggccatggacaccatggggcgattgctccagaacatgtgggggaggggtgtctagcagcagtcgtcattgcgactcaccacgaccaactattggaggaaagtattgtctcggagaaagacgaagacatcggtcatgcaataccgatgactgtcccccaggcagccaagatttcagggaggtgcagtgttcagagtttgattcgattccatttagagggaaattttacaaatggaagacataccggggagggggagtaaaagcctgcagcctgacttgcttagcagaaggctttaatttttatactgaacgtgcagccgcagtggtggacggcacgccctgtcggcctgacaccgtcgatatctgtgtgtccggcgagtgtaagcacgtgggctgtgatcgagtgctcggctctgacctgcgagaagataaatgccgcgtttgtggaggggacggatcagcatgtgaaaccatcgagggtgtattcagtccagcatcccctggggcagggtacgaagatgttgtctggatccctaaagggagtgtgcatatatttatacaggatctgaatctgtccctttcacaccttgcccttaaaggggatcaggaatcgctgctcctggaggggcttcccggaaccccacaacctcacagactcccactcgcaggcactaccttccaactacggcagggccctgaccaagtccagtcactcgaagctctgggcccaataaatgccagtctcatcgtgatggtcttagccaggactgagcttcccgcactgaggtaccggttcaatgcccctatagcacgagattcgctgccaccttactcgtggcattacgccccatggactaagtgctcagcccagtgcgccggaggaagccaggttcaggccgtcgagtgtagaaaccaactcgatagcagcgccgtagctccacactactgtagtgcccatagcaagctgcccaagcgacaacgggcttgcaacacagagccttgcccaccagattgggtcgtgggaaactggagcctatgttcaagatcctgcgacgcgggtgtgcgcagcaggtccgtagtgtgtcagagacgcgtctctgctgccgaggagaaagccctggatgattcagcatgcccccagccaaggccccctgtgctggaggcttgccatgggccaacttgccctcccgaatgggccgcattagactggagcgagtgcaccccaagctgtggacccggactccgccatagggtcgttctatgcaaatctgccgatcaccgggctacactcccgccagcacattgctcaccggcagcgaagcctcccgctactatgcgctgtaacctacgacggtgccctcctgctcggtgggtggccggtgaatggggagagtgtagcgcacaatgcggcgtgggtcagcgtcagagaagtgtaagatgtacaagccacaccggacaggctagccacgagtgcaccgaggctctgaggcccccaactacacagcagtgcgaggccaagtgcgacagccccactcccggagatggtccagaggaatgcaaggatgtgaataaggtggcctattgcccccttgtgttgaaatttcagttttgctcgcgcgcatattttcggcaaatgtgttgtaagacgtgtcacggtcattag

SEQ ID NO: 213434 - DNA, 2544 bp, Artificial Sequence
  Description of Artificial Sequence: Synthetic coding sequence
caagacgatggcggtctatctcgggcacccggatgcggagctgtctgtcccggacaccacgagcattgtcaggtggcgaagctattccaggacagctctttagggagcactgtgaatatactcgtgacacggttgattttactcacggaagatcagcctactctcgagatcactcaccatgcgggaaaatccctggattctttttgtaagtggcagaaaagcatcgtgaatcattccggtcatgggaacgcaattcccgagaacggggtggccaaccacgacactgccgtgctgattacacgatatgacatttgtatttacaaaaataagccttgcgggacattgggcctcgcccctgtaggcggaatgtgcgagcgagagcgatcatgctctgtgaacgaggacattggattggcaacagcctttactattgcccatgagatcggccatacattcggcatgaaccatgacggagtgggtaactcgtgtggcgcaaggggtcaggatcccgctaaactgatggcagcccacattactatgaagaccaacccctttgtctggtctagctgttccagagactacataacctctttcctcgatagcggactcggcctgtgtctgaacaacaggccacctcgccaggactttgtgtatcccaccgtggctcccggtcaggcctatgacgccgacgagcagtgccgtttccagcatggcgttaagtccaggcagtgcaaatatggagaagtgtgcagcgagctgtggtgcctcagcaaaagtaacaggtgtattacgaacagtattcctgctgcggagggcactttatgccaaacacacaccattgataagggatggtgctataagagggtctgcgtcccttttgggtccaggccagaaggagtggatggcgcatgggggccatggacaccgtggggtgattgcagtaggacatgcggcggaggcgtgtcatcaagtagccgccactgcgatagcccacgccctaccattgggggtaagtactgtctgggagagcggaggcgccacaggtcttgcaatactgatgactgcccacctggctcacaggatttcagggaagtccagtgttccgagttcgattccataccttttcgcggtaagttttataaatggaaaacatatcgcggaggcggtgtgaaggcctgttcactcacgtgcctggcagaaggatttaatttctacaccgaaagagccgcagcagtggtggatggcacgccttgccggccagacactgtagacatttgcgtaagcggtgagtgcaagcatgtgggttgtgatagagtcctgggttccgatttgcgagaggataagtgtagggtgtgtgggggtgacggtagcgcctgcgagaccattgaaggtgtattctcccccgcttcaccgggagctggttacgaggatgtcgtgtggatcccaaaaggctcggttcacatcttcatccaggacttaaatctgtccctgtcccacctcgccctcaagggtgatcaggagtctttactgctggaggggctccccggtaccccccagccacatcgactgcccctggccggtacaactttccagttgcgccagggcccagatcaggtgcagtcgttggaggctttgggccctatcaacgcttctctcattgtaatggtgctggctaggactgaactgccagccctacgctaccggtttaatgccccaatcgctagggatagcctgcccccttacagctggcattacgcgccttggactaaatgcagcgctcaatgcgcaggtgggtcacaagtgcaggctgtagagtgtaggaaccagctcgattcgagtgccgttgcaccacattactgttccgctcactcaaaattaccgaagagacaaagagcttgtaataccgaaccatgcccgcctgattgggtggttggcaattggtcactatgctctaggagctgcgatgctggtgtccgctccagaagcgttgtgtgccagagacgtgtgtctgcagcagaggagaaggcattggacgacagcgcctgcccccagccaaggccaccagtgcttgaagcctgccacggccctacatgcccgcctgaatgggctgctctggactggtccgaggtgtcacgacccctgccttctaggcccttaggatgccctggaggggttagtacagaaacaccattacgcggtctgcaagtgagctgtccacttctgaccagtcactgggggagtaccctctcaacaaagcgaccattccagctgcagtgcactccgtcttgcggccctggacttagacatagagtggtcctgtgcaagtcagcagatcaccgtgctaccctgcctcctgcccattgtagccccgcagccaagcctccagcaaccatgcgttgtaaccttagaaggtgccctccagctagatgggtcgcgggagagtggggggaatgttccgcacagtgcggagttggccagcgtcagaggtccgtgcgttgcacttctcacaccggccaggccagtcatgaatgtacagaggcctag

SEQ ID NO: 213435 - DNA, 4530 bp, Artificial Sequence
  Description of Artificial Sequence: Synthetic coding sequence
atgccatgtgctcaacggagctggctggccaacctgagcgttgtggcccagttactcaatttcggtgcgctgtgctatggcaggcagcctcagcccggaccagtgcgttttccagaccgccgacaagagcattttattaagggcctcccagaatatcacgtggtcggcccagtgcgcgtcgacgcctcaggccacttcctgtcctacggtctgcactatcctatcacttcctcaaggcggaagcgcgacctcgatggatccgaagattgggtgtattaccgcatatctcacgaagaaaaagatctcttcttcaatctgacagtgaatcaggggttcctgagcaactcttacataatggagaaaaggtacggcaatctttcccacgtgaagatgatggccagctccgcacccctgtgtcatctcagtggcacagtgctgcagcaaggtacaagagtgggcacagctgcactcagcgcttgtcacggcctgactggcttcttccaactcccccatggcgatttcttcattgagccggtcaagaagcaccctctggtcgagggcggatatcacccccatatcgtgtataggagacagaaggtgccagagaccaaggagccgacctgcggcctgaaagattctgttaacatttcacagaagcaggaattgtggagggaaaagtgggagaggcacaacctgccctcccggagtctttctaggaggtctatctccaaggagaggtgggtggagacgttggtcgtagcagatacaaaaatgattgagtaccacggctccgaaaatgttgaatcatacattctgactattatgaacatggtgactggcctgttccataatcccagtatcgggaatgctattcatatcgtggtggtgcgattgatactcctcgaggaagaggagcagggattgaagatcgtgcaccacgcagaaaaaaccctgtccagcttctgcaaatggcaaaaatctatcaatccaaagagtgatctgaacccggtgcaccacgacgtggccgttctgctcacccgcaaggacatttgtgccggatttaacaggccctgtgagacgctggggctctcacatctgtccgggatgtgccaaccccacaggagctgtaatataaacgaggatagcggcctcccattagcctttaccattgcacatgagctgggccattcattcggaattcagcatgatgggaaggagaacgattgcgaaccagtgggaagacatccatatatcatgtccagacagcttcaatacgaccccacacctctgacttggtccaagtgctcagaggaatacatcactcgcttcttggatcgagggtggggcttctgcctggacgacatccccaagaaaaaagggctgaaaagcaaagttatcgctcccggtgttatctacgacgtgcatcaccaatgccagttgcaatatgggcctaacgcaaccttctgccaagaggtggaaaacgtgtgccagactctgtggtgctccgttaaaggcttctgcagaagcaagctggacgcagctgcggatgggacccagtgcggagagaagaaatggtgtatggcgggtaaatgcattacagtaggaaagaagccagaatctattcctgggggttggggacgctggagcccttggtctcactgctccagaacttgcggagccggagtgcagtctgccgagaggctctgtaataatcccgagcctaaattcgggggtaagtattgcacgggggagcgaaaaaggtaccgcttatgtaacgtgcacccatgtagatccgaggctccaacattccgtcagatgcagtgcagcgaatttgacactgtcccatacaagaacgaattgtaccattggtttcccattttcaatcccggatatgttgacattggcctgatacccaagggagcgagggatattcgcgtcatggagatagagggcgctggcaacttcctggccattcgttcagaggatcctgagaaatactacctcaatggcggttttataattcagtggaacggaaactacaaactggctggtacggtgtttcagtatgatcggaagggggatctagagaagctgatggctactggacctacaaacgagtcagtctggatccagctgcttttccaagtaaccaatcccggaatcaagtacgagtacaccattcaaaaggacggtctggacaacgatgtggagcagcagatgtacttctggcaatacggccactggaccgaatgctctgtgacttgcggcactggaatccggcgacagaccgcccactgtattaaaaaaggtcgtggcatggtgaaagctacattttgtgatccagagacacagccaaatgggaggcagaaaaagtgccacgagaaggcgtgcccgccacgctggtgggctggggagtgggaggcttgttccgctacctgtggcccacatggggaaaaaaaaagaacggttttgtgcattcagacaatggtgtccgacgagcaggcactgcctcctacggactgccagcatctgctcaagcctaaaacattactctcttgcaatagagatattttgtgcccatctgactggactgtggggaactggtccgagtgctccgtgtcatgtgggggtggggtgaggattcgctctgtcacatgcgctaagaaccacgacgagccatgcgatgtcaccaggaagcccaattctcgcgcattgtgcggcctccagcagtgcccttccagcaggcgggtgttgaagcccaataaaggcacaataagcaacggaaaaaatcccccaactctcaagccagtgccccctcctacctccaggcccaggatgttgaccacccctacaggaccggagagtatgtctacctccaccccagctatatccagtccctcgcccaccaccgctagcaaggagggcgacctcggagggaagcagtggcaggactcgtccacccagccggagcttagtagcaggtatttgatctctactggttccacaagccaaccaatactgacctcccagtccttaagcattcaaccatcagaggagaacgtaagcagttcggacacaggtcctacatccgagggcggtctggtggccaccaccactagtggctcaggcctgagttctagcagaaatcctatcacctggccagtgacccctttctataataccctgaccaagggacctgaaatggagattcattccgggtccggggaagagcgtgagcaaccagaagataaagatgaaagtaatcccgtaatttggacaaaaatccgcgtgccaggcaacgacgcacccgtggagtccacagagatgccactcgctccgccattgaccccagatttgagccgtgagtcctggtggcccccattcagcacagtgatggagggactgctgcccagccagcggccaacaacttcagaaactgggacccccagagtggagggcatggtgacagagaagcctgccaataccttattgccgctgggcggagaccaccaacctgagccttcagggaagacggctaaccggaaccatctgaagttaccaaacaacatgaatcaaaccaagagttcagaacccgtcctgaccgaggaagatgctacaagtcttattaccgagggctttttgctaaacgcaagcaactataagcagctgacgaacggacatggatcagcccactggatcgtgggcaactggtcagaatgctccacgacctgtggattgggcgcttactggcggcgtgtcgaatgttccacacagatggattctgactgtgccgcaattcagaggccagaccctgcaaagaggtgtcaccttaggccttgcgccggatggaaagtaggcaactggtccaagtgttcccggaactgttctggtggattcaaaatccgtgagatccagtgcgtggactctcgcgaccatcgtaaccttcggccattccattgccagtttctggccggtattcctccgcctttgtccatgtcttgtaatcccgagccgtgcgaggcgtggcaggtggagccttggtcccagtgctcacgcagttgtggagggggagtgcaggagcgcggagtgttctgtccgggaggcctgtgcgattggactaagcggccaacgtctacaatgtcatgcaacgagcacctgtgttgccattgggcaacagggaactgggacctttgctccacatcctgtggcggagggttccagaagaggactgtccaatgcgtccccagtgaggggaataagacagaggaccaggaccagtgcttgtgtgaccacaaaccacggcctccagagtttaagaaatgtaatcagcaggcctgcaagaagtcagccgatctcctgtgtactaaggacaagctttccgcctctttctgtcaaactctcaaagctatgaaaaaatgcagtgtgcccacagttagggctgagtgttgcttcagctgtccccagacacacatcactcatacacagagacagcgacgtcagcggctcctccagaaatcaaaggagctttag

SEQ ID NO: 213436 - DNA, 4784 bp, Artificial Sequence
  Description of Artificial Sequence: Synthetic coding sequence
atgccatgcgctcagaggtcctggctggcaaacctgtccgttgtagcgcagctgcttaactttggggctctgtgctatggaaggcagccacagcccggtcctgttaggttccccgaccgcaggcaggagcatttcatcaagggcttgcccgaatatcatgtcgttggacctgtccgagtggacgcgtctggacactttttaagctacgggctccactaccccattacctccagccggaggaaaagggatctcgatgggagcgaggattgggtgtactacaggatctcacatgaagagaaggatctgttcttcaacctgacagtaaaccaagggttcttaagtaattcatacatcatggaaaagcgatacgggaacctgagccatgtgaagatgatggccagctcggccccattatgtcatctgtccggcaccgtcctgcaacaggggaccagggtgggcacagctgccctgtccgcttgccacgggttgaccgggtttttccagttgcctcatggagacttcttcatcgaaccagtcaagaagcaccccttggtagaaggtggctatcacccacatatagtgtatcggagacaaaaggtaccagaaacaaaggagcctacatgcggactcaaggactcagtcaatattagtcagaaacaggagctgtggagagagaaatgggagcggcataacttaccttccaggtccctctccagacgctcgatctccaaggaacgatgggtcgagaccctggtggttgcggacactaaaatgatcgaataccatggatcggaaaatgtggagagttacattttgactatcatgaatatggtgacaggtctgttccacaacccgtctattggaaacgcaatccatatcgtggtggtgagattaatcctgctggaggaggaggagcagggtctgaagatcgtgcatcacgcagaaaaaacactatcatccttttgcaaatggcagaaaagcattaacccgaaaagcgaccttaatccagtccatcacgacgttgccgtacttttgaccaggaaggatatctgcgcgggattcaatcgaccttgtgagaccctgggacttagccacctgtcgggaatgtgtcagccacataggagctgcaacataaacgaagacagcggcttaccccttgcttttacaatcgcacatgagctaggacattcatttggcatccagcacgatggcaaggaaaacgattgcgagcccgttggccgacacccatacataatgtcccgacagttgcaatacgatccaacacctctaacgtggagtaagtgttcagaggagtacattactaggttcctcgatcggggatgggggttctgcctcgacgatattcccaagaagaaggggctcaaatcaaaagtgatcgcccctggagtgatctatgacgtccaccatcagtgtcagcttcagtacgggccaaacgcaacgttctgtcaggaggtagaaaacgtgtgtcagaccctatggtgcagtgtgaagggattctgtcgctccaagttggacgcagccgctgatggcacccagtgtggtgaaaaaaagtggtgtatggctggaaagtgtatcaccgtggggaagaagcccgaatccattcctggtggctggggtcgctggagcccctggagccattgcagcaggacttgtggcgcaggggttcagtcggcagaacgtctatgcaacaatccggaaccgaagttcggcggtaagtattgcactggcgagaggaagcgatatcggctgtgtaacgttcacccttgcagatctgaggcccctacattcaggcagatgcagtgttccgaattcgacactgttccctacaaaaacgagctttaccattggtttcccattttcaaccctgcccatccctgcgagctgtactgcagaccaatcgacgggcagtttagcgagaaaatgctcgatgcagtcatcgacggcacgccttgcttcgaggggggaaacagcaggaacgtttgcattaacgggatctgcaagatggtggggtgcgattatgagatcgattcaaacgccacggaagatcgatgcggtgtctgtttgggggatggctcttcttgccagacagtccgcaaaatgttcaagcagaaggaagggtcggggtacgtcgacattggcttgatacccaagggcgctagggatattcgcgtgatggagatcgagggtgccggtaatttcctggcaattaggtccgaggaccctgaaaaatactaccttaacgggggtttcataatacagtggaacggcaattataagctcgcgggtaccgtgttccagtacgaccgcaagggtgatctggagaaactgatggcaaccggtccaaccaatgaatctgtgtggattcagctgctgtttcaagttaccaatccaggcatcaaatacgagtataccattcaaaaggacggtctggataacgatgttgagcagcagatgtacttttggcagtatggacactggacggagtgcagcgtgacatgtggtacagggatacgtaggcagaccgcccattgcatcaaaaaaggcaggggcatggtgaaagcgaccttctgtgaccccgagactcagcctaatggtcgtcagaagaaatgtcatgaaaaagcatgtccaccacgatggtgggctggcgaatgggaagcctgctctgcaacctgtgggcctcatggtgaaaagaagcgcacagtgctctgcatccagaccatggtaagtgacgaacaggccctgcctccgactgattgtcagcacctcctaaagccgaagacgcttctcagctgcaaccgggacatcttgtgcccatccgattggaccgtgggaaattggtcggagtgcagcgttagctgcggcggtggggttaggattcgctctgtcacgtgtgcgaaaaaccacgacgaaccatgcgatgtgacacgtaaacccaatagtcgcgctctctgcgggcttcagcaatgcccaagttctaggcgggtactgaagccaaataaaggcactatcagcaacgggaagaacccacccaccttgaagccagtcccacctcctacgtctaggcctcggatgctgactacgcccactggccctgagtctatgtccaccagcactccagcgatctcatctccatctcccactacagcctcaaaagagggagatcttggcggaaagcagtggcaggattctagcactcagcctgaactgtcttcacgctaccttatctcaacaggatctacttcccagccaatcctgacatcacagtcactgtctattcaaccttcagaggaaaacgtctcctcctctgacacggggccaacctctgaaggcggtcttgtggccaccacaacaagtgggtccggactctcctcttccagaaatcccatcacctggcctgtcacacctttctataacaccctgactaagggacccgagatggagatacactcggggagtggggaggaacgcgagcagccagaggacaaggatgagtctaatcctgtgatttggaccaaaatccgcgttcccggaaatgacgcgcctgtagaatctactgagatgccactcgccccacctctcaccccggacctctcaagagaatcctggtggcccccattctccacagtgatggagggactactacccagccagagaccaacgacatctgagaccggaacgcctagggtggagggcatggtgactgagaaacccgcaaacactctcctgcccctcggaggtgaccatcagccagaaccctctggaaagaccgcaaatagaaaccacttgaaactccccaataacatgaatcagactaagtcgtcagaaccagtgctgacagaagaagacgccacatctctcataaccgaagggttccttctgaatgcttcgaactacaagcagcttacaaacggccacggatctgcacattggatcgtaggcaattggagtgagtgcagcactacttgtggcttaggcgcatattggcgtagggttgagtgcagtactcagatggattccgattgtgctgcaatccagcgcccagaccccgctaaacgttgtcatctccgaccatgcgccggatggaaggtgggaaattggtcaaagtgtagtcgaaattgcagcggaggctttaagattcgcgaaatacagtgcgtggacagccgcgatcaccgaaatctacggccttttcactgtcagtttctggcgggaatcccacctcccctctcaatgtcgtgtaaccccgagccttgcgaggcatggcaggtggaaccgtggagccagtgcagcaggtcttgtggtggcggagtccaggaaaggggagtgttctgccccggtggcttatgcgattggaccaaacgaccaacctccaccatgtcttgcaatgaacatctgtgttgtcactgggccacaggcaattgggacctctgctccactagctgcggtgggggtttccagaaaaggaccgtccagtgtgttccgtccgagggaaataaaaccgaagatcaggatcaatgtctctgcgaccataagcctcgcccacctgaattcaaaaaatgcaatcagcaggcatgcaaaaaatctgccgatcttctctgcacgaaggataagctgtcggcatccttctgccaaaccctcaaagcaatgaaaaagtgcagcgtgcccaccgtaagagcggagtgctgtttttcttgccctcagacccacattactcacacacagcgtcagcgcaggcagagactgctccagaagagcaaagaactata

SEQ ID NO: 213437 - DNA, 699 bp, Artificial Sequence
  Description of Artificial Sequence: Synthetic coding sequence
atgccttgcgcacagagatcatggctggctaatttgagcgtagtagcccagctgcttaacttcggagcactatgctacggccgacagccacaacccggaccagtgaggttccctgaccgtaggcaggaacattttatcaagggattgccagaatatcatgtggttgggcctgtccgtgtggacgcgtccggacatttcctgtcatacggcctgcattatccgatcacttcctctcgtcgcaagagagacttggacggttctgaggactgggtgtattaccggatcagccatgaggaaaaagatctgttctttaatctaacagtcaatcagggcttcctgtcaaacagctacattatggagaaacggtatggcaatctgagtcatgtgaagatgatggcttcctccgcgccactctgccatctttctggcacggtattgcagcagggtacaagagtgggcacagcggctctgtctgcatgccacggattgacgggcttcttccagttgcctcacggagattttttcatcgaaccggtcaagaaacaccccctcgtcgagggaggctaccacccacatatcgtctaccgcaggcaaaaggttcctgagacaaaggaacctacctgtggcctgaagggtattgtgactcacatgagttcctgggtggaggagagtgtgctgtttttttggctgttttattag

SEQ ID NO: 213438 - DNA, 3675 bp, Artificial Sequence
  Description of Artificial Sequence: Synthetic coding sequence
atgaaaccccgagccaggggctggcggggtctggcggctttatggatgttactggctcaggtcgccgaacaggcaccagcctgcgcgatgggcccagctgctgctgccccaggaagcccttccgtcccgagaccgccacctccagcggaaaggcccggttggatggagaagggcgaatacgacctggtttcagcttacgaggttgatcaccggggagactacgtgtcccatgaaattatgcaccaccagcggaggcgtcgtgcggtaccagtgtccgaggtcgagtccctgcacctccgccttaaaggctcacggcacgacttccacatggacctgcgaacaagtagctctctggtggcccctggatttatcgtacagacattgggtaaaacgggaacaaagtccgtccagaccctgccccctgaagacttttgtttttaccagggctctcttaggtcacacagaaacagctcagttgctttatccacatgtcagggactgtccggtatgattcggaccgaggaagctgactacttcctccggccactgccgtctcatctctcgtggaagttgggcagagcagctcagggttctagcccgagccacgtattgtacaaacgatccaccgagccgcacgctcccggtgcctctgaagttctcgtaacttcccgtacttgggagctggcccaccagccactgcacagctccgatctgcgtttaggactgccccagaagcagcatttttgtggccgaagaaaaaagtacatgccacagccccctaaggaggatctgtttatcctgccagacgaatataaatcctgcctgcggcataagcggagcctgcttcgctctcataggaatgaagagctcaacgttgaaacgttggttgttgtggacaaaaaaatgatgcagaatcatgggcacgaaaatatcaccacatacgtcttgacaatactcaatatggtcagcgccttattcaaggacggtactattggcggaaatattaacattgccatcgtcggactgatcctcctcgaggacgaacagccgggactggtcattagccaccatgccgaccacaccctcagctcgttctgccagtggcagtccggcctcatgggaaaagacggtacccggcatgatcacgcgatactacttacaggattagatatatgtagttggaaaaatgagccctgtgatacactggggtttgcacccatttccgggatgtgctccaagtatcgcagctgcaccatcaatgaagatactggactgggcttagcctttacgatcgctcatgagagtgggcacaattttgggatgattcatgatggcgaaggcaacatgtgtaagaagagcgagggaaacataatgagtcctaccctcgccggtaggaacggcgtattcagctggtcaccctgttcgcgccagtacctccacaagtttctttccacggcacaagctatttgcttggccgatcagccaaagcccgttaaggagtacaaatacccagagaagttgcctggtgagctgtatgacgcaaatactcagtgcaaatggcagttcggggagaaggctaaactgtgcatgctggatttcaaaaaggatatttgcaaggctctttggtgtcaccggatcggcaggaaatgtgagaccaaattcatgcccgcagcagaaggcacgatttgcggccatgacatgtggtgcagaggaggccagtgcgtgaagtatggagacgagggccctaagccgactcacggtcactggtcggattggagttcttggagtccgtgctctaggacttgcggtggcggagtctctcaccgatctaggctttgcacaaatcctaaaccaagccatggcggaaagttttgtgaaggctcgacacggactctgaaactatgcaacagccagaagtgcccaagagactctgtcgatttccgagccgcacagtgtgccgaacataattcaaggagattccggggaagacattataaatggaagccttacacacaagtggaggaccaggatctctgcaaactttactgcatcgctgaggggttcgactttttcttctccctgagcaacaaagtaaaagatggtacaccatgctctgaagatagtcgcaacgtctgtattgacggaatttgcgaaagggtaggttgtgataacgtgctcggcagcgacgcagtggaggatgtttgcggagtgtgtaacggcaacaacagcgcatgtactatccatagaggcctttataccaaacaccatcacaccaatcagtactaccatatggtcacgatcccttccggcgcaagatcaattcgcatttacgaaatgaacgtgtccactagttacatatccgtgcggaatgccctcagacgctattatcttaacggccactggacagtcgactggccaggacgatataaattctctgggacaacgtttgattatagaaggtcttataacgagcctgaaaatctgatcgctaccgggcctaccaacgaaacgcttattgtcgagcttctttttcaagggagaaatccgggtgtcgcttgggaatacagcatgccccgtctgggaactgagaaacagccaccggcacagccgtcttatacctgggctatagtaagatccgagtgctccgtctcttgcggtggagggcaaatgaccgtgagagagggttgctaccgagacttgaaatttcaggttaacatgagtttctgcaacccaaaaactcggccagttacaggactggtgccttgtaaggtttccgcttgtcccccatcatggagtgtgggaaattggtcagcctgctcccgcacttgcggtgggggagcgcagtctcgtccggtccaatgcacaaggagagttcattacgattccgagcccgtgccagctagtctgtgccctcaacccgctccttctagcaggcaggcctgtaactcacagtcctgtccccctgcctggagcgccggaccctgggcagaatgctcccacacatgcggcaaaggatggcgcaagcgggcagtggcatgtaaatcaaccaatccaagtgcacgggctcagctgttgccagatgccgtttgcaccagtgagcccaagccccgtatgcacgaggcatgtctcctgcagaggtgccacaagccaaagaagctacagtggttggtgtccgcatggtcccagtgctccgtcacctgcgaacgaggtacccagaagcggttcctgaagtgtgccgagaaatatgtgtcagggaagtaccgcgaactcgcaagtaaaaagtgctctcatcttcccaagccttctctggagctggagcgtgcctgtgccccactgccctgcccaaggcacccgccattcgccgctgctggtccttccagaggctcgtggttcgcgagcccctggtcccagtgtacagctagttgcggtggcggagtgcaaactagatctgtgcagtgcctcgcagggggtcggccagcgtctggctgcctgttgcatcagaagccgagtgcttctctcgcatgcaacacccatttttgtccgattgccgagaagaaagacgctttttgtaaggactacttccactggtgttacctcgttccacagcatgggatgtgctctcacaaattttatgggaaacagtgctgcaagacctgtagcaagagcaatctgtag

SEQ ID NO: 213439 - DNA, 2787 bp, Artificial Sequence
  Description of Artificial Sequence: Synthetic coding sequence
atgaagcccagggcccgaggatggcggggtctggctgctctgtggatgttgctcgcccaggttgcagagcaggctcccgcttgcgccatggggccagccgctgccgcacctggttcgccctcggtgcccaggccgcctcctcctgccgagagaccagggtggatggagaagggggaatatgatctggtgagtgcttacgaagtggaccataggggtgactacgtaagccacgagatcatgcaccatcagcggagaagacgcgctgtgccggtcagcgaagtggagtcactgcacctgaggttaaaagggtcacgccacgacttccacatggatttacgcacgagctcctcccttgttgctcctgggtttatcgtgcaaacgctgggaaagacagggaccaaatcggtccagactttaccaccagaagatttctgtttttatcagggatctctccgtagccatcgcaatagtagcgttgccttgtctacttgtcagggtctatcaggaatgatccgaaccgaggaagctgattacttcctgcgccctctacctagccacctcagttggaagctgggcagagcggctcaagggtcctccccttcacatgtgctctacaagaggtctaccgaaccccacgcacccggtgccagcgaggtgctcgtgacatctaggacctgggaactcgcccaccaaccgctgcatagcagtgacctccgcctggggctgccacaaaagcagcacttctgtgggaggagaaagaaatatatgccccagccccctaaggaagatttattcatccttcccgacgagtataaatcctgcttaagacacaagcggtcactgttgcgttcacacaggaatgaggaacttaatgtcgaaacacttgtcgtcgttgataagaaaatgatgcaaaaccatggccacgagaacatcacgacttacgtgctgactatacttaatatggtatccgcattattcaaagatggcaccatcggaggaaatattaatattgccatcgtcgggcttattctcctcgaagacgaacaaccaggactggtgatatcgcatcatgcagatcatacactgagtagtttttgtcaatggcagtccgggctcatgggcaaggatgggactcgccatgatcacgccatcttgcttaccgggctggacatatgcagctggaaaaacgagccatgtgatacattggggttcgctccaatctcaggtatgtgttctaaatacaggagttgtaccattaacgaggacacgggtcttgggctcgcgttcacaatcgcacacgaaagcggccataactttggcatgattcacgatggggagggcaacatgtgcaagaagagtgaaggcaacatcatgagccctactctcgcagggagaaatggagtcttcagttggtccccatgttcccgacagtacttgcacaagttcctctcaactgcacaggccatctgtttagctgatcagcccaaacccgtaaaggagtacaaatacccggagaaactgcctggcgaactgtatgacgcgaacacccagtgtaagtggcagttcggggagaaggccaagctgtgtatgctggactttaagaaggatatctgtaaagccctctggtgtcatcggattggccgtaagtgtgagaccaagtttatgcctgctgccgaggggaccatctgtgggcacgatatgtggtgccggggtggccagtgcgtcaaatatggtgacgagggccctaagcccacccatggccactggagcgattggagttcgtggagcccttgttctagaacatgcggtgggggtgtctcacaccgcagtcggctgtgtactaatcccaagccaagtcatggcggtaagttctgtgaaggctcaactcgcacactgaaactgtgcaactcacagaaatgcccacgggactccgtggactttcgtgccgcacagtgcgcagagcataatagccggagatttagaggtaggcattacaaatggaagccgtacacccaagttgaggaccaggatctctgcaagctgtactgtatcgctgaagggtttgacttctttttttctttgtctaacaaggtcaaggacggaacaccttgttctgaagattcccggaatgtgtgcattgacggtatctgcgaaagggtggggtgtgataatgtgctcggcagcgacgctgttgaggacgtatgtggcgtatgcaatggcaacaatagcgcgtgtacaatccatcgcggactgtacactaaacatcaccataccaaccagtactatcatatggtgaccattccgagtggtgcaaggtcaattcggatttacgagatgaacgtgtctacctcatatatctctgtgcgcaatgccctaagaagatattaccttaacggccattggaccgtggactggccaggtcgctacaaattcagcggcacgacattcgattacaggaggtcatacaacgagccagagaacctgattgctaccggcccaaccaatgaaacactcatagtggagctcctgtttcagggacgcaacccgggtgttgcatgggagtacagtatgcctcggctcgggacggagaagcagccacctgcccagccctcctatacctgggcgattgtgcgttctgaatgctcagtgtcatgtggagggggacagatgaccgtcagggaaggctgttaccgggacttcctgtatttcatgttctacctctcccagctttttgcttctgagtgccccttcaaaaacacattgcttcatgcattcctgtgtaaatag

SEQ ID NO: 213440 - DNA, 3288 bp, Artificial Sequence
  Description of Artificial Sequence: Synthetic coding sequence
atgtgtgatggcgctctgctgccacccttggtcctgcctgtactgctccttctggtgtggggactggatccaggcaccgcagttggagacgccgcagctgacgtggaagttgtgttaccttggagggtgaggccagatgatgtgcacctaccccctctgcccgctgcgccaggtcccaggcgcagacgcaggcctcgcacccctccagcagccccaagagcacgtcccggagaaagagcgctgctgctccacctcccagcctttggacgagacctgtacctgcagctccgccgagatcttcgttttttaagccgtggtttcgaggtggaggaggccggtgctgccaggaggcgtgggaggcccgcagagctgtgcttttactcaggtagggttctcgggcatccagggtcactcgtgagtctcagtgcttgtggagcagccggtggattggtaggactgatccagcttgggcaggagcaggttctgatccagcccctgaataattcccagggcccattcagcggcagagagcacctgatccgacggaagtggtctctgacaccgtcaccctccgctgaggctcagaggcccgagcagctctgcaaagtattgacagagaaaaaaaagcccacctgggggaggccctctcgggattggcgggagaggaggaacgccattcgattgacatccgagcacaccgttgagacactggtggtcgccgatgccgatatggtccaataccacggagcggaggccgcacaacggttcatcctgaccgtgatgaacatggtatacaacatgtttcagcatcagtccttggggatcaagataaacatccaagtcactaaattggtgctcctcagacagcggccagctaagctctctattgggcaccatggtgagagatctctcgagtccttttgccactggcagaacgaagaatatggcggagctcggtatctcggtaataatcaggtcccgggaggaaaggatgaccccccattggtcgacgcggctgtgtttgtgaccaggacggacttctgtgtgcacaaagatgagccctgcgatacagtgggcatagcatatctcggcggagtgtgctcagccaaaagaaagtgcgtgctagctgaggataacggcctgaatcttgcttttaccatcgcccatgagctgggccataatctcggaatgaatcacgatgacgatcactcctcctgtgcgggtagaagccatatcatgagtggagaatgggttaaggggagaaatccatccgacctgagctggagttcgtgttctagagatgatctcgaaaactttctgaaatccaaggtgtcaacctgcctgctagtgactgatccacgctcccagcacacagttagactgcctcataaactgcctggtatgcattattccgccaatgaacagtgccagatactgtttggcatgaacgcaacattctgcagaaacatggagcatctgatgtgcgcaggtttgtggtgtctggtggaaggggacacgtcatgtaaaaccaagttggacccaccgctcgacggcaccgaatgtggtgccgacaaatggtgccgggctggtgagtgcgtatcaaagaccccaatcccggagcacgtggacggcgactggtcaccctggggagcttggtctatgtgcagccggacctgtgggactggggcacgcttcaggcagaggaaatgtgataatccccctccagggcctggcggaacacattgtccgggagccagtgtcgagcacgcggtctgtgaaaacctgccctgcccaaagggtctgccatcatttagagaccagcagtgtcaggcccatgaccgactttcaccaaagaagaaaggccttctgacagctgtggttgtggacgataagccttgtgagctctattgcagccccttaggtaaggaaagccctctgctcgttgcggatcgcgtgcttgatgggacgccctgtgggccttatgaaacagatctgtgcgtccacggaaagtgccagaagatcggttgtgacggcattatcggttctgctgcaaaggaggacaggtgtggagtctgttctggggacggaaagacctgccatctggtaaagggcgactttagccatgccagaggcactgcgctcaaggattcaggaaagggtagcataaactctgactggaagatcgagttaccaggggagttccagatagccggaaccacagtacgctatgtcaggcgaggactatgggaaaaaatttctgctaaaggccctaccaaactgcccctccatctcatggtgctgctgtttcatgaccaagattatgggatccattatgaatacactgtgcccgttaacaggaccgctgagaaccagagtgaaccagaaaaaccacaggactccctgtttatctggactcactctggctgggagggatgctccgtacagtgcggtgggggagagagacgtactatagtgtcatgtactaggattgtgaataagaccactaccctcgtcaatgattcagactgccctcaggcctcacgccctgaaccgcaggtgcgaaggtgtaatctccacccttgtcagagtcgatgggtcgccggaccatggtcaccatgctccgcgacgtgcgagaagggatttcaacaccgggaggtcacttgtgtgtatcagctgcagaacggtacacatgtggccactcgccctctgtactgtcccggtccacgtcctgcggctgtgcagtcatgtgagggccaggactgtctctccatatgggaggctagcgaatggagccagtgttctgcaagttgcgggaagggcgtgtggaagcgcaccgtggcatgcacaaacagtcaaggcaagtgtgacgcaagcacacgcccaagggcagaggaggcttgtgaagactactctggctgctatgagtggaagacaggagattggtcaacttgttcaagtacctgtggcaagggtcttcagtctcgagtggtccaatgcatgcataaggtgactggcagacacggatctgaatgtcccgctttatctaagcctgctccatacaggcagtgttaccaggaggtatgtaatgaccgcatcaatgcgaacaccatcacatctcccagactcgctgctctaacctacaagtgtacccgtgaccagtggacagtttactgtcgcgtgattcgagagaaaaatctgtgccaggacatgcggtggtaccaacgctgctgccagacctgtcgagatttttatgctaacaaaatgcgccagccccctcccaacagttag

SEQ ID NO: 213441 - DNA, 3666 bp, Artificial Sequence
  Description of Artificial Sequence: Synthetic coding sequence
atggaatgcgcactgctgctggcttgtgcatttccggctgcgggatctggcccaccacgcggattggctgggctcggtcgcgttgccaaggccctccagctgtgctgtctctgctgcgcaagtgttgcagcagcactggccagtgactctagtagtggggcatccgggctcaatgatgactacgttttcgttacaccagtggaggtggacagtgccggttcatatattagccacgatatcctgcacaacggcaggaagaaacgctctgctcagaacgctcgttccagcctacattaccggtttagtgccttcggccaggaactgcacctagagttaaaacccagcgctatcctgagcagtcactttatcgtgcaggtgctcggtaaggatggggcatctgagactcaaaaaccggaagtccagcaatgcttttaccagggctttatacgtaacgactcatcttccagcgtcgcagtctctacctgtgccggactctcggggcttatacgcaccaggaaaaacgagtttctcatctcccccctcccacagcttctggctcaggagcataactatagctcccccgctggccatcatccacacgtgttgtacaaaaggactgcggaagaaaaaatccagcgctacagaggataccccggatcagggagaaactaccccggatactcccccagccacattccacacgcttctcagtcacgagagacagagtatcaccatcgtcgcctgcagaagcaacatttctgcgggaggagaaagaagtacgcccctaagccccctactgaggatacttatctcaggtttgacgaatacggctctagtgggaggccgcgtaggtccgcaggaaaaagccaaaaagggcttaacgtggagacgctggttgtcgctgacaaaaaaatggtcgaaaagcacggcaagggcaatgtgaccacatatattctgactgtgatgaatatggtgagcggcctatttaaggatggcactatcgggtccgatataaatgtcgtggtcgtcagtctcatcctgctggaacaggaaccaggaggcttgcttataaaccaccatgctgaccagagtctcaacagcttctgtcagtggcagtcagccctaatagggaagaacggcaagcgccacgatcacgccattctcctcacaggtttcgatatttgtagttggaagaatgagccctgtgatactctcgggttcgccccaattagcggtatgtgttcaaaatatcggtcatgtaccattaacgaagataccggactgggtttagcattcaccatcgcacatgagtctgggcataatttcgggatgattcacgatggcgaggggaatccgtgtcgcaaggccgagggaaacataatgtctcccaccctgacaggcaataacggcgtatttagttggtccagctgcagccggcagtacctgaagaagtttcttagtacccctcaggctgggtgccttgtcgatgagccgaaacaagccggtcagtataaatatcctgacaaactgccaggtcagatttacgatgctgatactcaatgcaagtggcagttcggggctaaggcaaaactttgttccctggggtttgtgaaggacatttgtaagagcctttggtgccacagagtcggccacaggtgcgagaccaaattcatgcctgctgccgagggtacagtttgcggacttagcatgtggtgtcggcagggacagtgcgtaaaattcggcgagctgggcccacgtcccattcatgggcagtggtcagcctggtccaagtggtctgagtgctcacgaacctgcggaggaggtgtgaaattccaggagaggcactgtaacaacccaaagccccaatatggaggactgttctgccctggtagttccagaatttaccagctgtgtaatattaatccctgtaatgagaacagtctcgacttcagagcccagcagtgtgccgaatacaattccaaacccttccgcggttggttttaccagtggaagccatataccaaggtcgaagaggaagacaggtgcaaactgtactgtaaagctgagaacttcgaatttttcttcgccatgtccggcaaagtcaaagacggaaccccctgttctccgaacaagaatgatgtgtgtatcgatggggtttgcgaactcgtcggatgcgaccacgagttaggctctaaagccgtgagcgacgcttgcggagtgtgtaagggcgacaactccacctgcaagttctacaaaggcctatacttaaatcaacacaaggctaacgaatactaccctgtcgtcctcattcctgcgggagccaggagtattgaaatccaggaactgcaggtttcaagttcctacttggccgtcaggtctctgtctcagaagtattatctcactggaggctggtcgatcgattggccgggagagttcccattcgccggtacaactttcgagtatcagcggtccttcaaccgacccgagcggctctacgcacccggtcctactaacgagaccctcgtttttgaaatcctgatgcagggtaaaaatcccggaatcgcctggaaatacgcgttacctaaggtcatgaacggaacaccccctgccaccaaacgccctgcctacacatggagtattgtccagagcgagtgtagcgttagttgcgggggagggtatatcaacgtgaaggctatttgcttgagggaccagaacacccaggtgaacagctccttttgctcagctaagactaaacccgtgaccgagccaaagatctgtaacgctttctcatgccccgcttattggatgcccggtgaatggtctacatgttccaaggcttgcgcaggcggacagcagtcacggaaaattcagtgcgtgcagaagaaaccatttcagaaagaggaggccgtgctacacagcctgtgtcctgtgagcacaccaacccaagttcaggcctgtaactcacacgcgtgccccccacagtggagccttggcccatggtctcagtgcagcaaaacttgcggtagaggggtaagaaagagagaactcctgtgtaaggggtccgccgcagaaaccttaccagaatctcagtgcacatctctccctcgaccagaactgcaggagggttgcgtgctgggacggtgtcccaaaaactcccgtctccagtgggtggccagcagctggtcagaatgcagcgccacctgcggcctaggtgttcggaaaagagagatgaagtgtagcgaaaaaggttttcagggtaaactgatcacattcccagaacgaaggtgccgtaacattaagaaaccaaacctggatctcgaggagacttgcaatcggagggcctgccccgctcaccccgtctacaatatggtggccggttggtactccctcccctggcagcaatgtactgtcacttgtgggggaggcgtccagacacgatctgtccactgcgtgcagcagggcaggccaagtagcagctgtctactgcaccaaaagccaccagtcctgcgcgcatgcaacacaaatttctgccctgccccagagaaaagagaggacccttcatgcgttgacttctttaactggtgccatcttgttccacagcatggagtctgcaatcataagttttacggtaagcaatgctgcaagtcctgcaccagaaaaatttag

SEQ ID NO: 213442 - DNA, 825 bp, Artificial Sequence
  Description of Artificial Sequence: Synthetic coding sequence
atggagtgcgctctactcctcgcatgcgcattccccgcagctggaagtggccctccgagaggactagccggactcgggagggtggctaaggccttacagctgtgttgtctctgctgcgcatccgtggccgcagcactggctagcgattcgagtagcggagctagcggtctgaacgatgactatgtttttgtcaccccagtcgaggttgactctgccggaagctatatttctcacgacatcctgcataacggtcgaaaaaagaggagtgctcaaaatgcaagaagcagtttgcactacagattctcggcctttgggcaggagctgcacctggagctaaaacctagtgcgattctcagctcccacttcatcgtccaggtcctgggcaaggatggcgcatcagagactcagaaaccggaggtacagcaatgtttctaccagggtttcattcgtaatgacagttcttcttctgttgcagtctctacctgtgctggattaagcggcctgatcagaacccggaaaaacgagtttctcatctcccccctcccgcaactgcttgctcaggagcacaattactccagtccagccggacaccaccctcatgttctgtacaaacgtaccgccgaggagaagatccagaggtaccgtggatatcccggatcaggcaggaactatcctggctatagtccctcgcatatacctcacgcatctcagtcccgcgagacggaataccaccatagaagactgcagaaacagcatttctgtggcagacgcaagaagtgcatctgttcacaagctagtcaccgaggacacctgagtaaggtgtag

SEQ ID NO: 213443 - DNA, 3636 bp, Artificial Sequence
  Description of Artificial Sequence: Synthetic coding sequence
atggacccccctgccggagccgctaggaggctgctctgccctgccctgttgctgcttttgctgctcctgcctccccctctgctgcctccgccacctcctcccgctaacgcgcgactagcagctgcagcggaccctcctggcggaccccttgggcatggcgcagaacgcattctggctgtgcctgtgcgaactgacgcccagggtcgtctggtgtcccatgtggtcagtgcagccacctctagagccggagtgcgggctaggagagctgctccagtgcgcacgcctagttttcctggaggcaacgaagaggaacccggaagtcacctcttctacaacgttactgtgtttgggagggatctgcacctgcgccttaggcccaacgcgcgtttggttgccccaggcgctactatggaatggcaaggggagaagggcacaactcgagtggagcccctgcttgggtcttgtttgtacgtgggcgatgtcgcaggtctggcagaggcttcctcagtagccctctctaactgtgatggactggcaggtcttattcgaatggaggaggaagagttcttcatcgaacccctagaaaaaggactggccgcacaagaggctgaacagggcagggttcacgtggtgtataggagaccacccacaagccctccattgggcggtccacaggcactagatactggtgcctcactagacagcctggactcactttcacgcgcactgggcgtgttggaggaacacgccaacagttctagacgcagagcacgaaggcacgccgctgatgatgattataatatcgaggtgcttctgggtgtggacgactccgtggtccaattccatggtaaagaacacgttcagaaatacctcctcacacttatgaacatcgtgaatgagatctatcacgacgaatctttgggggcacatatcaacgttgtgctagtgcggatcatcctcttaagctacggcaagtccatgtctctgatcgagatcgggaatccttcgcagtctttggaaaacgtgtgccgctgggcctatctccagcagaaaccggacaccgggcatgatgagtatcatgaccacgcaatatttctcacacgccaggattttggacccagcgggatgcagggatatgcgcctgttacagggatgtgtcatcctgtgaggtcttgtaccttgaaccacgaggatggcttttcatcagcctttgtcgttgctcatgaaacgggtcatgtgctcggaatggagcacgatggccagggcaacagatgtggggacgaggtccgtctcggatccatcatggcaccacttgtgcaggcagcgtttcaccgatttcactggtcgcgatgctctcagcaggaactcagtcgttatctgcactcttacgactgcctgctggatgatcccttcgcccacgactggcctgcattaccccagttaccaggcctccactactcaatgaatgagcaatgccggttcgacttcggattgggatacatgatgtgtaccgccttccggacattcgatccatgtaagcagctgtggtgctctcaccctgataatccttatttttgcaagacgaagaaaggccctccactcgacggaaccatgtgcgcccctggcaagcactgtttcaaaggccactgcatctggctcacccccgatattctcaagagggatggctcttggggcgcttggagccccttcggttcgtgctctagaacctgtggcactggcgtcaagttccgaacccgccagtgcgataatccccatccagctaacgggggtcgcacttgcagtggcctggcatatgatttccagctctgtagtcgccaagactgtcccgacagccttgccgactttcgggaggagcagtgccgccagtgggacttgtatttcgagcacggagatgcgcagcatcattggctaccacatgaacaccgggacgctaaagaacgttgccacctgtactgtgagagccgggaaactggcgaagtggtctctatgaaacggatggtccacgacggtaccaggtgctcttacaaggacgcgttcagtctctgtgtacgtggcgattgcagaaaggtgggctgcgacggagtgatcgggtcttccaaacaggaagacaagtgcggagtgtgtggcggtgacaatagccactgcaaggtggtgaagggtacatttacacggtctccaaagaaacatggctacattaaaatgttcgaaatccctgccggtgctcgacacctccttatccaagaggtggacgccacatcccatcacctagcagtgaagaatcttgagactggaaagtttatccttaacgaggagaacgatgtggacgcgtcatctaaaaccttcatcgccatgggcgtggagtgggaatacagggatgaggacggaagagagacccttcaaacaatggggcctctccatggcaccattactgttctagttatccctgtcggagatacacgggtcagcctgacctataagtatatgatccatgaagactcgttgaatgtcgacgacaacaatgtgctggaggaggattctgtcgtttatgagtgggcgctgaagaaatggtccccatgttcaaaaccatgcggcggagggagccagttcacaaagtatggctgccggagaaggctggaccataaaatggtccaccgtggcttctgtgccgcactatccaagccaaaggccattcggagggcttgcaatccacaggaatgtagccagccagtctgggtcactggggagtgggagccttgctcccaaacttgcgggcgaacagggatgcaggtgcgctcggtcaggtgcattcagcccttgcatgataacacaacacgcagcgttcacgcaaagcactgcaatgatgccaggccagagtctcgacgggcatgctcacgggagctgtgccccggtcgctggcgcgcaggaccctggtctcagtgctcagtgacttgcggaaacggtacccaagaacggccagtgctatgcagaacagctgacgatagcttcggaatctgtcaagaggagagaccagagacagcccgaacttgtcgcctggggccatgccctagaaacatcagcgacccctccaaaaagtcttacgtagtccaatggttaagccggccagacccagatagcccaattcgtaagatcagcagtaagggacattgtcagggtgacaagagcattttctgtcgtatggaggtgctgtcaaggtattgtagtatacctggttacaataagctgtgctgcaagtcctgcaatctgtacaacaatctgacaaacgtcgaaggacgaatcgagccgccacccggaaaacacaacgatatagacgtatttatgcctaccctgcccgtgccaacagtcgcaatggaggtcagaccgagccccagcacaccactagaagtgccactaaatgcaagttcaacaaatgcaactgaagatcatcccgagaccaacgcggtggatgagccatataaaattcatgggctggaagacgaggtgcagccgccaaatctcattcctcggagacctagcccttacgagaagaccagaaaccagcggattcaggagctgatcgatgagatgagaaagaaagaaatgctcggcaagttttag

SEQ ID NO: 213444 - DNA, 1701 bp, Artificial Sequence
  Description of Artificial Sequence: Synthetic coding sequence
atggatccaccagcaggcgctgctcggcgactgctttgtcctgcactcctcctcctgctccttttgctgcccccaccactgctcccccctcctcccccacctgctaatgcccgacttgcagcagcggcagatcccccagggggtcctttagggcatggtgccgaacggatccttgctgtaccagttagaacggatgcccagggacggctggtgagtcacgtggtgtcagccgctacatctagggctggggtgcgagccaggcgcgctgctccggtgaggacaccttcatttccaggagggaatgaagaggagcccggttcccacctgttctacaacgtaaccgtgtttggtcgcgatctgcatctgcgccttcgcccaaacgctcggcttgtagcgcctggcgcaacgatggaatggcagggagagaagggaaccacgcgggtggaaccacttctgggaagctgcctgtatgttggcgacgtggcgggactggctgaagctagttccgtggccctgtctaattgcgatggcctggcaggactcataagaatggaagaggaggaatttttcattgaacccttagagaaaggtctggcagcccaagaggccgagcaagggagagtgcacgttgtgtaccgcagacccccaacctccccccctcttggcggaccacaggccctggacactggagcaagccttgattccctggactcactgtctcgagccttaggggtgcttgaagagcacgctaattcttctcgacgtcgcgcacgacggcatgcagctgatgacgactacaacatcgaggtgctgctgggagtagacgacagcgtcgtgcagtttcatggaaaagagcacgtgcagaaatatcttctcacgctgatgaacatcgttaacgaaatttatcacgatgaatcactgggcgctcacattaatgtagtgctggtccgcattatccttttgtcttacggcaaaagcatgtcacttatcgagattgggaatccctcacagagcttagagaacgtctgtcggtgggcatacctgcagcaaaagccagatactggccacgacgaatatcatgaccatgcaatttttttaacgcggcaggacttcggcccatctggaatgcagggatacgcccctgtgactgggatgtgccaccccgtacgctcttgcacactcaatcacgaggacggcttctcttccgctttcgttgtcgctcatgagacaggccacgtgctcggcatggagcatgatggacaggggaatcgctgcggggatgaagtcaggctaggatcgattatggctcccctcgtacaggctgcattccaccgtttccactggtcccggtgcagccagcaggaactcagtaggtacctgcactcttacgactgcctgttagacgatccatttgctcacgactggccagcacttcctcagctgcctggactgcattactccatgaacgagcaatgccgcttcgacttcggtctgggctacatgatgtgcacagcatttaggacttttgatccatgtaaacagctctggtgcagccatccagataacccttacttttgcaaaactaaaaagggaccaccccttgacggcaccatgtgcgcccctggtaagtttaggcctggggctgtagcccacgcttgttatccttccactctaggcggacaaggaaggtggattgcttag

SEQ ID NO: 213445 - DNA, 4515 bp, Artificial Sequence
  Description of Artificial Sequence: Synthetic coding sequence
atgtgggtcgcgaagtggctgacggggctgctttaccacttgtccttgttcatcaccagaagctgggaggtggactttcatcccaggcaagaagctcttgtcaggactctgaccagctacgaggtggtcatcccagagcgggtcaatgagtttggcgaagtgttccctcagtctcaccatttcagcaggcagaagcgctcaagcgaagcactcgagcctatgccttttaggacgcattaccgcttcacggcttatggacagctgttccaactgaacctcacggccgatgcatctttcctcgccgctggttacacagaagttcacctgggcacaccagaacggggagcctgggagtcagacgccggaccctccgacctgagacattgcttttacagaggccaagtgaacagccaggaggactacaaggccgtggtgagtctctgtgggggattgaccgggacgttcaagggccagaacggagaatatttccttgagccaattatgaaggctgatggtaatgaatatgaggatggccataacaaaccgcacctgatctacagacaggatcttaacaatagctttctgcagactttgaagtattgtagtgtgtccgaaagccagattaaggagacatcacttccattccacacgtattcaaacatgaacgaagacctcaacgtaatgaaagaacgagtcttgggccacaccagcaaaaacgtgcctctgaaagatgagaggagacatagcaggaagaaaagactcatctcttatccaaggtatattgaaatcatggtaacagcagacgctaaagtcgtctctgcccacgggtcaaatcttcagaattacatattgacccttatgtccattgtggccacaatttataaggaccctagcattgggaatctgattcacattgttgtggtaaagctggtgatgattcacagagaggaggaggggcctgtcataaacttcgatggcgctacaactctgaagaacttctgcagctggcagcagacacagaacgatctcgacgatgttcaccctagccaccacgatactgcagttctgattacacgagaggacatctgcagctccaaagagaaatgtaatatgcttggactttcttacttgggcacaatctgtgatcctctccagagttgtttcatcaatgaggagaagggcttgatctcggcgttcaccatcgctcacgagctggggcacaccctcggagttcagcatgacgataacccaaggtgcaaggaaatgaaagttaccaaataccacgtgatggccccagccctctcattccacatgtccccctggagctggagtaactgcagcagaaagtacgtgaccgagttcctcgataccggttacggagaatgcctgctggacaaaccggacgaggaaatttacaacctaccctccgagctgcccggtagcaggtacgatggtaataagcagtgtgagctggccttcggccctggttcacagatgtgcccccatattaatatatgcatgcacctgtggtgtacaagcactgagaaactgcacaaaggttgtttcactcagcacgttccaccagccgacggcacagattgtggacccggaatgcattgcaggcacgggttatgcgtaaacaaggagaccgaaaccagaccagtcaatggtgagtgggggccatgggaaccgtactccagctgctcacgaacatgcgggggagggatcgagtcagctactaggaggtgcaatagacctgagcctagaaatggcggtaactactgtgttggtagaaggatgaaatttcgatcctgtaatacagactcatgccctaaaggcacccaggactttcgagaaaaacagtgctccgactttaacgggaagcacttggacatctccggtatccctagcaacgtgcgttggctcccgcgatattccggcataggcacgaaagatcggtgtaagctctattgccaggttgctggaaccaactatttttatctgcttaaagatatggtggaagacggaacaccctgtggaactgaatcttacaatattgactgcaactgcgttctcaaggccgcagggtgcgatcacgttttgaacagcagtgccaaaatcgataagtgtggcgtgtgcggaggtgacaactcctcatgcaagactataaccggggtattcaattccagccactatggctataacgtggtggtcaaaataccagctggcgctaccaacgttgacattaggcaatattcatatagcggccagccagacgactcttacctggccctgtccgatgcagaggggaacttcctgtttaacgggaactttctgctctctacatcaaagaaagaaataaacgtgcaaggcaccagaactgtgattgaatactcagggtctaataacgcggtcgagcgcatcaattctactaacaggcaagagaaggaaatacttatcgaagtcctgtgcgtaggcaatctgtataacccggacgttcactatagcttcaatattccactggaagaaagatctgatatgtttacatgggatccatatggtccctgggagggttgcacaaaaatgtgtcaaggtctccagcgacgcaacataacctgcattcacaagagcgaccatagcgtggtttctgacaaggaatgtgaccacctgccccttccgtcattcgtcacacaatcatgcaacacggattgcgagcttcggtggcacgtgattgggaaatctgaatgttcctcgcaatgtgggcaggggtatagaacacttgatatccactgtatgaaatactcaatccatgagggacagaccgtgcaggtggatgatcattattgcggagaccaacttaaacctcccacccaggaattgtgccatggcaactgtgtgtttactaggtggcactattcagaatggagccagtgtagccgcagctgtggaggcggtgagagaagtcgcgagtcctactgcatgaacaacttcggccaccgcttggcggacaacgagtgccaggagctgtcacgtgtgactcgagagaattgcaatgagttttcttgccccagttgggccgcaagtgaatggagcgaatgtctagttacctgtggtaaaggcaccaagcaacgccaggtgtggtgtcaactgaacgtcgatcacctgtccgacggtttttgcaatagctcaaccaaacctgagagcctctcaccatgtgagctccatacctgcgcttcatggcaggtgggtccatggggcccttgcaccactacgtgcggacatggttatcaaatgagagatgtgaagtgcgtgaacgaactggcatccgccgtcctggaggatacggaatgtcacgaggcttcacgacctagtgacaggcagagttgtgtgctgaccccctgtagcttcatcagtaagttggaaacagctttgctgccaaccgtcctaataaaaaagatggctcaatggcggcacggctcctggaccccatgttccgttagttgtggcaggggaactcaggcccgatacgtgtcatgcagggacgccctggaccgcatcgccgatgagtcttattgtgcacacctgccccgacctgcagaaatctgggactgctttactccttgtggagagtggcaagccggtgactggagtccttgcagtgctagctgcggtcatggtaagactacgcggcaggtactctgcatgaattaccaccaaccaatcgacgagaactattgtgatccagaggttaggcctctaatggaacaggagtgcagcctcgccgcttgcccaccagcccacagccacttccctagctccccagtgcagccttcctactacttatcaactaatttgcctctcacacagaagttagaagacaacgagaatcaggtggttcacccctccgttcgcggaaaccagtggaggaccgggccttggggaagttgctcctcctcatgtagcggaggccttcagcaccgggctgtagtgtgccaagacgagaacgggcagtccgcctcatactgtgacgcagcatcaaaacctcccgaacttcagcaatgtggccctgggccatgtcctcagtggaactatggaaactggggggagtgctctcagacctgcggcggagggataaagtcgcgtctggtcatctgccagtttcccaacggccagatcctagaagaccacaattgcgagatcgtgaataagccccctagcgtcattcagtgccatatgcacgcttgtcctgccgatgtgtcttggcatcaggagccctggaccagtgaggatctgaaggtgaagttgcttccccagcggactataatattgtgggaactgatgaaaaacattttctgtcacggcaagcactcacacatgtatctgatcaatgtggtgaccgatcatctcctgtaccctcgccactgtgatccagagacgattgaaacatacttcttaagcctgtggagtcttcagttcacctggggcgatctgaaatattacaagaattcactgtag

SEQ ID NO: 213446 - DNA, 5732 bp, Artificial Sequence
  Description of Artificial Sequence: Synthetic coding sequence
atgtgggttgccaagtggttaacagggctgctttatcatttgtctctgttcataacacggtcctgggaggtagattttcatcccagacaagaagctctagtacgcacactgaccagctacgaggtggtgataccggagagagtgaacgaatttggcgaggtatttccccaatctcaccatttctcgcgccagaaacggagctctgaggcccttgagcctatgccctttaggacccattacaggtttacggcgtatgggcagctgttccagctgaacttgaccgcagacgctagctttctcgccgcaggatacacggaagtgcacctcggaacacctgaaaggggcgcttgggaaagcgatgcaggaccctccgacctccggcattgcttctatcgaggacaggttaatagccaggaagactataaagcggtcgtctctttgtgtgggggactcactgggacatttaagggccagaacggggagtactttctcgaacctattatgaaagcagacggcaacgagtacgaagacgggcataataaacctcacctgatttatcgccaagatcttaacaacagcttcttacaaactctgaagtattgtagtgtgtcagagtcacagattaaggagacctcactgcccttccatacatatagtaacatgaacgaagacctgaacgtgatgaaagagcgcgtcttgggacacaccagcaaaaatgtgccactgaaggacgaaagaagacatagccgtaaaaagagactcatttcttaccctagatacatcgagattatggtcacagcagatgccaaagtcgtctctgcccacgggtcaaatctgcagaattatattctgactttgatgagtattgtcgcaaccatttataaagatccatccataggaaatctcattcacattgttgtcgtcaagcttgtaatgattcacagggaagaagagggccctgtgatcaattttgacggagccactaccctcaagaacttttgtagttggcagcagactcagaatgatctggatgatgtacatccctcacaccacgacaccgctgtgttaatcacaagggaagatatttgttctagtaaagaaaagtgcaacatgctcgggctgtcctatcttggtactatctgcgacccactacagtcatgcttcattaacgaggaaaaggggctgataagcgcatttaccattgcccacgaattaggacacactctgggcgtacagcacgatgacaatcctaggtgcaaagagatgaaagtgacgaaatatcacgtcatggcgcctgccctgtcattccacatgtctccatggagctggtccaattgttctagaaagtacgttactgagttcttggacaccggttacggagaatgtctcctcgataagcctgacgaggaaatttacaatctccctagcgaactgcccggatctcggtatgatgggaataagcagtgcgagctggcatttgggccaggcagtcagatgtgcccacacataaacatctgtatgcatttgtggtgtacttcaaccgagaagcttcacaagggctgttttactcagcacgttccaccggctgacggcacagattgcggaccaggtatgcattgccgacacggcctatgtgtgaacaaagagaccgagacaaggcccgttaatggagaatggggcccttgggaaccgtactcctcttgcagccggacgtgtgggggtggcatcgagagtgctacacgcagatgcaaccggccagagcccaggaacggtggcaactattgtgttggtaggcgcatgaagtttcgcagctgcaatacagattcctgtccaaagggcacccaggacttccgagaaaagcagtgttcagattttaacggaaagcacttggacatctctggcattcccagtaatgtgaggtggctgcctcggtacagtgggatcggtactaaggaccgctgcaagctgtactgccaagtggcgggaactaactatttttatctgttgaaagatatggtagaagacggtacaccctgcggaaccgaaacgcacgacatttgcgttcagggccagtgcatggctgccggatgcgatcacgtcctcaattctagcgcgaagatcgataaatgcggcgtgtgtggcggagataacagttcatgcaagacgatcactggagtgtttaactcctctcactacggctacaacgtggtggttaagataccagctggcgcaacgaatgtggatatcaggcagtattcttactccggccaacctgacgattcctacttggcgcttagcgatgctgaagggaattttctgttcaacggaaactttcttctcagtaccagtaaaaaggagattaacgtgcagggcacgaggaccgtcattgaatactcaggcagcaataatgccgttgagaggatcaatagcaccaacagacaggagaaggagctgatcttgcaagtcctgtgcgttggaaatctgtacaaccctgatgtccactacagcttcaacattcctttagaagaacgctccgacatgttcacttgggatccatacggtccatgggagggctgcaccaagatgtgtcagggcctccaaagaaggaatatcacatgcattcacaaatctgatcacagcgtcgttagcgataaagaatgcgatcatctccccctgcccagcttcgttacacagtcctgcaacaccgactgcgagctcagatggcacgtgatagggaagtctgagtgttccagccagtgcggacaggggtataggaccttagacatacactgtatgaagtattctattcacgagggccagacggtacaggtggacgaccattactgtggagatcagctcaagcccccaacgcaggaactttgccacgggaattgtgtgtttacaaggtggcactactccgaatggtcccaatgctcacgaagctgtggcggaggcgaacgatcaagagagagttactgtatgaacaactttgggcaccgactggccgacaacgagtgccaggaactgtcccgcgtgactagagagaattgtaatgagtttagctgcccatcatgggctgcttcggagtggtcagagtgcctggttacctgtggcaaaggtacaaagcaacgccaggtgtggtgccagttaaatgtggatcacttatcggatggattctgcaacagttctaccaagcctgaaagcctgagcccttgtgagctgcacacctgcgctagctggcaggtgggtccgtgggggccttgcaccactacatgtggccacggttaccaaatgcgtgatgtgaaatgcgtgaacgagttggccagcgccgtgctagaggatactgaatgccacgaagcgtcacgcccatcagatcgtcagagctgcgtcctgaccccatgtagtttcatcagcaagcttgagactgctttattgcctaccgtgctgattaaaaaaatggcccagtggagacacggcagttggaccccttgcagtgtgtcctgcggcagaggaacgcaggcaagatatgtgtcctgccgcgacgctctggacaggatcgcagacgaatcatactgcgcccatttacccaggccagcagagatctgggactgtttcacaccttgtggggaatggcaggccggagattggtctccctgctccgcaagctgtggacatgggaagaccacacgccaagtcctctgcatgaattaccaccaaccaattgacgaaaactactgcgaccctgaggtgcggcctctgatggagcaagaatgctcgctggcagcctgtcccccagctcatagtcacttcccttccagtccagtgcagccgagctactacctgagcacaaacctgcccctgactcagaagttggaagacaatgaaaaccaggtcgtgcatcctagcgtccgcggaaaccagtggcgcaccgggccatggggctcatgcagctctagttgttctggtggccttcaacatcgggctgtcgtgtgtcaagacgaaaatggacaaagcgctagctactgtgatgccgctagcaaaccacctgagttgcaacaatgcggacccggaccatgtccccaatggaattatggcaactggggagagtgctcccaaacttgcggagggggaattaagagtcgattggtcatttgtcagtttcccaacggacagatactcgaggaccacaactgcgagatcgtgaacaagccgccatctgtcatccagtgccacatgcatgcatgcccagccgacgtttcctggcatcaagagccctggactagctgcagtgcgtcctgcggaaaggggaggaagtacagagaggtgttctgtatcgaccagttccagaggaaactggaggataccaattgtagccaggtccaaaagccacccacgcacaaggcctgtagaagtgtccggtgtccgtcctggaaagcgaactcctggaacgaatgctccgtgacctgcggcagcggagtccagcagcgagatgtgtactgtcggctgaaaggcgtcggacaggtggtcgaggagatgtgcgatcagagtaccagaccctgctcccagaggcgttgttggtcccaggattgcgtgcagcataagggaatggagagaggtagactgaactgtagcactagttgtgagcgaaaggatagccaccaaaggatggagtgcacggacaaccaaattcgccaagttaacgagattgtttacaattcctccaccatctccttgactagcaagaactgccgaaacccaccctgcaattacatcgttgtgaccgctgatagcagccaatgcgccaataattgtggtttttcttatcgacaacgtatcacatactgtactgagataccatcaacaaagaaacacaagctgcataggcttcggcctatcgtctaccaagagtgtccagtcgtgccatcttctcaagtgtatcaatgtattaactcctgtctccatctggccacttggaaggtgggcaaatggtctaagtgctctgttacgtgcggcatcgggatcatgaaaaggcaggtgaaatgtataacaaagcacgggctctcgtcggatttatgcttaaatcatctcaagcccggtgcgcagaagaaatgctatgctaatgattgtaaatccttcaccacatgtaaggaaattcaggtcaaaaaccatattagaaaagatggggactactacctgaatattaaggggagaattataaaaatttattgcgccgacatgtacctagagaaccccaaggagtatctgaccttggtccaaggggaagagaacttctctgaggtctacggcttccggctgaaaaatccctaccaatgtcctttcaacgggtccaggcgcgaggattgcgagtgcgacaacggccatctcgccgcaggctatacggtgtttagtaagattagaatcgacctgactagtatgcagatcaagacgaccgacctactgttttctaagacaatctttggcaacgcagtgccattcgctactgcaggcgattgctactccgcgtttagatgcccacagggtcaattctccattaaccttagtggcaccggaatgaagataagctccacagcgaaatggctgactcagggcagttacacatctgtgtctattcggaggagcgaagacggtacccggttctttggcaagtgtggcggttattgtgggaaatgcctgcctcatatgacaaccggtctgcccatccaagtcatcta

SEQ ID NO: 213447 - DNA, 1869 bp, Artificial Sequence
  Description of Artificial Sequence: Synthetic coding sequence
atgtttacctgggatccgtatggcccttgggagggttgtacaaagatgtgtcagggtttgcagcgacgcaatataacttgcatccacaaatccgaccattctgtggtaagtgacaaggagtgcgatcatctgcccttaccatcattcgtgactcagagttgcaatactgactgtgagttgcgctggcacgtcatcggaaaaagtgagtgttcaagtcagtgcgggcagggctatcgcaccctggacattcactgcatgaagtattccatccatgagggtcagactgtgcaagtggatgatcactactgcggggatcagctgaaaccgcctacccaggaactctgtcatggcaactgtgtgttcaccagatggcactattcagaatggagccagtgttcaagatcctgcggcggaggcgaaagatctcgcgagtcctactgtatgaataactttgggcacagactggctgataatgagtgtcaggaactgagccgcgtgacccgtgaaaactgcaatgaatttagctgccctagctgggctgcctcagagtggtctgagtgcctggtgacatgcgggaagggcacgaaacagaggcaggtgtggtgtcagcttaacgtggatcacctatccgacggtttctgcaacagcagtactaagccagaaagcctgagtccatgcgagctgcacacctgcgcttcctggcaggtggggccatggggcccatgcaccaccacatgcggacacgggtatcaaatgcgcgacgtcaaatgtgtcaacgagctcgcatccgccgtgttggaggatacagagtgccacgaggcctccagaccatctgatagacagtgttctgtatcctgtgggagaggcacccaggccagatatgtgtcctgcagagacgccctcgacaggattgccgacgaaagctactgtgctcatttgccccgacccgcagagatttgggactgctttaccccttgcggagagtggcaggcaggcgattggagcccatgttcagccagttgtggtcatggaaaaaccacccggcaggtactgtgcatgaactaccaccaaccaattgatgaaaattattgcgatcccgaagtgcgtcccttgatggagcaggagtgctccctagctgcatgcccacccgctcacagccactttccgtctagcccggtacaaccctcttactatctgagtaccaatcttccattaactcagaaactggaggataatgaaaaccaggtggtccacccttcagtgcgtggcaaccagtggaggactggaccttggggatcttgttcctcctcctgttccggaggtttgcagcacagagcagtggtgtgtcaggacgagaacggacagtccgctagttattgcgatgcagcctccaagccacccgaacttcaacagtgcggccctggaccatgtccccagtggaactacggaaattggggggaatgctctcaaacgtgcggagggggtattaaaagccggctggtcatctgccagttccccaacggccaaattctcgaagaccacaactgcgagattgtgaacaaacctcctagcgtgattcagtgtcacatgcacgcctgtcccgctgacgttagctggcaccaggaaccttggacctccgaagacctgaaagtcaaactgctgccccagcgtactatcattttgtgggaacttatgaaaaacatattctgccacggcaagcattctcacatgtatctcattaacgtggtgactgaccatctgttataccccaggcattgcgatccagagactatagaaacatattttctgtcgctgtggagtctgcagtttacttggggcgatctgaagtattataaaaatagcctgtag

SEQ ID NO: 213448 - DNA, 4515 bp, Artificial Sequence
  Description of Artificial Sequence: Synthetic coding sequence
atgtgggtcgccaagtggctcacggggctgctgtaccacttgtccttgtttatcacacgcagctgggaggtcgacttccatcctagacaggaggctttggtacggaccctaacttcctacgaggtggtaattcctgaaagggtgaacgagtttggtgaagtgttcccgcaatcacatcacttcagccgccagaagcgctcttcagaagcgctcgaacccatgccatttcggacacactacagattcacagcctatgggcagctattccagctaaaccttacagccgacgctagcttcctggcagccggatacaccgaggtgcaccttggtactcctgaacggggtgcctgggaaagcgacgccggaccatccgacctgcggcactgtttctatcggggacaagtgaactcgcaagaagattacaaggccgtggtcagtttgtgcggtgggctgaccggcacttttaaggggcaaaatggggagtactttctagagcccattatgaaagctgacgggaatgaatatgaggacggccataataaacctcacctcatctacagacaagacctcaacaattctttcctgcagacattgaaatactgctccgtgagcgaaagtcaaataaaggagactagcctcccttttcatacttactctaacatgaatgaggacctgaatgtcatgaaggagcgggtgctggggcacacgagcaaaaatgtacccttaaaagacgaacgcaggcattctaggaagaaaaggctgatctcttatcccaggtacatcgagatcatggtcactgccgacgctaaggtggtgtccgcccacggttccaatcttcaaaattacatccttacacttatgtccattgtcgctactatttacaaggaccccagcatcggtaacctgatccatattgttgttgtgaaacttgtcatgatacatagagaagaggaggggcctgtcattaatttcgatggagcaaccaccttgaaaaatttctgctcgtggcagcagactcagaatgacctggacgacgtgcacccttctcatcatgacacggcagtgcttatcactcgggaggacatctgttccagcaaagaaaaatgtaacatgttaggcttatcttacttaggcaccatttgcgatccacttcagtcgtgtttcattaacgaagagaagggccttatttccgctttcacaattgctcacgagctgggccatacacttggcgtgcaacacgatgataacccacgatgcaaagagatgaaggtaactaaatatcacgtgatggcccctgccctgtccttccacatgagcccctggtcctggtcaaattgttcacgcaaatacgttacagagttccttgacactggctatggcgagtgtctgctggacaaacccgatgaagaaatttacaatctgccctccgagcttcccggatcccgatacgacgggaacaagcagtgtgagttagcgtttggaccaggcagccaaatgtgtcctcacattaatatctgcatgcatctctggtgtacctccactgagaagttacacaagggatgctttacccagcacgtgccccctgcagacgggaccgattgtggaccaggaatgcattgccggcatgggctctgcgttaataaagagaccgagacaaggccagtgaatggcgagtggggcccatgggagccttactcttcctgttccagaacctgcgggggagggatcgagtcagccaccagacggtgtaacaggcccgagccacgcaacgggggtaattactgcgtagggagacgcatgaaattccgcagttgcaatactgattcgtgcccaaaaggaacgcaggactttagagaaaagcagtgctctgacttcaatggtaagcatttagatattagtggaatcccatctaatgtccgctggttgccacgctattccggaattggaaccaaggatcgttgcaagttgtactgtcaggtcgcaggcacaaactacttttacctgctcaaggacatggttgaggatggcacaccttgtggcacagagacccacgacatctgtgtgcaggggcaatgtatggcggctggatgtgaccatgttctgaatagcagtgcaaagattgacaaatgtggcgtgtgtgggggagacaatagcagctgcaagaccattacgggcgtgttcaacagttcacactacggttacaatgttgtcgtcaaaatcccagccggagctacaaatgtggacattcggcagtatagctactctggccagccagatgacagttatctcgccttgagcgacgccgaggggaacttcttgtttaatggtaactttttgctaagtacatccaagaaggagattaacgtacagggtaccaggactgtcatcgagtattcgggttccaacaacgccgtcgagcggataaactccacaaaccgccaggagaaggagttaatcttacaggtgctgtgtgtgggaaatttgtacaatccagatgtgcactacagctttaacatacccctggaagagagaagtgacatgtttacctgggacccctatggtccctgggagggatgtactaaaatgtgccaaggcctgcagcgcaggaatatcacctgcattcacaaaagtgatcattccgtcgtttccgataaggagtgcgatcaccttcccctgccatcctttgtcacacagtcctgtaataccgattgtgaattacgttggcatgttatagggaaaagcgagtgcagctctcaatgtggccagggctaccggactttggacatccattgtatgaagtactccattcacgaggggcaaactgtccaagtggatgaccattattgcggagaccagctgaagccacccacccaggaactgtgtcatggcaactgtgtgtttacccgctggcattacagcgagtggtcccaatgttcgcgttcctgcggaggaggagagcgctcaagggagagttactgcatgaataatttcgggcatcgcctcgctgataatgaatgtcaggagctgtcacgggtcactagggagaattgcaacgagttttcctgccccagttgggcagctagtgagtggagcgaatgtctcgtcacctgtggtaaaggcacgaaacagcgtcaggtctggtgccagcttaacgttgaccatcttagcgatggtttctgcaattcatccaccaaacctgaaagtttgtcgccatgtgaactccatacttgcgctagctggcaagtgggaccttggggcccttgtaccacaacttgcgggcacgggtatcagatgagagatgttaaatgtgtgaacgagctagcctctgctgtgttggaagacaccgaatgccatgaggcatcaagaccatccgataggcagtcctgcgtattaactccatgctcgttcatcagcaaactcgaaacagctctgctgccgactgtcctaatcaaaaaaatggcacaatggcggcatggctcttggacaccttgttctgtaagctgtggcaggggtactcaggctcgctacgtgagctgccgggacgcgctcgaccggatcgcggacgagtcatattgtgcccacctgcctaggcctgccgaaatctgggactgtttcactccatgcggcgaatggcaggccggtgattggagtccttgctctgccagttgtggacatggcaagaccacgagacaggtattgtgcatgaactaccaccagcccatcgacgagaattattgcgacccagaagttagaccactgatggagcaagaatgcagtttagcagcatgtcccccagctcatagtcactttccatcaagccctgtgcagccgagctattatctgtccacaaatctgcctctgacacaaaaattggaggataatgaaaatcaggtggttcacccttcagtgcgcggaaaccaatggaggactggtccctgggggagttgctcgagcagttgttcagggggactgcagcacagggccgtggtttgccaggatgaaaacggacaatccgcgtcgtactgtgatgcagcttctaagccccctgagcttcagcagtgtggcccaggcccttgcccccaatggaactatgggaattggggcgaatgttcacagacctgcggcggaggaattaagtctcgactggtgatttgccagttcccaaatggacaaatcttggaggaccacaattgcgaaatcgtgaataaacccccttctgtgatccagtgccacatgcatgcctgccccgctgatgtgtcctggcatcaggaaccttggacctcagaggatctcaaggtcaaactgctcccccagcgaacaataatcctctgggagctgatgaagaatatcttctgtcacgggaagcactctcacatgtacctaattaacgtcgtgactgatcacctgctttacccccgtcactgtgaccccgaaaccatagaaacttactttctctcactttggagtctacaatttacctggggcgatctcaagtattacaaaaacagtttgtag

SEQ ID NO: 213449 - DNA, 3618 bp, Artificial Sequence
  Description of Artificial Sequence: Synthetic coding sequence
atggtgttgctctcattatggctgatcgccgcagccctggtggaggtgaggacaagtgccgacggacaggccggtaatgaggagatggtgcagattgatctgcccatcaagcggtatagagaatatgagctcgtcactccggtctccactaatctggaaggacggtacctgagccacaccctctccgcctcccacaagaaacggtctgctagggacgtctcttctaacccagaacagctgttcttcaacattactgcctttggtaaagacttccacttgagactgaagcctaacacccagctagtggctccgggagcagttgttgaatggcatgaaacgtccctcgtgcccggtaacatcacagatccgatcaataaccatcaacccggatctgctacatacagaatccgcaggacagagccacttcagaccaattgtgcctacgtaggcgatattgtggatattccaggaacatcagttgcaattagcaactgtgatggcctggcagggatgatcaagtcggacaacgaagagtactttatcgaacctttggagaggggcaaacaaatggaagaagagaaggggagaatccacgttgtgtacaaacgatcagctgtggaacaagcccctatcgatatgagtaaggattttcactatagagaatccgatctggaagggctggacgacctcggtacagtgtacgggaatattcaccagcaactgaacgagaccatgcgaaggagacggcacgctggagagaacgactacaatattgaagtcttgcttggcgttgacgacagtgtggtgcgtttccacggtaaggaacatgtgcagaactacctcctcactctgatgaacattgtgaacgagatatatcacgacgaaagtctcggggtgcacatcaatgtagtattggtgaggatgattatgcttggctacgcaaaaagtattagcctgattgagcgcggaaacccgtcccgttcgctggagaatgtgtgtaggtgggccagccaacagcagagatcagatcttaaccacagtgaacatcacgaccacgccattttcttgactagacaggattttgggcctgctggcatgcaaggatatgctccagtcaccggtatgtgtcaccccgttagatcgtgtaccctcaatcacgaggacgggttttcctccgccttcgtggtcgcccatgagaccggtcacgttctaggcatggagcacgacggacagggtaatagatgcggagatgaaaccgctatgggctctgtgatggccccactcgtccaggccgctttccatagataccactggtccagatgcagcgggcaggagcttaaacgctatatccatagttatgactgtctcttggacgatcccttcgaccacgattggccaaagcttcccgagttacctggcattaactattctatggacgaacaatgccggttcgactttggcgtgggatacaaaatgtgtaccgcctttaggaccttcgacccatgcaagcagttgtggtgctcacaccctgacaacccttacttttgtaagaccaagaaaggcccaccactggatgggaccgagtgcgctgccggtaagtggtgttacaaaggacactgtatgtggaagaatgccaaccaacagaagcaagacggcaattggggctcatggaccaagttcggatcttgtagtaggacgtgcggaacaggggttcgattccgcacaagacagtgtaataatcccatgcccatcaacggtggtcaggattgtcccggagtgaacttcgagtaccagctttgcaacacagaggaatgtcagaagcactttgaggacttccgggctcagcagtgtcagcaacggaacagtcatttcgagtaccagaacaccaaacaccactggctgccttatgagcaccccgacccgaagaaacggtgccatctttactgccaatccaaggaaacaggggacgtggcctatatgaagcaactggtacatgatgggacccactgctcttataaggacccgtactctatctgcgtcagaggggaatgcgtgaaagtggggtgcgataaggaaatcgggagcaacaaggtggaagataagtgcggagtctgcgggggagacaactctcactgccggactgttaaggggaccttcacaaggacacctagaaaactgggatacctgaagatgttcgacatcccacctggagcgcgacatgttcttattcaggaggatgaagcttctccacatatcctagccatcaaaaaccaagcaaccggccactacatcttgaatggaaaaggagaggaggccaagagtagaacttttatcgatcttggtgtagaatgggactacaacatcgaggatgacattgagtccctgcacacagatggaccacttcacgaccccgttattgtgctaatcatcccccaagagaacgacacaagatccagtcttacctacaagtatatcattcatgaggatagtgtgccaaccattaacagcaataatgtgattcaagaggaactagacacatttgagtgggccctgaagtcatggagccagtgttccaagccatgcgggggagggttccagtatacgaaatatgggtgtcggaggaagtccgacaataaaatggtgcaccgatcattctgcgaagccaataagaagccgaagccaataaggcgtatgtgtaacatccaggagtgcactcaccctctgtgggtcgctgaagaatgggaacactgcactaagacatgcgggtctagcggttatcagctccggacagtaaggtgcttgcagccactgctggacggcacaaatcgcagcgtacattccaagtactgtatgggtgaccgcccagaatcccggagaccatgcaatcgagtgccctgtcctgcccagtggaaaacgggcccatggtcagaatgcagcgtgacctgcggagagggcaccgaggtccggcaggtcctgtgccgggctggagaccattgcgacggcgaaaaacccgaatcagtgcgggcttgccagctgcctccctgcaatgatgaaccctgtctgggtgacaagtcaatattttgtcaaatggaggtcctggcgaggtactgtagcattcctggttataacaaattgtgttgcgaatcctgctcaaaaagatctagtacactaccacccccatatctccttgaggccgctgaaacacatgacgacgttatcagcaatccttcagatctaccccgatctttagtgatgcctaccagtctggtaccctaccattctgagaccccggctaagaagatgagtctgtcatctatttcgtctgtgggtgggccaaacgcctatgctgcctttagacctaatagtaaaccagacggcgcaaacctgcggcaaagatcagcccagcaggccggatcaaaaaccgtgcgactggtcacagttccttcaagccctcctaccaaacgagtgcacttgtcctccgcaagccagatggccgcagcaagcttttttgcagcctccgactcaataggtgctagctcacaggccaggacgagcaagaaggacggaaaaattatagataatcggaggcccactcgctcctctacgttggagagatag

SEQ ID NO: 213450 - DNA, 1020 bp, Artificial Sequence
  Description of Artificial Sequence: Synthetic coding sequence
atgagccagacgggtagccatcctggaaggggcctggcgggacgatggctgtggggggcacagccctgcctgctccttcccattgtgcctttgagttggctcgtatggctgctgctgctccttttagcatcactgttgccgtccgcccgactggcaagcccccttccgcgagaggaagagattgtgtttccagagaagttaaacggctccgtcctgccagggagtggcgcacctgcaaggttgctttgcagactgcaagccttcggcgagacactgttgctagaactggaacaggactctggggtgcaggtggagggcctgaccgtccagtatttgggccaagcccctgaactcctggggggtgctgaacccggaacttacctcactggaaccattaatggcgacccagaaagcgtggcttccttgcactgggacggcggagccctcctaggagtgctccaatacagaggcgctgaactgcatcttcagccactagaagggggtactcctaattctgcgggagggcctggcgctcacattctgcggagaaagagcccagcaagcggacagggacccatgtgtaatgtcaaagcccctctgggatctccttcgccgcgaccccgtcgcgctaagaggttcgcaagtctcagccgcttcgtggagaccctagtggtcgctgacgataaaatggccgctttccacggcgctggtctgaaacggtatctcttgacagtgatggccgctgcagccaaggcatttaaacatcctagcattcgcaacccagttagcctggttgtgacgaggctagtcatcttgggaagcggcgaggaagggccacaggttgggccttcagccgcacagacgcttcggtctttttgtgcctggcagcgcggactaaatacccctgaggacagcgatcctgaccactttgatacagctattctgttcaccagacaagttagacctcaaagcgcgcctcaggctatgcattgcacaatcctgcgttctgcaaccacttag

SEQ ID NO: 213451 - DNA, 2514 bp, Artificial Sequence
  Description of Artificial Sequence: Synthetic coding sequence
atgtctcaaaccggtagtcacccgggtagaggattggccggaaggtggctctggggcgctcagccctgcctgcttctgccaatcgttcctcttagctggctggtgtggctgcttctcctgctgttagccagcctgctgccctccgctcggctagccagtccactgcctcgagaggaggagatcgtctttcccgagaaactcaacggctcagtgttacctggcagtggtgctccggctcgcttgttgtgcaggttgcaggctttcggtgaaacacttctactcgagttagagcaggactccggcgtacaggtggaggggctgacagtacagtacttaggacaggccccagagctactggggggtgcagagccaggcacttatctcactggaactattaatggtgaccccgaaagcgtggcgtcacttcactgggacggcggagcactgctgggggttctgcagtatagaggagccgaactgcatctccagccgttggaggggggaacacctaatagtgcgggtggccctggggctcatatattacggaggaagtcaccagcctctggccaaggacctatgtgtaacgtgaaggctcctcttggaagcccctcacccagacccagaagggccaagagattcgcgtcgctctcccgctttgtcgagaccctcgtggtcgccgatgacaagatggccgcttttcacggagctggcctgaagagatacctcctcacggtgatggccgctgcagccaaggcatttaagcaccccagcattcgcaaccctgttagtcttgttgtgaccaggctcgtgatcctgggcagtggcgaggagggaccccaagtcggcccaagtgctgcccaaaccctacgcagtttttgcgcctggcagagaggacttaacacacccgaggactcggatcctgatcatttcgatactgccattctttttactaggcaggatctgtgcggggttagcacttgtgacaccctggggatggcggatgtcggcacagtttgtgacccggctcgttcttgtgccatcgtcgaagatgacggcctgcaatccgccttcaccgctgcacatgagctggggcatgttttcaacatgctgcacgacaattcaaaaccgtgtatttccttgaatgggcctctttctacaagccgccatgtcatggcccctgtgatggcccatgtggatcccgaagagccctggtcaccttgttcagctcgcttcatcaccgattttctggacaatggctacggccattgtctgctggacaagcccgaggcaccattacatctacctgtcactttccccggaaaggactatgacgccgacagacaatgtcagctcacattcggtcccgattctcggcactgcccgcagctccccccaccttgcgccgcactctggtgctcagggcatctaaatgggcacgccatgtgtcagactaagcatagcccttgggcagatggcacgccttgtggcccagcccaggcctgtatgggaggcagatgtttgcacatggatcaactgcaggactttaacattcctcaagcagggggatggggcccatggggcccatggggtgattgctctcgaacgtgtggcggtggtgtccagttttcttcaagggactgtaccagacctgtgcctcgtaacggaggaaaatactgcgagggaaggagaaccaggttccggtcatgcaatacagaggactgccccaccggctccgccttgaccttcagggaagaacagtgcgctgcctataaccatcggaccgacctgttcaagtcctttccaggcccaatggactgggtccctcgttacaccggtgtcgccccacaggaccagtgcaaacttacatgccaggcccaggccctgggctactattatgtcctggagcctcgggtggtggacggtaccccctgctcacctgacagctcttcagtctgcgtccagggaagatgtatccacgccggttgcgatcgcatcatcggctcaaaaaagaagttcgataagtgcatggtgtgcgggggagatggctcaggttgttctaaacagtcaggctccttccgcaagttcaggtacgggtacaataatgtcgtgactattcctgcaggagctacacacatattggtaagacagcagggcaatccgggacacagatccatctatctggccttgaaactcccggatggatcatacgcgcttaacggggagtatacactcatgcctagtcctacggatgttgtgcttcctggagccgtgtcgctcaggtatagtggggcaaccgcagcctctgagacactctctggacatggcccattggcccagcccctgacgctgcaggtgctggtggctggtaatccacaagatacaagactccgatactcattcttcgtcccgaggcccacaccttctacgcccaggcctacgccccaagactggctgcaccgtcgagcccagattttggaaattttaagaaggcgcccttgggctggacgaaaatag

SEQ ID NO: 213452 - DNA, 2793 bp, Artificial Sequence
  Description of Artificial Sequence: Synthetic coding sequence
atgttattaggatgggcctcactcctgctgtgcgcctttcggcttccattggctgccgtgggccctgcagccaccccagcacaagacaaagctgggcagcctcctactgccgctgcagcagcccagcctaggcggagacagggggaggaagttcaggagcgtgctgagcctccgggtcacccccaccccctggcccagaggagacgctccaaggggctcgttcaaaatattgaccagctctactcaggcggaggcaaagtagggtatttggtgtacgccggaggacgccgatttctgctggacctggaacgggacggttctgtgggtattgctggtttcgtaccagctggaggtggaacatccgcaccatggaggcacaggagtcactgtttctacaggggtaccgttgacgggagtcctaggtccttggccgtctttgatttatgcggcggtcttgacggctttttcgcagtaaagcacgctcggtataccctgaagccgctcctaaggggcccttgggccgaggaggaaaaaggtcgagtttacggggatggatccgctagaattcttcacgtgtacaccagggaaggattcagtttcgaagccttgcccccaagagccagttgtgaaactcccgcttccacaccagaagcacacgaacacgccccagctcactcaaatccttctggtagagccgctttggcctcccagttgttggatcagtctgctctttcacctgccggaggttcaggaccacaaacctggtggaggagacgaaggagatccataagcagggcgcgacaggtagaactgctccttgttgctgacgccagtatggcacggctgtacggtcggggtctgcagcattaccttctgacccttgcatccattgcgaatcggctgtatagccacgcgagtattgagaaccacattaggcttgcggtggttaaggtggtcgtgctcggcgataaggacaagagcttggaggtgagcaagaatgctgctaccaccctgaaaaatttttgtaaatggcagcatcagcacaatcaactcggcgacgaccatgaagagcactacgacgccgcaattctctttactcgggaggacctgtgtgggcaccactcatgcgacactttgggaatggctgatgtgggaactatctgctccccagaacgctcttgcgccgtgattgaggacgatggactgcacgccgctttcacagtagcacatgagattggacacctgctggggctgtcacacgacgactctaagttctgtgaggagacctttgggagtacagaggataagaggctgatgtcctcaattttaacaagcatcgacgcctcgaagccttggtccaagtgcaccagcgcgacaatcaccgagtttcttgatgacggtcacggaaactgtctgttagatctgcccagaaagcagatcctgggcccagaagagctgcctggccagacctacgatgccacccaacaatgtaatttgaccttcggccctgagtactctgtgtgtccaggcatggatgtctgcgccagactgtggtgcgccgtcgtacgacaggggcagatggtttgtcttacaaaaaaattgccagcagtggaggggaccccctgcggcaaaggaagaatttgtttacagggtaaatgcgtagacaaaaccaaaaagaagtactactctacctcctcccatgggaactgggggtcctggggcagttggggccaatgcagcagaagttgcggaggcggagtgcagtttgcctatcgtcactgtaacaatccagccccaaggaacaatggtaggtactgtactgggaagcgggctatatatcgatcctgcagcctgatgccatgcccacctaacggcaaatcttttagacacgaacagtgcgaggccaagaacgggtaccagtctgatgctaagggggtgaaaacctttgtcgagtgggtgcctaagtacgcaggggttctgcctgcagacgtgtgtaaactcacatgccgcgctaagggaactgggtattatgttgtcttctcccctaaagtgactgacggaaccgaatgcagactttattctaacagtgtctgcgtgcgaggaaaatgcgtgcgtaccgggtgcgacggcatcatcggctctaagcttcaatacgacaaatgtggcgtgtgcggaggcgataactcttcttgtactaagatcgtgggtacctttaacaaaaaaagcaagggttataccgatgtggtgcggataccagagggtgccacgcacattaaggtaagacagttcaaggcaaaggatcagaccaggtttaccgcgtacctggcgctcaaaaagaagaacggcgagtacttaattaacggcaagtacatgatctcaaccagtgagacgatcatagacataaatggcacggtgatgaactattcagggtggtcccacagggacgactttttgcacggtatgggttacagcgcaactaaggaaattttgattgtgcagatactagctactgatcccacgaagcccctggacgtgagatattccttctttgtgcccaaaaaaagtactcctaaggtcaactcagtgacttcacatggcagtaacaaggttgggtcacacacatcccaaccacagtgggtaactgggccttggctggcctgctctcgcacatgcgacacgggctggcacactcgtaccgtccaatgtcaagacggtaaccggaaactggcgaagggatgtcctctgtcacagcgtccaagcgcttttaagcagtgcctcctgaaaaaatgttag

SEQ ID NO: 213453 - DNA, 2577 bp, Artificial Sequence
  Description of Artificial Sequence: Synthetic coding sequence
atggagattctgtggaagaccctgacatggatacttagtctgattatggccagttccgagttccactcggaccaccgactgtcatacagcagtcaagaggaattcctaacgtacctagagcactatcagctcaccatacccataagagtcgatcagaatggcgcttttctgagcttcacagtgaaaaacgataaacactcacggcgacggaggtctatggatcccatagaccctcaacaagccgtttccaagctgtttttcaagctgtctgcgtatggaaaacatttccatctgaatctcaccctgaacacagacttcgtgtccaaacacttcactgtggagtattgggggaaagatggaccgcagtggaaacatgacttcttagacaattgccattatactgggtatcttcaagaccagaggtctacgacaaaggtggcccttagcaactgcgtcggtctgcacggggtcattgcaaccgaagatgaggaatatttcattgaaccattaaaaaatacgacagaggattctaagcatttttcctatgaaaacggacacccccatgttatctacaaaaagagcgctttacagcagagacacctgtacgatcacagtcactgcggcgtctcagactttacgcggtctggcaagccgtggtggttaaatgatacatctactgtaagttattctctgcccattaacaacactcatatacatcatcgacagaaaagaagcgtgagtatcgagcggttcgtggaaacactagttgtggctgataagatgatggtgggctaccacggaaggaaagatatagaacactatatcctgagcgtgatgaatatagttgctaagctctatcgcgacagctcgctggggaacgtggttaacatcatcgtggcccgtctgatcgtgctgaccgaggaccagccaaacttggagatcaatcatcatgcagacaagtctctggactccttttgcaaatggcagaagtctatactgagccaccagtctgacggtaatactattccagagaacggaatcgctcaccacgacaatgcagtcctgataactagatatgatatctgtacctacaaaaataagccttgcggaacattaggattggcaagcgtggctggcatgtgtgagccagaaaggagctgttccattaatgaggacattggtctgggtagcgcgttcacaatcgcccatgagatcgggcacaattttgggatgaaccacgatggcatcgggaactcttgtaggaaggtcatgaagcagcagtatggaagtagccactattgcgagtatcagtcattcttcctggtctgccttcagtctagattgcaccatcagcttagccgcgaggtttgtcgcgaactctggtgtttgagtaaaagcaaccggtgtgtcactaatagcatccctgcagccgagggcactctctgccagacaggcaacatcgagaaaggctggtgttaccagggcgactgcgtgcccttcggcacctggcctcagtctattgacgggggatggggcccttggtctctctggggcgaatgtagcaggacatgtggtggcggagtgagtagtagccttcggcactgcgattccccagctcccagcgggggtggcaaatactgcctgggagagcgcaagaggtacaggtcttgcaacaccgatccatgtcccctcggctcgagagatttccgcgaaaaacagtgtgccgacttcgataacatgccctttcgcggtaaatactacaactggaaaccatatactggaggtggagtgaaaccgtgcgctttgaactgcctagctgaaggttacaatttctacacagaaagagcccctgccgtcatcgacggtactcagtgcaatgccgattccctggacatctgtattaatggagagtgcaaacatgtgggctgcgataacattctggggtccgatgccagggaggacagatgtagggtgtgcggaggggacggaagcacttgcgatgccattgagggatttttcaatgactcactgccccgtggcggatacatggaagtggtgcagattcccagaggaagcgtgcatatcgaggtgcgagaggtcgctatgtcaaaaaactatattgccttgaaatcagagggggatgattattatatcaatggagcatggactatcgactggccacgaaaattcgatgtggcagggaccgcattccattacaagcggcctactgacgagcctgagtcactggaagctttgggcccaactagcgagaatctaatagtaatggtcctccttcaagaacagaacctaggaatcagatataaattcaatgtgcctattactcgtaccgggtctggggacaacgaggttggctttacttggaatcaccagccatggtccgagtgttctgccacgtgcgcaggtggaaaaatgcccactagacagccgacacagagagccaggtggaggaccaaacatatactgtcttatgccttatgtctgctcaagaaactgatcggcaatatcagctgtagattcgcaagttcctgcaaccttgcaaaggagacgctgctgtag

SEQ ID NO: 213454 - DNA, 3354 bp, Artificial Sequence
  Description of Artificial Sequence: Synthetic coding sequence
atggaaatcctctggaaaactctgacttggatattgagcctcatcatggctagctccgaatttcatagcgatcaccgactaagctattccagccaagaagagttcctgacatatctggagcattatcagctgaccatccccatccgggtggatcagaatggcgcatttctcagcttcactgttaagaatgacaagcattcaaggcggcgaagatccatggatcctattgatccgcagcaagctgtctccaagctgtttttcaaattgagcgcctacggaaagcacttccacctcaaccttacgctgaacactgacttcgtgtccaagcactttacagttgaatactggggtaaggatggacctcagtggaagcacgattttttagacaattgccattacacaggatacttgcaggatcaacggtccactaccaaggtggcactgtctaattgcgtgggccttcacggtgtgattgccacagaagacgaggaatacttcatcgagcccttgaaaaacaccaccgaagacagtaagcatttcagctacgaaaacggacatcctcacgtcatctataagaaatccgcactccaacagcgtcatctgtacgatcactctcattgcggggttagtgacttcacacgaagtggaaaaccgtggtggctgaacgacacttcaactgtctcttattccctgcctatcaacaatactcacattcaccacaggcagaagaggtcggtgtccatagagagattcgtcgaaacacttgtggtggccgacaagatgatggtaggctatcatgggcgtaaggacattgaacattacatcctgagtgtcatgaatattgtggccaagttgtacagggatagctctttgggcaacgtggtgaacataattgtcgcacgactgattgtgcttaccgaagaccagcctaatcttgagatcaaccatcatgcggataaaagtctggacagcttctgcaagtggcagaaaagtattctcagtcaccagtctgacggaaatactattcctgaaaatggcattgcccatcacgacaacgcggtcttgatcacccgctacgacatctgtacttacaaaaacaaaccctgtgggacgctgggactggcatccgtggctggtatgtgcgagccagaaaggtcgtgcagtattaatgaagatattggactaggaagcgccttcacaattgctcacgaaatagggcataattttgggatgaaccacgacggcatcggcaactcctgcggtacaaaggggcacgaggctgcaaagcttatggctgcccatataacggctaataccaatcccttttcatggtccgcctgcagtagagactatatcacaagcttcctagacagcggacggggaacctgccttgataatgagccgccaaagcgcgacttcttgtaccccgcagtggcccctggccaggtgtatgacgccgacgaacagtgtaggtttcaatacggagccactagtcggcaatgcaagtacggcgaggtgtgtagggaactgtggtgtctttctaagtccaaccgatgcgtaactaactccatcccagccgcagaagggactctgtgccagacggggaacatcgagaagggctggtgctaccaaggagactgtgtcccttttggaacgtggccccagtcaattgacggaggatggggaccctggtccttgtggggagagtgcagtaggacctgtggtggtggcgtctcatcaagtctgagacattgtgactcccctgcgcctagcgggggagggaagtactgcctcggcgagcgtaaacggtacagatcctgcaacacagatccttgtcctttggggagtcgggattttagggagaaacaatgtgccgatttcgacaacatgcccttccgcggtaagtactacaactggaagccttacacaggtggtggggttaaaccttgcgctcttaattgtctggcagagggctacaatttctatacagagcgagcacctgccgtgatcgatgggactcaatgtaacgcagattctctcgacatctgtataaacggagaatgcaagcatgtaggctgcgataatatcctggggagcgatgcaagggaggaccgctgcagggtgtgcggcggagacgggagtacctgcgatgccatcgagggtttttttaatgacagcttgccccgtggaggatacatggaggtggtccagatcccaaggggctctgtacacatcgaggtgagagaagtggcgatgtctaagaactatattgctctcaaatctgagggtgatgattactatattaatggcgcttggactatcgactggccacggaagttcgacgtcgccggtaccgcttttcactacaagcggccaaccgatgagcctgagtcactggaggccctgggcccaacttccgagaacttgatcgtcatggtcctgctccaggaacaaaacttggggatccggtataagttcaatgtgccaattaccaggactggcagtggcgacaatgaagtgggctttacatggaaccaccagccctggtcggagtgtagcgccacatgtgccggaggcgtgcagaggcaggaggtggtgtgtaagcgactggatgataattcaattgtgcaaaacaattattgcgaccctgacagtaaacctcctgaaaaccagcgcgcatgcaatactgagccatgccccccagagtggtttattggggactggctggagtgcagcaaaacatgtgatggcggaatgcgcacccgagccgtgttatgcatccgcaaaatagggccttctgaagaggagacccttgactactcaggatgcctgacccaccggccagtcgagaaggaaccctgcaacaatcagagttgtcccccacagtgggtcgccctcgattggtccgagtgcacgcccaagtgcggaccaggatttaagcaccggatcgtgctgtgcaagtcatctgacctgagtaagaccttccccgctgcccagtgccccgaggagtctaagccgccagtcagaataaggtgctccttggggaggtgtccacctccccgatgggtgactggagattggggacagtgctcagcacaatgcggcctcggacaacagatgcgaactgtccagtgcttgtcttatacaggtcaggcatctagcgattgcctggagacggtgcgaccacccagtatgcaacaatgtgaaagcaaatgtgactccactcccatcagcaacacagaggaatgcaaggacgtgaacaaagtcgcctattgtcctcttgtgctgaagttcaagttctgttctagggcttattttcggcaaatgtgttgcaaaacctgccagggccattag

SEQ ID NO: 213455 - DNA, 1407 bp, Artificial Sequence
  Description of Artificial Sequence: Synthetic coding sequence
atggagatcttgtggaaaactctgacatggatcttatctcttattatggcctcttctgaattccactctgaccatagattgtcctactcatctcaagaggaattcttaacctatcttgagcactatcaattgactatcccaatacgcgtggatcagaatggtgcgttcctctctttcacagttaagaacgataaacatagccggcgtaggagaagcatggaccccatcgacccacagcaggctgtgtccaaactgtttttcaaactatctgcatacggcaaacactttcacctaaatctgacccttaatacagacttcgtttccaaacacttcactgtggaatattggggtaaagacggtccccagtggaaacacgacttcctggataattgccactataccggttatcttcaggaccagagatccacaaccaaggtagctctttccaattgcgtgggtctacacggagtgatcgcaacggaagacgaagagtacttcatagagccacttaaaaatacaactgaggactctaaacattttagctacgagaatggccacccccacgtgatctacaaaaagtctgccctgcaacagcgacacttgtatgaccattcacactgtggagtgagtgattttacacgatcaggtaaaccatggtggctgaacgacacgtccaccgtgtcatactccctacccattaacaacactcacatccaccataggcagaagagaagtgtttccatcgagaggtttgtggagacacttgttgtagccgataagatgatggtgggataccacggtcgcaaggatatcgagcattatatccttagtgtgatgaatattgtcgccaagctttaccgcgattcctcgttggggaatgtagtgaacattattgtggctcgcctgattgtgctgaccgaagaccagccaaacctggagatcaaccatcatgccgataagagcctcgatagtttctgtaaatggcagaaatccatcctgtcccaccaatccgatgggaatacaattccagagaatggaatagctcatcacgacaatgcggtcctgattacccggtacgacatttgcacttataaaaacaaaccctgcggaaccctgggcttggcaagtgtggccggaatgtgtgagccggagagatcttgcagcatcaatgaagatataggactcggttctgcgttcaccatcgcacacgaaatcggccacaattttggaatgaatcacgatgggattggaaactcatgcgggacaaaaggtcacgaagcagccaaactgatggccgctcatataactgctaatacaaacccattttcttggagcgcctgcagccgagactacatcacaagttttttagagtttctcaagttgggcgatagcatctctgggtcttag

SEQ ID NO: 213456 - DNA, 5061 bp, Artificial Sequence
  Description of Artificial Sequence: Synthetic coding sequence
atgcctggtggcccaagtccaaggtcgcccgcaccgttgctgagaccgttattgctgctcctttgtgctttggcccctggggctccgggtccggcaccagggcgtgctacagagggcagggcagcgctggatatagtacatccagtgcgggttgacgcaggagggtccttcctatcttatgagctgtggccacgtgctttaaggaagcgcgatgtgtccgtgcggagggacgcccctgccttttacgagctccagtaccgcggaagagagctccggtttaacctgaccgctaatcagcacttgttggcacccggatttgtctccgagacccgaaggcgaggcggactcgggagagcacacataagggcccacactcccgcttgccatctcctaggagaagtgcaggacccagagctggagggtggcctggctgcaatcagcgcctgcgatggcctgaagggggtgtttcagctctcaaatgaggactattttatcgaacctcttgatagtgccccagcccgtcccggacatgcacagccccacgtcgtttataagcgtcaagccccagaacgactagcccagagaggcgattcatccgctccttccacctgcggcgttcaagtgtaccctgaactggagagcagacgggagcggtgggaacagcgccagcaatggagacggcctaggctgcgtcgtctccaccagcgctcagtgagcaaggaaaagtgggttgaaacgctggtagtggcggacgcgaagatggttgagtaccatggccagccccaggttgagtcctatgtattgaccattatgaatatggtggccggtttgttccatgacccatccatcggtaatcctatccatatcaccatcgtccggctggttctgctagaggacgaagaagaggacctgaaaatcactcaccacgccgataacacactgaaatctttctgcaaatggcagaagtcaataaatatgaagggtgacgcacaccccctccatcacgacacagccatcctgctcaccagaaaggacttatgtgctgctatgaacaggccttgcgagacgctgggcctgagccatgtcgccggaatgtgccaaccccaccggagctgttcaatcaatgaggacactggactgcctttagccttcaccgtggcacatgagctggggcatagtttcggcatccaacacgacgggagcggaaacgactgcgagccggtcgggaaaaggccctttattatgagcccacagctgttgtacgacgccgcacccctcacttggtcccgatgtagccgacaatacataactcggttcctagatcggggttgggggttatgtcttgacgaccctcccgcaaaggatattatcgattttcctagcgttcctccgggagtgctatacgacgtcagtcaccaatgtcgcctgcagtatggtgcttacagtgctttctgcgaggatatggacaacgtgtgccatacactatggtgtagtgtaggcacaacgtgccatagtaagctcgacgccgcagtggatgggaccagatgcggagaaaacaagtggtgcctctccggagaatgcgttcccgtgggcttccgcccagaagctgtggatggaggctggagtggatggtctgcctggtccatttgttcgcgctcttgcggaatgggcgtgcagtctgcggagagacagtgcacccagcctactcccaaatataaagggcgatattgcgttggcgaacgaaaacggttccgtttatgtaaccttcaggcctgtcccgcaggccgaccctcgtttcgacacgtccagtgcagccatttcgacgctatgctctataagggacagctacatacatgggtgcccgtggtcaacgatgttaacccttgtgagcttcactgcaggcccgcaaatgaatactttgctgagaagctccgggacgcagtggtagacggcacaccgtgttatcaggtcagagcgtctcgagatttgtgcattaacggaatttgtaagaacgtgggctgcgacttcgagatcgattcaggcgctatggaagaccgctgcggcgtgtgtcacggtaacggcagcacttgccataccgtctctggaacctttgaggaagcagaggggttgggttacgtcgacgtgggcctgattccagccggtgcgagagaaatccggatacaggaggtcgcggaggctgctaacttcttggcccttcgcagcgaggacccagagaagtactttctgaacgggggatggaccatccagtggaacggagattaccaggtggcagggactacatttacgtatgctaggaggggcaactgggagaatctgacttctccgggaccaactaaggaacccgtgtggatacagctgctttttcaggagtcaaacccaggggtccactatgagtacaccatacatagagaggcaggtggccacgatgaggtacccccacccgtgttctcctggcattacggaccgtggaccaagtgtacagtgacctgcggcagaggggtgcagagacagaacgtctactgccttgaacggcaggcagggccagtagacgaggaacactgcgaccctctggggagacccgatgatcagcagagaaaatgctccgaacagccatgccctgcaaggtggtgggcgggagagtggcagctgtgtagctcctcttgcggtcccggtggcctttcaaggcgcgcagtcctgtgcattaggagcgttggattagatgaacagagtgcactggagccacccgcttgcgagcatctgccaagacccccaaccgagacaccctgtaacaggcacgttccatgtcctgccacatgggctgtgggcaactggtctcaatgctctgtcacttgcggggagggaacccagagacggaacgtactgtgcacaaacgatacaggcgtcccttgtgacgaggcacagcagcccgctagcgaggtgacctgttcactccctctgtgtcgctggcccttgggcaccctgggtcccgaaggttctggcagcgggtcaagttcgcatgagttgttcaatgaagccgactttataccgcaccacttggccccaaggccttctcccgctagtagccctaaaccaggcaccatgggaaatgctatcgaggaggaagcaccagagcttgacctaccagggccagtattcgtggatgacttttactatgattataattttattaatttccatgaagacctgtcctacgggccaagcgaggagccagacctggacctggccggaaccggcgatcggacccctccccctcactcccaccccgctgcgccatcaaccggaagccctgtaccagccactgaaccccctgccgcaaaagaagaaggggtattaggaccttggtctccctctccctggcccagccaggccggacgatcccccccaccaccctctgaacagacaccaggaaaccctctgatcaatttcctgcccgaagaagacactcctatcggcgctcctgatctaggcctcccatcgctgagctggcctagggtctccactgacgggctccaaaccccagccactcctgaatcgcagaatgatttccccgtgggcaaagacagccagagtcaactgccgcctccctggagagatcgaactaatgaagtcttcaaagacgacgaggaacccaaggggaggggagcgccacatctgccgcctcgcccttccagcactctgccgccattgtcacctgttgggtccacccatagtagtccatctcccgatgtcgccgagctgtggaccggcggaacagttgcttgggagcctgccctcgaagggggtttgggccctgtcgacagcgagttgtggcctacagtgggggtcgcttctcttctgccccctcccatcgcccctcttccggaaatgaaagtccgtgattccagtctggaacctggcaccccctcttttcctactcccggaccgggaagttgggacttacagactgtggctgtgtggggtacatttcttcctactacgctgaccgggttgggtcatatgcctgaaccagccctgaaccccggaccaaaagggcagcccgagagcctgtcccctgaagtgccactgtccagcagactgctgtctacccctgcttgggattcccctgctaatagtcaccgcgttcccgagacccaaccactggccccttccctggcagaagccggtccacctgcagatcctctggttgtccgcaatgctggctggcaggccggtaactggagtgagtgttccaccacatgtggactcggagccgtgtggcggccagttcggtgctcaagtggtcgcgatgaggactgtgcccctgctggacgcccacagccagctagacgatgtcatcttaggccgtgcgccacctggcactctggcaattggagtaagtgttctcgctcatgcgggggaggctcttccgtgcgcgatgtgcagtgcgtggacaccagggacttgaggcctctgcggcctttccattgtcaaccaggacccgctaaacctccagcgcatcgcccttgtggcgctcagccttgcctgagctggtacacaagctcttggagagagtgcagcgaggcatgcggaggcggtgaacagcaacggctggtgacctgtcctgagccgggactttgtgaggaggctctccgacctaacaccacacgtccctgtaacacgcatccgtgtactcagtgggtcgttggcccttggggtcaatgctcaggcccttgtggcggtggcgtgcaacgtcgcctggttaagtgcgtcaatacacaaacaggtctacccgaagaggactccgaccaatgcggtcatgaagcatggcctgagtctagtagaccatgtgggacagaggattgcgagcccgtggagcctcccagatgtgagcgggatcgcctaagcttcggattttgtgaaacgctgcggcttttagggcgttgtcagctcccgacaatccgcacccagtgctgccgttcgtgctcacctccctcccatggcgcaccttctcgaggacaccagagagtggcaaggaggtag

SEQ ID NO: 213457 - DNA, 1383 bp, Artificial Sequence
  Description of Artificial Sequence: Synthetic coding sequence
atgccaggcggaccttccccacgctcccctgctcctctgctacggcctctattgctgctgttgtgcgcccttgcccctggtgccccaggacccgcacccggacgcgctacggaaggcagggcagctctggacattgtgcatcctgtgcgggtggatgccggagggagcttcctctcctatgaactgtggccgagagcactgcgaaaaagggatgtgtccgtgagaagggatgctcctgctttttacgagctgcagtacagaggtagggagttacggttcaatctgacagcaaaccagcacttactggcacctgggtttgtgtctgagactagacgaaggggaggactcggcagggcccacattagggcccacacccctgcatgccacctgctgggagaggtgcaggatccagaactggaagggggtctcgctgccatttccgcttgcgacggccttaagggagtgttccaattatcaaacgaggactattttattgaacccctcgactcagcccctgctcgtcctggccacgcccaaccgcatgtggtgtataagcgacaggcccctgagagactggctcagagaggagatagctcagctccttctacatgtggcgttcaggtgtaccccgagctggaaagccgcagagagcgctgggaacagcgacaacagtggagaagaccacgattgcgaaggctgcatcagcggagcgtgtccaaagaaaaatgggtggaaaccctcgtggtggccgatgcaaaaatggttgagtaccatggacagccccaagtagagagctacgtgctcacaatcatgaacatggtggcaggtctttttcacgaccctagcatcgggaaccccattcacattactatcgtgaggttagtgctattggaggacgaagaggaggacttgaaaatcacgcaccacgctgataataccttaaaatccttttgcaaatggcagaagtccatcaacatgaagggagacgcccacccactgcaccacgacacagccattctccttacaaggaaggacctgtgcgcagcgatgaatcgcccatgtgagacattgggactgagtcacgtagctgggatgtgccagccccatcggtcttgcagtattaacgaagacacaggtctccccttggcgtttactgtggctcatgagctgggccatagctcttgtactacacccctacctagtcccggtcccgctgccgcagcatcaataagtcccggaagtctttccgtgcaacggcagaatgtttactgcctggagcgacaggccggtcccgtggacgaagagcattgtgatccccttggcaggccagacgatcaacaacgaaaatgttctgagcagccctgcccagcaagcgcccagtag

SEQ ID NO: 213458 - DNA, 2670 bp, Artificial Sequence
  Description of Artificial Sequence: Synthetic coding sequence
atgctgccagctcctgcggcacctcgatggcctcctctcctgcttttactgcttctactgttgccgctggcaagaggtgctccagctaggcccgcagctggcggtcaggcttccgagctcgtcgtgccaaccaggctccccggaagcgccggagaactggcgctgcacctcagtgcctttggcaaggggtttgtgcttaggttggcacctgacgattcattcctggccccagagtttaaaatagagcggctgggaggatctggccgagcaactggcggtgagagagggcttagaggatgtttcttttccggcactgtgaatggggagcccgaaagtctcgcagcagtgtctctgtgcagggggctctcaggaagtttcctgcttgatggagaggagtttacaatccagcctcaaggtgctggaggttcactggcgcagccccacagattgcagagatggggccctgccggtgccagacccctgcccagaggcccagagtgggaggtggagaccggagagggtcagcgccaggagcgcggagatcatcaggaggattctgaggaagagtcacaggaggaggaagctgagggcgcatcggaaccccctccccctttaggcgctactagccggaccaagaggtttgttagtgaagccaggttcgttgagacactcctggtggctgatgcttcaatggcagctttttacggcgctgacctgcaaaaccatatcttaactttgatgtcggttgcggctagaatttacaagcacccttcaattaaaaattctatcaatctgatggtcgtcaaggttctgatagtggaggacgaaaaatgggggccagaggtgagcgacaacggtggcctgactctgcgcaacttctgcaattggcagagaagatttaaccaaccctccgatcggcacccggagcattacgatactgctatattgctcaccaggcagaacttctgtgggcaggaaggcctgtgtgatacactgggcgtggccgatatcggtacaatttgcgatcctaacaaatcttgcagcgtcattgaggatgagggcctgcaagcggctcacacacttgctcacgaactcgggcatgtgctgtccatgccgcacgacgatagcaagccatgcacacgcctgttcggcccaatggggaagcaccatgtgatggctccgttatttgtccacctgaatcagaccctcccctggtccccttgttctgcaatgtatttgacagaacttctggacggtggccatggagactgtctgctcgatgccccagcggctgccctcccccttccaacaggccttcccggacgcatggctttgtaccagctagaccaacagtgtcgccagattttcgggcctgactttaggcattgccctaacacatcagcgcaggatgtctgtgcccagctgtggtgccacactgatggggctgagcccctctgtcacaccaagaacggatccctgccgtgggcggacggcactccgtgcgggcctggtcacctgtgttctgaaggcagctgccttcccgaagaagaagtggagagaccaaaaccagtggcagacggtgggtgggcaccgtgggggccttggggagaatgttcgcggacatgtggcggtggagtgcagtttagccacagggagtgcaaagatcccgagcctcaaaacgggggacgttactgtctcggtaggagagcaaagtaccagagctgtcatactgaggaatgtccccctgatggtaagagtttcagagagcagcagtgcgaaaaatataacgcctacaactatacggatatggacggcaatctcctgcaatgggtgcccaagtacgccggtgtgtccccacgggatcggtgcaagcttttctgtagggcacgcggaaggagtgaatttaaagtgttcgaagcgaaagtgatcgacggaacgctgtgtgggccagagactctggcgatttgtgttagaggtcaatgtgtgaaagctggatgcgaccatgtggtggattcccccagaaagctggataagtgtggagtctgtggcggtaaaggaaacagttgccgcaaagtttccggctccctgaccccaaccaactacgggtacaacgacattgtgaccattccggcaggagctaccaacatagacgtgaagcaaaggtcacatcctggcgtgcagaatgatggcaactacttggctctgaagacggccgatggccagtatctcttgaatggtaatctggctatcagtgccatcgaacaggacatcttagtcaaaggtaccattctgaagtactctggaagcatcgccaccttggaaaggctccagagttttcgtcctctccccgagcccctcacggtgcaattgctgaccgtccccggagaggttttccctcccaaggtaaagtatacatttttcgtgccgaacgacgtggatttttctatgcagagtagcaaggaaagggccaccaccaatattatccagcccctcctccatgcccagtgggtgttaggtgattggagcgaatgttcatcaacttgcggggctgggtggcagcgacgaaccgtcgaatgcagggacccaagcgggcaggcaagcgcgacatgcaacaaagcgttaaaacctgaagacgccaaaccttgcgaatcccagctatgtcctttgtag

SEQ ID NO: 213459 - DNA, 2757 bp, Artificial Sequence
  Description of Artificial Sequence: Synthetic coding sequence
gccgctagagctcgtctgggaggcggtggcgctggcggagccggatgtgctagtcagagaggcagacgcggaagcgctcccgcagctggcccacgaggcccatccagaccctgtaccagattgattcctttatttctggaacgggctgccggaccacgctcaggaaggcagcaccttcctgcccctgggggattgctgccaagcccggcacgcagccatcgacgatcacctcacgcgcctcgcccacggcgacctcctgtggcctccgcacccgcagctgcggcagccgctgccgcagccggtcctcggaggccaggacctgcccgtagccgcggagccggactgggagctggcggagcccacgctgttgccaggctgcggggttgcttcttctccggcaccgtgaatggggaaccagaatccttagcggctgtaagcctatgtaggggattatccggcagcttccttctagatggggaagagttcaccatccagccacaaggcgcaggcggtagtctcgctcagccccatcgtctgcaaaggtggggtccagcaggcgctaggccactgcccagaggccctgaatgggaggttgagactggtgagggccagagacaggagcggggtgatcatcaggaggatagcgaggaggagtcccaggaggaagaagccgagggggctagcgagcctcctcccccattgggggcaacctcacggaccaagaggttcgtatccgaagctcgctttgttgagaccctgctcgtggccgacgcaagcatggctgccttctacggcgctgacctgcagaatcacattctcactctgatgtccgttgcagccagaatctataaacatccttctataaagaattccattaacttaatggtcgtgaaagttctgatcgtggaagacgagaaatggggcccagaggtcagtgacaacggcggactgacactgaggaatttctgtaattggcagcgaaggttcaatcagccgagcgatcggcaccccgagcattacgacacagcgatcctgctcacgaggcagaatttttgcggacaggagggtttgtgtgatacattgggagtggccgatattggcacaatctgcgatcccaacaaatcctgcagcgtgattgaggacgagggcttgcaggccgcacataccctggcacacgagctgggtcacgtcctgtcaatgccacacgacgactctaagccttgcacaaggctctttggtccgatgggtaagcaccacgtcatggcacccctatttgtacacttaaatcagaccctgccctggtccccctgttccgccatgtacctcaccgagctattggacggaggccacggtgactgcctgttggatgctccggctgcggctctcccactccccactggactccccggtcggatggctctctaccagctggatcagcagtgtcgtcaaatttttggccctgacttcaggcactgccctaacacatcagcacaggacgtttgcgcacagctttggtgtcacactgatggggcagagcctctgtgtcacacaaagaacggctcccttccatgggccgatgggacaccatgcgggcctggccacttatgtagtgaaggctcctgcctacccgaagaagaggtggagaggcccaagccagtggctgatggtggttgggcaccgtgggggccatggggcgagtgttcaaggacttgtgggggaggggtccagttcagccaccgggaatgcaaagatccagagccccagaacgggggtcgatattgcctcggtaggcgcgctaagtatcagtcttgtcacactgaggaatgtcctcccgacggcaaatcatttcgagaacaacagtgcgagaaatacaacgcgtataactatacagacatggatggcaatctgctacaatgggtgcccaagtacgccggtgtgtctcccagggatcgctgtaaacttttctgcagggctagagggagaagtgaattcaaagtgtttgaggccaaggtcatcgacgggactctgtgcggcccagaaacacttgcaatatgtgtcaggggccaatgcgtgaaggccggatgtgatcatgtggtggattcacctaggaagctcgataagtgcggggtctgcggcggaaagggcaactcctgcaggaaagtgagtgggtcgttgactcccaccaactatggctacaatgatatcgttaccatcccagccggtgccacgaacattgacgtgaaacagcgctcacaccctggcgtgcagaacgacggcaattatctggctctgaaaactgccgacggccaatacctgctgaatggcaatcttgccatctccgctattgagcaggatatccttgtgaaaggaaccatcctgaagtattccggctcgattgctacactcgagaggctccagtccttcaggccgctccccgagccactgaccgttcaactgctcacagtacctggagaagtgttcccgcctaaggttaagtacaccttcttcgtgcccaacgatgtagacttttccatgcagtctagtaaagaaagagcaactactaacatcatacagcctctattgcacgctcaatgggtcctgggagactggagcgaatgttcatctacatgtggcgcaggatggcagcgtcgtacggtagaatgccgcgacccatccggacaagcttctgctacatgcaacaaggccctcaaaccggaggatgctaagccgtgtgaatctcagttgtgccctctctag

SEQ ID NO: 213460 - DNA, 5724 bp, Artificial Sequence
  Description of Artificial Sequence: Synthetic coding sequence
atgcaatttgtctcctgggccaccctgctcacgcttctggtgcgtgacttggctgagatggggtccccagatgctgcagccgctgtgagaaaagatcgtctccacccccgacaggtcaagctgttggaaactctcagtgagtatgagattgtgagtcccattagggtgaacgctcttggggaacccttcccaaccaacgtacatttcaagaggaccaggagaagtatcaacagcgccacagatccgtggcctgcttttgcatcttcatcttcaagctctacgagctcacaggcacactataggttgagtgcctttgggcagcagttcttattcaatttgacagccaacgcagggttcatcgcccctctcttcaccgtgacattactggggactcccggagtcaaccaaactaagttctactccgaagaagaagctgaattgaagcactgtttttacaaaggctacgttaataccaactcagaacataccgccgtaatcagcctttgttccgggatgttagggacattccgttcacacgacggggattatttcatagagcctctacaaagtatggacgagcaggaggacgaagaagaacagaataaaccccatataatctaccggaggtccgcaccgcagcgcgaaccttccaccggtcggcatgcttgcgatacctcagagcacaagaacaggcacagtaaggacaaaaagaagacgagggctaggaaatggggagagcgcatcaatctggctggtgacgtcgccgctttgaatagcgggttggctaccgaggcattttctgcatatggcaataaaactgacaacactcgtgagaagcgtactcaccgcaggactaagcggttcctttcctatccgcgttttgtcgaggtactggtggttgctgataaccgaatggtgtcatatcatggagagaatcttcagcattacatcctgacgctcatgtcaatcgacggcccaagcatttccttcaacgcccagaccactcttaaaaacttctgccagtggcagcatagcaaaaatagccccggaggtattcatcatgatacagccgtcctgttgacacgccaggacatctgcagggctcatgataaatgtgacactctcggcctcgccgagcttgggaccatttgcgacccttacagaagctgttccatctcagaggactcaggcctctctactgctttcacaatcgcacatgaactgggacacgtgttcaatatgccgcacgacgacaacaataagtgtaaggaagagggcgtgaaatccccccagcacgttatggcacctaccttgaacttctacactaatccttggatgtggtcaaaatgctcaaggaaatatatcacagaatttttggacactggctatggtgaatgcctgctgaatgagccagagagtcggccatatcccttacctgtacagctgcctggaattctttacaacgtgaataaacagtgcgaactgatttttggaccaggatcgcaagtttgcccctacatgatgcaatgccggcgtctgtggtgtaataatgtgaatggggtgcacaagggatgtagaacacagcacaccccctgggcggacggtacagagtgcgagcccggaaagcattgtaagtacgggttctgtgtccctaaagaaatggacgttcctgtgacggatggaagctgggggtcttggtctccattcgggacctgttcccggacctgcggtggcggaatcaagactgcgattcgtgagtgcaaccgaccggagccaaagaacggagggaaatattgtgtggggagaagaatgaaatttaaatcgtgcaacaccgaaccgtgcctcaagcagaaacgggattttagagacgaacaatgtgcccacttcgatggtaagcactttaatatcaatggcctgctcccaaatgtgcgctgggtgccaaaatattcaggaatcctaatgaaggacaggtgcaaactgttctgtcgagtggcagggaacacggcctactaccaactgagggacagagtgatcgatggaacaccctgcggtcaggacactaacgacatttgcgtccagggtctgtgtagacaggctgggtgtgatcacgtgcttaattctaaggcgagacgtgacaagtgcggggtgtgcgggggagacaactcttcctgcaaaacagtagcaggcacattcaacactgtgcactacggatacaacactgtggttagaattcctgctggggcaactaacatcgacgtcaggcagcactctttctctggtgagacggatgacgataactatctcgccttatcatcctccaaaggagaattcctgttaaacggaaatttcgttgtcaccatggcaaaacgcgaaatccggatcggtaacgcagtggtcgagtattcggggagcgagacagctgtggagaggatcaattcaacagaccgtatcgaacaggagttgctcctgcaagtgctgtcagtgggtaagctttacaaccccgacgtgcgttatagcttcaacatacccatagaggataaacctcaacagttctactggaattcccatggcccatggcaggcttgttccaagccatgccaaggtgagaggaagcggaaacttgtttgtacccgcgaatccgaccagttaactgtcagtgatcagcgatgtgatagattgccacaacctgggcacatcacagagccttgcggaaccgactgtgacctgcgatggcatgtagcatcaagatcagaatgtagtgcccagtgcggccttggttaccgcacattagacatttactgtgcgaagtattccaggttggatggaaagactgagaaggtggatgatggtttctgtagcagccatccgaaaccctcgaatagagagaaatgctctggcgagtgtaacacaggcggatggaggtattccgcttggaccgagtgtagtaagtcatgcgatggcggaactcagaggcgccgagcgatctgtgtcaacacgcgaaatgatgtgctggacgattcgaagtgcacgcaccaggagaaggtgacaatacagagatgctcagagtttccgtgcccccagtggaagagcggggattggtctgaatgcctggtgacttgcgggaagggacacaagcaccgccaggtttggtgtcagttcggcgaagaccgcctcaatgaccgcatgtgcgaccccgagactaaacctaccagtatgcagacttgccagcagcctgagtgcgcctcctggcaagctggaccatggggccaatgttcagtaacctgcggccagggctatcaactgagagctgttaaatgcatcatcgggacatacatgtcagttgtcgacgacaatgattgtaatgcagctaccaggccaactgatacgcaggattgtgaactgccgtcgtgtcacccaccacccgcagccccagaaacgaggcgcagtacctatagtgcccctcgaacacagtggagattcgggtcttggactccctgtagcgccacttgcggcaaaggtacacggatgcgttatgtgtcctgtagagatgagaatggatctgtggccgatgagtccgcgtgtgctactctgcctcgtcccgtggccaaggaggagtgttccgtgactccctgcggacagtggaaggcactggactggagctcgtgctctgtaacctgcggccagggccgtgctactcgccaggtcatgtgtgtgaactactctgatcatgtaatcgacagatcagagtgcgaccaggactatatccctgaaaccgaccaggattgttctatgtccccctgtccacagcgaacccccgattccgggttagcacagcatccttttcaaaatgaagattacagaccacgcagcgcttcaccctcacggactcacgtgttggggggaaatcagtggcgaactgggccttggggggcatgtagttctacttgtgccggaggctcccagcggagagtcgttgtgtgccaagatgagaatggatatactgcaaatgactgcgtcgaacggatcaagcctgacgaacaaagagcttgcgagagtggaccatgcccccaatgggcctatggaaactggggagagtgcaccaaactctgcggaggagggatacgtaccagactagtggtgtgccagaggagcaacggagaacgattccctgacctgagctgcgaaatcctcgataagccacccgaccgagagcagtgtaacacgcatgcatgtccccacgatgcagcatggtcgaccggcccttggagcagttgctctgtgtcttgtggtcgcggtcataagcagaggaatgtttactgtatggcgaaagatggatctcacttagaaagtgattactgtaaacatctcgccaaaccccacggtcacagaaagtgtcggggaggaagatgtccaaagtggaaagcaggcgcatggtcccagtgcagtgtttcatgcgggcgaggggtacagcagaggcacgtcgggtgtcaaatcggcacgcataaaatcgctagagagactgagtgcaacccctatactaggccagaatccgaaagagattgccaaggccctcggtgtcctttatacacatggagagccgaagaatggcaggaatgcactaaaacttgtggagagggcagtaggtatcgaaaggtcgtgtgtgtagacgataataagaacgaggtccacggggctaggtgcgatgtttcaaaacggcctgtggaccgggaatcttgtagtctgcagccctgcgagtacgtttggatcactggtgaatggtctgagtgcagtgtgacatgtggcaagggctacaaacagcggctcgtgagctgcagcgagatctataccggcaaggagaactacgagtattcctaccagacgactatcaattgtccaggcacacagccaccttctgtgcacccctgctatctgagagactgtcccgtgtccgcgacatggagagttggaaattgggggagctgcagtgtttcctgtggggtcggggtgatgcaaaggtctgtgcaatgtctcactaacgaagatcagccatcccacctctgtcatacggacctgaaacctgaggagagaaagacctgcagaaatgtgtacaactgcgagctgccccagaattgcaaggaagtgaaaagactgaaaggagcctctgaggatggggagtactttctcatgatacggggaaagctgctgaagatcttctgcgctggcatgcatagcgatcatcccaaggagtacgtgacgctggtgcatggggattctgaaaactttagtgaggtgtatggacacaggttgcacaatcccacggagtgtccttataatggtagcagacgggacgactgtcagtgcagaaaggactacacagcggcaggattttcctcattccagaagattcgtattgatctgacatccatgcaaatcataaccactgatttacagtttgccagaacctcagaaggccacccagtgccatttgccactgcgggagactgctactccgctgcgaaatgcccccaggggcgattctcaatcaatctctatgggaccggtctcagccttacagaatccgctcgctggatctcgcagggaaactatgctgtaagtgatatcaagaaatcccctgacggcactagggtagtcggaaaatgtggtggatattgtggcaaatgcacaccctccagcggcactggattggaagtgcgtgtgctctag

SEQ ID NO: 213461 - DNA, 2976 bp, Artificial Sequence
  Description of Artificial Sequence: Synthetic coding sequence
taggaatgttctgcacaatgcgggttgggctatcgaactctcgatatatattgcgccaagtactcccggctggacggtaagacggagaaggtggacgatggcttctgctcatctcatccaaagccatctaacagagaaaagtgttccggggaatgtaacacaggcggatggaggtacagtgcctggactgagtgctctaaatcttgcgacggagggactcagagaaggagggccatatgcgtgaatactagaaatgatgtgctcgacgattccaagtgtacccaccaggagaaggtgaccattcaaagatgctcagaattcccttgcccacagtggaaatcaggtgattggagtgaatgtctagttacgtgcgggaaaggacacaaacacaggcaggtatggtgtcagttcggagaagaccgcctgaacgataggatgtgcgatcctgaaactaagccaacctcgatgcagacgtgccagcagcctgaatgcgcaagttggcaggccggaccatggggccagtgttctgtcacttgcgggcagggttaccagcttagggccgtcaaatgtatcattggtacgtacatgtcggtggttgatgataacgattgcaacgctgccactaggcctacagacacccaggattgcgagctgccttcatgccatccgccacccgctgcccctgaaacccgcagaagtacctacagcgcaccccgaacacagtggaggttcggtagttggacaccttgctctgccacttgtggcaagggcactcgcatgcgatatgtctcttgccgagacgagaatgggagtgtcgctgatgagtccgcttgtgcgacactccctaggcctgtggctaaggaggaatgttcggtcactccttgcggacagtggaaggcgttagattggagctcatgtagcgtgacgtgcggccaaggccgtgctacacgccaggtaatgtgcgtgaactatagtgatcacgttatcgaccgttctgaatgcgatcaagactatattcccgagaccgaccaagactgtagcatgagcccgtgtcctcagcgtacccctgattcaggattggctcagcatccctttcagaacgaagattacagaccgagaagcgcttcaccttcaagaacacacgtgttaggcggaaatcagtggcgaacaggcccatggggcgcatgtagctcgacttgtgccggtggttcacagcggagggtggttgtctgtcaggatgaaaacggttataccgccaatgattgcgtggaacggataaagcccgacgagcagcgagcgtgcgaatctgggccttgccctcagtgggcgtacgggaactggggggaatgtaccaaactgtgcggtggaggtattcggacccgacttgtggtgtgtcagcgatcaaatggtgaaaggttccctgatctgtcctgtgagatccttgataagcccccagaccgcgagcagtgcaacacccatgcctgccctcacgatgctgcttggtctaccggtccttggtcttcttgcagcgtgtcttgcggcagaggccacaaacagaggaacgtctactgcatggctaaggatgggagccacctggaatccgattattgtaagcacttggctaagcctcatgggcacagaaaatgtagaggaggtcgatgtccaaaatggaaggcaggtgcatggtctcaatgtagtgtgagttgcggtcgaggcgtccagcagcggcatgttggatgtcagatcggaacacataaaatcgcacgcgagactgagtgcaacccctatacccggcctgagagtgagagagactgtcagggacctcggtgccccctctatacctggagggcagaggagtggcaggaatgtacaaaaacctgtggcgagggatcaaggtataggaaggtagtttgtgtggatgacaacaaaaacgaagtgcacggggcaagatgcgacgtctctaaacgccctgtggaccgcgaaagctgtagtcttcaaccttgtgaatatgtgtggattaccggagaatggtccgagtgttccgtcacctgtggtaagggttacaaacagagactcgtcagctgctccgaaatctataccgggaaggaaaattatgaatactcatatcagactacaatcaattgccccggaacccaaccacccagtgtgcatccttgttatctaagggattgccctgtgagcgccacatggcgcgtaggtaactggggcagttgttcagtatcatgtggagtgggcgttatgcagaggtccgttcaatgtctcaccaatgaagaccaaccctctcacctgtgccacacagaccttaagcccgaggagagaaagacatgtcggaacgtctataattgtgaactccctcagaactgtaaggaagtcaagaggttgaaaggcgcttcagaggatggtgaatattttctaatgattcggggaaaactcctaaaaatattttgcgccggtatgcatagtgaccatccaaaagagtatgtaactctggttcacggcgacagcgagaacttcagcgaggtctacggccataggctgcataaccctacggaatgcccctacaacggatcacgcagggatgactgtcagtgccggaaggactacacagcagctggatttagctctttccagaagattagaattgacctgactagtatgcagattataacaacagaccttcagttcgctaggaccagcgagggccaccccgtgccttttgccacagctggggactgctattcagccgctaaatgcccccagggaaggttttctatcaacctttatgggacaggcctgtctctcacagagtcagctcgctggattagtcaaggcaattacgcggtaagcgacatcaaaaagtcccccgacggaacaagggtagttggcaaatgcgggggatactgtggcaaatgcacgccaagcagcggtacaggtctcgaggtccgcgtcttgtag

SEQ ID NO: 213462 - DNA, 5807 bp, Artificial Sequence
  Description of Artificial Sequence: Synthetic coding sequence
atgcaattcgtcagctgggccacgctgctgacactcctggtgagggatctggcagagatgggctcccctgacgcagctgctgcagtgaggaaagatcgactgcacccgcgtcaagtgaaactcctggagactctgagtgaatacgagatcgtgagccctattcgagtgaatgccctgggagaaccctttcctactaatgtccatttcaagcggaccaggaggtctatcaacagtgctaccgatccatggccggctttcgctagcagttcatcaagttctactagttcccaggcacactacaggttaagcgcctttggacagcagttcctattcaatctcacggccaatgctggtttcattgccccactgtttaccgtaacgctgttgggcactccgggagtcaaccagactaagttttattcggaggaagaggccgagctgaagcattgtttctataaagggtatgtcaataccaactccgaacacactgcagtgatatccctctgcagcggcatgctgggcactttccgctctcatgatggcgattattttatagaacctctgcaatcaatggatgaacaggaggacgaagaggaacagaataaaccacacatcatttatagacggtccgctccccagagagagccaagcactgggagacacgcgtgcgatacctccgaacacaaaaatcgccactctaaggacaagaaaaagacacgagcgcgaaagtggggagagaggattaaccttgccggagacgtcgcagctttgaattctggcctggccacagaggcatttagtgcctacggtaacaagaccgacaatacgagggagaagagaacccaccggagaaccaagaggttcctgagttatcccaggttcgtggaagtgctggtagttgctgacaaccggatggtgagttaccacggagagaacctgcagcattatattttgaccttaatgagcattgtggcctcaatttacaaggacccttccataggcaacttaatcaatatcgttattgtgaacctgattgtcattcacaacgaacaggacgggccttccatatccttcaacgcacaaaccacacttaagaacttctgccaatggcagcatagcaaaaatagccccggaggcatccaccatgacaccgctgtgttgctaacccggcaagatatttgtagggcccacgataagtgtgacactctgggactcgccgaacttgggaccatctgcgacccttacaggtcttgttcgatcagcgaagactccggactcagcactgcatttaccatcgctcatgagctgggccatgtgttcaatatgccccatgacgacaataacaagtgtaaggaggaaggtgtgaaatcaccacagcacgtcatggctccaactctcaatttttatactaatccctggatgtggtcaaagtgctcacggaagtatattacagagttcctcgacactggctatggagaatgtctcctcaatgagccggaaagcaggccctatccacttccagtgcagctcccaggaattctctacaacgtgaacaaacagtgcgaactgatatttggccctggctctcaggtgtgcccttacatgatgcaatgtcgcagattatggtgtaacaacgtcaatggcgtccacaaagggtgtagaactcagcacaccccttgggctgacggcactgaatgcgagcctggaaagcactgcaagtacggcttttgtgtccctaaggagatggacgtacccgtgaccgatggcagctgggggagctggagtccatttggtacttgttccaggacatgcggagggggaattaagacagccattcgcgaatgtaatcgacctgagcctaagaacggaggaaaatactgcgttggtcgtcgcatgaagtttaaaagctgcaatactgagccatgtctcaagcagaagagagactttcgcgacgaacagtgtgcccattttgacgggaagcatttcaacatcaacggcctgctgccaaatgtgcgatgggtgccaaaatactccgggatcctcatgaaagatcggtgcaagctgttttgtagagtggccggtaacaccgcctattaccagctcagagacagagttatcgatggtactccctgtggtcaagacacgaacgacatctgcgtccaaggtctctgtcgccaagccggttgcgaccatgtgttgaatagcaaagccaggagagataagtgcggtgtctgtgggggtgacaattcaagctgcaagactgttgcaggaactttcaatacagtgcactacggctataacaccgttgttagaattcctgctggcgcaacaaatattgatgtccgccagcacagcttcagtggggagaccgacgacgataattatctggccctctcatcatccaagggagagttcttacttaatgggaattttgtggttaccatggcaaagcgggaaattcggatcggaaacgccgtggtcgagtattccggatccgagaccgccgtggagagaattaattccactgacagaatagagcaggaattattgcttcaggtcctgtccgtgggcaaactgtacaaccctgatgtgcgctacagcttcaacattcccatcgaagataaaccgcagcagttttactggaattcacacgggccttggcaggcgtgcagcaagccttgccaaggggagaggaagcgtaagctcgtctgtacaagggagtcagaccagctcactgtgtctgatcagagatgtgataggctgccccagcctggccacatcacagagccatgtggaacagactgtgacctcaggtggcacgtggcttccaggagcgagtgttcagcccaatgtggccttggttaccgcaccctggatatctactgtgcaaagtacagcaggcttgacggcaaaactgaaaaagtcgacgatgggttttgcagtagccacccgaaacctagcaacagagagaaatgttcaggggaatgcaatacaggcggatggaggtactcagcctggactgaatgtagcaagtcctgcgatgggggtacgcagcggcgtcgagccatatgcgtgaacacccggaacgacgtccttgacgatagcaagtgcactcatcaagagaaagtcactattcaacgctgctccgagttcccgtgcccacagtggaagagcggagattggagtgaatgtttggtgacctgcggaaagggacacaaacatcggcaggtatggtgccagttcggagaggatcgcctaaatgacaggatgtgtgacccagagaccaagccaacatctatgcagacgtgtcagcagcccgagtgcgcgagctggcaggccggaccttggggccagtgctctgtgacttgcggacaggggtaccagcttagagctgtcaaatgtataataggcacttatatgtctgtcgttgacgataatgattgcaacgccgcaacgcgtcccacagatacacaggactgcgaattaccttcctgtcaccctcctcctgcagcccctgaaacacgacgctctacctacagtgctccgagaacgcagtggagattcgggtcatggactccatgctccgccacctgtggcaagggaacaagaatgcgctacgtatcttgcagagacgagaatggctcagttgccgatgaaagcgcttgcgctaccctgccaaggccagtggccaaggaagaatgtagcgtaacaccttgcggccagtggaaagctctggattggtcgagttgttctgtcacttgtggtcaagggagggccacccgccaagtcatgtgtgtgaactacagcgatcatgtgatcgaccggtctgagtgtgatcaggactatatcccagaaaccgaccaagactgctccatgagcccctgcccgcagcggacaccagactctggactggcccagcacccctttcagaacgaggattatcgacctcgcagtgcctccccaagtcgcacccatgtcctgggaggcaaccagtggcgcaccggaccgtggggagcctgttcatccacttgcgcaggcggtagtcagcggagagtggtggtgtgtcaagatgagaacgggtatacagcaaatgactgcgtggagcggatcaaaccagatgagcaacgcgcatgcgagtctggaccatgcccccagtgggcttatggaaactggggggaatgcactaagctgtgtgggggtggaatacggaccaggctggtggtgtgccagcggtctaacggagagcggttccccgacttgagttgcgagattctcgacaagccgccagatcgcgagcagtgtaatactcatgcttgccctcacgacgcggcttggagtacaggcccttggtcttcttgttccgtttcttgcggcaggggccacaaacaacgtaatgtgtactgcatggccaaagatggttcccatctcgagagcgactactgcaagcacctcgcaaaaccacatgggcacaggaagtgccggggtggaagatgccctaagtggaaggcaggtgcgtggagccaatgcagcgtctcatgcggacgtggtgttcagcagcgtcacgtgggctgtcagattggtactcacaaaatcgcgagagagaccgaatgcaacccctacactcgcccagaaagtgagagggactgccaaggccctagatgtcccctgtacacttggagggcggaggagtggcaagaatgtactaaaacatgtggcgaaggcagtcggtacagaaaagttgtctgcgtggacgataataaaaacgaagtgcacggggcaagatgtgacgtgtcgaagcgccctgtggaccgagagagttgtagtcttcagccgtgcgagtatgtgtggatcactggcgagtggagtgagtgctcagtgacgtgtggcaagggctacaagcagcgcctggtgtcatgctctgaaatttatactggtaaggagaactatgagtacagttatcaaaccactataaactgtcccggtacccagcctccaagcgttcacccttgttatctgagagattgccccgtaagtgcgacatggcgtgtgggtaattggggcagctgcagcgtgagctgcggagtcggggtgatgcagcgctccgtacagtgtttaaccaatgaggaccagccatctcacctgtgtcatacagatttaaagcctgaagagagaaagacgtgtcgtaatgtctacaattgcgagctcccccagaattgcaaggaagtgaaaaggctgaaaggcgcatctgaggatggggagtactttctcatgatcaggggaaagctccttaagatcttctgtgcgggaatgcatagcgaccatccaaaagagtacgtgacgctagtgcatggcgatagcgagaacttttccgaggtgtacgggcaccggctacataaccctactgaatgcccgtacaacggaagccggcgagatgactgtcaatgcaggaaggactatacggcagctggcttttcgtcattccaaaaaattagaatcgatctgacatctatgcagatcattacgactgatctgcaattcgccaggacctctgaaggacaccctgtcccatttgcaaccgcgggagattgctattcagctgccaaatgccctcaggggaggttcagtattaacctctatggcaccggcttgtccctcaccgagtcagcaaggtggatctctcagggtaattatgccgtctccgacataaagaagtccccagacggaaccagagtcgtagggaagtgcggaggttattgcggcaagtgcactccgagcagtggtactgggctggaagtcagagtactata

SEQ ID NO: 213463 - DNA, 1176 bp, Artificial Sequence
  Description of Artificial Sequence: Synthetic coding sequence
atgattctgaacggggaggaaataattctgtccttacagaagactaagcatctgctggggcctgactacactgaaaccctctactctccccgtggggaagagattacgaccaaacccgaaaacatggaacactgctactacaaaggaaacatactcaacgaaaaaaactctgttgccagtatcagtacttgtgatggactccgaggctattttacccaccaccaccaaagatatcagatcaagcctctgaagtcaacagacgagaaggagcacgctgtttttaccagcaaccaggaggaacaggaccctgcaaaccacacctgtggcgttaagagtacagacggaaagcaaggacctatccgtatttcccgctctctgaaaagcccagaaaaggaggatttcttgagggctcagaaatacatcgacctgtacctggtgctggataatgctttctataagaactacaatgaaaatctgacactcatccgcagcttcgtattcgatgtgatgaacctcctcaacgtgatctacaataccatagatgtccaagtggcactggttggtatggagatctggtctgacggggataagataaaggtggtgccaagtgcaagcacgacattcgataacttcttaagatggcactccagtaatctgggcaagaagatacacgatcatgctcagttgttaagcggtattagtttcaacaaccgcagagttgggcttgcagcatctaattctctctgcagtccctcatctgtggctgtgattgaggccaagaagaaaaacaatgtggctctggtgggcgtgatgtcacacgaactcggccacgtcctaggaatgcccgacgtgcccttcaatacaaaatgtccgagcggatcatgcgtgatgaaccagtatctgtcctctaaatttcctaaagacttctccacatcatgtagggcccacttcgagcgctatcttctaagtcagaagcctaaatgcttgctgcaggcccctattccaactaacataatgaccactcctgtgtgtgggaaccacttgctggaggtgggagaggattgtgattgtggatcgcctaaggagtgcactaatctgtgctgtgaggccttgacttgcaagctgaaacctggcacagattgcggaggcgacgccccaaatcataccacagaatag

SEQ ID NO: 213464 - DNA, 1413 bp, Artificial Sequence
  Description of Artificial Sequence: Synthetic coding sequence
atgctgcggggtattagtcagcttccggcagtggccactatgtcatgggtgctgctgcccgtgttgtggcttattgttcaaacacaagctattgcaatcaaacagactcccgagctaaccttgcacgagattgtatgccctaaaaagttgcacattctccataagcgcgagataaaaaataaccagactgaaaagcacgggaaggaagagcgctatgagccagaggtgcaatatcagatgatcctaaatggagaggagatcattttgtccctgcaaaaaaccaaacacctcttgggaccggattatactgagaccctttacagccctaggggggaggagatcacaaccaaacccgaaaacatggaacactgttattataaggggaatatccttaatgagaagaactccgtggcaagcatctccacctgcgacggactcagggggtactttactcaccaccaccagcggtatcaaatcaaaccattgaaaagcactgatgagaaggaacatgctgtgtttacatcgaatcaggaggaacaggacccagctaaccacacctgtggcgtaaaatctaccgacggcaaacaagggccaatcagaatctcacggagccttaaatctcctgaaaaagaagactttctgagggcacagaagtatattgacttgtatctggttctagacaatgccttttataagaattataacgaaaatttgacactaataaggagcttcgtgtttgacgtaatgaacttactcaatgtgatttacaacaccatagatgttcaggtggccctggtcggtatggaaatctggagcgatggagacaagatcaaagtggttccatcagcttctactaccttcgacaatttcctgaggtggcatagcagcaatctgggaaagaaaatacatgaccatgcccagctacttagcggcataagcttcaataatagacgggtgggattagctgcaagtaattccctatgcagtccgtcctccgtggctgtgatcgaggcaaaaaagaaaaacaacgtcgccctggtgggggtgatgagccatgaattaggccatgtcctgggcatgcccgacgtgccattcaacacgaagtgtccaagtggatcctgcgtcatgaaccagtatctgagctctaaatttcctaaggactttagcacgtcctgccgcgcacacttcgaacggtacctgttaagccagaagcctaagtgtctgctccaagcaccaatccccacaaacatcatgactactcccgtgtgtggcaatcacttactcgaagtgggggaggactgcgattgtggaagtcccaaggaatgtacaaatctgtgctgcgaggccttaacgtgcaagctgaagcccggtacagattgcgggggtgatgcaccaaatcacacaaccgagtag

SEQ ID NO: 213465 - DNA, 1176 bp, Artificial Sequence
  Description of Artificial Sequence: Synthetic coding sequence
atgatcctgaatggtgaggagatcattctgtcccttcagaagacgaaacatctgctcggaccggactacactgaaactttatattcccccagaggagaggagataactacaaagccggaaaatatggagcactgctactacaagggcaatatactgaacgagaagaactccgtggccagcatcagcacgtgcgacggactccgcggatatttcacccaccaccaccagaggtaccaaattaagcccctgaagtctaccgacgaaaaagaacacgctgtattcactagtaaccaagaggaacaggatccagctaaccacacatgtggcgtgaagagcaccgatggcaagcagggccctatccgtatttctcggtccttgaagagtccagagaaggaggacttcttacgggctcagaagtatatcgacctctacttggtgctggataacgctttctacaagaactacaatgagaatctcactctgataagatccttcgtctttgatgtcatgaacctgctaaacgtcatttacaataccatagatgttcaagtcgctcttgtggggatggagatttggtctgatggagataagatcaaggtggtgccctctgccagcaccaccttcgataatttcctccggtggcacagcagcaatctcggaaagaagatccacgatcacgcccagcttctgtccggcatctcctttaataatagacgggtcggcctcgctgcaagcaacagtctgtgctctccaagcagtgtggccgtgatagaggctaaaaaaaaaaacaatgtcgcactggtgggtgtgatgagccacgagctgggacacgtcctgggaatgcccgatgtgcccttcaacaccaagtgcccttccggatcctgtgtgatgaaccaatatctttcttctaagtttcccaaggattttagcactagttgcagagcccacttcgaacgttacctactcagccaaaagcccaagtgtttgctgcaggcacctatcccgacaaatatcatgaccacacccgtctgtggcaaccatctgctggaagtgggcgaagactgcgattgcggatcacctaaagagtgcaccaatctgtgctgtgaggcattgacctgcaagctgaaacccggtacagattgcggtggcgatgcacctaatcataccacagaatag

SEQ ID NO: 213466 - DNA, 2052 bp, Artificial Sequence
  Description of Artificial Sequence: Synthetic coding sequence
atggaatgttgccgcagagccacgccgggtactctgctgctctttcttgcctttttattgcttagttctagaacggctcgatctgaggaggatcgcgatggtctttgggatgcctggggcccttggtcagagtgttcaagaacatgcggcggaggggcttcttattccctgagacgttgtctcagcagtaagtcgtgcgaaggcaggaacatcaggtatcgaacatgcagcaatgtggactgtccacccgaagccggtgacttccgggctcagcagtgttcagcccacaacgatgtgaagcaccacgggcaattttacgagtggctccctgtttccaacgaccctgacaatccgtgcagcttgaaatgccaggctaagggcacaacccttgttgttgagcttgctcccaaggttcttgacgggaccaggtgttacacagaaagcctggatatgtgtatctctggactttgtcagatcgttggctgcgatcaccaactgggcagtactgtcaaagaggacaattgtggcgtgtgtaatggggatggctctacatgtcgcttagtacgcggtcagtacaaaagccagttgagcgccactaagtcagatgacacagtggtcgccattccatacggctccagacacattagactggtgcttaaagggccagatcacctgtacctggagaccaaaactctccaggggactaagggagagaattccctgagctcaaccggaacttttcttgtcgacaactctagcgtagacttccagaaatttccagacaaagagattctgaggatggctggcccacttactgcggatttcatcgttaaaattcgcaattcaggatctgcagactccaccgtgcaattcatcttttaccaacctatcattcacagatggcgtgagacagacttttttccttgttctgcaacctgtggtggaggctaccagctgacatctgctgaatgctacgatctgcgctcaaatcgagttgtggctgaccagtattgccactattacccggaaaatattaagccaaagcctaaactccaggagtgtaacctggatccctgccctgcaagcgacgggtacaagcagatcatgccttatgatctgtatcacccattacctaggtgggaagctaccccctggaccgcatgctcttcgagttgcggcggaggcattcagtcgagagcagtgagctgcgtggaagaggacatccagggccatgttacctccgtcgaggagtggaagtgtatgtacactccgaagatgccaatcgctcaaccttgcaacatatttgattgtcctaaatggcttgctcaggaatggtctccatgtaccgtgacctgcggccagggattgaggtatagagttgtactatgtatcgatcaccgcggaatgcacacgggcggatgctccccaaagacaaagcctcacattaaggaagaatgtatcgtgccaacaccttgttacaagcccaaggagaagttgcccgtggaggccaagcttccatggttcaaacaagcacaggagctcgaagagggagccgcagtgagcgaagagcccagttttatacctgaggcctggagcgcctgtactgtgacctgtggcgtcggaactcaggtacgcattgtgcgctgccaggtgctgctctctttctcacagagtgttgcagacctccctattgatgagtgtgagggaccgaagcccgcaagccaacgcgcttgctatgctggcccatgttccggtgagatccccgaattcaatcctgatgaaacagacgggctgttcggcggtctacaggatttcgatgaactgtacgactgggaatacgagggtttcaccaaatgtagcgagagttgcggtggtggcgtccaggaggccgtggtttcttgcctcaataagcagacccgcgaaccagcggaggagaacctatgtgtaaccagtcgccgacctccccagctgctaaagagctgcaatcttgacccctgcccagcaagaagctcaatcgattcagcatggaacgcttgcaatgttctctgctag

SEQ ID NO: 213467 - DNA, 1401 bp, Artificial Sequence
  Description of Artificial Sequence: Synthetic coding sequence
atgtgtctgacggatgaatggggctttttcttctttttttttctcggcgtgccggaggccgaagtcacatggttccggaataagtccaagctgggatctccgcaccacttgcacgagggcagcctgctgctaactaatgtgtccagtagcgaccagggtttatattcatgccgggcagccaacctccacggtgaactgactgaaagcacgcaactgctcatcttggaccctccacaggtgccaacacaactcgaagacataagggctcttttggcggcaacaggcccaaatctcccctcagttctaacttccccgctgggtacccagctagtgctggaccccggaaacagtgcgctgctcggatgccctattaagggacaccctgtaccaaacatcacttggttccatgggggacagccaattgtgactgctacgggactgacccatcacattttggccgctgggcagatcctgcaggtggctaacctttccgggggatctcaaggggaattctcatgtcttgcccaaaacgaggcaggggtgctgatgcagaaggcttccctggtaatccaggattattggtggtcagtcgacaggctggctacttgctcagctagttgcggcaatcgaggtgttcagcagccgagattaagatgcctgttgaacagtaccgaggttaatcctgcacattgcgctggcaaggtgagaccggctgtccagcccatagcatgtaacagacgtgattgtccctccagatggatggtaacttcttggtctgcgtgcacacgtagctgcggcggaggggttcagacacgaagggtgacatgccagaagctcaaagcctccggaatatctacccccgtcagtaacgatatgtgcactcaggtggcgaagaggccagtggatacccaggcgtgcaaccagcaattgtgtgtggagtgggcattttcctcctggggacagtgcaatggcccatgcattggtccacacctagcagtgcagcacaggcaggtcttctgccagacccgcgatggcatcactctgccgagcgaacagtgcagcgccctgcccagaccagtttccacccagaattgctggagcgaggcctgttcagtgcactggagggtgtccctctggaccctctgcacagccacttgtggcaattatggtttccaaagcagacgggttgagtgcgtccatgccaggaccaataaggctgtgccagaacacttatgtagttggggcccacggcctgctaactggcagcgctgtaacatcaccccttgtgaaaatatggagtgcagggacacgacccgctactgcgaaaaagtgaagcagctgaagttatgtcagctgtctcagttcaagtccagatgctgtgggacttgtggaaaagcctag

SEQ ID NO: 213468 - DNA, 1578 bp, Artificial Sequence
  Description of Artificial Sequence: Synthetic coding sequence
atggaatgttgtcggagagccactcccggtaccctcctgctgtttctggcattcctgttgctctcctcaaggacggcgagatctgaggaggacagggacgggctgtgggatgcatggggcccatggagtgagtgctcacgaacctgtggagggggtgcatcctacagcctgcgcagatgtctgtcttctaaatcttgtgagggcaggaacattagatatagaacgtgctcgaacgttgattgcccacccgaagccggagatttcagagcccaacagtgttcagctcataatgacgtcaagcatcatggacagttttatgagtggctgcccgtcagcaacgatccagataatccctgtagcttgaagtgccaggctaagggaaccaccctggttgtggaactggcccctaaagtcttagacggtacacggtgctacaccgagtctctggacatgtgcatcagcggactatgccagattgtgggatgtgaccaccaattgggatccactgttaaagaagacaactgcggcgtgtgtaacggagacggaagcacctgtaggctggtccgaggacaatacaaatcgcagctgagcgcgacgaagagcgatgacaccgtcgtggccatcccgtatggcagcagacacatacggctggtcctgaaggggccagaccacctgtacctggagacaaagaccctccagggcacaaaaggcgagaatagtttgagcagtactggtacattcctagtggataatagctctgtagacttccaaaaatttcctgacaaggagatattacgaatggcgggtccactgacggccgatttcatcgttaagattcggaactcaggttctgcagattcaaccgtgcagtttatcttttaccagccaatcattcacagatggagggagacggacttcttcccatgctcggcaacctgtggcggtgggtaccaactgacaagtgcagagtgttatgatctgaggtccaatagggtggtcgctgaccagtactgtcactactacccagaaaacatcaaaccgaagcccaagctgcaggaatgcaatctggacccttgtccagcgtccgatggctataagcaaattatgccttatgacctttatcatccattgccaagatgggaggctaccccatggaccgcctgttcatctagttgtggaggtggcatacaaagcagagctgtgtcttgcgtagaggaagatatccaggggcacgtgactagcgtggaagagtggaaatgtatgtacacccctaagatgccaattgcccagccatgtaatatcttcgactgtcccaagtggttggcacaggagtggtctccatgcaccgtgacatgtgggcagggattgaggtaccgggtggtgttatgtatcgaccaccggggtatgcacactggtggatgttcaccgaagacaaagccacatataaaggaggaatgtatcgttcctactccttgctacaaacccaaggagaaattgcctgttgaggcgaaacttccatggtttaagcaggcccaggaactggaggagggggctgccgtgagcgaagagccaagttag

SEQ ID NO: 213469 - DNA, 786 bp, Artificial Sequence
  Description of Artificial Sequence: Synthetic coding sequence
atgtgtctcaccgacgaatggggatttttctttttttttttcctcggggtccccgaggctgaagtaacatggttccggaacaaaagcaagctaggaagcccccaccatcttcacgaaggcagtctgttactcaccaatgtaagttccagcgatcagggtctctattcatgtcgggctgccaatttgcatggtgagttgacagagtccactcagttgttgatcctcgacccaccccaggtgccaacacagctcgaagatatacgcgctctgttagctgccactggacctaatctgcccagcgtgctgacctctccactaggaacgcagctggtactcgaccctgggaacagtgctttgctggggtgtcctataaagggccatcccgtgccgaacatcacttggtttcacggcggtcagcccattgtcacggcgacggggcttacacaccacatcctcgccgcagggcagatactgcaggtggcaaatctcagtggcggatcccagggggagtttagctgtttggcccagaatgaggccggagtgttgatgcagaaagccagtcttgtcattcaggattactggtggagcgttgacagactcgcaacatgttctgcgtcctgtggaaaccgtggcgtgcagcagccgaggcttaggtgcttactgaacagtactgaggtgaaccccgctcattgtgccggtaaggtcagacctgccgttcagcccatcgcttgcaacaggcgcgactgcccgtccagagccatggggctcgcttcaggactcacatag

SEQ ID NO: 213470 - DNA, 5288 bp, Artificial Sequence
  Description of Artificial Sequence: Synthetic coding sequence
atggagtgctgccgcagagctactcccggaacccttttgctctttctggccttcttgctgttatcctctcgtactgctcggagtgaagaagaccgagatgggctgtgggatgcttggggcccttggtcagaatgcagccggacatgcgggggaggagccagctacagcctgcgtaggtgcctatcatctaaatcctgtgaagggcgaaacatccggtatcggacctgcagcaatgtggactgtccccctgaagccggagactttagagcacagcagtgtagcgcccataacgatgtgaagcaccatggacagttttacgaatggctgccggtcagtaacgaccctgataatccctgttccctcaagtgtcaagcaaaaggcactacacttgtcgtggaattagccccaaaagtcctagatggcaccagatgctacaccgaatccttggatatgtgcatctcaggactgtgccagattgtcgggtgtgaccaccaactgggttccaccgtaaaagaggacaactgcggtgtgtgtaatggggatggttccacatgcagactagttcggggacaatacaagagtcaactgtccgccactaaatcagacgatactgtagtcgcaattccatatggatcgcgccacattcgcctcgtgcttaagggccctgatcacttgtacctcgagaccaagactctgcagggaaccaaaggcgagaactctttgagctccactggaacattcctcgtggataactcctcagtcgatttccagaaattcccagataaggaaatcctgagaatggcaggtccactgacagccgacttcatcgttaagatccggaacagtgggagcgccgatagcacagttcaatttattttttaccagcccattattcataggtggagagagacagatttctttccgtgttctgctacatgcgggggtggttaccaacttacatctgcagaatgctacgatctgcggagcaaccgggttgtggccgaccagtactgccactattatccagagaatatcaaacccaaaccaaagctccaggaatgcaatttagacccatgccctgcctctgacggatataaacagattatgccatatgacttatatcatccgctcccacgatgggaggcaaccccttggactgcttgctcctcctcgtgcggtggcggtattcagagcagggctgtgtcatgtgtggaggaagatattcagggacatgtcacttctgtggaagagtggaagtgtatgtacacccccaagatgcctatcgctcagccatgcaacatcttcgactgccccaagtggctggctcaggagtggtccccttgtactgtgacatgtggtcagggactaaggtaccgcgttgttctctgcatagaccacagagggatgcacacaggcggatgttcgcctaagacgaagcctcatatcaaggaggaatgtatcgtgccaaccccctgttacaaaccaaaggagaagctacccgtagaggcaaaactgccctggttcaagcaggcacaagagctggaggagggggctgctgtgtccgaggagccatcttttattcccgaggcctggtccgcttgcacagtgacttgcggggtgggcacccaggtccggattgttcggtgccaggtactgctgagcttttcacagtccgttgctgaccttcctattgatgagtgtgagggtcccaagccagctagtcagcgagcatgttacgccggaccatgtagtggcgagatccctgaattcaaccccgacgagaccgacggtctcttcggtggtctgcaagattttgacgagctgtacgattgggaatatgagggatttacaaagtgctccgaatcatgtggtgggggagtacaagaggccgtggtgtcgtgtctcaacaagcagacgcgtgaacccgctgaagagaatctgtgtgtgacctctcggagaccccctcaactgttaaagtcctgcaatctggatccttgtcctgctaggtgggagattggcaagtggagtccgtgttctctgacttgcggtgtgggattacagacacgagatgtgttttgttcccacctgctcagcagagaaatgaacgagaccgttatactagccgatgaactttgccgccaacctaaacctagcaccgttcaggcttgcaataggtttaactgtccacccgcttggtaccctgctcagtggcagccttgcagtcgaacctgtgggggtggggttcaaaagcgagaggttctctgcaaacagcgcatggcggacggaagcttcctggagctcccagaaaccttttgttccgcttccaagccagcatgccaacaggcttgcaaaaaagatgattgccctagcgagtggctcctatccgactggacagaatgcagcacctcttgtggtgagggcactcagacccggtccgctatctgcaggaaaatgctcaagacagggctctccacagtagtcaattctactctgtgccctccattgccgttttcgtctagcattcggccatgcatgttggcaacgtgtgccaggcccggtaggccgtcaactaagcactctccccacatcgcagctgctcgtaaggtgtacattcagacccgtcgccagagaaaattacacttcgtcgtgggcggatttgcatatctcctcccgaagaccgcagtcgttcttcgatgccccgcaaggagggtgcgaaaaccgctgattacttgggagaaggacggtcagcatctcatctcgagtactcacgtaaccgtggcgccatttggctatcttaagatccaccggctgaaaccgtccgatgctggcgtgtacacatgcagtgcagggccagcgcgagaacattttgtgataaagttaattggaggaaatagaaaactggtagcccgtccactcagcccgagaagtgaggaggaggtactggccggaagaaagggcggtcctaaagaggcacttcagacacataagcaccaaaacggaatcttctccaatggctctaaggcagaaaagaggggattggccgcaaatcccggaagccgctatgatgatctggtcagtcggttgctggagcaaggcggttggcccggtgagctcttggcaagctgggaagctcaggactcagccgagcgcaatactacctctgaagaggatccgggagccgagcaagtgctgttgcatttaccattcactatggtgaccgagcaacgaaggttggacgacatactcggtaatctcagtcaacaaccagaggagctgagggatctatactccaaacacttggtggcacaactggcccaggaaatattccggagtcacttggaacatcaggacacacttctgaagcccagcgagcggaggacctcccccgtgaccttgtctccacacaaacatgtttctggcttttcgtcgtcattgcggacttcttcgactggcgacgcagggggtggatcccgccgtccacataggaaacctactattctgaggaaaatcagtgcggctcaacagctgtccgcatctgaggtggtgacacacttaggacagactgtcgccctggcttccggtactctgagcgtgcttctccattgtgaagcaatcggccacccaaggcctactattagctgggccagaaacggggaggaagttcagtttagtgaccggatcttgctacagccagacgactccctccagatcctggcccctgtagaagcagacgttggattttacacctgcaatgctaccaatgcgcttgggtatgactctgtgagtattgcagtaacattggccggtaagcctttggtgaaaaccagcagaatgacggtgataaatactgagaagcccgcagttacagtcgacatcgggagcactatcaagacagtccagggcgtgaatgtaacaattaattgtcaggtggccggtgtgcccgaggctgaggtgacatggtttcggaacaaatcaaagcttggctctccgcaccatctgcacgagggttccctgctcctgacgaacgtgagctctagtgaccaaggcctgtactcctgtcgcgcagcgaacctgcatggagaactcaccgaatctacacaacttctgatcttagacccgcctcaggttccaactcagttggaggatatcagggccctactcgccgctaccggcccaaatttgccgtcagtcctcactagcccactgggtactcaactagtactcgatcccggtaatagcgctctgttaggttgtcccattaaagggcatccggtcccaaatatcacttggttccacggcggacagcccatcgtcaccgctactggtttgacccaccacatacttgctgcgggacagattctacaggtagcgaacctgagcggagggagccagggggaattctcttgtctcgcccagaacgaggctggcgtactgatgcagaaagccagtctggtcatccaggactactggtggtctgtcgaccgtcttgctacctgttcggcaagctgtggcaataggggcgtgcaacaacctaggttgcggtgtctgctgaacagtacagaggtgaacccagcccactgtgctggaaaggttcggccagccgtgcagcctatcgcttgcaacaggagagactgcccaagcagatggatggtgacatcatggtcggcgtgcacccggtcatgcgggggaggcgtccaaaccagaagggtcacctgccaaaaactgaaggctagtggcataagcacgccggtgagcaatgacatgtgcacccaagttgccaaaaggccggtggatacacaggcatgcaatcaacagttgtgcgtggaatgggcattcagctcatggggccagtgcaacggaccctgcatcgggcctcaccttgccgtacagcaccggcaagttttttgtcaaaccagagatggcattacattgccctccgaacaatgtagcgccttgcccaggccagtatcaacccagaactgctggagtgaggcttgtagtgtacactggagagtgtccctgtggactctgtgcactgctacatgtggcaattacggttttcaaagccgtagagtggaatgcgtccatgcaaggactaacaaagccgtcccagagcacctttgttcttggggacctcgaccagcaaactggcagcggtgtaatataaccccttgtgaaaacatggagtgcagggatactacaagatactgtgaaaaggtgaagcagctgaaactgtgtcagctgagtcaatttaagtcccggtgctgcggcacttgcggtaaagcata

SEQ ID NO: 213471 - DNA, 1320 bp, Artificial Sequence
  Description of Artificial Sequence: Synthetic coding sequence
atggaatgttgtaggagggccacaccaggaacccttttgctctttctagccttccttttgctgtcatccaggacagccaggtcagaggaggatcgtgacggactgtgggacgcatgggggccttggagtgagtgctctcgcacatgcggcggtggggcaagttacagtctgaggcggtgcttgtcctccaaatcctgtgagggtcgtaacatccggtatcggacttgctcaaacgtcgactgtccccctgaagctggagacttcagagcccagcagtgtagtgcacacaacgatgtcaagcatcatggccaattttacgagtggctgcccgtgtcaaatgacccagacaatccttgtagtctgaagtgccaggcaaaagggactaccttggtagttgaattggcgcctaaagtcctggatggaactcgttgctatactgagtccttggacatgtgcatctcgggcctttgtcagatcgtgggttgtgatcaccagctgggtagcacagttaaagaggacaattgcggagtatgcaacggtgatggatccacgtgtagactggttaggggccagtacaagtcacaactatctgcaaccaagagtgacgataccgtggtcgcgattccctacggatctcgccatattcgattagtgctaaagggccctgaccatttgtatctggagactaaaaccctccaggggacaaaaggggaaaactcactgagctccaccggcacctttcttgtggataattcctcagtggactttcagaagtttccggacaaagagatcctaagaatggccggtcccctcacggccgactttattgtgaaaattcgcaatagtggctctgcagacagcactgtgcagtttattttctaccagcctataatccaccgctggagggagacagattttttcccatgttctgccacatgtggcggtgggtaccaacttaccagcgccgagtgttacgacctgcgtagtaatagagtggtcgcagaccagtactgccattactaccctgagaacatcaaacctaagcctaagttgcaagaatgtaacctcgacccttgcccagcaaggtgggaggcaacaccctggaccgcatgtagttcaagctgcggtggaggcatccaaagtagagctgtgtcctgtgtcgaggaggatattcagggccatgtcacttctgtggaggagtggaaatgcatgtacacccctaaaatgcctatcgcccagccttgtaacatcttcgattgccccaagtggctggcccaggagtggtcacctgttaccgtcccaagcttttttgtgcactag

SEQ ID NO: 213472 - DNA, 2856 bp, Artificial Sequence
  Description of Artificial Sequence: Synthetic coding sequence
atggacggccgttggcagtgttcttgctgggcatggtttctgctggtgctcgccgtcgtggccggtgataccgtctctaccgggagcactgataactctcctacaagtaacagccttgaggggggtacagacgccaccgccttttggtggggcgaatggaccaaatggacagcctgttccagaagctgtgggggaggagttacctcccaggagcggcattgtctgcaacagcgtaggaagtctgtgccaggcccagggaaccgcacgtgcactggcactagtaagagataccagctgtgtcgcgttcaggaatgcccacccgacggaaggagcttccgcgaagaacagtgtgtgtcttttaactcccatgtgtacaatggtaggacccaccagtggaagcctctgtatcccgatgactacgttcacataagcagcaaaccgtgcgacctgcactgcacgaccgtagacggacaaagacagctgatggtgccagcgagggatgggacgagctgcaagctgacggacctacggggtgtctgcgtgtccggcaagtgcgaacctattgggtgtgacggggtgctgttttcaacacacactctggacaaatgcggcatctgtcagggcgacggctcatcctgtactcacgttaccggcaactaccgcaaaggaaatgcccaccttgggtattcccttgtgacccacatccctgcaggcgcacgcgatatccagatagtggagaggaagaagtccgcagatgtgttagctttagcagacgaagctgggtactacttcttcaatgggaattataaagtggatagccccaagaatttcaatatagctggaacagtggtaaagtaccgcaggcctatggatgtatacgagaccggcattgaatatattgtggctcaggggcctaccaatcaggggctcaatgtgatggtttggaatcagaacggcaagtcaccatctataacattcgagtatacactcctgcagcccccacacgaaagccgcccacaacctatctattatggattctcagagtccgccgagagccaaggacttgatggggctggtcttatgggcttcgtgccgcacaatggctccctctacggccaagcctcgtctgagcgcctggggcttgataaccggctgttcggccaccccggtctggacatggagctgggtccctcccaagggcaggaaactaatgaagtatgcgaacaggccggaggtggtgcctgcgagggaccaccacgcggaaagggattcagggaccgcaacgtcactgggactccactgactggcgacaaggatgacgaagaggtcgacacccacttcgcctctcaggagtttttcagcgctaatgcgatctcagaccagttgctgggggcaggctctgatctgaaggacttcactctgaatgaaactgtgaattctattttcgcccagggcgcaccacgcagctctttggccgaaagcttcttcgtggactacgaggagaacgagggtgcagggccttaccttctaaacggtagttacctcgaactgagctcagatcgcgttgccaattcttcatccgaagccccattccccaatgtgtcaacatctctactcacatcagccggaaatagaactcataaggctaggacaaggcctaaggcccgtaaacagggtgtgagccctgccgatatgtatagatggaagctctcgtcccacgagccctgcagtgctacctgcacaacaggagtgatgtccgcgtacgctatgtgtgttagatacgatggagtagaggttgatgattcctattgtgatgccctcactagacccgagcccgttcacgagttctgtgcgggaagggagtgccaaccacggtgggagacaagctcttggagcgaatgcagccgcacgtgtggtgaggggtaccagtttagagtggttcggtgttggaagatgctgtctcctggatttgattcttccgtatacagtgatctatgcgaagcagccgaggccgtgagaccagaggaacggaaaacatgtcgaaatccagcctgcggccctcagtgggaaatgagcgaatggagtgaatgcaccgcaaagtgtggggagcgcagtgtagtcactagggacatcagatgtagtgaagacgagaagctctgtgatcctaacacacgcccagtgggtgaaaaaaattgcacaggtccaccatgcgacagacaatggacagtgtccgattggggcccatgcagcggatcctgtggccaaggaaggaccatcaggcacgtgtattgcaagaccagcgatgggcgtgtggtaccggaatcccagtgccagatggaaacaaaacctctcgctattcacccatgtggcgacaaaaattgccccgcacattggctggcacaggattgggaaaggtgtaatactacatgcggcagaggagttaaaaagagactggtgttgtgcatggagctggccaatggcaagccccagacacggagcggtccagagtgtggcctcgccaagaagccacccgaggaaagcacctgtttcgagcgcccatgttttaaatggtataccagcccatggagcgagtgcaccaaaacatgtggcgtgggagtgcgcatgagagatgtcaagtgttatcaggggacggatattgttcggggttgtgatcctctcgtgaagcctgtgggaaggcaggcatgtgatttgcagccatgtcctacagaaccacccgacgactcttgccaagaccagcccggaaccaactgcgctttagcaatcaaagtcaacctgtgcggtcattggtattacagcaaggcttgctgccgtagttgtagaccaccccattcttag

SEQ ID NO: 213473 - DNA, 2856 bp, Artificial Sequence
  Description of Artificial Sequence: Synthetic coding sequence
atggacggacgctggcagtgttcttgttgggcttggtttctgctggttctggctgtcgtggcaggcgatacagtctcgaccggcagtacagataatagtccgacttccaactcgttggaaggaggcacagacgctacagctttctggtggggcgagtggactaagtggaccgcgtgctctcgcagttgtggaggaggggtgacatcccaggaacggcactgtttgcagcaaagaaggaagagtgttccaggacccggaaaccgtacctgtacgggaacttcaaagagatatcagctctgccgggttcaggagtgtccccctgatggacgctcttttcgagaggagcagtgtgtatcctttaacagccacgtctacaatggcaggacccaccagtggaagcctctctacccagacgactacgtgcatatatcctccaagccttgtgatctccattgcactaccgtggacgggcagagacagcttatggtgcccgcaagggatggcacatcgtgcaaactcacggatctgagaggagtttgcgtcagcggtaaatgtgagcctatcggatgcgacggtgtgctcttctccactcacacgttggacaagtgcggcatatgccagggcgacggttcctcttgcactcacgtcaccggtaactaccgaaagggcaatgcacatctggggtattctcttgtaacccatattcccgctggggctcgagacatacagattgtcgagagaaagaaatctgcagacgtgctggcacttgccgacgaggcaggttactatttttttaacggcaactataaggtagattctcccaaaaacttcaatatcgctggcaccgtggttaaataccgacgccctatggacgtctacgagactggaatcgagtacatcgttgcacagggacctactaatcaaggattgaacgtgatggtctggaaccagaacggcaagagcccttctatcaccttcgaatataccctccttcaaccaccacacgaatctcgaccccagccaatctactacggattttcagagtcagcagaaagccaaggacttgatggcgctggactgatgggattcgtaccccacaacggatcactttacggtcaagcttcctcagaacgtctcgggcttgacaaccgtctgtttggtcaccctggtcttgacatggagcttggcccttcccagggacaggaaaccaacgaggtgtgcgaacaggctggcggtggggcttgtgagggacccccacgagggaaaggatttcgggataggaatgtcaccggtacccctctgaccggcgataaggacgacgaagaagtggatactcactttgcctcccaggaatttttctccgccaatgccattagcgaccagctcttgggcgcaggcagcgacctgaaagactttactctcaatgagaccgtcaattctatttttgcccaaggagcacccagatctagtttggcagagagctttttcgttgactatgaggaaaacgaaggggctggcccatatttgttgaacgggtcctacctggaactgtcttccgacagggtcgccaactcatcgtctgaggcacccttccccaatgtgtcgactagcctgctcacttctgcagggaacaggacacataaggccagaacaagaccaaaagcacggaaacagggagtctctccagccgatatgtaccggtggaagctctcctcccacgagccctgcagcgccacatgcaccacaggtgtcatgagcgcctacgcaatgtgtgtgagatacgatggagttgaggtcgacgatagctactgtgatgctctgacccggcctgaaccggtccacgagttctgtgctggaagagaatgccagccgagatgggaaaccagctcctggtccgagtgctcccggacatgcggtgaggggtaccagtttagggtcgtgaggtgctggaaaatgttaagccctggattcgattcttcagtctacagcgacctgtgcgaggccgcagaagccgtacgtcccgaggaacggaagacctgcaggaaccctgcctgcggaccccagtgggagatgtctgagtggtctgagtgtaccgctaaatgtggagagcgtagtgtcgtgacaagagacatcagatgtagtgaagatgagaagctgtgcgatcccaatactaggccagttggcgagaagaactgtaccgggccaccctgtgacaggcagtggacagttagcgactggggaccatgcagcggaagctgcggacagggccgaacaatccgccacgtatattgcaagactagtgatgggagagtggtccccgagagtcagtgtcaaatggagactaagcctcttgctattcacccgtgcggcgacaaaaactgtcccgctcactggcttgcccaggattgggagcgctgcaacacaacttgcgggaggggggtaaaaaagcgccttgttctctgtatggaattggcgaatggaaagccccagactcgctcggggcctgaatgtggcctggcaaagaagccacctgaggagtctacctgcttcgagcgcccttgtttcaaatggtacacgtccccatggtctgaatgtactaagacctgtggcgtgggcgtgaggatgcgggatgtgaagtgttatcagggaacagacatcgtgaggggatgcgatcctttggtgaagcctgtgggaagacaagcctgtgaccttcagccctgccccacggagccacctgacgactcatgccaagaccagcctggtaccaactgtgcacttgctattaaagtgaatctatgtggacattggtattactccaaagcctgctgtcgcagctgtcgaccaccacacagctag

SEQ ID NO: 213474 - DNA, 3183 bp, Artificial Sequence
  Description of Artificial Sequence: Synthetic coding sequence
atgctgtttgaggtgggagaaggcggaggggctggggaggaggggaagggcagaggccgacccggtcgatcgctatgtacacacgcagccccagctagaacagctcacttggccccaagtgctctgcgaagcgccaggcctttcctgtgggaagataacctgttgaccagatcacagggcttaccagacaatcacgaccaacttgtgcccgacaatctcgaagcttgggcattggcagggcctcgtggattgtttcccaagcgaacattagttatatggaagcgtatcggcgcaggactcgttgtgacagtagccctgctgcctaggatggatggcaggtggcagtgtagctgctgggcatggtttttgcttgtgctggctgtcgttgctggtgatacggtgtccacgggcagtaccgacaattcccctaccagtaattccctggaaggcggaactgatgcaactgccttctggtggggggagtggactaagtggaccgcatgttcaagatcctgtggcggaggcgtgacctcacaggagcggcactgtctgcaacaaaggcgaaagtccgtaccagggcctggaaaccgtacctgcaccggaacaagtaagagatatcagctatgtagggtccaggaatgccctcctgacggtcggtcttttcgcgaagaacagtgcgtatcatttaattcccacgtgtataatgggaggacccaccagtggaagcctttatatcctgatgactacgtgcatatttcttcgaagccttgcgacctccattgtaccacagtggacggccagcgtcagttgatggttcccgctagagacggcacctcctgcaaattgacagacttacgtggtgtctgcgttagcggaaagtgcgagcccattggttgcgacggcgttttgttttccacgcacaccctggataaatgcggaatctgccagggtgacggctctagctgcacccacgtgactggaaactatagaaaaggcaacgctcatctggggtacagcctggtaacacatattcccgctggagctcgcgacatccaaatagtcgagcgaaaaaagtctgcagacgtgctggcccttgcagatgaggccggatactattttttcaacgggaactacaaggttgactctcctaagaacttcaacattgctgggaccgtggttaaatacagaaggccgatggacgtgtatgagactgggatcgagtatatcgtcgctcaggggccaaccaaccaagggctcaatgtgatggtgtggaatcaaaatgggaagtccccctcaattacattcgagtataccctcctgcagccaccccacgaaagccgcccacagccgatctactacggctttagcgaatccgctgagagtcagggactcgacggcgcaggattaatgggtttcgtgcctcacaacggatctctctatgggcaggcttcaagtgaaaggctgggtctggataatcggttatttgggcacccaggtctggacatggagttgggtccatcgcagggtcaggagaccaacgaagtatgcgagcaggccggtggcggagcctgcgaaggccctcccaggggaaaagggttcagggacaggaacgtcaccggcacacccctgacaggcgataaagacgatgaagaagtcgatacccactttgccagccaggagtttttttcagccaatgctatcagtgaccagcttcttggggctgggtcagatctgaaggactttacgcttaatgagacagtcaattctatttttgctcagggggcacccagatcatccctggccgagagctttttcgtcgattatgaagaaaacgaaggggctggtccatacctgctgaatggcagttacctggaattgagcagcgaccgtgtcgctaattcttcaagtgaggcacccttccccaatgtgtctacctctctcctgacctcagccggaaaccggacacacaaggcacggacaagaccaaaagcccgaaagcaaggcgtgtccccggctgatatgtaccgatggaagctgagctcacatgagccttgttcagctacatgtaccacaggtgtaatgtctgcatatgctatgtgtgtgaggtacgacggtgtggaagtggatgacagttactgtgatgccctcactcggccagagcccgtccacgaattctgcgcgggacgtgaatgccagccgagatgggaaacctcctcatggtctgagtgcagccgcacttgcggcgaaggataccagttcagagtcgtgcgctgctggaaaatgttgagccctggcttcgactcatccgtttactcagatctctgtgaggcagccgaggctgtgcgtccagaggaaagaaagacctgccgaaaccctgcctgcggccctcagtgggagatgtccgaatggagcgagtgtacagccaagtgtggagaacgtagtgttgttacccgcgacattcgttgtagtgaggacgaaaagttgtgtgaccctaatacccgccctgttggggaaaaaaattgtactggacccccttgtgataggcaatggaccgtatcagattggggtccctgcagcggctcttgtgggcaggggcgtaccatccgtcacgtgtactgcaaaacatctgatggtcgggtggtcccggagtcccagtgtcagatggaaactaagccgctggcgattcatccctgcggcgacaagaactgccccgctcactggctcgcccaggattgggaacgctgtaacacaacatgtggcaggggcgtgaagaaacgcctggtgctctgcatggagctagctaatgggaagccccagactcgctctggccctgaatgtggtctcgctaagaaaccgcctgaagagagtacttgtttcgagcggccatgcttcaagtggtacaccagtccctggtcagagtgcactaagacttgtggcgttggcgtgcgtatgcgggacgtcaaatgttatcagggtaccgacattgttcggggttgcgacccactagtaaagccagtgggacgccaggcatgtgacctccaaccctgccccaccgaaccgcctgatgattcctgtcaggatcagcccggtaccaactgcgcattggcaatcaaagtgaacctgtgcggtcactggtactatagcaaggcatgttgcagatcatgtcgtcccccacattcatag

SEQ ID NO: 213475 - DNA, 5076 bp, Artificial Sequence
  Description of Artificial Sequence: Synthetic coding sequence
atggcgagctggaccagcccatggtgggtgctgattggaatggtgttcatgcattctcctctgccacagacaaccgccgaaaaatcaccaggagcctatttcttgccagagtttgccctctcccctcaagggtccttcttagaagacaccactggggaacagttcttgacttatagatacgacgatcaaacctcacggaatacaaggtccgacgaagataaggatgggaactgggacgcttggggcgactggagtgactgcagcagaacatgcggaggcggagcttcctattcactgcggcgatgcctcacaggcagaaactgtgaaggtcagaacatcagatataaaacctgctccaatcatgactgtcctcctgatgcagaggattttcgggcacagcagtgctcggcctacaacgacgtacaatatcaaggccactactatgagtggttgccacgctacaacgatccagctgcaccttgcgctctgaaatgtcacgcccagggtcagaacctcgtggtggaactggcacctaaggtgctcgatgggactagatgtaacacggactccctggacatgtgcattagtggcatctgccaagcagtcggctgcgacaggcagttgggatctaatgccaaagaggacaattgtggagtgtgcgcaggcgacggatccacatgccggttggtgcgcggacagtccaagagtcacgtgtcccctgaaaaaagagaggagaatgtgatcgctgtgccactgggttctcgttcagtgaggatcaccgtgaagggccctgcccacctgttcatcgaatccaaaactttgcaaggctcaaaaggcgagcatagcttcaacagccctggagttttccttgtcgagaatacaactgtggaattccaaagaggatccgagagacagaccttcaaaattccaggcccactgatggccgactttatctttaagacccggtacaccgccgcaaaggacagcgtggtgcaattttttttttaccagccaatcagccaccagtggaggcagacagactttttcccttgtaccgtgacatgcggcggaggataccagctgaactcagcagaatgcgtggacatacggctcaaacgtgtggtacccgatcattactgccattactatcctgagaatgttaagcctaaacccaaactaaaagaatgctcgatggatccttgtccgtcaagtgatggatttaaagagattatgccctatgatcatttccagcctttacctaggtgggagcataatccctggaccgcctgcagcgtttcatgtggtggtgggattcaaagacgatcttttgtgtgcgtggaagagagcatgcacggcgaaatactgcaggtcgaggaatggaagtgcatgtacgcacctaagccaaaggtcatgcagacctgtaatctgtttgactgccccaagtggatcgcaatggagtggtctcagtgtacagtgacctgcggacggggtctgcgataccgcgtcgtgctgtgcattaatcatcgcggagaacacgttgggggttgcaacccccagctgaaactgcacatcaaagaggagtgcgttatcccgatcccatgttacaaacccaaggagaaatctcccgtggaagctaagctcccctggctgaaacaggcccaggaactggaagagactaggattgctaccgaagagcccacattcatccctgaaccctggagtgcatgttctaccacatgtgggcctggtgtgcaagtgagggaggtcaagtgccgtgtgctcttgacctttacccaaacagagaccgaattgcccgaagaagaatgcgaagggcctaaactccccactgagagaccttgtctgctggaggcttgtgacgagtccccagcgagtcgcgaattggatataccattgccggaggattcagaaaccacttacgattgggagtatgccggatttacaccttgtacagctacatgcgttggcggacatcaggaagctatcgcagtatgtctgcacattcaaacacaacagaccgtgaacgactctctgtgtgacatggtgcaccggccaccagctatgagtcaggcatgcaatacagagccttgccctccccgatggcacgtgggctcctggggcccttgctcagctacctgtggagtcgggatacaaacgcgagatgtgtactgcctacatcctggcgaaaccccggctccacctgaggaatgtagggatgagaaaccacacgctctccaggcgtgtaatcaattcgattgcccccctggctggcatatagaagaatggcaacagtgttccagaacatgtgggggtggcacgcagaaccggagagtgacatgccgccaacttttaaccgatggttcttttctcaacctgagcgacgagttatgccagggcccaaaggcttccagtcataagagctgtgcaaggactgattgtccccctcacttggcggtgggcgattggagcaaatgtagcgtgtcctgtggtgtcggcatccagcgcaggaagcaggtatgtcagcggctcgctgccaagggtagaaggatccctttaagtgaaatgatgtgccgagaccttcccggtctcccactcgtgagaagctgccagatgcccgaatgctccaaaatcaagtccgagatgaagacaaagctcggggagcaaggcccacagattctcagtgtgcagagggtgtatatccagaccagggaagagaagagaatcaacctcacgatcggttccagagcatacttactccctaacaccagtgtcatcatcaaatgtccagtgagacgcttccaaaagagtttaatccaatgggagaaggatgggagatgtctgcagaacagcaaaaggctggggatcaccaagagcggaagtctgaaaatccatggcctcgctgcacccgacatcggggtgtatagatgcatagctggcagtgctcaggaaaccgttgtcctcaaactcatcgggacagataaccgtctcatcgctagaccagcattgagagaaccaatgcgagaatatccaggaatggatcactctgaggccaattcactgggggtcacatggcacaaaatgcggcagatgtggaataacaaaaacgatctgtaccttgacgatgaccatattagcaatcagccctttctgcgtgccctgctgggccactgttcaaactcagcgggttctactaatagctgggagctgaaaaacaagcagttcgaggctgcagtcaaacaaggtgcctatagcatggacacggctcagtttgacgagcttattcgcaatatgtcccagctcatggagacaggtgaagtgagcgacgacttggcctcacagctcatctaccagctggttgcagaactagcgaaggcacaacccacacacatgcagtggaggggcattcaagaggagaccccacctgctgcacagctgcggggagaaaccggctctgtcagtcagagctctcacgccaaaaattccgggaagctcaccttcaagccaaagggaccagtcctgatgagacagagtcagcctccctccattagctttaataagacgattaactcgagaattggcaatactgtgtacattacgaaaaggaccgaagtaatcaacattctgtgcgatctcatcacaccatcagaggctacctatacgtggaccaaagatggcaccttacttcaaccgtccgttaagattatcttggacggaacggggaagattcaaatacagaatcccactaggaaagaacaaggcatttacgagtgctctgtcgcaaatcatctcggcagcgatgtggagtcaagtagcgttctgtatgccgaggcacccgtgatcctttccgttgagcgcaacatcaccaaacctgaacacaatcacttatccgttgtggtaggcggaattgtcgaggcggctctgggcgctaacgtcactatccggtgcccagttaagggggttcctcagcccaatattacttggcttaagaggggtgggtccctgagcggtaatgtctccctgttgttcaacggctcattgctgctgcagaacgtgagcctggaaaatgaaggcacgtatgtttgcatagcaacgaacgccttgggcaaggcggttgcgacgtccgtgctgcatctgctggagcgcagatggccagaatcccgtattgtgtttctgcaggggcataaaaaatacattctgcaggctactaacacgcgcacgaacagcaacgatccaactggagaacctccaccacaggagcccttctgggagccgggaaattggtcccactgctctgctacctgtgggcatctcggcgctcggatacaacggccacagtgcgtaatggcgaacgggcaggaggtgtccgaagccctgtgcgaccacctccagaagcctctggccggtttcgaaccttgtaacatccgtgactgtcctgccaggtggtttacttccgtgtggtcccagtgttccgtgtcctgcggagaagggtatcatagccggcaggtcacctgtaagcgtaccaaggcaaacggcactgtgcaggtggtgagcccaagagcatgtgcccctaaggacagacccctggggcgaaagccctgtttcgggcacccttgtgtgcaatgggagccgggaaatagatgtcccggtagatgcatgggtcgcgcagtccgtatgcagcagcggcacacagcctgtcaacacaacagtagtgattccaactgtgacgacagaaagcggcctacactgcgtagaaactgcacatctggagcttgtgacgtgtgttggcacactggtccttggaaaccgtgcaccgccgcttgcgggcgaggcttccagagcagaaaagtggactgcattcatacaaggtcctgtaaacccgtggcaaagaggcactgtgtgcaaaagaagaagcccatctcctggcggcactgccttggcccaagttgcgatcgagactgcacagacactacccactattgtatgttcgtcaagcacctgaatttgtgtagccttgaccgctataagcagagatgttgtcagtcatgtcaagagggttat

SEQ ID NO: 213476 - DNA, 3225 bp, Artificial Sequence
  Description of Artificial Sequence: Synthetic coding sequence
atggagaattggacaggcagaccctggttatatctgctcctgctgctgagcttgcctcagttatgcctcgatcaggaggtgctttcagggcactccctgcaaacacccaccgaagaggggcagggtcccgagggcgtgtggggaccctgggtacagtgggcctcttgcagtcagccttgcggagtgggcgtgcagaggaggtctagaacatgccagctgccaacggtacagttacacccttcactacctctccctcccagaccccctcgacatccggaggcgctgttacccaggggtcaaggccctcgccctcagacatctcctgaaactcttccactttatcgtacacagtccagagggaggggcggacctctcaggggaccagcgagtcatttgggtagagaggagacacaagagatcagggctgcccgacgttccaggctcagggacccgatcaagccgggaatgtttgggtatggccgtgttccttttgctctgccactgcatcggaatcgtcggcaccccaggtccccgccacggagtgaactttctctgatttccagtcggggagaagaagccatcccttctcctacgccgagagctgagcccttcagtgctaatgggtctcctcaaacggaactgccacctacagaattaagtgtgcacactccgtctccacaggctgagcccttgtctcccgagaccgcacagaccgaggttgctccccgtacacgccctgccccattgaggcatcacccacgggcacaggcctccggcaccgagccacccagcccaacacacagccttggcgagggcggattcttcagggcctcaccccagccacggagaccatcctcccaggggtgggcatccccacaggtcgctgggagaagacctgaccccttcccatctgtcccacgtggcagggggcagcaaggccagggaccttgggggaccggaggaacgccccacggaccccgattagagccagacccccaacaccctggcgcatggctgccccttctcagcaacggtccacacgccagtagcctgtggagtctctttgcgccaagcagcccgattcccagatgcagtggggagagtgagcaattgagagcctgttctcaggccccttgcccaccagaacaacccgatccccgagccctccaatgtgccgcttttaactcacaggaatttatggggcagctctaccagtgggaaccattcaccgaagtccagggatctcagcgttgcgaactaaactgccgtcccaggggctttcgattctacgtccgccatactgagaaggtccaggatggtacactgtgtcaaccgggagccccagacatatgtgtggccggtagatgtctatccccagggtgtgacgggatcctcggcagcggacggaggcctgacggatgtggagtatgtggaggtgacgactcaacttgtcgccttgtttctggcaatctgacagataggggcggaccacttggctatcagaagatcctatggattccggctggagccctccgcctgcagatcgcccaacttagaccaagcagtaattacttggcactgcgaggaccaggagggagatcaataattaatggtaactgggctgtggaccctcccggatcctatagggcagggggaactgtgttccgctataataggcctcctagggaggaggggaagggggagagtctgagtgccgaggggcctacgactcaacccgtggacgtctacatgattttccaggaagagaatcccggagttttttatcaatacgtgatatccagtccacctcctatattggaaaaccccacacccgaacctcccgtcccacagctgcagcctgagatattgagagttgaaccccctctggctcccgcacctcgacctgcgagaaccccaggcacactacagagacaggtccggataccccagatgccggcacctccccatcccagaacccctctgggaagtccagcggcatactggaaaagggtgggccacagcgcttgttccgccagttgtggcaaaggtgtctggaggcccatatttctctgcatctcccgagaaagtggggaagaactcgacgaaagatcctgtgccgcaggagcccgaccaccagcaagccccgagccctgtcacggcacaccatgtccaccttactgggaggccggtgaatggacaagctgttcccggtcctgcggcccaggtacccagcatcgacagctccagtgccgtcaggagttcggaggtggcggatcctcagtgccaccagagcgatgtggccatctgcctcgacctaatatcacacagagctgccaactaagattatgtggtcactgggaagtgggcagcccatggtcacaatgctccgtgcggtgcggccgagggcagcgtagtcgccaggttcgctgtgtcgggaataacggggacgaagtgagtgaacaggaatgtgcgtccggcccacctcagcccccttcgcgcgaagcctgcgacatgggaccctgtacaaccgcctggtttcactcagactggagctctaagtgttctgctgagtgcgggaccggcattcagcgccgttccgtcgtttgtctcggcagcggtgccgcactgggacctgggcagggcgaggctggggctgggacaggccagtcctgtcctacgggttcacggccacccgacatgcgcgcttgttctctgggtccttgtgagcgcacttggagatggtatacagggccatggggagaatgcagcagcgagtgcggctctggcactcagcggcgtgatatcatctgtgtatcaaagctgggtacagaattcaacgtcacatcaccgagtaattgttcacatctgccgagaccacccgctctgcaaccatgtcagggtcaggcttgtcaggatcgttggttttccactccctggtctccatgcagtcgaagttgtcaaggaggaacccagacacgtgaagtccagtgcctttcgacaaatcagacattatctacccggtgcccaccacaactgagaccaagccgcaaaaggccttgcaatagccagccctgctctcagcgcccagacgatcagtgtaaggactccagccctcattgccctcttgttgttcaggccagactttgtgtgtatccctattatactgccacttgttgccgcagctgcgcccatgtcctggaacgctctccacaggacccttcctag

SEQ ID NO: 213477 - DNA, 3225 bp, Artificial Sequence
  Description of Artificial Sequence: Synthetic coding sequence
atggagaattggactgggcgaccatggttatacctgctcctacttctgagcctgcctcaactttgcctggaccaagaggttctgagcggccacagcctccaaactcccacagaggaggggcagggtcccgaaggtgtgtggggaccttgggttcaatgggccagctgtagccagccatgcggagttggagtgcagcggagatcccggacatgccaactgccaacggttcagctgcacccttcactgccactccctcctaggcctcccagacaccctgaagccctactccctcggggacaaggacctaggcctcagacctcaccagagaccttgcccctgtacaggacgcagagcagggggaggggaggccctctcagaggcccagcgtctcacctcgggcgagaggagacgcaggaaattcgcgcagcccgtcgcagccggttacgagatcctatcaaacccggaatgttcggatacggcagggtacctttcgcattgccactccacaggaaccgtcggcacccacgtagcccacctaggtcagaactgtctcttatttcttcaaggggagaagaggctattccctcaccaacacctcgggcagagccctttagcgccaacggttctcctcaaaccgagctcccacctactgaactaagcgttcacactcccagcccccaagcagaaccgctcagcccagagaccgcccagactgaggtcgcacccagaaccagacccgctcccttgcgccaccacccaagagctcaggcttctggcacagagccacccagccccacccactccctgggcgaaggcggattctttcgcgcaagccctcagcccaggcggccttcttctcagggatgggcctctccgcaagtcgctggcagacgtccagaccctttcccaagtgtacctcggggtaggggacagcagggacaaggcccatggggcacaggcggtacccctcacgggccaaggctggagccagaccctcagcatcctggcgcttggctgccactgttgtctaatggccctcacgcttcctcattgtggagcctcttcgccccaagctctcctattccccgttgttcaggggaatctgagcaattgcgagcttgcagtcaagccccatgtccgccagagcagcccgatcctagggccctgcagtgcgcggcatttaattcccaggaatttatgggtcagctctatcagtgggaaccttttaccgaggtgcagggctcacagagatgtgaacttaactgccgtccccgaggctttcgattctacgttaggcacaccgaaaaggttcaggatggcactttgtgtcaaccgggagccccagacatttgcgtggccggtagatgtctcagtcctggatgtgacgggatcttaggtagtgggaggcgtccagacggatgtggcgtttgtggtggcgatgattccacatgccgccttgttagtggtaatttaaccgatcgcggaggcccattaggttatcagaaaatcctgtggatcccggctggggctcttcgcctgcaaattgctcagttacggccttcttccaattacctggccttgcgagggcctgggggacggtcaattattaatggaaattgggctgtggatccgccaggctcatatcgcgctgggggtacagtctttcgatacaatagaccacccagagaggagggtaaaggcgagagcttaagtgcggagggaccaacaacgcagccggtggatgtctatatgatcttccaggaagagaatcccggtgtattttaccagtacgtgataagtagccctcctccaatactggagaaccccacccctgagccccctgtgccccagctgcagcctgaaatactgagagtcgaacctcctctggctccagcgccaaggcctgccaggacacctggcacactccagagacaagtgcggatccctcagatgcccgctccaccccacccgcgaaccccattgggatcccccgctgcatactggaagcgtgttggccattctgcctgttctgcttcctgtggcaagggagtctggcgccctatcttcttgtgcatttcacgagaaagcggggaggagctggacgagcggagttgtgcagcaggggctcgaccacccgcttccccagaaccatgccacggaaccccctgccctccatattgggaggccggtgagtggacttcctgtagtcgctcatgcgggcctggcacccagcatcggcagctgcagtgccggcaggagtttgggggagggggtagtagcgttccccctgaaagatgcggacaccttccgcgtcccaatatcacacaatcttgccagttgcggctgtgtgggcattgggaagtcggctccccctggtcacaatgtagtgtgcgatgcggccgtggtcagagatcacgccaagtccgctgcgtgggaaacaacggcgatgaggtgtccgagcaggaatgcgcaagcggtccaccacagcctccctcaagagaggcatgcgacatgggcccatgtacaactgcttggttccattcagattggtcaagtaaatgctccgcggagtgcgggacaggcatccagcggagaagcgtggtctgcctggggtcaggggcagccctcggccctggacagggggaagctggagctggtactgggcagagttgccccactggatcccgcccacctgatatgcgcgcatgctcgctgggtccctgtgagcgcacttggagatggtacaccgggccatggggggagtgctcttccgagtgcgggtcgggtacgcagcgcagagatattatatgtgtttctaagttaggaacggagtttaacgttacaagcccttctaactgctctcatttacctcgccctccagctctccagccgtgccagggtcaggcttgccaggaccgatggttttccacgccatggtctccttgtagtaggagctgccagggtgggactcaaacccgcgaggtgcaatgtttaagcaccaatcaaaccctcagcactcgttgtcccccacaacttagacccagccgcaagcgaccttgcaacagccagccctgttcccagcgtcccgatgaccaatgcaaagactctagcccacattgccctctcgtggtgcaggccagactctgcgtgtacccctattatactgccacatgttgtcgatcctgtgcacacgtcttagagagaagtccccaagacccatcctag

SEQ ID NO: 213478 - DNA, 3294 bp, Artificial Sequence
  Description of Artificial Sequence: Synthetic coding sequence
atggaaaactggacaggcagaccgtggctctatttgctacttcttttgtccctgccccaattgtgcctcgatcaagaagtcctttccgggcattctttgcagacccctaccgaggaaggtcaggggcctgagggtgtgtggggtccatgggtacagtgggcgtcctgcagccagccatgcggcgtgggcgtgcagagacgctctaggacttgccaactcccaaccgtccagctgcatcctagtcttccactgccaccaaggcccccaaggcatcccgaggctctgcttccaagagggcagggaccgagaccccagacctcaccagagacactgcccctgtatagaacgcagagtcggggtcgcggtgggcctctgaggggcccagcaagccatctgggcagggaggaaactcaggaaattcgtgctgctcgcaggagtcgcctcagagatcccattaaacctggaatgtttggttatggacgcgtgccctttgcactaccactacacagaaaccgacgacacccaaggtcaccgccaagatcagaactctcactgatttccagccgtggcgaagaggccatcccttcaccgactcccagagccgaaccattctctgctaatggctctccacagactgaactgcctccaactgagttgtccgttcatactccctccccccaggcggaaccattgagccccgaaaccgcacagaccgaagttgctccacggacccgaccagcaccgttacgccaccatcctcgggctcaggcttccgggaccgaacccccttcaccaacgcactctctcggcgagggcggatttttccgggcatccccccagcctaggagacccagcagccaaggttgggccagcccccaagtggcaggcagacgccctgatccgtttcccagtgtgcctagaggcagagggcaacaggggcaggggccatggggaactggtggaactccacacggcccaagattggaaccagatcctcagcatcccggagcttggcttcctctgttgtctaatggaccccacgcttcttccctttggtccctgtttgctccatcatctccaattccaagatgttccggagagagtgaacagctgcgggcatgttctcaggccccatgccccccagaacagcccgaccccagggcactgcagtgtgccgcatttaactctcaggagtttatgggtcagctataccagtgggagccgtttactgaagctcccctcttgcccctgcgccacgctttcttcctgctgcctggagcaggtagcggcgatagcactggtgtgcaagggtctcaaagatgtgagctcaattgtcggccaagaggatttcgtttctatgtccggcatacagaaaaggttcaggatggcacactgtgtcagcctggcgctcctgatatctgcgtggctggacgatgcctgagccctggatgcgacgggatcctaggctcaggacggagaccggacggttgcggtgtttgcggcggtgacgattctacttgtaggcttgtgtcaggaaatctgactgataggggcggacccctgggttaccagaagatcctgtggatcccagcaggggcactaaggttacaaattgctcaactacgtccctcatcgaattatctggccctgcgtgggccagggggacgatctataattaacgggaactgggccgtagatccgccaggcagctacagggcagggggaacagtgtttagatataataggcccccaagggaggaaggcaaaggcgagtccctgagcgcagaggggcctacaacccagcccgtggatgtttacatgatcttccaggaggagaaccctggcgtcttctaccaatacgtgatttctagcccccctcctatcctcgagaatccaacgcccgagccaccggtgcctcagttgcagccggaaatcctgcgcgtggagccaccattagctcccgctccacggccagctcgcactcccggaacactgcagcgacaggtgcgcattccacagatgcctgcccctcctcaccctcgcacccccctggggtccccggcagcttattggaagagggtcggccatagcgcctgctcagcaagttgcggcaagggcgtgtggagacccatcttcctttgcatcagcagagagtccggggaggagctcgacgagaggagctgcgcggctggagctcggcctcccgcttcccccgagccgtgtcatgggacaccatgccctccgtactgggaggccggagaatggacaagctgcagcagatcctgcggaccagggactcaacataggcagctgcagtgtaggcaggagttcgggggaggagggagctccgtgccacctgaacgatgcggccatctgcctagacccaatattacacaatcgtgccagttgcgcttgtgtgggcattgggaggtcggatctccatggtcccagtgttccgtccgctgcgggcgaggccaacggagccggcaggtcaggtgtgtgggtaacaacggcgacgaagtcagcgaacaggaatgtgcttccggcccaccacagccacctagtagggaggcctgcgacatgggaccttgtacaacagcatggtttcattctgactggtcgagcaagtgctctgcagaatgtgggacaggcattcagagaaggtctgtggtgtgtctaggcagtggcgctgccctggggccaggacaaggagaggcaggggctggcaccggtcagtcctgcccaactggaagtaggccacctgacatgagggcctgctctctcggcccatgcgaacggacttggagatggtacaccggaccttggggcgaatgcagttcggagtgcggctcaggaacgcagaggcgggacatcatctgtgtcagcaagctgggcaccgagttcaacgtcacttccccttccaattgttctcatctacctagacctcctgcgctgcagccgtgccaagggcaggcctgccaggacagatggtttagcactccatggagcccttgctccaggtcctgtcaggggggaactcagacacgcgaggtgcaatgcctctctaccaaccagacgctgagtactcgctgtccacctcaactgaggcccagcagaaagcgcccttgcaatagccaaccatgtagccagagaccagacgatcagtgtaaggattcatccccacattgcccactggtggttcaggcgaggctgtgcgtctacccctattacacagccacctgctgtaggtcatgtgctcacgtcctggaaaggtctccacaagacccctcgtag

SEQ ID NO: 213479 - DNA, 2634 bp, Artificial Sequence
  Description of Artificial Sequence: Synthetic coding sequence
atggaaaactggacgggtagaccttggttatacctgctccttctgctttccctcccacaattgtgtctcgaccaggaggtgctgtcgggccattcattacagactccaaccgaagagggacagggaccagagggagtctggggtccgtgggtccagtgggcctcctgtagccaaccatgcggggtcggcgttcaaaggaggagtcggacttgccagctgcccaccgtacagctgcatccctccctgccacttcccccacgacctccacggcaccccgaggctctgttaccacggggacagggtccgaggcctcaaaccagccctgagacgttaccgctctaccggacgcagagccgaggcagaggcggtccactgcgtggacctgcctcacatctcggtcgagaggagacccaagaaatcagagcagcacgtaggagcaggcttcgggatcctatcaagcctggcatgttcggatatggcagggtcccattcgctcttcctctgcaccggaatcgccgacatcctcgctcaccccctcgcagcgaattgtcattaatcagtagcaggggggaggaggctattccctcaccgaccccacgcgctgagcctttctccgcaaatgggtctcctcagaccgagttaccgcctacagagctcagcgtgcacacaccatcgccacaggcagagccactgtccccagagacagcacaaacagaggtggccccaaggaccaggccagccccactccgccaccatccgagggctcaagccagcggcacagaacctccaagtccgacccatagcctgggggaaggaggattttttcgggcaagcccccagccgagacgtccgtccagccaaggatgggcctcgccacaggtggccggtcggcgacctgatccattcccttctgtaccacgtgggcgtggccagcagggacagggcccatggggcacaggtggtactccacatggcccacggctggagcctgatccccaacacccgggtgcctggctccctttactttctaacggccctcatgcttcgtccctctggagtctctttgcacctagctctccaatcccaagatgttcgggcgaaagtgagcagctgagggcatgttcacaggccccatgtcctcctgagcagcctgacccacgagcattacagtgtgctgcatttaactctcaagaatttatggggcagctgtaccagtgggagcccttcacggaggtgcagggttcgcagagatgcgaactgaactgtcggcctcgagggttccgattttacgtgcggcatacggagaaggtccaagatggaacactttgccagcctggggcacccgacatttgtgtggccggaaggtgtctgagccccggatgcgacgggatcttaggctccggtcggagaccagatggttgtggcgtatgtggcggagacgacagcacttgccggcttgtgtccggcaacctcaccgatagaggaggacccctgggctaccaaaagatcctatggatccccgctggcgcactgaggctgcagatcgcccagctcagaccctcatccaattacttggccctgcgcggtcctgggggaaggagcatcatcaacggcaactgggctgttgatcctcctggcagttatagggcaggaggcactgttttccggtacaatcgaccccctagggaggagggtaaaggcgaatcattgtccgccgaaggaccaaccacccagcccgtggacgtatatatgattttccaggaggaaaatccgggagtgttttatcagtacgtgatttccagccctcccccaattttggagaaccccactcctgagccacccgtgccccagttgcaaccagagatactgcgggtagagccccctctcgccccagctccgagaccggctcggaccccaggaacccttcagcggcaggtgcggatcccgcagatgcctgctcccccacatccccgaaccccactgggctcccccgctgcctactggaaaagggtgggtcactcagcttgctctgcctcatgcgggaagggggtatggagaccgatttttctgtgtattagtagggagtctggcgaagaactggatgagcgatcctgtgcagctggagctcgccctcccgcttcaccagagccctgccatggtacaccctgccctccgtactgggaggccggagaatggacctcctgcagcaggtcttgtggcccaggaactcagcaccgccaactgcagtgcaggcaggaattcggcggtgggggttcctcagtacctcctgagaggtgcgggcatctgccgaggcccaacatcacccaatcttgtcagctgcgcctgtgcggacattgggaggtggggtccccatggtcacagtgctccgtcaggtgtggaagagggcagcgcagtcgccaggttcgttgcgttggtaataacggggacgaggtgagtgaacaagaatgtgcttctggacccccacagccgccatccagagaggcctgtgacatggggccttgtactacagcttggtttcactcagattggagctctaaagtctcccctgagcctccagctatttcatgtattttaggaaaccatgctcaagacacatcagccttccccgcatag

SEQ ID NO: 213480 - DNA, 1311 bp, Artificial Sequence
  Description of Artificial Sequence: Synthetic coding sequence
atgggctctctggccctggcgggagtgctgatggcagtcgaaagcgttggtgtcatgattcttccggtcgctttgttcaggggtacctccctcacagagggcgcaccctgggctatcagacgctcatgtgggttccagagggagccttgcggtagtcggctgcccagctcagggcttgccccaactacttggcactttgtggcgctgggcaggagcatcatcaacggcaactgggcggtggacccccctggttcgtacagggcgggtggtactgtgttccgctataaccggccaccaagggaggaggggaagggcgaaagcttgtccgccgaggggcctactacccagcccgtggacgtgtatatgatttttcaagaggagaacccaggagtcttttatcagtatgtaattagctctcctccacccatcctcgaaaatcccacaccggagccaccggtgccacagctgcagcccgaaatcctgcgcgtggagcctcctctcgcacctgccccacgtcccgcacgtacacccggtactttgcaacggcaggtcaggatcccacagatgccggcaccccctcatccccgaacacccttggggtcgcctgctgcctattggaagagagtcggccactcagcctgcagcgcttcctgcggcaagggagtctggaggccaatattcctctgcatcagtcgggaaagcggggaggagctggatgagcgcagttgcgccgctggtgcaaggccgccagcaagccccgagccgtgccatggaaccccgtgccccccttattgggaggcgggagaatggacctcctgctcccgctcctgtggcccaggcactcaacaccggcagctccagtgcaggcaggagttcggcggtgggggaagtagtgtgcccccagagcgttgcggccacttgcctcggccaaacataacccagtcttgtcagttgcgactgtgtgggcattgggaggtggggagtccctggagccagtgttccgtgaggtgtgggagaggccagaggtcacggcaggttagatgtgtgggaaataacggagatgaggtctctgagcaggaatgtgcaagcgggccacctcaacccccaagccgggaggcctgtgacatgggaccttgcacaaccgcctggtttcatagtgactggtctagcaaatgtagcgccgaatgtgggacaggaatccagcggagaagtgtcgtctgtctgggatccggagcggcacttggtcccggacaaggagaagcgggtgccggaactgggcagtcatgcccaactggttcacgacccccatag

SEQ ID NO: 213481 - DNA, 2130 bp, Artificial Sequence
  Description of Artificial Sequence: Synthetic coding sequence
atgccaggaattgacaagctgcccatcgaagagactctagaagactcaccgcagacacgatcacttcttggcgtgttcgaggaggatgcaactgccatctctaattatatgaaccagctctatcaggctatgcatagaatttacgacgcccaaaatgagctgtcagcagcaacacatctgacctctaaactcttgaaggaatacgaaaagcagagattccctcttggcggtgatgacgaggtaatgagcagcacattgcagcagttttccaaggtcattgatgaactcagtagttgtcatgccgtcctcagcactcagcttgctgacgctatgatgtttcccattacacaatttaaggaaagggatttgaaggaaattttaaccctgaaggaagtcttccagattgcctctaacgatcatgatgccgctattaataggtactcaagactctccaaaaagagagagaatgacaaagtcaaatatgaagttactgaagatgtctatacaagccggaaaaagcaacatcagaccatgatgcactacttttgcgcccttaatactcttcagtataagaagaagatcgccctcctggagccactccttgggtatatgcaggcacagatcagcttttttaaaatgggatcagagaatcttaacgagcaactcgaagaatttttagcgaatatcggcaccagcgtgcaaaatgtgcggcgtgagatggacagcgatatcgagacaatgcagcagacgatcgaggatttagaggtggctagcgaccctctatacgtaccggaccccgaccccactaagttcccagtgaatcgcaatttaacaaggaaagccggatatcttaatgctagaaacaaaactggcttggtgagttccacttgggacaggcagttttactttactcaggggggtaatcttatgtcccaggcacggggagatgttgcaggtggattggccatggacattgataattgcagcgttatggcggttgattgtgaagacagaaggtattgctttcagattacttctttcgatggaaagaagagtagtatcttacaagcggaatcaaagaaggaccacgaggagtggatctgtaccattaataatatctctaaacagatctacctctcagagaaccccgaggaaaccgccgcaagagtgaaccaaagtgccctggaagctgtgactccaagcccgagcttccaacaaaggcacgagagtctaagaccagctgcaggtcagagcagaccaccaacagcacgtacatcgagctctggcagtctgggtagcgaatccacgaatttggcggctctcagtctggattcactagtcgcccctgataccccaatccaattcgacataatcagccctgtttgtgaggaccagcctggacaggcaaaagcctttgggcaggggggtagacggacgaatcctttcggggaatccggcggaagcacgaaatcagagaccgaggactctatcctgcaccagctttttatcgtccggttccttggaagtatggaagtgaaaagcgatgaccaccctgatgtcgtgtatgaaaccatgaggcaaattctggccgcaagggcaatccacaacatcttcagaatgactgagtcgcatcttctcgttacatgcgactgtcttaagttaattgaccctcaaacacaggtgacaaggctgacgttcccactgccatgcgtggtgctgtacgcaacacaccaggaaaataagcggctgtttggttttgttctgagaacgagcagtggcagatctgagagcaacctgtctagcgtttgttatatcttcgagtccaataatgagggcgagaaaatctgcgactccgtgggcctagcaaaacaaattgccctgcacgctgagttggacagacgggctagcgagaagcaaaaagaaattgagcgggttaaagagaagcagcagaaggaactcaataagcagaaacaaatagagaaggatttagaagagcagagtcggttaatcgcagcgtcaagtaggcctaaccaagcctccagcgaagggcaatttgtcgtcctttcttcgtctcagtccgaggagagtgacttaggcgaagggggtaagaagcgggaaagcgaagcttag

SEQ ID NO: 213482 - DNA, 1995 bp, Artificial Sequence
  Description of Artificial Sequence: Synthetic coding sequence
atgccagctgtggacaaactgctgttagaggaggctctgcaggacagcccgcagacgcgcagcctcctaagtgtttttgaggaggacgctgggactctgacagattacacaaatcagctgctgcaggccatgcagagagtgtatggtgcacagaacgaaatgtgcctggctacacagcagttaagtaagcaactactggcctacgagaaacagaactttgcactgggtaagggggacgaagaggtcatatcaacattgcactacttttctaaagtcgtggacgaacttaatcttttgcacacagaactggctaaacaacttgccgacaccatggtgttacccatcattcaatttagggagaaagacctcacagaagtctccacattgaaggatctgtttggtctggcgagcaatgagcacgacctctctatggccaaatactcgcgtctgcccaagaagaaggaaaacgaaaaagtgaagaccgaagtggggaaagaggtggcagctgcgagacgaaaacagcacttatcttcgctccagtattactgtgcactcaacgcattgcagtacagaaagcaaatggccatgatggagcccatgatcggctttgctcacggacaaattaattttttcaaaaagggagccgagatgttctcaaagagaatggactccttcctctcctctgtcgcagacatggtccaatcaatccaggtcgagttggaagctgaggccgagaaaatgagggtatcccaacaggaactactgagtgtagatgaatccgtttatacgccagactcagatgtggccgcaccccaaatcaatcgcaaccttatacagaaagcaggttatctgaatctccgtaacaagaccgggctcgttacaactacttgggaacggttgtactttttcacacagggcggaaatctcatgtgccaacctagaggggcagtagctggcggtctgatccaggacctggataattgttctgtgatggctgtggattgtgaggacagaagatattgctttcagattaccaccccaaacggcaagagtgggatcattctgcaagctgaaagtcggaaagaaaatgaagaatggatatgtgctatcaacaacattagcagacagatttatctaacagacaaccccgaggctgtggctatcaaactgaatcagaccgctctgcaagcagttacacccattacgagcttcggcaagaaacaggagtcctcctgcccaagtcagaacctcaagaacagcgaaatggagaacgaaaatgataaaatcgtgccgaaggccacggcatcactgcctgaggcagaggaacttatcgctccagggacacccatccaatttgatatagtgttacctgccaccgagttcctggaccagaaccgaggaagcaggcggactaaccctttcggggaaacagaggacgagagtttccccgaggcagaggattctctcctacagcaaatgttcattgtaagatttcttggaagcatggccgttaagactgatagtaccactgaggtgatctacgaggctatgcggcaggtactcgcagctcgagctatccacaatatctttagaatgactgaaagtcacctgatggttacgtcccaatcgctgcggctcatcgacccccagacgcaggtatcacgagcaaattttgagttgacttctgtgacacagttcgcggcacatcaggagaacaagaggctggtcggatttgtgatcagagtcccggaatctacaggggaggagtcactttctacctacatcttcgaaagcaactccgaaggcgaaaagatctgttatgccattaacctgggcaaagagatcattgaggtgcaaaaagatccagaggctctggcccagcttatgctcagtatccccctgactaacgatgggaagtatgtgctgctcaacgaccagcctgacgacgacgatggaaatcccaacgagcatcgcggagccgagtctgaggcttag

SEQ ID NO: 213483 - DNA, 2013 bp, Artificial Sequence
  Description of Artificial Sequence: Synthetic coding sequence
atgcccgctgtggacaagctgctccttgaggaggctttgcaggacagcccccaaactagatctctcctttcagttttcgaggaggatgctggtaccctgacagactacaccaatcaactgctccaggcaatgcaaagggtgtatggagcccagaatgaaatgtgtctagcaacccaacagctctcaaaacagttgcttgcgtacgagaaacagaactttgcgctcggtaagggcgatgaggaagtgatctctacactgcactacttctctaaggtcgtagacgaactaaaccttctccacacagagctagccaagcagctggccgacaccatggttctgccaattatccaattcagagaaaaagacctaaccgaggtcagcactctcaaggacctctttgggctggcatctaatgacgtatgcctcttcttagaacacgatctgtccatggctaagtatagtcgtctgcccaaaaaaaaggagaacgaaaaagtgaaaaccgaggtaggcaaagaggtggctgcggctcggaggaagcaacatctctcttcattgcagtattactgtgccctcaatgcccttcagtatcggaagcagatggcaatgatggagcctatgatcggattcgcgcatggtcagattaacttctttaaaaagggagcggaaatgttctctaagcggatggatagttttctgtcaagtgtcgccgacatggtccagtccattcaagttgagctggaggccgaggcagaaaaaatgagagtgagccaacaagaacttctgagcgtggatgaatcagtatacaccccggacagcgacgtagccgcaccacagatcaataggaacctgatacaaaaggctgggtacttgaatttgaggaacaaaactggcctcgttacaaccacctgggagaggctctatttctttacgcaggggggtaatctaatgtgccagccacgaggcgctgttgcaggagggctcatccaagatctggacaattgctcagtgatggccgtagattgcgaggacagacggtattgttttcagataaccactcccaacggaaaaagcggaattatcctgcaggcagagtcccgcaaggagaacgaagaatggatttgcgccatcaacaatattagcaggcagatctacttaacagataatcctgaggctgtggctatcaaactgaaccagacggccctccaggccgttaccccaatcacctcttttggaaaaaagcaagagtcttcatgtccgtctcaaaaccttaagaactcggagatggaaaatgagaatgataaaattgtgccaaaagcaaccgcctccctcccagaggccgaggagttgatagcgcctggcacgccaattcaattcgatattgtccttccggctactgaattcctggaccagaatagagggtcccgcaggacaaatcctttcggagagacggaggacgagagcttcccagaggctgaagacagccttctccagcagatgttcatagtgaggttcctgggctcgatggcagtgaagacagactctacgacagaagtaatctatgaggctatgagacaggtgctggccgcacgcgctattcacaatatctttagaatgacagaaagccatctcatggtgactagccaatccctgaggctgattgatccccagactcaggtgagccgggctaattttgagctcacctctgttacccagttcgccgctcaccaggaaaataaacgtctggtaggtttcgtgatccgtgttccagagagtacaggcgaggaatctctaagcacatacatatttgaatctaattcggagggggaaaagatctgctacgctattaatctgggtaaagagattattgaggtgcagaaggacccagaggctttagcgcagttgatgctgagtatccctctgacaaatgacgggaagtatgttctgttgaacgaccagccagatgatgatgatggcaatccaaacgagcataggggtgctgagtcagaggcctag

SEQ ID NO: 213484 - DNA, 2760 bp, Artificial Sequence
  Description of Artificial Sequence: Synthetic coding sequence
atgaccgattcaaagtatttcaccaccaccaagaagggggaaattttcgagttgaaggccgagctcaatagcgataagaaggagaagaagaaggaggcagtgaagaaggttatagcttcgatgactgttggcaaggacgtctctgcattgtttcccgatgtcgtgaactgcatgcagactgacaacctggaactcaagaaactggtttacctgtatctgatgaactatgcgaagagtcagccagacatggcaataatggcagtgaataccttcgtcaaggattgtgaggatccaaaccccttaatcagggcactagcagtgcgaaccatgggttgtattagggttgataagataaccgagtatctttgcgaacccttgcggaagtgcctaaaggatgaggatccatatgttaggaaaaccgccgctgtgtgtgtcgctaagctgcacgatatcaatgctcagctagtggaggatcaagggtttctggatactctcaaggacctgatcagcgacagtaacccaatggtcgtggctaatgccgtggctgccctttcagagatagccgaatcccatccctcctccaacttactggacctgaacccccagtccattaataagcttctcacggccctgaacgagtgtactgaatggggacagatctttattttagattgtttggctaactatatgcctaaggatgatcgcgaggcacaatctatatgtgagagagtcacccctcgactatcacacgctaactcagcagtggtgctgagcgctgtgaaagtcctcatgaaattcatggaaatgctgtccaaagacctcgattactacggcacactgttgaagaaattggcccctccactagtgacactattatcagcagaacctgaactccagtacgtcgctttacgcaacatcaacttaatcgtacaaaagcggccagaaattctaaagcacgagatgaaggtgttctttgtgaagtataacgacccgatctacgtgaagctggagaagctcgatatcatgataagactggcatcccaggccaacatagctcaggtgctggccgaattaaaggaatacgcaaccgaagtggacgttgatttcgttaggaaggctgttagggccattggtcgatgcgccattaaagtcgagcaatcagccgagagatgcgtgtccaccctgctggatctgatacagacaaaggtgaactatgtcgtccaggaggctattgtggttattaaagacatcttccgcaagtaccccaacaagtatgagagtgtcatcgctaccctgtgtgagaacctggatagcctggatgaacccgaggccagagctgccatgatctggattgtgggcgagtacgccgaaaggatcgataatgctgacgagctgctcgaatccttcttggagggctttcacgatgaaagcacccaggtgcagctgcagctgctgacagcaatagttaagctctttctcaaaaagcctaccgaaacgcaagagttagtacagcaggtgctatcgcttgccactcaggactctgacaatcctgatctgagagatcgtggttatatctactggagattactctctacggaccctgtggcagccaaagaggtcgtactggcggagaaacctctgatctctgaagagacagatttgattgaacccaccctgttagatgaactgatctgctatatcgggaccctggcaagcgtatatcacaaacctccctcagccttcgtagagggtgggagaggcgtcgtgcataaaagtctgcctccaagaaccgcttctagcgaatccgccgagtcgccagagacagcaccaacaggcgcaccacctggcgagcagccggatgttatccctgctcagggcgatttacttggggatttactgaacttggatctcggaccacctgtgtcgggccctcccctggccaccagctccgttcagatgggcgctgttgatctgttaggcggaggactcgacagcctaataggtggtactaactttgtcgccccacccacagccgctgttccggctaatctgggggctcccataggctccggtttgagcgacttgtttgacctgacctccggagttggcacactatctggcagttatgtagcacccaaggccgtgggcagcattagtatggatctgcaactcacgaataaagctcttcaagtgatgaccgactttgccattcaatttaaccggaactctttcggactcgcccctgccactcctttgcaggtgcacgcccctttgtccccaaatcaaactgttgagatctccctgcctctgtcgactgtagggtccgtaatgaagatggagccacttaacaacttgcaggtcgcggttaagaacaacatagatgtcttttatttttctaccctgtacccactccacattctgtttgtggaggacgggaaaatggatcggcagatgtttctggccacgtggaaagatattccaaacgagaatgaggcacagttccagattagggattgtcctctgaacgcagaggccgctagcagtaagctacagtcatccaatatttttaccgttgccaagagaaatgtagaaggccaggacatgctgtatcagagtctgaagttgacgaacggaatctgggttctggctgaacttcgtatccaacccggtaacccttcttgcacactctcactcaaatgccgggcacccgaggtttcacagcacgtgtaccaggcatatgagactattttaaagaactag

SEQ ID NO: 213485 - DNA, 2829 bp, Artificial Sequence
  Description of Artificial Sequence: Synthetic coding sequence
atgaccgacagtaagtatttcacgaccaccaagaagggtgagatctttgaattaaaagccgagctgaattctgataagaaagagaagaagaaggaagcagttaaaaaagtaattgcatctatgactgtcggaaaagatgtctctgctctgtttcccgacgttgtgaactgcatgcagactgacaatcttgagttgaaaaagctggtttatttgtatttgatgaactacgctaagtcacagcctgatatggctatcatggccgtcaacacctttgtgaaggattgtgaggaccctaacccccttatcagggccttagccgtgcgcacgatggggtgtatccgagtagataagattacggaatacctctgcgagcctcttcgtaagtgtctgaaggacgaggacccatacgtgagaaaaacagccgcagtctgtgtggcaaagctccacgatatcaatgcccagctggtggaggaccagggcttccttgatacccttaaggaccttattagcgactcaaacccaatggtcgttgcgaacgcagtcgccgcactttctgagatcgcggaatcacacccttcctccaaccttctggacctgaaccctcagtccataaataagctgttgacggccttaaacgaatgtacggagtggggtcaaatctttattctggattgtctggcaaactacatgcctaaagacgatagagaagcacagagcatttgcgaaagagtcaccccacggctatcacatgccaactcagctgttgtactcagtgcagtgaaggtactaatgaagttcatggagatgctctcaaaggatctcgactattatggaacactgcttaagaaacttgcccctcccctagtgaccttactctccgcggagcctgagctccagtatgtcgctttacggaatattaatctcattgtccagaaaaggccggagatcttaaaacacgaaatgaaagtattttttgtcaaatacaacgatccaatctacgtcaagctcgagaaactggatataatgatcaggctcgcaagtcaggctaacatagcacaggttctcgccgaactcaaggagtatgcgacagaggtggacgtcgattttgtaagaaaggcagtgcgagcaatcggaaggtgtgctataaaagtggagcagtcggcggagaggtgcgtgtccaccttactggacctgatacagaccaaggttaactacgtggtccaggaagcaatcgtggtgatcaaagacatttttagaaaatacccgaacaaatacgagtcggtgattgcgacactgtgcgagaatcttgatagtctggacgaaccggaagcaagagcggctatgatctggatcgtgggcgaatatgcagaacgaatagataacgccgatgagctgctggagtccttcctagaagggttccacgacgagtccacacaagtccaactccagctgcttacagcaattgttaaactgtttctcaaaaaacctacggaaacacaggaactggtgcagcaggtgctctccctggctacacaggactccgacaatcctgacctgagggaccgcggatacatctattggagattgctctcaacagaccccgtggctgcgaaggaggtagtgctcgccgagaaaccactgatctccgaggagactgacctcattgaaccgacattgctggacgagcttatctgctacatcggtaccctggcaagcgtgtaccacaagccgccatctgcgttcgttgagggcggaaggggcgtggtacataaatccctgcctccccgtacagcctctagcgaatctgccgaaagtccagagaccgcccctaccggtgcccctcccggagagcagcccgatgtcattcctgcacagggcgacctattgggcgacctgctcaacctggatctgggccctcctgtttctggtcctccattggccacttcctccgtgcagatgggtgccgttgatctcctgggcggagggctcgacagcctgatcggagggaccaattttgtggcccctccaacagccgcagtgcccgcaaacttaggtgcgcctattgggagcgggttgtccgatctcttcgatcttacatccggggttggaacgctatccggctcatacgtggccccaaaagcggtatggttgcccgcaatgaaagctaagggcctcgagattagtggcacattcactcgacaggtagggtcaatctcaatggacttgcaattaactaacaaggcactccaagtgatgaccgattttgccatccagttcaacagaaactctttcggactggccccagccacccctcttcaggtgcacgccccactgtcaccaaaccagacagtcgagatttccctgccccttagcactgtgggatctgtcatgaagatggagccactgaataatttgcaagtggccgtgaagaacaacatcgacgtgttctacttttccaccttgtaccctctgcatatcctgttcgtggaggacggaaaaatggatagacagatgtttctggccacttggaaggacattcccaacgagaatgaggcacaattccaaatcagggattgccctctaaatgccgaggcagcctcctcaaaactgcagtcctccaatatcttcaccgttgccaagcgcaacgtcgaaggccaggacatgctgtaccagagcctgaagctcaccaacggcatatgggtgctggctgagctgcgcatccagccagggaatccctcatgcaccgacctcgaactgtcactaaaatgcagggctccagaggtatcacaacacgtgtaccaggcctacgaaacaatactcaaaaactag

SEQ ID NO: 213486 - DNA, 2850 bp, Artificial Sequence
  Description of Artificial Sequence: Synthetic coding sequence
atgactgatagcaagtatttcactacaaccaagaagggtgagattttcgagctcaaggccgaattgaacagcgacaagaaggagaaaaagaaggaagctgttaaaaaggtgattgccagcatgacagtgggaaaggatgtgagcgccctgttccccgacgtggttaattgcatgcagaccgacaacctcgagctaaaaaagctggtgtatctctatctcatgaattatgcgaagagtcagccggatatggctattatggccgtcaatacctttgtgaaggactgcgaagatccaaaccccctcatcagggcactagctgttcggacaatggggtgcatccgcgtcgataagatcactgaatacctttgtgagccgctgaggaagtgcctgaaggatgaagatccttatgtacgtaaaacagccgctgtctgtgttgccaagttacacgacatcaatgcccaactcgtggaagatcaaggatttcttgataccctgaaggaccttatctctgacagcaaccccatggtggtggctaatgctgtggcagctctgagtgaaatagccgaaagccacccttcaagtaatctcctcgatctgaacccccaaagtatcaataagcttttaacggctctgaatgaatgtactgagtggggccagatcttcatcctggattgcctcgctaattacatgcccaaggatgatcgggaagcccaaagcatctgtgaacgagttaccccacgactgtcccatgctaatagtgctgttgtactgagtgccgttaaagttcttatgaagtttatggagatgcttagcaaggatctggattactacggcaccctcctaaaaaaactcgctcctccactggtgacactgctgagcgcggaacccgaactccagtacgtggccctccgcaatatcaacctgattgtgcaaaagcgccctgagatcctgaaacatgaaatgaaagtgttttttgttaagtataatgatcccatttacgtcaaactggaaaagctggacatcatgatccggcttgctagccaggcgaatattgcacaggtcttggctgagctcaaggaatatgctacggaagttgacgttgactttgttcgtaaagcagttagagccatcggcagatgtgccatcaaagtagaacaatccgccgaacgatgtgtcagtacattgttggacctgatacagactaaagtgaactatgtagtgcaggaagccattgtcgtgatcaaggacatctttaggaagtatcctaacaagtacgagtctgtgatcgctacgctttgtgaaaatttagactcactggacgaaccggaagctcgagctgcgatgatttggatcgtgggagagtacgccgagcggatcgataacgctgacgagttactggagtctttcctcgagggattccatgatgaatccactcaggtgcaactgcagctgttgacagctattgtgaagctgtttctcaaaaaaccaacagaaactcaggagctggtccagcaagtattgtctctcgctacgcaggatagcgacaaccccgaccttcgcgacaggggttacatctactggaggttgctttcaacagaccctgtggctgctaaggaggtcgtactggccgaaaaaccccttatctccgaggagacagacctgatcgagcctacactccttgacgagctcatctgctatatcggcacactggccagcgtgtaccacaaaccgccatctgcatttgtcgaaggaggacggggagtagttcataagagtctacctccacgcactgcctcaagcgagtctgctgaaagccccgaaacggcacctactggcgctcctcccggagagcaaccggacgtgatccctgcccaaggcgatttactcggcgacctgttgaatttggatctaggccctccagtttctggcccacctctagccacaagtagtgtgcagatgggtgctgtcgacttgttgggaggtggactggattctctcatgggggacgagccagaagggataggcggtaccaattttgtggccccacctactgctgccgtccccgctaacttgggcgctccgatcggaagtggtctgagcgatcttttcgatctgacttccggggttgggaccttgtctgggagttacgtggctcccaaggctgtatggctccccgcaatgaaggccaagggtctggaaatctctggtaccttcacccggcaagtgggctcaattagcatggatctgcagttgaccaataaggctctacaagttatgactgactttgccatacagttcaaccgaaattcgttcggattggcccctgctacaccccttcaagtgcatgcgccattgtcgccaaatcaaaccgtcgaaatttcactaccattgtctacggtagggtccgtcatgaaaatggaacctttgaacaaccttcaagtcgccgtaaagaacaacatagatgtgttttacttcagtaccctgtatcccctccacatcctttttgtggaggacgggaaaatggacaggcaaatgtttctggcaacctggaaggatataccaaacgaaaatgaggcccagttccagataagagattgccccctgaatgctgaggccgcttccagcaagctccaaagctcaaatatcttcacagtcgcaaagcgcaatgttgaggggcaggacatgctttatcagagcctcaagctgacaaatggtatctgggttttagctgaattaagaattcagcccggaaacccctcgtgtactgacctggagctgagcctcaagtgtcgagcccctgaggtgagccagcatgtgtaccaggcttatgagacaatcctaaagaactag

SEQ ID NO: 213487 - DNA, 2820 bp, Artificial Sequence
  Description of Artificial Sequence: Synthetic coding sequence
atgacagatagtaaatactttactactacgaaaaaaggtgagattttcgagctgaaagctgaactaaactcagataagaaagagaaaaagaaagaggcggtgaaaaaagtcatagcttcaatgactgttggcaaggacgtcagcgctctgtttcccgacgtggtcaattgtatgcagacagacaatctggaacttaaaaaactggtttacctatacctgatgaattacgctaaatcacagcctgatatggcaattatggctgttaacaccttcgtgaaagactgcgaggacccaaaccctttgatcagagccctcgccgtgcgtaccatgggctgcattcgcgtcgataagattacagagtatctgtgcgaacctcttaggaagtgcctgaaggatgaagacccatacgtcaggaagacagctgcggtgtgcgttgctaaattacacgacatcaatgcccaactcgtagaagatcaagggtttttggatacactgaaggacctcatctccgatagcaatccaatggttgtcgcgaatgccgtcgccgctctgtctgaaatagcagaatctcatccttcttctaacctactggatttgaacccccagtccatcaacaagctgcttactgccttaaatgaatgcaccgagtgggggcagatatttatcctggactgcctcgctaactacatgccaaaagacgacagagaagctcagtccatatgtgaaagagtgactccccgattgtcacacgccaatagtgcggtcgtgctgtccgcagtcaaggttctaatgaagtttatggagatgctgagcaaagacctggactattacggtaccctgctaaagaaattggctcccccattagtgaccctcctgtccgctgaacctgagctgcagtatgttgcacttcggaatatcaacctcatcgtacagaaacgacccgagatcctcaaacacgagatgaaggtgttttttgtgaaatacaatgacccaatttacgtgaaactagagaagttggacataatgattcggctcgcaagccaggccaatattgctcaggtgctggcggaattgaaagagtacgccacagaggtggacgtcgattttgtgcgcaaagctgtgcgagccatcggcagatgtgctatcaaggttgaacagagtgcagaacgctgtgtcagtactttgctagatctcattcaaacaaaggtgaactacgttgtacaggaagctatcgtggtaattaaggacatctttagaaagtacccaaacaagtatgagagtgttatagccacgctatgtgagaacctggactcattagacgagcccgaggccagggccgcaatgatctggattgttggggagtacgccgagcgaatcgacaacgctgacgagctcttggaatcatttctcgaggggttccacgatgagtcgactcaggtacagctccagctcctgactgccatcgtcaaattgtttctaaagaaacccactgaaacacaggaacttgtgcagcaggtcttaagcctcgccacgcaagattctgataaccccgacttgcgtgatcggggatatatctactggaggctgctgtcaaccgatcccgtcgctgctaaggaagtggttctggcggagaaacccctaatctccgaagaaaccgacttaatcgaacccacactccttgacgaactaatctgctacatcggaacacttgcctccgtctatcacaaaccgccatcagcctttgtcgagggaggtcgtggagtcgtgcataaatccctcccacccaggacagctagctcagagagcgcagaatctcccgagaccgcgccaactggcgcaccaccgggagagcaacccgacgtcatccccgcacagggcgacctgcttggcgacctgctgaatctcgacctggggccaccggtgtccgggcctccattggctacctccagtgtacaaatgggagcagtcgacctgctgggtggcggactcgatagtctcataggcggaaccaacttcgtcgcaccgccaacggccgcagttcccgctaatctgggagcacccatcggcagtggcctgtcagacctctttgatcttacgtcaggggtcgggacgctcagtgggagttacgtggctccgaaagctgtttggctgccagcaatgaaagcgaagggcttagagatctccgggacgttcactagacaggtcggctctattagcatggacttgcagcttactaacaaagcactgcaagtaatgaccgattttgccatacagtttaatagaaattcctttggactggcgccagcaacacctctccaggtgcacgcgcctctgtcacctaatcaaacagtggagatctctcttccccttagcactgtgggcagcgtgatgaaaatggagcctctcaacaacctgcaggtagcggtaaagaacaacatcgatgtcttctattttagcaccctttaccctctccatattctgttcgtggaagatggtaagatggataggcagatgtttctggctacttggaaagatattcccaacgaaaatgaagcacagttccaaatccgcgattgccccttgaacgccgaggccgcatcaagtaagctgcagtcttcaaatattttcaccgtcgctaagagaaacgtcgagggccaggacatgctgtatcagtcgttgaaactgaccaacgggatttgggtgctggctgagctccgaattcagccagggaacccatcctgtactctctcactgaagtgccgagcgcctgaagtgagtcagcatgtgtatcaagcttatgagactatccttaagaattag

SEQ ID NO: 213488 - DNA, 2850 bp, Artificial Sequence
  Description of Artificial Sequence: Synthetic coding sequence
atgaccgatagtaaatattttactacaactaagaaaggagagatctttgagctcaaagcagaattaaatagcgacaagaaagaaaagaaaaaggaagccgttaagaaggttatagctagcatgaccgtgggcaaagacgtgagtgctctctttccagacgttgtaaactgtatgcagacagacaatttggaactaaaaaagttggtctacttatacctgatgaactatgctaagtctcagcctgatatggccattatggccgtgaacacatttgtcaaggattgcgaggatcccaatcccttgattagagctttggctgtcagaaccatgggctgtattcgggtggacaaaattactgagtacctatgtgaacccctgcgcaagtgcctcaaggacgaagatccttacgtgcgcaagaccgcggctgtgtgcgttgccaaacttcacgacataaacgcccaattggtggaagaccagggctttctggataccctcaaagatctgatctccgattctaacccaatggtagtggccaacgccgttgctgctctatctgagattgcagaatcgcacccctcctcaaacctactggacttgaatcctcagtcaatcaacaagcttcttacagctctgaatgagtgtaccgagtgggggcagatattcatcttggactgcttggccaactatatgcctaaggacgaccgagaagcccagtcgatatgcgaacgtgttactccgagactttcacacgccaattcagctgtcgtcctgtcggcggtgaaggtgctgatgaagttcatggaaatgctgagcaaagacctggactattatggtacccttctcaaaaaacttgcccctcctctagttactttattgagcgccgagcctgaactccagtatgtagcacttagaaacatcaatttaatagtgcaaaagcggccagagattctgaagcacgaaatgaaagtgtttttcgtgaagtataacgacccaatttacgtgaaactggagaaacttgatataatgatcagactggcaagccaggccaacattgcccaagttctggctgaactgaaggaatatgcaaccgaagtcgatgtcgattttgttagaaaggccgtacgcgctataggtcgttgcgccatcaaggtggaacaaagtgcggaacgttgtgtaagtaccttacttgatctcatccagactaaagtcaattatgtggtgcaagaggccatcgtagtgattaaggatatctttcgcaaatatcccaataagtacgagtcagtcattgctaccttatgtgagaatctggactccctggacgaaccagaggcaagggctgcaatgatttggattgttggggagtacgccgagcgcatcgacaacgctgacgagttgcttgagtcgttcctggagggtttccacgacgagtcgacacaagttcaactacagctgctgaccgctatagtgaagctgttcttgaaaaagccaacagagacgcaggagttagtgcagcaggtgctctcactcgccactcaggatagcgataacccagaccttcgcgacaggggctatatttactggagattactgtccactgaccctgtggccgcaaaggaggtggtactggctgagaaacccctgatatccgaggagacagatttgattgaacctaccctgctggacgagctcatctgttacattgggaccctggctagtgtgtaccataaacccccaagcgcctttgtcgaaggagggagaggagtcgtccataaatccctaccacccagaactgccagttctgagtctgccgaatccccggagactgctcccactggagcccctcctggggagcagcctgacgtgattcccgctcagggcgatctgctgggcgacttactgaacctggacctgggtcccccagttagcggaccccctctcgctacctcttccgtccagatgggagcagtggaccttttaggtggcggactggactccctgatgggagatgaacccgagggcataggaggaactaactttgtcgcccctcctaccgccgcagtaccagcgaacctgggcgctccaataggaagtggcctgtccgacctatttgacctcacttcaggcgtgggaaccctaagcggttcttacgtggctccaaaggcggtatggcttcctgccatgaaagccaaaggccttgaaatctccggaaccttcacccgccaggtgggctcaatctctatggacttgcagctgacgaacaaggccctacaagtcatgactgacttcgccattcaattcaaccggaatagtttcgggctagctcccgctacccctctacaggtacacgcacccctgagcccaaatcaaaccgtcgagatcagcctgccgctgtcaactgttggatctgtcatgaagatggagcctctgaataatctacaggtagccgttaagaataacatcgacgtgttctacttttctactctgtatcccctgcatatcctgttcgttgaagacggtaagatggacagacaaatgttcctggccacctggaaggatattcctaacgagaacgaagcccagtttcaaattcgagactgtccactgaacgccgaggcagcaagctctaagctccagagtagtaacattttcacagtggccaagcgcaatgttgaagggcaggacatgctgtatcagtctctgaaacttactaatggaatctgggttttggccgagctgcgaatacagcctggcaatcccagttgcacagacctggagctttccttgaaatgccgggcaccggaggtgtctcagcatgtctatcaagcgtatgagacgatcctcaagaattag

SEQ ID NO: 213489 - DNA, 2820 bp, Artificial Sequence
  Description of Artificial Sequence: Synthetic coding sequence
atgactgactctaagtacttcacaacaacgaagaagggggagatttttgagttgaaagccgaactgaatagtgacaagaaggagaagaaaaaggaggccgtaaaaaaggttatcgcctccatgactgtgggtaaggatgtatccgcactgttccctgacgtcgtaaattgtatgcagactgataacttggagttgaaaaagctggtctacctgtacctgatgaattatgccaaaagccagcctgacatggccattatggcggtcaacacattcgtcaaagattgtgaggacccaaaccctctgatccgggctctggcagtccgcaccatggggtgcatcagggtggacaagataactgagtacctgtgcgaacctctgcggaaatgccttaaggacgaggacccctacgttcgaaaaactgccgctgtgtgtgtcgccaagctccacgacatcaatgcacagctcgtcgaggatcaggggtttttggacaccttaaaggatctcatctccgacagcaatcctatggtggttgccaatgcagtggccgcattgtcggaaattgcagagtcccatcccagttccaacctactggatttgaacccacagtccatcaataaacttctcaccgccctgaatgaatgcacagagtgggggcagatctttatactggactgtctggctaattatatgccaaaggacgacagagaggcccaatccatctgtgagcgtgttaccccaagactatcccacgccaatagcgccgtggtcctgtcagcagtgaaagttcttatgaagttcatggagatgctgtccaaggacctcgattactatgggacgctgctaaagaaattggcaccaccactggtgactctgctgagcgcagaaccagaactgcaatacgtcgcccttcgcaatataaacctgattgtgcaaaaaagacctgagattcttaaacatgaaatgaaggtattctttgttaaatataatgatcccatttacgtgaagctcgaaaagttggacatcatgatacggctggcaagccaggcaaatattgcacaggtactggccgagctgaaggagtatgccacggaggttgatgtagatttcgtgcgaaaggctgtgcgagctataggcaggtgtgcaatcaaggtagaacagagtgccgaaaggtgcgtcagcacccttctggatttgatacagaccaaggtgaactacgttgtgcaagaagcaatagtcgtcatcaaggacatctttcggaagtaccctaataagtacgagtcagtaatcgctacattgtgcgaaaacctcgactcactagacgagcccgaggccagagccgctatgatttggatagtaggagagtatgcagagcgtattgataatgccgacgagctgctggaatcctttttggagggcttccacgacgagtccacccaagtgcagttgcagttactgacagctattgtgaaactcttcttgaaaaaaccgacagagacgcaggagttggtacagcaggtgttatctttagccacgcaagattctgataaccccgacctgagggacaggggctacatctactggcggctcctctcaaccgacccagtggcagctaaggaagtcgtgctggccgagaaaccactaatcagcgaggagaccgacctgatcgagcccactcttctcgacgaactgatctgctacataggtactctagccagcgtctaccataagcctccatcagcctttgtagaaggcggtcggggagtggttcataagagcctaccaccaaggaccgcgagctcagaatctgcagaatcgccggagaccgcccctaccggtgctcccccaggcgaacagccagatgtcattccggcacagggcgatcttctcggcgatctgctgaatctcgacctgggtccacccgtctcagggcctccactcgccactagttctgtgcaaatgggcgcagttgatttactaggcggaggccttgacagtttaattggtgggaccaactttgttgccccacctacagccgcagtgcccgctaatctgggagcccctattggctctgggctgtccgatctgtttgatctcacctccggagtgggaacactatctggcagctatgtggctcctaaggcagtttggctcccagcaatgaaggccaaaggtttggaaatttcaggcacatttactcgacaggttggtagcatttccatggatctgcaactcaccaataaggctcttcaagtgatgaccgactttgccattcaattcaatcgaaactcttttggcttagccccagccactcctcttcaagtgcacgcccctctgtctccaaaccagaccgtggagatcagcctgcctctgtctacggttggcagtgtaatgaaaatggagcccttaaacaacctccaggtcgccgtgaaaaataacattgacgtattctatttcagtactctgtacccgcttcacattctctttgtcgaagatggcaaaatggaccgccagatgttcctcgcgacctggaaagatattccaaatgagaatgaggcgcaattccagattagggactgcccactgaacgcggaagccgctagttccaagctgcagagcagtaatatattcactgtggcaaagcgaaacgtggaaggccaagatatgctgtaccaaagcctgaagctgactaatgggatctgggtactcgccgagctgcgaatccagcctgggaaccctagttgcactctgagcttaaagtgccgggctcctgaggtatcccagcacgtttaccaagcttatgaaacaattttgaaaaattag

SEQ ID NO: 213490 - DNA, 1737 bp, Artificial Sequence
  Description of Artificial Sequence: Synthetic coding sequence
atgaccgattctaagtacttcaccactaccaagaagggcgagatctttgagttaaaagccgaactcaacagtgacaagaaagaaaagaaaaaagaggctgtgaagaaggtgattgccagtatgacggtgggaaaagacgtgagcgctctgtttccggatgtagttaactgcatgcagaccgacaatcttgaactcaaaaagttggtgtatctctacctgatgaattatgctaagagccaacccgacatggccatcatggctgttaacacttttgtaaaggactgcgaggatccaaatccactcattcgagcactggcagttcggaccatgggatgcatcagagtggataagatcactgaatacttgtgtgagcctttgaggaagtgtctgaaagatgaggacccgtatgttagaaagactgctgctgtgtgcgttgccaagctgcatgatatcaatgcacaactcgtggaagatcaggggttcttggataccttgaaggaccttatctccgatagcaatcctatggtggtagccaacgctgtcgctgccttgtccgaaatcgctgaaagtcacccaagttctaatctactagatctcaaccctcagtccattaataaactcctgactgctctgaatgagtgtacagagtggggtcagatcttcattctggattgcctcgccaattacatgcccaaggacgacagggaagcccagtccatctgtgagcgagtcacacctcggctaagtcacgctaactctgctgtggtcctgagcgcagtcaaggtgctcatgaagttcatggagatgcttagcaaagaccttgattactatggcacgctgctgaagaagctggccccaccactagtgaccctattatctgcagagcccgaattgcagtacgtggcactgcggaacatcaacctgatagtccaaaaaaggccggagatcttaaaacacgagatgaaagtgttcttcgtcaagtataatgaccctatttacgtcaagctggagaagttggacatcatgatccgtctcgcatcacaggcgaatattgcacaggtgctggccgagttaaaggagtacgcaacagaggttgacgtggattttgtgcgaaaagcggtcagagcaatcggcagatgtgctattaaggtcgaacagtcagctgagaggtgtgtctctaccctcttagatctgatccaaactaaagttaactacgtggttcaggaggcgatcgtagtaatcaaagacatctttcgcaagtatccaaacaagtatgagtccgttattgccacactgtgcgagaatctggattctctggacgagcccgaagcacgtgcagcgatgatctggatcgtgggggagtatgcggaacggattgataacgctgacgagctgctagagtccttcctagagggtttccacgatgagtcaactcaggtccagttgcagctcctgacagcgatagtcaaactctttctcaagaagccaacagagacccaagaactcgtccagcaggtgctaagcctggccacccaggattcagacaatcccgacctacgggatcgtggttatatctactggcgactgctgtcaactgatccagtagccgcaaaagaggttgtgctggccgaaaaaccgcttatctccgaagagaccgatttaatcgagcctactctgctggacgagttaatatgctacattggaacgctggcttccgtgtaccataagccaccctag

SEQ ID NO: 213491 - DNA, 2820 bp, Artificial Sequence
  Description of Artificial Sequence: Synthetic coding sequence
atgacagattccaagtacttcactaccacaaagaaaggagagattttcgaactcaaagccgaattgaactctgacaaaaaagaaaaaaaaaaggaagccgtgaagaaagtgattgctagcatgactgtagggaaagatgtatccgccttatttcccgacgtggtcaactgcatgcaaaccgacaacctggagcttaagaagctcgtttacctgtacctgatgaattacgcaaaaagccagcctgatatggccatcatggccgttaatactttcgtgaaagactgtgaagacccgaatcctctgataagagcattagctgttcgaactatgggctgtattcgggtggacaaaattaccgaatacctgtgcgaacccctgcggaaatgtctgaaggacgaggacccctacgtgcggaagacagccgctgtgtgcgtcgcaaaactgcatgatattaacgctcagctcgtggaggaccaagggtttcttgacactcttaaggacttgatcagcgacagtaacccgatggtagtggccaacgcagttgccgcactgtctgaaatagcggagtcccacccgagcagtaacctcctcgatctgaatcctcagagtataaataagctactgacagccctgaatgaatgcaccgagtggggccagatcttcatcctcgactgcctcgccaactacatgcccaaagacgatcgggaggctcagagcatctgtgagcgggtcacacccagactgtcacacgcgaactctgcggtcgttctgagtgctgtgaaagtacttatgaagttcatggagatgctgagcaaggatctcgactactacggtactctgctgaaaaagctggccccacccctcgtcacactcctgtctgcagagcctgagcttcagtacgtcgcacttcggaatatcaatctcatcgtccagaagaggcccgagattctaaaacacgagatgaaggtcttctttgtgaaatataacgacccaatctacgtgaaactggagaagcttgatattatgatccgtcttgcgagccaggctaatatcgcacaggtactcgccgagttaaaagagtacgccacagaggtggatgttgatttcgtgcggaaggccgtgcgcgcaatcggcagatgcgctattaaagttgaacagtccgctgagagatgcgtctcaacgctgctcgatctgatacagaccaaagtgaactacgtcgtccaggaggccattgtggtgattaaagacattttcagaaagtatccaaacaagtacgaaagcgtcatagcaactttgtgcgagaacctggactcactagacgagcctgaggcaagggcagctatgatttggatcgtgggtgagtacgccgagcgcatcgacaatgccgatgagctgttagagtctttcctagagggctttcacgatgagtctacccaggtccagctgcagcttctgacggcgatcgtcaaactgtttctgaagaagccaacggagacacaggagctcgtccagcaggtactctccttggctacccaggattctgacaatcccgatcttcgagacagaggctacatttattggcgcctgctctccactgatccagtggcagcgaaggaggtcgtcctggccgagaagcccctgatttcggaggaaacggacttaattgaacccacactgctggatgagcttatttgctacatcgggacactcgcctcagtgtaccataagccgccttccgccttcgtcgaaggcggacggggtgtggtgcacaagagcctgcccccacgaactgctagctccgaatcagccgagagccccgagacggcacctacaggtgctcccccaggagagcagcccgacgtgattccggctcagggtgacctgctgggcgatctgttgaatctagacctggggccaccagtgtccggaccacccttggcaacctcaagcgtccaaatgggcgcagtagacctcctggggggtggtcttgactcactcattggaggcactaacttcgtggcacccccaacagcagccgttcccgctaatctgggagccccaatcggatctggactgagcgatctcttcgatttaactagcggggtaggtacgcttagtggtagctacgtcgccccaaaagctgtgtggctgccagcaatgaaagccaagggcctggagataagcgggacattcacacgacaagtgggatctatttcaatggaccttcagctgaccaacaaggctctgcaggtgatgacagacttcgctattcagttcaaccgcaacagctttgggctcgcaccagcaacacctctgcaggtccacgcgcctctttcgcccaatcagacggtagaaatctctctgcctctgtctacagtaggatctgtgatgaagatggagccactaaacaatcttcaggtcgcagtgaagaacaatatcgatgttttttatttctctacactgtatccactccatatcctattcgtagaggacgggaaaatggacaggcaaatgtttcttgccacttggaaagatatccccaatgaaaatgaagctcaatttcagattagagattgtcctctgaacgcagaagctgcaagtagcaagctgcaatcctccaatatttttacagttgccaagcgcaatgtcgaaggccaggacatgctttatcagtctctcaagctgactaacggaatctgggtactggccgaactgcgcatccagccaggaaatccttcttgcaccctgtctctcaaatgtcgcgcaccagaagttagccagcatgtgtaccaggcatacgaaaccattttaaaaaattag

SEQ ID NO: 213492 - DNA, 2469 bp, Artificial Sequence
  Description of Artificial Sequence: Synthetic coding sequence
atgcccgctcccattaggctacgagagctgattcgcactatccgtacagctaggacacaggctgaagagcgagaaatgattcaaaaggagtgtgccgctataaggagctccttcagggaagaagataacacctaccgctgtcgtaatgtggcaaaactcctttacatgcacatgctcggttacccagcccattttggacaactcgaatgccttaagctcattgcctcacagaaattcactgacaagcggattggctatctgggcgctatgttgctgctggacgaaaggcaggatgttcatctgctcatgacaaactgcatcaagaatgatctgaaccactctactcagttcgtgcagggccttgccctgtgtaccttggggtgcatgggttcttccgaaatgtgtagagacctggcaggggaggtggagaaactgttgaaaacttccaacagttacttgagaaagaaagccgctctgtgtgccgttcacgttattagaaaagtgccagagcttatggagatgtttttaccggcaacaaaaaacttgctaaatgaaaagaaccacggagttctccatacctccgtcgtgctattgacggagatgtgtgagaggtcacctgacatgcttgcacacttccgcaaacttgtcccccagctagtccgaatcctcaagaatctcatcatgtcagggtactcacctgagcacgacgtgtctggaattagcgatccttttttgcaggtaagaattctgcggttgctgcggatactgggaagaaacgacgatgactccagcgaggcaatgaacgatatactcgcacaggtcgctactaatactgagacttccaagaacgttggaaacgcgatcctgtatgaaacagtgcttacaatcatggacattaagtcggaatctgggctgagagtgttagccatcaatattttaggaagatttctactcaacaatgacaagaatatccggtatgttgcactgacaagcctgttgaagaccgtccagaccgaccataacgccgtccagaggcacagaagcaccattgtggattgtctgaaagatttagatgtctctatcaagagaagggctatggaactgtccttcgcactggtgaatgggaataacattcggggaatgatgaaggaactgctgtatttcttagatagttgtgagcctgaattcaaggccgattgtgccagcggtatttttttggccgctgagaaatacgccccatcaaagcgttggcatatagatacaatcatgagagtgttaaccactgcaggatcctatgtgcgcgacgacgctgttcccaacttaatacagctcattactaatagtgttgagatgcacgcttacactgttcagcgcttgtacaaagctatcctcggtgattactcccaacagccacttgtgcaggttgccgcttggtgtatcggtgagtatggggaccttcttgtgtcgggccagtgtgaagaagaagagcctattcaggttacagaggatgaagttttagatatcctggaaagtgttctcatctctaacatgtccacatccgtgactaggggatacgcgctcaccgcgatcatgaagctgagcacgcgtttcacttgcacagttaaccgcatcaagaaagtggtaagcatctatggtagctctattgatgttgagctgcaacagcgggcagtggagtacaacgcactgtttaagaagtatgatcacatgagatccgcattgctagaaaggatgcccgtcatggaaaaggttacaactaatggacctacagaaattgtccagacaaatggagagacagagcctgcccctctggagaccaagccaccaccctctggccctcagccgacatcacaggccaacgacctgctagatctcctggggggtaacgatatcacgccagtcatcccaacagctcccacctccaagccatcaagcgcgggaggagagctcttggatctcctgggagacattaacctcacaggggcacccgctgccgcaccggctccggcttccgtgcctcagattagtcagcctccattcctactggacggcctgagctctcagcctctattcaatgacatcgcagcgggaatcccgtccataacagcctattctaagaacggattaaaaatcgagttcacctttgagcggagcaataccaatccttccgtgactgtcattaccattcaagccagcaacagtaccgagctggacatgactgatttcgtctttcaagctgccgtgcccaagacatttcaactgcagctgctctctccctctagtagcatagttcccgcttttaacactggtaccattactcaggtcataaaggtgctgaatccccagaaacagcagctgcggatgagaatcaagcttacttacaatcacaaaggctccgcgatgcaagatctggcagaagttaacaacttcccaccccagagctggcagtag

SEQ ID NO: 213493 - DNA, 2478 bp, Artificial Sequence
  Description of Artificial Sequence: Synthetic coding sequence
atgccagcaccaattcgcctccgtgaactgatccgcacgatcaggaccgccagaacacaggccgaagaacgggagatgattcaaaaggaatgtgctgccatacgatcatcatttagggaagaagacaacacctaccgctgtagaaacgttgccaagcttctgtacatgcacatgcttggatatccggcacatttcggacagttggagtgcctgaagctgattgcaagccagaaatttacagataagcgcatcggctatctgggcgctatgctccttctggatgagagacaggacgtccaccttttgatgaccaactgtattaaaaatgacctcaaccactctactcagttcgtgcaggggctcgccctctgtaccctcggctgtatgggctcttccgaaatgtgtcgtgacctggctggcgaggtggaaaagctgctcaaaacttcgaattcatatctgcggaagaaggcagcgctttgcgcagttcatgtcattagaaaggttcctgaactgatggagatgttcctcccggctactaagaaccttctcaatgagaaaaaccatggcgtcctgcacacaagtgtggtccttctgactgaaatgtgcgaaagaagtccagatatgctggcccatttcaggaaaaatgagaaactggttccacaactcgtgcggatcctcaaaaatctgatcatgtctggatatagcccagaacacgacgttagcggcatcagtgacccttttctgcaggttagaattctgaggctcctgcgaatcctagggaggaacgatgacgactccagcgaggcgatgaacgatattctggctcaagtggctacaaatacagagactagcaaaaatgtgggaaacgctatcctttacgagaccgtgttaacaatcatggacattaaaagtgagtcaggacttagggtcctggcaatcaacatcctgggaaggttcctcctcaacaatgacaagaatatccgttacgtcgcattgacatccctgctaaagaccgtgcagacggatcataacgccgtgcagaggcaccgttccacaatcgtggattgcctcaaggacctggacgtctctattaagaggcgtgctatggaactgtcctttgcattagtcaacggaaataatattaggggaatgatgaaagaactcttatatttccttgattcttgcgaacccgagtttaaagcggattgcgcctctggaatcttcttagccgcagaaaagtatgccccttcgaagcgctggcacatcgacacgattatgcgggtgctgacgaccgcagggagctacgtcagggatgatgcagtccccaatcttattcaactcattacaaattccgtggaaatgcacgcatatactgtacaacgcttgtacaaggcaatcctgggcgattactctcagcagccactggtgcaagtggccgcttggtgtataggcgaatacggcgatctgctagttagtgggcagtgtgaagaggaggagcctatacaggtgacagaggatgaggtactcgatattctggaatctgtgctgatatctaacatgtccactagtgtgacacggggttatgcacttacggccatcatgaagctgtccactcgcttcacatgtactgtgaacagaataaaaaaagtggtttccatatacgggtcatctatagacgtggagctgcagcagcgagctgtggaatataatgcactctttaagaagtacgaccatatgagaagcgcgcttctggagaggatgcccgtgatggaaaaagtgacaactaacggtccaactgagatcgtgcagaccaacggcgagacagagccagcaccacttgaaactaagcctcctccgtccggtccccagccaacaagccaggccaacgatctgctagatctcctggggggaaacgacattaccccggtcattcctaccgccccaaccagcaaaccatcttccgccggaggagaactgctagatcttctgggggatataaatctgacaggcgcaccagcggctgcacctgctcccgcatcagtaccccaaattagtcaaccaccctttttactcgacggcctctcgtctcagcctctgtttaatgacatcgctgcgggaataccttctataactgcatactccaagaacggcctcaagattgaattcactttcgaaaggtccaatactaatcccagcgtgacagtgatcaccatacaggcgtctaactccactgagttagacatgaccgattttgtgtttcaggccgctgtcccaaaaacatttcagctgcagctgctctccccctccagttctattgtccccgcattcaataccgggacaataacccaggttatcaaggtcttgaacccccagaaacagcagctcagaatgcgaatcaagctgacgtataaccataaaggctccgcgatgcaggatctcgctgaggttaacaactttcccccacaaagttggcagtag

SEQ ID NO: 213494 - DNA, 2478 bp, Artificial Sequence
  Description of Artificial Sequence: Synthetic coding sequence
atgcctgctcccattcgcctaagagagttaatccgcaccattcgtacagccaggacccaagctgaggagcgtgaaatgatccaaaaggagtgcgcggctattcggtctagcttcagagaggaggacaacacctaccgatgtcggaatgtggcaaaattgctttacatgcacatgctcggttaccccgctcattttgggcagctggagtgcctgaagctgatcgcatcccagaaatttaccgacaaaaggattggctacctgggcgcaatgttattattggacgaaagacaggacgttcacttgctcatgaccaattgcattaaaaatgacctgaatcattccacacaatttgttcagggactcgccctttgcacactgggctgtatgggatcaagtgagatgtgccgtgacttggctggggaggtggagaaactgctgaaaactagtaattcttacctcagaaaaaaggcagccctgtgcgcagtccatgtgatccggaaggtcccagagctgatggagatgttcttacctgccactaaaaatctcttgaacgaaaaaaatcacggagttcttcatacaagtgttgttttgctgaccgaaatgtgcgagaggagcccagacatgctggcacacttccgcaaagagagtaagctcgtgcctcaactcgttcgaatacttaagaacttaattatgagtggctactcacctgaacacgatgtatcaggaatctcagaccccttcctccaggtgagaattcttaggttactccgcatcctgggccgtaacgacgacgactcatcagaggccatgaatgacatcctagcacaagtagccaccaacaccgaaactagtaaaaatgttgggaacgccattttgtacgagacagtgctgaccatcatggatattaaatccgagtctggtcttcgcgtcctggccattaacatcctcgggcgttttctgttgaataacgacaaaaatataaggtacgtggccctcacaagccttctgaagaccgtgcagacagaccataatgccgtgcaaagacatcgctcgaccatcgtcgattgcctgaaagacctggacgtttctattaagcgacgggctatggagctgtccttcgcccttgtgaacggcaacaatattaggggcatgatgaaggaactgttatattttctagactcctgcgagcccgagttcaaagcagactgtgccagcgggattttcctggctgccgaaaagtacgctccctcgaagcgctggcacattgacacaattatgcgtgtgctaaccaccgcaggctcctacgtgagggacgacgccgtgccgaatttgattcaactgattacgaattcggtcgaaatgcatgcttacactgtgcagagactgtacaaggcaatcttaggcgactatagccagcagcctctggtccaggttgctgcttggtgtatcggcgaatatggcgatctgctcgtgagcggccagtgtgaggaggaggaacctatccaggtgacagaagacgaagtgctagacatccttgagtctgtcttgatttcaaacatgagtactagcgtgacacggggatatgccctgaccgccatcatgaagctgtctacccgatttacttgtacggtgaataggataaagaaggtggtaagtatctacgggtcttccattgacgttgagctccagcagagggctgttgaatacaatgcgctgtttaagaagtatgatcacatgcgaagtgccctgttagagcggatgcccgtcatggaaaaggttaccaccaatgggcctaccgagatcgtgcagacgaatggggaaacagaaccagccccactggagacaaaaccaccccctagcgggcctcagccaacaagtcaagccaatgacctgctagatctgctgggaggtaacgacatcacacctgtgatcccgactgctcctacttccaagccaagctccgcaggcggtgagttgctggatctattaggggacataaaccttaccggagctcccgctgccgctcccgcacccgcttcggtgcctcagattagtcagcctcccttcttgctggatggtctttccagccaacctctttttaacgacatagcggcaggaattcccagtattacagcctacagtaaaaacggtctgaagatcgaattcacatttgagcgctctaacactaatcctagcgtgaccgtcattactattcaagccagtaatagtaccgaattggacatgactgacttcgtgttccaggctgctgtccccaagactttccagctccaactacttagtcccagttcttctattgtgccagcttttaacaccggtactattacgcaagttatcaaggtgctgaacccacagaaacagcaattgaggatgaggatcaagttaacctataaccataaagggagcgccatgcaggacctggcggaagttaacaactttcctccgcagtcttggcaatag

SEQ ID NO: 213495 - DNA, 1698 bp, Artificial Sequence
  Description of Artificial Sequence: Synthetic coding sequence
atgttcgggagctgttgccactgctgtcgcagaccacggtcttgctggtttcactcccggtttagggccgtcagcggcgtccaatcgcaggccgtcggtgtcgagaaaagacgtcagcgaagttgggcacggagagggagggaacctcagggcctcctgagactgctagagggaagaccacgagggctaggcccagggggttccgcacgaagaggtgtgccatgctgtggagtggcaccccctcgtatgcccgcacctataaggctgcgggagttgatccggacaattcggacggcgaggacacaggcagaggaacgagagatgatacagaaagaatgcgccgctattcgctcctccttccgagaagaggacaacacttacagatgcagaaacgtggcaaagctgttgtacatgcatatgctgggctatcccgcacactttggccagcttgagtgtctgaaactcatagccagccagaagtttacagacaagagaataggctatctcggcgctatgctattgctagatgagcggcaggacgtacaccttctaatgactaactgcatcaaaaatgacctcaaccacagtacccagtttgtgcagggtctggcactatgcacgctcgggtgcatgggaagctcggaaatgtgtcgagacctggccggagaggttgaaaagttgttgaaaacctctaatagttatttaaggaaaaaagcggcattgtgtgcagttcatgtgatacgaaaggtgcctgaactgatggaaatgttcctccctgccacaaagaaccttttaaacgagaagaaccacggagtactccacacttcagtggtactgctgactgagatgtgtgagcgctctccggatatgctggcacacttccgcaaagaaagcaaactcgtacctcagctggtgaggatcttgaaaaatcttatcatgagcggctattccccagagcacgatgtgtctggcattagcgaccctttcctgcaggtgagaatactgaggctgttaaggatcctggggcgaaacgatgatgactctagcgaggcaatgaacgacatcttggcccaagtggctacaaacactgaaacatcaaagaatgtggggaacgccatcctgtatgagacagttctgacaataatggatattaagtccgagtccgggctccgcgttctcgctattaatatattgggaagatttttgctcaacaatgacaaaaatataaggtacgtggctctgacatcgctgttaaagactgttcagaccgatcacaatgccgtccagcggcaccggtccactatcgtggactgcctgaaggacctggatgtgtcgatcaaacggagagccatggaattatccttcgcgctggtcaacgggaacaacattcgtgggatgatgaaagagcttctctatttcttagatagttgtgagcccgagttcaaggcagactgtgcctcggggattttccttgctgccgagaagtatgcaccatcgaaacggtggcacatcgataccatcatgcgcgtgctaaccacagctggctcctatgttcgcgacgatgccgtgcctaacctgattcagctgataaccaattccgtcgagatgcatgcctacacagtccagaggttatataaagcaatcctgggggactatagtccaaccttcggcactagtggctgtatggtctaccgttag

SEQ ID NO: 213496 - DNA, 2538 bp, Artificial Sequence
  Description of Artificial Sequence: Synthetic coding sequence
atggagaagaatataaaccttaggaactgccaaacactgaacacatacgtcatgcttacccacctgaggatgcctgcccctataaggctccgtgaactgatcaggacgataagaaccgccaggacacaggcagaggagcgagaaatgattcagaaagagtgtgcagccatccgttcaagttttcgcgaggaggataatacatacagatgcaggaatgtagcaaagctgctgtacatgcatatgctcggctacccggctcatttcggccagctggagtgtctgaagcttattgctagccagaagtttacagataaacgtatcggatacctcggtgctatgcttctcctggacgagagacaggacgtgcacctgctgatgacaaactgtattaagaacgatctgaaccacagcacacagttcgtacagggccttgctctttgcacacttggttgtatggggagcagtgagatgtgccgggatctggccggagaggtggaaaaactgcttaaaacaagtaactcataccttcggaaaaaagccgctctgtgcgccgtgcacgtaatccgcaaagtgcccgagctcatggaaatgtttctcccggcaacaaaaaatcttctgaacgaaaagaaccacggagtccttcacaccagtgtggtgctattaacggagatgtgcgagagatctcctgacatgctggctcactttcggaagctcgtcccacagctggttaggatccttaagaacctgatcatgtccgggtacagtcctgagcacgacgttagcggcatctccgacccttttcttcaggtgcggatcttgcgcctgctgagaattctcggacggaatgatgatgatagttcagaggctatgaacgatatcctagctcaagtggcgactaacaccgaaacaagcaagaatgtgggcaatgcaattctgtatgaaactgtcctgacaatcatggatattaaatctgagtcagggctgagggtgctagctattaacatcctaggcagattcttactcaacaatgataaaaacatacgatacgtcgccctgacctcactgctgaagaccgtgcagacggaccacaacgctgttcagaggcacagaagtacaatcgtggattgtctgaaggatctcgacgtgtctatcaaaaggagagctatggaactttcctttgcactggtaaatggtaataatattcggggaatgatgaaggagcttttgtacttcctggatagttgcgagccagaattcaaagctgactgtgcatcagggatctttcttgcggctgaaaagtacgccccatctaagcgttggcatattgataccattatgagagtcctcactaccgcgggttcttacgttagggacgatgccgtcccgaacctcattcagctcatcactaacagtgtcgaaatgcacgcatataccgtccagcggctgtacaaagctatactgggcgattactcccaacagccgttagtgcaagtcgccgcttggtgtatcggcgagtatggagatctgctggttagcggacagtgtgaggaggaggaacctattcaggttacggaagacgaggtgctggacattttggaatctgtgctgattagcaacatgtccacctctgttacacgaggatatgctttgactgccatcatgaagttgtcaacccgcttcacatgcaccgtaaataggatcaaaaaagtagtctcaatttacggatcaagcattgacgttgagctccaacagcgcgctgtggagtacaacgccctctttaaaaaatacgaccacatgcgctccgcactgctcgagagaatgcccgtgatggagaaagtcacaacaaatggtccaactgaaatcgtgcagaccaacggggagacagagccggctcctctcgagactaagccccctccctctgggcctcaacctacttcccaggccaacgacttgttggacctcctggggggaaatgacataactccagtaatcccaacggcacctactagtaaaccgagttcagcgggtggagagctccttgatctgctgggcgatattaatcttacaggcgctccagccgcagccccagccccagcctccgtccctcagatctcccagcctcctttcctgttagatggactttcttcccaaccattatttaatgacattgccgctggcatcccttcaattacagcctactctaaaaatggcctaaaaatcgagttcacctttgagcgttcgaatacaaatccaagtgtgactgtcataaccattcaggctagtaattccactgagcttgacatgaccgatttcgttttccaagcggctgtgcctaaaacctttcagttacagctgctgagcccctcttccagcattgtgccagctttcaacaccggaacgatcacacaggtgatcaaagtgctaaatccacagaagcagcagctgcgcatgcgcattaagctcacatacaaccataaggggtcggcaatgcaggatctcgccgaggtgaataacttccccccacaaagctggcagtag

SEQ ID NO: 213497 - DNA, 531 bp, Artificial Sequence
  Description of Artificial Sequence: Synthetic coding sequence
atgcctgcacctatccgcctgcgcgagctgatccgaaccattcgcacagcacgaacacaggctgaggaaagggaaatgatacagaaggagtgtgcggctataaggtcctcttttcgcgaagaagataacacctaccgatgccgcaacgttgctaagctcttgtatatgcatatgctcggctaccccgctcattttggccagttggaatgcttgaaactgattgcgtcccaaaagttcaccgacaaacgtattgggtacctgggagcaatgctcctcctcgatgaaagacaggacgtgcacctgctgatgactaactgtatcaagaatgacctgaaccacagtacacagttcgtccagggcctcgccctctgtactctggggtgtatggggtcatcggagatgtgccgagacctcgcgggagaagtcgagaagctcctcaagacatcaaatagttatctgcgcaaaaaagaaatgatttacaagcagactaatgtcaccgggtacatcttagggggtatccctaactcctag

SEQ ID NO: 213498 - DNA, 1047 bp, Artificial Sequence
  Description of Artificial Sequence: Synthetic coding sequence
atgaaggacaagatgtgccgagatctggccggtgaagtggagaagttattgaagacttccaactcctatcttcggaagaaggccgctctgtgcgccgttcacgtgattcgcaaggttccagaactcatggaaatgttcctgcccgctaccaaaaacctgttgaatgagaagaaccacggggtgctccacaccagcgtagtgctcttgaccgaaatgtgcgagagaagccctgatatgttagcacactttcgaaaacttgtgcctcaactcgtgaggatccttaagaacttgatcatgtccggatatagccctgagcatgacgtttcaggtattagtgatccctttctccaggtgcggatcctgagactgctgaggatccttggccgtaacgatgatgactcatccgaagccatgaacgacatcctggcccaggttgctactaacacagagacctctaagaatgtaggcaatgccattctgtacgaaaccgttttgaccattatggacattaaatccgagagcggccttcgtgttttggccatcaacattctggggaggtttcttcttaataatgacaaaaacatccgctacgtggccctgactagcctcctgaagaccgtgcagaccgatcataacgctgtacagcgccatcggagcaccatcgttgactgtctgaaggatctagacgtgagtataaaacgaagagctatggagttgtcttttgctctcgtgaatggaaacaacatacggggtatgatgaaggagcttctgtattttttggattcatgtgagcctgagtttaaggccgattgcgcatctggtattttcctggccgcagttcctaagacctttcagctgcagctgctctctccatcctcttctatagttccagcattcaatacgggaactatcacccaggtgataaaggtgttaaatccccaaaagcaacagctgagaatgaggattaagctcacctacaatcacaaagggagcgctatgcaagaccttgcggaagtcaataactttcctcctcagagctggcagtag

SEQ ID NO: 213499 - DNA, 1272 bp, Artificial Sequence
  Description of Artificial Sequence: Synthetic coding sequence
atgagcgcctctgcggtgtacgtgctggacctgaagggaaaggtcctcatctgtcggaattatagaggcgatgtggatatgtctgaggtcgagcatttcatgcccatcttgatggaaaaagaagaggaagggatgctgtccccaatattagcacacggtggagttcgctttatgtggattaagcacaataatttgtacctggttgcaacaagtaagaaaaacgcttgtgtaagtctcgtatttagctttctttacaaagtggtgcaagtgttctcagagtactttaaggaactcgaggaggagtccataagagacaatttcgtgatcatctacgaactactcgatgaactcatggatttcggctacccccagacaacagattctaagattctacaagaatacatcacccaagaagggcacaagctggagaccggcgcacctagaccccctgcgaccgtcaccaacgccgtaagttggagatccgaggggatcaaatatcgcaaaaacgaagtcttcctggatgtcatcgagagtgtcaacctactggtgagtgccaacggcaatgttcttcggagcgaaatcgtgggaagtataaaaatgcgagtgttcctgagcggaatgccggagctgagattagggcttaatgacaaggtgcttttcgataataccgggaggggcaaatcgaaaagtgtggagctggaagatgtcaaattccatcagtgtgtgagactctcccgtttcgaaaatgatcgaaccatttcctttataccgcctgatggtgagttcgaactgatgtcctatcgattgaacactcacgtgaagcccctgatctggatcgagtccgtgatcgagaaacattcacattcgcggattgagtacatgattaaggctaagagtcagttcaaacggcgatcaacagccaacaatgttgaaatccacatccccgtccctaatgatgcagacagccctaaattcaagacaacagttggttctgtgaagtgggttcccgagaatagcgagatcgtgtggtctatcaagagttttcccggaggcaaggagtacttaatgcgcgctcactttggcctacccagtgtcgaggctgaagacaaggagggaaagccccctatatccgtgaagtttgaaatcccctattttaccacaagcggcattcaggttcgctatcttaaaatcatcgagaaatccggctaccaggctctcccttgggtccgatatattacacagaatggggactaccaactgcgaactcaatag

SEQ ID NO: 213500 - DNA, 1113 bp, Artificial Sequence
  Description of Artificial Sequence: Synthetic coding sequence
atgagtgcatccgccgtatatgtgctcgacctgaagggtaaggttctaatctgtaggaactacagaggcgacgtggatatgtcagaggtcgagcactttatgcctattctaatggaaaaggaagaggaggggatgctgtccccaatcttagcccacgggggtgtgaggtttatgtggattaagcataacaacctgtaccttgtcgcgacctctaagaagaatgcctgcgtatcccttgttttttctttcctgtataaagtggtgcaggtgttctctgagtattttaaagaactggaagaagagtccatccgggacaactttgtcattatatatgagctcctggacgagttaatggacttcggttacccccagacaacagactctaagattctccaggagtatatcacacaagaggggcacaagctcgaaactggcgctcctcggccacctgccacagtgacaaacgcagtgagttggcgtagtgagggtatcaaatatcggaagaatgaggtgtttcttgatgtaatcgagagcgtgaacctcctggtgagcgccaacggaaatgtactcagaagtgagatcgtgggtagcattaagatgcgagtcttcctctccggtatgccagaactccgtttgggattgaacgacaaggtgctcttcgacaacactggccgtggcaaatctaagagcgtggagttggaggacgtgaaatttcatcaatgtgttcggctgagtcgatttgagaatgacagaactatctctttcatcccacctgacggtgaatttgaactgatgtcatacagattaaatacgcatgttaaacctcttatctggatcgaatcagtaatagagaaacatagccactcccggattgagtatatgatcaaaggcggaaaagaatacctaatgcgcgctcatttcggattacccagcgtagaagcagaggataaggagggtaagccacctatctcagtcaagttcgagataccttatttcacaacttcaggcatccaagttcgctacctgaagattattgagaaatcaggatatcaggcattgccctgggtgcgctacattactcagaatggggattaccaactcagaactcaatag

SEQ ID NO: 213501 - DNA, 1308 bp, Artificial Sequence
  Description of Artificial Sequence: Synthetic coding sequence
atgtccgcctcagccgtctatgttttggatctcaaaggtaaggtactgatctgccgtaattatcgcggtgatgtggacatgtctgaggtggagcacttcatgcctattttgatggaaaaggaagaggaaggcatgctgtctccaatcttggctcatggcggagtcagattcatgtggataaaacacaataatctctatctggtggctacatcgaaaaaaaatgcatgcgtcagtttggtatttagtttcctgtacaaggtcgttcaggtgtttagcgagtacttcaaagaattggaagaggaaagcatccgggacaactttgtgattatttacgagttgttagacgagctgatggatttcggatatccacaaactaccgattccaagatactccaggaatacattacccaggaaggtcataaactcgagacaggcgcaccgaggcctcctgccaccgtcactaatgccgtgtcatggcgatcagaggggattaagtaccgcaagaatgaagtgttcctggacgtgatcgagagcgtgaatctgctgggcaaatacccgggtgtaggatggcttggacacaccgtctccgcaaatgggaacgtccttagatccgaaatagtagggtctattaaaatgagggtgtttctttcgggcatgcccgagctgcgtctgggtctgaacgacaaggttctctttgataataccggccgaggaaagtctaaatctgtggagcttgaggacgtgaagtttcaccagtgtgtgagactgagcagatttgagaacgaccgcactatcagcttcattcctccagacggcgagttcgaactgatgtcgtaccggctaaatactcacgtaaaaccactgatctggattgagtctgtgatcgagaagcatagccattcccggatcgagtatatgatcaaagccaagtcgcagtttaaaagacgttcgaccgccaacaacgtggagatccatatccccgtccctaacgacgccgattcccccaaatttaagactactgttggcagtgtgaagtgggtacctgaaaactcagagatcgtatggagtataaaatcctttcccggaggtaaggagtatcttatgagagcgcacttcggactgccctctgtggaggcagaggacaaagaaggaaaacccccaatcagtgtaaaattcgaaatcccgtacttcaccacttctggcatccaggtacgatacctgaagattattgagaaatctggttatcaggcactgccctgggtgcggtacattactcagaacggcgactaccagctcaggacacagtag

SEQ ID NO: 213502 - DNA, 1056 bp, Artificial Sequence
  Description of Artificial Sequence: Synthetic coding sequence
atgtctgcaagcgccgtttatgtgctggatttgaaaggcaaagtggtgcaggtgttcagcgaatattttaaagagttggaagaagagagcatacgcgataattttgttatcatttacgagctgctcgacgagttgatggacttcggttatcctcagaccactgattcgaaaatcctccaggaatacataacacaggagggacataaactggaaaccggagcaccccgacctccagccacagttacaaatgcagtctcttggaggtccgaggggattaaatatcgaaaaaatgaggtattcctcgatgtgatcgaatccgtgaacttattggtttcagccaacggtaacgtgctgaggagcgaaatcgttggttcgattaagatgagagtgtttctctccggcatgccagagctaagactaggcctcaatgacaaggtgttgtttgataacaccggccgtggaaaatccaaatccgtcgagctcgaggatgtgaagtttcaccagtgtgtgagactcagcagattcgaaaacgacaggactatatcctttataccacccgatggcgaattcgaactcatgagctatcgcctgaacacccatgtgaagccattgatttggatcgaaagtgtgattgaaaagcactcccacagtaggatcgaatatatgattaaagctaaatctcaatttaagcgccgatccacggcgaataacgttgagatacatatacccgttcctaacgacgcagattctccaaagttcaaaaccacggtaggttctgtaaagtgggtaccagagaattctgagattgtatggagcatcaagagctttccagggggaaaggaatacttaatgagagcccattttggactgcccagcgtggaagcggaggacaaggagggaaagcccccaataagtgtgaagttcgagatcccgtactttaccacgtccggcatccaggtgagatatttaaaaattatcgaaaagtccggataccaagcactgccttgggtacgttacattacacagaatggagattaccagttacgaacccagtag

SEQ ID NO: 213503 - DNA, 1272 bp, Artificial Sequence
  Description of Artificial Sequence: Synthetic coding sequence
atgtctgccagtgctgtctttatactcgatgtgaaagggaagcctctgatctctcgcaactacaagggtgacgtggcaatgtctaagatcgagcactttatgccactgctcgtgcagcgggaagaggagggggctcttgcccctctactgagccacggccaagtgcattttctgtggattaagcatagtaatctgtacttagtcgctacaaccagtaagaatgccaacgcctcattagtgtacagctttctctacaaaaccatcgaagtgttttgtgaatacttcaaggaactagaggaggaatccatacgggacaatttcgtcatcgtttatgagctgttggatgagttaatggacttcgggtttccccagaccacagattcaaagattctgcaggaatacattactcagcagtcgaataagctagaaaccggaaaatcccgggtgcctcccactgtgaccaatgccgtgtcatggaggagcgaggggatcaaatataaaaagaatgaggtattcatagacgttatcgagagcgtcaacctgcttgtaaacgcaaatgggagcgtgttgttgagcgaaattgtggggacaatcaagctgaaagtgtttttaagcggaatgccagaactgaggttgggcctgaacgatcgcgtgctgttcgagctgacaggtaggtccaagaacaagtctgtggagctggaggacgtcaaattccaccagtgtgtccgcttatctagattcgataacgatcgtactatttccttcattccgccagacggagactttgagctgatgtcctaccggctatcaactcaggtaaaaccactcatttggattgaatcagtcatcgagaagttctcgcattcccgtgtggagatcatggtgaaagccaaaggacagttcaagaagcagtcggtggcaaacggcgtggaaattagcgtaccagtgccgtccgacgccgatagtcctaggtttaagaccagtgtcgggtctgccaagtacgtccctgaaaggaacgtcgttatatggtctattaagtcgttccccggaggcaaagaatatctgatgcgcgctcacttcggcttacccagcgtagaaaaagaggaggtggagggaaggcccccaataggagtaaagttcgagatcccttacttcacagtctcaggaatacaggtccgatacatgaagatcatcgagaaatcagggtatcaggcactgccctgggtccgctatattacccagtcaggcgactaccagcttcgcacatcgtag

SEQ ID NO: 213504 - DNA, 477 bp, Artificial Sequence
  Description of Artificial Sequence: Synthetic coding sequence
atgatgaggtttatgctcctgttctctagacaagggaaactgagactgcagaagtggtacctcgccaccagtgacaaggagaggaagaagatggtgcgtgaactgatgcaggtggtgctggcacgcaagcccaaaatgtgttcctttttggagtggcgagacctgaaggtggtatacaaacggtatgctagcctttatttctgctgtgctatcgagggacaagacaatgaacttatcactctcgagctgattcaccggtatgtagagctgctcgataagtacttcgggagcgtgtgcgaactggacattatattcaactttgagaaggcatactttattctcgatgaatttttgatgggcggagatgtgcaggatacgtccaagaagagcgtgctcaaggctatagaacaggctgatttactacaggaagaggacgagagccctcggagtgtgctagaagaaatggggctggcgtag

SEQ ID NO: 213505 - DNA, 477 bp, Artificial Sequence
  Description of Artificial Sequence: Synthetic coding sequence
atgatgcgctttatgcttctttttagtaggcaggggaagctgcggctgcagaaatggtatttagcaacatctgacaaggagaggaagaagatggtccgcgagctcatgcaagtggtgctcgccaggaagcccaaaatgtgcagctttctggaatggcgcgacctaaaagtggtgtataagcgctacgcaagtttgtatttttgctgcgctattgagggacaggataacgagttaattactttggagctcattcacagatacgtcgagttgctcgacaagtatttcggcagtgtctgtgagctagacataattttcaacttcgagaaagcttactttatcctcgatgaattcctcatgggtggtgatgttcaggataccagcaaaaaaagtgtgcttaaagcaatcgaacaggctgatctgctccaggaagaagatgaatcccctcgaagcgtgttggaggagatgggtctggcatag

SEQ ID NO: 213506 - DNA, 474 bp, Artificial Sequence
  Description of Artificial Sequence: Synthetic coding sequence
atgcaatttatgttactctttagccggcaaggaaagctccggctgcagaaatggtacgttccactatctgacaaggaaaagaagaagatcacgagggagctggttcaaacggttctcgcacgcaagccgaagatgtgctctttcctagaatggcgagacctaaaaatagtgtataaaaggtatgcttcactgtacttctgctgcgccatcgaagaccaggacaacgaactgatcactctggagataattcatagatacgtcgagctcctcgacaaatatttcggctctgtctgtgagctggacataatttttaacttcgagaaggcctacttcatccttgatgagtttcttctgggtggtgaagtgcaagagacctcgaagaagaacgtgctaaaggctattgagcaggccgatctactccaggaagaggccgagactcccaggtcagtgcttgaagagataggccttacttag

SEQ ID NO: 213507 - DNA, 462 bp, Artificial Sequence
  Description of Artificial Sequence: Synthetic coding sequence
atgctcctgttttccagacagggtaagttaaggcttcagaaatggtacgtccccctcagtgacaaagaaaagaaaaagataaccagggagctggttcagacagtcttggcgagaaaaccaaaaatgtgtagctttctggagtggagagatttaaaaatcgtgtacaaaaggtacgcctctctgtacttttgctgcgccattgaggaccaagacaacgagctgatcactctcgaaataatccaccggtacgtggagcttcttgataagtacttcggctcggtgtgtgagctggatattatttttaattttgaaaaggcctattttatccttgacgagttcctgctcggcggagaagtgcaggaaaccagcaagaagaacgtactgaaagcaattgagcaagcagatctcttgcaggagagtcagaacgaggaatggggtggtctttcagaggacatcctgtag

SEQ ID NO: 213508 - DNA, 483 bp, Artificial Sequence
  Description of Artificial Sequence: Synthetic coding sequence
atgcaattcatgctgctattctcccggcaggggaaacttcgtctgcagaagtggtatgtgccactgtctgacaaagagaaaaaaaagattactagagagttagttcagaccgtcctagcaaggaagccaaaaatgtgtagttttctggaatggcgggatctcaagatagtttataagcggtacgccagcctgtacttctgttgcgcaattgaagaccaagataatgaactaatcaccttggaaataatacatagatatgttgaattgctggataagtattttgggagtgtgtgtgagttagatataatttttaactttgagaaagcatattttatcctggatgaatttctgctcggaggggaggtgcaagagacgtctaaaaaaaacgtgcttaaggcaatcgaacaagctgatctgctccaggaaaaaacggagaccatgtaccactcaaaaagtttcattggattcaagaaagcttactag

SEQ ID NO: 213509 - DNA, 609 bp, Artificial Sequence
  Description of Artificial Sequence: Synthetic coding sequence
atgcctgctggctgtcctcctcattcgaccacggcctcacttccacagcatggagaccgaggatttcccttcgccgcagcggctgctgccggacaagccccaccacggcctcggcctgcagcggctatgcaatttatgttgctattcagccgtcaggggaaactccggctgcagaaatggtacgtccccctaagtgataaggaaaagaagaagatcacgcgcgagctggtccagactgtcttagctaggaaaccgaaaatgtgctccttcctcgagtggagagacctcaagatcgtatataagcggtacgcttccctttatttctgctgtgccattgaagatcaggataatgagctgattacactcgaaatcattcatcgctacgtggaactgctggacaagtactttggatccgtgtgtgagctggacataatctttaacttcgaaaaggcttacttcattctggatgaattcctgctgggcggagaagtgcaggaaacaagcaagaaaaatgtgctgaaagctattgagcaagccgatctcctacaagaaaaaactgagacgatgtatcacagcaagagctttatcggcttcaagaaagcctattag

SEQ ID NO: 213510 - DNA, 441 bp, Artificial Sequence
  Description of Artificial Sequence: Synthetic coding sequence
tgaaggcaggggaaactaagactacaaaaatggtatgtgcccctctcggacaaagagaagaaaaaaattactagagagctggtacagactgtcctcgctcggaaacccaagatgtgctcattcctggaatggcgcgaccttaagatcgtttacaagcgttatgcctctttatatttctgctgcgctatcgaagaccaggataatgagttgattaccctcgagatcattcaccgttatgtcgaacttttggataagtacttcggtagtgtatgtgaactggacatcatctttaactttgagaaggcatacttcatcttagatgagttcctcctgggcggagaggtgcaggagacatccaaaaagaatgtgttgaaggctattgagcaggccgacctcctgcaagagcctcgacatgagtacttcaacgtgccagtgtactag

SEQ ID NO: 213511 - DNA, 462 bp, Artificial Sequence
  Description of Artificial Sequence: Synthetic coding sequence
tgacttcttttctccagacagggcaagctgagactgcaaaagtggtacgtccccctgagtgacaaagaaaaaaaaaaaatcacacgcgagctggtgcagaccgtactcgctagaaaaccaaaaatgtgctcttttctggaatggcgagacctgaagatcgtgtacaaacgatacgcgtctctgtacttctgttgcgccatcgaggatcaagataacgagttgatcactctcgaaatcatccataggtatgtagaattgttagacaagtacttcggcagcgtctgcgagctggacataattttcaattttgagaaggcctacttcatcttggacgaatttctcctcggtggtgaagtccaggaaaccagtaaaaaaaatgtgctgaaagcaattgaacaggcggaccttcttcaagaatctcaaaatgaggaatggggcggactgtccgaggatattttgtag

SEQ ID NO: 213512 - DNA, 588 bp, Artificial Sequence
  Description of Artificial Sequence: Synthetic coding sequence
atgccagccggatgtccaccccatagcaccactgcaagtctgcctcagcatggggaccgcggtttcccatttgctgctgccgcagctgccggacaggccccacctcgcccacgcccagccgctgccatgcaattcatgctgctcttctctcgccagggaaagctccgcctacagaaatggtatgtccccctctctgataaggaaaagaaaaagatcacccgcgaactggtgcagactgtgctggcaagaaaacccaagatgtgctcctttttagagtggcgggatcttaaaatagtctacaagcgatatgccagtttgtatttttgctgcgccatagaggatcaagacaacgaattaatcacacttgaaatcatccatcggtacgtcgagctgttggacaagtatttcgggagcgtttgtgagctggacatcatttttaacttcgagaaagcctattttatcctcgatgaattcctactcggtggcgaggtgcaggaaacctctaagaaaaacgtgcttaaagcgatcgagcaggcagatcttctgcaagagcctagacatgagtatttcaatgtgccagtgtattag

SEQ ID NO: 213513 - DNA, 315 bp, Artificial Sequence
  Description of Artificial Sequence: Synthetic coding sequence
atgatccggttcatccttatacagaatcgtgcaggtaaaacacggcttgcaaagtggtacatgcagttcgacgacgatgaaaagcagaaactgatcgaggaagtgcatgcagtggtgacagttcgcgacgccaagcacaccaacttcgtagaggtgttaaatgagtactttcacaacgtgtgcgaactggacctggtgttcaatttttataaagtgtacacagtagtggacgagatgttcctagctggagaaattcgggagacctcacagacaaaggtgttaaagcagcttctcatgctacagtccctcgagtag

SEQ ID NO: 213514 - DNA, 2868 bp, Artificial Sequence
  Description of Artificial Sequence: Synthetic coding sequence
atgcctgctgtgagcaaaggcgacggaatgcggggactggcagtgtttatttcagatatacgtaactgtaagagtaaggaggcagaaattaaaagaattaataaagagctggcaaatatccgcagtaaattcaaaggggataaagccctggatggctattcaaagaaaaaatacgtctgcaagttgctctttatctttctcctgggtcacgatatagactttggccacatggaagcggtcaacctgttgtcatcgaataaatacacagaaaagcaaatcggttatctatttattagcgtgctggtgaactccaactctgagctgattaggttgatcaataacgctattaagaacgacctggcctcccggaatcccacattcatgtgcctggcgctccactgcatagcgaatgtgggttcccgggaaatgggggaagccttcgctgctgacatccctagaattttagtcgcaggcgatagcatggactctgtcaaacagtcagctgccctttgtcttcttaggctgtataaggcatctccagatctggtccccatgggtgaatggacagcacgggtggtgcacctgcttaacgatcaacacatgggggtggtgacagccgcagtgtccttaattacatgcctatgtaagaaaaatcctgatgattttaaaacatgcgtcagcctagccgtctcccgcctttcgcggatcgtcagtagcgcttctactgacctacaagactatacatactactttgttcccgcaccttggctttctgttaagctgcttcgccttcttcagtgctacccccctcccgaagatgctgccgtcaagggacgcctggtggaatgtctagagacagtgcttaacaaagcccaggagccccctaagagcaagaaagtgcaacatagcaacgcgaaaaacgccattctgtttgaaactatcagcctgattattcattacgatagcgaaccgaaccttttggtccgagcttgtaatcagctggggcagtttcttcagcatagggaaactaaccttaggtacctggcgctcgagtccatgtgcacactcgcctcttcagaattctctcacgaagcagtgaagactcacattgatactgtgatcaacgcccttaagactgagcgcgatgtcagtgtacgccagagagcagccgacttgctgtatgccatgtgcgatcggagtaacgcgaagcagatcgtgtcagaaatgctgaggtatctcgaaacagctgattatgctattagagaggagatcgtgctgaaagtggcaatattagcagagaaatacgctgtggattactcttggtacgtcgatactattctgaacctgatccggatcgcgggtgactacgtgtctgaggaggtgtggtaccgagtgctgcagatcgtgacgaatcgggatgatgtgcagggatacgctgccaaaaccgtgtttgaggcactccaagcccctgcctgtcacgagaatatggtgaaggtgggcggttacatcctcggggagtttggaaacctcatagccggtgatcctcgaagcagcccaccagtgcagttctctctgctgcacagcaagttccatctctgtagcgtggcgacccgcgcacttttactgtccacctacatcaaattcatcaatctgtttcccgagaccaaggcaactatccagggcgtactacgggcaggctctcagttgaggaacgccgacgtggaactacagcagagagcagtggagtacctgactctgtcttccgttgcctccaccgacgtcctcgcaacagtccttgaggaaatgcccccttttccagagagggaatcatccatcctggcaaaactgaaacggaaaaaaggccctggcgctgggtctgccctagatgatgggaggcgcgacccttcctccaatgacattaatggtggaatggagcccaccccttctactgtctcgacacccagtccctctgccgacttgctgggactccgggctgccccaccgcctgcagctcctcctgcatccgccggagccggaaatctgttggttgacgtgttcgatggcccagccgcacagccaagtcttgggcctacacctgaggaagcgttcctgtccccagggcctgaagacatcggccctccaatcccggaagccgatgagctgcttaacaagtttgtgtgcaaaaacaatggggtcttgttcgaaaatcagttgctgcagatcggggtcaaatcagagtttcggcagaaccttggacgcatgtatctattttatggcaataaaacctctgtgcagtttcagaatttttcccccacagtagtgcaccctggcgatctccagacccagttagcagtccagactaaaagagtagcagcccaggtggacggaggggcacaggtccagcaggtgctgaatatagagtgcctgcgggactttttgaccccacccttactgagcgtccggtttaggtatgggggagctccccaggctctgacactgaagttacccgtcactataaataagttttttcagccaacagaaatggcagctcaggacttcttccagagatggaagcagttatcacttccccagcaggaggctcagaagatctttaaggccaaccatcctatggatgccgaggtcacaaaagctaagttgttggggttcggcagcgcattactcgacaatgtggaccctaacccagaaaatttcgtcggcgcaggcattatccagacaaaagcactacaagttggatgtctgttaaggcttgagcctaacgcacaggcccagatgtacagattgactttgcggacctccaaggaacctgtttcgcgacatctgtgtgagctgctggcccagcagttctag

SEQ ID NO: 213515 - DNA, 2934 bp, Artificial Sequence
  Description of Artificial Sequence: Synthetic coding sequence
atgcccgctgtgtcaaaaggagacggcatgcgcggtctggccgttttcatttcagatatccgcaattgtaagagtaaggaagcagaaatcaagaggatcaataaagaactggcaaatatccggtcaaaatttaagggggataaagcactggacggctactccaagaagaagtatgtctgtaaactgctctttatctttttactcggccatgacatcgacttcgggcacatggaagctgtgaacctcctttcatccaacaaatatactgagaaacagattggatacctgttcatcagtgtccttgtgaatagcaactcggaactgatccggctgattaacaacgccattaagaatgatttggcctcccggaatccaacatttatgtgcctggccttacattgcatagccaatgtagggtcaagagagatgggggaggcatttgctgctgatattccgaggattttagtcgccggagattctatggactctgtcaagcagagcgccgcactgtgcctgttgcgtctctataaggcgagcccagacttggtcccaatgggcgaatggacggcccgagtggtacacctgctcaacgaccagcacatgggagtggtcactgcagcagtctctctcatcacttgtttgtgcaagaaaaatcctgatgactttaagacatgcgtctccttggctgttagcagactgagcagaatcgtctcttccgcttccacggatttgcaagattatacatattattttgtgcctgccccttggctgtccgtgaaacttctacgtctcctgcagtgttacccaccaccggaggatgcagcagtgaagggcaggctggtagagtgcctagagaccgtgttgaacaaggcccaagaaccacctaagagtaagaaggtccaacattccaacgctaagaatgctattctttttgaaacaatcagtctcattatccactacgatagcgagccaaacctgctcgtgcgggcttgtaaccagcttggacagtttttgcagcatcgcgagacaaatctgagatatctcgctcttgaatcaatgtgtaccctggccagctcagagttttctcacgaggccgtgaagacacatatcgacactgtgatcaacgctctcaaaaccgagcgcgacgtttccgtgaggcagcgagcagcggacttgctctatgcgatgtgtgaccgttccaacgcgaagcagatagtaagtgaaatgctgcgctacctggagactgccgactacgctatcagagaggagatcgttttaaaagtagctattcttgctgaaaagtacgccgtggactactcatggtacgttgatactattcttaatctgattaggatcgcgggtgactacgtatccgaagaagtgtggtaccgcgtgcttcaaattgtgactaatcgcgacgatgtacagggctacgctgctaagacagtatttgaagcactacaggccccagcctgtcacgaaaatatggttaaagtggggggatacatcctgggagaatttggcaacctgattgctggtgatcctcgttcaagcccaccagtccagttttctctgctgcattccaaatttcatctatgctctgtcgcaaccagggctctgctgttatctacctatataaaattcattaatctctttccagagactaaagcaactattcagggcgtgctgagagccggatcacagctgcgtaacgccgatgtggaattgcagcagcgagctgttgagtacctgactctgtcttctgttgctagcacagatgtcttagccacagtgttggaagagatgcccccttttcctgagcgtgagagcagcattctggcgaaactcaaacggaagaaaggacccggtgccggatccgccctcgatgatggcaggagggatccttcctcaaacgatatcaatggtggcatggaacccacgcccagtaccgtatcaacacctagcccttcagccgacctgctcggcctcagagctgcacccccaccagccgctcccccagcctcggccggtgctggaaatttgctcgtggacgtttttgatggcccagctgcccagcccagtctcgggccaacgcctgaggaggcttttctgtctgagttggaacctcccgctccagagtctcctatggctctcctggctgaccctgctccagctgcagaccccggacccgaagatatcggcccaccgattcctgaagccgatgagctcctcaacaagtttgtttgcaagaacaacggcgtgctgtttgaaaaccagctgcttcagattggcgtcaagtcagagttcagacagaatttgggtcgaatgtaccttttttatggcaataaaacatcggtccaattccagaacttcagtcccacagttgtacatcctggggatctgcagacccagctggccgtacagacaaaaagggtcgcagctcaggtcgatggtggggcacaggtgcagcaggtgttgaatattgagtgtttgcgggactttcttaccccacccctgctctctgtacgttttcggtacggaggagctccccaggcgctaacactaaagctgcctgtgactatcaataagttttttcagccgacagagatggccgcacaggacttttttcagcggtggaaacagctgagtttgcctcagcaggaggcacaaaaaattttcaaagcgaatcaccctatggacgctgaagtgaccaaggccaagcttctgggatttggctcagccctcttggacaacgtcgacccgaatcctgagaattttgtcggagcaggaattattcagacaaaagccctccaagtcggctgcctgctgcgactggagccaaatgcccaggctcagatgtatcggttaaccttacgaacgtccaaagaaccggtgtctcgccatctatgcgagctcctggcacagcagttttag

SEQ ID NO: 213516 - DNA, 1404 bp, Artificial Sequence
  Description of Artificial Sequence: Synthetic coding sequence
atgggactggctcttcactgcatagcatcagtgggctcgcgcgagatggcagaggcattcgccggtgagatcccaaaagttctggtggctggagacactatggattctgtaaagcagagcgctgccttatgtctcctccggctctacagaaccagcccggatttggttcctatgggagattggacttcacgcgtcgttcacctgctgaacgatcagcacttgggggtggtgaccgctgctacctcacttattaccactttagctcagaagaatcctgaggaattcaaaaccagtgtcagtttagccgtttcaagactgtcacgcattgtcacgtcagctagtaccgacctccaggactatacatattatttcgtgcccgctccttggctgagcgtaaagctgctgcggctgctccagtgctacccccctcccgacccagcagtcaggggaagactgacagaatgcctggagacaattcttaacaaagctcaagagcctccgaaatcaaaaaaggtacagcactcaaacgctaagaacgctgtgctcttcgaggcaatctctttgatcattcaccatgattcagaaccaaacctgttggtcagagcctgtaaccaactgggtcagttccttcaacacagggagaccaatcttaggtacctggctttggaatctatgtgcactctggcatcctctgaattctctcacgaggccgtgaaaactcacatcgaaacggtgatcaatgctctaaagactgagagggatgtgagtgtgctccctcccacgcccccacgtagtctttgggagcaacaatgccattgcgcatggaggggcttgagcctgggcgtgtggccatcctggtggctccacacgtggagaagaccaggcccactgggcggtgctcaactgaccctcgtcctgctgcagagccagctagactgcttcccgagacaggactttaacctggaatttcggaatatatgcatctgcaatgacttttggcagaaacatgtgtcttggcctgatgtcacggtcctgctgagccaattgctgttcgtgaaaggcgtgtgctacgccccagctgttgctgaagctctcgatgtgcagccaggcgaggaacggcctgctggcccagcgggaccgcctggcctgcaggggaaagtatgggccggaggtgctcgactgagaggagtccttgtgtcttttttaagtgaatgggccagccctggacatggggctggtttgtccccatccaccgggcctgttcagtcgtcgctggagggcctttggcgcagggatgcttctgtatggagcggttccgagggcgcaattggtcggatgccctgtgctacttgcggcctgtgcctaacctgtcacctggattcagcccctagactacatgtctag

SEQ ID NO: 213517 - DNA, 2823 bp, Artificial Sequence
  Description of Artificial Sequence: Synthetic coding sequence
atgccagcagtgtctaaaggagacgggatgagaggactcgccgtgttcatatctgatattcgcaattgcaagagcaaagaggctgagattaagaggatcaataaggagctagccaacattagatctaaatttaaaggtgacaaggccctggacggatattccaagaagaagtacgtgtgcaaactgctgttcatctttctgctcggacacgatatcgactttggccacatggaagctgtcaatttactgagcagcaaccgctacaccgagaaacaaattggctacctcttcatctctgtgttggtcaatagtaactctgagctgatccggctcataaacaacgccatcaaaaacgatctggccagccgcaacccgactttcatgggcctcgctctgcactgtatcgccagcgtcggtagccgagaaatggcagaagcctttgccggtgaaattcctaaggtcctggtcgctggggacacgatggatagtgttaaacagagcgcagccctttgcctcctgagactatatcggacttctcccgacctggtccccatgggggattggaccagccgcgtcgtgcaccttcttaacgatcaacacctgggtgtggtgacagccgctacctctctgataacgacgctggctcagaaaaacccagaggagttcaagacttctgtctctttggctgtgtctcgcctgtccaggatagtgacctccgccagcacggatctgcaggattatacttactactttgttccagcaccatggcttagtgtaaaattgctgcgtctgctgcagtgttatccccctccagaagatcctgccgtgcggggaagacttacagagtgcctggagaccatccttaataaggcacaagagccaccaaaatcaaagaaggtgcagcatagcaatgccaagaacgccgtcctctttgaagcgatcagcctgatcatccaccacgacagcgaacccaacttgctcgtgagggcatgcaaccagcttgggcagttcctccagcacagggaaactaatctccggtacctggccctagagagcatgtgtactttggcgagttctgagtttagtcatgaagccgtaaagacccacattgagaccgtgatcaacgcccttaaaactgagagggacgtgagcgtgcgccagagagctgtggatctgctgtacgctatgtgcgaccgctcaaacgctccacagatcgtagccgaaatgttaagttatctggagaccgccgactattctatccgggaagagatcgtcctcaaagtcgctattctagctgagaagtatgcagtggattatacatggtacgtggacaccatcctgaatctcataagaattgctggcgactacgtctcagaagaagtttggtacagagtgatccagatagttatcaacagggatgacgtgcaagggtacgccgcaaagaccgtgttcgaggcccttcaagcccctgcttgccatgagaatctcgtcaaggtgggaggatacattttgggcgagttcggcaatctcattgcgggagacccacgatctagccctctgatccaatttcacttactgcattccaaatttcatctgtgttctgtgcccacaagagctctgctgttgagtacatacattaaattcgtcaatttgttccctgaggtaaagcccacaatacaagacgtattgcgctcagatagccagctgcgaaatgccgatgtcgaactccagcagcgagcagtcgaatatctccggctgtcaactgtggcgtccaccgacatcctggctacagtcctggaagaaatgccccctttccctgagagggaatctagtatcctggcaaaactcaagaagaagaagggtccatccaccgtgacggacctcgaggacactaaaagggatcgatccgtcgacgtgaatggtggccctgaaccagcacctgcctccacatcagcagtgagtacaccttccccttctgcagacctgctggggctgggtgccgctccgcctgcgcctgccggaccccctccctcctcagggggatccgggcttctcgtggatgtgttcagtgattccgcctcagtggtcgcaccgcttgcgccaggctccgaagacaacttcgctcgatttgtgtgcaaaaacaacggggtgctcttcgagaaccagctactccagatcggcctgaaaagcgagttcaggcagaacctgggtcgcatgtttatcttttacggcaataaaacatccacccagtttttgaactttactcccacacttatttgctcggacgatctccagcccaacctaaatctccagactaagccagtggatcctaccgtggaaggtggggctcaagtgcagcaggtggtgaacatcgagtgcgtatcagactttacagaggcccctgtactgaacattcagttccgatacggcggaaccttccaaaacgtttctgtccagttacccatcactctgaataagttcttccagcctacggaaatggctagccaagatttttttcagagatggaagcagctgtctaacccacagcaggaagtccaaaacatatttaaagcaaaacacccgatggacacagaggtgaccaaagcaaagatcatcggttttgggtctgctctgttagaggaggtcgacccaaatccggctaacttcgtgggtgctggaataattcacacaaaaactacacagatcggatgtttgctccgcctggagcccaacttacaagctcagatgtacagattgaccttgcgtacatccaaggaggccgtaagtcaacgtctctgtgaactcttatcggcgcaattctag

SEQ ID NO: 213518 - DNA, 1062 bp, Artificial Sequence
  Description of Artificial Sequence: Synthetic coding sequence
atgccagccgttagcaagggggacgggatgcggggactcgctgtattcatttccgatatccgcaactgtaagtctaaggaagccgaaattaaaagaatcaacaaggagctagcaaacatccgttccaagttcaaaggtgataaagcactggacggctattcaaaaaaaaaatatgtgtgtaaactgctctttatctttttgctgggccacgacattgatttcgggcatatggaagcagttaaccttctctctagtaaccggtacacggagaaacagataggatatctgtttatcagcgtgttggtgaattccaatagcgagttgataaggctcatcaataacgccataaagaacgacttagcctctcgcaatccaacattcatgggacttgcactgcactgcatagccagcgtgggaagtcgggaaatggccgaagcattcgccggagagatcccaaaggttctggtggctggagacacgatggacagtgtcaagcagtctgctgccctgtgcctgctgagactatatcggaccagccccgatctagtgcccatgggggattggacttctagggtagtccaccttttgaatgatcagcacttgggcgtggtcactgccgctacatccctcattaccactctcgcacaaaaaaatccggaagaatttaaaacctcggtcagtctggcagtttcccggctgtccaggattgtcacctcagcatctaccgatctgcaggattacacttactacttcgtgcctgccccatggctaagtgtcaagctgctgcgattactgcaatgctatccgcctcctgatcccgctgtgcggggaaggctaaccgaatgtctggaaactatcctgaataaggcccaggaaccgcctaagtcaaagaaagtgcagcacagtaacgccaaaaacgcagtgctgttcgaggcgatttcactgatcatccatcacgatagagaacccaacctgcaagcgcagatgtatcggctgactctgcgcacttccaaggaggcagtgagtcagcggctctgtgagctgctttccgcccaattttag

SEQ ID NO: 213519 - DNA, 1971 bp, Artificial Sequence
  Description of Artificial Sequence: Synthetic coding sequence
atgcctgccgtctcaaaaggcgatggaatgagaggcctggctgtattcatatccgacattaggaattgtaagtctaaggaagccgagattaagcggattaacaaggaactcgcgaacattaggagcaaatttaagggagataaggctttagatgggtactctaaaaaaaagtatgtgtgcaagcttctatttatttttctgttgggccacgatattgactttgggcacatggaggccgtgaatctgctgagcagcaatagatacaccgagaaacagatcgggtacctgtttatcagcgtgctagtgaacagcaattccgagttaatccgtctcatcaacaatgctatcaagaatgatctggcgtccagaaatcccacattcatggggctggctctacactgtattgccagcgtgggctctcgagaaatggccgaggcattcgcaggggagataccaaaggttctggtcgccggtgatactatggactccgtgaaacagtccgctgccctgtgtctgcttcgcctgtatcgcacctcacccgacctggtccctatgggggactggacgagccgggtggtccatctgttgaacgaccagcacttgggcgtggtaacagcagccacatctctcatcaccactttagctcaaaaaaaccccgaagagtttaagactagcgtaagtctggcggtgtcaagattatctagaattgtgactagtgcctcaaccgatttacaggattatacatactatttcgtccccgctccttggctgtctgtgaagttactgagacttctccagtgctatcctcccccagaagatccggctgtacgcggaaggctgactgagtgtcttgagacaatcctgaataaggctcaggagccccctaagtccaaaaaggtgcagcactcgaacgcaaagaacgcagtccttttcgaagcaattagcttgattattcaccacgacagtgaacctaatttgttggtaagggcctgcaatcagctgggccagttcctgcaacatagggaaacaaacctgcgatacctcgctctggagtccatgtgtactttagcgtcctccgaattctcccatgaagcggttaagacccacatcgagaccgtaatcaatgccctgaagacagaacgcgatgtgtccgtgagacaacgagcggtggacttgttgtacgctatgtgtgataggtccaatgctccccagatagtagctgaaatgctctcttacctcgaaactgccgattactcaatccgtgaggagattgtgctaaaagtggccatcctagccgagaaatatgcagtggattatacctggtatgtcgacactatactcaatctgatcagaattgccggtgactacgtctctgaagaggtctggtacagggtaattcaaattgtgattaatagggatgacgtacagggctacgccgcaaagaccgtcttcgaggccctgcaggccccagcatgtcacgagaatttggttaaggtcgggggatacatacttggcgaatttggaaatcttatcgctggcgatccacgtagcagccccttgatccaattccacctgcttcattctaaattccacctgtgttccgtacctacacgggctcttcttctgtccacatacatcaagttcgtgaacttgtttcccgaagtgaagcctacgattcaggacgtcctgcggagcgactcacagctaaggaacgccgacgttgaactgcagcaacgtgccgttgaatatctgcgcctttctaccgtggcctcaacggatatactcgcaacagtactggaggaaatgccaccatttcctgagcgcgaatctagcatcctggccaaactaaaaaaaaagaaggggccaagtactgtgaccgaccttgaagacacaaagcgggacagatccgtcgatgtgaatggcggacccgagccagctcccgcatctacttcagcagtactctgcctctag

SEQ ID NO: 213520 - DNA, 2820 bp, Artificial Sequence
  Description of Artificial Sequence: Synthetic coding sequence
atgccagccgtgagtaagggcgacggaatgcggggtctggctgtcttcatctccgacatccgaaactgcaagagtaaagaggcagaaattaagcggataaataaagaattggccaatattagatccaaatttaaaggcgataaggccttagacggttattccaaaaaaaaatacgtgtgtaaactcctgttcatctttctactggggcatgacattgatttcggccatatggaggccgtgaacctgctgagttccaatcggtacacagagaagcaaattgggtacttattcatctctgtactggtcaattcaaattcagagctcatccgtctcataaacaacgcgataaaaaacgatttagcttcccgaaaccccacatttatggggcttgccctccactgcattgcttctgtaggcagccgcgagatggccgaggcattcgcgggagaaatacccaaggtgttggtggccggagacacaatggacagcgttaaacagtccgctgcattgtgtctgctacgtctataccgtaccagccccgacctagtgccaatgggagattggacgtcccgggtcgtccatctgttaaacgaccaacatttaggcgtggtgactgcagcgacctcgctgattactaccctggctcaaaagaatcccgaggaatttaaaactagcgtgtctctggctgtatctaggctgtccaggattgtgacaagcgcctctaccgatctgcaggactacacatactactttgttccagccccttggctttctgtcaagctgttgaggctactccaatgttacccaccaccggatcctgcggttcgtggacgtcttacagagtgtctggaaacaattcttaacaaggcgcaagagccaccgaagtctaagaaagtgcagcacagcaatgctaaaaacgctgttctctttgaggcaatttccttgattatccaccacgatagtgagcccaacctgcttgtgcgagcctgcaatcaactgggccagttcctccagcatagagaaacaaatctgcggtacctggcccttgagtccatgtgcactctagcgtccagtgagttttctcacgaggccgtgaaaacccatatcgagaccgttattaacgctttgaaaactgaaagggatgtgagtgtacgtcagcgggctgtcgatctactatacgccatgtgcgacagaagtaatgcgccacagatagtggccgagatgctcagctacctggagaccgcagactactcaattagagaagaaatcgtcttgaaggtcgccattctggctgagaaatatgccgtggactacacatggtatgtggacaccattctgaacttaatcagaattgccggagactatgtgtcagaggaggtctggtaccgcgtgatccaaatagttatcaatagagacgatgttcaggggtacgccgctaaaactgtgttcgaagctctccaggcccctgcctgccacgagaatctcgtcaaagtggggggatatatactgggagagttcggcaacctgattgccggtgaccctcgctcaagcccactcatacagttccacctgcttcattccaaattccatttatgctcagtgcctaccagggcactgctgctgtctacctatatcaagtttgtaaatctgtttccggaggtcaagcccacaatccaagatgtgctgcggtcagactcacagcttcggaatgccgacgtggagctgcagcagagagccgttgagtatctgaggctctccacagtggcaagcacagatattttggccactgtactggaagagatgccgcctttccccgagagggagagtagcatcctggccaaattaaaaaagaagaagggtccctccacagtgacagacttggaggatacaaagcgagaccgttctgtggatgtgaatgggggtccagaacctgcacccgctagcaccagcgctgtgtctacaccaagccccagcgctgaccttcttggcttgggcgctgcccctcccgctccagccggtccaccaccatctagcgggggatccggactgttggtagacgttttttccgattcagcaagcgtggtcgctcctctagcccctggctccgaggataattttgcgagatttgtgtgcaagaataatggagtcttgtttgaaaatcagcttctgcaaattggactcaaatccgagtttaggcagaacttgggaaggatgttcatcttttacggaaataaaacctctacacagtttttaaattttacccctacactgatctgcagtgacgatctgcagccaaacttaaatctccagacaaagccagtagacccaacggtcgagggcggtgcacaggttcagcaggtcgtgaacattgaatgtgtgagtgactttaccgaggcacccgtccttaatatccagttccgatatgggggaacattccagaatgtgagtgtgcaattgcctataactttaaataagttcttccaaccaaccgagatggcttctcaagacttcttccaacggtggaagcagctgtcgaatcctcagcaggaggttcagaatatctttaaagccaagcaccccatggatacagaggtgacaaaggcaaaaataatcggcttcggatcggcgcttctggaggaggtggaccctaatccggctaatttcgtgggcgcaggtattatccatacaaagacgacccagattggctgccttctccggctggagccgaacttgcaggcccagatgtatcgcctgaccctacgaacatcaaaagaagccgtaagccagaggctgtgcgaactgctttctgcacaattctag

SEQ ID NO: 213521 - DNA, 2040 bp, Artificial Sequence
  Description of Artificial Sequence: Synthetic coding sequence
atgccggctgtctctaagggggatgggatgcggggattggccgtttttatttcagatatccgaaactgcaaatccaaggaggccgagatcaaacgcataaacaaggagctggctaacattagatccaaattcaagggtgacaaggctttggacggctacagtaagaagaaatatgtctgtaagctcctgtttattttccttctgggccatgacattgacttcggccatatggaagccgtgaacctcctgagcagcaatcggtacactgagaagcagatcggatacctattcatctcggttctggttaactcaaatagcgaactcattaggttgattaataatgcaattaaaactgagcgggacgtgagtgttaggcagcgtgccgttgatctgctgtacgcaatgtgtgaccggtcgaacgcacctcagattgtggctgagatgctctcatatctcgaaacagcagactacagcatccgggaagagatcgtcctgaaagtggccatcttggcggagaagtacgccgtggattacacgtggtacgtagacactattttgaacctgatcagaatcgctggagactacgtgtctgaagaggtatggtatcgcgtcattcagatcgtgatcaacagagacgatgtgcagggttatgctgcgaaaaccgtgtttgaagccctacaggcgcctgcttgccatgaaaatctggtaaaggttgggggatatatcctgggagagttcgggaatctgattgccggagacccacggtcttcgccactgattcagttccatttactgcatagcaagtttcatctgtgctccgtgcctaccagggcgctcctgctttccacctatatcaagttcgtgaacctcttcccagaggtaaagcccaccatccaagacgtgctgcgaagcgacagccagctccggaacgccgatgttgagctgcaacaacgagccgtggagtaccttcgactgagcactgtagcctcgacagacatcttagccactgttctggaagagatgcctccctttccagagagggagtcaagcatactggccaagctgaagaaaaaaaagggcccatcgactgttaccgacttagaagacactaagcgggatcgatctgttgacgtgaacggtggacccgaaccagcccctgcttcaacttctgcagtgtctacaccctcaccttccgccgatttgctgggtctgggtgcagccccacccgctccagccggtccccctccttcgtccggcggatccggcctcctggttgacgttttctccgactcggcctccgtcgttgcgcctttagccccaggttcggaggacaacttcgcaaggttcgtgtgtaagaacaacggagtgctttttgagaaccagctgctgcagattggcctgaaaagcgaattcagacagaatttaggtcgcatgttcatattctacggcaacaagacaagtactcaattcctgaactttacccccacccttatatgtagtgatgacttgcagcctaacctaaatttacagactaagcccgtcgatccaacagttgaagggggagcccaggtgcaacaagtggtgaatatcgagtgtgtgagcgatttcaccgaggcccctgtgctgaacatccaattcagatatggagggacctttcaaaacgtgtctgtccaattgcccataaccctgaataaattctttcagcctacagaaatggccagtcaagactttttccagcggtggaagcagctgagcaatccgcagcaggaggtccagaatatctttaaggcgaagcacccgatggacaccgaagtcactaaagccaagataatcgggttcgggtccgcactgcttgaagaagtggaccccaaccccgctaacttcgtgggtgcgggaatcatccacacaaaaaccacacagattggctgcttgctcagactggaacccaatctccaagcacagatgtacaggctcacccttcgcacaagtaaagaagccgtatctcagcggttgtgcgagttactctcagcccagttctag

SEQ ID NO: 213522 - DNA, 2031 bp, Artificial Sequence
  Description of Artificial Sequence: Synthetic coding sequence
atgccagccgtgtccaagggtgacggaatgcggggactcgccgtgtttattagcgatatccggaactgcaagtccaaggaagcggagattaagagaattaacaaggagctagctaatatccggtccaaatttaagggtgacaaagctctcgacggatactccaagaagaaatacgtttgtaaactgttgtttatttttctgcttgggcacgatatcgattttggccacatggaagccgtcaaccttttatcaagcaatagatataccgagaagcagatcgggtacctgttcatctctgtcctggttaactctaatagtgagctgatacgcctgattaacaacaccgagagggatgtgtctgtcagacaacgggctgtggatcttctgtatgccatgtgcgatcgtagtaacgcgccacaaatcgtagccgagatgttatcctacttggaaactgcagattactctatccgggaggagatagtgctcaaagtagcaattctcgcagaaaaatacgcagtggactacacttggtatgtggatacgatattgaatcttatccgcatcgcaggtgattatgtctccgaggaagtgtggtaccgtgtcatacagatcgtgatcaacagggacgacgtgcagggctacgctgccaagaccgtgttcgaagctcttcaggccccagcttgccacgaaaacttggtaaaggtgggcggttacatactgggcgaattcgggaacctcatcgccggagacccgaggtcatctcccctgatacagttccacctactacacagcaagttccatctgtgtagcgtgccaacaagggctttgctgctgtcaacttacatcaagtttgtgaatttgtttcccgaggtgaaacccacgattcaggatgtgctacggtccgacagtcagctgaggaacgctgacgttgaactgcagcagcgcgcagtcgaatatcttagactgtctacagtagcatcaaccgatatacttgctacggtgctggaagagatgccaccttttccagagcgagagagctctattctggcaaagctcaaaaagaaaaaaggccctagcaccgtcactgacctcgaagacaccaagcgcgacaggtcagtcgacgtgaatggaggcccagaacctgctccagcttctacaagcgctgtgtctactccttccccatctgctgatctgttgggcctgggcgcagcacctcccgctcctgctggaccccctccgagttctggcggatccggcctgctcgtagatgtgtttagcgacagcgcttccgtcgttgccccacttgcgcctggttcagaggataattttgcacgcttcgtctgtaagaacaacggcgtcctgttcgaaaaccagttgcttcaaatcggcttgaagtcagagtttcggcagaatctgggtcgcatgttcattttttacgggaataaaacctccacccagtttcttaacttcacccctaccctaatctgctcggacgatctacagcccaacctgaaccttcagacaaagccagttgatcccaccgtagaggggggtgcacaagttcagcaagtggtcaatatcgagtgcgtctcagatttcaccgaggcacctgtgctgaatatccagtttcgttacggcggaacctttcagaatgtttccgtgcagctgcccatcacactgaacaaattctttcagccaaccgaaatggcttctcaagacttctttcaacggtggaagcagctgagtaacccacagcaggaagtgcagaatatttttaaggccaaacaccctatggatacagaggtgactaaggctaagatcatcggcttcgggtcagctttgcttgaagaggtggaccctaacccagccaatttcgttggcgctggtatcatacacactaagaccacccagatcggctgcctgctgaggctggaaccaaaccttcaggcccagatgtataggctgactttacgaacttctaaggaagcggtcagccaaaggctctgtgagctcttaagcgcacagttctag

SEQ ID NO: 213523 - DNA, 2814 bp, Artificial Sequence
  Description of Artificial Sequence: Synthetic coding sequence
atgaccgatagtaaatacttcaccaccaacaaaaagggtgaaatattcgaactgaaggcggaacttaataatgagaagaaggagaagcgaaaagaagctgtgaaaaaagtcatcgccgcaatgactgtggggaaggacgtgtccagccttttccctgacgtggttaactgcatgcaaactgacaacctagaactgaagaaactagtgtacttgtacttgatgaactacgcaaaatctcaaccagatatggccatcatggcagtgaactcttttgtcaaggattgcgaggaccccaaccctttgatccgggcactggccgtgaggactatgggttgcatcagagtcgataagattacagagtatctttgcgagcctctccgcaaatgcctcaaagatgaagacccgtacgtgaggaaaacggctgccgtgtgcgtggccaagttgcatgacatcaatgcccagatggtggaggatcagggttttctagactctcttcgggatcttattgccgacagcaatcctatggttgtcgcgaacgcggtggccgcactgtccgaaattagcgagtctcacccaaattccaatctgttagatttaaatccacagaacatcaacaagttactcaccgctttaaacgagtgtactgagtggggccagatattcattctagactgcctgtcaaactataatccaaaggatgatcgagaggcccaatccatctgcgagagagttacgcccagactgtctcacgctaacagcgccgtggtgctgtccgctgtaaaggtcctcatgaaattcctggaacttttaccaaaggactccgattactacaatatgctgttgaaaaaactcgcaccaccgctagtgaccctgctgagcggagagcccgaagtccaatacgtggcattaaggaatatcaatcttattgtgcagaagcgccctgaaatcctgaagcaggagattaaagtgttttttgtaaaatataacgatccaatctacgttaaactggagaagctagacataatgatccggctcgcctctcaggctaacattgcacaggtgcttgctgagttaaaagagtacgctacggaagtcgatgtggactttgtcaggaaagctgttagagccatcggcagatgtgccatcaaagtggaacagtcagcggagcggtgcgtcagtacccttctggacctgatccaaactaaggttaattacgttgtgcaggaggccattgtcgtcattcgggacatcttccgtaaataccctaataaatatgaaagtatcatcgcaacgctgtgcgagaatcttgattcgctggatgagcctgatgcccgagcggctatgatatggatcgtgggcgaatacgctgagcggatcgataacgcggatgaacttctggagagcttcctggaagggttccacgatgaatctacccaggtccaacttacactcctgacggccatcgtaaagctgttccttaagaagccctctgagactcaggagctggtgcagcaggtgctgagtctcgccactcaggattcagacaatccagacttgcgtgaccggggttatatttactggcgactgctcagcacagatcccgtgaccgcgaaagaggtcgtgctgagcgaaaagccgctgatttctgaggaaacagatctcattgaacccacactactggacgagctcatttgccatattggcagtctcgcatcagtgtaccacaagcctcctaatgctttcgtggagggaagccacggaatccaccggaaacatctgccaatccatcatggaagtaccgatgccggtgatagtcctgtagggactactaccgctaccaacttggaacagccccaggtgattccgtcccagggagatctcctgggggatctcctcaacctggatcttggtccaccagttaacgttccacaggttagttccatgcaaatgggcgctgttgacttgttgggaggcggactggattcgctggtgggacagtcattcattccttcgagtgttcccgcaacttttgcaccttcaccaaccccagctgtagtctcctccggacttaatgacctgtttgagctctcgacaggtatcggcatggccccaggcggatacgttgctcccaaagccgtctggctgccggctgtgaaggccaaaggcctggagatatctgggactttcactcatcgtcaggggcatatatacatggagatgaactttaccaacaaggcgttgcagcacatgactgactttgccattcaatttaataaaaactctttcggcgtgataccgagcactcccctggccatccatacccctctaatgcctaaccagtcaatcgacgtgagcttgccgttgaataccctgggacccgtgatgaagatggagcccctgaataaccttcaggttgctgtgaagaataatattgatgtgttttactttagctgcttaattccactgaacgtcctcttcgtggaggatgggaaaatggagcgacaggtatttctggcgacttggaaagatatcccaaatgagaatgagctccaattccagattaaggaatgccacctaaacgcagacacagtcagttccaagctgcagaataacaatgtgtatacaatcgccaaacgcaatgtcgaagggcaggacatgttgtaccagtccctcaagctgaccaacggcatttggatactggccgagctgagaatccaacccggaaaccccaactatacacttagcttgaaatgccgggcacccgaggtaagccaatacatatatcaagtctacgattctatcctgaaaaactag

SEQ ID NO: 213524 - DNA, 2856 bp, Artificial Sequence
  Description of Artificial Sequence: Synthetic coding sequence
atgaccgattctaaatactttacaactaacaagaagggagagatatttgaattgaaggccgagcttaacaacgagaagaaagaaaaaaggaaggaggccgtgaagaaggttatcgccgcaatgacagtgggcaaagacgtctcttctttattccccgacgtggtgaactgcatgcagactgataatctggaactcaagaagttggtgtacctttatctcatgaactacgccaagagccagcccgatatggctatcatggctgtcaacagctttgtgaaagactgtgaggaccccaacccactgattagagccctggcagtgaggacgatggggtgcatacgtgttgacaagatcactgaatatctgtgcgagcctctgcgtaagtgtctcaaagacgaggacccttacgtcaggaagacagccgctgtgtgcgtagctaaattgcatgacattaacgctcaaatggtggaggaccagggcttccttgattcactgcgagatttaattgccgactctaacccaatggtcgtcgccaatgctgttgcagcgttgtcggagatttccgaatcccatcctaacagcaaccttctggacctgaatccacagaatattaacaaacttttgacagccctcaatgaatgtaccgaatggggacaaatttttattttggactgcctgtcgaactacaatccaaaagacgatagggaggcccagtccatttgcgaaagagttaccccaaggctatcccatgctaactccgcagttgtgttaagtgctgtaaaagtgctgatgaaattccttgaacttctgcctaaggatagcgattattataatatgttgctcaagaaactggcgcctccactggttactctgcttagtggcgagcccgaggttcagtatgtggcccttcgcaacatcaacctgatcgtccaaaaacgccctgaaatccttaagcaagagatcaaggtcttcttcgtcaaatacaacgatcccatatacgttaagctagaaaaactggacatcatgatccggctagcttcacaggccaacatcgctcaggtgttagcagagttgaaggagtacgccactgaggtggatgtggacttcgtcaggaaagccgttagggctataggcaggtgtgcaatcaaggtggagcagtccgcagagaggtgtgtcagcacactcctcgaccttatacagacgaaagtcaactacgttgttcaggaggctatcgtggtaattcgcgatatttttcgcaaatatcccaataagtatgagagcattattgccaccctgtgcgaaaacctcgatagcctagacgagccagacgcacgagctgctatgatttggattgtaggcgaatacgccgagcgtattgacaatgctgacgagctgctcgaaagctttctggagggtttccatgatgagtctacgcaggtccagctcaccttgctgactgcaatcgtcaagctttttttgaagaagcctagtgaaacccaggaacttgtccaacaggtcctgagtctggctactcaagattccgataaccccgacctacgggatcgaggttacatctactggagacttctttcaacggacccagtaaccgctaaggaggtggtcctgtcagagaagcccctcatttctgaggaaactgacctcatcgagccaacattactcgacgagctgatttgccatattggatctctagcctctgtgtaccataaacctcctaatgcatttgttgaaggctcccatggcatccatcgaaaacatctgccgattcatcacggtagcacagatgctggggatagccccgtgggcaccacaaccgccacaaatctcgagcaaccacaggttataccttcccagggggatctcctaggggacctgctgaacctcgacctcggacctcccgtgaacgtgcctcaggtgagctcaatgcagatgggagccgtggatcttctgggcggagggttggacagtctgctgggatctgacttgggcggagggatagggggaagcccagcggtggggcagtccttcataccctcatccgttcccgcaacctttgcaccctcacctacccccgctgtcgtcagttctgggctgaatgacctatttgagctgtctacgggcatcgggatggctcctggcggatacgtggccccaaaggccgtgtggctgcctgccgttaaggccaaagggctggaaatttctggtacatttactcatcggcaaggacatatttatatggaaatgaacttcacaaataaagccctccagcacatgaccgacttcgctatccagttcaacaagaatagttttggagtaattcccagcacgcctttggccatacacactccactgatgccgaatcaatcaattgatgtgtcactgcctctaaataccttaggacccgtgatgaagatggagccgctgaataacctccaagtcgccgttaagaataatattgacgtattctactttagctgtcttatacctcttaacgtgctcttcgtggaagacgggaagatggaacggcaggtcttcctggccacttggaaagatatccctaatgaaaatgaattacagttccagataaaagaatgtcacctgaatgccgacacggtaagctctaagctgcagaataacaacgtgtataccatcgctaagaggaatgtcgagggacaggacatgctgtaccagtcgctcaagctcaccaacggaatatggattctcgccgagttaaggatccagcctggaaaccctaactacactttgagtctgaagtgtcgggcaccagaagtatcacaatatatctatcaagtttacgatagtatcctgaagaattag

SEQ ID NO: 213525 - DNA, 2856 bp, Artificial Sequence
  Description of Artificial Sequence: Synthetic coding sequence
atgaccgattctaagtattttactaccaacaagaagggagagatattcgaactgaaagccgagctgaataatgaaaaaaaggaaaagcggaaagaggccgttaagaaggtgattgcagccatgaccgtcggtaaggatgtctccagtctctttccggacgtagttaattgtatgcagaccgataatctggagctgaagaagttagtatacttatacctgatgaattatgccaaaagtcagccagatatggccattatggccgttaacagcttcgtcaaggattgcgaggaccccaatccattaattcgtgccctggcagtccgaactatgggttgtatccgagtggacaagatcacagaatatctatgtgagccactccggaagtgcctgaaggacgaagatccttatgtgaggaagacggcggctgtctgcgtggctaagctccatgacatcaatgctcagatggtggaagatcaggggttcttagactctctccgggacttgattgccgacagtaaccctatggtagtggccaatgctgttgccgctctgtctgagatatccgagtctcacccaaatagcaatctgctggacctgaatcctcagaacattaacaagctacttacggccctgaacgagtgcacagaatggggacagattttcattctggactgtctctctaattacaaccctaaagacgaccgagaggctcagagtatttgtgagagggtcaccccaagattgtcccacgccaactctgccgttgttctcagcgctgtcaaagttctgatgaaatttcttgaactgttgcctaaggattccgactactacaacatgttactgaaaaaactagcaccaccactggtcactctcttgtcaggggaacctgaggtgcagtacgtagctctgaggaatattaacttgatagtgcagaagagaccagaaatcctgaagcaggaaatcaaggttttcttcgtcaagtacaatgaccccatctacgtaaaactggaaaaactggatatcatgattcgtttggcaagccaggctaatatcgctcaggtcctagccgagctgaaggagtacgccactgaggtggacgtggattttgtgcggaaggccgtgcgcgcaatcggccgatgtgctataaaagttgagcagagcgccgagcgctgtgtcagtaccctgttagatctgatccagacgaaggtgaactatgtggtacaggaggccattgtggtcatcagagacatctttaggaagtatcccaacaaatatgagtcaattatagccactctctgtgagaatttggactccctggacgagcctgacgcacgcgcagcaatgatctggattgttggcgaatatgctgagcggattgacaatgccgatgaactccttgaatccttcctggaagggtttcatgatgagagcacccaggtccaactaacactcctcaccgccatagttaaattgtttctgaaaaagccttccgagacccaagaattagtacagcaggtgttgagccttgcaacacaggacagtgacaaccccgatctgagagacaggggatacatatactggcgcctgctctcaaccgacccggtaacagcgaaagaggttgtactgtctgaaaagcctctgatatctgaagagaccgatctgatcgagccaacattgttggacgaattgatttgtcatatcggctctctcgcgagcgtgtaccacaagccccctaatgcgtttgtcgaaggctctcatggaatccaccgaaagcatctgccaattcaccatgggtcaacagatgccggtgacagcccggttgggacaacaacagcaactaacttggagcagcctcaggtgattcccagccagggggacctgctgggagacctgctgaacctcgacctcggaccacccgttaatgtgccccaggtatcatcgatgcagatgggagcggtggacctccttgggggaggattggactctctgttgggttccgaccttgggggagggattggcggtagtcctgctgttggacagtcctttatcccctcaagcgtgcctgccaccttcgcgccaagccccacccctgcagttgtcagctcaggactgaatgacctgtttgaactgtcaactggaatcggtatggcgcctggaggctacgtggcgccaaaggctgtgtggctcccggcagtgaaggccaaaggactggagatctcaggaacgtttactcaccgccagggacacatttacatggaaatgaattttaccaataaggccctgcagcacatgacagactttgcgattcagttcaacaagaattcgttcggggttataccttccacacccttggcaattcacacaccattaatgcctaaccagtcaattgacgtgtctttacccctgaacacgttgggacccgtgatgaagatggagcctctcaataatttgcaggtcgctgtgaaaaacaatattgacgtcttttacttctcctgtttgattccactgaacgtgctattcgtggaggatggcaagatggagcgccaggtatttctagctacttggaaggacatccctaacgagaatgagctgcagtttcaaattaaagaatgtcacctgaacgccgacaccgtttcttctaagctccagaacaacaacgtgtataccattgcaaagagaaatgtggaggggcaagatatgttgtatcagagtttaaagctgaccaatggaatttggattctcgctgagctgcgtatccagcctgggaaccccaactacaccctgtcacttaagtgcagggcaccagaagtctctcagtacatttaccaggtgtacgacagtatcttaaagaattag

SEQ ID NO: 213526 - DNA, 2643 bp, Artificial Sequence
  Description of Artificial Sequence: Synthetic coding sequence
atgcaaacagataatcttgagctgaagaagttggtctacttatatctgatgaattacgccaagtctcagccagacatggccattatggccgtgaactccttcgtcaaggactgcgaggatcccaatcccctcattagagcccttgcagtgagaactatggggtgtatacgcgtggacaaaataacagaatatctgtgcgagcctctcaggaaatgtttgaaggacgaagacccttacgtacgaaaaactgctgccgtatgcgttgccaaactgcacgacattaatgcccaaatggtggaagatcagggctttcttgactcattgcgggacctgattgccgattcgaatccaatggttgtggctaacgcagtggctgccctttccgaaatttccgaatctcaccccaactccaacctgctggaccttaacccacagaacataaacaaattgcttactgcactcaacgagtgcaccgagtggggacaaatttttatcctggactgcctgtccaactataatcccaaggacgaccgcgaggctcagtccatctgcgagcgagtgaccccacgtctctctcatgcaaactcagctgttgtcctgtctgccgtcaaggtccttatgaaattcctggagttgctgccaaaagattccgactactacaacatgttactgaagaagttagctcccccactagtgactcttttgtctggggagccagaagttcagtacgttgcgctcaggaacattaacctaatcgtccagaaaaggcccgagattctgaagcaggagatcaaagtgttcttcgtgaaatacaacgacccgatctatgttaagctggagaagctcgacattatgatccgattggcttcacaagccaacatcgctcaggttcttgccgagctcaaggaatatgcgacagaagtagatgtcgacttcgtgcggaaggctgttcgtgcaataggtcgatgcgccattaaggtggaacagtccgccgaacggtgcgtttctacactgctagatctgatccagacaaaggtcaattatgtggtacaggaggccatcgtcgttatcagagacatcttcagaaaatatcctaacaagtacgaaagcatcatcgctacactgtgcgagaatttggactccctcgatgaacccgatgctcgcgcagcaatgatttggattgtaggtgagtacgctgaaagaatcgataacgctgacgagctgctcgagagtttcctcgagggtttccatgatgaatccacacaggttcagctcaccttgctgaccgctattgtgaaactgtttctgaagaaaccttcggagactcaggaacttgtgcaacaagtcctctctctggccacgcaggactcagataaccctgacttgagagacagggggtacatttactggaggctgctatcgacagatccagttactgccaaggaggtcgtgttatccgaaaagcccctgattagcgaggagacggacctcatcgaacctaccctcctcgacgagctcatttgccacatcggatcactcgcctctgtgtaccacaagccccctaatgcatttgtagaaggctctcacggcattcacaggaagcaccttccaatccaccacggaagcaccgatgccggagactcaccagtaggaaccaccaccgctacaaacttggaacagccccaagtgatcccttcacaaggagaccttttgggtgatctcttgaatctggatttgggccctcctgtgaacgtgcctcaagtgtcatctatgcaaatgggcgcagtggacctcctaggcggaggcctggatagcctcgtgggccaaagttttatcccctcgtctgtgccagcaaccttcgccccttcacccactccagcagtggttagttctggcctgaatgatctgttcgaattgagcacaggaatcggtatggcgccaggcggatacgtggccccaaaagcagtgtggctccccgctgtgaaagccaaggggctggaaatttctggtacatttacgcatagacagggccacatttacatggagatgaatttcaccaataaggcactacaacatatgactgattttgccattcagtttaacaaaaattcatttggcgtcattcctagcactccgctcgcaattcacacacccttaatgccgaaccagagcatagacgtttcactgccgctgaacactctaggccctgtgatgaaaatggagcccctcaataacctgcaggtggccgtaaaaaacaacatcgatgtgttttacttcagttgcctgattccgctcaacgtgctgttcgttgaggacgggaagatggagagacaggtttttttagccacctggaaggacattcccaatgaaaatgagctgcagtttcagatcaaggaatgtcacctgaacgccgacacagtgagttccaagttacagaacaataacgtgtatacaattgctaaacggaacgtggagggccaggatatgctgtatcagtcactcaaattgactaacggaatctggattcttgccgagcttcggatccagcccggaaatccgaattacactttgtcattgaaatgtcgggcaccggaggtgagtcagtacatataccaggtgtatgatagcatactgaaaaactag

SEQ ID NO: 213527 - DNA, 2067 bp, Artificial Sequence
  Description of Artificial Sequence: Synthetic coding sequence
atgaaattccttgagctactccctaaggattcagactactacaacatgctgctaaagaagctcgcacctccgctcgtgaccctcctctcaggtgagcccgaggttcaatacgtcgctctgcgtaatatcaacctgattgttcagaaaagacccgaaattcttaagcaggagattaaggtattctttgtgaaatacaatgatcccatctatgtaaagctggagaaactggacatcatgataaggttagcttctcaggcaaacattgcacaagtcctcgctgagctgaaggagtatgctacggaagttgacgtggactttgtgcggaaagctgtgcgagcaatcggcagatgtgctataaaagtagaacagtccgctgaacgctgcgtgagcaccctgctggacctaattcagacaaaggttaattacgttgtgcaggaggctatcgtggtcatcagagatatatttaggaaataccctaacaagtacgagtccattatagctactttatgtgaaaacctggacagtctggacgagcccgatgctagggccgcaatgatttggattgtcggggagtacgcagaacgcattgacaatgccgacgaactgctagaatcgttcctggagggtttccatgatgagtccactcaggtccagttgacactgctaaccgccatcgtcaaattattccttaagaaaccatctgagacacaagagctggtccaacaggtgcttagcctggcgacacaagactcggacaatcccgatctgcgcgatcggggttatatttattggaggctactgtccaccgacccagtgactgctaaagaggtggtgctcagcgaaaaaccattgatctcggaagaaacagatctcatcgaacccaccctgctagatgagctcatctgccacattggatccttggccagcgtttaccacaagccgccaaacgcattcgtcgagggtagccacggtattcacagaaagcacctgcctattcaccacggatccacggatgccggagattcccctgtagggaccaccactgccacaaatttggaacagcctcaggtcattcctagtcagggagatctgttgggggatcttctgaacctggacctgggacctcctgttaatgtgccacaggtgtcgagcatgcagatgggcgcagtcgatcttctggggggaggactggacagcctgcttggatctgacctgggcggaggtattggcggatctcccgctgtcggacagtcattcatcccttcttctgtccctgccacattcgcgccttctcctactcctgccgtcgtgtcatctggactcaacgatttatttgagctttctacagggattgggatggcccctggcggttacgtggcacccaaagccgtatggcttcctgccgttaaggcaaagggcctcgaaatctctggaactttcacacataggcagggacacatctacatggaaatgaacttcaccaacaaggcccttcagcatatgacagatttcgccattcagtttaacaagaactctttcggcgtgatcccatcaaccccgttggccattcacaccccgctgatgcccaatcagagcatcgatgtgtctttgcccctgaacacactcggccctgtgatgaagatggagcccctcaataatctccaggtggccgtgaagaataatatcgacgtattttacttctcttgtctaatcccactgaatgtcttattcgttgaagatggtaaaatggaacgacaggtgttcttggctacctggaaggacattccaaatgagaacgaactacaattccagatcaaagagtgtcacctgaacgcagataccgtcagttctaagcttcagaacaataatgtgtacacgattgcgaaacgcaacgtagaaggacaggacatgctctaccagagcctcaaactgacgaacggcatctggattctggcagagctcagaattcagcccggtaaccctaactacacactctctcttaagtgtcgggctcctgaggtttcccagtatatataccaggtttatgactctatactcaagaactag

SEQ ID NO: 213528 - DNA, 1308 bp, Artificial Sequence
  Description of Artificial Sequence: Synthetic coding sequence
atgattggagggctgtttatctataaccacaaaggtgaagtgctcatctcccgcgtatacagggatgatatcgggagaaatgctgtggacgctttccgagtcaacgtgattcacgctcggcaacaggtccggtctccagtcaccaacatcgcaaggaccagttttttccatgtgaagagatcaaatatctggttggcagccgtaacgaagcagaacgtgaatgccgcaatggtctttgagtttctgtacaagatgtgcgacgttatggccgcatacttcggaaagatttctgaagaaaatattaaaaacaactttgtcttgatttacgaactgctggacgagatactggacttcggctacccccagaattctgaaacaggagccctcaaaacctttatcacccagcaaggtatcaagtcgcagcaccagactaaagaggaacaaagccagatcacgtcacaggtgactggccaaatcggctggagaagagagggcatcaagtatcggcgaaacgaactgtttttggatgtgcttgaatcagttaacttgcttatgtcgccgcagggccaggtacttagcgcccacgtgtctggccgagtcgttatgaagagttacttgagtggcatgccggaatgtaaattcgggatgaacgacaaaatagtcatcgagaagcaaggaaagggaacagccgacgagacgagcaaatccggaaagcagtcaattgctatcgatgattgcacctttcatcagtgcgtgaggctcagcaagttcgattctgagagatcaattagctttattcccccagacggagaattcgagcttatgaggtaccgcacaacaaaagatattattcttcctttcagagtcattcctttggtgagggaggtaggacgcaccaagttggaggtgaaggtggtcataaaatcaaactttaaaccttctctcttggcccagaaaatcgaagtaagaattcccacacccctcaatacgtctggagttcaggtgatatgtatgaaggggaaggctaagtacaaggctagcgagaacgcgatagtttggaaaattaagcggatggcaggcatgaaagaatcacagatttccgctgagatcgagctgctcccaacgaacgataagaaaaaatgggcaaggcccccaatcagtatgaacttcgaggtcccctttgcgccatcaggattgaaggtgagatatctgaaggtatttgagcccaaactcaattattcagaccatgatgtcattaagtgggtgcgctatattggcagatcaggaatctacgaaacgcgctgttag

SEQ ID NO: 213529 - DNA, 1302 bp, Artificial Sequence
  Description of Artificial Sequence: Synthetic coding sequence
atgattggagggctgttcatttacaaccacaagggtgaggtccttatttcgcgcgtctatcgggacgacattggacggaacgctgtggatgcctttcgagtaaatgtgatccacgcccgtcagcaggtgcggagccccgttacgaatattgcccgtacatctttctttcatgtgaaaagatcaaatatctggctggcagctgttacaaagcagaacgtcaatgcagcaatggtgttcgagtttttgtataaaatgtgtgacgtaatggccgcatacttcggtaaaatcagcgaggaaaatattaaaaataactttgtgttaatctacgagctcctggacgaaatcttggacttcggctacccccagaattctgagaccggagcattgaagaccttcatcacacagcaagggatcaaaagccaaaccaaggaagagcagagccagatcacttcacaggtaacaggtcaaattggttggcgcagggaaggcattaagtaccgccgtaatgagttattcttggatgtgctcgaaagcgtgaacctgttgatgtcgcctcaggggcaggttttatctgcccacgtatcagggagagtcgtgatgaagtcctacctgtccggaatgcctgagtgtaagtttggaatgaacgacaaaatagtcattgaaaaacagggaaagggcacagcagacgagacttcgaagtcaggaaaacaatccatagccattgacgactgcaccttccaccagtgtgtgcggctttcaaaattcgactctgagaggagcatctcattcattcctccagacggcgagtttgaattaatgcggtacaggacaaccaaggatatcatcttacctttccgcgtgatcccgctggtaagggaagtaggcagaacaaagttggaagtgaaagtcgtcatcaagagcaactttaagccaagcctgctggctcaaaagattgaggtgcgaatccccacccccctgaacacctcaggggttcaagtgatctgcatgaaggggaaggcaaagtacaaggcttccgagaacgcaattgtgtggaaaattaagcgaatggccggtatgaaagagagccagatatcggcagagatcgagctgctccctaccaacgataagaaaaagtgggcccgacccccaatctctatgaactttgaggtgccattcgctccgtccgggttgaaggtccggtacctcaaggtgttcgagcctaaactgaattactcagatcacgacgtaattaagtgggttcgatacatcggtcgatccggcatctacgagactcgctgctag

SEQ ID NO: 213530 - DNA, 1302 bp, Artificial Sequence
  Description of Artificial Sequence: Synthetic coding sequence
atgattgggggactgttcatctacaatcataaaggagaagtactaatcagcagggtgtaccgagacgacattggaaggaacgcggtagatgccttcagagtcaacgtgatacatgccaggcaacaggttcgctcccccgtgacaaatatagcccgtacatcttttttccacgtgaagaggagcaacatatggctagccgcagtgacaaagcagaacgtgaacgctgccatggttttcgagtttctctataaaatgtgtgacgttatggctgcctatttcggaaagatctctgaggaaaatatcaaaaataatttcgtcctcatatacgagctgttggacgagatcctggacttcggatacccgcaaaactctgagaccggtgcactcaaaaccttcataacacagcaggggattaagagtcagactaaggaagagcagagtcagatcaccagccaggtcacgggacaaatcggttggcgtcgcgaagggatcaaatacagaaggaatgaactgtttctggatgtcctggaatcagtcaacctgctgatgtcaccacaggggcaggtgctgtcggctcacgtgtcggggagggtagtcatgaagtcgtatctaagcgggatgcccgagtgtaaatttggcatgaatgataaaattgtgatcgaaaagcagggaaaaggcacagctgacgaaacaagcaaaagtggtaaacagtccatcgccatcgacgactgtactttccaccagtgcgtcaggctctccaagttcgattccgagcgttcaatcagtttcataccccctgacggcgaatttgaactcatgagatatcggaccacaaaggacattatactcccgtttagggtcattcctctggttcgggaggtcggccgtaccaagttggaagtaaaggtggtgattaaatctaacttcaaaccaagtcttctggctcagaagatagaagttagaatcccaacacctttaaacacgtccggagtgcaagtgatctgcatgaagggcaaagccaagtataaagcgagcgagaatgccattgtctggaagattaagagaatggcgggtatgaaggaatcacagatctccgcagagatagaactacttccaacaaatgataaaaagaaatgggccaggccacctataagcatgaattttgaagtgccattcgcgccttctgggctcaaggtgaggtacctgaaggtgttcgagcccaagctgaactactcagaccatgacgtgattaaatgggttcgttacattggtcgtagcgggatttatgaaactagatgttag

SEQ ID NO: 213531 - DNA, 342 bp, Artificial Sequence
  Description of Artificial Sequence: Synthetic coding sequence
atgatagggggactatttatatacaaccacaagggcgaggtgcttatcagccgcgtttatcgagacgacatcggtcgcaacgctgttgatgcattccgagtgaatgtgatccacgccagacagcaagtgagatcccccgttacaaacattgccagaactagcttttttcatgtaaaacgctctaacatctggttggcagccgtaacaaaacagaacgtaaacgcagctatggtgtttgaattcttatataaaatgtgtgacgtgatggctgcgtattttggaaaaatcagtgaggagaatattaagaacaactttgtgttgatctacgagctgctcgattag

SEQ ID NO: 213532 - DNA, 1263 bp, Artificial Sequence
  Description of Artificial Sequence: Synthetic coding sequence
atgattgggggtctgtttatttacaaccataagggcgaggtgctgatctctcgcgtgtatcgggatgacattgggcgaaacgctgtggacgcgtttcgtgtgaatgtgatccatgccaggcagcaagtgcggtcgcctgtcaccaacatctggttggccgcagtgaccaagcagaatgtgaacgcagctatggtgttcgaattcctctataagatgtgcgatgtgatggctgcatattttggcaagatttctgaagagaatatcaagaataattttgtcctgatttacgagctgctcgacgaaatactggacttcggataccctcaaaactccgagaccggcgctttaaagacatttatcacgcagcaagggatcaaaagtcagacaaaagaggagcaatctcagataacctcacaggtgaccggtcaaattggttggcggcgagaaggaattaaataccggagaaacgaactgttcctggatgtcctggagtccgtaaatttgctgatgtctccccagggccaagtactaagcgcccacgtgtccggacgggtggtgatgaaatcttatctaagtggcatgcccgaatgcaagttcggtatgaacgacaaaattgttatcgaaaaacagggcaaaggtaccgccgatgaaacgagcaaatctgggaagcaaagcattgccatagacgactgcactttccaccaatgtgtgcgcctgtccaaatttgattcagaaagatctatcagtttcatacctcccgatggtgagttcgagcttatgcgctaccgcactactaaggatattatactgccatttagggtaatccccctcgtgagggaggtaggcaggacgaagctcgaagtgaaagtggtaattaagtcaaactttaaaccttccttgttagcgcagaaaatcgaggtcagaatccccacacctttgaacaccagcggtgtgcaggtcatctgtatgaagggcaaggctaagtacaaagcaagtgagaatgccatcgtgtggaaaatcaaacgtatggctggcatgaaagagtcccagatttcagcagagatcgagttgctgcccacgaacgacaaaaaaaaatgggccagacctcccatcagcatgaatttcgaagtaccattcgccccatcgggtctgaaagttaggtacctcaaagtgtttgagccaaaactaaattattccgatcatgacgtgatcaaatgggttcgctatataggcaggtccgggatttatgagacgcgctgctag

SEQ ID NO: 213533 - DNA, 1128 bp, Artificial Sequence
  Description of Artificial Sequence: Synthetic coding sequence
atgattgggggactttttatttataatcacaaaggggaggttttgatcagtagggtatatagggatgatataggtcggaacgccgtggcagcctacttcggaaaaatttccgaggagaacattaagaataactttgttctcatttacgaactgctggacgagatcctggacttcgggtatccacagaattcggagacaggcgctttgaagactttcatcacacagcaaggcatcaaaagccagcaccagacaaaggaagagcagtcccagattacctctcaggtgactggacagatcggttggcgcagggagggaataaaatatagacgaaacgaactgtttctggatgtgctggagagcgtgaacctgctcatgtcaccacagggccaagtgttgagcgcccacgtgtccggaagagtggtgatgaagagctacttgtctggcatgcccgagtgcaagttcgggatgaatgataagattgtgattgagaaacaggggaagggcaccgctgacgaaacctctaaatcggggaagcagagcattgctatcgatgactgcactttccaccagtgtgtacgtctttcaaaattcgattcggaacgcagcataagctttattcctccggacggggagtttgagcttatgcgttatcgtaccactaaggatattatcctgccgtttagagtgatacctctggttcgcgaggtgggccgaacaaagctggaggtcaaggtggtgataaagtcgaatttcaagcccagtctcctggctcagaagatcgaggtgagaatacccacaccgctgaacacctccggggttcaggtcatttgcatgaaagggaaagctaaatataaagcctctgaaaacgctatagtgtggaagattaaacgtatggccggaatgaaggagtctcagatctctgcagagattgaactactcccaactaacgacaagaaaaagtgggccagacctcccatatcaatgaacttcgaagtaccattcgctcctagcggcctgaaggtgagatatctgaaagtgttcgagcctaaattaaattattccgaccacgacgtgataaagtgggtgagatatatcggccgatcagggatctacgagaccaggtgctag

SEQ ID NO: 213534 - DNA, 429 bp, Artificial Sequence
  Description of Artificial Sequence: Synthetic coding sequence
atgattcggttcatactgatacagaaccgggctggcaagacccgcttagccaaatggtacatgcagttcgacgatgatgaaaaacagaagctaatcgaggaggtgcacgccgtggttacagtcagagacgccaagcatacaaattttgtggagtttaggaatttcaaaatcatctacagacgttacgcaggactctacttttgtatctgtgtagacgtgaatgacaataacctggcgtatcttgaagccattcataattttgtggaggttcttaacgagtattttcacaatgtgtgtgaactggatctcgtgtttaacttctacaaggtttatactgttgtggacgaaatgttcttggctggagaaatccgggaaacgtcccagacaaaggttctgaagcagcttcttatgctgcagtctctcgagtag

SEQ ID NO: 213535 - DNA, 315 bp, Artificial Sequence
  Description of Artificial Sequence: Synthetic coding sequence
atgattcggtttattctaatccaaaatagagccggaaaaaccagattggcaaaatggtacatgcagtttgacgatgacgagaagcagaagctgatagaggaagtgcatgccgtagtgaccgtgcgagatgccaaacacaccaacttcgttgaggtgttgaacgagtacttccataatgtttgtgagctggacctggttttcaacttctacaaggtgtacacggtggtggacgaaatgtttctcgccggagagattcgcgagacaagtcagaccaaggtactcaagcagctgcttatgctccagagtttagaatag

SEQ ID NO: 213536 - DNA, 3285 bp, Artificial Sequence
  Description of Artificial Sequence: Synthetic coding sequence
atgtctagtaacagcttcccctacaacgagcagtcagggggtggtgaagcgactgagctcgggcaggaagcgacgagcaccatttcaccctcgggcgcattcggactgtttagctctgatttgaaaaagaacgaggatctcaaacagatgctcgaaagcaacaaggactctgccaaactagacgctatgaaaaggatcgttggcatgatcgccaagggcaaaaacgcctctgagctgtttcctgctgtggtgaagaacgtcgcttccaagaacattgagattaaaaaactggtttatgtctacctggtacgctacgctgaggagcaacaggacctggcgttattgagcatttccacctttcagcgagcccttaaagaccccaaccagctgatccgagcatctgccctaagggtcttgagcagcatcagagtcccaatcatcgtgcccataatgatgctggccatcaaagaagcctcagccgatctctctccttacgtccgtaaaaacgcagcccacgctatccaaaaactctacagtctcgaccccgaacaaaaagaaatgcttatcgaagtcatcgagaagctgttgaaggataagagcactttggtcgccggtagcgtggtcatggcattcgaagaagtgtgcccagaccggatcgatctcatccacaagaattaccggaagctgtgtaatctactggtggatgtggaagagtggggccaagtggtcatcattcatatgcttacgcgctacgcacgtactcagtttgtgagcccctggaaagaaggggacgagcttgaagataacgggaagaacttctatgagtccgatgatgatcaaaaagagaagaccgacaaaaagaaaaagccttatactatggacccagaccacaggttgttgatccggaatacaaagccccttctccagtcacggaatgcggctgtggtgatggctgtggcccagctttactggcacatcagccccaagagcgaggcaggaattataagcaagagtttggtgcgtctcctgagaagcaaccgagaggtgcagtacatagtactccagaacatagctacaatgagcattcagagaaaaggcatgttcgaaccctaccttaaatctttttacgtccggagcacagatccaaccatgatcaagactttgaaactcgagattctgactaatctcgcaaatgaggctaacatttctaccctgctaagggagttccagacctatgtgaagtcacaggataagcagttcgctgcagccactatccaaactatcgggaggtgtgccaccaacatcctcgaggtgacagacacgtgcctcaacggcctagtttgtttgctgtcaaaccgagatgaaatagttgtagcggagtccgtggtagtgatcaaaaagctcctccagatgcagccggcacagcatggagaaataatcaaacacatggccaagctgcttgactcaatcaccgtccctgtggctcgcgcatccatcctgtggctgatcggagagaactgcgagcgggtgccaaagattgcacccgacgtactgcgcaagatggcaaagagcttcacaagcgaagatgacttagtgaaactccagattctcaacttgggcgctaagctttacctgaccaattccaagcagaccaaactgttaactcagtatatactgaacctgggaaagtacgatcaaaactacgatatacgagatcgaacccgctttataagacaactaattgttcctaacgtgaagtccggagctctttccaagtacgctaagaaaatttttttagcgcagaaacccgcacctctgctggagagcccctttaaagatcgtgaccactttcagctcgggactctttctcacactctgaacatcaaggcaacgggttacctcgaactctctaattggcccgaggtggcccctgatccatctgtgaggaatgtggaggttattgaactggctaaggaatggaccccagccggtaaagctaaacaggagaatagtgcaaaaaagttctacagcgaatctgaggaagaggaagattcatcagatagctcttcggactccgaaagtgaaagtggctctgagtcaggggaacaaggagagtcgggagaagagggcgatagcaatgaggatagttccgaggactcatccagtgagcaagactccgagagtgggcgagagagcggccttgaaaataagcggacggccaagaggaatagcaaggcaaagggcaagtctgactccgaagatggggagaaagaaaacgaaaaaagcaagaccagtgattccagtaatgacgaatctagctctatcgaggattcatcaagcgattcggaaagtgagtctgagcctgagagcgagagcgaatcgcgaagagttacaaaggagaaggagaaaaagaccaagcaggaccgaacccctctgaccaaagacgtatctctgctggatctggatgacttcaatcctgttagcacaccagtggccctcccgaccccagcactaagcccatccctcatggccgacctggaaggcctgcacctgtcaacttcatcaagtgtgattagcgtttctacaccggcattcgtccccaccaagacccatgtactgcttcacaggatgagtgggaaaggcctggctgctcactatttttttccacgacagccgtgcatcttcggagacaagatggtcagcattcagattacgctgaacaataccacagatcgcaagatcgagaatatacacatcggagagaagaagctccctattggaatgaaaatgcacgtgtttaatcccatagactcactcgaacctgaaggttctataaccgtgtccatgggtatcgatttctgcgactctactcagacggcctcatttcagttgtgtaccaaagacgattgttttaacgtgaatattcagcccccagtgggagagctgttgctgccagttgcaatgtctgaaaaggattttaagaaggaacagggtgtgttaacaggtatgaatgagaccagtgcagttataatagctgcccctcagaactttactccgagtgttatttttcagaaggtggtaaacgtggccaacgttggggcagtgcctagcgggcaggataacatccataggttcgccgcaaaaactgtgcattctggatcgctgatgctggtcactgtcgagttaaaagagggatcaaccgcgcagctcataatcaacaccgaaaaaacggttattggcagcgtgttgctcagggagttgaagcccgtcctgtcccagggttag

SEQ ID NO: 213537 - DNA, 1698 bp, Artificial Sequence
  Description of Artificial Sequence: Synthetic coding sequence
atgtcctccaatagtttcccctataatgaacagtcaggtgggggagaggctactgagctggggcaagaggcaaccagcactatatcaccatcaggagcatttgggctcttcagcagtgatctcaagaaaaatgaagacttaaagcagatgctagagtctaacaaggactctgccattaaagaagcaagcgctgacctgtcaccatatgtgaggaagaacgcggcacacgctattcagaagctgtacagtctggacccagaacagaaggaaatgctcatcgaggtaatcgagaaactcctgaaggataagagcaccctggtcgccggtagcgtcgttatggcatttgaggaagtatgtccggaccgaattgacttgatccataagaattaccggaagctctgtaacctcctggtcgatgtggaggagtgggggcaagtggttatcatccacatgctaactaggtacgccagaactcagttcgtatccccatggaaggagggtgatgagttggaagataatggcaagaacttttatgagtctgacgatgatcagaaggagaagaccgataagaagaaaaagccatacacgatggatccagaccatcgtcttcttattaggaacactaaacccctgctgcagtcacgaaatgccgcagtagtcatggccgtggctcaactgtattggcatataagccctaagtccgaagccggtattatatcaaaatctttggtacgccttctgcgctcaaacagagaggttcaatatattgtgctccagaatattgccaccatgtcaattcaacggaaagggatgttcgagccctacctcaagtctttttatgtccgcagcactgacccaactatgatcaaaacactcaaattagaaatcctgaccaacttggcaaacgaagctaacattagcaccctccttagggagtttcagacctacgtaaaatcccaggataaacagttcgcagcagcgacaatccagaccatcggtcgctgcgcaaccaatatattggaggtgacagacacttgcctgaacgggctagtctgcctgttatcaaacagagacgaaattgtcgtggccgagtccgtggttgtgatcaagaaactcctgcagatgcaacccgctcagcacggagagatcataaagcacatggctaagcttttggactccataacagttccagtagccagggcctcaatcctctggctgatcggggagaattgcgagagggtacctaaaattgctccagacgtgctcaggaaaatggccaagagcttcacctcagaggacgacctggtgaagctccagatcctaaacttgggcgcaaagctgtatcttaccaactcaaagcagaccaagctgctgactcagtatattcttaacctggggaagtatgatcagaactacgatatccgtgatcgaaccagatttataaggcagcttatcgtgccaaacgtgaaaagcggagcactaagcaagtatgctaagaagatctttctagcacaaaagccagcccctctgctcgagtcacctttcaaagacagggaccattttcaactgggaacactgtcacatacccttaacatcaaggcgaccgggtatctggaattgtctaactggccagaagtggcacctgatccttcagtacgcaacgtggaggtaatcgagctcgtcgtattgtctgagtag

SEQ ID NO: 213538 - DNA, 2403 bp, Artificial Sequence
  Description of Artificial Sequence: Synthetic coding sequence
atgtcaagcaattcatttccttacaatgaacagtcgggcggaggagaggcaacggaacttggtcaagaggccactagcacgattagcccaagcggcgctttcggtctcttcagcagcgacctcaagaagaacgaggatcttaagcagatgctggagtctaacaaagattcagccaagcttgatgcaatgaagcgcatagtagggatgattgctaagggcaaaaatgcatctgagcttttccctgcagtcgtgaagaacgtcgcatcgaagaacattgaaataaaaaagctggtctacgtttacctcgtcagatatgctgaagagcagcaggacctcgcgctgctctccatcagcactttccagcgcgctctcaaggaccccaatcagctgattagagcctctgccctgagggtgctgtcgtcaattcgagtcccaatcatcgtgcccataatgatgctggcgattaaagaagcttctgccgatttatccccatatgtcagaaagaatgcggctcacgctatccagaagctctacagcctggatcctgaacaaaaagaaatgctcatcgaggtgatagagaagttgctgaaagacaagtctaccttggtagctggaagtgtcgtgatggcatttgaggaggtttgtccagatagaatcgatttgattcacaaaaactatagaaagttgtgcaatttgctcgttgatgtcgaggagtggggacaagtcgtgatcatccacatgcttactcgctacgccaggacccagtttgtatcaccgtggaaagaaggtgatgagctcgaagataacggtaaaaatttttacgaaagtgatgacgatcagaaggagaaaaccgacaaaaaaaaaaaaccctatacaatggatccagaccataggctgctgatcaggaataccaagccgctgctccagagcaggaatgctgcagtcgtgatggcggttgcacagctatattggcacatttcacccaagtccgaggcaggcattatcagtaaatcactcgtgagactgctaaggtccaatcgcgaggttcaatacatcgtcctacaaaatattgctacaatgtccatccagcggaaggggatgttcgagccttatctgaagagcttctatgtcagatccactgacccgactatgatcaagacattgaagctcgagatcctaaccaatctggcaaacgaggcaaacatcagcacgttgctgcgtgagtttcaaacctacgtcaagtcacaggacaaacagtttgcggcagccacaattcaaacgattggaagatgcgctaccaacatcctggaagttaccgatacgtgtttgaatgggttggtttgtctcttgagcaatcgcgacgagattgtggtcgcagaaagcgtcgtcgtcatcaagaagctgttgcagatgcaaccagctcagcatggggaaatcatcaagcacatggcaaaactcctagactctattacggttccagtggccagggccagcatactgtggcttataggcgaaaattgtgagagagtcccaaagattgcccctgacgtattgaggaagatggccaagagctttacatccgaagatgatcttgtgaaacttcaaatcctcaatcttggcgcaaaattgtatttaacaaattccaaacagactaagctgctgacccagtacatcttaaacctcggaaaatacgaccaaaattatgatatccgcgatcgaacccgcttcatacgtcagcttattgtgcccaacgtgaaatccggtgccctgagcaagtacgccaagaaaatctttcttgctcagaaaccagcccctttattagaaagccctttcaaggatcgcgatcactttcagctgggaacgttgtcccacacactgaacataaaagcgactggatatctggagctttcaaattggcccgaggtcgccccagacccctcagtgcggaacgtagaggtgattgagctagctaaggagtggacacccgctggcaaagccaagcaagaaaattctgcgaaaaagttttatagcgaaagtgaggaggaagaggatagcagcgactcaagctccgatagcgaatccgagtcaggctcggaatctggggagcagggagagagcggggaagagggggattcaaatgaggattcatccgaagatagttcttccgaacaggactcagagagcggaagggagtctggtctggaaaacaaaaggaccgccaaacgcaactcgaaagcaaagggaaaatctgatagcgaggacggggagaaagagaatgagaagagtaagacaagcgactcctccaacgacgagtcctcgtcaatcgaagactcctcatctgatagcgagagtgagtcagaaccagaatccgaatcagaaagccgacgggtgaccaaagaatag

SEQ ID NO: 213539 - DNA, 582 bp, Artificial Sequence
  Description of Artificial Sequence: Synthetic coding sequence
atgatcaaggccattctgatctttaataatcacgggaagcctaggctgagcaagttctatcaaccgtactctgaggatacacagcagcaaatcatacgcgagacgtttcaccttgtttccaagcgggacgaaaatgtctgtaacttcctggaggggggtcttctgataggaggttcggacaacaagttaatctacagacactatgcaaccctctacttcgtgttctgtgtcgattcaagtgagtctgagctgggaattcttgaccttatccaagtgttcgtcgagacactagataaatgctttgagaacgtatgcgaactagacctcatctttcacgtggataaagtacataacatactcgccgagatggtaatgggtggaatggtcctggagacaaatatgaacgagattgtgacccagatagacgcccagaacaagctggagaagagtgaggcaggtctggcgggtgctcccgctagggccgtatccgccgtgaagaacatgaatctcccagagatccccagaaacattaatataggtgatatctccataaaggtccccaacctgccttcttttaagtag

SEQ ID NO: 213540 - DNA, 450 bp, Artificial Sequence
  Description of Artificial Sequence: Synthetic coding sequence
atgatcaaattctttttaatggttaataagcaagggcagacacgactgtcgaagtattatgagcatgtggacatcaataagaggacgctgctagaaaccgaagttatcaaaagttgcttatctcgtagcaacgagcaatgctcttttatcgaatacaaagacttcaagctgatttatcgccaatatgccgctctctttattgtggttggggtgaatgataccgaaaacgagatggccatttacgaattcatacacaatttcgtcgaggtgctcgatgaatattttagcagagtgtcagagttagatgtgtccttctttaatacagtgttccactcaacatggcagatgcattcgggcccttaccaaacaagatcctgctctgtgacacaggccggagtgcaacggtgcgatcatggctccctgcatcccggaagcccaggtttgaagtag

SEQ ID NO: 213541 - DNA, 408 bp, Artificial Sequence
  Description of Artificial Sequence: Synthetic coding sequence
atgatcaaattcttcctgatggtgaataaacagggacaaacacgtctgagcaaatactacgaacacgtagatattaacaaaaggacacttctcgaaacggaggtgattaagagttgcctgtcaaggagcaacgagcagtgttcctttatcgaatacaaggattttaaactgatttaccgacagtatgccgctctgttcatcgtggtgggcgttaacgatacagaaaatgaaatggcgatctacgagttcattcacaatttcgtcgaagtgctagacgagtatttctctcgggtggagccgatcgacgagttgcctaagatttgtagtgccctcgagccccagcagacctgtttctctcctgactcctcatcctttaaaggcgcagcctccacaaccccgatctattag

SEQ ID NO: 213542 - DNA, 2220 bp, Artificial Sequence
  Description of Artificial Sequence: Synthetic coding sequence
atgccatacttaggcagtgaagatgtcgttaaggagctgaagaaggcactatgcaaccctcacatacaggcggacagactccgttaccgcaatgtgatccagcgggtcataagatatatgacccaggggctggatatgtccggagtctttatggagatggttaaagcttccgccacagtggacattgtgcagaaaaagctggtgtatttgtacatgtgtacctatgcacctctcaaaccagacctggctctgctggctataaacacgctgtgcaaagactgcagtgatcccaaccccatggtgcgcggactcgctttacgttcgatgtgctcgcttcgtatgccgggagtgcaggagtacatccagcagccaatcttaaacgggcttagagataaggcctcctatgtgcgccgagttgccgtgctaggatgcgctaagatgcataatcttcatggagactccgaagtagacggagccttagtgaacgagctatatagcctgttaagagatcaggaccctatcgtcgtggtgaattgtttgcggagcctggaggaaatcctcaaacaggaggggggtgtggttatcaataagcctattgcacatcatctgctcaaccgtatgagcaagctggaccagtggggacaggcagaggtgctgaacttccttctgagatatcaaccccgatccgaggaggaattatttgacattctgaatctcctcgacagttttctaaagtcctcctcaccaggggttgtcatgggggctactaagttgttcctcatcttggcaaagatgttccctcatgtccaaacggacgtcctagtgcgagtcaaaggcccattgctggcagcttgttcctcagagtccagagagttgtgtttcgtggccttatgtcatgtgaggcagattttacacagccttcctggccatttctctagccactataagaagtttttttgcagttacagtgagccccactatatcaagctgcagaaggtcgaagtgttgtgcgagctggtcaacgatgagaacgttcagcaggtgctggaagaactgcgtggttattgcaccgatgttagtgcagactttgcccaagcagccatcttcgctatcggtggaattgccaggacttataccgatcagtgcgttcaaatattaacggagctattaggacttcggcaggagcacattacaaccgtggtggtgcagaccttccgagatctggtatggctgtgccctcagtgcaccgaggcagtgtgtcaagcattgcccggatgcgaggagaacatccaagacagcgaaggaaaacaagcactgatctggctattgggtgtgcatggtgaacgcataccaaacgctccatacgtgctcgaagacttcgtagaaaacgtgaagagcgagacgtttcctgccgtgaaaatggagttgcttacagccctgttgcgcttattcctgagccggcctgccgagtgtcaggatatgctgggaaggctcctctactattgcatcgaggaggaaaaagacatggccgtgcgagaccgcggtctcttctactacaggctgctactcgtcggtattgatgaggtcaaacgcatcctgtgtagtcccaaatcagatcccacactaggtctgctggaggatcctgctgaacgcccagtgaacagctgggccagcgacttcaatactctggttcctgtgtacgggaaggctcactgggcaaccatttccaagtgtcagggcgcagagagatgcgaccctgaactgcctaagacctcctctttcgctgcatctggccctctgattcccgaagagaacaaggagcgggtgcaggagctgcctgacagtggcgctttgatgcttgttccaaataggcaactcaccgcggactacttcgagaagacatggctctctctcaaggtcgcccatcagcaagtgctgccctggaggggtgaattccacccagacaccttgcagatggctttacaggtcgtaaacatacagaccatcgccatgagtcgcgctggtagtagaccgtggaaggcctatctgagcgctcaggacgatacgggatgtctctttttgacggaattattgctggagccaggaaattcggagatgcagatttctgtgaagcagaatgaggccagaacagaaacactgaactcctttattagtgtgctagaaaccgtcattggcacaatcgaagagattaaaagctag

SEQ ID NO: 213543 - DNA, 891 bp, Artificial Sequence
  Description of Artificial Sequence: Synthetic coding sequence
atgccctatctggggagcgaggacgtagtgaaagaacttaaaaaggctctgtgcaacccccacatacaagccgaccgtttacgatacagaaacgttatccaaagagtgatacgtatgcccggagtgcaggaatacatacagcagccaattctgaacggtttgagagataaggcctcttacgtgcgccgtgtagcagtgctcgggtgtgcgaaaatgcacaatctccacggtgactctgaggtcgatggagctttagtaaacgagctgtacagcctgctccgcgaccaagaccccatcgtcgtggtgaattgccttaggtctttagaggagattcttaaacaggaggggggtgtggtgatcaataagccaatcgcccaccacctgctgaaccggatgtctaaattagaccagtgggggcaggcagaggtactgaactttttattacgctaccagcccaggagtgaggaggaactctttgatattttgaatctcctggactccttccttaagtctagcagcccaggggtggtgatgggtgctacaaagttgtttttgatcttggctaagatgttcccccacgttcagaccgacgtgttggtcagagtgaaggggccactgcttgcagcctgcagtagcgagagcagggagctgtgttttgtggctctctgtcacgtccgacaaatcttgcatagcctccccggtcacttctcaagtcactacaaaaaatttttctgtagctacagtgaaccacactatatcaagcttcagaaagttgaggtgctgtgcgagctcgtgaatgacgaaaacgttcaacaggtcctggaggagctgcggggatactgtaccgacgtgagtgcagactttgctcaggccgcaattttcgcaatatag

SEQ ID NO: 213544 - DNA, 909 bp, Artificial Sequence
  Description of Artificial Sequence: Synthetic coding sequence
atgccatacttgggcagcgaggatgtcgtcaaagagctaaaaaaagctctgtgcaatccgcacatacaagccgacagattacgataccgaaacgtcattcaacgcgtcatccgttacatgacacaagggctggacatgagcggcgtgttcatggagatggtaaaggcatctgccacagtggacattgtgcagaagaagcttgtgtatctgtatatgtgtacctacgcacccctaaagcccgatttggcgctgctggcgattaacaccttgtgcaaggattgttctgatcccaaccccatggtacgtgggctggccttgcgctctatgtgcagtctgcggatgagtaaactcgaccagtgggggcaggccgaagtgcttaattttctcctgagataccagccaagatctgaggaggagctcttcgacatactgaacctactcgactctttccttaaaagtagttctccaggggtcgtcatgggagccacaaaactcttcctgattcttgcaaaaatgtttcctcacgtgcagaccgacgttctggttagggtcaaaggccctttgctcgccgcatgctcatctgagagtcgagaattatgttttgtggccttatgccacgtccggcagatccttcatagcctccccggacattttagtagccattataagaagttcttctgcagctatagcgaacctcactacataaagctgcagaaagtcgaggtgctttgcgaactagtgaacgatgaaaatgtacaacaggttttggaggagctgcgtggctactgtaccgacgtgtcagcagatttcgcacaggctgccatctttgcaattggcaggtgcttgctgctgttccttctcgaaaacctggatcagcccgcacggaaattatggctcgaagagccctag

SEQ ID NO: 213545 - DNA, 1716 bp, Artificial Sequence
  Description of Artificial Sequence: Synthetic coding sequence
atgccctatcttggctcagaagatgtggttaaggagctgaaaaaggctctttgtaatcctcatatccaggccgataggctgcgctatcgtaacgttatacagcgagtgataaggatgagcaagttggaccagtgggggcaggccgaggtcctcaacttcttactgcgataccagccgaggagtgaggaggagctcttcgacatcctgaacctgctcgattcctttctgaaaagctcttcccctggcgtggttatgggcgctaccaagctattcctcattctggctaaaatgttcccccatgtgcagacagacgtactagtaagggtcaagggcccacttcttgccgcatgctcttccgagtctcgcgagctgtgctttgtggctttatgtcatgtgaggcaaatccttcattctctgcccggtcatttcagtagccattacaaaaagtttttttgctcctattcagagcctcactacattaagctgcaaaaagtggaagtcctctgcgagctggtaaatgacgagaacgtccagcaggtcttagaggaactgagagggtactgcacagatgtaagtgcggactttgcgcaggcagccatctttgccatcggcggaatcgccagaacttataccgaccagtgcgtccagattctgacggaactcctcggcctgcggcaagagcacattacgaccgtggtcgttcagactttccgggatttagtttggttatgccctcaatgtacggaggccgtttgtcaggccctcccaggttgcgaggagaacatccaggacagcgaggggaaacaagcactgatctggctgctcggcgtgcatggcgagcgcatccccaacgcaccatatgtcctggaggactttgtggaaaacgtgaagtcagaaactttcccagccgtcaagatggagttactgaccgccctgctcaggttattcctcagccgcccagccgagtgccaggatatgctcggacgcctgctttattactgtatagaagaggagaaggatatggctgtccgcgatcggggactgttctactatagactacttttggttggtatcgatgaagtgaaaaggatcctctgctccccaaagagtgaccccacattgggactcctggaggaccccgcagagaggccggtcaactcatgggcatccgattttaatacattggtgccagtctatggaaaggcccattgggctactatcagcaagtgccagggcgcagaacggtgtgatcccgagcttccaaaaacttctagttttgccgcatctggcccactcatacccgaagaaaacaaggaacgcgtgcaagaacttcccgattctggggctctgatgctcgttcctaaccgacagctcacggccgattacttcgagaaaacctggctgtctttaaaggtggcacaccagcaggtgttgccttggaggggagagtttcatcctgacacactccaaatggcactccaagttgtcaacatacaaactatcgctatgtcgagagctggtagtcgcccatggaaagcatacctctctgcccaagatgacacaggttgccttttcctcactgaattgctcctcgagcccggtaattcagagatgcagatctcagtgaagcagaatgaggcaaggacagagacgctaaatagtttcatcagcgtgctcgagacagtcatagggactattgaggagattaaaagctag

SEQ ID NO: 213546 - DNA, 2220 bp, Artificial Sequence
  Description of Artificial Sequence: Synthetic coding sequence
atgccctatctgggctctgaggacgtcgtgaaagaactgaaaaaggcgctgtgtaatcctcacatccaggccgatagactgcgatacagaaacgtcatccagcgcgttatccgctatatgacgcagggacttgatatgtctggcgtttttatggagatggtgaaagccagcgcgactgtagatatagtccaaaagaagctggtatatctatacatgtgtacttacgcacccttgaagccagacctggcgctgttggccatcaacaccctgtgcaaggactgcagcgatccgaatcccatggtcagaggccttgcgctcagaagcatgtgttcgctccgaatgcctggcgtccaggagtacattcagcagccaatcttaaacggactgagggacaaagcctcttatgtgcgcagggtggccgtgctcggttgcgctaaaatgcataacctgcacggagattctgaggtagatggagctctggtgaatgagctttattctttgctcagggaccaggatcccatcgtggtcgtgaactgtctccggtctttagaggaaatacttaagcaagagggcggagttgtgattaataagccaatagcccaccatctgttgaatcggatgagcaagctggatcagtgggggcaggctgaagtgcttaattttctgctgcggtaccagccacggagtgaagaagaactttttgacatcctgaatctgctggactcttttctgaagtcctcctctccaggggtggtcatgggagcgacaaagctgtttcttattctggcaaagatgttcccccacgtacagaccgatgtgctggtcagagtgaaaggcccactcttggctgcctgttcgtctgagagccgggaactatgctttgtggcactttgtcacgtccggcaaatcctgcatagcctgccgggtcactttagctcccactataagaaattcttctgctcctactcggagcctcactatattaaacttcaaaaggtggaggtgctgtgtgaactcgtcaacgatgagaatgtccagcaggtcttagaagagttaagaggatactgcacagacgtgtcagcagattttgcccaggccgcaattttcgctattggcggaatcgcacggacttacactgatcagtgcgtacaaattctgacggaacttctgggccttagacaagaacacatcacaacagtggtggttcaaacttttcgggacctggtttggttgtgtccacagtgcactgaggcagtgtgtcaggctctgcctggatgcgaggaaaacatacaggacagtgaggggaagcaagctctgatctggctcctaggcgtgcatggggagagaatccccaatgccccttatgtgctggaagatttcgtggaaaatgtgaaaagtgagacctttcctgccgtgaaaatggaactgctcactgctttgctgcgcttgttcctcagtaggcctgcagagtgtcaagatatgctcggtagactgttatattactgcattgaggaggagaaggatatggcagtgcgggaccgtgggctcttctactacaggctcctgctagtgggaattgacgaagtcaagcgaatactttgcagcccaaaaagcgacccaacattagggctattagaggatcctgcagagcgaccagttaacagttgggccagtgacttcaatacactcgtgccagtctatggaaaagcgcattgggccacaatatcaaagtgccagggcgctgagaggtgcgatcccgaacttccaaaaacatcttcctttgccgcatctggccctctgatcccggaggaaaacaaggagagagtgcaggagctgcccgactccggggcactgatgctggtgccgaaccgccagcttacagccgattactttgaaaagacttggctctctctgaaggtggcacaccagcaagtactgccatggcgcggtgagttccacccagatactctgcaaatggccttgcaagtggtcaacatccaaactatcgctatgtccagggccggatcacgtccatggaaggcctacctcagtgcccaggacgacactgggtgtctgttcctcactgagctcctgctcgagcctgggaactctgagatgcagatctctgtcaagcaaaacgaggcaaggaccgaaacactgaattctttcattagcgttctggagaccgttatcggaacaatcgaggaaatcaaatcatag

SEQ ID NO: 213547 - DNA, 789 bp, Artificial Sequence
  Description of Artificial Sequence: Synthetic coding sequence
atgccttatctgggctcagaggatgtggtcaaagaactcaaaaaggctctgtgtaatccccatatccaggccgaccgccttcgctaccgcaacgtgatacagcgcgtgatcagatacatgacgcagggcctcgacatgagtggagtatttatggaaatggtaaaggcaagcgcgaccgttgatatcgtccagaaaaagctggtctatctgtacatgtgtacgtatgcccctctgaaaccggacctggctctcctcgccatcaacactctgtgcaaagattgtagtgatcccaacccaatggtcaggggcctcgcactgcggagtatgtgttcacttcggatgcctggggtacaggagtacatacagcagcccattctgaatggtttgagggacaaagcatcctatgtgcgcagggtcgctgtactcggctgcgcaaagatgcacaacctgcatggtgacagtgaggtcgatggcgctctggttaatgaactttatagcttactcagagaccaggacccaatcgtggttgtgaattgtctacgcagtcttgaagaaatactcaagcaggagggtggtgtggtgattaacaagcctatagcacaccatcttttgaacaggatgtccaagctcgaccagtgggggcaagccgaggtgttaaacttcttgctgcgataccagcctaggtccgaagaggaactttttgacattctgaatttgctcgactcctttttgaagagcagctctcctggggtggtaatgggcgctacaaagctatttttgatactttag

SEQ ID NO: 213548 - DNA, 528 bp, Artificial Sequence
  Description of Artificial Sequence: Synthetic coding sequence
atgccttacctgggaagcgaagacgtcgtcaaagaactgaaaaaggctttgtgcaacccccatattcaggcggacagactccgctacagaaacgtgatccaacgggtcattcgtatgtcaaaactggatcagtggggccaggccgaggtgctcaattttctcctaagataccagcccaggagtgaagaggagctgttcgatatcttgaacctgctagactcctttctcaagtctagctcacctggtgttgtgatgggcgctactaaactctttctgattcttgcaaaaatgtttccacatgtccagaccgatgttctggtgcgcgtaaaagggccacttctcgcagcctgtagttcagaatccagggagctatgcttcgtggctctctgccacgtgaggcaaatactgcattcactcccgggtcacttcagttctcactacaagaaatttttttgcagttatagtgagcctcattacattaagcttcagaaggtggaagtcctgtgcgaactggtgaacgatgaatag

SEQ ID NO: 213549 - DNA, 3414 bp, Artificial Sequence
  Description of Artificial Sequence: Synthetic coding sequence
atgagtgatatagttgaaaagaccctcacggccctgccgggattattcctccagaatcagccgggaggagggccagccgctgctaaagcttcatttagctcccggctaggttcgctggttcgtggaatcacagccctgacatcaaaacatgaagaggagaagcttatacaacaggagttgtcttcactgaaggcaactgtcagtgcgcctaccacaacattgaaaatgatgaaagagtgtatggtccgcctcatatactgtgagatgctgggatatgatgcctcctttgggtacatccacgctatcaagttagcccagcagggaaacttattggaaaagagagtagggtacctggcagtttctctgttcctccacgaaagtcacgagcttctcctgctcttggtcaataccgtagtgaaagatctccagtctaccaacttggtagaggtgtgtatggcactcacggtggtctctcaaatatttccctgcgaaatgattccagcagtgctgccactgatagaagataagttgcagcactccaaagagatcgtgcgtagaaaggcagttcttgcactgtacaagttccacctgatcgctcctaaccaagtccagcatatccacattaaatttcgaaaagcactttgtgacagagacgtcggagtcatggcggcttccttgcacatatatttgagaatgattaaggagaattcaagtgggtacaaggacctaacaggttccttcgtgacgattctcaagcaggttgtcgggggaaagctacccgtggaatttaactatcatagtgtgcccgcaccatggctgcagattcagctgctacgcatcttgggcctgctgggcaaggatgatcagaggacatccgagctgatgtatgatgtgctggacgagtcccttcggagagctgagctgaatcacaacgtgacatatgccattctgtttgaatgcgtgcacaccgtctactcaatttatccaaaaagtgaactgcttgaaaaagctgcgaagtgtattggaaagtttgtcctttcacctaagattaatttaaagtacttggggctcaaagccctcacctatgtcattcagcaggacccgaccctcgctctgcagcaccagatgaccattatagagtgtctcgaccatccagacccaatcataaagagagaaaccctggaacttctttaccgcatcactaacgcacaaaatatcaccgtgatcgtccagaaaatgctggagtatctccatcaaagtaaagaggagtacgttatagtgaatctggtaggcaagatcgctgagctcgcagaaaagtacgcccctgacaatgcttggtttatccagaccatgaatgcggtgttttctgtggggggagacgtgatgcacccagacattcccaataactttctgcgattactcgccgaggggttcgacgatgaaactgaggatcagcagcttcgtttgtacgctgtgcagagctaccttacgttactggacatggagaacgttttttatcctcagagatttctgcaggttatgagctgggtgttgggggaatatagctacttgctggacaaggaaactcctgaagaagtgatcgcaaaactgtacaagctattaatgaatgattcggtgtctagtgaaacgaaagcgtggttgatagccgctgtcactaaactgacctcccaggcacattcttcaaatacagtggagagattaattcatgagttcaccatttcgctggatacttgcatgaggcagcacgccttcgagcttaaacatttgcacgaaaatgtggagctgatgaagagtcttctccccgtggatcggagctgtgaggaccttgttgttgatgcttcactctcatttttggacggcttcgtcgccgaaggactcagccagggcgcagccccatataagccgcctcaccagaggcaggaggaaaagctgagccaggagaaggttttgaactttgagccgtatggtctgtcattctccagctccggctttaccggccgacagtccccagccggaattagcctcggcagcgacgtctctggtaacagcgcggagactggcctcaaggagactaactccttgaagttagaaggcattaagaagctgtgggggaaagagggctatcttcccaagaaagaatccaaaaccggagatgagtccggagccctgcctgtgccacaggagagcatcatggagaacgtcgaccaagcaataaccaaaaaggaccagagtcaggtgctgacccaatcaaaggaagagaaggaaaagcagcttctggcctctagcctgttcgtggggctgggttctgagtctacgattaacttgttagggaaagcagacaccgtgtctcataaattccgcaggaaatctaaggtgaaagaggccaagtctggagagactacgtctactcacaatatgacttgttcaagcttctcatcactaagcaatgtggcctatgaggacgattactacagtaacactctgcacgatactggagataaggaactgaaaaaattcagcctgacaagtgagctactcgattcggaatctctcaccgagctccccctagtagaaaaatttagctattgtagcctgagcactccatctctcttcgcaaataataacatggaaatcttccatccccctcagagcaccgcagcaagtgtggcaaaggaatcttcactggcctcaagcttcctcgaagagaccacagagtatattcatagcaatgcaatggaagtgtgcaacaacgaaacaatcagcgtatctagctataagatttggaaagacgattgcctgttaatggtatggtcagtaaccaacaaatccggattagaattgaagtcggcagatctggaaattttcccagccgagaactttaaggtgacggagcagcctggctgctgtctcccagttatggaggccgaatccacgaagtccttccaatatagcgtgcaaatcgagaagccttttaccgagggcaatttgacgggttttatatcataccatatgatggacactcatagtgcacaactggagttttcggtgaacctgtccctgctggatttcatccggccactcaagatcagcagcgatgacttcggcaagctttggctctcgttcgccaatgatgtgaaacagaacgtgaagatgagcgagtctcaagcggctctgcccagcgcactgaaaacgctgcagcagaagctgcggctgcacataattgaaattattgggaacgagggcctgttggcttgtcagcttctgccatcaatcccctgtctattgcactgcagggtgcatgcagacgtgctggctttgtggttccgctcctcttgttcaacccttcccgactatctattataccaatgtcagaaagttatggagggcagctag

SEQ ID NO: 213550 - DNA, 1362 bp, Artificial Sequence
  Description of Artificial Sequence: Synthetic coding sequence
atgatttcacagttcttcatcctttcatccaagggagatcccctgatctacaaggacttccgaggcgacagtgggggaagagacgtagctgagctgttctaccgaaagctgaccggtttgcccggtgacgaatcaccggttgtgatgcatcaccatggcaggcactttatacatatacgccacagcggactgtacctggtcgtcacaactagcgagaatgtgtcgcccttctcacttctggaattactcagtcggctggctactctgttgggagactactgcgggagcttaggcgaaggtaccatctcaaggaatgtggccctggtatatgagcttctcgatgaagtcctggactacggatacgttcaaactacttccaccgagatgcttagaaactttattcaaaccgaagccgtggtctccaagcctttcagtctatttgacctgagcagcgtgggtttatttggagctgagactcagcaatctaaagtggcgccatcttcggccgcatcacggcctgtgctgtctagccggagcgaccagagccagaaaaacgaggtcttcctcgacgtggtcgagcgattgtccgtcctgattgcgtccaacggctcgctcctgaaagtggacgtgcaaggggaaattcggctgaagagtttcctgccatccgggagcgagatgcggatcggcctgaccgaggagttttgcgttggaaagtccgagctcagaggatatggacctggaatacgagttgatgaagtgagtttccatagttccgtgaatctagacgaattcgagtcccacagaatcctccggcttcagcctccccagggggagctgacagtgatgcgatatcagctctcagacgatcttccgtcccccttaccttttagactttttccttctgtgcagtgggaccggggttctgggaggctccaggtatacctcaaactgagatgcgaccttctttctaaatcacaggcgctcaacgtcaggttacacctcccccttccaaggggcgtcgtatccctttcacaggagttgtcctcccccgagcaaaaggccgaactagctgaaggggcactgcgatgggacctcccacgcgtgcaagggggaagccagctgagcgggctgtttcagatggatgtccccggaccacccggacccccttctcatgggctgagcacaagcgcttctccactgggtctgggaccagcatcactgtcgttcgagctgccacgccacacatgctccggtctacaggtgcgattcctgcggctggcattccgcccttgtggcaacgccaatccacacaaatgggttcgccacctgtctcattccgacgcatacgtcatacgcatctag

SEQ ID NO: 213551 - DNA, 1362 bp, Artificial Sequence
  Description of Artificial Sequence: Synthetic coding sequence
atgatcagccagtttttcattctgagttctaagggagatcccttaatttacaaggactttcgcggagactctgggggaagagatgtggccgagttgttctaccgcaaattgacagggttgccgggtgacgaaagcccagttgttatgcatcatcatgggaggcatttcattcacatcagacactctggactttacctggtggtcaccacaagcgagaacgtgtcaccattttcattgctggagctgttaagtagactcgcgacgctgcttggggactattgtggttctttgggggaaggaacgataagtcgaaatgtcgcacttgtctatgagctgctagatgaggtcctagattatgggtacgttcagacaactagcacggagatgcttagaaactttattcagaccgaggcggttgtctccaaacccttttctctgtttgatctctcaagtgtcggcttatttggagctgaaacccagcaatctaaggttgccccatcaagcgccgcaagcagacctgtgttatccagtaggtccgatcagagccaaaagaacgaagtcttcctggacgtcgtggaacggctttcagtgctgatcgcatctaatggcagcctgctcaaggtggatgtgcagggtgaaattagactgaaatcattcttgcccagcggctcagaaatgagaatcggtctcactgaagaattttgcgtgggcaagagcgaattaaggggttatggccctgggatccgggtggatgaggtgtctttccatagttccgtgaacctcgacgagttcgaatctcatcgaatcttgaggctccagccccctcagggggagctgaccgtcatgcgctatcaactgtccgatgacctgccatctcccctgcccttcagattgtttcccagtgtgcaatgggacaggggatcaggaaggctgcaggtgtacctgaaattgagatgtgacctgctgagtaagagtcaggccctgaacgtgcgtctgcacctacctctgcctcgaggcgtggtgagcctgtcccaggagctgtcctcacctgagcagaaggccgagttagctgagggggctttgagatgggatttacctcgtgtgcaaggcggtagtcagctcagcggtctgtttcaaatggatgtcccaggacctcctggcccaccatcgcacggtctgtctaccagtgcttctcccctgggactgggtcccgcatctttgagcttcgagctccccagacacacatgttccggtttgcaggtaaggttccttaggctcgcctttcggccttgcggtaatgccaatcctcataagtgggtgaggcacttgagccattccgacgcctatgtcatccgcatctag

SEQ ID NO: 213552 - DNA, 1653 bp, Artificial Sequence
  Description of Artificial Sequence: Synthetic coding sequence
atgtccgccgcttggatccctgcacttggcctgggagtttgtctgctactgttgcctgggccagccggtagcgagggtgcggcacctattgcgattacctgttttaccaggggcttggatattaggaaggaaaaggctgacgtgctgtgtcccggtggttgtccacttgaggaattttcggtgtacggaaatattgtgtatgcctctgtgtcatccatatgtggtgccgctgtgcatcgaggggtgataagcaacagtgggggacccgtccgggtgtatagcctgcctggccgtgagaactacagctctgtagacgcgaatggaatccaaagtcagatgctcagtcgttggagcgcaagcttcacagtcaccaaaggcaagtctagtactcaagaagctaccggccaagccgtctcaaccgcccatcctccgaccggaaagcgactgaagaagacccctgagaaaaagaccgggaataaggattgtaaagcggacatcgcttttctcatagatggctctttcaacatcggccagcgacgttttaacctgcaaaagaatttcgtcggaaaggtggccttaatgctggggatcggcaccgaaggccctcatgtgggcctggtccaggccagcgagcaccctaagatagaattctatctcaaaaactttacgtcagcgaaggatgttctctttgccataaaagaggtgggtttccgtgggggaaactccaacacaggcaaagctctgaagcacactgcccagaagttctttactgtggatgccggagtgcgtaagggaatccccaaggttgttgtcgtgtttattgatgggtggcccagtgatgacatcgaggaagctgggatagtggcccgagaattcggggtgaatgtattcattgtgtccgtcgccaaaccgataccagaggaactgggaatggttcaggatgttacattcgtggacaaagccgtgtgcagaaataatggcttcttctcttatcacatgccaaattggttcggaacaacaaagtacgtgaagcccctggtgcagaaactgtgtacccatgaacagatgatgtgttcaaagacgtgctataacagcgtgaacatcgctttcttaattgatggctctagcagtgtgggcgactccaactttagactgatgctcgaatttgtatcaaacattgcaaaaaccttcgagatttctgacatcggcgctaagatcgccgcagtgcagtttacttatgaccagagaaccgagtttagttttaccgattattcaaccaaagaaaatgtcctcgccgtgatcaggaacatcaggtacatgagtggcggaaccgcaacgggggacgccatttcatttaccgttcggaatgtttttgggccaatccgggaaagcccaaacaagaatttcctagtgattgtgacagacggacaatcgtacgacgatgttcaaggacccgctgcagcagctcatgacgccggtatcacaatcttctcagtaggcgtagcttgggcgcctcttgatgacttaaaagatatggctagcaagccaaaagaaagtcacgcctttttcacgagagagtttaccggcctggagcctattgtttcggatgtgattcgcggtatatgtcgtgattttttggaatcccagcagtag

SEQ ID NO: 213553 - DNA, 435 bp, Artificial Sequence
  Description of Artificial Sequence: Synthetic coding sequence
atgattaagttcttcctaatggtcaataagcagggacagaccaggttgtctaaatactacgaacacgttgatatcaacaagagaaccttgctggaaaccgaagtcattaagtcttgtctttcacgctcaaacgagcagtgcagctttatcgagtacaaagattttaaactgatataccgacagtatgctgccctgttcatcgtggtcggcgtgaatgacacagagaacgagatggccatttacgaattcatacacaactttgtggaggttcttgatgagtacttttcccgggttgtaaagggccacatcatgtttaacttggacaaagtgcatatcatcctggatgagatggttctgaacggatgcattgtggagactaatagggcccgtatactggctcctctgctcatattagacaagatgagtgagagctag

SEQ ID NO: 213554 - DNA, 435 bp, Artificial Sequence
  Description of Artificial Sequence: Synthetic coding sequence
atgataaaatttttcctgatggttaataaacagggtcagaccaggcttagtaaatattacgaacacgtggacattaataagcggaccctgctggaaactgaggtgattaagtcgtgcctatctcgaagtaacgagcaatgctccttcatcgagtataaagatttcaagctcatttaccggcagtatgccgctctttttattgtcgttggcgtgaatgacacagaaaacgagatggccatctacgaattcattcataatttcgtggaagttcttgacgagtattttagccgggtgagtgagctggacattatgttcaacttggataaagtgcatatcattttggacgaaatggtgctcaatgggtgtatcgtcgagaccaaccgagcaaggatcttggctcccctgcttatcttagacaagatgagcgagtcttag

SEQ ID NO: 213555 - DNA, 27 bp, Artificial Sequence
  Description of Artificial Sequence: Synthetic coding sequence
atgattaagttttttttaatggtgtag

SEQ ID NO: 213556 - DNA, 297 bp, Artificial Sequence
  Description of Artificial Sequence: Synthetic coding sequence
atgatcaagttcttcctgatggtcaacaagcagggacaaacgcggttaagcaaatattacgagcacgttgatataaacaaaagaacattgctggagaccgaagtcatcaagtcttgtctgtcccggagcaacgaacagtgctcgttcattgagtataaagacttcaaattaatttatcgccagtacgccgctctgtttattgtcgttggagtgaatgatactgaaaatgagatggccatctatgagttcattcacaattttgtggaggtattagatgagtatttcagccgggtgtag

SEQ ID NO: 213557 - DNA, 402 bp, Artificial Sequence
  Description of Artificial Sequence: Synthetic coding sequence
atgatcaaatttttcctgatggtcaacaaacagggacaaaccaggctgagcaagtattacgagcatgtggacattaacaagcgaactctgctggagactgaggtgatcaaatcctgcctgagtcgatctaacgagcagtgctcattcatcgagtataaagatttcaagctcatttatcggcagtatgccgcactgttcattgttgtgggggtgaacgataccgaaaatgaaatggccatctacgagtttatccacaacttcgtagaggtgctcgatgaatacttctctcgagtcagcgaactcgacattatgttcaatctggataaagtgcacattattttagatgagatggtgttgaacgggtgtattgtcgaaaccaaccgcgcacgcattcttgcatag

SEQ ID NO: 213558 - DNA, 4611 bp, Artificial Sequence
  Description of Artificial Sequence: Synthetic coding sequence
atgggtgtggtgaacttcgtgtttcgagcctccgaggacttgcaggtactcgagaactacagtgatgcgccaatgaccccaaagcagattctccaggtcatcgaagccgaaggtctcaaagagatgtccggaacctctcccctcgcctgcctgaacgctatgctccacagcaactcgaggggcggagaaggcctgttctacaagctgccgggacgtatttccctgtttacgctaaagaaagatgcactacaatggtcccggcaccctgcaactgtggagggcgaggagcctgaggataccgctgatgtcgagagctgtggatccaacgaagctagtaccgtaagtggcgagaacgacgtgtccctagatgagacttcctccaacgccagttgcagtacagagagtcaatctagacctttgtctaacccccgtgatagttaccgcgcaagcagtcaggctaacaagcagaagaagaagaccggtgtgatgttgcctcgtgtggtgcttactcccctgaaggtgaacggcgcacatgtggaatcagcctcggggttttcgggctgccatgccgatggagagtcaggatcacctagcagctcaagctccgggagtcttgcactggggagcgcagccatcagagggcaggcagaagtaacgcaggatccggctcctctgctgcgtggatttcgcaaacccgcaacaggccagatgaagcggaatcgtggcgaagagattgatttcgaaacacctggctccatcctggtgaacaccaatttgcgtgctctcattaattctaggacctttcacgctttgccctcgcactttcagcagcagctgctgtttctgctgcccgaggtagaccggcaggtggggacggacgggttgctgaggcttagctcaagtgctttgaataacgagttctttacacacgctgcacaatcctggagggaacgcctcgccgacggtgaatttacacatgagatgcaagttagaattaggcaagaaatggagaaggagaagaaggtagaacagtggaaagaaaagttctttgaggactactatggccagaaactgggactgacaaaggaggaatccctgcagcagaacgttggacaggaagaggcggaaattaaaagcgggttgtgtgtgcccggagagtccgtgcgcattcagcgtggccctgcaacacgccaacgcgacggacatttcaaaaagagatctagaccggatcttagaacccgggctagaaggaatctctataagaaacaggagtctgaacaagcgggagttgctaaggatgccaagtccgtggcatctgacgtcccgctatataaagacggcgaggccaaaactgatcctgcaggcctcagctcccctcacctaccgggtacatcctcggccgctccagacttggagggcccagaatttccagtagagtccgtcgcctctcgaattcaggctgagcctgacaacctcgccagagcttctgccagtcccgatcgaattccctcattaccccaggaaacagtcgatcaggagcccaaggaccagaagagaaaaagttttgaacaagcggcatcagcgtcttttcccgagaaaaagccacgtctggaagaccggcaatccttccgcaataccattgagtcagtacacaccgagaagccgcagcctaccaaagaggagccaaaggtgccacccatccgtattcagcttagccgcataaaacctccctgggtagtaaaaggacagccaacctaccaaatatgcccgcgaatcattccaactacagagtcctcctgtcgtggatggacgggagccaggactttagcggacatcaaggcaagggccctacaggtgagaggcgcacgcggacaccattgtcacagagaggccgcaacaacggctattggcggtggtggagggccaggcggaggtgggggaggggcaacagacgagggaggcggaagaggttcgagcagcggggacgggggagaggcttgcgggcacccggaacccagaggcggtccaagcacccctgggaaatgcactagcgaccttcagcgcacacagctcttgcccccttaccctcttaacggggagcatacccaggccggaaccgctatgagccgagctaggcgcgaagatctaccatcactgcggaaagaggagtcgtgtctgttacagcgagccaccgtcggtctcactgatggcctgggagacgcctcccaactgccagtcgcgcctactggggaccagccctgccaggccttgccactgctatcctctcaaactagtgtggcagagcggctcgtggagcagccacagctacacccagacgtgcggacagagtgcgaaagtgggacaacatcttgggaatcggatgacgaagagcagggcccaacagtgcctgccgacaatgggccaatcctgagcctggttggagatgacacacttgaaaaagggacgggtcaagctctcgatagtcatcccactatgaaggatcctgtcaacgtgactccatcctcgacccccgagtcatccccaacagattgtctccagaacagggcctttgacgacgagttggggctcggcggaagctgcccacccatgcgcgagtcagacacgcggcaggagaatctgaagacaaaggccctggtgtccaactccagcctgcattggatcccaatccctagcaatgacgaggtggtgaagcagcctaagcccgagtctcgagaacacatcccctcagtcgaaccacaggtgggggaggagtgggagaaagcggctccaactccccctgccttgcccggagatctgactgccgaagagggccttgacccgttggatagcttgacctccctgtggacagtgcctagccgcggtggctccgactccaacggctcatattgccagcaggttgatatcgaaaaactcaaaatcaatggtgattctgaggccctctctcctcatggcgagtcgaccgacaccgcctcagactttgaagggcacctgaccgaggactcctcagaggcagatactcgcgaggctgccgtaacaaagggatctagcgtcgataaggatgagaagcctaactggaaccaatccgcaccattgagtaaggttaacggcgatatgagactcgttacacgcacagatggtatggtcgccccacaatcttgggtgtccagggtttgtgccgtgaggcagaaaattcctgattccttgttactggcctcgactgagtatcagcccagagctgtgtgcctctcaatgccaggatcatccgtggaagctacaaacccattagtgatgcagttgctgcagggaagccttcccctcgagaaggtcctaccaccggcacacgatgacagcatgagtgaatctccgcaggtccccttaacgaaagatcaaagtcacggttccctgcggatgggctcgctccacggactggggaagaattctggcatggtagatggatccagcccatcttcactgcgcgctctgaaggagcccctactacccgattcttgtgaaacgggcactgggctggctcggatagaggctacacaggccccaggagctcctcagaaaaattgcaaggcagtacccagcttcgattctttacaccctgttaccaatcccatcacctcttcgcggaagctggaagaaatggattcaaaggaacaattttctagtttctcttgtgaagaccagaaagaagtgagagccatgtctcaggactcaaactccaatgctgcccctggaaagagcccgggagacttgaccacatccaggactcctcgctttagttccccaaatgttatctcctttggacccgaacagacaggacgcgctctgggggatcagagcaatgtcaccggccaggggaaaaagctatttggctcgggtaacgtcgctgcaaccctccagaggccacgaccagcggacccaatgcctctgcctgccgagattcctccagtcttccccagcggcaaactggggcctagcaccaattctatgtcgggaggcgtgcaaacccccagggaagattgggcgcctaagcctcatgctttcgtgggcagtgtcaagaatgagaaaacattcgttggtggccctctcaaggctaatgcagagaaccgcaaggctacagggcattctccactggaactcgtgggtcatctggaaggtatgccattcgtaatggatttgcccttttggaagcttcccagagaaccaggcaaggggttgtcagagccccttgagccttcaagcctcccttcgcagttatctattaagcaggccttctacggcaagctgtcaaagctgcagctctccagtacatctttcaactacagctcctcttccccgacattccccaaggggttagccggatctgttgtgcaattatcccacaaggcaaactttggcgcttcccacagcgcctccctttctttacagatgtttacggattcctctactgttgaaagcatctctctgcagtgcgcatgctcattaaaagcaatgatcatgtgccaggggtgcggcgcattttgtcacgatgactgtatcggcccatctaagttgtgcgtcctgtgtctggtggtgagatag

SEQ ID NO: 213559 - DNA, 4626 bp, Artificial Sequence
  Description of Artificial Sequence: Synthetic coding sequence
atgaaagacaagcagaagaagaagaaggaaaggacgtgggcagaggctgcccgactggtgctggagaactacagtgatgcacctatgacgcccaaacagatactccaggtgatagaagcagaggggttaaaggaaatgaggtccgggacgagccccctggcttgcctgaatgctatgctgcattctaacagccgaggcggagaagggctcttttataaacttccaggcaggataagtctctttactctgaaaaaagacgctctgcagtggtcaaggcaccctgctactgtggagggtgaggagcctgaagacactgctgatgtggagagctgcgggagcaatgaagcctctacagtctctggtgagaacgacgtgagcctcgatgagacgtcctcgaacgctagctgtagcactgagagccaaagtaggcctttgagcaaccctcgcgactcgtaccgagccagctcccaggcaaacaaacagaagaaaaagaccggagtcatgcttccccgtgtcgttctcacgccccttaaagtcaatggcgctcacgtggaatcagccagcggattctccggctgccacgcggacggtgaaagcgggtccccttcctcttcctcttcagggtccctggcactgggatcagctgccattaggggtcaagcagaggtcactcaggatcctgccccattgctgcggggtttcagaaaaccagcaacggggcagatgaagagaaataggggggaggaaatagactttgaaactcccggaagcatcctcgttaatactaatctgcgggcattaatcaattcccggaccttccacgccctacccagccacttccaacagcagttgctgtttctcctccccgaagtagaccgacaagtgggcactgatggcttgctccgcctgtcctctagcgcactaaacaacgagttcttcacacacgctgctcagtcttggagagaacgcctggctgacggggagttcactcacgaaatgcaggtacggattagacaagaaatggagaaggagaagaaggtcgagcagtggaaagagaagttcttcgaagactactacggacagaagttgggcttgactaaagaagagagcttgcagcagaatgtgggacaggaggaagcggagatcaagagtggtctgtgtgtgccaggggagtccgtacgtattcagaggggccctgctacccggcagagagatggccattttaagaaacggtcgcggccagacctgagaaccagagctaggaggaatctgtacaagaagcaagagagtgaacaggccggagtagctaaggacgcgaagagtgtggccagcgacgtcccgttgtacaaagacggcgaagccaaaacagaccctgctggtctcagtagccctcatttgccaggaaccagctctgcagctcccgatttagaaggcccagaatttcccgtagagtcggtggcaagccggatccaagccgaaccagacaatctggctcgggcttccgccagcccggatcggattcccagtctgccacaagagacagtggatcaggagcccaaagaccagaagcggaagagctttgaacaggcagcttctgctagctttcctgagaaaaaaccacgactcgaagatcggcaatcctttaggaatactatcgagagcgtccacacagaaaaacctcagccaactaaggaggagccaaaggtgccccctataaggatacagttatctcggataaagcccccatgggtcgtgaaaggtcagcccacctaccaaatttgcccccgaatcatccctacaaccgagtcatcttgcaggggatggaccggtgcacggacattggcagacattaaggcgagagctctccaagtcagaggtgctaggggtcaccattgtcatcgggaggccgctaccactgccataggcggagggggtggtcccggagggggtggcggaggagccactgacgaaggtgggggaagggggtctagtagcggcgatgggggagaagcatgtggccaccccgagccccgagggggaccgtctacccccggaaaatgcactagcgacctgcagcgcactcagctgctaccaccttatcccctaaatggggaacatacgcaggctggaaccgcgatgagccgggcacgcagagaagacctcccaagcctccgcaaggaggagtcctgcctactgcagcgcgctacggtaggcctgactgatggactgggtgatgctagccaactccctgtagcccctacgggtgatcagccttgtcaagccttgccactgctgtccagtcagacatcagtggccgagaggctcgttgagcagcctcagctccatcccgacgtgcggacagagtgtgaatctgggaccacttcctgggagtccgacgacgaggaacaagggcctaccgtgcctgctgataacggacccatcctctcattggtaggcgacgatacccttgagaagggtactggccaggcactcgattcacaccctacgatgaaggatcccgtgaacgtgaccccatcttccacccctgagagcagccctactgactgtctgcagaatcgtgcctttgatgacgaattagggctgggcggatcatgtccacccatgagagagtctgacacacggcaggaaaatcttaagaccaaggctctggtgagtaattctagtcttcactggatcccaatcccatcaaacgacgaagttgtaaagcagcccaaaccagagagcagagaacatatcccaagcgtggagccgcaggtgggggaagagtgggaaaaagctgcacctaccccacccgcattaccgggagatttgaccgctgaagaagggctcgaccctctcgacagcctcactagtctgtggactgtgcccagccgtggcggaagcgactctaacggttcgtattgccagcaagtggacatcgagaagctgaaaatcaatggggatagtgaggccctgtccccacacggagagtccacagacacggccagtgatttcgaaggccacctgaccgaggattcgtccgaggctgatacacgcgaagctgcggtgacgaagggatcttccgtggataaggacgaaaaacctaattggaaccagagcgcacccctctcgaaggtaaacggagacatgcggctcgtgactcgaactgatggtatggtagcccctcagagctgggtgtccagggtgtgcgctgtgcgccagaagatccctgactcattattactggcttctacagagtatcagccacgcgctgtttgtctttccatgcccggttctagcgtggaggcgacaaaccctttggtcatgcagctactacagggcagccttcccttggagaaagtcttaccgcctgcacacgacgatagcatgtccgaatcccctcaggttcccctgacaaaagaccagtcgcatggttcactgcgcatgggatcacttcatgggctgggaaaaaacagcgggatggtggacgggtcgtcccctagtagcctccgcgctctaaaagagcccttgttacctgatagttgcgagacaggcacgggtctcgctcgcatcgaagctacacaagccccaggtgcacctcagaaaaattgtaaagcagtcccctcatttgactcactgcaccccgtcacaaacccaattacttcttccagaaagctcgaggaaatggattcaaaagaacagttctcttcctttagttgcgaggaccaaaaggaagtgcgggcaatgtcacaggacagtaacagcaacgctgctcccggtaagagcccgggtgatctgaccacatcacgaacgcccagattcagctctcccaatgtgatctcattcggcccagaacagactgggagagcccttggcgatcagtctaatgtgacggggcagggcaaaaagctattcggttccggcaacgtagcagctacacttcaacgcccacggccagctgacccaatgcctctgccggctgagattccccctgtattcccttctggcaaattggggccttcgaccaattccatgagtggcggagtccagaccccgagagaggactgggccccaaagccccacgctttcgtgggctccgtgaagaacgagaagactttcgtgggcggtcccctgaaggccaatgccgagaatcggaaagccaccggccattccccactggagctcgtcgggcacctggaagggatgcccttcgtaatggacctcccattctggaagctgccaagggagcctggcaaaggcctttctgagccactggagccttcaagccttcccagccaactgtccatcaagcaggcgttttacgggaaactttctaagttgcaactgagtagtacgagcttcaactactctagttcttcacctacttttccaaaaggcctggcaggctccgtggtgcaactgagccataaagcaaattttggggcaagccacagcgcttccttgtctctgcaaatgttcacagacagctccacagtggagtcaatctccctgcaatgtgcatgttctctgaaggcaatgatcatgtgtcagggctgcggggctttctgccacgacgactgcatagggccttccaagctctgcgtgttatgcttggtggtgaggtag

SEQ ID NO: 213560 - DNA, 4626 bp, Artificial Sequence
  Description of Artificial Sequence: Synthetic coding sequence
atgaaggacaagcagaaaaaaaaaaaagagcgcacttgggctgaggctgccaggctagtgctggagaattattcagacgctcctatgactcctaaacagattctccaggtcatagaagctgaagggttgaaagagatgcgcagcggcacgagcccattagcatgcctaaacgcaatgttgcatagcaactcaagagggggtgaggggctcttttacaaactacccggaagaatcagcctgttcacattgaaaaaggatgccctccagtggagtcgacaccccgcaaccgtagagggcgaggaacccgaggacacagctgatgtcgagagctgtggcagcaatgaggcctccacagtgagcggtgaaaacgacgtcagcctagacgaaacctcaagcaatgcttcatgctcgaccgaatcacagtcgcgcccactatccaatcccagagatagctacagagcctcaagccaggctaacaagcagaagaagaagacaggggtcatgctaccacgcgtggtgctcaccccccttaaggtgaacggagcccatgtcgagtccgcaagcgggttttctgggtgtcatgccgacggggagtctgggagcccatcgagcagctccagtggctctttggctctggggtctgccgcaattagaggacaagcagaggtcacacaggacccggcaccattgcttagaggtttccgcaagccagcgaccggccagatgaagaggaaccgaggggaagagatcgacttcgaaactcctggctcaattcttgtaaatacaaatctccgtgccctaatcaacagccgcacctttcatgctctgcccagccactttcagcaacagttgctcttcctcctgccagaggtggatcgccaggtaggcaccgatggcctgctgcgtttaagctcatctgccctcaataacgagttttttactcacgcggctcagagttggagggagaggttagcagatggagagttcacccatgaaatgcaggtgaggattagacaggagatggagaaagaaaagaaggtggaacagtggaaggagaagttctttgaggattattatgggcagaagcttggcctgacgaaggaggaatccctgcagcagaatgtgggacaggaagaagcagagatcaaaagcggactgtgtgttccaggtgaaagcgtgcggatccagagagggcctgctacccgacagagggacggccacttcaagaagaggtcaagacctgacttgcgaacacgcgctcggaggaatctgtataaaaagcaggagagtgagcaggccggagtagcaaaggatgcaaagtccgtcgcctcagacgtgcctttatacaaggatggagaagcaaaaactgatccagcaggactgtcctcccctcatctgccaggtacatcctccgcagcccctgatcttgagggccctgagttcccagtggaatctgtagcctcacgaatccaagctgagccagacaacctcgctcgagcctcagcgtcaccagaccgcattccaagcctcccacaggaaacagtcgatcaggagcccaaagaccaaaagaggaagagctttgaacaggccgctagcgcctctttccccgaaaagaaacctcgcctggaggacaggcaaagcttccgaaacaccatagaatctgttcacaccgaaaaaccccagcccacaaaagaagagcctaaggtgcctccaattcggatccagctgtcacgaatcaaaccaccatgggtggttaaggggcaacccacataccagatctgcccacgaatcataccaacgaccgagtcttcgtgcaggggctggactggcgcacgcacactcgccgatattaaagcccgagcgctacaggttcgtggtgccagagggcatcactgccacagggaggctgcaacaacggcaatcggtgggggtggcggtccaggcggaggcggaggcggtgcaaccgacgaggggggaggcaggggatccagctccggtgatggcggagaagcttgtggccatcctgaacctaggggcggacccagcacccctggcaagtgtactagcgatctccagcgcactcagcttctgcctccctacccgctgaacggagagcacacccaggcaggcactgccatgtccagggcacggagagaggatcttccaagcctccgaaaagaagaaagctgcctgcttcagcgcgcaacagtggggctcaccgacggcctcggtgatgcatcgcaactgcccgtggccccaacgggcgaccagccttgtcaggcactgcctcttctgtcttctcagacctcggtcgccgaacgccttgtagagcagccccagctgcaccctgatgtgagaacagagtgtgaaagtggcacgacttcatgggagtcagatgatgaggaacaggggccaaccgttccagccgacaacggtccaatcttatctctggttggagacgacacattggaaaaggggacaggacaggcccttgactctcatcccactatgaaggatcccgtcaatgtcactccatctagcactcccgaaagctctcctaccgactgcctgcagaaccgtgcttttgatgacgaactgggactcggaggtagctgccctcctatgcgggaaagcgacacccggcaggaaaacctgaagactaaagctctcgtgtcaaacagttcactgcactggattccaattccatctaacgatgaggtggtgaagcagcctaagcccgagagcagggaacatattccatcggtggaaccacaggtcggcgaagagtgggaaaaggctgcccctacgccaccggcattaccaggcgacctcaccgccgaggaggggcttgacccactggactcactgactagtctgtggacagtgcctagccgcggtggctctgatagtaacggctcttattgccagcaggtggacatagagaaattgaaaatcaacggggatagcgaagcgttgagcccccatggcgaaagtacagataccgcttcagattttgaggggcaccttaccgaagactcctcggaggccgatacacgggaggccgcagttaccaaaggcagctcagtggacaaggacgagaaacctaactggaaccaatcggctcccctttctaaggtgaacggcgatatgaggctggtcacacgtactgatggaatggtcgcaccccagagctgggttagcagagtttgcgccgtcagacagaagatacccgattctcttctcctcgcatccacagaatatcagcccagggctgtgtgtctgtccatgcccggtagctcagttgaggccactaatccattggttatgcagctcctgcaagggtctcttcctctcgagaaagtgctgccccctgcccatgatgatagtatgtcagagagcccgcaggttccactcacaaaggatcaaagccacggatccctgcggatgggctctcttcacggcctcgggaagaactccggaatggtagacgggtctagcccgtcctccttacgggcactaaaggagcccctgctgcccgatagctgcgaaactggcacagggttggcccgtatcgaggccactcaagctcccggagcgcctcaaaaaaactgcaaggcagtgccctctttcgatagccttcatcccgttaccaatcccattacatcctccagaaaacttgaagagatggactccaaggagcagttcagttcattctcctgtgaagatcagaaggaggttagggccatgtctcaggactccaattctaatgccgctccagggaagtcacctggagacttaacaacatctcggacccctaggttctcatctcccaacgtgatcagttttggcccagaacagacggggagagcactgggagatcagtctaacgtgaccggtcagggcaaaaagctgtttgggtccggaaacgttgctgcaacactgcagcgccctcgccctgccgatccaatgcccctacccgctgagatcccaccagtgtttccaagcggcaagctgggcccttccacgaattccatgagcggcggtgtacagaccccaagggaggattgggcgccaaagccccacgcctttgtgggttccgtgaagaacgagaaaacatttgtgggcggtcccctgaaagcgaacgcggagaataggaaggcaacggggcatagcccactggaactagtgggccacctggaggggatgccgttcgtgatggaccttcccttctggaagctcccacgcgagccaggaaaggggctatcagagccactcgagcccagttcgcttccttcacagctgtccattaaacaggctttttatgggaagttgagtaaattacagctctcttcaacaagtttcaactatagctctagctctcctacatttcctaagggccttgctggttccgtggtgcagttgagccataaggctaacttcggagctagccacagcgcatccctgagtctccagatgttcaccgattcttctacagtcgagagcatcagtcttcaatgcgcgtgctctctcaaagctatgattatgtgccaagggtgtggcgctttttgccatgacgactgcatcggacccagcaagctgtgcgtgctatgtctcgtagtgagatag

SEQ ID NO: 213561 - DNA, 4389 bp, Artificial Sequence
  Description of Artificial Sequence: Synthetic coding sequence
atgctgtcttttccaaatctcaatcaggtgttagaaaattattcggatgcacccatgacacctaagcagatactgcaggtcatcgaggcagagggcctgaaggaaatgtcttctgggacttccccgctggcatgcctcaatgccatgttacactccaattctcgtggcggagagggacttttctacaagttacccggtagaatctccctgtttacgctcaagaaagacgccctgcaatggtcgcgacatcccgcaaccgtggagggagaagaaccagaagacaccgcagatgttgaaagttgcggttcaaatgaggcctctacagtcagtggcgagaatgatgtttccttggacgagaccagttccaacgcttcatgttccacagaatctcaatcccgccctctctcaaaccctcgggactcttaccgcgcaagttcgcaggctaacaaacaaaagaagaagaccggtgtgatgctgcccagagtcgtcctgacccccctgaaagtgaatggggctcacgtggagagcgctagtgggcagatgaaaaggaatcgtggagaggagatagacttcgagacccccggttctatccttgtcaatactaatctcagagcactaattaactccagaacatttcacgccctgccgtctcactttcaacagcagctgttgtttctcctgcctgaggtagaccgacaggtcgggactgacggcttactgcgattatcctctagcgcccttaataacgaattcttcacccacgcagcccagtcctggcgcgaaaggctggcggacggcgagttcactcacgaaatgcaggtccggattcgccaggagatggagaaggagaaaaaggttgaacaatggaaggagaagttctttgaggactactatggccagaaacttggcttgaccaaggaggaaagtctgcagcaaaacgtagggcaggaagaggcagaaatcaagtctggtctctgcgttccgggagagtccgtgcgaatccagcggggacccgcaactagacagcgtgacgggcatttcaagaagaggagccgaccagacctaaggaccagagctaggagaaacttgtataagaagcaggaatccgagcaggccggagtggcaaaggatgctaaaagcgtggccagcgacgtgccactgtacaaggatggagaggctaaaaccgatcctgccggacttagttctccccatcttcctggaacctcgtctgccgcacctgacctcgaaggtccggagttccccgtggagtctgtggcctcacggatccaagccgaacctgacaatctggcaagggctagtgcctctcctgatagaataccctcactaccccaggagactgtggaccaagagccaaaagaccaaaagcgcaagtccttcgagcaggcagcatctgcatcatttccagagaaaaaaccacgcctggaggacagacagagtttcagaaacacaatcgagtcggttcacactgaaaaaccccagcccacgaaggaagagcctaaggtcccacctatcagaatccagctttcccgtattaaaccaccctgggtggtgaaaggccagccaacctaccagatctgcccccgaatcatcccgactactgaaagctcatgccgcggatggactggcgctaggacactcgcagacataaaggcacgcgcacttcaggtgaggggcgctcgcggtcaccactgtcaccgtgaggcaacagatgaaggagggggacgcggaagctccagtggcgatggcggagaggcctgcggacaccctgagccacggggaggaccttccactccaggaaagtgtaccagtgatcttcagaggacccagctcctgccgccataccccctgaacggagaacatacacaggccggaacggccatgagcagggccagacgcgaagatctcccctcactccgtaaagaagagtcatgcttgttgcaaagagccaccgtggggctgactgacggattgggggacgctagtcagctgcctgtggctcccaccggggaccaaccatgtcaggcccttcctttgctcagctcacaaacttctgtcgccgagcgcctggtcgaacagccccagctacatccagacgtccgaaccgaatgcgagtctggtaccacatcctgggaatccgatgacgaggaacagggccctaccgtacccgctgataacggacccatcctaagcttagtcggagacgacacgctggagaagggtaccgggcaggcactggattctcaccctacaatgaaagatccagtgaacgtgacaccgtctagcacgccggagtcaagtcctaccgattgcttacagaatcgagcatttgatgatgaactcggactgggtggctcctgtcctccgatgcgggagtcagacactaggcaggagaatctcaagactaaagccctggtgtcgaactcttctctgcactggattccaatcccttccaacgacgaagtggtcaaacaacctaagcccgaaagccgcgaacatatcccctccgtggagccccaggtgggggaagaatgggaaaaggccgcacccacaccacctgctctccctggagaccttaccgcagaagagggactggatcccctggactcactgacttccctctggacagtcccctcaagggggggatccgatagcaacggtagctattgtcaacaggtagacattgagaagctgaaaatcaacggggactcggaagcactcagtccacatggggagtcaactgacaccgcctctgattttgaaggacacctgaccgaggactcctccgaagctgacacacgcgaagcagctgtaacgaaggggagctccgttgacaaggacgaaaagccaaactggaaccagagcgcacctctttcaaaggtaaacggggatatgcgcctggtgacccggaccgatggcatggtagcaccccagagctgggtctccagagtttgcgcagtgcgtcagaaaattcctgattccctgctattagcttccaccgaataccagccacgagccgtgtgtctgtccatgccaggatcttctgtagaagccacgaaccctttggttatgcagctcctgcagggaagtctcccactcgagaaggtgctgcctccggcacatgatgatagtatgagcgaatcccctcaggttccactgactaaggatcaatctcatggcagcctccgtatggggtctctgcatggcctgggaaagaactccggaatggtggatggaagcagtccctcatccctccgagcacttaaggaacccctgctacccgattcttgcgaaacaggaactggcctggctcggatcgaagctacacaggcaccaggagctccccagaagaattgcaaggccgttccgagctttgactctctccaccccgttaccaaccccattacatcttcgcgaaaattagaagagatggacagtaaagaacagttctcctcgttcagttgtgaagatcaaaaggaggtccgtgccatgagccaagattccaactcaaatgcggctccaggaaaatcaccgggtgatctgacaacaagtaggacgccccgattcagtagtcctaatgtgataagcttcgggccagagcagaccggcagagctctgggtgatcagtcgaacgttaccggtcagggcaaaaaactctttggcagcgggaatgtagcggctactctgcagcgtcccaggccggcagacccgatgccactgcccgctgagatccccccagttttcccctccgggaaactcggaccttctaccaatagcatgtccggcggtgtccagactccgagagaagactgggctcccaagcctcatgccttcgtcggtagcgtaaagaatgaaaaaacattcgtcgggggacctttgaaagcaaatgccgaaaacagaaaggcaactggtcatagcccccttgagctggttggacacctggagggcatgcctttcgttatggatctccccttctggaaattaccacgggagccaggaaaagggctaagtgaaccactggagccttcgtcgctgccgagccagctctcaatcaagcaggccttctacggcaaattgagcaagctgcagctatcaagtacctccttcaattactctagttcttcacccacttttcccaagggacttgccggaagtgttgtccagcttagccacaaagcaaacttcggagctagccactcagcttccctgtctctacagatgtttaccgacagttcaacagtggaatcaatcagtctccaatgcgcctgcagcctgaaagccatgatcatgtgtcaggggtgcggagccttctgccatgatgattgtatcggacctagcaagctgtgtgttctctgtctcgtggtgaggtag

SEQ ID NO: 213562 - DNA, 4626 bp, Artificial Sequence
  Description of Artificial Sequence: Synthetic coding sequence
atgaaggacaagcagaagaagaaaaaagagcgaacttgggccgaggctgcacgccttgttttggaaaattattctgacgctcccatgactcctaagcagatactccaggtgatcgaggccgagggactaaaagaaatgcggtccgggacttccccattggcgtgtctcaatgcaatgctgcatagcaattcccgcggaggcgaaggcctgttctataagttgcccggtcgcatttcactttttacgcttaagaaagacgctttacagtggagtagacacccagccactgtcgaaggcgaggagccagaagatactgccgacgtggagtcatgcggctcaaacgaagcctccacggtgtcaggcgagaatgacgtcagcttagatgagaccagtagcaatgcttcttgtagcaccgaatcacaatcccgcccactgtccaaccctagggacagctatagagcgagttcccaggccaacaagcaaaagaaaaagaccggcgtgatgcttccacgcgtcgtcttgacacccttgaaggtgaacggggctcacgtagaatctgcgagcgggttttccgggtgccatgctgacggcgaatctggctctccttcgtcgagctctagcgggtcactcgccttgggatcggctgccatcagaggacaggcagaggtgacgcaagatcccgcaccccttctccggggtttcaggaagccagcaacgggccaaatgaagaggaatcgaggagaagaaatcgatttcgaaacacctgggagtatccttgttaacacaaatcttagagcgctgattaattctcgtacattccacgccttacctagtcactttcagcagcagctgctgtttctcttaccagaagtggaccgtcaagtcgggaccgatggtctactcagactgtcaagttcggctctcaataacgaattctttacccacgccgcacaatcctggcgggaaaggctagcagacggagagttcactcacgagatgcaggtccggattagacaggaaatggagaaggaaaagaaggttgaacagtggaaggaaaagttttttgaagactattacgggcagaagctcggtctaactaaggaggagtcacttcagcagaatgttggccaggaagaggccgaaattaagtctggtctgtgtgtgccaggtgaaagcgttcgcatacagaggggccctgcaaccagacagcgcgacggacacttcaaaaagagatctcgcccagacctgcgaacaagggcaagacgtaacctttacaaaaagcaggagtccgagcaggccggtgtcgcaaaagatgctaagtctgttgcttcagatgtccccctgtataaagacggcgaggccaagaccgaccccgctggcctttctagcccccatttacccggtacctcaagcgctgccccagacctggagggaccagagttcccggtagagtctgtcgcttctcggatccaagccgaacccgacaatctggcccgtgcaagcgccagtccagaccggattccttcactgccgcaagagactgtcgaccaggagcccaaggaccaaaagcggaagagctttgaacaggcggcatcagcatcattccccgagaaaaaaccgaggcttgaggatagacagagctttcggaacactatagaatcggttcacactgagaagccacagccgactaaagaggaacccaaagtaccccctatccgcattcagctgagcaggatcaagcctccatgggtcgttaaagggcaaccgacgtaccaaatctgtccccgtataatcccaaccacagaatcttcctgccggggatggacgggagcaagaacacttgctgacatcaaggctcgcgctctgcaggttcgcggagctcggggtcaccactgccacagagaagcagcaaccaccgccattggtggtgggggtggacctggcggtggagggggaggcgcaaccgacgagggcggtggacggggatctagcagcggcgacggcggagaggcctgcgggcatcctgagcccaggggcggaccttcaacgccgggtaagtgtacgtccgacctgcagaggactcaacttcttcctccttatcctttgaacggcgaacacacgcaagcaggaaccgccatgtcccgagccaggagagaagatctcccaagcctacgcaaagaggaaagctgtctgctccaaagagctactgttggtctgacagatggtctgggcgacgcctcccagctgcccgtggcgccaaccggcgatcaaccatgtcaagctttgcccctactcagctctcaaacttccgtcgcggagcgattggtcgagcaacctcagctccaccccgatgtgcgtacggagtgtgagtctggcacgacatcctgggagtctgatgatgaggaacaagggccaaccgtgccagctgacaatggcccaattttgtctctggtcggcgatgataccctagaaaagggcaccggccaggcgctagacagccatcctacgatgaaggatcccgtcaacgtcacaccctccagcaccccagaaagctcaccaaccgactgtcttcagaatagggctttcgacgatgagttaggcctgggcggtagttgtccgcctatgcgggaaagcgatacaagacaagagaacttgaaaacgaaggccttagtgagtaactcctccttgcactggattcctatcccctctaacgacgaggtggtaaagcagcctaagccagaaagccgagaacacatcccatcggtggagccccaggtgggagaggagtgggaaaaagcggctccaacccctcccgctctgcctggggacctcaccgccgaggagggcctggaccctttggattcactcacaagcctgtggactgttccatcccgcggtgggagcgactcaaacggaagttactgccaacaagtggacatcgagaagttgaagattaacggagatagtgaggccctcagccctcacggcgaatccactgacaccgcttctgatttcgagggtcacctgacagaggactcgagcgaggcggacacacgggaagctgcagtgacaaaaggctcatcagttgataaagacgagaagccgaactggaatcagagcgcacctctgagcaaggttaacggcgacatgcgcctcgtgacccgcaccgacggtatggtagcccctcagagctgggtatctagggtgtgcgctgttaggcagaagattccagactccctcctcttggccagcaccgaataccaaccacgggctgtttgcctgtccatgccaggaagctcagtcgaagccaccaatcccctggtgatgcaacttctccagggtagcctccctctggaaaaagtgctcccacccgctcatgacgacagcatgtctgagtcaccacaggtcccactcaccaaagatcaatctcatgggtcgttgcggatgggtagcctgcatgggctcgggaagaacagtggcatggtggatggaagctcccccagtagtctgagagccctgaaggaacctttgttacctgattcatgcgagaccggaacaggactggctaggatcgaagcaacacaagcgccaggtgctcctcagaagaactgcaaggccgtgccatcttttgactccctgcacccggttaccaatcctattacgagctcaagaaagttggaagagatggacagcaaggaacagttcagttctttctcctgcgaggatcagaaagaggtgagagctatgtcgcaggatagtaatagcaacgccgctccaggtaaatcccccggtgatctgaccacgtcacggactccaagattttcgtcacctaatgtgatcagttttggcccagagcagaccggacgagccctcggtgatcaaagcaatgttacagggcaaggtaagaaacttttcggaagcggtaacgtggccgctactctccagaggccaaggcccgctgaccccatgccgctgcccgcagagattcctcccgtgttcccgtccgggaaactcggcccttccacaaattccatgagtggaggagtacagacccccagggaggactgggcccctaagccccacgcctttgtggggtcagtcaaaaatgagaaaacctttgtcggagggccactcaaagccaatgccgaaaaccggaaggctactggacactcaccgctcgaactggtgggccacttggaaggtatgccctttgtgatggacctgccgttctggaaactacctcgggaaccaggtaagggtctctctgaacctctggagccctcctcattgccgtctcagctaagcattaaacaggcattttacggcaaactcagtaaattgcagctgtccagcacctcctttaactattcctcatcctcacccacatttcctaaaggtttggcaggcagtgtcgttcagttatcccacaaggccaacttcggtgcctcacatagtgcaagtctgagcctacagatgtttacggacagcagtactgtggagagcatcagcctccagtgcgcttgttccctcaaagcgatgattatgtgccaggggtgcggcgctttctgccacgacgactgtatcggaccctcgaaactgtgtgttctgtgtctcgttgtgcgttag

SEQ ID NO: 213563 - DNA, 225 bp, Artificial Sequence
  Description of Artificial Sequence: Synthetic coding sequence
tgatgggcagaagcagccagacttgtgcttgagaattattctgatgctccgatgacacctaagcagattttacaggtcattgaagcggaaggattgaaggagatgcgttccgggacgagtcccctagcatgcctgaacgccatgctgcacagcaatagtagggggggagagggtctgttctataagctgccagggagaatcagtcttttcactctcaaggtgtag

SEQ ID NO: 213564 - DNA, 258 bp, Artificial Sequence
  Description of Artificial Sequence: Synthetic coding sequence
atgaaagataaacagaaaaagaagaaagagagaacttgggctgaggctgcacggttagtgctagaaaactattcggacgcaccgatgaccccgaagcagattctgcaggtcatcgaagctgagggcctaaaggaaatgcgatccggcacatcccctctggcctgtttaaatgccatgctgcattctaacagcagaggcggagaaggactgttctataaactccccggtaggatatcactgtttacacttaaggtgtag

SEQ ID NO: 213565 - DNA, 255 bp, Artificial Sequence
  Description of Artificial Sequence: Synthetic coding sequence
atgaaggacaagcagaagaagaaaaaagaacggacgtgggcagaggccgctagactggtcctggaaaactactctgacgcccctatgacccccaaacaaattcttcaggtgattgaggccgagggcctgaaggaaatgtctggtactagtccattagcctgcttgaatgctatgctccattccaacagtagaggcggagaaggccttttttacaaactgccaggcaggataagcctcttcaccctgaagcgatag

SEQ ID NO: 213566 - DNA, 2757 bp, Artificial Sequence
  Description of Artificial Sequence: Synthetic coding sequence
atgaagagaaccaaatgcgccgatattgacgtggagacccctgactccatccttgtgaataccaaccttcgcgctctcatcaacaagcatacatttagcgttctgcctggcgactgccagcaaagactgttgctgctgcttcctgaagtagatagacaggtgggtcccgacgggcttatgaagctcaacggctctgcattaaacaatgagttttttacttcggcagcacaggggtggaaagaaagactatccgaaggtgagtttacacccgagatgcaggtgcggataaggcaggaaattgagaaggagaaaaaggtcgaaccatggaaagagcagtttttcgagtcttactatggccagtccagcggcctgtccctagaggactctaagaaactgactgcctcaccttctgatcccaaagttaagaaaacgcctgccgagcagcccaaaagtatgcctgtatctgaggccagcctgatcaggatagtgcccgtggtgagccaaagcgaatgcaaggaagaggcccttcagatgtcatcacccggacgcaaggaagaatgcgagagtcagggcgaggtacaacccaactttagtacctcatcagagcctcttttatccagcgcccttaacacgcacgaactgtcttcaatcctgccgatcaaatgcccaaaagatgaagacctacttgaacaaaagcctgtgactagcgcagagcaggaaagtgagaagaaccatcttaccaccgcatccaattacaacaagagtgaatctcaggaatcgcttgtgacctcaccatccaagcctaagagccccggagttgagaagcccattgtgaagccaactgcaggcgcagggccacaagagaccaatatgaaagagccccttgctacacttgtggaccagtcccccgagtccctcaagcgtaaaagtagcttgacacaggaggaggcacctgtctcttgggagaaacggccaagagtcacagaaaaccggcagcatcagcaaccttttcaggtttctccacagccttttctcaatcgcggagacagaattcaggtccggaaagttcctcccttaaaaataccggtctctcggatctctccaatgcctttccacccctcacaggtgtcccctagggctcgctttcccgtctctattaccagcccaaatcgaaccggagcccgtaccctcgcggatattaaggccaaggcccagctggtaaaagcccagcgggcagcggcagccgctgcagccgcagctgcagctgcagcgagcgtggggggtacaattccaggacccggtcctggaggcggacaggggcctggcgagggaggcgaagggcagacagccagaggtggttccccaggttctgatagggtatcagaaactggcaagggacctaccctagagctggccggaactggctctcgcggaggcactcgggagctattaccctgtgggccagagacacagccacaaagtgagacaaagaccacgccaagtcaagctcagccccactcagtgagcggtgctcagctccagcagacaccgcctgtgccgcctacaccggcagttagcggggcttgcaccagcgtgccctctccagcccacatcgagaagttagacaacgagaaactgaatccaaccagagctaccgctaccgttgcgagtgtgtcgcatcctcagggaccatcgagctgcaggcaggagaaggctcctagtccaacgggatttcagctggaggatatttccacaagtcaaaggttcatgctcggcttcgccggaagaaggacctctaagcctgcgatggctggtcactatttgctgaacattagtacttacgggcgtggctcagagtcctttagaagaacccattcagtgaacccagaggaccgcttttgcctgtctagtccaaccgaggcgctaaagatgggatatacagactgtaagaatgcgactggtgaatccagtagtagcaaggaggacgataccgacgaagagtcaacgggggatgagcaggagtccgttaccgtaaaggaagaaccacaggtgtcacagtccgcaggaaagggcgacacctcatccgggcctcactcaagggagaccttaagcacaagcgactgtctagcgtccaagaatgtcaaagccgagattccactgaatgaacagacgaccttatcgaaggaaaattatctattcacacggggacagactttcgacgagaaaactctcgcaagggacctaattcaggcagcccagaaacagatggcccacgccgtgcggggaaaggccattcgcagctctcctgagctgtttagttcaacggtcctccctctgccggctgatagccccactcaccaaccgttgctgctgccccctttgcagacccctaagctgtacggatcgccaactcagatcggcccatcatacaggggtatgatcaatgtgtccacctcatccgacatggaccataattctgccgtgcctggatcgcaggtgagttctaatgttggtgacgtgatgtctttcagcgtcacagttactacgattcctgcaagtcaggctatgaacccctcctcccacggtcaaacgatcccagtgcaggcctttagcgaggaaaacagtatcgaaggtacccccagcaagtgttactgtcgcctaaaagccatgattatgtgtaaagggtgtggggctttctgtcatgatgattgtataggtccctctaagctctgtgtgtcctgtctggtggtccggtag

SEQ ID NO: 213567 - DNA, 4224 bp, Artificial Sequence
  Description of Artificial Sequence: Synthetic coding sequence
atgagccacaaggaaatcctacaagtgatccagagggaaggactgaaagaaatatcaagcggcacctctccgcttgcttgtctaaacgccatgctccatacaaattcccgcggtgaagaaggtatattctacaaggttcctggacgcatgggtgtgtataccctgaaaaaagatgtgcctgatggagtaaaagagctcagtgaaggtagcgaagaatcctcagatggccagagtgattcccagtcctctgaaaactcgtcttccagtagtgacggcggatctaacaaagagggcaagaaaagccggtggaaacgcaaagtgtctagtagcagcccacagtcggggtgcccctctcccaccattcctgcaggtaaggtgatttcaccaagccagaagcacagcaagaaagctctcaaacaagcactgaagcagcagcagcaaaagaaacagcagcagcagtgccggccatccatatccattagttcaaatcaacatctatcattaaagacagtgaaagcagcctcggattccgtgccagcgaagcccgcaacatgggaagggaagcagagtgatggccaaactggatctccacaaaacagcaactccagcttttcctcctccgttaaggtggaaaatactctgttgggcctcggcaaaaagtcattccagaggagcgagcgattgcacacgcgacagatgaaaaggacaaagtgcgccgacattgatgttgagacccctgactctatcctggtgaacacaaacctaagagctctgatcaataagcacacattttccgtgctccctggagattgccagcaacgtctcctgctgttactgcctgaagtcgaccgacaagtgggtccagacggcctgatgaaactgaacggatcagctctaaataacgaattcttcaccagtgctgcccaaggatggaaggaaagactgtccgagggtgagtttacccccgaaatgcaagttcgcatcagacaggagatcgagaaagagaaaaaggtggagccttggaaggagcagttcttcgagagctactatgggcagtccagcggtttgagcctggaggattcaaaaaagcttacggcatcaccttccgaccccaaggttaaaaagactcccgcagaacagcccaagagcatgcccgtgagtgaggccagtctgattagaatcgtccctgtcgtttcacagagcgagtgtaaagaggaagctcttcaaatgtcaagccctgggagaaaagaagagtgtgagtctcagggcgaggtccagccaaactttagtacctcgagcgagcccttgctaagttccgccctcaatactcatgaactgagctccatccttcccattaagtgcccgaaggatgaggatctgctggagcagaagcctgtgaccagcgctgagcaggagagtgagaagaaccatctgaccaccgctagtaactataacaaaagcgaatcacaggagtctctggttacctcaccatcaaaaccaaagtctcccggagtggaaaagcctatcgtgaaacctactgctggagctggcccacaagaaaccaatatgaaagaacccctcgcgacactggtagatcagtcacccgaatccctgaagaggaagagcagtttgacacaagaagaggctcccgtcagctgggaaaaaagacccagagtcacagaaaaccggcaacatcaacaacccttccaggtctcaccccagccattcttgaaccgcggagatcgaattcaagtgagaaaggtgcccccattaaaaatccctgtttcaaggatttcccccatgccattccacccaagccaggtgtctccaagagcacggtttccagtgtcaattacctccccgaacagaacgggtgcccgtaccctggctgatattaaggcaaaggctcagctggtgaaggcccaaagagctgcagccgcagccgcagctgccgctgctgccgctgcatcagtcgggggaactattcccggtcctggtccaggagggggacaggggcctggagagggtggtgaaggccagaccgccaggggcggatcacctggttccgaccgcgtctcggagactggaaaggggcctactcttgagctggcaggtaccggtagcagggggggaacccgggagctcctgccatgcgggcctgaaacgcagcctcaatccgagaccaagaccacgccaagtcaggcccagccccatagtgtgagtggagcccagctccagcagacaccccctgtgcccccaacacccgctgtctcaggcgcttgtacatccgtcccgtcccccgctcatatcgaaaaactggacaacgagaagctgaatccgacacgcgctactgctacagttgcgtccgtgtctcacccccaaggcccaagtagctgccggcaagagaaagctcccagccccaccggcccagcactgatcagcggggcatcacccgtgcattgtgctgctgacggcacagtggagctcaaggccggacctagtaagaatatccccaacccctccgcaagcagcaagacagatgcaagtgtgcctgtcgccgtaacacctagcccactgacttctctcctcacaaccgctaccttggaaaagctgccggtgccccaggtatccgctactaccgctcctgcgggaagcgctccacctagctcaactcttcccgctgctagctcgctgaaaacgcctgggacgtctctgaacatgaatggcccaactttaaggccaaccagctctattccagccaacaatccactcgtcacgcagctgctgcagggcaaagatgtccccatggagcaaatcctgcccaaacctctgacaaaggtagagatgaagacagttccgctcactgcaaaggaggagagaggtatgggtgcactgattgcaaccaatactaccgaaaacagtaccagggaggaggtcaatgaacggcagtctcatcccgctactcaacagcagctaggcaagactttgcagtcaaagcagctgccacaagttcccaggcccctgcagctgttcagcgcgaaggagctgagggattctagtattgatacccaccaataccacgagggcctcagtaaggctacccaggatcagatcctccagactttaatccagagagtccggaggcagaacctgctgtccgtagtgccaccaagccaatttaatttcgcacatagtggcttccagctggaggacataagcactagccagcgatttatgctgggcttcgccggacggaggacttctaagcccgcaatggcaggccactacttgttaaatatctcaacttacgggagaggaagtgagtccttccgcagaactcacagtgtcaatcccgaggaccgcttttgtttgtcatctcctacagaggctctcaagatgggttacactgattgtaagaacgctaccggcgagtctagctcttccaaggaggacgacaccgatgaagaatcaacaggtgatgagcaagagagcgttacagtgaaggaagaacctcaagtttcacaaagcgccggaaagggggacacaagcagcgggccacactcgcgcgagacgcttagcacaagtgactgtctggcatccaaaaacgttaaagcagagatcccccttaacgaacagactactctgagcaaggagaattacctatttaccagggggcagacattcgacgaaaagactctcgcaagggatttgatccaagccgcacaaaagcaaatggcgcatgcagtacgtggcaaggcaatccgatcgagcccagagttattctcatcaactgtcctgcctctgcctgcagatagccccacccatcaaccactgctgctcccaccccttcagaccccaaagctgtatgggtcccctactcagattggcccatcgtaccggggtatgattaacgtgtccacctctagcgatatggatcacaactccgctgtgcctggatcacaggtgagcagcaatgtgggcgacgtaatgtccttcagtgtgactgtgacaaccatacccgcttcccaggcaatgaatccatctagtcatggccagaccattcccgtgcaggccttctctgaggagaactctattgaagggacgccatccaagtgttattgccgcctgaaagccatgattatgtgtaaggggtgtggggcattttgccacgacgactgcatcggcccatcaaagttgtgtgttagttgtctggtggtgcggtag

SEQ ID NO: 213568 - DNA, 2757 bp, Artificial Sequence
  Description of Artificial Sequence: Synthetic coding sequence
atgaagcgtacaaaatgcgccgatatcgatgttgagaccccggatagcatcttggtcaatacaaatttgcgcgcactgatcaataagcatactttctctgttttgcctggggactgtcagcaacgcctgctgctcctgctacccgaagtcgacagacaggtggggcctgacgggcttatgaagctgaacgggagcgcccttaacaacgaattttttaccagcgctgcacagggctggaaagaacggctatcagagggggagttcacccctgagatgcaagtcaggattcggcaggagattgagaaagagaagaaggtggagccatggaaagagcaatttttcgaatcttactacgggcagtctagcgggctgtcactggaagattcaaagaaactgacggccagcccaagcgatccaaaggtaaaaaagacccccgctgaacagcccaaatctatgccagtgtcggaggccagcctgattagaattgtccctgtggtgagccaatctgagtgcaaagaggaagcacttcaaatgtctagcccgggaagaaaagaggagtgcgaaagtcagggggaggtgcagccgaactttagtactagtagcgagcctctgctgtcatcagcgctcaatacacacgagctttcatccatcttacccattaagtgtccgaaagacgaagacttgttagagcagaaacctgttacttccgccgaacaggaatccgaaaagaatcatctcaccacagccagcaactacaacaaaagtgaatctcaggagagcctggttacaagcccaagcaaacctaaaagccctggggttgagaagccaattgttaagccgacggctggggctggccctcaagaaacaaatatgaaagagcctctggccaccttggtagatcagtcccctgaatcccttaaaagaaaaagttctcttacacaggaggaagcacccgtgtcttgggagaagaggcctcgggtgacagaaaaccgtcagcaccaacagccgttccaagtaagcccccagcccttcctgaaccgcggtgaccgcatccaggtgagaaaggttcctccactgaagattcctgtctcccgaatctccccgatgccttttcatcccagtcaggtctctcctagagccagattcccggtgagcatcacgtccccgaacagaactggcgcaagaacactggccgacatcaaggcaaaagctcagctggttaaggcacagcgggcagccgcagcagccgctgctgccgctgcagccgctgcctctgtcggtggcactattcccggaccgggtccaggcggagggcaggggccaggtgaggggggtgagggccagaccgcgcgaggtggcagtccaggatcagatcgcgtgagtgagacgggaaagggccctactctcgagttagcaggtactggaagtcggggaggtacacgagagctactgccttgtggaccagaaacccagcctcaatctgaaactaagaccacgcccagccaggcacagcctcatagcgtcagcggtgctcagcttcagcagaccccacctgtgcctcccacacctgctgtgtctggagcttgtactagcgttccttctccagcccatattgagaaactcgataatgagaagttgaatcctacccgggcaacggccacagtggctagcgtcagccaccctcagggaccctcctcctgtagacaggaaaaagctccctcaccaacaggcttccagcttgaggatatttctacaagccagcggttcatgctcgggttcgccggtcggagaactagcaagcctgccatggcaggccactatttgcttaacatcagcacgtatgggaggggctcagagtccttcaggaggacccacagtgtaaatcctgaagatagattctgtctgtcctcccctactgaggcattgaagatgggttatacagattgtaagaatgcaacaggtgagagttcctcatctaaagaggatgatacggatgaagaatccaccggggacgaacaagaaagtgtaacagtgaaggaagagcctcaggtaagtcagtcagctggtaagggagatacatctagtggaccacacagtcgggagaccctgagtacaagcgattgccttgccagtaagaacgtcaaggcggagattcctttaaacgagcagaccaccttaagtaaagagaactacctatttacgagagggcaaaccttcgacgagaagactttggcccgtgatctcattcaggctgcacagaagcagatggcacacgccgtgagggggaaggcaatacgctcctcccccgagctttttagctcaacggtgcttcccctgccagccgacagtccaacacatcagcctctcttattgccaccactacaaacaccgaaattatacggatctcccactcaaattgggccatcctaccgagggatgatcaatgtttccacctcttctgacatggatcacaacagtgccgtgcctggaagtcaagtaagttctaatgtaggggatgtgatgagcttctctgtaaccgtgaccactatccccgcatcccaggcaatgaatcccagtagccacggacagaccatccctgttcaagccttcagtgaagagaactctattgaaggcaccccgtctaagtgttactgtagactgaaggctatgatcatgtgcaagggttgcggagcgttttgccacgatgactgcatcggaccgtcaaagctatgtgtgtcctgtctggtggtgagatag

SEQ ID NO: 213569 - DNA, 4308 bp, Artificial Sequence
  Description of Artificial Sequence: Synthetic coding sequence
atgagggagaaaggacgtcgaaaaaaggggagaacatgggcagaggctgcaaaaacagtcctggaaaagtaccccaacacgcccatgtcccataaggagatcctgcaggtcattcagagggagggcctgaaggagatcagatccggaactagcccactcgcctgcctgaacgccatgctacacacgaattcccggggagaggaaggcattttctacaaggtgcctggtcgcatgggagtctatactctcaagaaggatgtacccgatggcgtaaaggaacttagcgaaggtagcgaggagtcctcggacggtcagagtgattctcaatccagcgaaaattcttcttcttcctctgatggcggttccaataaagaggggaaaaagagcaggtggaaaaggaaggtctcctcctcatctccacagagtggctgccccagccccacgatccctgccggtaaggttatttctccatcccagaagcatagtaagaaggcacttaagcaggcattgaaacagcagcaacagaagaagcaacaacagcagtgccggcctagtattagtatctccagtaaccagcacctgtctctgaaaacagtaaaagccgctagtgactcagtccctgcaaagcctgccacctgggagggtaagcagtctgacgggcagacaggaagcccccagaactcaaatagctcgttttcctcgtccgtgaaggtggagaacactctacttggacttggtaagaaaagcttccaaaggtcagaaagactgcatactcgccagatgaagcggacaaaatgtgccgatatcgatgttgaaacacctgacagtattctagtcaataccaatctacgagccctgatcaataagcacacattcagcgtgctccctggtgattgtcagcagagactgcttctgctgttgcccgaggtggatcgccaggtcggtcccgacggcctgatgaaactcaacggcagcgctctgaacaacgagttcttcacatccgccgctcagggctggaaggagcgacttagcgaaggggagttcacgccggagatgcaggttagaatccgccaggaaatcgaaaaggaaaagaaagtcgagccatggaaagagcagttctttgagtcgtattatggtcagagctccggcctctcactggaagactcaaaaaaactgaccgccagtccatccgaccccaaagtgaagaagacaccggcagagcagcctaagtcgatgccagttagcgaagcttccttaatccgcatcgtaccggttgtgtcacagtctgagtgcaaagaggaggcgctgcagatgtctagcccaggcagaaaggaagagtgcgaatcccaaggagaagttcagcctaactttagcacatcgagcgaaccactattgagctcagcactgaatacccatgaactgtcgtctatcctgcccatcaagtgccccaaggatgaagatctgctggaacaaaagccagtaacttccgccgaacaggagtccgaaaagaaccatttgacaactgcctctaactataacaagtcagagtcccaggagagtcttgtaacatctccgtccaagcctaaatcgcccggtgtcgagaagccaatcgtaaaacctacggctggggcaggccctcaggagacaaatatgaaagaacccctcgcgactttggttgaccagtcccctgaatccctgaagcgaaagagcagcctgacccaggaagaggcgcctgtgtcctgggagaagcgaccccgagtgaccgagaacaggcagcaccagcaaccatttcaggtgtctccacaaccatttctcaacagaggggatcggatccaggtgaggaaggtgccacccctgaagattcccgtaagcaggatctctccgatgccttttcacccttcccaagtatctcctagggcccgatttcctgtgtccattaccagccctaacaggaccggggctaggaccttggccgacatcaaagctaaggcacagctagttaaggcccagagggcagctgcagctgcagcggctgcagctgccgcagccgcttcagttggaggcaccatccccggtccaggacctgggggtggtcagggacccggagagggaggagaaggccagacagcccgaggcggtagtcctggtagcgacagagtctctgagaccggcaagggcccaaccctggagctggccggtacgggctcccgaggaggtacaagagaactcctgccttgtggccctgagactcagcctcagtcagagacgaagactacaccttcacaggctcaacctcactcagtgtccggagcacagctgcaacagaccccgcctgttcccccaacacctgccgtgtctggggcatgtacttctgtgccttcgccagcacacatcgaaaaacttgacaacgagaaactcaaccctacccgggcaactgccactgttgcgagtgtcagccacccacagggtccatcctcctgccgccaggagaaagccccaagccccacaggccctgcactgatcagcggagcatcgccagtgcactgtgcagcagacgggaccgttgaacttaaagccggaccgtcaaaaaacattccgaacccttcggcgtccagtaagacggacgcctcagttcccgtggccgtcacaccctcaccactcacgtccctgcttaccactgctaccttggagaagctccccgtgcctcaggtctctgccactaccgctcccgcaggaagtgcacctcctagctctacactgcccgctgccagttctctaaagacccctgggaccagtttaaacatgaacgggccaaccctccggccaacttcctccattccagcgaacaacccactggtgactcagttgcttcagggtaaggacgtgcccatggaacaaattcttccaaagcccttaaccaaggtggagatgaagacggtgccgctgaccgccaaggaggagaggggaatgggtgctctcatcgcaacgaacaccacagagaattccacacgggaggaggttaatgagcggcagagtcatccagcaacccagcagcagctcggcaagacacttcaatcaaagcagctgccccaagtcccgagaccacttcagttgttctctgccaaagagctgcgcgactcatctatagacacacaccagtaccacgaagggctgtccaaggccacccaggatcagatcctgcagaccttgatccagcgggtacggaggcaaaacctcctttcagtagtccctccttcccagttcaacttcgcccacagtgggttccagcttgaggatatctctacttctcaacggttcatgctgggctttgccggaaggcgcacatctaagcctgcgatggccggtcattatctcctgaatatttccacctatgggcgtgggtccgaatcatttcgcaggactcactccgtgaacccagaggacagattttgtctgtcttctcctacagaggccttgaagatgggctacaccgattgcaaaaatgccacaggcgagtcgagttccagtaaggaagacgataccgatgaggagtccaccggggacgaacaggagagcgtgacagtcaaggaagaaccacaagttagccaaagcgcaggaaaaggcgacactagcagtgggcctcacagcagagagactctctcaacgtccgattgtctagcatctaagaatgtgaaggcagagattcctctgaatgaacagacaactctctcaaaggagaactatctgttcactcggggtcagaccttcgacgagaagacactggcgagggacctgatccaagcagcccagaagcagatggcacatgccgttaggggcaaggcgatccgctctagtcctgaactgttctcgtccacagtgctgcccttaccagccgactcccctacacaccagcctcttctgctgcctcccctgcagacccctaagctctatggaagtccaacgcaaatcggaccctcctaccggggtatgattaatgtgtccactagtagtgacatggaccataacagcgccgtgcccggaagccaggttagcagcaacgttggcgacgtaatgagcttctctgtcaccgttacaaccatccccgctagccaagctatgaacccatcatctcatggacaaaccatccccgtccaggccttttccgaggagaattcaatcgagggaacgcccagtaaatgttattgccgactcaaggcgatgatcatgtgcaagggttgtggggcattctgtcacgatgattgcataggaccaagcaaactgtgtgtgtcatgcctggtggtgcggtag

SEQ ID NO: 213570 - DNA, 6746 bp, Artificial Sequence
  Description of Artificial Sequence: Synthetic coding sequence
atgaaggataagcggaagaaaaaggatcgtacctgggccgaggcggctagactggccttggagaagcaccccaattccccaatgactgctaaacagattctggaggtgatccaaaaagaaggtttaaaggagacttccggcacgagccctttggcctgtctcaatgccatgctgcacacaaatacaagaataggggacgggaccttcttcaaaatccctggcaaatcaggcctgtatgcactgaaaaaggaggagtcctcatgtcctgcggacggcaccctagacctcgtgtgtgagtcagagctcgatgggactgacatggcggaggcaaacgcacacggcgaggagaatggtgtttgcagcaagcaggtgaccgatgaggcctcaagtactcgggattcgtcgttgacaaataccgcggtccagagcaaactggtgagcagctttcagcaacacaccaagaaggccctgaaacaagcactgagacagcagcagaaaaggcgaaatggggtgtcaatgatggtgaataagacggtgccgagagtcgtattgaccccgcttaaagtgtcggatgaacaaagcgatagtccatctgggtcagaatccaaaaatggtgaggcagactcatctgacaaagagatgaaacatggtcaaaaaagtcctaccggcaaacagacatcacagcacctgaagagattaaagaagagcggcctcgggcacctcaaatggaccaaggctgaggacattgacatagaaacaccaggctctattctggtgaacacaaacctgcgcgctcttattaacaagcacacatttgcctcactgccccagcacttccagcagtatctgctgctgctgcttcccgaagtggacagacaaatgggttctgacggcatcctgagacttagtacaagcgccttaaataacgagttcttcgcatacgctgcccaggggtggaagcagcggttggctgagggcgagtttactcctgaaatgcagctgagaatccggcaggagatcgagaaagagaagaagaccgagccctggaaagagaagtttttcgaacgattttacggcgagaaactcgggatgtcccgcgaggagagcgtaaaactgaccactggccctaacaacgccggagctcagagctcgagctcttgcggaacctctggactgcctgtgagcgcacaaactgccctcgccgagcagcagccaaagagcatgaagagtccagcatcccctgaacccggtttctgcgccactctgtgcccaatggtggagataccacctaaggatattatggccgagttggaatcagaagacattcttatccccgaggagtcagtgatccaggaagaaattgctgaggaggtagaaacatccatctgtgagtgccaggacgaaaatcacaaaaccattcctgagttttcggaggaggcagagtctcttaccaattcccatgaagagcctcagatagcgccaccagaggacaatctcgagtcgtgtgtgatgatgaacgatgtgcttgagacgctccctcatattgaagtaaagatcgaaggcaagtccgagtccccccaggaggagatgacagtggtaattgatcagctggaagtttgtgattccttgatcccctctacctcgtcaatgactcacgtgagcgacaccgagcacaaggagtcagagacagccgtagaaactagcacccccaagattaagactgggtcctcctcattggagggtcagtttcccaacgaggggattgccatcgatatggaactgcagtctgaccctgaagaacagctgagcgaaaacgcttgcatctccgaaaccagcttctcctcggaaagccctgaaggagcttgtactagtctcccctctcctggcggtgagacccagtctacctcagaggagagttgcacaccggcaagcctggaaactacattttgctctgaggtgagcagcaccgaaaacactgacaagtataatcagaggaatagcaccgatgaaaattttcatgcttcactgatgtcggagatcagtcctatcagtacgtcacccgaaatctccgaagcctctttgatgtcaaacctccccctcacctccgaagcctcccctgtcagcaacttgcccctgaccagcgagacatccccaatgtccgacctgcccctgacaagtgagacaagcagtgttagtagcatgctgttaacttccgagacaaccttcgttagcagtcttccgctgccatccgaaacgtctcccatcagcaactcttccataaatgagaggatggcccatcagcagcgtaagagccccagcgtgtcggaagagcctcttagcccgcaaaaggatgagtcctcagccaccgccaaacccctcggtgagaatctcactagtcaacagaagaacctgtccaacacccccgagccaatcatcatgtcatcctcgtctatagcccctgaggcctttcctagcgaagatctgcacaacaagaccctcagtcaacagacatgcaagagccacgtggatactgagaagccataccccgcttctattcccgaactggcatcaacggagatgattaaagtgaagaatcatagtgtgctgcagagaacagagaaaaaggttctgccctctccgctcgaactgtctgtcttcagcgagggcactgacaataaaggcaatgagttgccgagtgcaaaactgcaagacaagcaatatatttcttccgttgacaaggctccattctcagagggtagtaggaacaagacccacaagcagggaagtacacaaagcaggctcgagacatcccacacctctaagtcaagcgaaccctcgaaaagtccggacggcatcagaaatgaaagcagagactcagagatcagtaagcgcaaaactgcggagcaacatagctttggcatttgtaaggagaagagggcgaggattgaagatgatcagagtacacggaacattagtagtagttcacctcctgaaaaggagcagccccctcgtgaagaacctcgggtgccccctctgaagattcagttgagcaagattggaccgccatttattatcaagagccagcctgtaagtaaaccggagtctcgtgcctcaacttcgacatccgtgtctggtggaaggaacactggggctagaacgctggccgatataaaggcccgtgcccagcaagctagggcacagcgggaggcagccgctgccgctgcggtggctgccgctgcctctatcgtttctggcgcaatggggtctcccggagagggaggaaagacacgtaccctagctcacataaaggagcaaaccaaggccaagcttttcgcaaagcaccaggccagagcccatttgttccagacctcaaaggaaacaaggctgccccctcccctctctagcaaagaaggacctccaaacctggaagttagcagtacccctgagacaaaaatggagggcagcaccggagtcatcatcgtcaacccgaactgtcgatcccctagtaataaatccgctcatctaagggagaccacaaccgtgttacagcaatcacttaatccctccaaactacccgagaccgcaaccgacctgagtgttcactcctcagacgaaaacatccctgtgtcacacctgtccgagaaaatcgtgtcatccaccagcagcgaaaactcgagcgttcccatgctgtttaataaaaactctgtgcctgtgagtgtgtgctctacagctatatcaggcgcaataaaggagcatccttttgtatctagcgtggacaagagttccgtgctcatgagcgtcgactcagcgaacaccacaatttctgcctgcaatatcagcatgttaaagactattcagggcaccgacactccctgcatagctattattcctaaatgcatagaatctacccccatctctgctaccacggagggtagctcaatctctagttccatggacgataaacagctgcttatttcatcgtcatccgcctctaatctggtctctacacagtacacttccgtgcccaccccctcgatcggcaataatctgccaaacctctctaccagctctgtgttaataccaccaatgggcatcaataaccggtttccctccgagaaaatagcaataccaggctctgaagaacaggccaccgtgagcatgggaactacggttagagccgctctttcttgtagcgatagtgtggctgttaccgacagcctcgttgcccatccaacggtagcgatgttcaccggtaatatgttaaccattaatagctacgactctcctcctaagctttcagccgaatcactcgacaagaattccggacccaggaaccgcgcagacaacagcgggaagccacaacagccaccaggtggtttcgctccagccgctattaaccgatcaatcccatgtaaggtcatcgttgatcactccaccacgctgacaagctccttgtccctcacagtgagcgtcgagtcttcagaagcttctctggatctccagggaaggcctgtccggaccgaggcttccgttcagcccgtcgcctgtccccaggtcagcgtaatatcaagaccagagccagtggccaatgaaggcatcgatcacagcagtacgtttatcgcagccagcgctgcgaagcaggattccaagacgctgcctgccacctgtacatcactacgcgaattacctcttgttcccgataagctgaatgagccaacagctcctagccacaattttgcagagcaggcccgtgggcctgcacccttcaagagtgaagcggatacaacgtgcagcaatcagtacaacccgtcgaatcggatctgttggaatgacgatggcatgaggtcaacaggacagcccctggtaacccactcagggagtagcaagcagaaagaatatctagaacagtcctgccctaaggccataaaaaccgagcatgctaactatctgaacgtgtcggaactccatccacgcaatttggtcaccaacgttgccctgcctgttaagtctgagttgcacgaagccgacaaggggttccggatggacacggaagactttccaggccctgagcttccaccccctgccgctgagggtgcttcctcagttcagcaaactcagaatatgaaggccagcacatcttctccgatggaggaagccatctcactggccacggacgcactgaaacgggttcctggcgctggttcttctggatgcaggttgtcatcagtcgaggcaaacaatccgctagtgacacagctcctgcagggtaacctgcccctagaaaaggtgctgccacagcccaggctgggggctaagctcgaaattaaccgcctgcccctcccactgcagactaccagcgtaggaaagacggcacctgaaagaaatgtagaaatcccacccagcagccccaaccctgacgggaagggatatctagccggaaccctggcgcctctgcagatgaggaaacgcgaaaatcatcccaagaagcgggtcgcacggacggttggtgagcatacacaggtgaagtgtgagcccggtaagctgcttgtagagcctgacgtcaaaggcgtgccatgtgtcatcagctccggaattagccagctcgggcactctcagcccttcaaacaggaatggctgaacaagcacagtatgcaaaaccgcattgtacactccccagaagtgaaacagcagaagaggctactaccgtcatgttccttccagcagaatttatttcacgttgataaaaacggtggtttccacaccgatgctgggaccagccacagacagcagttttatcaaatgcccgtcgctgccaggggcccaatacctaccgctgctcttctgcaagcgagctctaaaacccccgttggatgtaatgcattcgcatttaatcgacatttggaacagaaaggtctcggcgaggtgtcactttcatctgccccacaccaactgagattggccaatatgctcagccctaatatgcccatgaaagagggtgacgaggtgggcggtaccgcacacaccatgccaaataaggcactggtacatccaccccctccgcctccccctcctcccccacctccactggccctgccaccgccaccccctcccccacctcctctgccccctccgcttcctaacgctgaagtgcctagtgatcagaaacaacctccagtaactatggagaccacaaaaagactttcctggccacagtcaacagggatctgtagcaacatcaaaagtgaaccgctctctttcgaggagggcctcagctcatcatgcgagctggggatgaaacaggtcagctacgatcagaatgagatgaaggaacagctgaaggctttcgctctgaagtccgccgattttagcagctacctgctcagtgaaccccagaaacccttcacacagctcgcggcacagaagatgcaggtacagcagcagcagcaactgtgcggaaactatcccaccattcactttgggtccacttcatttaagcgcgctgccagtgcgatcgagaaaagtatcggcatcctgggcagtgggtcgaatcccgctaccgggctaagcggccaaaatgctcagatgccagtccagaacttcgccgactctagtaacgccgacgaactggagctgaaatgctcgtgtagactcaaagccatgatagtgtgcaaagggtgtggcgctttttgccacgatgactgtatcggcccttcgaagctgtgtgtcgcatgtcttgtagtgaggta

SEQ ID NO: 213571 - DNA, 2307 bp, Artificial Sequence
  Description of Artificial Sequence: Synthetic coding sequence
atgaatggcgactctcgagcagcagtggtgacaagcccccctcccaccaccgcccctcataaggaacggtacttcgatcgtgtggatgaaaacaaccccgagtacctgagggagagaaacatggctccggacctcaggcaggattttaacatgatggaacagaagaaaagggtgtccatgatcctgcagtcccccgcattctgtgaagagctcgagagtatgatccaggaacagtttaaaaagggtaagaatcctaccggattgctggcactgcagcagatagccgatttcatgactacaaatgtgcctaacgtttaccccgcagcccctcagggcggtatggccgctctgaacatgagtctcggcatggtgacccctgtgaatgatcttcggggatccgacagcatagcttacgataagggagagaagctacttaggtgtaaactggccgcattttacaggctggctgacctgttcggatggagccagttgatctacaatcatattactacaagagtgaactcagagcaggagcactttcttatcgttcctttcggcctgttgtacagcgaagtgaccgcatcaagtctggtgaagattaatctgcaaggggatattgtggaccgtggttcgacaaacctgggcgtcaaccaggccggatttacgctgcattccgccatctacgctgctaggccagacgtcaaatgcgttgtccatattcacacacccgcaggcgctgccgtcagcgctatgaagtgtgggctgctgcctatttcccctgaggccctaagtctgggagaggtggcttaccacgactatcacggaatattggttgacgaggaagagaaggtactgattcagaagaacctgggcccaaaaagcaaagtcttgatcctgcgcaaccatggtcttgtgagcgtgggcgaaagtgtcgaagaagcattctattatattcacaacctggtagtagcctgcgaaattcaggtgcgtaccctggccagtgctggtgggcctgataaccttgtgctgctgaatcctgagaaatacaaagccaaaagccgctctcctggctcacccgttggagaaggaaccggaagtccaccgaagtggcagattggcgagcaagagttcgaggcgctgatgagaatgctggacaacctgggttatcggacgggttacccatataggtacccagcactgcgggaaaagtccaagaagtacagcgacgtagaagttcccgcaagtgtcaccggatatagcttcgcctcagatggagattctggcacctgctctcccctgcgccattccttccagaagcagcagagagagaagacccgctggttaaatagtggcagaggcgacgaagcatccgaggaagggcagaatggttccagtcctaaatccaaaactaaggtgtggacaaacatcacacacgaccacgtgaaaccactactgcaatctctgagttccggagtgtgcgttccttcatgtatcactaactgtctatggacaaaagaagatggccacagaacgagtacgtccgccgtgccaaatcttttcgtccctctgaatacgaaccccaaggaagtccaggagatgagaaacaagattcgggagcaaaacttacaagatatcaagacagctggtcctcagtctcaagttctttgtggcgttgtgatggaccggagtctggtgcagggcgaactggtaactgcttcaaaagccatcattgagaaggaataccagccccacgtgatcgtgtctacaactgggccaaacccttttaccaccctcacggacagagaactggaggaatacaggcgcgaggtggaacggaagcagaaggggtcagaagaaaatctggatgaagccagggagcaaaaagagaaaagtcccccagatcagccggcagtgcctcacccacctccaagcactccaattaagttggaagaagacctggtaccagagcccacaacaggagatgattccgacgcagcaacctttaagcctaccctacccgatctgtctccagacgagccctcggaggccctcggtttccccatgctcgagaaagaggaggaagcccatcgcccacccagccctaccgaggccccaacagaggctagtcccgaaccagctcctgaccccgctcctgtggcagaggaagccgctccatcagccgtggaagagggcgctgcagctgacccaggtagtgacggctctccaggaaagtcacctagtaaaaagaagaagaaattccgcaccccctcctttctgaagaagtccaaaaaaaagtcagatagttag

SEQ ID NO: 213572 - DNA, 1989 bp, Artificial Sequence
  Description of Artificial Sequence: Synthetic coding sequence
atgaacggtgacagtagagcagcagtagttacatcccccccacccacaacagcccctcataaggagcgctactttgacagagtggatgaaaataatcccgagtacctgcgagaacggaacatggcccctgacctgagacaggatttcaacatgatggagcagaaaaaaagggtgtctatgattctgcagagcccggcattttgtgaggagctggagtcaatgatccaggaacagtttaagaaaggaaaaaatccgaccggactcctggccctgcagcagattgctgatttcatgactactaacgttccgaatgtctaccctgctgccccacaagggggaatggctgctctgaatatgtctctgggcatggtgacccctgtcaatgacctgcgcggtagcgattcaatcgcgtatgacaagggggagaagctgctacgatgtaagctggcagccttttatcgccttgcagatctattcggatggtctcagctgatttataatcatattacaacacgggtgaactctgagcaggagcactttcttatagtgccattcggcctcctctatagtgaggttaccgcctcctccctcgtgaaaatcaacctccagggtgatattgtcgaccggggttcgaccaacctgggagtcaaccaagcaggcttcacactgcactccgccatatacgcagcccgacctgatgtgaagtgtgtagtccacatccacactcccgcaggggctgccgtcagcgctatgaaatgtggcctgctccctatctctccggaggctctctctctgggagaggtggcctaccacgactaccatggcatattggtggatgaggaggaaaaggtgctgattcagaagaacctagggccaaaatccaaggtcctgatactccgcaaccatgggctggtaagcgttggtgaatctgtcgaggaagctttctactacattcacaacctcgttgttgcatgcgagattcaggtgaggaccctcgccagtgccggtggccctgacaatctggtgctgttaaaccctgagaagtacaaggccaaaagccgatccccaggaagtcccgtgggtgaaggtacaggcagtcccccaaagtggcaaatcggagagcaggaatttgaggcattgatgcggatgctggacaacctgggctaccggacaggttatccttaccggtatcccgctcttcgcgagaagtctaaaaagtatagtgatgttgaggtgccagcttctgttacagggtatagcttcgcatccgatggagactcaggcacttgtagtccattgcgacactcattccagaagcagcaaagggaaaaaacaagatggctcaacagcggtaggggggacgaggcaagcgaagaaggacagaacgggagctcgcccaaatctaagaccaagtggaccaaggaagacgggcaccgaacaagcactagcgccgtgcccaacctgttcgtaccactgaacacgaatcccaaagaggtccaagagatgaggaacaaaatcagagagcagaatcttcaagacatcaagactgcgggacctcaatctcaggtcctgtgtggagtggtgatggatcgctcattggttcaagacgcacccctttccgactgcactgaaactatcgaaggcctggagctgaccgaacaaacattttccccagcaaaatctcttagcttcaggaaaggggagttggtgacagcctcaaaggcgattattgaaaaggaataccagccacatgtaatcgtgtcgactaccggccctaacccgttcacaacactcacggacagagaacttgaagagtaccgtcgggaggtagagcgtaaacagaaaggaagcgaggaaaacttggatgaggccagagaacagaaggaaaagagcccccctgaccaacccgctgtgccgcatccacctccttcaacgcctataaaattggaagaaggtgatggctgtgcccgagagtatttacttccctag

SEQ ID NO: 213573 - DNA, 1989 bp, Artificial Sequence
  Description of Artificial Sequence: Synthetic coding sequence
atgaatggcgattcaagagccgctgtggttacatcaccacctccaactactgctccacacaaggagagatacttcgatcgcgtggatgagaacaaccccgaatatctgcgcgagcgcaacatggctcccgacctccgccaagactttaatatgatggaacaaaagaagagagtttctatgattcttcaatcccctgcattttgcgaggagctggagtccatgattcaagaacaattcaaaaagggaaagaatcccacagggctgctcgcgctgcagcagatcgcagacttcatgaccactaatgtgcccaatgtctaccctgcagcaccccagggtggcatggccgcactcaatatgtcacttggaatggtgaccccagtgaatgatttacgaggcagtgactcgatcgcatacgacaagggagagaaacttctgcggtgtaaactcgccgctttttaccggctcgcagacttattcgggtggagtcagctcatttataaccacataacaactcgcgtgaacagcgaacaggaacatttcctgatcgtgccctttgggttactctactccgaggttacggcgtctagcctggtcaaaattaatctgcagggcgatatcgtggaccggggttcaacgaatctgggagtgaatcaggccggtttcacactacactctgctatctacgccgctaggcctgacgttaaatgtgtggtgcatatacataccccggctggcgctgccgtatcagcaatgaagtgcggtctgctacctatatcccctgaggctttgtcactgggcgaagtggcataccatgactaccacggtatcctcgtggacgaagaggaaaaagtacttatccagaaaaatttagggccaaagagcaaagtactgatactgaggaatcacggtctagtcagcgttggcgagtctgtcgaggaagcattctattacatacataatttggtagttgcgtgcgaaatccaggtgaggacactggcttccgctggtggccctgataatcttgtcctgttaaatccagaaaagtataaggccaagagcagaagccctggaagtcctgtcggtgaaggaacaggatctccccctaaatggcagattggtgagcaagagtttgaagcactgatgaggatgctggataatttagggtaccggactgggtacccctatcggtatccagccctcagggagaagtccaaaaaatactctgacgtagaggttcctgcttctgtaaccgggtactcttttgcctcggatggagacagcggtacctgttcacccctaaggcactccttccaaaagcagcagcgtgagaagacccggtggctcaactccgggaggggcgatgaagcttccgaagaagggcagaatggctcctcacctaagtcaaagactaaggtctggactaatatcactcacgatcacgtgaagcctctgctccaaagtctgagctccggagtctgtgtgccctcttgcatcacaaattgtttgtggacgaaggaggatggacataggacatctacatcagctgttcccaacctattcgttcctttaaacaccaatccaaaggaagtgcaggaaatgcgcaataagatcagagagcagaacttacaagacattaagaccgccggaccacagtctcaggtgttatgtggggttgttatggataggtccttggtgcagggcgagctcgtgactgcgtcaaaggcaataatcgaaaaagagtatcaacctcacgtgattgtttcgacaaccggtcctaacccctttacaacacttacagacagagagctcgaggagtacagaagggaggttgaaaggaagcaaaaaggcagtgaggaaaacttagatgaggcgagggagcagaaagaaaagtcaccgcctgaccagcccgcagttcctcaccctcccccttccacacccattaaactggaggaaggtgacggatgcgccagggagtacttgttaccatag

SEQ ID NO: 213574 - DNA, 1203 bp, Artificial Sequence
  Description of Artificial Sequence: Synthetic coding sequence
atgaatggcgattcccgggcagcggttgttacctcccctcctccaaccaccgccccacataaggagcgatattttgacagagtggatgagaacaacccggagtacctccgcgagcgaaatatggccccagatctccggcaagactttaacatgatggagcagaagaagcgcgtctccatgattctccagtcccccgcattctgtgaggagctagaaagcatgatccaggagcagtttaagaaaggcaagaatccgacaggcctcctggccctgcagcaaattgctgacttcatgaccacgaacgtccccaatgtctatcccgctgcccctcagggcggtatggctgctcttaacatgagcctcggcatggtaactcctgtaaacgatttacgaggtagtgactctatagcatacgacaaaggagagaagctgttgaggtgcaagttagcagccttctatcggctggctgatctgttcggttggagccagctgatctataaccacattaccacaagggtcaacagcgagcaggaacattttctgatcgtgccatttggactcctgtatagcgaggtgaccgcctcatccctcgtaaagattaaccttcagggggacatcgttgatcgaggctccaccaaccttggagtcaatcaggcaggcttcaccctgcacagtgctatctatgctgcccgaccagatgtcaaatgtgtggtccacatacatacgccggctggtgccgctgtttctgcgatgaaatgcggcctattgcccatttcacccgaggccctctctcttggcgaggttgcgtaccacgactatcacgggattctggtggatgaagaggagaaggttctgatacagaaaaacttaggtcctaagtccaaggtgttaattttgcggaaccacgggctggttagcgtcggggagagtgtggaggaggcattttattatatacataatctcgtggtggcttgcgaaatccaggtgaggacactggcttcagccggaggcccagacaacttggtactgctcaaccccgagaaatacaaagccaagagccggtcgcccggttctccggtaggcgagggcaccggaagtccgccaaagtggcagattggcgaacaggaattcgaagccctcatgcgaatgctggacaacctaggctatcgcacaagtagctccggccgacgccaggatggctag

SEQ ID NO: 213575 - DNA, 1989 bp, Artificial Sequence
  Description of Artificial Sequence: Synthetic coding sequence
atgaatggagacagtcgggcagcagtggtcacctctccccctcctacaaccgctccccataaggaacgatactttgaccgtgttgatgaaaacaaccctgagtatcttcgcgaacgcaacatggctccggatcttcggcaagatttcaatatgatggagcagaaaaaacgggtctcaatgatacttcagagcccagccttttgtgaggaactggagtctatgattcaggaacagtttaagaagggcaagaaccccacaggattgcttgcactgcaacaaatagcagatttcatgacaactaatgttccgaacgtatatccagccgctccccagggcggaatggctgcactaaacatgagcttaggcatggtcacaccggtgaacgatttgagaggcagcgattccatagcctatgataaaggagaaaaactactcaggtgtaaactagccgcattttatcgcctggccgacctttttgggtggtcccagcttatttacaaccacattaccacgcgcgtcaattctgagcaagaacacttcctgatagtccctttcggcctcttatattcagaggtgaccgccagctcgctcgtgaagatcaatctgcagggggacatcgtggatcgtggaagtaccaacctcggcgttaatcaagcaggctttacactacacagcgccatctatgcggctcgccctgatgtaaagtgcgtagtgcatattcatacccccgcaggagctgccgtgtcagctatgaagtgcggcctattgccaattagtccagaagcactcagccttggcgaagtggcttaccatgactaccacgggatcctggtggatgaggaggagaaagtgctgattcaaaagaatctgggcccaaaaagtaaagtgctaattttacgaaaccatgggcttgtctccgttggagaatcggtcgaagaggcattctattatattcataatctcgtggtagcctgtgagatccaggtgaggaccctcgcatcagcaggtgggccagacaatctggtcctactgaatcctgagaaatataaagccaagtcccggagccctggtagccccgtgggcgaaggcacggggtcaccacccaagtggcagatcggcgagcaggagtttgaggcactgatgagaatgttggataatctgggctacagaaccggatacccttacaggtaccccgctctgcgcgagaaatctaaaaagtacagcgatgtggaagtgccggcaagcgtcacaggatattcatttgcatctgatggcgacagcggcacatgttcaccactgagacactcgttccagaaacagcagagagaaaagacaaggtggctcaatagtggaagaggagatgaggccagcgaagaaggccagaatgggtcatccccaaaaagcaaaacaaaagtgtggacgaatatcacccacgatcacgttaagcctctgctgcagagccttagttccggtgtatgcgtgcctagctgcatcactaattgtctgtggacgaaggaggatgggcaccgcacctcaacaagcgcagttcccaacctgttcgtacctttgaacactaacccaaaggaggtgcaggagatgaggaacaagatacgcgaacagaacttgcaagacattaagactgctggacctcagtcgcaggtgttgtgcggcgtcgtgatggatcggtctctcgtgcagggggaacttgtgaccgcctccaaggccatcattgagaaggagtatcaaccacacgttatcgtgagcaccacgggacctaaccctttcaccaccctcaccgatagggagcttgaggagtataggagggaggtagagcggaagcagaagggcagcgaggagaacctggacgaggcgcgtgagcagaaggagaaatcccctcctgaccagccggctgtgccgcacccgcctcccagcactcccatcaagctcgaagaaggggatgggtgtgctagggagtatctgttgccctag

SEQ ID NO: 213576 - DNA, 2214 bp, Artificial Sequence
  Description of Artificial Sequence: Synthetic coding sequence
atgaatggggactctagggctgccgttgtcacgagccccccacccaccacagccccacataaagagagatacttcgaccgggtcgacgaaaacaatcctgagtaccttcgggagagaaatatggccccagacttgaggcaggactttaatatgatggaacagaaaaaaagggtgagcatgatattacagagccctgcgttctgcgaagagctcgagtcaatgatccaggagcaattcaagaagggcaagaaccccaccggtttgctggctctgcagcagattgcagacttcatgactacaaatgttcccaatgtttaccctgccgctcctcagggcggtatggccgcacttaatatgtcattgggaatggtgactccagtcaacgaccttagggggtcagacagcatcgcctatgataaaggagagaagctgctgcgctgcaagctggcagccttctaccgccttgccgatctgttcgggtggtctcagctgatctacaaccatatcacaacgcgggtgaacagtgagcaggagcacttcctgattgttcctttcggactgctgtatagcgaggtgacagccagtagcctcgtcaagatcaacctacagggtgatattgtggaccgcggatccaccaacctgggagtgaaccaggcaggattcacgttgcactctgccatctatgctgcgagaccagatgtaaagtgtgttgttcatatccacacacctgccggagctgccgtgagcgccatgaagtgcggtttgctcccgatttcacctgaagccctgtctctgggagaggtggcgtaccacgattatcacggcatcttagttgatgaagaagagaaggtcctgatccagaaaaatctgggtccgaagtccaaggtgctcattctacggaatcatggcctcgtcagtgtgggcgagtccgtggaggaagccttttattacatacataacctggtggtggcatgcgagattcaggtgcggacgctggcttccgccggtggaccagacaacctggttctccttaaccctgagaaatacaaggccaaaagccgttccccaggctcccccgtcggagaaggaacaggcagcccgcctaagtggcaaatcggagagcaggaatttgaagctctcatgcgtatgctggataatctgggttacagaactggctatccgtaccgatatccagctctgagggaaaagtccaagaaatatagcgatgtcgaggtgcctgcttccgtaaccggatatagcttcgcgagcgatggggatagcggcacttgcagcccactcaggcattctttccaaaaacagcagcgcgaaaagacacggtggctaaactcaggtcgcggagacgaggcgtccgaggaaggccagaatgggtccagccccaagtccaagacaaagtggacaaaggaggatggacaccgcacaagcacatccgccgtccccaacctcttcgtcccactgaataccaacccgaaagaggtgcaggaaatgaggaataaaattcgggaacaaaacctccaagacattaagactgcgggaccccaaagccaggtgctttgtggagtggttatggaccgttccctggtgcagggtgaactggtaaccgctagcaaggcgattatcgaaaaggagtatcaaccacacgtgattgttagcacgacaggaccaaatccttttacgaccctgaccgacagggagctggaggaataccgtcgcgaggtggagcggaagcagaaaggctccgaagaaaatttagatgaggccagagagcagaaggaaaaatccccccctgaccagcctgccgtaccccacccaccgccaagcacccccatcaagctcgaagaggacctcgttccggagcccacaacaggcgatgactccgacgccgctacctttaaaccaaccttgcctgatttgagtccagatgaaccaagtgaagctttagggtttcctatgctggagaaggaagaagaggcgcaccgtcccccatctcccactgaagctcccactgaggctagcccagagcccgcaccagacccagcaccggtcgctgaagaggcggctcccagcgccgtggaggagggcgcagccgctgacccaggcagcgacgggtcccctggaaaaagcccgagtaaaaaaaagaaaaaatttaggaccccttcattcctgaaaaagagcaagaagaagtcagactcgtag

SEQ ID NO: 213577 - DNA, 2214 bp, Artificial Sequence
  Description of Artificial Sequence: Synthetic coding sequence
atgaacggggattctcgcgcagccgtggtcacttcccccccaccaaccacggcccctcacaaggagaggtacttcgacagggtagacgaaaataatccagagtacttacgggagcggaatatggcccctgaccttcgacaagactttaacatgatggaacagaagaagcgcgtgagcatgatcctccaatcacctgcgttctgtgaagagctggaatccatgattcaggagcagttcaagaaaggaaaaaacccgacaggtctgctagcccttcagcagattgcagacttcatgactacgaacgtacccaatgtctatccggctgcgccacaaggcggaatggccgcactcaacatgtctctgggaatggttacacccgtgaacgaccttcgcggttccgatagcatagcctatgacaaaggcgaaaagctgctgagatgcaagctggcagctttttacagactcgctgatctcttcgggtggagccagctgatatataaccacatcaccacccgggtgaatagcgaacaggagcactttctgatcgtgcctttcggcttactgtacagcgaggtgaccgcatcctctctggtgaagatcaatctgcaaggagacattgttgacagagggtctaccaacctcggcgtgaaccaggctggattcactttacattcagccatatacgccgctagacctgacgtcaaatgcgtcgtccatatccacacaccagcaggagcggcagtatctgccatgaagtgtggattactgcctatctccccagaggctctcagccttggagaagttgcttatcacgactatcacggcatcctggtcgatgaggaggaaaaagtgctcatccagaagaacttagggccaaaatctaaagtcttgattctcaggaaccatggactggtatcggtgggcgaatctgtcgaagaggcattctattacattcacaacttggttgtggcctgcgagattcaggtcagaacactcgcctctgccggaggaccggacaacctggtactgctgaatcccgagaagtataaagctaagagcaggtcaccgggaagcccggtgggcgagggaactgggtcccccccaaagtggcaaattggcgagcaggaatttgaagccctgatgcggatgctggacaaccttggataccggaccgggtacccataccgttacccggctttaagagaaaaatccaagaagtattcagatgttgaggtacctgcctccgtgaccggctattcgttcgccagcgatggcgacagtggaacctgctctcccctgagacactcctttcagaagcagcaaagagaaaaaactagatggctcaatagcggcaggggggacgaggccagtgaagaaggacagaatggttcaagtcccaaatctaaaaccaagtggaccaaagaagacgggcacagaactagtacctccgctgtacccaatctctttgtacccctgaacacaaatccgaaagaggttcaagagatgagaaacaagatccgcgagcagaatttgcaggacattaaaaccgcgggacctcagagccaagtgctgtgtggcgttgtcatggaccggtctctcgtccaaggtgagctggtgaccgcttccaaggcaataatcgagaaagaataccaaccacatgtcattgtctccaccacaggtccaaatccttttacaacactaactgaccgagagctggaggaatatcgccgagaggtggagaggaaacagaagggctcagaagaaaacctcgacgaggctagagagcaaaaggagaagtctcccccagaccagccagccgtcccgcacccccctccttcgactcccataaaactggaggaagatcttgtgccagagccaactaccggcgacgacagcgacgccgctacctttaaaccaacactgcctgatctttcccctgacgagccctcggaagcgttgggatttccgatgctcgaaaaagaggaagaggcccacaggcctcccagcccaacagaagctcccacagaagcctcgcctgaaccagccccagatcctgcacccgttgcagaagaggcagcaccttctgccgtggaggagggagccgcagccgaccctggaagcgatgggtcacccggaaaatcaccttcaaagaaaaagaagaagtttagaactccatctttcctgaagaaatcaaagaaaaagagtgactcatag

SEQ ID NO: 213578 - DNA, 414 bp, Artificial Sequence
  Description of Artificial Sequence: Synthetic coding sequence
atgaatggggactcacgggcagcggtggtcacctctccaccgccaaccacagccccacataaggaaaggtattttgatcgcgttgacgagaataacccagaatacttgcgggagcggaatatggcaccggaccttcgtcaagattttaatatgatggagcagaagaagagagttagtatgatactccagtctcccgcattctgcgaggaactagaatcaatgatccaggagcagtttaagaagggtaagaaccctacggggctgctagccctgcagcagatcgccgactttatgaccactaacgtacctaatgtgtaccccgcagcaccacaagggggtatggcagccttgaatatgagcctgggcatggtaacccctgttaatgatctccggggatcagatagtatcgcctag

SEQ ID NO: 213579 - DNA, 1899 bp, Artificial Sequence
  Description of Artificial Sequence: Synthetic coding sequence
atgaacggtgactccagagcggcagtggttacatccccccctcccaccaccgcacctcacaaagagagatactttgatagagtcgacgaaaacaacccagagtacttgcgagaacgaaatatggcaccagacttgcggcaggacttcaatatgatggaacagaaaaagcgggtgagtatgatcttgcagtctccagccttctgcgaagaactggaatctatgatccaggagcagtttaaaaaaggcaaaaatccaaccggtcttctggcactgcagcagatcgcggacttcatgacaaccaacgtcccaaatgtgtaccccgcagccccacagggcggaatggccgctttaaatatgtctctcggaatggttactcctgtgaacgacctccgtgggagcgatagtatagcttacgataagggtgagaagctgctccgttgcaagctggcagccttctaccgactcgctgatctgttcggatggtctcagctgatatacaaccacatcacaaccagggtgaattcagaacaggaacacttcctcatcgttccttttggcctgctatattccgaggtgaccgcctcaagcctcgtgaagatcaacctccagggcgatattgtagacaggggatctaccaatttgggcgtgaaccaggccggtttcacactccactcagccatttatgctgcccgacctgacgtgaagtgtgtggtccacattcatacacccgctggcgcagcagttagcgcaatgaagtgtggcctcctgccaatcagcccagaagcgctctcgctgggggaggtggcataccatgactaccacgggatcttggtggacgaagaggagaaagtgctgattcaaaagaacttgggccctaagtctaaggtgctgatccttaggaaccacggactggtttccgtgggagagtcagtggaggaggccttttattacatccacaatctggtcgtcgcctgtgaaattcaggtaagaaccctggcctctgccggaggaccggacaacctggtgttgctgaatccagagaagtacaaggcaaagagtcgaagcccagggtcccctgtcggcgaaggaacgggctcaccccctaagtggcagattggcgaacaggagtttgaagctctgatgagaatgctcgacaatctgggctaccggactggatatccatataggtacccagccttgagggaaaaaagtaaaaaatacagtgacgtggaagtgcctgcgtcagttactggctattcctttgcttcagatggagactcagggacttgttcgccactgagacactcctttcagaagcaacagcgggaaaagactcgctggcttaattccggtcggggtgacgaagcttcagaggagggccagaatgggtcttcccccaagagtaagacaaagtggaccaaagaggatggtcaccgtacctctacctcagctgttccgaacctgttcgtgcctcttaatacaaatcccaaagaggtgcaggaaatgcgcaataaaatccgggagcagaatctgcaggacatcaagacagcgggtccacagtcccaggtcctgtgcggagtggtgatggacagatcactggttcagggggaactggtaaccgcttccaaggcaatcatagaaaaggagtatcagcctcacgtgatcgtgtctactaccggtcctaatccattcaccaccctgaccgacagagagcttgaagagtaccggagagaggtggagagaaagcagaaaggctccgaagaaaaccttgacgaggctagagaacagaaggagaaatcacccccagaccagccggctgtgccacaccctccaccatcaacacctattaaattggaagaggccggagatggctgcgccagagaatacctcttaccctag

SEQ ID NO: 213580 - DNA, 1335 bp, Artificial Sequence
  Description of Artificial Sequence: Synthetic coding sequence
taggtacttatcctaaggaatcacggccttgtgtcggtcggcgagagtgtggaggaggctttttactatatccacaacctcgttgtcgcatgcgaaatacaggtgaggaccctggcctcagctgggggacccgacaacttagtcctgctgaaccccgagaagtacaaggctaaatctaggagtccaggaagccctgtgggtgaggggaccgggagtccgccaaagtggcagattggcgagcaggaattcgaggctttaatgcggatgcttgataacttgggatacaggaccggttacccttacagatatcctgctctgcgagaaaagtctaaaaaatatagtgatgtggaggtcccagcaagtgtgaccggctactcattcgcctcggacggtgacagcggaacctgctcccctctgcgccactcatttcaaaagcaacagcgtgagaaaaccaggtggcttaatagcggtagaggagatgaggcttccgaagaaggccaaaatggaagcagtccaaaaagcaagaccaaggtgtggacaaacattacacacgatcacgtgaaaccgctgctgcagagcctgagcagcggagtgtgtgtaccatcttgcatcacaaattgcttatggactaaggaagatggccacagaacgagcacgagtgctgtgcccaacttatttgtcccattgaatacgaatccgaaagaagtccaggagatgaggaacaaaatcagggagcagaacttacaggacattaagacagcgggaccacagtcccaggtgttatgcggggtcgtgatggacaggtcattggttcaaggtgagctcgtaacagcctcaaaggcgatcattgagaaggagtaccagccacatgttattgttagcacaaccggacccaatcccttcactactctgaccgatcgcgagctggaggaatacagacgagaagtggaacgcaaacagaaaggtagcgaggagaatcttgatgaggctagggagcagaaagagaagtctccaccggaccaacctgcagttccacatcctcccccaagtacccctattaaactggaagaggacctcgttccagagcctaccacgggcgacgatagcgacgccgcaacctttaaaccaacgctgccagacctgagcccggatgagccatctgaagcactgggcttccccatgctggagaaggaggaggaggcccaccgacctccgtctcccacagaagccccaactgaggctagtcctgagcctgcgccagaccccgcacccgtggctgaagaggcggcacctagcgcagtggaggagggcgcagcagcagaccccggtagttag

SEQ ID NO: 213581 - DNA, 2181 bp, Artificial Sequence
  Description of Artificial Sequence: Synthetic coding sequence
atgtctgaggaaacagtccctgaggccgcatcgcctccacctccccagggccagccttatttcgatcgctttagcgaggacgatcctgaatacatgcgactacgtaatcgagcagcagatttacgacaagatttcaacctcatggagcagaaaaagcgggtgactatgatcctgcagtctccctcttttcgggaggagcttgaggggttgattcaagagcagatgaaaaagggcaacaactcttcaaacatctgggccctgaggcagatcgccgatttcatggcatcaacttctcatgctgtctttcccaccagctcaatgaatgtgtcgatgatgacaccaatcaatgatcttcacacagctgactctcttaacctagccaagggcgagcgcctgatgcgctgtaagatatcctctgtatacaggctcctggatctatatggctgggcccagttatcagacacttatgttacgctccgcgtgagcaaggaacaggaccacttcctgattagccccaagggagtgtcctgtagcgaagtgactgcctcctccctgattaaagtgaacatccttggtgaggttgtggagaaagggagttcctgttttccagtcgacaccaccgggttttgtctccacagtgccatttacgcagccaggcctgatgtgcgctgtattattcacctgcacacaccagccactgcagccgtgtctgcgatgaaatggggattgctgccggtctctcataatgccctgctggtaggagacatggcttactatgactttaacggagagatggagcaggaggccgacaggatcaatctgcagaaatgtctcggccctacctgcaagatcctggttctgcggaaccacggagtggtggccctgggtgacaccgtggaagaggcgttttacaaaatctttcatttgcaggccgcttgcgaaatccaagtctctgccctgagcagcgctggcggtgttgagaacttgattctgctcgagcaagaaaaacatcgacctcatgaagtgggatccgtccaatgggcgggtagcacattcggcccaatgcaaaagtctcgcctgggtgagcatgagtttgaggctttaatgcggatgctggataatttgggatacagaaccgggtatacctatagacaccccttcgtgcaggagaaaacaaaacacaagagcgaggtagagattccggctactgtgactgccttcgtgtttgaggaagatggtgcacctgtacccgcacttcgccagcacgcccagaagcaacagaaggaaaagacccgctggcttaatactcccaatacctatttaagagtgaatgtcgctgatgaagtgcagaggtcaatggggtcgccacggccaaagaccacctggatgaaggcggatgaggtggaaaagtcatcatccggaatgcctattcgcattgaaaacccaaatcagttcgttccactgtacactgatcctcaggaggtgctggagatgaggaataaaataagggaacagaaccgacaggatgtcaagagtgcaggaccacagagccagctgttagcttctgttattgctgagaagtcgcgctcccctagcacagagtcccagcttatgtccaaaggcgatgaggacacaaaggacgattccgaagaaaccgttcccaatcccttctctcagctgactgaccaggaattggaggagtacaagaaggaggtggaacggaaaaagttggaacttgacggagaaaaggagactgccccagaagaacctggatccccggctaagtctgcccctgcctcacccgtacagtccccggctaaggaggcagaaaccaagtccccactggtctccccttcaaagtcacttgaggagggaaccaagaagactgaaacctcaaaggcggcaactacagaaccagaaaccactcagccagaaggcgtagtggtgaacggaagagaggaggagcaaactgctgaggaaatcctgagcaaaggcttgtcacagatgacaaccagcgccgacacggacgtcgacacctctaaagacaagacagagagtgtcacctcaggccctatgtctcctgaggggagcccctccaagagtccctctaagaaaaaaaagaagttccgaactccttccttcctgaagaaatctaagaagaaagaaaaagtcgaatcctag

SEQ ID NO: 213582 - DNA, 297 bp, Artificial Sequence
  Description of Artificial Sequence: Synthetic coding sequence
atgtccgaggagaccgtccccgaggcagcaagcccaccaccaccccagggtcaaccttatttcgataggttctccgaggatgatcccgaatacatgagattgagaaacagggccgcagacttgcgccaggatttcaatctgatggagcagaaaaagagagtcactatgattctacaatccccctcatttcgagaagaacttgaaggtctgatacaagagcagatgaagaaggagtataagaaagaagtggaacggaagaagctggagctcgacgcacccggatggttctcctcttag

SEQ ID NO: 213583 - DNA, 1764 bp, Artificial Sequence
  Description of Artificial Sequence: Synthetic coding sequence
atgtccgaggaaactgtccccgaagccgcttccccgcctcccccacagggccaaccttacttcgaccgtttctcagaggatgaccccgaatatatgcgacttcgtaatagggcagccgatctccgccaagattttaatctcatggaacagaagaagcgggtgacgatgattctgcagagcccctcatttagggaagaactggaaggcctcatccaggagcaaatgaaaaaaggaaataactcaagcaatatatgggcgttaagacagattgctgactttatggcctccaccagtcacgccgtgttcccaacatcttcgatgaatgtgtccatgatgacaccgattaatgacctgcatacagccgactccttaaatctggcaaaaggagagagattaatgagatgtaaaatctcttctgtgtaccgacttctggatctctatggctgggctcaactctccgatacgtacgtcacgctcagggtgagcaaagagcaggatcatttccttatatcccctaaaggcgtttcatgctccgaggtgacggcgagtagtctaataaaagtaaatattctgggtgaggtggtagagaaaggatcctcctgcttcccagttgatacaacaggattctgcctccacagcgccatttacgctgcccgacccgacgtcaggtgcattatccatctacacacaccagccacagccgcagtgagcgctatgaagtgggggctactcccagtgagccacaatgccctgttggtcggagatatggcctactatgattttaacggtgaaatggagcaagaagctgatcgaattaacctccagaagtgtctgggaccaacctgcaaaatcctggtcttgcgcaatcacggagtggtggccctgggcgacacagtggaggaagccttttacaaaatcttccatcttcaggccgcatgtgagatccaggtgtctgccctgagctcagcaggaggagtcgaaaacttgatcctgctggaacaggagaagcacagaccacatgaggtcggatccgtgcagtgggctggatctaccttcggcccaatgcaaaagagtcgattgggtgagcatgagtttgaagcattaatgcggatgctggacaaccttggctatcggaccggctacacatatcggcatccattcgttcaggaaaagaccaagcacaaatcagaggtcgaaatccccgctacagtcaccgcgttcgtgttcgaggaggatggagccccagtgcccgctttgcgacaacatgcccagaagcagcagaaagaaaagaccagatggttgaatactccaaatacataccttcgggtgaatgtggctgacgaggtccagagaagcatgggttcccctagacccaagacgacatggatgaaagccgacgaagtggaaaaatcctctagtggcatgcccatcaggatcgagaaccccaatcagtttgtacccctctatacggatcctcaggaagtgctggagatgcggaacaaaatccgtgaacagaatcgccaggatgtgaagtcagctgggcctcagtctcagctactggcctctgtgatcgcggaaaaatccagaagtccctccaccgagagccagcttatgtccaagggcgacgaggatacaaaggatgacagtgaggagactgtccccaatcccttctcacagctgaccgatcaggagcttgaggaatacaaaaaggaagtagagcgcaagaagcttgagctggatgcacccggatggttttcttcctag

SEQ ID NO: 213584 - DNA, 2181 bp, Artificial Sequence
  Description of Artificial Sequence: Synthetic coding sequence
atgtcggaagaaacggttccggaagcagcctctcctcccccaccccagggacagccatatttcgatcgtttctcagaggatgatcctgaatacatgcgacttaggaatagagcggctgatcttcgacaagactttaatctcatggaacagaagaaacgcgtcaccatgatcctgcagtctccctcctttagagaagaattggaaggacttattcaagaacaaatgaagaagggtaacaatagttctaacatatgggccttgaggcagatcgctgactttatggcctctacttcccatgccgtctttcctacttcttctatgaacgtatctatgatgacccccattaacgatctccacaccgccgacagcttgaacctggccaagggagaacgcctgatgaggtgcaaaatcagcagcgtctatcgcctcctggacctctatggttgggcccagttatcagatacctacgtgacactaagagtttctaaggaacaggaccactttctgatatcaccgaaaggtgtatcatgctctgaggtcactgccagttccctgataaaggtgaacatcttaggagaagtggtggagaaaggatcttcttgctttcctgtcgacaccaccggtttttgcctgcattccgccatctacgcagctcggccagatgtgcgctgtatcatacacctccacacacccgctaccgcagcagtctcagctatgaaatggggcctcttgcctgtctcccacaatgccttactagtgggcgatatggcttattatgactttaatggcgagatggagcaggaggctgacaggataaacttgcagaagtgcctgggaccaacttgcaaaatactggtgctgagaaatcacggggtcgtagctctcggcgataccgtggaagaggcgttctataagatcttccaccttcaggcagcatgcgaaatccaggtgtctgccctgtccagcgctggcggagttgagaaccttattctgctggagcaggaaaaacacagaccacacgaggtcggcagcgtgcagtgggccggaagtacgttcggccctatgcagaaaagtagactcggtgagcacgagttcgaggctctcatgaggatgctggataacctgggatatcgcaccggatatacctaccgccaccccttcgttcaggaaaaaactaaacacaaaagcgaggtggagataccagcaacagtcacagcatttgtgtttgaggaagatggggctcctgtgcctgcactgcgccagcacgcacagaagcaacaaaaggagaaaacccgttggctgaatacccctaacacatacctccgggtgaacgtggcagatgaggtccagcgctcaatggggtcacctcggcctaaaactacgtggatgaaggcggacgaagtggagaaatctagcagcggaatgccaatcaggattgagaatcctaaccagtttgtgcccctgtacactgacccccaggaagtgctcgagatgcgtaacaagattagagagcaaaatcggcaggacgtcaaatctgccggtccccagtcccagttgcttgcttctgtcatcgcagaaaagtcccgtagcccttctaccgaatcccagctcatgagtaagggtgacgaggacaccaaagacgactcagaagagacggtccctaatcctttcagtcaacttacggatcaagagctggaggagtacaaaaaggaagtggagcggaagaagctggaactcgatggagagaaagagacagcccctgaagagcctggctcacctgccaaatccgcccctgctagccccgtacaaagtcccgctaaggaagccgaaaccaagtcaccactagtcagcccctcaaaatccctggaggaagggaccaagaaaacagaaacaagcaaagccgcaacaacagaaccagagactacacagccagagggggtggttgtgaatgggagggaggaggaacaaaccgctgaggaaatactgtcaaaaggtctttcacagatgaccacgagtgctgacactgacgtcgacacttcaaaggacaaaactgaaagcgtaacgagtggcccaatgagtcccgaaggatccccaagcaaatctcctagtaaaaagaagaagaagtttcgtacaccaagctttctgaaaaaaagtaagaagaaggaaaaggtggagagctag

SEQ ID NO: 213585 - DNA, 2181 bp, Artificial Sequence
  Description of Artificial Sequence: Synthetic coding sequence
atgagcgaggagaccgtccccgaagccgcttccccaccacctcctcagggacagccgtatttcgaccggttctcagaggatgaccccgagtatatgaggttgcgcaaccgtgcagccgatttgcggcaggacttcaatctgatggagcagaaaaaacgggtgacaatgatccttcagagcccatcattcagggaagaattagaaggacttattcaggagcaaatgaagaagggaaataacagcagtaacatctgggcacttcggcaaatcgctgatttcatggcaagtacatctcacgcagtcttccccacttcatcaatgaatgtatccatgatgacaccaatcaatgatcttcatacggccgattcactcaatctcgccaagggagagcgcctcatgaggtgtaagatctcctctgtctacaggttactggatttgtacggctgggcccagctctctgacacgtatgtcacgctccgagtgtctaaagagcaagaccactttctgatttcccctaagggtgtgtcttgctcggaggtgacagcctcaagtctgatcaaagtgaacatactgggtgaggtggttgaaaaaggtagttcatgtttcccggttgatacaacaggtttctgcttacattccgctatctatgctgctcgtcccgatgttcgctgtataatacacttgcacactcctgccacagctgcagtatcagcaatgaaatggggcctactccctgtctctcataacgctctcctagttggggatatggcttactacgactttaatggagagatggaacaggaagccgacaggataaatctccagaagtgtctgggaccaacatgcaagatcctggtcctgaggaatcacggcgtggtggcccttggcgacaccgtggaagaggcattctacaagattttccatctgcaagccgcatgtgagatccaagtgtccgccctttcgtcagcgggaggggttgaaaatcttatccttctggaacaggagaaacatcgaccccatgaagttgggtccgtgcagtgggccggatcaacattcggccctatgcagaagagcaggctgggggaacatgaatttgaagccctgatgcgcatgctcgataacctcggttatcggacagggtacacttataggcacccttttgtacaggaaaaaaccaaacacaaatcagaggtggagatccccgctactgtgacagcttttgttttcgaggaggacggagccccagtgcccgctctgcgccaacacgcgcaaaaacagcagaaggagaaaactcgatggctcaacacaccaaatacataccttagagttaacgttgcagatgaagtgcagagaagtatgggctctcccaggcctaaaacaacctggatgaaagcagatgaggtggagaaatctagctccggaatgcctattaggattgagaatcccaatcagtttgtgcctttatatacagatccccaagaagtgctggagatgcgaaacaagattagagaacagaaccgccaagatgtgaagtcagccggaccgcagagccaactcctggcctcagttatcgccgagaaatcaagatctccttcaactgaatcacagttgatgtcaaaaggggatgaagacacaaaagatgatagtgaggaaactgtcccaaacccattctcccagttgactgatcaggagttggaggagtacaagaaggaggtcgagaggaaaaaattggaactggatggggagaaggaaacagctccagaagagccaggatcgcccgctaagtccgcgcctgccagtcccgtccagtccccagctaaggaagccgagacgaagtcacctctagtgtctccatccaaatccctggaggaggggacaaaaaagaccgagacaagcaaggccgctaccacggagcctgaaaccacacagccagaaggcgttgtagttaatggccgagaggaagaacagacagcggaagaaattctgtccaaaggactgagtcagatgaccacctcagccgatacagatgtggacacatctaaggacaagacagaatccgtcactagcggacctatgtctccggaggggagtccatccaaatccccctctaagaaaaaaaagaagttcaggacccccagctttctcaaaaagtcaaagaaaaaggagaaggtggaaagttag

SEQ ID NO: 213586 - DNA, 1680 bp, Artificial Sequence
  Description of Artificial Sequence: Synthetic coding sequence
atgtccgaagaaacggtccccgaagctgccagccctccaccacctcagggccagccttatttcgaccgctttagcgaggacgacccagagtatatgcgcctgaggaacagggccgcagacctgcgccaggacttcaaccttatggaacagaagaagcgtgttacgatgatactccagagcccgtccttccgcgaggaactggaagggttgattcaggaacagatgaagaaggggaacaattcttccaacatatgggccctccgccagattgctgacttcatggcctcaacctcacacgccgtgttcccaacgagttccatgaatgtatccatgatgacccccattaatgatctgcacacggccgactcgctcaacctggcgaaaggagaaaggctgatgcggtgtaagattagctcggtctaccggctattagatctgtacggctgggctcagctctccgacacctatgtgaccctgagggtgagtaaggagcaggaccacttcctgatctcccctaagggagtaagttgctcagaagtgacagcatccagtttaatcaaggtgaacatcttaggtgaagtcgtcgagaaaggatcctcatgcttcccagtggacaccaccggattctgtttgcactctgcaatttatgcagccagaccagacgtgaggtgcattatacacctgcatactcccgctaccgccgcagtgtctgcaatgaaatgggggctcctccccgttagtcataacgcactgttggtgggagacatggcttactatgacttcaacggggaaatggagcaagaagctgataggattaaccttcagaagtgcttgggccctacctgtaagatccttgtattacgcaatcatggcgtggtagccctgggcgatacggtcgaggaggcattttacaaaatcttccacctccaggctgcgtgtgaaattcaggtctctgccctatcatccgccggtggtgtggaaaatctgatcctgttagaacaagaaaaacatcggccacacgaagtcggctcagtccagtgggcaggcagcaccttcgggccaatgcagaaaagcagattgggggagcatgagtttgaagctttgatgaggatgctggacaacttgggatatagaactgggtatacgtatagacatccattcgtacaggagaaaacgaaacacaaaagcgaagttgagattcccgctaccgtgactgcttttgtattcgaagaagatggcgcacctgtgcccgctctgaggcagcacgcccagaagcagcagaaagagaagacacggtggttgaatactccgaacacttacctgcgggtgaacgtggcagacgaagtacagcggagcatgggatctcctcgccctaaaacgacttggatgaaagccgatgaagtggagaaatcaagttccgggatgcctatcaggatcgaaaacccaaaccagttcgtgcctctttatactgatccccaagaagttctggaaatgcgcaataaaatcagggagcagaacagacaggacgtaaaatccgctggaccacaatctcagctcctcgcaagcgtgatcgccgagaagtcaaggtcacccgtggaacagcgcttacccctgaccggcggagaaacatgcctaccttccggaagttccgttcccggtgccggactccaagacccttag

SEQ ID NO: 213587 - DNA, 681 bp, Artificial Sequence
  Description of Artificial Sequence: Synthetic coding sequence
atgtcagaagagaccgtgcctgaagccgcttcgcctccacctccccagggacagccttacttcgacaggtttagcgaagacgaccccgagtatatgagactccggaaccgtgccgctgatctcagacaggatttcaacctcatggagcaaaaaaaacgtgttaccatgatactccaatccccgtccttcagggaggagctggagggccttatccaggagcaaatgaaaaaaggtaacaattcaagtaacatatgggcgctcaggcaaatcgccgatttcatggcgtctacctcccacgcagtgtttcccacaagttcgatgaacgtcagcatgatgacgcccataaatgacctgcacactgccgacagtctcaatctggccaagggggaacggctgatgaggtgcaaaatcagctccgtgtacagactgttagatctctatgggtgggcccagttgagcgacacatatgtaaccctccgtgtgagcaaggagcaggatcacttcttgatcagtccaaagggggtgagctgcagcgaagttaccgcatcctccctgatcaaggttaacatcctcggcgaagtagtggaaaagggctccagctgcttccctgtggacaccaccggcttctgtctacattccgctatttatgctgctcgcccagatgtgcggtgcatcatatag

SEQ ID NO: 213588 - DNA, 432 bp, Artificial Sequence
  Description of Artificial Sequence: Synthetic coding sequence
atgtcagaggagactgtgcctgaagctgcctcccctccccctccacagggacagccttacttcgatcgattcagtgaagacgatccggagtacatgaggctgcgaaatcgagccgcagatctccggcaggactttaacctgatggagcagaagaagagggttactatgattctccagtccccatcttttcgggaagagcttgagggcttaattcaggagcagatgaaaaaagggaataacagcagcaacatttgggccctgcggcagatcgccgactttatggcatcaacctctcacgcagtcttccctacctcaagtatgaatgtcagcatgatgacgcctatcaatgacctgcacaccgctgatagcctgaacctggccaaaggtgaacggttgatgcggtgcaaaattagctccgtgtatcgcttatag

SEQ ID NO: 213589 - DNA, 1728 bp, Artificial Sequence
  Description of Artificial Sequence: Synthetic coding sequence
atgcccaggagaagagtcccgggtgccaactgcaaaccaaccggtaagatgtcagaggagaccgtgcctgaggccgcttccccaccacccccacaaggtcagccctacttcgaccgcttcagcgaggacgaccctgaatacatgcggctcagaaatcgtgccgctgaccttcggcaggactttaaccttatggagcaaaaaaaaagggtgaccatgattcttcaatccccttcgttcagagaggaactagaggggcttatccaggaacagatgaaaaaagggaacaattcatcgaatatctgggccttaagacagattgcggactttatggcctccacatcacacgcggtgttccctacaagttcaatgaatgtctccatgatgactcctatcaatgatctccatacagctgattctcttaacctggccaagggcgagcgattaatgcgctgtaaaatcagctccgtgtaccgattattggatctttatggatgggctcagctgagcgatacatacgtcactctccgggtgagtaaagaacaggatcactttctgattagccccaagggagtgtcctgtagcgaagtaaccgctagctccctgattaaagtgaacatcctcggcgaggtggtagaaaaaggcagctcttgctttccagtagatactaccggattctgtttacatagcgcgatttatgctgcccgaccagatgtgcggtgcatcatccacttacacactcccgcaaccgctgccgtcagtgctatgaaatggggactgctgccagtttcccacaacgcacttctggtgggtgacatggcctattacgactttaacggtgagatggagcaggaggcagataggatcaatctccagaagtgcctgggacctacctgtaagatccttgtgctgagaaaccatggagtcgtggccctgggagacactgtggaggaggccttctataagatcttccacctccaggccgcatgtgagatacaggtcagcgcactctcctctgccggaggcgtagagaatttgatcttactggagcaagaaaagcatcgaccccatgaagtgggctcagtgcaatgggccggatctacatttgggccaatgcagaagagcagactcggggagcacgaatttgaggctctgatgcgaatgctggataacttgggataccgaacaggctatacataccgccatccttttgtgcaagagaagaccaaacacaagtcggaggtcgagatcccggctaccgtcaccgcattcgtttttgaggaagacggtgcacctgtccccgcactgaggcaacatgcccagaagcagcagaaggagaaaacaaggtggctgaacacgccgaacacttacctgcgggttaacgtggcagacgaggtccagagaagcatggggtctcctcggccaaagacaacgtggatgaaagcagatgaagtcgaaaagagcagctctggcatgccgatacgaatcgaaaaccccaaccagttcgttccactgtatacagatccccaagaggttctcgaaatgaggaataagatcagagaacagaacaggcaggacgtgaaaagtgcaggtccacagagccagttactggcttccgtaattgctgaaaagagtcgcagtccagtcgagcagaggcttcctctgacaggtggcgagacatgtctacctagtggctcatccgtacctggagctgggctgcaggacccatag

SEQ ID NO: 213590 - DNA, 54 bp, Artificial Sequence
  Description of Artificial Sequence: Synthetic coding sequence
atgtccgaagagacggtacctgaagccgcatccccccctcctccacaggggtag

SEQ ID NO: 213591 - DNA, 846 bp, Artificial Sequence
  Description of Artificial Sequence: Synthetic coding sequence
atgagcgaggaaactgttcctgaagccgctagcccccctccaccccaaggacaaccctatttcgaccggttcagcgaggacgaccctgaatatatgaggctcagaaaccgtgcagcggacttgagacaagattttaatttgatggagcagaagaaacgggttacaatgattctccagtccccatcctttagggaagagctggagggcctcattcaagagcaaatgaaaaaaggcaataacagttcgaacatctgggccctacgacagatcgctgactttatggcctcaacatcccatgcagtgttccctaccagcagtatgaacgtgtctatgatgacacccattaatgatctgcacaccgcagactccctgaacctggccaaaggagagcgtctgatgaggtgcaagatatcctccgtgtatcggttgttagacctgtatggttgggcacaactttctgacacatacgtgactctgagagtgtctaaggagcaggaccattttctaatctctcctaaaggcgtgagctgtagtgaggtgacagctagctcgctggtgagtgaggtgctcgagatgcgcaacaagatccgcgaacaaaacaggcaggatgtgaagagcgcaggccctcaatctcagctgttggctagcgtgatcgccgagaagtcccgcagcccaagtaccgagtcccagctcatgtcaaaaggcgacgaagacacaaaagatgattccgaggagaccgtgccgaacccattcagccagctgaccgaccaagagttggaggagtataaaaaggaggtggaacggaaaaagcttgaactggacgcccctgggtggttctcaagctag

SEQ ID NO: 213592 - DNA, 1932 bp, Artificial Sequence
  Description of Artificial Sequence: Synthetic coding sequence
atgagtgaggagaccgtgcctgaggccgcatctccaccccctcctcagggtcaaccatacttcgaccgctttagcgaggatgacccggaatacatgaggctgcgtaatcgcgcagcggaccttcggcaggactttaacctgatggaacagaagaagagggttactatgatcctgcagtccccctccttcagggaggaactggaaggacttatccaggaacagatgaagaaagggaacaacagctcaaacatttgggctcttagacagatcgcagactttatggctagcacttcccatgccgttttccctacatcctcgatgaacgtttcaatgatgaccccaatcaacgacctgcacacggcagatagcttaaatctggccaaaggggagaggcttatgcgctgtaagatctcttccgtataccgtcttctggacctctacgggtgggcccagctatccgatacttatgtcacactcagagtgagcaaagagcaagatcactttcttatctcccctaagggcgttagctgttctgaagtaaccgccagctcattaatcaaggtgaatatcctgggagaagtggtggaaaaaggcagttcctgctttccagtggacacaaccggattttgccttcactccgccatctacgccgcacgtccagacgtacggtgtatcattcacttgcacacaccggctacggcagcagtgagcgccatgaagtggggcctacttccggtatcccacaatgcccttttggtcggcgatatggcgtactacgacttcaacggtgaaatggagcaggaggctgaccgaattaacttacagaagtgtttgggccctacctgcaagatcctcgtgttgcgaaaccacggagtggtggccttaggtgatacagtcgaggaggccttctacaagatttttcacctgcaagctgcctgcgagattcaggttagcgccctttcctcagccggtggcgtggaaaatctcatcctgctggagcaggagaaacatcggccacacgaggtcggctctgtccagtgggccggatccacttttggtcctatgcagaagagcagattgggcgagcacgaattcgaggcgcttatgcgtatgctcgacaacctagggtaccgcacaggatacacctatagacaccctttcgtccaggagaaaaccaagcacaaatccgaggttgaaatcccagcaacagtgactgctttcgtgtttgaagaggatggtgctcccgtgcccgcactcaggcagcacgctcaaaagcagcagaaagagaaaacgcggtggctgaacacccctaacacttacttgagagtgaatgtggcagatgaggtccagcgctctatgggctcacctagacctaaaacaacctggatgaaggccgacgaggtggagaagagcagctccggcatgcctataagaatcgagaacccaaaccagtttgtgcctctgtacacagaccctcaagaggtgctggagatgcgtaacaagatccgcgaacagaacagacaagacgttaagtcggcaggtcctcagtctcagctgttagcctcagtgattgcagagaaaagcagaagcccctccacagagagccagctcatgtcaaaaggagacgaagacactaaagacgatagcgaagagaccgtacccaatcctttttcccagctgaccgaccaagaactggaggaatacaagaaggaggtggagaggaaaaagctggaactggatgagacgggccaggaaagagagccgggttctggtcccgctgtgtgcgagtttttctcagtggcactgcacatttggagcaatattctggaacgcaagaagctgcctcagaaaagcctggctcacttgcagagcctgcacctgctgttacagtgccgagcacaaaggcgccgacagcgccagagagccttgtag

SEQ ID NO: 213593 - DNA, 2025 bp, Artificial Sequence
  Description of Artificial Sequence: Synthetic coding sequence
atgtcttcagatgcatcacagggtgtaatcacgactccaccgcctccaagcatgcctcacaaagaaagatattttgaccgaatcaacgagaacgatcctgagtacattcgggagcgaaatatgagtccagatctccggcaggatttcaacatgatggagcagcgaaagagggtgacgcagattttgcagtcacccgcatttcgagaggacctcgagtgtctgatccaggaacagatgaaaaagggccacaacccgactgggctactggcgctgcagcaaatcgcagattatattatggctaactcctttagcggattctcctcccccccattaagcctgggtatggttacaccaatcaatgacctgcccggagccgatactagttcatacgttaaaggtgagaagcttactaggtgtaagcttgcatctttatatcgccttgtcgatttgttcggatgggcccatctggctaatacatacatctctgtgagaatctcaaaggaacaggaccacattatcatcattcccaggggactatccttctccgaggcgactgcaagcaatctggtaaaggtgaacattattggtgaagtggttgatcagggctcaaccaatctaaagattgaccacaccggtttcagccctcacgctgccatctattcgaccaggcccgacgtgaagtgcgttatccacatccacacattggcaactgctgcggtaagctccatgaagtgtgggatactccccatatctcaggagagtctgctcctaggggatgttgcctactacgattaccagggctcactagaagaacaggaggaaaggatccaactgcagaaggtcctcgggcctagttgtaaagtgctggttctgaggaaccacggcgtggtcgcactcggggaaactcttgaggaagctttccactacatcttcaacgttcagcttgcgtgtgagatccaggtacaggccctggcgggtgcgggaggtgttgataatctacatgtgctggattttcagaaatataaagcattcacctacaccgtggccgctagcggcggaggcggagtgaatatggggagccatcagaagtggaaagtcggcgaaatcgaatttgagggactgatgaggaccctcgacaacctcggttaccgcacaggttatgcatacaggcaccccctgatcagggaaaagccccgacacaagagcgacgtggaaattcctgctactgtgacagcctttagcttcgaggacgacaccgtccctctgtcacccctgaaatatatggcccaacggcagcaaagggaaaagacaagatggttgaattcaccaaacacttatatgaaggttaacgttcctgaggagtcacgcaatggggaaacatcacccaggacaaagattacttggatgaaagccgaggactcgagcaaagtgtccggtggaactccaatcaagattgaggatcccaatcaattcgttcctcttaacaccaacccgaacgaggttcttgagaaaagaaataagatcagagagcaaaataggtatgacctaaaaactgccggtcctcaatcacagctcctcgctggtatagtggttgacaaaccgccatcgaccatgcagtttgaagatgacgatcacggacctcccgcaccacctaaccctttcagtcacttaactgaaggtgaactggaagagtataagaggacaattgaacgcaagcagcaaggactcgaggaaaaccacgaattattctccaagagttttatcagcatggaagttccggttatggtggtaaatggaaaggatgacatgcacgacgtggaggacgagctagccaaaagggtctccaggctgagcacaagtaccactattgagaatatcgagattacaattaaaagcccggagaaaattgaggaagtcctgtcacccgagggatccccatctaaaagcccatccaaaaaaaaaaaaaagtttcgcacaccctccttccttaaaaaaaataagaaaaaggaaaaagtggaagcgtag

SEQ ID NO: 213594 - DNA, 2121 bp, Artificial Sequence
  Description of Artificial Sequence: Synthetic coding sequence
atgtccagcgatgcctctcagggcgtgattacaacacccccaccaccatctatgccccataaggaaagatacttcgacagaatcaacgaaaatgatcctgagtacatacgcgaaagaaacatgtcgcccgacttacgacaggatttcaacatgatggagcaaagaaagcgcgtgacccagatcttgcagtcccctgcatttcgcgaggatcttgagtgtctcatccaggaacagatgaagaagggccataatcccactggtctgcttgctctccagcagattgcagattacatcatggccaattccttttccggattcagttccccccctttgagcctgggaatggtgacaccgattaacgatctccctggcgctgatacaagtagttacgttaagggcgaaaagttgacaaggtgtaaattagcatccctttacagactcgttgatctattcggatgggcacacctggcaaatacctacatctcggtgcgcatctcgaaagaacaggatcatatcattatcattccacgaggtttatcattttcagaagccacggcttccaacttggttaaggtcaacattatcggggaagtcgttgaccagggctcaaccaatctgaaaatcgatcatacaggcttcagccctcacgccgcaatctattccacgcgtccagacgtgaaatgtgtcatccacattcatacattagcgactgccgctgtctcttctatgaaatgtggaatcctgccaatctctcaggaatctctacttttgggcgatgtggcatattacgactaccagggatctttggaggagcaggaagaacgtatacagctccagaaagtgctgggacccagctgtaaggtattagtgcttcgcaatcatggcgtggttgccctgggcgaaacattggaagaggcttttcattatatctttaacgtgcagctggcctgtgaaatacaggtccaggcattggccggtgccggaggggttgataatctgcacgtgctagattttcagaaatataaagccttcacctacaccgtagctgcgtccgggggaggaggggtgaacatgggcagccaccagaagtggaaagtgggagaaattgaatttgaaggactgatgcgcacccttgataacctgggctacagaacggggtacgcctatcggcatccgctgatacgagagaagcctcgtcacaagagcgatgtggaaatcccggcaacggtcacagctttcagttttgaggatgacaccgtgcctcttagtccacttaaatacatggcacaaaggcagcagagagaaaagacccgctggttgaattcccctaacacttatatgaaagtaaatgtgcccgaagagagccgaaacggagaaacttctccgaggacaaagattacatggatgaaggcagaggactcatctaaagtatccggcggaacaccaattaagatcgaagatcccaaccagttcgtccctcttaataccaatcccaatgaagtcttagagaaacgtaacaagattcgggagcagaaccgctatgacctaaagacagccggtcctcagtcccagctgctggcgggaatcgtagtcgacaagcctccctcgactatgcagttcgaagacgacgaccatggacctccagcacccccaaacccctttagccacctgaccgaaggggaactcgaagagtacaagcgaactatcgagcgtaaacagcaggggctggaggacgccgagcaagagttgctctctgacgacgcttccagtgtgagtcagatccagtcgcaaacacagtccccacagaacgtgcccgaaaaacttgaagaaaaccacgaactgttttctaaatctttcattagcatggaggtaccggttatggtagttaatggaaaagatgacatgcatgacgtagaagatgaactcgcaaaacgagtctcaagactctctactagcacgacaatcgagaacatagagatcaccatcaagtctccggaaaagatcgaggaagtccttagtccagagggttctccatccaagagcccgagcaagaagaagaagaaattcaggacgcctagcttcctaaagaagaacaaaaaaaaagagaaggtggaagcgtag

SEQ ID NO: 213595 - DNA, 2025 bp, Artificial Sequence
  Description of Artificial Sequence: Synthetic coding sequence
atgtccagcgacgctagtcaaggtgtgatcaccactccccctcctccttcgatgccacacaaggaacgatatttcgaccggataaatgaaaatgatccagaatatattcgggaaaggaacatgtcccccgatcttcggcaggacttcaatatgatggagcagaggaagagagttacccagattcttcagtcccctgcttttagagaagacttggagtgcctcatacaggaacaaatgaagaaaggccataaccctaccgggttgcttgcgcttcagcagatcgcggattacatcatggcaaactcttttagtggcttctcttctcctccgctaagcttaggcatggtgacacccatcaacgacctgccgggagccgatacttcttcctacgtgaaaggagaaaagctgactcgctgtaagttggcaagtctgtatcgcctggtggatctgttcggctgggcccacctagctaacacctatattagtgtgcgtatatctaaggaacaggaccatataatcattattccccgtggccttagcttctcagaagctactgcatcaaaccttgtgaaggtcaacattatcggggaggtggttgaccagggctccacaaacctgaaaatcgatcacacagggttcagtcctcatgccgcaatttattcaacgcggccagacgtgaagtgtgtgattcacatccacactctcgctactgccgcagtgtcgagcatgaaatgtggcatcctgcccatttcgcaggagagcttgctgctgggcgacgtggcatattacgattaccagggctccctggaagaacaagaagaacgaattcagcttcagaaggtcctgggccctagctgcaaagtgctggtgttgagaaaccatggcgtggtagcccttggggagaccctggaggaagcatttcactatatctttaatgtacagctggcctgcgagatccaggtccaggccttggctggagccggaggggtcgacaatctgcacgtgctggattttcagaagtacaaggccttcacctatacagttgccgcttccggagggggaggcgtgaatatggggagtcaccagaagtggaaagtaggggaaatagagttcgaggggctgatgcgcactctagacaatctgggttaccgaacgggttacgcctatcggcacccccttattagggaaaagccaaggcacaagagcgacgtggagatcccggctacagtgacagccttctcatttgaggacgatacagtaccgctctctcctctaaagtatatggcacaaaggcagcagcgggagaagacgcggtggctcaatagcccgaatacctacatgaaggtcaacgttcctgaggagtcacgcaacggcgagactagtccacgtactaaaatcacttggatgaaggcagaggactcctccaaagtcagtggcggtacaccaattaaaatcgaggatcctaaccaatttgtgcctctaaacacaaatcccaatgaggttctggagaaaaggaacaaaattcgcgagcaaaatcgatacgatctcaagacagccggaccccagagccagttgcttgctggaattgtggtcgataagcctccgagcaccatgcagttcgaagacgacgaccacggccctcctgccccacctaaccccttctcacatttaacagaaggggagctggaagaatacaagcggacaatagagcgcaaacagcagggcctggaggagaatcatgaactcttttctaagagctttattagtatggaggtgccagtcatggtggtgaatggcaaggacgacatgcacgacgtcgaggatgagctggcaaagagggtgtctcgcctctcaaccagcacaaccatcgagaacatcgaaataacaatcaaaagtccagaaaaaatagaggaggtgctatctcccgagggctccccgagcaaaagtccatctaagaaaaaaaaaaaattcaggaccccatcttttctcaagaaaaacaagaaaaaggaaaaggtagaggcctag

SEQ ID NO: 213596 - DNA, 543 bp, Artificial Sequence
  Description of Artificial Sequence: Synthetic coding sequence
atggctgacagcgagctgcagttagtggaacaaagaatcagaagcttcccggacttccctacgcccggtgtcgtgttcagggacatatcccctgtcttaaaggatcccgcatcatttcgcgcagcgatcgggctgctggccaggcatcttaaggcgacacatggcggtaggatcgactacattgctggcctggacagtcgcggttttctttttggcccaagtttagctcaggagctgggcctcggctgtgtcctcattcggaaacgcggtaagttaccagggccaaccctgtgggcgtcttatagcctggaatacgggaaagccgagctcgaaatacagaaagatgccctcgagcctggacaacgggtcgtagtcgtggatgacctgctggcaaccgggggtacaatgaacgccgcatgtgagttgctgggtcgcctgcaagcagaggtgctggaatgcgtgagtctggttgaactgactagtctgaaggggagggagaaacttgcgcctgtgccgttttttagcctgctgcagtatgaatag

SEQ ID NO: 213597 - DNA, 405 bp, Artificial Sequence
  Description of Artificial Sequence: Synthetic coding sequence
atggccgattccgagctacagttggtggagcaacgaattcgaagtttccctgacttcccaacgcccggagtggtctttcgggacattagtccagtgctgaaggatcctgcttcgtttagagccgctatcgggctccttgccaggcatctcaaagcgacacatggtggccgaatcgactacattgccggtctggacagcaggggattcctgtttggaccctccctggctcaggagctggggctcgggtgcgtgctgattcgcaaaagggggaaattacccggtcccactctgtgggcatcctattcattagaatacgggaaggcggaactggaaattcaaaaagatgctttggaacccggtcagagggtagtggtcgtggacgacttactagctacaggcgtatag

SEQ ID NO: 213598 - DNA, 555 bp, Artificial Sequence
  Description of Artificial Sequence: Synthetic coding sequence
atggatgggctgcggcaacgtgtcgaacacttcctggaacagaggaacctagtcaccgaggtgctgggtgccctcgaggctaaaacaggcgtcgagaagaggtacctggccgctggagccgtcacccttctgtccctttacctgctttttggatacggcgctagtctcctgtgtaacttaattggcttcgtgtatcctgcatatgcaagcatcaaggccatagagtcgccgtctaaggacgacgacaccgtgtggttaacatattgggttgtttatgcccttttcgggctggctgaattcttctcagacctgttgctgtcttggtttccattctactatgttgggaagtgcgcttttctgctattttgcatggccccaaggccgtggaacggtgcgttaatgctgtaccagagggtggtgcgaccgttattcttgcggcaccacggagccgtggatcgaataatgaatgacctcagtgggagagcactggacgctgctgcagggattaccaggaacgtaaaacctagtcagacaccccagccaaaggacaaatag

SEQ ID NO: 213599 - DNA, 6090 bp, Artificial Sequence
  Description of Artificial Sequence: Synthetic coding sequence
atggcttcctctgttgccccttacgaacaactcgtgcggcaggtggaagcattaaaagctgaaaattcgcatctccggcaggagcttcgtgataactcctcccatctgtccaaattggaaacagagacatccggaatgaaggaggtcctcaagcatctacaagggaaactcgaacaggaggctagggttctggtgagtagcggccaaacagaggttttggagcaacttaaagctttgcagatggacatcacctcgctgtacaacctaaaattccagcccccaactctggggcctgaaccagccgctcgtacccccgaggggagcccagtgcatggcagcggcccttctaaagactcctttggggagctttcacgagccacaattcgcttactagaggagcttgaccgcgagcggtgctttctcctcaatgagatcgaaaaggaggagaaagaaaagctctggtactatagccagctccaaggcctgtccaaacgcctggatgagctccctcacgttgactatgagatgcacaagatgactcgggatcctcttaacttggccttgcgcagatatgctggaatgacactcaccaatctgacatttggtgacgtagcaaacaaggccaccctctgcgcccgacggggttgtatggaagccatcgtcgcacagctcgcctctgactcggaggagttacatcaggtggtgagcagcatcctgcgcaatctttcctggcgagctgatatcaactcaaagaaggtcttacgcgaggcaggctctgttactgcgttagtccagtgcgtcctgcgcgctaccaaggaaagcaccctgaagtcggtgttgagtgcgctgtggaacctgagcgcccattccactgaaaataaagcggctatttgtcaagtagacggtgcactcgggtttctggtgtcaaccctgacttataaatgccaatcgaacagcctagccatcatcgaatccggaggaggaatcttgcggaatgtatcttcactggtggctacacgagaggattaccgccaggtccttcgcgatcataattgccttcagacactgctacaacacttgacttcgcacagcctgaccatagtaagcaatgcctgtggcacactctggaacctcagtgctaggtccgcccgtgaccaggaactcctatgggatctcggtgccgtggggatgctccggaatctcgtgcattcaaaacacaagatgattgccatggggagcgccgctgcccttaggaacctgctcgcacacaggcctgccaagcaccaggctgccgcaacagccgtgagcccgggttcatgcgtgccctccctgtatgtgcggaaacagcgcgctctggaggccgaactcgatgctcggcaccttgcacaggctttagagcacctcgagaaacaggggcctcctgccgctgaagccgcaaccaagaagcccctgcctcccctgaggcacctcgatgggctcgctcaagactatgcaagcgattccggctgcttcgacgacgatgacgcgcctagctctctggcagccgcagcagctacgggtgagccagcctcaccagcagcgctcagtttgttccttggttccccattcctgcaggggcaggctctggccagaacacctcccaccaggagaggtggtaaagaggccgagaaggacacatccggcgaagccgcagtggcagcaaaggcgaaggctaagctcgctctcgcagtcgctcggatagaccaactggtggaggacatctcagccctgcacaccagttctgatgattcctttagcctgagcagcggtgatcccggacaggaggcaccccgtgaggggagagcccagtcgtgcagtccttgcagaggcccagaagggggtcgtcgcgaggctgggagtcgcgcacatcccctactacggcttaaggccgctcacgcgtctctatccaacgactccctcaacagcgggagcgcctcagatgggtattgcccgcgagaacatatgctcccttgccccttagccgcattagcttccaggagagaggatcccagatgtggccagccgagaccttccagactggatttggatctgcccggttgtcaagccgaacctcctgccagagaggcaacttctgcagatgctcgtgtcaggactatcaagttaagccctacataccagcacgtgccccttctggagggcgctagtagggctggcgctgagcccttagcgggaccagggatatcgcccggtgccaggaagcaagcctggctgcccgctgatcatctgtcaaaagtcccagagaaactggccgcagccccattgtccgtggcgagcaaggcgctccagaaactcgccgctcaggaaggtccactgtcactctcacggtgctcttcactcagtagcctgtcctccgcgggacgccctgggccaagcgaaggtggggatcttgatgactcagactcctccctggaagggctggaagaggccggtcctagcgaggctgaacttgacagcacctggcgcgctcccggtgccacaagcctccccgttgcaattcctgctcctaggcgaaatcggggaaggggactcggggtggaggatgcaacaccatccagttcctccgaaaattacgtgcaagaaacaccactcgttttatctcgctgctcttctgtcagcagcctgggcagcttcgagagtcccagtatcgcgtctagtataccctctgagccatgttctggccagggaagcggtacgatatccccatcagaactgcccgattctccaggacagacaatgccccctagcaggtcaaagacacctccgctggcacccgctccacaggggccaccagaggccactcagttttctctccagtgggagtcatacgtcaaacgttttttagatatcgctgattgcagagagaggtgtaggttgcccagtgagctggatgccggatcagtgagattcaccgtggagaagcccgacgagaatttctcttgcgcctccagcctgtcggccctggccttgcacgagcactacgtgcagcaggacgtcgagctccgcctactgccaagtgcctgtcctgagaggggtgggggagcgggaggcgctggcctacattttgctgggcaccggcgacgcgaggaaggtcccgctcctacgggatcaagaccgagaggggctgctgatcaggaactggagctgttgagggagtgcttgggcgcagccgtgccagcccgtctgcggaaagtggcctccgccttggtgccgggacgtcgcgctctgccagtcccggtttatatgctagtgccagcccctgctcctgcccaggaggacgattcctgtaccgactcagcagaaggaaccccagtcaattttagttctgcagccagtctttctgatgagacgctccaaggaccgcctcgagaccaaccgggtggccctgcgggaaggcagcgcccaacaggcagacccacctcagcgaggcaggccatggggcaccgccataaagcaggaggggcaggacgatcggcagagcagtcgcggggtgccggaaagaacagagctggcctggaactccccctgggacgacccccaagcgcacccgctgacaaggatggctctaagcccggaaggaccagaggggacggcgctttgcaatcattatgtctcaccacaccaactgaggaagccgtctactgcttctacgggaatgacagtgatgaggagcctccagctgccgcacctaccccgacccatcgtaggacgagcgccatacccagagcgttcacccgcgaacggccacagggccgtaaggaagctccagccccaagcaaggccgcaccagctgcccctccacctgctagaacgcagccttccctgatagcagatgaaacccctccttgctatagtctgagttcatctgctagcagtttatctgaaccagaacccagcgagccacccgcagtacatccaagggggcgtgagcccgcagttaccaaggaccctggccctgggggtggacgtgacagcagtcctagccctcgtgcagctgaagaactactgcaaagatgtatctcatctgccctcccgaggcgacgcccacccgtgtctggcttaaggcgcaggaagccgcgagccacaagactagacgagcgtccagccgaaggctctagagaaagaggtgaggaggctgctggaagtgacagagcgagcgatctcgattccgtagagtggcgcgctattcaggaaggcgctaactcaattgtgacctggctgcaccaggccgcagctgccaccagggaagcttccagcgaatcagacagtatcctgtccttcgttagcggactttcggtcggaagcacacttcagcccccaaaacaccgcaagggtagacaggccgaaggtgagatgggcagtgcaaggcgccctgaaaaaagaggcgcagcttccgtgaaaacatccggaagtccgagatccccggctggccctgagaaaccaaggggaacacagaagaccacaccaggcgtgccagcggtgctcagggggcgaacggtgatctacgttcccagtcctgctccacgtgcccagccaaaagggacccccggacctcgggcaacaccacgcaaagtcgcaccaccttgcctggcccagcctgccgctcccgcaaaggttccctccccgggacagcagcggtccagatctcttcacagacccgctaaaacaagcgagttagccactctgtcacagccgccaagatccgccacgccaccggctagactggctaagactccgagttcatcgtccagccagacaagccctgccagtcaaccactcccccgaaaacggcctccagtgacgcaagcagcgggtgcactaccagggcctggcgcaagtcccgtgcctaaaacacccgctcgaactttactggccaaacagcacaaaacacaaagatcacccgtgagaattccctttatgcagcggccagcgaggagaggaccaccccctctggccagggcggtacccgagcccggaccacgtggaagggccggtacggaggctggtccgggagccaggggtggtcgcttgggactggtgagagtcgccagtgcactctcctccggatcagagtcaagcgaccggtcggggttcaggagacagctgacatttatcaaagagtcgccgggtctccggagaagacggagcgaactgtcctccgctgagtctgccgctagtgctccgcagggcgcttcacctaggaggggacggccagcattaccggctgtgtttctttgttcaagtcgttgtgaggagttgcgtgccgcaccaaggcagggtccagctcccgcacgacaacggccacccgcagccaggccaagtcccggtgaacgccctgccagacggacgactagcgaaagtccttcacggctgccagtcagggccccagccgctagacccgagacggtaaaaagatacgcctcacttccccacatcagcgttgcccgtaggcccgatggggcagtccccgcagcccctgcttcagctgacgcagcacggaggagttctgatggagaaccacgtcctttacccagggtcgcagcccctggtaccacctggcgccgaatccgcgacgaagatgtaccacacattctgcggagcacgctgcctgcaactgcgctccctctcagagggagtacacctgaggacgccccagcgggtcccccaccaaggaaaaccagcgacgccgtggttcaaaccgaagaagtcgccgcacccaaaacaaacagctcaaccagtcctagtctcgagacacgcgaacctcctggcgcacccgcaggaggccagctgtctctactcgggagtgatgtcgacgggccttccttagcaaaggcccctatatcagccccattcgtgcatgaaggtctcggcgttgccgttggaggcttccccgcaagccgtcatggcagtccctcccggagtgccagagtgcctccctttaactatgtgccatcacctatggttgtggctgccacaactgatagcgctgccgagaaagcacccgcaactgcctcagccaccctgctcgagtac

SEQ ID NO: 213600 - DNA, 6911 bp, Artificial Sequence
  Description of Artificial Sequence: Synthetic coding sequence
atggcctcatcagtcgccccatacgaacagctggttcggcaggtcgaggccctgaaagcggagaatagtcatttaaggcaggaactccgcgacaatagctctcatctgtctaagcttgagaccgaaacctctggaatgaaagaggtcctaaagcatctgcagggcaaattagagcaggaggcaagggttttggtgagctcaggacaaactgaagtgcttgaacagctgaaggctctgcaaatggatattacttctctgtataacttgaagttccagccgcctaccttaggacctgagcccgcagctcggactccggaaggatcaccggtccatgggtccgggccttccaaagactctttcggcgagttaagcagagccaccatccgacttctcgaggaacttgacagggaacggtgcttcctgctgaacgagatcgaaaaggaagaaaaagagaagctgtggtactatagccaactgcagggcctgagcaaacgcctggacgaacttccgcacgtggaaacgcagtttagcatgcaaatggatttgatacggcaacagctggagtttgaagctcagcacatccggagcctaatggaagagaggttcggcactagcgacgaaatggtccagcgcgctcaaatacgtgcttctcgacttgaacagatcgacaaggaattgctcgaagcccaggacagagtgcagcagaccgagccacaggccttgcttgctgtgaagtctgtgccggtggacgaagatccagaaaccgaggtgccaactcatcccgaggacggtactccccagcctggcaactctaaggtcgaggttgttttttggttgctgtctatgctcgcaactagagaccaggaagataccgcgcgtacactcctggctatgtcatcttcacccgagtcgtgtgtggcaatgagacggtccggctgcctgcccctcctcctacagattctgcacggcaccgaagccgcagccggaggcagggcaggcgctccaggagctcctggtgctaaggatgccagaatgagagctaatgcggcactgcacaatatcgtattctcacaaccagaccaggggctggccagaaaggagatgcgcgttctacatgtgcttgaacagattcgcgcttactgtgagacctgctgggactggctgcaggcaagggatggaggcccagaggggggtggggcagggtcagctccgatccctatcgagccccaaatttgccaggcaacttgtgccgtaatgaagctgtcattcgacgaggagtatcggcgagcaatgaacgagcttggtgggctgcaggctgtggcagaacttctgcaggtggattatgaaatgcataaaatgaccagagaccctctcaacctagccctcagaagatacgccggaatgaccctgaccaacctgacgttcggagacgtggctaacaaggcaacgctctgtgctcgtcgagggtgtatggaggcaattgtagctcagctcgcctcagactctgaggaactgcatcaggtggtgagcagtatcctcagaaatctgagctggcgggctgatatcaattcaaagaaggtgttgagggaggctgggtccgtgaccgctctggtccagtgtgtactgcgggctacaaaggagtccaccctgaaaagtgtgctcagcgctctgtggaacctttctgcacactctactgaaaataaggcagccatctgtcaggtggatggcgcacttggctttctagtctctaccctaacgtacaaatgccagagtaattctctggcaatcattgagtctgggggaggaatccttcggaatgtgtcctcccttgtggctacaagggaagactacaggcaggtgctccgggatcacaactgtctacaaactctccttcagcacctgacgtcccacagtctgacaatcgtctccaatgcgtgtggcaccctctggaacttatccgcccgaagcgccagggaccaggaactcctgtgggatctgggagccgttggcatgttgagaaatttggttcattccaaacacaaaatgattgcaatgggctcagccgctgcactccgcaatctgctggcccacagacccgctaaacatcaggcagcagcgactgccgtttctcccggtagttgcgtcccttcactgtacgtacggaagcaaagggccctcgaagccgagctggatgccaggcacttggcccaggcgcttgagcacctggaaaagcaggggccacccgcagcagaggccgctacgaagaagcccctgccacccctccgacatctcgatggcctggcacaggattacgcctctgattccgggtgcttcgatgatgatgacgccccttcttccttggctgccgctgctgcaacaggcgagcctgcgtcccctgcagccctatctctgttcttagggtccccttttctgcaggggcaggcccttgcccgtacacctccaacacgccgtggaggtaaggaagccgaaaaggatacttccggagaagcagccgtcgcagctaaggctaaagcaaaactagctctggcagtggcacgaattgaccagctggtagaagatatctctgccctgcataccagttccgacgacagcttctctttgtcatccggagatcctggccaggaggcccctcgggagggcagggcacaatcgtgctccccgtgtcggggaccggaaggaggccgacgggaagccggatcacgggcacaccccctgctgagactcaaggcggctcacgcatccctctctaatgactctctaaatagcgggagtgccagtgacggatactgcccacgagagcatatgttgccctgtccactggctgcacttgcatcaagaagggaggatcccagatgcggccagcccaggccatctcgattagaccttgacttacctggatgtcaggcagaacccccagcgagagaggcgaccagcgccgatgccagggtgcgcaccattaaactcagccctacttatcaacacgttccgctgttagaaggagcaagccgcgcaggtgccgaacctctggcaggacccggtatatcacctggggctcgtaagcaggcctggttgccagctgatcatctctcaaaggtaccggaaaagctcgccgcagctccgctgagcgtcgcgagtaaggcgctgcagaagctcgctgcacaggagggccctctcagtttaagccgatgttcatccctgtcatctctcagttctgccggtcgccctgggccatcggaaggaggggacctggacgatagcgactcctcattagagggcttggaggaggccggaccatcggaagcagaacttgacagcacatggcgcgcaccaggcgcaacctccctaccagtcgccattccggcacctaggagaaatcgtgggagggggttgggcgtggaagacgctactccttcttcttcttccgaaaattacgtacaagaaacacctctcgtgctaagcagatgtagttcagtgtcctcactgggttctttcgaatcacccagtatcgcttcaagcataccctccgagccttgttcaggtcagggaagtgggactatcagccccagtgaactccccgattctccaggccagactatgcccccttcaaggtccaagacacctccactcgccccagctccacaagggcctcccgaggccacccaatttagtcttcaatgggagtcttacgtaaagcgatttttggacatcgctgactgccgcgagcgttgtcgcctgcctagcgaattagacgccggaagcgtacgattcacagtggaaaagcccgatgaaaacttttcctgcgctagttccttatctgccctagcattgcacgagcattacgtccagcaggatgtggaactaaggttacttccaagtgcctgtccagaaaggggcggaggagccggaggggctggtctgcatttcgccggacatcggaggcgcgaggagggccctgcacctacgggatctcggccacggggagccgcagaccaggagcttgaactgttgcgagagtgcctgggcgctgcagtgccggctaggctccgcaaagtagccagcgctcttgtgccaggacgtcgggcactaccagttcccgtgtatatgttggtgccagccccagctccagcccaggaggatgactcctgtactgactcggccgagggcactcctgttaatttctcctccgcagcttccctgagcgacgagactttgcagggtcctccgagagaccagcctgggggacccgctggtcgacagcgcccaaccgggaggcccacctcggctcgacaggccatgggccacaggcataaggcaggcggagctggccgatccgcagaacagtcgcgaggcgctgggaaaaatagagcaggactcgaacttccactcggtcggcctccgagtgccccagcagataaggacgggtccaagcccggaagaacgaggggggatggcgctctgcagagcctgtgtttgacgacacctaccgaggaggcagtctactgtttctatggaaacgacagcgacgaggagccacctgccgctgctccgactccaactcatcgccgtacttctgcaatccctcgagcgtttactcgcgagcgaccacagggcagaaaggaggcccctgctcccagcaaggcagctccagctgcgccaccgccagccaggacccaacccagcttgatcgccgatgaaacaccaccttgctactcattatcaagttcggcctcaagcttaagtgaaccggaaccatccgagcctcctgcggtgcacccccgaggccgtgagcctgccgtcactaaggacccaggtcccggagggggaagagactcaagcccctccccacgagctgctgaagagctgcttcagagatgcattagctccgctctgcctagacgaaggcccccagtctcaggactgcgacggaggaaaccaagagcgacaaggttagatgagcggccagccgaggggtcacgcgaaaggggagaggaggctgccggttctgatcgcgctagcgatctcgactcagtggaatggcgtgctatacaagagggcgcaaactctatcgtcacatggctgcaccaggcggctgccgcaacacgggaagctagttctgagagcgatagtattctgtctttcgtgtccggattgagcgtcggaagtacactccagccccctaagcataggaagggcagacaggcagaaggagaaatgggctccgccagacggcctgaaaaaagaggagccgctagtgtgaagactagtggtagtcctcgcagcccagccggtccagaaaagcctcgcggtactcagaaaaccactcccggtgttcctgccgtccttcgaggtcgaactgtgatatatgtgcctagtcctgccccacgggctcaacccaaggggaccccaggcccacgcgcaacgccccgaaaagtggccccaccttgcctcgctcagccagccgcaccggctaaggtaccctcacccggtcagcagcgatcccggtccctgcatcggccagccaagacctcggaactcgcaacgctgagccagccaccccgtagcgctacgcctcccgctcgcctggccaaaactccctcttcctcatcatcccagacctcccccgcaagccagcccttgcctcgcaaacgtcctcccgtgacgcaggcagctggtgccttgcccggaccgggtgctagtcccgtccccaagacccctgcgagaacgctgctggcgaagcagcataaaactcagcgctctccagtcaggatacctttcatgcagcggcctgctagaagagggcctccacccttagctcgcgctgtcccagagcctggacccagaggacgtgctggaaccgaggctgggccaggtgctaggggtggcagacttgggctcgttagagtggccagtgccctcagctcagggtctgaatctagtgatcgtagcggatttaggcgccagcttacatttattaaggaatcaccgggtctcagaaggcggaggtccgagctctcctccgccgaatccgcagcatcagcgcctcagggcgcaagccccaggcgaggaagacctgccctccctgcagtctttctctgtagttcccgatgcgaagagctccgagccgctcccaggcagggtccagcacccgcacggcagagaccccctgcagctagaccgtcacccggagagcgtccagctaggcgaaccacgtctgaatcgccaagcaggctgcctgtgagagcacccgcagcgcgtcctgagacagtaaagagatatgcatccctgccccatatttcggttgcccgacggccagacggagcggtccctgctgccccagcatcggccgatgctgccaggcggtcatcagacggcgaacccagacctcttccgcgagtggcagcgccaggaacgacctggcgcagaattagggacgaggatgttcctcacatccttcgttctacactgcccgctaccgcgctcccactgcgtggaagtacacccgaggatgctcctgcaggccctccacccaggaagacaagcgacgctgtcgtccagactgaggaagtggcagcacccaagacgaatagctctacttcgccttctctggaaactagggagccccctggcgctcctgctggagggcagttatccctgctgggcagtgatgtcgacggaccatctctggccaaggcccctatttcagcacctttcgtacatgaaggcttaggcgtggccgtcgggggatttccagcatcccggcatggctcacccagcagaagcgcaagggtccctcccttcaattacgttccatcacccatggttgtcgcagccactacggactccgcagcggagaaggcccctgcaactgcctccgcgactctactggagta

SEQ ID NO: 213601 - DNA, 1545 bp, Artificial Sequence
  Description of Artificial Sequence: Synthetic coding sequence
atgtcatggcccagaagactgctgctacgatatctcttcccagctttgctcctacacggcctgggcgagggttccgctctcttgcaccccgacagccgctcccaccccagaagtctggaaaagtccgcctggagggcgttcaaggagagtcagtgtcatcacatgctgaaacacttgcacaatggtgcccgaattacagtccagatgcctccaacaatagaagggcactgggtgtctacaggatgtgaagtccgctcaggacctgaatttatcaccagatcttacaggttctaccataacaacaccttcaaagcatatcaattctactacggttcaaatcgctgcacaaacccaacatatacactcattatcaggggcaagatacgcctcaggcaggcgagttggattattaggggcggtacggaggctgattaccagctccacaatgtgcaggtgatctgtcatactgaagccgtcgccgagaagctaggacaacaagtgaaccgcacctgccctggattcctggcagatgggggaccatgggtccaggatgtggcatatgacttgtggcgggaagagaacggatgtgagtgcaccaaggccgtcaatttcgctatgcacgaattacagctcattcgagtggaaaaacagtatttacaccataacctcgatcatctggtggaggaactatttttgggggatattcacacagacgccactcaacgcatgttttaccgcccttcctcatatcagcccccactgcagaatgccaagaaccacgatcatgcatgcattgcttgcagaatcatttaccggagcgacgagcatcatccacccatcctcccccctaaagctgaccttactattggcctgcatggagagtgggtcagtcagcggtgtgaggtgcgacctgaggtcttgtttctcactaggcatttcatcttccacgacaacaacaacacatgggaagggcattactaccactactccgacccagtctgcaagcaccccacattttccatttatgccaggggccgatactcgaggggggtactgagttctagggtgatgggtggcactgagttcgttttcaaagtaaaccatatgaaggtcacccctatggatgccgcaactgcttcactcctaaacgtgtttaatggaaatgaatgcggggcagagggtagttggcaggtaggcatccagcaagacgtaacacatacaaacggctgtgttgccttggggattaagctgccccatactgagtacgagatcttcaagatggagcaggacgcgagaggccgttacctcttgttcaacgggcaacggcctagtgatggttcttcacccgacaggcctgagaagcgggcaacaagctaccagatgccacttgtgcagtgcgctagctcctcccccagggcggaggaccttgcagaagacagtggttcctcgctgtatggcagagcacctggacgtcacacatggagcctcctgttggcggctctagcgtgcttagtccctttgctgcattggaacatccgacggtag

SEQ ID NO: 213602 - DNA, 1698 bp, Artificial Sequence
  Description of Artificial Sequence: Synthetic coding sequence
atgaagagaaggtgttcttgcggcggtggaggaggccactgttcttcagagcggagacgcacaagacccgaggccgaaggtagagctcgagcccagctgcccggacaccagatcggcgctagaagagcaggtggcccaagggccggactggagatgagctggccacgtagactcctattacggtacctctttccggctttactgctgcacggtctgggcgagggctcagcactattgcaccctgatagccggtcgcaccccagatctctggagaaaagcgcctggcgtgccttcaaggagtcccagtgtcatcacatgctcaaacacctccacaatggggcacgaatcacagttcagatgcctcctactatcgagggtcattgggtttctaccggctgcgaggtgcgctccggacccgaatttataacccgctcctataggttctaccacaataacacattcaaagcctaccagttttactacggttctaaccggtgtactaaccccacatatactctaatcattcgcggtaagattaggctgcgccaagcgtcctggatcattagaggaggcaccgaggctgattatcaactgcataatgttcaagtgatttgtcacacagaagctgtggccgaaaaactgggacagcaggttaaccgaacatgtccgggtttcttggccgatggcggtccatgggttcaggacgtcgcgtacgatctctggcgcgaggagaacggttgcgagtgtacgaaagccgtcaattttgctatgcacgagctgcaacttatccgtgtcgaaaaacagtacttgcatcataatctggatcatttggttgaggagctcttcttgggggacatccatacggacgcgacccagcgtatgttctatcggccaagctcctatcaaccaccactgcaaaatgcaaaaaatcacgatcacgcgtgtattgcctgccgcattatatacagatccgacgaacaccatcctccaatcctgcctcccaaggctgatctcaccataggcctccacggggagtgggtgtcacaaagatgtgaagtaagaccagaggtacttttcctgactaggcacttcatatttcatgataacaataatacttgggaaggccactattaccactacagcgaccccgtctgtaaacacccaaccttcagtatctacgctagagggcgatactctagaggtgtgttgagtagccgggtgatgggaggtacagaatttgtcttcaaggttaaccacatgaaagtaacacctatggatgctgcgacagcctccctcctgaacgtgttcaatgggaacgagtgtggggctgaagggagctggcaggtaggaatccagcaggacgttacacataccaacggttgtgttgctctcggtatcaaactgccgcataccgagtacgagatcttcaagatggaacaagacgcaagaggtaggtatctgttattcaacggccagcgacctagtgacggttcttcccccgaccggcctgagaaaagggcaacttcctaccagatgccgttggtccagtgtgcttcttcctccccgcgtgcagaggatctggccgaggacagtgggagttccttatacggcagagcccctgggagacatacatggagcctgttgctggcggcactagcctgcctagtcccccttctccattggaacattcggcgttag

SEQ ID NO: 213603 - DNA, 981 bp, Artificial Sequence
  Description of Artificial Sequence: Synthetic coding sequence
atgccacctagcataagtgcgtttcaggctgcttacattggaatcgaagtactgatagctcttgtcagtgtgccagggaacgtgctcgttatttgggccgtcaaagtgaatcaggcgcttagagacgccacattctgctttatcgtctctctggccgttgccgatgtggccgttggcgcactcgttatccccctcgccatcttgattaacattggtcctcaaacctattttcacacgtgcttgatggtggcttgcccagtgttgatactgacacaatccagcatcctcgcgctgcttgctatagctgtcgacaggtacctgcgcgtgaagattccgctgaggtacaaaatggtcgtaacacctcgccgtgccgcagtcgctatcgcaggttgctggatcctcagttttgtggtggggctaacccctatgttcggttggaataacttgagtgccgtggagcgagcatgggccgctaatggatccatgggggagcccgtgatcaagtgtgagtttgagaaagttattagcatggagtacatggtgtactttaatttcttcgtgtgggtgctgccacctctgctgctgatggttctgatttatctcgaagtcttttacctgattcgaaagcaattaaataaaaaggtcagtgccagcagtggtgacccgcagaagtactatggtaaggagttaaagattgcgaaatcactggcactgatcttatttctgtttgcactttcttggctcccactccatattctgaattgtattaccttgttctgcccgtcctgccacaagccctccatcttaacttatatcgccatttttttgactcacggaaactccgctatgaatcccatagtttacgcgttcaggattcaaaagttccgggtgacttttcttaagatttggaacgaccactttcgctgtcaacctgccccacccattgacgaggacctgcctgaagaacggccagatgactag

SEQ ID NO: 213604 - DNA, 981 bp, Artificial Sequence
  Description of Artificial Sequence: Synthetic coding sequence
atgcctcccagcatctctgcttttcaagctgcatacattggcatcgaagtgctgatagctttagtaagcgtgcccggaaatgtgctggtcatctgggcggtgaaagttaatcaggcactgagagacgctacattctgcttcatcgtctcccttgcggtggccgatgtcgctgtgggtgcacttgtcatccctttggctattctcatcaatatcgggcctcagacctacttccatacgtgtctgatggtggcgtgcccggtgctgatcttaacccagtctagtattctggcattgctggcaattgcagtcgatagatacctgcgtgtcaaaattccactgcgctacaagatggtcgtcacgccgcgacgcgcagctgtggcaatcgccggatgttggatcctgtctttcgtagttggtctgacgccaatgttcggttggaacaacctgtcggcagttgagagagcttgggccgctaacggctccatgggcgagccagtgatcaagtgtgaattcgaaaaggttatatccatggagtatatggtctacttcaactttttcgtatgggtgctgcccccactcttgttgatggtgctgatctacctggaagtcttttacttaatcaggaagcagctgaataagaaagtatccgcttcctccggcgatccccagaagtactatgggaaggagttgaagatcgccaagtccctggctttaatcctgttcctcttcgccctaagttggttgcccttgcatattctcaattgcatcacactgttttgtccaagctgccataaaccttcaattcttacatacatcgctatcttccttacccacggaaacagcgctatgaatcccattgtttatgcattccgcatccagaaattccgggtgacatttctaaagatctggaacgatcacttcaggtgccagcctgctccccctatagatgaggacctccctgaagagcgcccagacgactag

SEQ ID NO: 213605 - DNA, 378 bp, Artificial Sequence
  Description of Artificial Sequence: Synthetic coding sequence
atgcccccttcaatatccgcgttccaggccgcttatataggtattgaagtgcttattgcactggtcagcgtccctggaaatgtgctcgtgatctgggccgttaaggtcaaccaggcattgagggacgctactttctgcttcatcgtttctctagccgtggcagacgtggcggtgggtgccctggtcataccacttgctattttgattaatatcggcccacagacatacttccacacctgcctcatggtggcgtgtcccgttcttattcttacacagagctccatattagcactgctggctatagctgtggaccgatacctgcgtgttaaaatccctttgcgtagaatcagccagtgcatggcttccactaagtcgtag

SEQ ID NO: 213606 - DNA, 981 bp, Artificial Sequence
  Description of Artificial Sequence: Synthetic coding sequence
atgcctccttccatctccgcattccaggccgcttacatcggtatcgaggtgctgatcgctctggtgagcgtcccaggaaatgtgctcgttatttgggcagtgaaggttaatcaggcactccgtgacgcaaccttctgtttcattgttagcctggctgtcgccgacgtggctgtgggagctttggtaattcctctggctatcctgatcaatatcggcccacagacctactttcacacttgcctcatggtggcatgcccagtgctgattcttactcagtcctccatcttagccctgctagccatagcagtggatagatatctgagagtcaaaatcccgctacgatacaagatggtagtgacacctagacgggcagcagtggcgatagccggatgctggatcctcagctttgtggttggcctgactccaatgttcggctggaacaatctgtccgccgtggagcgtgcctgggccgcaaatgggtccatgggggagcctgtcattaagtgtgaattcgagaaggtgatcagcatggagtacatggtttacttcaatttcttcgtatgggtgctacctccccttctcctcatggttctgatatatctggaggttttctatctgatccgcaagcagctgaacaagaaagtgtctgccagctctggggatcctcagaaatactacgggaaggaactgaagattgccaagtccttagctctgatcctctttctgttcgccttaagttggcttcctctccacatactaaattgcatcacactcttctgcccttcttgtcacaagccctcaatcttaacatatattgcgatatttcttacacatgggaatagcgctatgaatccaatagtatatgcttttcggattcagaaatttagagtgacttttttgaaaatctggaatgaccacttccgttgtcaacctgcgccacccatcgatgaggatctgccagaggaacggccagacgactag

SEQ ID NO: 213607 - DNA, 1239 bp, Artificial Sequence
  Description of Artificial Sequence: Synthetic coding sequence
atgcccattatggggtctagcgtatacataacggttgaattggctattgccgtcctggccattctggggaacgtgttagtttgttgggcagtctggttgaatagcaacctgcagaacgtcactaactattttgtcgtgagcctggctgctgccgatatcgctgtgggggtccttgccattcctttcgctattacaatctcgacagggttttgtgcagcttgccatggctgcctttttattgcatgttttgtgctggtgctgactcagtctagtatcttctcactgcttgccattgccatagataggtatattgcaatacgcattccgctgcgttataatggtctggttaccggaactagggccaagggaattatagctatatgttgggtattatcatttgccatcggcttaactccaatgcttggatggaacaattgtggccagccaaaggaagggaagaatcattcacaaggctgcggcgagggacaggtcgcctgcctattcgaagacgtggtacctatgaactacatggtgtattttaacttttttgcttgcgtgttggttcctctcctactgatgctgggcgtgtacttacggatttttctggctgctaggagacagcttaaacaaatggaaagccagccccttcccggagagagagctaggtcaacactccagaaagaagtgcatgccgcaaagtctctggctatcattgtcgggctgttcgcactctgttggcttccgttgcacattataaactgttttactttcttttgccctgattgttcccacgccccattgtggctgatgtatctggcgatcgtgctgagtcacactaacagcgttgtgaatccatttatatacgcttaccggatcagggaatttcgacagaccttcagaaaaatcatacggtcccatgtgctgcgacagcaggaaccattcaaggccgcaggcacttcggcaagagtcttggcagcccatggttcagacggagaacaggtctcattgagactgaacggccacccaccgggagtttgggcgaatggatctgccccacatcccgaaaggcgaccgaacggctatgccttggggttggtgagtggcggatccgcacaagagagtcagggaaataccggcctacctgacgtcgagttgttatcacatgagttgaagggggtttgccccgaacccccagggttggacgaccctctggcacaggatggcgctggtgtgtcttag

SEQ ID NO: 213608 - DNA, 1239 bp, Artificial Sequence
  Description of Artificial Sequence: Synthetic coding sequence
atgcctatcatgggatctagtgtttacattacagtagaacttgccattgcagtcctggccatcctgggtaatgtcttggtttgctgggccgtctggctcaattccaacctgcagaatgttacaaattattttgtggtatccctcgcagctgcggacatcgcggtgggagtcctggctatccctttcgcaatcaccattagcacgggtttttgcgctgcctgtcacggatgcttgttcattgcctgcttcgttcttgtgctgactcagagttctatcttttcccttctggccatcgccattgatagatatattgccatccgcatacctctgagatataatggtctcgttaccggcacaagagccaaggggatcatagctatctgctgggtactgtccttcgctattggcctgacgcctatgctgggatggaataactgcggccagccaaaagagggtaaaaaccactcccaaggatgcggagagggacaagtagcctgccttttcgaggatgtggtaccaatgaactatatggtgtactttaatttcttcgcttgcgttttagtgcccttattgctcatgctcggcgtatacctgagaatattcttagctgcgaggcgacaattgaaacaaatggaatctcagccactgcctggtgagcgcgctaggagcactctgcaaaaagaagtgcatgccgctaaaagtctcgccataattgtcggcttgtttgctctgtgctggctgcctctgcatatcatcaactgctttaccttcttctgccccgattgttcgcatgctccactctggctcatgtacctggccatagtactttcccataccaatagcgtcgtgaacccgttcatatatgcttaccggatcagagagtttagacagacatttaggaaaatcataagatcccatgttttgcgccagcaagaacccttcaaagccgctggcacatctgcgagggtgcttgccgcacacggatcagacggggagcaggtatccttacggttgaacggtcaccccccaggagtgtgggcgaatgggagcgcaccgcatcctgagaggagacccaacggctacgcattggggttggtgagcggtggtagcgctcaagaatcccaggggaatactggcttgcccgatgtggaattactgtcccatgagctgaagggagtctgtccagagccacccggtctcgatgaccccctggcgcaagacggggcaggagtctcttag

SEQ ID NO: 213609 - DNA, 267 bp, Artificial Sequence
  Description of Artificial Sequence: Synthetic coding sequence
atgcctattatgggctcaagcgtgtacattacagtggagctggctatagcggtgctggccatcttaggaaacgtgcttgtttgctgggcagtgtggctaaatagtaatttacagaatgtgacgaattactttgtggtatcactcgccgctgccgatatcgctgtgggggtgcttgctatcccttttgctattacaattagcactgggttctgtgccgcatgccacggctgtctgttcattgcatgctttgtcttggtgctcacatag

SEQ ID NO: 213610 - DNA, 195 bp, Artificial Sequence
  Description of Artificial Sequence: Synthetic coding sequence
atgcctattatgggaagctctgtttatatcaccgtggaactggccattgctgttttagctatcctggggaatgttctagtctgttgggctgtgtggctgaactctaatttacaaaatgtcactaactactttgtggtctctctggcggctgcggacatcgcagtgggggttctggccatcccattcgctatctag

SEQ ID NO: 213611 - DNA, 231 bp, Artificial Sequence
  Description of Artificial Sequence: Synthetic coding sequence
atgcctatcatgggaagcagtgtatatattaccgtcgaactcgccatcgccgtgctggcaatcctggggaacgtcctggtctgttgggccgtgtggctgaactctaatttacagaacgttacgaactactttgtggtaagtctcgctgcagcagatattgccgttggggtgctcgctatacctttcgccatcactatatcaaccggtttttgtgccgcttgtcacgggtag

SEQ ID NO: 213612 - DNA, 1098 bp, Artificial Sequence
  Description of Artificial Sequence: Synthetic coding sequence
atgcccattatgggaagcagtgtgtatatcaccgtcgaactcgcaatagctgtgctggctatcctgggtaatgtgctggtgtgctgggccgtgtggttgaactccaatctgcagaatgtcacaaactacttcgttgtgtcactagccgctgccgatattgcagtcggggtccttgccatccccttcgcaattactatttctaccgggttttgcgcggcttgtcatggctgccttttcatcgcctgtttcgtgttggtactcactcagagctcgatcttctctctgctggccatcgcgatcgataggtacatcgcaatccgcattcctcttcggtataatggtctagtcaccggcactagggcgaaaggaattatcgctatttgttgggtccttagttttgccattggcttgacacccatgttgggatggaataactgtggtcaaccaaaagagggaaagaatcactctcagggttgcggggaaggccaggtcgcctgtctgtttgaggatgtcgttcctatgaactatatggtgtactttaatttcttcgcttgcgtgctggtgcctcttctgcttatgctgggcgtgtatttacgcatttttcttgcagctcggagacagctgaaacagatggaaagtcagcctctccctggggagcgcgcacggtcaacactgcagaaggaggttcatgcagcgaagtccctagcgattatcgtcggattgtttgctctgtgctggctgccactgcacatcataaattgctttacgtttttctgccccgactgtagccacgctccactctggctcatgtacctggctatagttctctcacacacgaactctgtcgtcaatccttttatatatgcctaccgcattagagaattccgccagactttccgaaagatcattagatctcatgtgcttaggcaacaggaaccgtttaaagcggcaggcacatccgccagagttcttgctgctcacggcagcgacggggaacaggtttcactgaggctgaacggacaccccccaggagtgtgggccaatggtagcgctccccatccggaacgaagaccaaatgggtacgcactgggtctatag

SEQ ID NO: 213613 - DNA, 1239 bp, Artificial Sequence
  Description of Artificial Sequence: Synthetic coding sequence
atgccgatcatggggtcaagcgtgtacatcacagttgaactggctatagccgttttggctatcctcggaaatgttttggtatgttgggctgtttggctgaattctaacctgcaaaatgtcactaattacttcgtggtgtctctcgctgcagccgacatcgccgtaggagtcttggcgatacccttcgccattactatctcaaccgggttctgtgccgcatgccatggctgcctgttcatcgcctgtttcgtgctggttctgactcagtctagtatcttcagtctgcttgctatcgcaatcgaccgatacattgccatcagaatccctctgcggtacaatggattggttaccggcacacgtgccaaaggcattattgctatctgttgggtcctgtcgtttgccatcggcctcactcctatgctggggtggaataattgtggacagccaaaggaggggaaaaaccactcccaggggtgcggggagggccaggtggcttgcctctttgaggacgtagttcccatgaactacatggtgtatttcaatttttttgcgtgcgtgcttgtgcccctcttgctcatgttaggggtatacctcagaatcttccttgccgcacggagacaacttaagcagatggagtcacaaccactcccgggtgagcgcgcacgctcaacattgcagaaggaggtccacgccgcaaagagcctggccattattgtgggcctttttgccttgtgttggctgcctctgcacatcattaactgcttcacatttttctgtccagactgctcgcatgccccactgtggcttatgtatctggcaattgtcctgagtcacacgaactctgttgtaaatcccttcatctatgcatatagaatccgtgaattcagacagacatttcgaaaaatcatccggtcacacgttcttcggcagcaggaaccatttaaagcagctggaacttccgcccgagtccttgccgctcacgggagcgatggagaacaggtcagtctccggctgaacgggcatcctcccggtgtgtgggctaacggatctgcccctcaccccgagaggaggccaaacgggtacgcactgggcctcgttagtgggggatccgcacaggagtcacagggcaacactggcctccctgatgtggaactgctgtcccatgagctgaaaggcgtctgcccagagccccctggacttgatgatcccctggctcaagatggcgctggtgtgtcatag

SEQ ID NO: 213614 - DNA, 999 bp, Artificial Sequence
  Description of Artificial Sequence: Synthetic coding sequence
atgctgctggaaacccaagacgctctgtacgtcgcactcgagctggttattgcagccctcagcgtggcaggaaatgtccttgtgtgcgccgcagtgggaactgccaacactctccagactccaactaactacttcctcgtatctctggccgctgccgacgtggcggttggactctttgcgattcctttcgcgatcactatctcgctggggttctgcaccgatttctacggttgtctctttctggcctgcttcgtactggttctgactcagagctcaatattctctcttctagcagtagccgtggacagatacctagccatctgtgtgcccttgaggtataaatctctggtgaccggtacccgcgctcgcggagtaatagcagtgctatgggtgttagcatttgggatcggactaacaccattccttgggtggaactccaaggactccgccacaaacaactgtacagaaccttgggacgggacaactaatgagagttgttgccttgtcaagtgcttattcgaaaatgttgtgccaatgtcatatatggtatatttcaatttcttcggctgtgtgctaccaccacttttgattatgctggttatctatattaaaatattccttgtcgcttgtagacagctgcagaggaccgagctgatggaccatagtcgaactacgcttcagcgtgaaattcatgccgctaagagtttagcgatgatcgtgggcattttcgctctctgctggctgccggtccacgccgtgaactgtgtgaccctatttcagcccgctcagggaaagaataaacccaagtgggcaatgaatatggccatcttgctaagccatgccaacagcgttgtgaaccctatcgtgtatgcctacagaaatcgggacttccgctatacttttcacaagattataagtaggtatctgctctgtcaggcagatgtgaagtcggggaacggtcaggccggtgtgcagccagcactaggagtggggctgtag

SEQ ID NO: 213615 - DNA, 957 bp, Artificial Sequence
  Description of Artificial Sequence: Synthetic coding sequence
atgccgaataattctaccgccctgtctcttgccaacgttacctacatcaccatggagatcttcataggcctttgcgcgattgtcgggaacgttctggtgatatgcgtggtcaagctaaatccaagcttgcagactaccacattttattttatagtcagtttagctctggctgatatagctgtgggcgttctcgttatgcctctggctattgtggtcagtctgggcatcaccatacacttctactcttgtctcttcatgacgtgcctgctgctgatctttacccacgccagtattatgtctttactggctattgcggtggatcgctacctgagagtcaaactcaccgttcggtataagagagttaccacccaccgcagaatttggttggctttaggcctgtgctggttggtatcgttcctcgtgggcttgacccctatgtttggttggaatatgaaactaacctctgaataccaccggaacgttacctttctatcatgtcagttcgtgtctgtcatgcgaatggattacatggtatatttctctttcctgacctggatattcataccccttgtcgtaatgtgtgctatttacctggacatcttttacataattcgtaataagctctccctgaatctgtccaattcaaaggaaactggagccttttacggacgtgaatttaaaacagccaagagccttttcctggttcttttcctgtttgccctttcctggctgccgctctctataatcaactgtatcatctatttcaatggggaggttcctcagctggtgctgtacatgggcatcctgctttcacacgctaactcaatgatgaatcctatcgtatacgcctacaagatcaaaaaattcaaagagacctacttattgatcctgaaggcctgtgtagtgtgtcacccttctgattccttggacaccagcatcgagaagaacagcgagtag

SEQ ID NO: 213616 - DNA, 537 bp, Artificial Sequence
  Description of Artificial Sequence: Synthetic coding sequence
atggaaggttccccagcaggacccatcgaacagaaggaggccaggtgggaaagttcctgggaggagcaaccggactggactttggggtgtctcagccccgaatctcacacgaatcacgtcgccctgcgcgatacgggcaatcagctgatagtaaccatgtcctgcctgacaaaagaggatacgggttggtactggtgtggtatccaaagggacttcgctagagatgatatggacttcactgaactgatcgtaacagacgacaaaggtaccttggctaacgacttctggagcgggaaagatctttctgggaacaagactagaagctgtaaggctcctaaggttgttcgaaaggctgatagatccaggaccagcattctgattatttgcatcctgatcaccgggcttggcataatcagcgtgattagtcatctcaccaagagacggaggagccagagaaaccggagagtgggaaacacactcaagccttttagccgagtcttgacccctaaggagatggctcctacagaacaaatgtag

SEQ ID NO: 213617 - DNA, 1044 bp, Artificial Sequence
  Description of Artificial Sequence: Synthetic coding sequence
atgccaaacaactctactgcgctgagtctggctaatgtcacatacatcaccatggagatctttattggcctttgtgctatcgttgggaacgttctggtgatatgtgttgtcaagctgaatccttcattgcagacaaccacattctactttatcgtgtcgttagccttagccgacatcgccgtaggcgtcttggtcatgcccctcgctatagtggtgtcactcggaattactattcatttttattcatgtctgttcatgacatgcctgctgctgatcttcacccatgcctctataatgagtctcttagccatcgccgtggacaggtatctcagggtgaaactgacggtgaggttcaggatcccaggtcttcctggctgcattctgagttttcagcttaaagtatgcttcctgcctgttatgtggctgtttatactgttatccctcgccctgatctctgacgctatggtgatggatgagaaggtaaagaggtcattcgtgctggacaccgcatctgcgatctgcaactataacgctcattacaagaaccaccctaagtattggtgccgcggttattttcgcgactactgcaacataatcgctttcagtcccaacagtacaaaccatgttgccctacgtgatactggcaaccaactgattgttactatgagttgtctcactaaggaagatacaggttggtactggtgtggcatccaacgggattttgccagagatgatatggacttcactgaactaatcgtcaccgatgacaagggaactctggccaacgatttttggagcggcaaggacttgagcggcaataaaactcgctcttgtaaagcccctaaggtggtccgaaaagccgaccgctcacggactagcattctgatcatttgcattctgattacagggctcgggataatttctgtgatctctcacctaacaaaaaggcggcgatctcagagaaaccgcagggtgggtaacacactaaagcccttctccagggtattgacacccaaggaaatggcaccaacggagcaaatgtag

SEQ ID NO: 213618 - DNA, 801 bp, Artificial Sequence
  Description of Artificial Sequence: Synthetic coding sequence
atggagggttccccagctggcccaatcgaacagaaggaagccaggtgggagtcttcctgggaggagcagccggattggaccctcggatgtttgtcccccgagtcgcagtttcgcattccaggcctgccaggctgtatcctttcatttcagctcaaggtttgctttctcccagtcatgtggctgttcatcctcctgtctcttgcactaatttccgatgcaatggtaatggatgagaaggtcaagaggtctttcgtactggacaccgccagcgccatttgtaattataacgcacattacaagaatcacccaaaatactggtgtcgcggttattttagagactactgcaacatcattgcattcagccctaacagcactaaccatgtcgcactgcgagataccggcaaccaactgatcgtaactatgagctgcctcaccaaagaggacacaggatggtattggtgcgggattcagagagacttcgcccgtgatgatatggactttacagaacttattgtgactgacgataaggggacactcgcgaacgatttttggtccggtaaggacctctctggcaataagacccgctcatgcaaagcccctaaagtagtgagaaaagctgacagaagccggacatccatactcatcatctgcattctcattacaggtctcggaattatcagtgtgatcagccacttgacaaagcgcaggagaagtcagcggaacaggagagttggcaacacactaaaaccattctctcgggttctgaccccaaaagagatggctccaactgaacagatgtag

SEQ ID NO: 213619 - DNA, 624 bp, Artificial Sequence
  Description of Artificial Sequence: Synthetic coding sequence
tagccccaggctctgcaaggcccaccaagctctaacgacgcaatggttatggatgaaaaggtgaagcgttcctttgtactcgataccgcgtcagcaatttgcaattacaacgctcattacaagaatcaccctaaatactggtgtagagggtactttcgcgattattgtaatatcatcgctttttcccctaactctaccaatcatgtggctctccgcgatacaggaaatcagctgatcgtgaccatgtcttgtcttacaaaggaggataccggatggtactggtgtggtattcaacgcgattttgccagagacgacatggatttcactgaacttatagtgacagacgataagggaacgctcgccaacgatttctggtctggcaaagacctcagtggaaacaagacaagatcatgcaaagccccaaaggtggtccgtaaagcagaccgctccaggacgagtattctgattatttgcattctaatcacaggactggggatcatttcggtgatttcacatctcacgaagaggagaagatcccaaaggaatagaagagtgggcaacacactgaagccctttagcagagtcctcacacctaaagagatggcacctacggagcagatgtag

SEQ ID NO: 213620 - DNA, 348 bp, Artificial Sequence
  Description of Artificial Sequence: Synthetic coding sequence
tagccctctagccacgtagcactccactccactctcctgggctcccatttcagcacaaaccacgttgctctaagagacacaggaaaccaactgatcgtgacaatgtcatgtctgactaaagaagatacgggctggtattggtgtggcatccaacgggactttgccagggacgacatggatttcacagagctcatagtcacggacgacaaaggaacgctggccaacgatttctggagtgggaaagatcttagcgggaacaagacccggtcctgtaaagcacctaaagtcgtgagaaaggccgaccgctctagaacaagtattctaatcatttgcatactcattacctag

SEQ ID NO: 213621 - DNA, 519 bp, Artificial Sequence
  Description of Artificial Sequence: Synthetic coding sequence
gggccaatcgagcagaaagaggcacgttgggagagctcgtgggaggaacagcctgactggacacttgggtgtctcagcccagagtctcacaccaatcacgtcgcactccgcgatacaggaaaccagctgatcgtcacaatgtcatgtctgacaaaagaggatacgggttggtactggtgcggcatacagcgcgattttgcccgtgacgatatggatttcactgagctgatcgtgacagatgacaagggcactctggctaacgatttctggagcggtaaggatttgagcggcaataaaactagatcctgtaaagcacccaaagttgtccgaaaggcggatagaagcagaacgtccatacttataatctgtattttaatcacagggctgggaatcatctcagtcatctcacacctgacaaaaagaagaaggagtcaacgcaatcgacgcgtgggtaacaccctgaagccattcagtagagtgctgacacccaaagaaatggccccaacagaacagatgtag

SEQ ID NO: 213622 - DNA, 1092 bp, Artificial Sequence
  Description of Artificial Sequence: Synthetic coding sequence
atggcccagacccccgcatttgacaaacctaaagtcgagcttcacgttcatctcgacggcagcatcaagcctgagacaatcctgtactacggtaggaggagaggcatagccctccctgccaataccgcagaaggacttctgaacgtcattggcatggacaagccccttacattgcctgatttcttggccaaatttgactactacatgcccgctatcgcgggatgtcgggaagcaatcaaacgaatagcttatgagtttgttgaaatgaaggcaaaggaaggcgttgtctacgttgaagttagatactccccacatctactcgccaactcgaaagttgaacctatcccttggaaccaggctgaaggtgatctcactcctgacgaagtcgtcgcactggtaggacagggccttcaagaaggagagcgggactttggcgtgaaggctaggagtattctatgctgcatgaggcaccagccgaattggtcccccaaagtggtcgaactctgcaagaaataccagcaacagaccgtggtggcgatcgatttggctggtgacgagactatccccggtagcagcttgttgcctggccatgtgcaagcttaccaggaagccgtgaagagcggtattcaccgcacagttcatgccggtgaggttggttctgctgaggttgtgaaagaggccgtcgatatcttaaagacagaacgcctcggccacggttaccatacgctcgaggatcaagcgttgtacaatcgcctccgtcaggaaaatatgcattttgagatctgcccatggtcctcttatttgacaggtgcatggaagcccgacaccgagcacgccgttatccggctcaaaaatgaccaagccaactacagccttaacaccgatgatcctcttatcttcaagtcaacattggacaccgactatcagatgactaagagggacatgggttttactgaggaagagtttaagcggctgaacattaatgcagcaaagtccagcttcttgccggaggacgagaaacgcgaactgttggacctgctctataaagcctacggaatgcctccttccgcttcggccggtcagaacctgtag

SEQ ID NO: 213623 - DNA, 1731 bp, Artificial Sequence
  Description of Artificial Sequence: Synthetic coding sequence
atggcaagtaataaccactggttccagagctctcaggtacctagttttgctcaaatgcttaagaaaaatctgccagttcagccagctacaaaaaccatcaccacaccaaccgggtggagttctgaaagttatggcctgtctaagatggcctcgaaggtcacccaggtgacagggaactttcctgagccgctgctgtccaagaacctctcttccataagcaaccccgtattgcctcctaagaaaatccccaaggagtttattatgaagtacaagcggggagagatcaaccctgtttcagcgctccaccagttcgcccagatgcagcgcgtgcagctcgacttgaaggaaaccgtgactacaggaaatgtgatgggcccatattttgcattctgcgccgtcgtagatggtatccagtacaagacaggcttaggacaaaataaaaaggagtcacgatctaatgcggctaaacttgcactcgacgaactcctacagctggacgaaccagaacccagaatcctcgaaacttcaggcccacctccattcccagcggagcctgtcgtgctcagtgagttggcctatgtctctaaagttcattacgaaggaagacacatacaatatgccaaaatcagccagatcgtaaaagaacggtttaatcaactgatttctaataggtctgagtacctgaagtactcctcttctctggccgcttttataatcgagagagcaggtcaacatgaggtcgtggccatcggaacaggggaatataactactctcaggacattaagcctgacggcagggtgctgcacgatacccacgccgtggtaaccgcgagacgctctttactgcgctacttctaccgacagcttctcctgttctattcaaaaaaccccgctatgatggaaaaatccattttttgtaccgagcctacatccaatcttctgacgcttaagcaaaacatcaacatctgcctatacatgaaccaactgccgaaaggaagcgctcaaataaaaagccagttgaggctcaacccccattccattagtgctttcgaagctaatgaggagttgtgtctgcatgtcgccgtggagggaaagatctatctgacggtatactgcccgaaggatggcgtgaatcgaatatcaagcatgagttcaagcgacaaactcaccagatgggaggttctcggcgttcagggggcactcttgagtcactttatacaaccggtttatatatccagcattctgattggggacggcaactgcagcgatactaggggactggaaatcgctattaagcagcgtgtggatgacgcgctgacgagcaagctgcctatgttctacttagtgaatcggccacacatcagcctggtgcctagcgcatatcccctccaaatgaaccttgagtacaagtttcttagtctgaactgggctcagggggacgtgagtcttgagatcgtggatggactatccggcaaaatcacagaatctagtcccttcaaaagcggaatgtcaatggcctcaaggttgtgcaaggccgctatgctgtctcgctttaatctccttgccaaggaggccaagaaagaactgctggaagcgggaacgtatcatgccgctaaatgtatgtcggctagttatcaggaggccaaatgcaagcttaaatcttacttacagcagcacggatacgggtcttggatcgtgaaatctccctgcattgagcagtttaacatgtag

SEQ ID NO: 213624 - DNA, 1698 bp, Artificial Sequence
  Description of Artificial Sequence: Synthetic coding sequence
atggcatcaaacaatcattggttccagagcagtcaggtgcccagtttcgcacaaatgcttaaaaagaatttgccggtacagccagccaccaaaacgatcacaacccctacaggctggagcagtgagtcgtacggtctcagcaaaatggcaagtaaggtcacccaagtgacaggcaattttcccgagccactactgagtaagaatttatctagtatcagtaacccagttctccctccaaaaaagatacccaaggagtttatcatgaagtataagaggggggaaataaacccagtgtccgccttgcatcagttcgcgcagatgcagcgcgtgcagttagacctgaaagagactgtgactaccggaaatgttatgggcccatatttcgccttctgtgcagttgtggatggaattcaatataaaactgggctcgggcagaacaaaaaagaatcccgctctaatgcggcaaaactggcccttgatgagctgctgcagttggacgaacccgagcctagaatcctcgaaacttccggacctccaccctttccagccgagccagttgtcttgtcagaactggcgtacgtatcaaaggtgcattatgaaggtcggcacattcaatacgcaaagattagccagatagtcaaggagcgtttcaaccaacttatttccaataggtctgagtacctgaaatattcttctagcttggcggcattcatcatcgaacgcgctggccagcacgaggtggtggcaatcgggaccggcgaatacaactattctcaagacattaagcccgacgggcgagttctgcacgacactcatgccgtcgtcacagcgagacggtccctgttgtcaaagaatccagcaatgatggaaaagagtatattttgtacagaaccaaccagtaacttactaacattaaagcaaaatataaacatctgcctctacatgaatcaactgcccaaaggctcagcacagataaagagtcaactccgactgaatccacattctatctccgcctttgaagccaatgaagagttgtgccttcatgttgccgtggagggaaagatttatttgactgtatattgtcctaaggatggagtgaatcggatctcttcaatgtcaagctccgacaaactgactcgatgggaggtgctgggagttcagggtgcactcctttcgcatttcatccagccagtgtacatctcaagcatcctgataggcgacggcaactgttcggacactaggggcctcgaaatcgcaattaagcaaagagtggacgatgccctcacctcaaagctaccaatgttttatttggtcaaccggcctcatatcagccttgtgccgtccgcataccctctgcagatgaacctcgagtataagtttttatctctaaattgggcccagggggacgtatctttagagatagtggatggcctttccggcaagatcaccgaatcctctccatttaagtccggaatgtccatggcctcccgcctctgtaaagccgctatgttgagcaggttcaacctgttagccaaagaagccaaaaaggagctgttagaggctggcacgtaccacgctgctaaatgtatgtcagccagctaccaagaagcaaagtgcaaattgaaatcctatctgcaacagcacgggtatgggagctggatcgtgaagtcaccatgcatagagcagtttaatatgtag

SEQ ID NO: 213625 - DNA, 726 bp, Artificial Sequence
  Description of Artificial Sequence: Synthetic coding sequence
atggccagtaataatcactggttccaaagtagccaagtgccttcatttgctcagatgctgaaaaaaaatttgcctgtgcaacccgctactaaaaccataactaccccaacaggatggtcaagcgaatcctacgggcttagtaaaatggcttcaaaagtgactcaggtgacaggaaactttcctgaacctctgttgagtaaaaatctcagtagcatcagtaatcctgtgttgccccctaaaaagatacccaaggaattcatcatgaaatacaagcggggtgagatcaaccccgtctccgcactccaccagtttgcccagatgcagagggtgcaactggatttgaaagaaacggttactacaggaaatgtgatgggaccctactttgctttttgcgcagtcgtggatggtatccagtacaaaactgggctggggcagaataagaaagagtcgcgttctaatgcagcaaaactggccctggacgagctcctgcaactggatgagccagagccacggatactcgaaacttcagggccaccgccattccccgctgagcccgtggtgctttctgaactcgcctacgtgagcaaggtgcactacgaaggcaggcacattcagtatgcaaaaattagtcagattgtcaaagagcgcttcaaccagttgatcagcaacaggagcgagtacttgaaatactcaagctctctggcagcctttataatcgagagatag

SEQ ID NO: 213626 - DNA, 471 bp, Artificial Sequence
  Description of Artificial Sequence: Synthetic coding sequence
atggcttccaataaccactggtttcagtctagccaagtgccttcctttgctcagatgctgaaaaaaaacctgcccgtgcaacctgccacaaagacaatcactactccaactggttggtcatctgagagctatggactttcgaaaatggcaagtaaggtcacccaggtcactggtaatttcccggaacctttactgtctaaaaacctctccagcatcagtaatcctgtgttaccgccaaagaaaattcctaaagagttcattatgaaatacaagcggggtgagatcaatcccgtgagcgcactgcatcaattcgcacagatgcagcgcgtgcagctcgatctgaaggagaccgtgaccaccggcaatgtgatgggcccatacttcgccttctgtgctgtcgtggacggcatacagtataaaacaggcctgggtcaaaacaagaaggagtcaagatctaacgccgcaaagtag

SEQ ID NO: 213627 - DNA, 1677 bp, Artificial Sequence
  Description of Artificial Sequence: Synthetic coding sequence
atgctgaagaaaaatttaccagttcagccagccaccaagactatcaccacccctaccggctggtcctcggagtcttatggtctgtctaaaatggcctccaaagtgacgcaagtgaccggcaattttcccgaacccttgttgtctaagaatctgagcagtatttctaacccagtgctgccacccaagaagattcctaaggagtttatcatgaagtacaagcggggtgaaattaatcccgtgagcgcgctccatcagttcgcgcagatgcaacgggttcagctagatttgaaggaaactgtgacaaccgggaatgttatggggccatacttcgcgttttgtgctgtagttgacggcatccaatataaaacaggtctcggccagaacaagaaagagagccgttccaatgctgctaaactggccttagacgaacttctgcagcttgatgagcccgaaccacgcatcctcgagaccagcggccctccgccattcccagcagagcctgttgtactgtccgaacttgcatatgtgtcaaaagtacactacgaaggtagacacatccaatacgccaagatctcacagatcgttaaagagaggtttaatcagctgatatcaaatcgctctgaataccttaagtattccagcagcctggcagcgttcattatagagagagcaggtcaacacgaggttgtcgccataggaacgggagaatataattattctcaagacatcaagcctgacggccgagtgttacacgatacacacgccgtggtgacggcaaggagaagtttattgaggtacttttaccggcaactgttactgttttactcaaagaaccctgctatgatggaaaagtctattttttgcaccgagcctacttcaaatctcctgacgctgaaacagaatatcaacatctgcctgtacatgaaccagctgcctaaagggtccgctcagatcaagtcccaactccggctcaatccccattccatttcagccttcgaggctaatgaagagctatgtctgcatgttgctgtcgagggaaaaatctaccttacagtctactgtcctaaggacggcgttaataggatttcctcaatgtcctcatccgacaaactgaccaggtgggaggtgctcggcgtccaaggcgctttactgagccactttatccaaccggtgtacatctctagcattttaatcggcgacgggaactgttccgacacccgcggactggaaatcgccatcaaacagcgagtggatgatgccctcacctcaaagttgcctatgttctacctggtaaatcgaccccacattagcctcgtgcccagcgcgtatccactgcagatgaatttggaatacaagtttctgtcactgaactgggcccagggggatgtgtctctggagatagtggacggactgagtgggaagataaccgagtcctccccatttaagagtggcatgtcaatggcatctcggctgtgcaaggcagcaatgctgagtaggtttaaccttctcgcgaaggaggccaagaaagaactgctggaagctggaacttaccacgcggctaaatgtatgtctgcttcctatcaggaagctaagtgcaagctgaagagctacctacagcagcacggctacggcagctggattgtgaagagcccttgcatcgagcaattcaatatgtag

SEQ ID NO: 213628 - DNA, 3810 bp, Artificial Sequence
  Description of Artificial Sequence: Synthetic coding sequence
atgatgagcccgatctgcgaccagaccattgacagcagactcaaagtcgaaaaagccacttggtggggcagggtcggagggggtagccgcccacactggcagtcccctggggtgcggccatgtcctgaagaggtgcaggaccccggatactccctgtccggatattacacccacccattccaaggttacgagcaccgccagttgcggtaccaacagccgggacccggttcttccccatcgagctttctgctcaagcaaattgaatttctgaaagggcagctgccggaagcaccggtgattggcaaacagactccttcgctccccccttcactccccggattgaggcctcgctttcctgttcttctcgcttcatccacacgcggtcgacaggtcgatatcaggggcgtcccccgaggggtgcacttaaggagccagggactgcagcgtggctttcagcacccatcccctaggggcaggagcctacctcagcggggtgtcgattgtctgtcctctcattttcaggaactctctatttaccaggatcaagaacagcgtattcttaaatttttggaggaactcggagagggaaaagccacaacagctcatgacttgagcggcaaactgggcaccccaaagaaggagataaacagggtgctgtactctttggccaagaaaggcaaactgcagaaggaggccggtaccccacccctgtggaaaattgctgtcagtactcaagcttggaatcaacactctggcgtggtcaggccagatggccatagccagggtgcacctaattctgatccatctcttgagccagaagatcggaacagcacctcagtctctgaggatctgctagaacccttcatcgctgtttccgcccaggcgtggaaccagcactccggtgttgtgaggcccgactcccactcccagggctctcctaatagtgaccccggacttgagccagaagatagtaatagtacatctgcccttgaagacccgttggagttcctagacatggccgagatcaaggaaaagatctgtgactatctgttcaacgtcagcgattcttctgccctaaacttggccaaaaacataggtctgacaaaggcacgggatatcaacgctgtcctgatcgacatggaacgccagggagatgtatatcgccaggggacaactcccccaatctggcacctgacagacaaaaagcgtgagcgcatgcagatcaaacgaaacacaaattctgtccccgagactgcccctgccgcaattcctgagacgaaaagaaacgccgaatttctgacttgcaacattccaacatcaaacgcctcaaacaacatggtgacaactgagaaagtcgagaacggccaggaaccagtgatcaagctggaaaaccgccaggaggccaggcccgaacccgctagactcaaacctccagttcactataacgggccaagcaaagccggttatgtcgattttgagaatggtcagtgggccaccgatgacatccctgacgatctgaattccatccgtgcagccccaggcgagtttagagccataatggagatgccctccttttatagccatggtcttcccagatgtagcccttataaaaagctgacagaatgtcaacttaagaacccaattagcggcctactggagtatgcccaattcgcatctcaaacctgcgagtttaacatgattgaacagagcggcccaccccacgagcccagattcaagtttcaagttgtgattaacggcagggagttcccaccggcagaagctggctccaagaaggtggcaaaacaagacgccgctatgaaggcgatgaccatactgctggaggaggcaaaggctaaggatagcgggaaatccgaggaatcatctcattatagtacggagaaggagtccgagaagactgcagagtctcaaactcccacaccaagtgctactagcttcttcagcggcaagagcccagtcactaccctcttggagtgcatgcacaaacttgggaactcttgtgagtttcggctgctgagtaaggaaggaccggctcacgaaccaaaattccagtactgcgttgccgtaggcgctcaaacctttccgtctgtgtctgccccttctaagaaggtcgctaagcagatggcggcagaggaagcaatgaaggccctccatggtgaagctactaattccatggcctccgacaatcaacccgaggggatgatcagcgagtcacttgataatctggaaagtatgatgcccaacaaagtgaggaagataggagaactggtgcgatacctaaacactaaccccgtggggggactgctggaatatgccagatcccatggattcgctgctgagtttaagctggtcgaccagtcggggcctccccatgagcccaagtttgtgtaccaggccaaagtgggcggaagatggttccccgctgtttgcgctcactcaaagaaacaggggaagcaggaagccgctgatgcagccctgcgtgtgctgattggtgagaacgagaaggctgagagaatgggcttcacagaggtcacgccggtgacaggtgctagtctcagacgaaccatgcttctgcttagccggtcaccggaggctcagccaaagaccctgccccttacaggcagcacctttcacgaccagatcgccatgctgagccataggtgtttcaataccctcactaattcattccagccgagtctgctgggtagaaagatactggctgctatcattatgaagaaagattccgaagatatgggcgttgtggtttccctgggcaccgggaacaggtgtgtcaaaggcgactctttatccttgaagggcgaaactgttaacgattgccatgccgagatcatatcccggagaggatttattcggtttctttacagcgagctgatgaagtataattctcagaccgctaaagattcaattttcgaaccagccaaaggtggtgaaaagttacagatcaagaaaacagtgtcttttcacttgtacatctccacggctccatgcggggatggagccttatttgacaaatcttgtagcgatcgggcaatggagtccacagaaagccgtcactaccctgtgttcgagaaccctaagcagggtaaattacgcaccaaggtggagaacggagaagggaccataccagttgaatcttctgacattgtccctacctgggatgggatacgcctaggcgaacgcctgaggaccatgagttgcagcgataagattctgaggtggaacgtgctcggattacagggcgctttgctcacccactttttgcagcccatatacctgaaaagtgtcacactgggatatcttttttctcagggacacctgacgagagctatctgttgccgtgtgactcgggacggctccgcgttcgaagacggcctgcgacatccctttattgtcaaccatcccaaagtgggacgcgtgtccatctatgactcaaaacgccaatcaggaaagacaaaagaaacttccgttaactggtgcctcgcggacgggtatgacctcgagatattggacggtacacgtgggaccgtggatggacctcggaatgagctcagcagagtttccaaaaaaaatatcttcctgctgttcaagaaactctgctcctttcgataccgcagagatctcctgcggctgtcgtatggggaagccaaaaaggcggctcgtgactatgaaaccgccaagaactacttcaagaagggtttgaaagacatgggttatggcaactggattagcaaacctcaggaggaaaaaaatttctacttatgccccgtgtag

SEQ ID NO: 213629 - DNA, 159 bp, Artificial Sequence
  Description of Artificial Sequence: Synthetic coding sequence
atggcaaatgagcacacattaattcaccccgctagcatcgaagatcccctggaggctcggcctatgtccgacgaagaccccgaagacgaggatgccctgcccgctcgatggaagaaggagatgggacggaagcgcaagcgtaccatcgctacgctgtag

SEQ ID NO: 213630 - DNA, 2106 bp, Artificial Sequence
  Description of Artificial Sequence: Synthetic coding sequence
atggacattgaagatgaggagaacatgtcgagttccagcaccgatgtgaaggagaaccgcaacctagacaatgtgtcgccaaaagatgggagcacccccggacccggtgagggctcacaactctccaacggagggggaggcggaccgggacgcaagagaccactggaggaaggatccaatggtcactctaagtaccggcttaaaaaacgccgtaagaccccagggcctgtgttgcctaagaatgccctcatgcagctcaacgaaatcaaacctggattacagtatacattgctcagccagactgggccagtgcatgcccctctgtttgtgatgtcagttgaggtcaatggtcaggtgtttgaagggagtgggccaaccaaaaaaaaagcgaaattacatgctgcggagaaagctctgagatccttcgtccagtttcccaatgccagcgaggcgcatttagccatggggcgaaccctcagcgtgaacaccgatttcacatccgatcaagcagacttccccgacacgctgttcaacgggtttgaaacacccgataaagcggaaccaccattttacgtggggagtaatggagacgatagcttctctagctccggagacctgtccctctcggcgtctccagtgccagcctctctcgcgcagcctcctctgccagtccttcctccatttccacctccctccgggaaaaatcctgtgatgatactgaatgagctcagaccaggacttaaatatgactttctttccgaaagcggtgaaagtcacgccaaatctttcgtgatgtcagtggtcgtggacggtcagttctttgagggctcaggcagaaataaaaagctcgccaaagcccgagcagcccagtctgccctggctgctatttttaacctgcatctggatcagactccctcacgccaacccatcccttccgaaggccttcaactgcatctgccccaggtgctcgcggacgctgtgtctagactggtgctcggaaagtttggagaccttaccgacaactttagctcaccacatgctaggcgcaaagttctggccggagtcgtgatgacgaccggcactgatgtgaaagatgcaaaagtaatcagtgtgtctaccgggactaagtgcatcaatggagagtacatgagtgaccggggtttggctctgaacgattgtcatgcggagatcatctctcgaaggtcactccttcggtttctctacactcagttggagctgtatcttaataataaggatgatcagaagcgcagcattttccagaaatccgagagggggggattccggttgaaggagaatgtgcagttccatctctatatcagtactagcccatgtggtgacgcacgcattttcagcccacacgagcccatcctggaagagcctgcagatagacaccctaaccgaaaagcccgtggccagctgcgcactaaaatcgagtcaggtgaagggactatccctgtgagatctaacgcttcaatccaaacctgggatggggttcttcaaggtgagaggctgttgaccatgtcttgttctgacaagattgccaggtggaacgtggtgggaatacagggaagcttactgtcaatctttgtggagccaatctatttctcttcaatcatcctcggaagtttgtaccacggggatcatctttcacgtgctatgtaccaacgaatcagcaacattgaggaccttcctccgttgtacaccctgaacaagccactgctctcaggcatctcaaacgcagaagctaggcaaccagggaaagctcctaacttctccgtcaactggacagtcggggactctgcgattgaggtgattaatgccacaactggtaaggacgagctggggcgtgcaagcaggctttgcaagcatgctctttactgcagatggatgagggtgcacgggaaagtcccatcccaccttctgagatccaaaattacaaaacccaacgtctatcatgagagtaagttggcagctaaagagtatcaggcggctaaagccaggctgttcaccgcgttcataaaagcagggctgggcgcttgggtggaaaagcccactgaacaggaccagttttccttgactccctag

SEQ ID NO: 213631 - DNA, 2226 bp, Artificial Sequence
  Description of Artificial Sequence: Synthetic coding sequence
atggatatcgaagacgaggagaacatgtcctcaagttccactgatgtaaaggagaaccgaaatctcgataacgtctctcctaaagatggctctacaccaggccctggggagggttcgcagctaagtaatggcggtggcggaggcccaggcaggaaaaggcctctggaggagggaagcaacggccattctaaatatagactaaagaagcggcgtaaaactccaggtcccgttctacccaagaatgccctgatgcagctcaatgaaattaagcccggactgcagtacactttgctgagccagacaggcccagtccacgctcccttgtttgtcatgtccgtagaggtgaatggccaagtctttgagggaagtgggccaacaaaaaagaaggctaaactgcacgcagccgagaaggccctgcgctcctttgtccagttccctaatgcctcagaagcacacctggcgatgggtagaactctcagcgtcaatacggactttacttccgaccaggctgattttcctgacaccttgtttaacggcttcgagactcctgataaagccgaaccccctttttatgtgggatcaaacggagacgatagtttcagctcttccggcgatctgtcactgtctgcatctccagtcccagcatcgctggctcagcctcctttgccagtccttcccccttttccccctcccagtgggaagaatcctgtcatgatcttgaatgagctcagacctggactcaaatatgactttttgagcgagagcggcgagtctcacgccaagtcctttgttatgtctgtggtggtcgacgggcagttcttcgaggggtctgggaggaacaagaaactggcgaaggctagggccgcacagtccgccctggccgctatcttcaatctgcacctggatcagacgccctcccgccaacctattccctctgagggactgcagctgcacctgcctcaggtgctggctgacgcggtaagccggcttgtgctggggaagtttggtgatctgacagacaatttctcatctccccatgccagaagaaaggtactggccggagtggtgatgacaacaggcaccgatgtgaaggacgctaaggtcatctctgtgtccaccgggaccaagtgtataaatggagagtatatgtcggatagagggctggccctgaacgactgtcacgccgaaatcattagtagacggtccttgctgcgcttcctctacacacaacttgagctgtacttaaataacaaggatgaccagaaaagatccatatttcagaagagcgagcgcggaggattccgactcaaagaaaacgttcagttccatctttatatcagcacatcaccatgtggtgacgctaggattttcagccctcacgagccaatccttgagggatcccgctcgtatacacaggcaggcgtccagtggtgcaatcacggcagcctgcagccgaggccccctggtttgctgtccgacccctccacctctacatttcaaggagccggtaccacagaacccgctgatcggcaccccaatagaaaagcccgtggacagctgaggaccaaaatagagtctggcgaggggacaatccccgtgcgcagcaacgctagtatccagacctgggatggagtgcttcagggcgagcgactgctgactatgtcttgttccgataaaattgccaggtggaatgtcgtgggaatccaaggctccctcttgtccattttcgtggagcccatttattttagcagcatcatcttggggtccctttaccacggcgaccacctctcccgtgcaatgtaccagcgcatttcaaatatcgaagatctgccacctttatataccctgaacaaacccctgttgtcaggtatttcaaacgccgaagcacgccagcccggaaaagcacccaatttctcggtgaattggacagtgggagattctgccatcgaggtcataaatgccaccacgggcaaggacgaactgggacgggcatctaggctgtgtaaacacgcactgtactgtcgctggatgcgcgtgcatggaaaggtgccttcccacctgttgagaagcaaaatcacaaagccaaacgtgtaccacgaatcaaaattggcagccaaagagtaccaggctgccaaggcacggctctttaccgcctttattaaggcagggctgggggcttgggtggaaaagccgactgagcaggaccagtttagcctcactccttag

SEQ ID NO: 213632 - DNA, 2145 bp, Artificial Sequence
  Description of Artificial Sequence: Synthetic coding sequence
atggacatcgaagacgaagagaatatgtcttcctcgtccaccgatgtcaaagagaaccgcaacctcgacaatgtgtctcctaaggatggaagtacccccggacctggagaaggcagccagttgtcgaatgggggtggcggtgggccaggccgaaaacgcccactggaggagggaagcaacggtcacagcaaataccggctgaaaaagcggcgtaagacccccggtcctgtacttcccaagaacgcacttatgcagcttaatgagatcaagcctggactacagtacaccctgctcagccaaactggcccagtacacgccccactcttcgtcatgtctgtcgaggtaaacggccaggtattcgagggatccgggcctaccaaaaagaaagcgaagctgcacgcagccgaaaaagccttgcgctctttcgtacaatttcctaacgcctctgaagctcacttggctatgggaaggacgctgtccgtgaacacagattttacatccgatcaggcagatttcccagacacattgttcaacggatttgagactcctgataaggcagagccgccattttacgtaggctcaaacggagacgactcattcagctcaagcggcgaccttagcctctctgcctctccagttccagcaagtctggcccagccccctttacctgtgctgcccccattccctcctccttctgggaaaaacccagtcatgatactcaacgaattgcgcccaggtctaaagtatgattttcttagtgagagcggcgagtcccatgccaagagttttgtgatgtctgtggtggtcgacgggcaattctttgagggctctggtagaaacaagaagcttgccaaggcacgagcagcccaatccgcattagccgctatctttaacttgcacctggaccagactcctagcagacagccaatcccgtcagaagggcttcagctgcatctgcctcaggtgctggcggatgcagttagtagactcgtactcggaaaatttggggacctcaccgacaatttttctagtccccatgccagacgcaaagtgctggctggcgtagtgatgacaacgggcacggacgtcaaagacgctaaggttatcagtgtcagtacaggcaccaagtgtataaacggggaatacatgagcgacagagggcttgcgctgaatgattgtcacgctgaaatcataagcagacgctccctgctgcggttcctgtatacacaacttgaactatacttaaataacaaagatgatcagaagagatcaatattccagaaaagcgaacgaggcggtttcagactgaaagaaaacgtgcaatttcacctatacattagcaccagcccatgcggtgacgctaggatatttagtccgcacgagcctatcctcgagggctcacgctcctacacacaagcaggagtccagtggtgtaaccacgggagcctgcagccaaggcccccaggtctcctctcagatccatcaaccagcacattccagggggcagggacaactgaacccgctgatcgtcatcctaaccggaaggcacgaggacagttaaggacaaaaatcgagtcgggcgaggggacgatccctgtgagatcaaatgctagtattcagacctgggacggggtgctgcagggagaacggctgctcacaatgtcttgcagcgataaaatcgcccgatggaatgtggtcggcatccaaggaagtctcctgtcgatattcgtggagccgatctacttttccagcatcatcctgggatccctgtaccatggggaccatttaagccgggcaatgtaccaacgtatctccaacatagaagacctcccaccgctttacactctaaacaaaccgctgctgtccggaatcagcaatgccgaagctcgccagcccggaaaggcacctaacttctccgttaactggaccgtgggtgactctgccatcgaggtgattaacgccacaacgggcaaagacgagctcggaagggccagccgattgtgtaagcatgcgctgtattgtcggtggatgcgggtccatgggaaagtaccgtcacaccttctgcgaagcaagatcaccaagcccaacgtatatcatgaaagcaagcttgccgcaaaggagtatcaggcagccaaggtgcattag

SEQ ID NO: 213633 - DNA, 39 bp, Artificial Sequence
  Description of Artificial Sequence: Synthetic coding sequence
atggatatagaagacgaggagaatatgtccttttcctag

SEQ ID NO: 213634 - DNA, 426 bp, Artificial Sequence
  Description of Artificial Sequence: Synthetic coding sequence
atggacatcgaggacgaagagaacatgtcctctagcagtaccgacgtcaaagagaatcggaacctcgataacgtgtcccccaaagatggtagcactccgggaccaggtgaaggaagtcaattgagtaacggaggagggggtggaccgggaagaaaaaggccccttgaagaggggtcaaatgggcacagtaagtatcgcctcaagaagaggcgcaagacacccggacccgtcctccccaaaaacgcactcatgcaactgaatgaaatcaagcccggattgcagtacacactgctcagccagaccggtcctgtccacgcccctctgtttgtgatgtcagttgaagtaaacggccaggttttcgaaggctcgggacccaccaagaaaaaggccaagttacacgcggcagagaaagccctacgatcttag

SEQ ID NO: 213635 - DNA, 2226 bp, Artificial Sequence
  Description of Artificial Sequence: Synthetic coding sequence
atggatatcgaagacgaagaaaatatgagttcctctagtaccgatgttaaagagaacagaaatctggataacgtttctccaaaggacgggtccactcccggacctggggagggttcccagctgagcaatgggggtggcggagggcctggcaggaagcgtccactggaagaaggctcgaatggccactccaagtataggctcaaaaaaagacgaaagacgcctggcccagtgctgcccaagaacgcactgatgcaacttaacgagatcaagcctgggctccagtatacgctgttaagtcagactgggccagtgcacgcgccactgttcgtgatgtccgtagaggtaaacggacaggtctttgaaggtagtggtcccaccaagaaaaaggcaaagctgcacgctgccgaaaaagctttacgaagttttgtccagtttcccaacgcgtcagaagcgcatctcgccatgggacggacactgagcgtcaacacagattttacgagcgatcaggcagacttccccgacactctgtttaatggctttgagacacctgataaagctgagcctccattctacgttgggagcaacggagacgacagctttagttccagtggagacctgtccttgtctgctagtccagtcccagctagcctggctcagcctcccctgcctgttctgccaccctttccacccccatcaggcaagaaccccgtgatgatattaaacgagcttcgtcccggtctcaagtatgacttcctctcggaatcaggggaatctcatgctaagtcttttgtgatgagcgtcgttgtcgatggccagttttttgagggatcagggaggaacaaaaaactcgccaaagctcgggcagcccagagcgctctggccgctatcttcaatctgcacctggaccagaccccatctcggcagcccatccccagtgaggggcttcagctgcacctcccacaggtcctggctgatgcagtgtcccgccttgtacttggcaaatttggagatctcaccgacaacttctcttccccccatgccaggcggaaggttctggctggggtggtaatgactactggaacggatgttaaggacgctaaggttatcagcgttagtaccgggactaaatgcattaacggagaatacatgtcagaccggggtttagctttgaacgactgtcacgctgaaattatctctaggcgctcactgctaagattcctatacacacaactcgaattatacctcaataacaaggatgaccaaaaaagatctatattccaaaagagcgagagagggggtttccgcttaaaggaaaacgtgcagttccatctgtacatctccacatccccatgtggtgatgctcgcatcttcagcccccacgaaccgatcctggaaggatctcgatcctacacacaggcgggtgtgcaatggtgcaaccacggcagtctccagcctcggcctcctggcttgctgtccgacccgtcgactagtactttccagggtgccggaacaacagagccagcggaccgtcatccaaatcggaaagctcgtggccagctgaggactaaaatcgaatctggggaaggaactatccctgtgcgttccaatgcctctatccagacctgggacggagtgcttcagggcgaaagactcctcaccatgagttgcagtgacaagatcgctaggtggaatgtagtcggtattcaaggctctcttttgagcattttcgtcgaacctatctatttttcgagcatcatccttgggtcactgtatcacggggaccatttatctcgcgctatgtaccaacgcatttccaatatcgaggacttgcctccgctctacacattgaacaaacctctgctgtctgggatctcaaatgcagaagccagacagccaggcaaggctcccaactttagcgtcaactggacagttggggactctgctatagaggttataaatgcaaccactgggaaggatgagctgggcagggctagtcgtttatgtaagcatgccttgtattgccggtggatgcgcgttcatgggaaggtgccatcacatctcttgagaagcaaaataaccaagccgaacgtgtatcacgagagcaaacttgctgctaaggaatatcaggcagccaaggcccgactgttcacagcgttcatcaaagcaggactgggggcttgggtggaaaagccaactgagcaggaccagttcagtctgactccatag

SEQ ID NO: 213636 - DNA, 2226 bp, Artificial Sequence
  Description of Artificial Sequence: Synthetic coding sequence
atggacattgaagacgaagaaaacatgtcctcgtcctccacggatgtgaaggaaaacagaaatctcgataacgtgagtcctaaggacggctcgactccgggacccggtgagggcagccaactgtccaatgggggagggggaggcccagggaggaaaagacccctggaggagggctctaacggccattccaaatacagactgaagaaacgacggaaaaccccaggacctgtcctgcccaagaatgctctaatgcagttgaacgaaattaagcccggtttgcagtatactctgttgagccagacgggaccagtgcatgctccgctgtttgtcatgtccgtcgaagtgaatggccaggtctttgagggaagcggtccaaccaaaaaaaaggctaagttgcacgcagcggagaaggcactgaggagtttcgtgcagttccctaacgcttctgaggcccaccttgccatggggagaacgcttagtgtgaacactgactttactagcgatcaagcggactttcctgatactctgtttaatggttttgagacccccgataaggctgaaccgcctttctacgtaggttcgaatggggatgactccttttcttccagcggggatctcagtctttcggccagccctgttcctgccagcttggcgcagcctcccctacctgttttgccgccttttcccccaccgtcaggaaagaatcctgtgatgatcttgaacgagctccgccctggactgaagtacgatttcctctcagagtccggggaaagccacgcgaagagcttcgtgatgtccgtcgttgttgatgggcagtttttcgaggggtcagggaggaacaagaagctcgcaaaagctcgagccgcacagtccgccctggctgccattttcaacctgcatctggaccagacgccctctaggcagcccataccctcagagggcttacagctccaccttccccaggtcttggcagacgcagtttctcgcttagttcttgggaagtttggagatctaaccgacaatttctccagtccccacgctagacgcaaggttctggccggtgtcgtaatgactacagggaccgacgtgaaggatgcaaaggtcattagcgtctctacaggcacaaaatgtatcaacggagagtacatgagcgatcgtggcctagcccttaatgattgccacgctgaaattattagcaggcgctccttgctgcggtttctgtatacccaactggaactttatctcaacaataaagacgaccagaagcggagcattttccagaagtcagagcgcggaggctttcgcctgaaagaaaacgtgcagtttcatttgtacatctcaacgtcgccctgtggagacgctaggattttctctccccatgaacccattctggaagggtctcgctcttatacacaggcgggtgtccaatggtgcaatcacggatcactgcagccacgaccacctggtctgcttagcgaccctagtacaagcacctttcagggggcaggaacgactgagccggcagaccgtcatccaaacagaaaggccagggggcaactccggactaagatagagtccggggaaggaaccattccagttcgctctaatgcctcaattcaaacatgggacggggtgctgcaaggcgagagattgctcaccatgtcatgcagcgataagatcgcgaggtggaatgtcgttggaatacagggcagcctcctgagtatctttgtggaaccaatatatttctcttcaatcattctcggctccctgtaccatggcgatcatctgtcccgagctatgtaccagcgcattagtaatatcgaagacctgccacctctctacactctgaacaagcctctcctgagtggcatttctaacgccgaagctaggcagccaggaaaggcaccgaatttttcggtgaactggaccgtgggagattctgctatcgaggtgatcaatgctaccaccgggaaggacgagctcgggcgagccagtagactctgcaaacacgctctttactgtagatggatgagagtgcatggcaaagtaccttctcacctcctgcgctccaaaatcaccaaaccaaacgtgtatcacgagtcaaaattagctgcaaaggaatatcaggctgccaaagcaaggcttttcactgctttcattaaggccggattgggggcttgggtcgaaaaacctaccgagcaggatcagtttagtctgactccatag

SEQ ID NO: 213637 - DNA, 2097 bp, Artificial Sequence
  Description of Artificial Sequence: Synthetic coding sequence
atggacattgaggacgaggagaacatgtccagttctagcacagatgtgaaagagaaccggaatctcgacaacgtgtctcctaaggacggatccactccgggacccggagagggatcacaactaagcaacggcggaggcggaggccctggaaggaagcgaccactcgaagaggggtccaacggccattctaaataccgtttgaagaagagacggaaaactcccggtcccgtcctgcccaagaacgccttaatgcaacttaacgaaatcaagccaggtcttcagtacacgctgctttctcagaccggtcccgtgcacgcacccttgtttgtgatgtctgttgaggtcaacggacaggtgtttgagggcagtgggccaacaaagaaaaaagcaaagctgcacgccgctgagaaggctctgcggtctttcgtgcagttcccaaatgcgtcagaagcacatttagctatgggaagaacactgtccgtcaacaccgatttcaccagtgatcaggccgacttcccggataccttatttaatggtttcgaaactccggacaaggcggagccgcctttctacgtcggatccaatggagacgactcctttagcagcagtggagatctgtccctgtccgcctcccctgttcccgctagcctcgcccagccacccctgcctgttcttccaccattcccccctcctagcggcaaaaacccagttatgattttaaacgaactccgacccggtcttaagtacgactttttgagcgagtctggcgagagccacgccaaaagtttcgtgatgtcagtggtcgtggatgggcagttcttcgaaggctctggcagaaacaaaaaactcgccaaggcccgagccgcacaatctgcattagctgctatctttaatctccaccttgatcaaactccctcacgacagccaattccctctgagggcctgcagttgcatctgccccaggttctggccgacgcagtgtcaagattagtgctgggcaaattcggcgacctgaccgataacttctcttccccacatgctagacggaaggtattggccggagtcgtaatgaccacaggtaccgatgttaaggacgctaaggtgatctccgtctctacgggtaccaaatgtattaacggcgaatatatgagcgaccgaggcctggcccttaacgattgtcatgctgagataatctctcgtagatccttattgaggttcctgtacactcaactcgagctttacctgaataataaggatgaccaaaagaggagcatatttcagaaaagtgaacgtggcggattccgtctaaaggaaaatgtgcagtttcacctttatattagtacatcgccctgcggagatgcccgtatcttttccccacacgagcctatcttggaaggatctcggagttatacacaggccggagtccagtggtgtaatcacggatctctgcagcccagaccccctggcttactgagtgacccgtcaacctcgaccttccaaggcgcagggaccaccgaaccagcggaccggcaccctaaccgcaaggctcggggacagctgagaactaaaatagaatccggagagggcactatcccagtacggagcaatgcttcaatccagacttgggacggcgtgctgcaaggcgagaggctcctgaccatgtcctgttccgacaagatcgctcgctggaacgtggtgggtatccagggttctctgctcagcattttcgtagagcctatctatttttcctccattattctgggcagcctttaccacggagaccacctctctagagcaatgtatcagcgaatctctaacatcgaagaccttcccccactctacaccttgaacaagcccttattgtccggaatcagtaatgcagaagctcgccagccgggaaaagcccctaatttttccgttaattggacagtgggagacagtgcaatcgaggtgatcaacgcaacaactggaaaagacgagctgggcagggcatcccggctgtgcaaacacgcactctattgtcggtgggcctgcgcgaggcaggggagtttgcccctaactaccctgcaagactatcaggcccagcgggtgccttag

SEQ ID NO: 213638 - DNA, 426 bp, Artificial Sequence
  Description of Artificial Sequence: Synthetic coding sequence
atgagccacagaatggaaggtgtcggccaattgcctgcctcttacaggcacaatagaccgttattaagtggtgtgagtgatgcggaggcgagacagccgggtaaaagcccccctttcagcatgaactgggtagtcggatccgcagatttggaaatcatcaacgctactaccggaagacgcagctgcggcggtccctcacgcctttgtaagcacgtactctctgcacgctgggccaggctttacggcagactttcaacccgcacaccatcaccaggggataccccatcaatgtactgtgaagctaaactgggcgcacatacctaccagagcgttaaacaacaattatttaaggcctttcaaaaagccggtttaggcacatgggtccggaaacctccggagcaacagcagttcctgctaactctctag

SEQ ID NO: 213639 - DNA, 747 bp, Artificial Sequence
  Description of Artificial Sequence: Synthetic coding sequence
atggggttgtggtcccccgtccccggtaattcggttccacgcgctccagtcatggctgggctgggactgggacattcacaaggtgcgccacagggcccacacgatggcaagactgaccggtcatccggacctggtcggaggagaaccgagagaacgcgcctgcctggtcttctcggtggagccccattaacagccggtagcccacaccgctggaacgtgttgggtctgcagggcgcactgctgtcacattttgtggaacctgtctacctgcagtcgatcgtcgtgggctccttacatcacaccggacacctggctagagttatgtctcatcggatggagggggtgggccagctgcccgcttcttatcgccataaccgcccactcctgtctggggtgtcagacgcagaggcaaggcagcccggtaaatcacctcccttttctatgaattgggtcgttggcagcgcggatctggaaataatcaatgcaaccacaggaagaagaagttgcggagggccatctcggctctgcaaacacgttctgagtgcccgatgggcgagactctacggtaggctgtcgacgagaacccctagccctggagacaccccaagtatgtactgcgaggccaagctaggagcccatacataccagtcagtaaaacagcagctttttaaagcattccagaaggctggactcggtacttgggttcgtaaaccacctgagcagcagcagttcttgcttacactttag

SEQ ID NO: 213640 - DNA, 2220 bp, Artificial Sequence
  Description of Artificial Sequence: Synthetic coding sequence
atggcatcagtgcttgggtctgggagaggctctggtgggctgagctcacaattaaaatgtaagtctaaaaggcggcgaagacggcgtagcaagcgcaaggataaggtcagtatcttgagcacgttcctggcaccctttaagcatctctccccgggaatcacgaacacggaggacgacgacacattgtctaccagctctgctgaggtgaaggaaaaccgaaatgttggcaatctggctgctagaccaccccctagcggagacagggcccgagggggagcacccggtgctaagcgtaaacgaccgctggaggaagggaacgggggtcatctttgcaagcttcagttagtctggaaaaaactcagctggtctgttgctccgaaaaatgccttggtgcagctacatgaactgcggcctgggctgcagtaccgcacagtatctcaaacagggcctgtgcacgcccctgtctttgccgttgccgtagaggtgaacggcctcacctttgaggggacaggacccaccaaaaagaaagccaagatgcgagcagcagagttggctctgcggtctttcgtccaattccccaacgcgtgccaagcccacctggccatggggggagggcctgggcctgggaccgatttcacatccgaccaagctgatttccccgacacactctttcaggaatttgaaccacctgctcccaggcccggattagctggcggtcggccaggagatgccgctctgctatccgcagcctatggacgcagacgactcctctgtcgggcactggacctggtagggccaactccagctacacccgctgctcccggtgagaggaaccctgtggttttactaaatagactaagagcaggcctgagatatgtttgcctggccgaacccgctgaaagaagagctagaagctttgtgatggcagtgtccgtcgatggcagaacgttcgaaggatcggggcgaagcaagaaattggcgagggggcaggccgcacaggccgctcttcaagagctgttcgacatccaaatgcctggccacgccccaggccgagcacgcaggactcctatgccgcaagaattcgccgattctatatctcagctcgtgacccagaagtttcgtgaggtcaccaccgatctgactccaatgcacgctcgccacaaggcccttgctgggatcgtcatgacaaaagggctggacgcacgccaggcccaggtagttgcccttagctctgggactaagtgcataagtggggaacaccttagtgatcaaggtctggtagtgaatgactgccacgcggaggtggtggcacggagggctttcctgcatttcctctatactcaactggaattgcacctcagtaaaagaagagaagacagtgaaagatcaatctttgtgaggctcaaggagggaggatatcggctccgcgaaaacattttattccatctttacgtgagtaccagcccctgcggcgacgcaaggctccactctccatatgagatcacgacagacctccactccagtaagcacctagtgagaaagttcaggggtcacttgcgaactaaaatagaaagtggggaaggcacggttcccgtgcggggacccagcgcggttcagacttgggacggagtgctcttaggggagcagcttataacaatgtcatgtaccgacaaaatcgcccgttggaacgtgttgggtctgcagggagcactgctgtcgcatttcgtcgaacctgtgtatcttcagagcattgtggtcggcagcctccaccacaccggccacctggcgagagtgatgagccacaggatggaaggcgtcggccagctgcctgccagttacagacacaacaggccgttgctctccggcgtgtctgatgccgaggccaggcagcctggcaagagtccccctttcagcatgaattgggtggtcggctccgcagatctggaaattatcaatgcaacgacaggaagacggagttgtgggggtccttcaaggttgtgtaagcacgttctgtctgcgagatgggcgaggctatatggaaggctgtctacccgcaccccaagtcctggtgacacaccaagcatgtattgcgaggctaagttaggcgctcacacgtaccaaagtgtgaaacagcagctcttcaaagcttttcagaaagccggattaggcacgtgggttcgcaagcccccagagcaacagcagtttctgctgaccttgtag

SEQ ID NO: 213641 - DNA, 1509 bp, Artificial Sequence
  Description of Artificial Sequence: Synthetic coding sequence
atgtggacagctgacgaaattgcccaactttgttatgagcattacggaatcagactgccaaagaagggtaagccagagccaaatcatgaatggaccctgttagcggctgtcgtcaagatccagtctcccgctgataaagcctgtgatacgccagacaaacccgtccaggtgactaaagaggtagtgtctatggggaccggcacgaagtgcatcggccaaagtaagatgcgcaagaatggcgacattctcaacgattcacacgccgaggttatcgcgagacgatcatttcagcggtatctccttcatcagttgcagctggcagccaccctgaaggaagactcaatctttgtgcccggtactcagaagggagtgtggaagctgagacgtgacctgatcttcgtattcttttcatcgcacactccttgtggagacgcctctatcatacccatgctggaatttgaagaccaaccctgctgccctgtcttcagaaattgggcgcataattcttccgttgaagccagcagtaatttggaagccccagggaacgaacggaaatgcgaggacccagacagccccgtcacaaagaagatgcgcctggaacccggtactgccgcaagagaagtcacaaatggggcagcacaccatcagagctttgggaagcagaaatccggccctatttctccagggatccactcatgcgatctgacagttgaaggtttggcgacagtgaccaggattgcccctggcagcgctaaggtaattgacgtgtaccgtacaggtgcgaaatgcgtgcctggggaagccggagacagcggaaaacccggagccgcatttcaccaggttggcctcctacgggtcaaacccggtcgaggtgaccgcacgagatctatgtcatgttccgacaaaatggcaaggtggaacgtcctagggtgccaaggagctctcttgatgcatctgttagaggaacctatctacttgagtgccgtggtgatcggcaaatgtccttatagccaggaggctatgcagagggccctgatcggcaggtgccaaaacgtgtctgccctgcccaaggggttcggagtccaggagctcaaaatcttacagtccgatctgctatttgagcagtcccgaagtgccgtgcaagccaagcgggcagattcgcctgggcgtctcgtcccctgcggagctgcgatttcctggtctgccgtccctgagcagccccttgatgtcacggcgaacggatttccccaggggaccactaaaaagaccatcggttcgctccaggcacggtcccagatttcaaaagtcgagctgttccgttcttttcagaagttgctcagtaggatagctagggacaagtggccgcacagtcttcgcgtccagaagctcgacacatatcaggaatacaaggaggctgcctcctcgtatcaggaggcatggtccacgcttcgcaagcaggtcttcggatcatggatcaggaatccacctgactatcatcagttcaagtag

SEQ ID NO: 213642 - DNA, 1422 bp, Artificial Sequence
  Description of Artificial Sequence: Synthetic coding sequence
atgtggactctgcttgcagccgttgttaagatacaatctccagccgacaaagcctgcgacacccctgataagcccgtgcaggttacaaaggaggtggtgtccatggggacagggacaaaatgcatcggacaatccaagatgaggaaaaacggcgacatcttgaatgatagccacgccgaggtgatcgcccgacgcagttttcagcggtatctgctgcaccagctgcaattggctgcgactctcaaggaggattctattttcgtccccggtactcaaaagggggtctggaagctccgccgtgacttaatttttgtgttcttctcaagccacacaccttgtggagatgcctcaataatccctatgctggaattcgaggaccagccgtgttgcccagtctttaggaattgggctcataactcaagcgtcgaagcttcctcaaacctggaggcgcctggaaacgagaggaaatgtgaagatcccgacagccccgtgaccaaaaagatgagactggaacccggaacagcggctagggaagttaccaacggggctgcacatcatcagtcctttggaaaacaaaagtctgggccaatttccccgggaatccattcttgcgacctcacagtggaagggctcgccacagtcaccaggattgctcctgggtccgccaaggtgattgacgtgtaccgcaccggagccaagtgtgtgcccggagaggcgggtgattctggtaaaccaggagctgcttttcaccaggtagggcttctgcgggtcaagcctggcagaggagaccgcacaagatctatgagctgctctgacaagatggcgcgttggaacgtacttggatgtcagggtgcgcttctgatgcatttactggaagaaccaatctacctctccgccgtagtgatcggcaagtgcccctacagtcaggaagccatgcagagagcgctgatcggaagatgtcagaacgtgtccgcattgcccaagggcttcggggtccaggaactgaagatcctgcaaagcgatcttctatttgagcaaagtcgatctgctgtccaggcaaagcgcgctgactctcctgggaggctggtgccctgtggggcagccatctcctggtccgcagttccagaacagccactcgacgtgacagcgaacggcttcccccaggggacaaccaagaaaaccattggatcattgcaagcaaggtcacaaatatccaaggtcgaactgtttcgttctttccaaaaactgctgagccgaatcgctcgagacaaatggccacacagtctgagggtgcaaaagttagatacttaccaggaatataaagaggcagctagctcttatcaggaggcttggagcaccttacgtaaacaggtgttcgggtcatggatacggaatcctccagactaccaccaatttaaatag

SEQ ID NO: 213643 - DNA, 1089 bp, Artificial Sequence
  Description of Artificial Sequence: Synthetic coding sequence
atggctgctgccgaggaggaacccaaaccgaaaaagctcaaagttgaggcacctcaagcgttgcgtgagaatatcctgtttggcatgggaaatcctcttctggacataagcgcggttgtggacaaggatttccttgacaagtactccctgaagcccaatgaccagattctggctgaggacaaacataaagaactctttgacgagctggttaaaaagtttaaagtggaatatcacgcaggagggtctactcaaaatagcattaaggtggcgcaatggatgatacagcagccccataaagcagcaacttttttcgggtgtatcggaattgataaattcggggaaattctgaagcgcaaagcagcagaagcacatgtagacgcccactactacgaacagaacgaacagccaaccggcacctgcgcggcatgtataaccggggataatagatcgctaatcgctaatctggccgctgccaattgttacaaaaaggagaagcatctggacctagaaaagaactggatgctggttgagaaggctagggtgtgctatattgctggcttttttctcacagtgtctccagagtccgttttgaaagttgctcatcacgcttccgagaacaaccgaattttcaccctcaacttatccgccccttttatttcccagttttataaagagagcctgatgaaagtcatgccttacgtcgacatcctttttgggaacgaaacagaggccgcaacctttgcacgggagcagggattcgagaccaaggatattaaagagatcgccaaaaagacccaggctttgccaaagatgaattctaagcggcaacgaattgtgatctttacacaaggtcgtgacgacacgatcatggccacggagtccgaagtcaccgcctttgcagttttggaccaggaccaaaaggaaatcattgatactaatggtgcaggggacgcttttgtgggaggattcctgagccagctggttagtgacaagcccttgacagagtgcatccgggctggccactatgccgcttcaattataattaggaggacagggtgcacctttcccgagaaacctgatttccactag

SEQ ID NO: 213644 - DNA, 1038 bp, Artificial Sequence
  Description of Artificial Sequence: Synthetic coding sequence
atgacctcagtaagagagaatattctctttggcatgggtaatcccctgcttgacatctctgctgtagttgacaaggacttcctggacaagtatagcttaaagccaaatgaccagatactggcagaggacaaacacaaggaattgtttgatgagctcgtgaagaagttcaaggttgagtaccacgctgggggatctactcaaaactcaataaaagtcgcccaatggatgattcaacagccgcataaagcagcgacatttttcggctgtatcggaattgacaaatttggagagattttaaagagaaaagcagcagaggcccacgtggatgctcactattatgaacagaacgagcagcctaccgggacttgcgcggcatgcataacgggcgataacaggagcctcatagccaacttagctgccgctaactgctacaaaaaagaaaaacacctggatcttgagaaaaactggatgctcgtggaaaaagctcgagtgtgttacattgccggtttctttctgacggtcagcccagagagcgtgctcaaagtggcccatcacgcatcagagaataatcggatctttaccctcaacttatcagctcctttcatttctcagttctacaaggaatcccttatgaaagtgatgccctatgtcgacatactgtttgggaacgagaccgaggctgcgacttttgcacgggaacagggtttcgagactaaagatattaaagagatcgccaagaagacccaggccttacccaagatgaacagtaagaggcagcgcatcgttatctttacacagggtagggacgataccatcatggccaccgaaagcgaagtgactgcgtttgcagtgctggatcaggatcaaaaggagatcattgacacaaatggggctggcgatgccttcgttggcggatttcttagccagctggtctctgacaagccattgaccgagtgtatcagggctggccactatgccgctagtattatcatccgacggaccggttgtacttttcctgagaaacctgatttccactag

SEQ ID NO: 213645 - DNA, 918 bp, Artificial Sequence
  Description of Artificial Sequence: Synthetic coding sequence
atggccgcagctgaagaagagccgaagcccaaaaagctgaaggtagaagctccacaggctctgcgggaaaacatactcttcggaatggggaacccactcctggacatttctgccgtggtggataaagacttcctggacaaatattctctcaagcccaatgaccaaattctcgcagaagacaagcacaaggagctgtttgatgaacttgtgaaaaaatttaaggtggagtatcacgctggcggttcaacccagaactccatcaaagtagcacagtggatgatccagcagcctcataaggccgctacttttttcggctgcattggaattgataagttcggagaaatcctcaaacgaaaagccgcagaggcacacgtagatgctcactattacgagcagaatgagcagcccacaggcacttgtgccgcatgcattaccggcgacaaccgcagcctgattgcaaacctggcagctgccaactgctataagaaggagaagcacctcgatctggaaaagaactggatgcttgtcgagaaagcgcgagtgtgttatatcgcagaggccgctacctttgcacgcgagcagggattcgaaacaaaggacatcaaagagatcgccaagaaaacacaggccttgccaaagatgaattcaaaaaggcagcggatcgttattttcacgcagggccgagatgataccatcatggccactgagtctgaggtcaccgctttcgctgtgctcgatcaggatcagaaggaaattatcgacacaaacggcgctggagacgcgtttgtagggggtttcctatctcaactggtgagtgataaacccctcactgagtgcatacgagccggacattatgctgcctccattattattcggagaaccgggtgtactttccccgaaaagcctgactttcactag

SEQ ID NO: 213646 - DNA, 984 bp, Artificial Sequence
  Description of Artificial Sequence: Synthetic coding sequence
atgacttcggtgagagaaaacattctctttggtatgggcaaccctctgctggatatatccgccgtggtggataaggatttccttgacaagtttgacgagctagtgaaaaagtttaaagtggagtaccatgctggtggttcgacgcaaaacagcataaaagtggcccagtggatgattcaacaaccacacaaggctgcaactttctttggttgtatcggcattgataagttcggagagatacttaagcggaaagcggctgaagcacatgtggatgcacactattatgagcaaaatgagcagcccacagggacctgtgcggcttgcatcactggcgacaaccgctccctgatcgccaaccttgccgctgccaactgttacaagaaagagaagcatctcgacttggagaagaactggatgctggtggaaaaggcacgtgtatgctatatagcgggattctttctgaccgtgtcaccggagagcgtcttgaaggtggcacatcacgcttcagagaataatcgtatcttcactctcaacctgtctgcaccctttatttctcagttttacaaggagtcgctcatgaaagtcatgccctacgtcgatatcctttttggtaacgagaccgaggctgctaccttcgcacgcgagcagggattcgagaccaaagatatcaaagaaattgccaaaaaaactcaggccctgcctaaaatgaactctaagagacagagaattgtgatttttactcaggggagggacgatactattatggccaccgagagcgaggtgacggccttcgctgtcctggaccaggatcagaaggagatcatcgacaccaatggagcaggcgacgctttcgtgggcggattcctgagtcagttggtgtccgataagcccctcactgaatgcatccgggctggtcactacgccgcatctatcatcatccggagaaccggttgcacctttcccgagaagccggatttccactag

SEQ ID NO: 213647 - DNA, 2244 bp, Artificial Sequence
  Description of Artificial Sequence: Synthetic coding sequence
atgccgctgttcaaactgcctgcagaagagaaacagatcgacgatgccatgaggaactttgccgagaaggtgttcgccagcgaggttaaggatgagggcggaaggcaagaaattagtccctttgacgtggatgaaatttgcccgatcagtcaccacgaaatgcaggcccacatctttcacctggagacactatcaacgagtactgaagcacgccgaaagaagcgcttccagggtaggaaaactgtcaatttatccattcctctttcagagacaagctccacgaagctgagtcatattgatgaatatatttcctccagccccacttaccagaccgtcccagacttccagcgagttcagataactggcgactacgcttctggcgtcacagtcgaagatttcgagattgtgtgcaagggactgtaccgtgcgttatgtatcagggaaaaatatatgcagaagtccttccagcgttttccaaaaacaccgtctaagtaccttcggaatatcgacggcgaggcgtgggtggccaatgaaagcttttaccccgtgtttacacctcctgtgaaaaaaggtgaggaccctttccgtaccgataatctgccagaaaatttgggataccatctgaaaatgaaagatggcgtagtttacgtataccccaatgaggccgcagtcagtaaggacgagcctaagcccctgccataccctaacttggacacgttcttggacgatatgaactttctactggcactcatagcacagggacctgtgaaaacatacacccatcgtaggttgaagttcctgtcttcaaaattccaagtgcatcagatgcttaatgaaatggacgaattgaaggaactgaaaaataacccccacagagatttttataattgtagaaaagtcgacacccatattcacgctgcagcgtgtatgaatcagaagcacttattgagatttatcaagaaatcttaccaaatcgacgcagaccgggtagtctacagcacaaaggagaaaaacttgactctcaaggagttgttcgctaaactgaagatgcatccatatgatctcaccgtggatagcctggatgtgcacgccggaagacagacctttcagcgctttgacaaatttaacgataagtacaacccagttggagcctctgaactgagggatctttacctgaagacagacaactacatcaacggggaatacttcgcgacaattattaaggaggtaggtgcagacctggttgaagctaagtaccagcacgcagaacccaggctgtccatctacgggcgttctcctgatgagtggtccaagctgtccagttggtttgtgtgcaaccgtatccactgccccaatatgacctggatgatacaggtgccacgcatttacgacgtatttcggagcaaaaacttcctcccacatttcgggaaaatgctggagaacatcttcatgcctgtgttcgaggctaccatcaacccgcaagctgacccagagctgtcagtgtttctgaagcacatcactggatttgattctgtggatgacgagtctaagcactccggacacatgttctcatccaaaagcccaaagccacaggaatggacactggaaaagaacccctcttacacgtactacgcgtactatatgtacgccaacataatggtgcttaattcgttgcgcaaggaacgtgggatgaataccttcctgtttcggcctcattgcggtgaagcaggggctctgacacatctgatgacagcgtttatgatagctgacgatatctcacacggattgaatctgaagaaatcaccggtgttgcagtacctttttttcctggcccagattccaatagcgatgtcgcctctgagcaacaattccctgtttcttgagtatgccaagaatccttttctggatttcttgcaaaaaggcctgatgatttccctatcaacagatgacccaatgcagtttcacttcactaaggagcccctcatggaagagtacgcaatcgcagcgcaagtgtttaaactgtccacttgtgatatgtgcgaggtggcaagaaacagtgtccttcaatgtgggatatcccacgaagaaaaagtgaagttcctgggagataactatcttgaagagggtccagccggaaacgacatccgacgtactaatgtggcccagatcagaatggcatatagatatgaaacatggtgctacgagttgaaccttatcgccgagggactaaagagtaccgaatag

SEQ ID NO: 213648 - DNA, 2343 bp, Artificial Sequence
  Description of Artificial Sequence: Synthetic coding sequence
atgaatgttcgaattttctactctgtgtcccaatctcctcactccctcctgtctctccttttctactgcgccatcctggagtcaagaataagtgctactatgccactcttcaagttacccgctgaggaaaagcagatagacgatgcaatgcgtaattttgcagagaaagtgtttgcgtccgaagtcaaggatgagggaggtcggcaggaaatcagcccattcgacgtggacgaaatctgccccatcagtcatcacgagatgcaggctcacatcttccatctcgagacactgagcacatcaaccgaggcgcgaaggaaaaagcgcttccaggggcgtaagacagtgaacctcagcattcccttgtccgagacaagctctactaaactatctcatattgacgaatacatttctagcagccccacctatcagactgtgccagatttccaaagggtgcagataaccggagactatgcgtctggggtgacggttgaagactttgaaatcgtgtgcaaggggctgtaccgagctctgtgcatccgggagaagtatatgcagaaatcatttcagaggtttccaaagacgccctccaaatatctgcgcaacatagatggcgaggcgtgggtcgccaacgaatccttctatccagtgttcacaccgccagtcaagaagggggaggatccttttcggaccgacaacttacccgagaacctcggatatcacctgaaaatgaaagatggagtcgtgtatgtttacccgaatgaagccgctgtaagcaaggacgagcctaagcccctgccatatcctaatctggacaccttcctggacgacatgaattttttgctcgcgctgatagcccagggccctgtaaaaacctacacacatcgacggttgaagtttctttccagcaaattccaagtgcaccaaatgctcaatgaaatggatgagctcaaggagttaaaaaacaaccctcatcgtgacttctacaactgtcggaaggtagatacgcatattcatgctgcggcatgtatgaaccagaagcatctgctgcgcttcatcaaaaagtcttatcagatagatgctgacagagtggtgtattccaccaaggaaaaaaatttaaccctcaaagagctgttcgccaaacttaagatgcacccctatgacctcacagttgactccttagatgtgcatgctgggcgacagaccttccaacgctttgataagtttaacgataagtacaaccctgtcggcgcttccgaactcagggacctgtatctgaagacagacaactacattaatggcgagtattttgcaaccatcatcaaagaagtgggagccgacctcgtggaagctaagtatcagcatgctgaacctaggctgagtatttacgggcgttcccccgacgaatggtctaagctgagctcctggttcgtatgcaaccgtattcactgtcctaacatgacgtggatgatccaggttccacgcatttacgacgtattcaggtccaagaactttctgccgcactttggaaagatgcttgagaacatattcatgccggtgttcgaagccaccatcaacccccaagcggatccagagctctccgtgtttctgaaacacattacagggttcgactcagtcgatgacgagtccaaacacagtgggcacatgttttcttccaagagcccaaaaccccaggagtggactctggagaagaacccatcatatacctactatgcctactacatgtacgcgaacattatggtgttgaactccctacgaaaggaaaggggtatgaataccttccttttcagaccccattgcggtgaagcaggggctttaacacacctcatgacggccttcatgatagctgatgatatatctcacgggttaaatctaaagaagtcacctgtgcttcagtacctgttctttctggcccagatccccatagctatgtcacccctctccaacaatagcctctttctggagtacgccaaaaatcccttcctggactttctccaaaagggactaatgataagcctctccactgatgatccgatgcagttccactttaccaaggagccactgatggaagaatatgcaattgccgcacaggtttttaagctttctacctgcgacatgtgcgaagtggcaaggaactcagtgctgcaatgtggtatcagccacgaggagaaggttaagttccttggcgacaattacttggaagagggaccggcagggaatgatatccgcaggactaacgtggcccagatacgaatggcttatcgctatgagacttggtgctacgagttaaaccttattgctgagggtctgaaaagtacagaatag

SEQ ID NO: 213649 - DNA, 2331 bp, Artificial Sequence
  Description of Artificial Sequence: Synthetic coding sequence
atgaacgtccgcatattttattcagtgagccaatcacctcattcactactgtctcttctgttctactgtgccattttggaatccagaatttctgccaccatgccactgtttaaactcccagagatagatgacgctatgaggaatttcgccgaaaaagtcttcgcatctgaagtaaaggatgaaggtgggagacaggagatcagtccgttcgatgtggatgaaatctgccctatttcacatcatgaaatgcaggctcacatattccacctcgaaacacttagcacgagcaccgaagcacgcagaaagaagcgcttccaggggcgaaagacagttaacttgtcaattcctttgtctgaaacatcatcaactaaactgagtcacatcgacgagtacattagttcttccccaacataccagaccgtgcccgatttccaaagagtgcagataactggggactacgcatctggcgtgacggtggaagactttgaaatcgtgtgcaaggggttgtaccgtgcattgtgcatccgcgaaaagtacatgcagaagagcttccagcggtttcctaaaactccctctaagtatctgaggaacatcgatggggaggcctgggtggctaacgagtcgttctaccccgtgttcaccccacccgttaaaaaaggggaagacccctttagaacagacaacctgccagagaacttagggtatcacctgaaaatgaaggatggagtagtttatgtctatcccaacgaggcagcggtgtccaaggatgaacctaaaccgctgccatatccaaacttggacacttttttagatgatatgaacttcctgctcgctctgatcgcccagggtcccgtgaaaacatatacgcaccgaaggctaaagttcttaagcagcaagtttcaggtgcatcaaatgttgaacgagatggacgaactgaaggaactgaagaataatccccaccgggatttctataattgcaggaaggtcgacactcatattcacgctgccgcatgcatgaaccagaagcacctgctccgattcattaagaagtcctatcagatcgacgcagatcgggtcgtttatagcactaaggagaagaacctcacccttaaggaattgtttgccaagcttaagatgcatccatacgatctcacggtggattcactcgacgtacacgccggtcgccaaaccttccagcggtttgataaatttaacgataagtacaaccctgttggcgctagtgagttgagggatttatacttgaagacagataactacatcaatggcgagtacttcgctactatcattaaggaggttggagccgacctggttgaggccaagtaccagcacgctgaacctcggttgtcaatctacggcagatcccccgacgagtggtcgaagctctcctcttggttcgtgtgtaaccgtattcactgccccaacatgacgtggatgatccaggttcccagaatatacgatgtcttcagatccaagaactttttaccccacttcggaaaaatgcttgaaaacatattcatgcccgtatttgaggcaaccatcaacccccaggccgatcccgagctctctgtgtttttgaagcatataacgggctttgatagcgtggacgatgagtctaagcattctggtcatatgttctcatctaaaagcccgaaaccacaggagtggactttggaaaaaaaccccagctatacctactatgcatattacatgtatgccaacattatggtgctcaacagccttcgaaaggagcggggaatgaacacatttctctttcgtccccactgcggcgaagctggcgcactgactcatctgatgactgcattcatgatcgcagacgacatcagtcacgggctgaatctgaagaagagccctgtacttcaatacctcttctttctagctcaaattcccatcgctatgtccccccttagcaataattcgttattcctggaatacgcgaaaaaccctttcctggattttctgcagaagggactgatgatcagcctctctaccgacgacccaatgcagtttcacttcactaaggaacccctaatggaggaatacgccatcgcggctcaggtgtttaagctgtcaacttgcgacatgtgtgaggtagccagaaactctgtgcttcagtgcggcataagccatgaagaaaaagtgaagttcttaggagacaattatttggaggaaggtcctgctggaaatgatattagaagaactaacgtggcccaaattcgtatggcctataggtatgaaacgtggtgctacgaactcaatctcatcgccgagggtcttaaaagcaccgaatag

SEQ ID NO: 213650 - DNA, 2640 bp, Artificial Sequence
  Description of Artificial Sequence: Synthetic coding sequence
atgaggaacaggggtcaggggctgttccgcttgagaagccggtgcttccttcaccagtcactacccctcggagccggtcggaggaagggactcgatgttgccgagcctgggccatctagatgcagatccgatagccccgcagtcgccgcagtagtgccagcaatggcatcttatccctctgggtctggaaaacctaaagcaaagtacccatttaagaaacgcgcttcactacaggcctcaacggcagccccagaggcgcgtggcggtctgggggcaccccctctccagagcgcgcgatctctcccgggtcccgctccttgcctgaaacacttccctctggacctcaggactagcatggatggcaagtgcaaagagatcgcagaagaactcttcactcgctcattggccgagtccgagctgaggtccgcaccatatgagtttccagaggagtctcccatcgaacaactggaggagcgccgacaacgtctggaaaggcagatttcacaggacgtcaaacttgaaccagacatcttgctgagagccaagcaagattttttaaagactgattctgacagcgatctccagctgtacaaagagcagggggaaggacagggcgaccgctccctgagagagcgtgacgtcctggagagggagtttcagagggtcaccatttctggtgaggaaaagtgcggcgtcccgtttaccgatctgctcgatgctgccaaaagtgtggtgagagcattgtttattcgggaaaagtatatggccctttcactacagtcgttctgtcccactaccagaaggtatctgcagcagcttgccgagaaaccactggagacacggacctacgagcaggggccagacacacctgtctctgctgatgctccagtgcaccctccagccttagagcagcatccctatgaacattgcgagcctagtacaatgcccggagacctcgggctgggtctgcggatggtgagaggtgtcgtccacgtatacacccgacgcgaacctgacgagcactgctctgaggttgagcttccctacccagatctgcaggagtttgtggccgacgtgaacgttctgatggccctcatcattaatgggcctatcaaatctttctgctataggagactgcagtacctgtcaagcaagttccaaatgcacgtgcttttgaatgaaatgaaggagttagccgctcagaaaaaagtcccccaccgagacttctacaatattcgaaaggtggacactcacatccatgcatcatcatgcatgaaccagaagcacctactgcgcttcattaaacgcgcaatgaagcgacacctggaagaaatcgtgcatgtggaacagggccgtgaacagaccctgcgagaggtattcgaatctatgaacctgacagcttatgacctgagtgtggacacactcgacgttcacgccgaccggaatacattccacaggttcgacaagttcaacgctaagtataaccctatcggtgaatctgttctgagggaaattttcatcaagaccgacaatcgcgtgagtgggaagtactttgcacatataattaaggaggtgatgagtgacctggaggagagcaagtatcagaatgccgaactacggttgtcaatctatgggaggtcgcgagacgagtgggacaagttggcacgctgggcggtcatgcacagagtgcactcccctaatgtaagatggttggtgcaggtacccaggctgtttgatgtgtaccgaaccaagggccagctggcgaattttcaggagatgctggagaatatcttcctgccactcttcgaagccacagtgcatcccgcatctcacccggagcttcacctgtttctcgaacacgttgatggcttcgacagtgtagacgacgaaagcaagcctgaaaaccacgtgttcaacttagagtctccactccctgaagcgtgggtcgaggaggataatcctccgtacgcctactatctgtactacacgtttgccaacatggccatgctgaaccatctgagaagacagagagggtttcacactttcgttctacgccctcattgtggagaggcaggaccaattcatcatttggtcagcgcgttcatgctcgccgagaacattagccatggtctgttactgagaaaagcacctgtgctccagtatctttattatttggcccagattgggatcgcaatgtccccgctgtcaaacaactcactgtttctgagctaccacagaaatcccctccccgagtacctgagccgagggctgatggtgtcgctgagcaccgatgatcccttgcaatttcacttcactaaagaacctctcatggaagaatactctatcgcgacacaggtttggaagctctcgtcttgtgacatgtgtgagctcgcacggaattctgtgcttatgagcgggtttagccataaagtgaagtcgcattggcttggacctaattataccaaagaaggacctgaaggcaacgacatacgcagaaccaatgtgccagatattcgagtggggtataggtacgagactttgtgccaggagctggccctgataacccaggcagtccagtccgagatgttggagacgattccagaagaggcaggcatcacgatgtctcctggccctcaatag

SEQ ID NO: 213651 - DNA, 2397 bp, Artificial Sequence
  Description of Artificial Sequence: Synthetic coding sequence
atggcctctgaggccaggggcggactgggtgcccctccattgcagtcagcccgaagcctccccggaccagccccatgcctgaagcactttcctttggatttgaggacaagtatggatggtaagtgcaaggaaatcgcagaggaactatttaccagaagcctggccgagtctgagctgcgctctgctccttacgaatttcctgaggagtcacccatcgaacagctcgaggagaggaggcagcgcttggaacgacaaatttcacaggatgtcaaattggagccggacatactgcttcgagccaaacaggacttcctcaaaaccgatagcgacagcgacttgcagctttacaaagagcagggagaagggcagggagaccgaagtttacgtgagagggacgtccttgagagggaattccagcgtgttacaatctccggcgaggagaaatgcggggttccgttcacggacctgctcgacgccgctaagagcgtcgtgcgggctctgtttatccgcgagaagtatatggctctgtctctccagtcattttgtccaactacacgcagatacttgcagcagctggctgagaaaccgttagagacccgcacttatgaacagggcccagacactcccgtgtccgccgacgctcctgtgcatcctccggcacttgagcagcatccttatgagcactgtgagcctagcacaatgccaggcgatcttggattgggcctccgaatggttcgaggcgttgtgcacgtatacacgcgaagagaacctgacgagcactgtagcgaggtggaacttccctacccagaccttcaggagttcgtggctgacgtgaacgtcctgatggccctgatcattaatggcccaattaaaagcttctgttaccggcgtctgcagtacctctcctcaaagtttcagatgcatgtgctgcttaatgagatgaaagagctggccgcacaaaagaaggtgccacaccgcgacttctacaacatcaggaaggtcgacacccatatccacgctagctcctgtatgaaccagaagcacttgttaaggtttattaaacgggctatgaagcgacatttagaggaaatagtacacgttgaacaagggcgtgaacagactctccgggaggttttcgagagcatgaacctgaccgcctatgacctgtccgtagatacactggatgtccacgccgataggaacacattccacaggtttgacaagttcaacgccaagtataatccgattggtgagtcggtcttacgagagatttttatcaagaccgacaaccgtgttagcggcaagtacttcgcgcacatcatcaaagaggtcatgagcgacctagaggagtcaaagtatcaaaacgccgagttacgcctatcgatctatgggagatctcgagacgagtgggataaacttgcacgctgggctgtgatgcacagggtgcatagccctaacgtgcgatggctggttcaggttccaagactgttcgacgtctatcggacaaaggggcagctcgctaattttcaggagatgctcgagaatatttttctccctctgttcgaggcaaccgtccaccctgcaagtcaccccgagcttcatctgttcctggaacacgtcgatggttttgactccgtggacgatgagagcaaaccagagaatcacgtctttaatcttgaaagcccactgcccgaggcttgggtagaggaggataatcctccctacgcatactatctttattatacatttgctaacatggctatgttgaaccaccttcgaagacagcgcggattccatacttttgtccttagacctcactgcggagaagctggcccaattcatcaccttgtttccgccttcatgcttgctgaaaacatttcccacggtctattgcttagaaaggctccagtgcttcagtacctttactacttggcacagatcgggatcgccatgtcacctctgtccaataactctctgtttcttagctaccacagaaatccactacccgagtacctctcgcgcggattgatggtatccctttccactgacgacccactgcagtttcactttaccaaagagcccctgatggaggagtattccatcgcgacacaggtctggaaactttccagttgcgacatgtgcgaactggctagaaactctgtactcatgagcggctttagccacaaggtgaagtctcattggctcggtccgaactacacaaaagaaggacccgaaggaaacgatattcggaggacaaacgttcccgacatacgggtgggctacagatacgagacattatgtcaagaacttgccttgatcacccaagccgtgcagagcgagatgctggaaaccattcctgaagaggcagggatcaccatgagtcccggaccccaatag

SEQ ID NO: 213652 - DNA, 2415 bp, Artificial Sequence
  Description of Artificial Sequence: Synthetic coding sequence
atgtggcagagccaagccccagcaggagccgcacagacgcctcccttaagccctccttggagtcagccatggcatcccatccatcttgcactagccagcccaaggcccaacatccctcttaggtcaggccctgcttgtagacccccactgcagcttcaagaactgttcacgagatcacttgccgaaagtgagcttcgcagcgctccctacgaattccccgaagaaagccccatcgagcaactagaagaaaggagacagaggttggaacgccagatctctcaggacgtgaagttggagcctgatatactcctcagggccaagcaggatttcctcaagaccgactctgacagcgatctccaactttacaaagaacagggcgaaggacagggagaccggagcctccgggagcgggatgtgctggagagagagttccagagagtaaccatctcaggcgaggaaaaatgtggagtgccattcacagacctgctggacgcagctaaatcggtggtcagagccctgtttatccgagaaaaatacatggctttgtctctgcagtctttttgcccgaccacacgcagatatcttcaacagctggcagagaagcctctggagactaggacctacgagcagggacccgacacacccgtgtccgcggatgcgccagtgcatcccccagccctagaacagcacccgtacgaacactgtgaaccttctaccatgccaggcgacttgggactgggactgagaatggttcgaggagtagtgcacgtgtatacccggagagaaccagatgagcattgctctgaggtggagctgccttatccagacctgcaggagttcgttgcagacgtgaacgtgctcatggccttgataattaacgggccaattaagagtttctgttaccgccgactgcagtacctgagctctaaatttcagatgcatgtgcttctgaatgagatgaaagagctcgccgcacaaaaaaaggtgccacacagggacttttacaacattaggaaggtcgatacgcacatccacgcgtcttcatgcatgaaccaaaagcatctgctgaggttcattaagcgcgcaatgaagcgacacctggaagaaattgtacacgtcgagcaaggacgggagcaaactctccgcgaggtgttcgagtcaatgaaccttacagcgtacgacctgagcgttgatactctggatgttcacgcagaccggaataccttccacagattcgataagttcaatgcgaagtataatcctataggcgaatccgtgcttagagaaatctttattaagacagacaaccgcgtttccggcaagtacttcgcacacattatcaaggaagtgatgagcgacctggaagaaagcaaataccagaatgctgagctcaggctcagcatatatggcagatcaagagatgagtgggacaaactcgccagatgggccgtcatgcatagggtccactccccaaatgtgaggtggctggttcaggtgccacgcctgttcgatgtctaccgaactaaaggacagttggctaatttccaagaaatgctggagaacatttttctcccactgttcgaagccactgtgcatcccgcatcccacccagaactgcacctttttctggaacatgttgacggctttgacagcgtagacgacgagagtaaacctgagaatcacgtgtttaatttggagtcccctttgcctgaggcctgggttgaggaggacaaccccccatatgcctactatttatactacacgtttgcaaacatggccatgctgaaccacctcaggagacagcgagggtttcacacattcgtgttgagacctcactgcggagaggctggaccaatccaccacctcgtgagtgcatttatgctagcggaaaacataagtcacggacttctgcttcgcaaagcgcctgtcctgcagtatctttattaccttgctcagattgggattgcgatgagtcctctaagtaataactcactctttctgagttatcaccggaacccactgccggagtatctgagccggggtctcatggtaagcttatcaactgatgacccactgcagttccactttaccaaagagcctcttatggaggagtactctatagccacccaggtttggaaactgtcttcgtgtgacatgtgtgaactggccagaaattctgttcttatgtccggcttctctcataaggtgaagtcacactggctcggccctaattacactaaagaagggcctgagggcaatgacatcaggcggacgaacgtccccgacattagggtcgggtatcgatacgagactctgtgccaggaattggcgctgattacacaggctgttcagtcagaaatgcttgagacaatccccgaggaggctggcatcaccatgtcgcccggacctcagtag

SEQ ID NO: 213653 - DNA, 2283 bp, Artificial Sequence
  Description of Artificial Sequence: Synthetic coding sequence
atgctgaccttcctgcccagccctcaggagttgtttactcgctccctggctgagtcagagctgcgttctgccccttatgagttcccggaagaatcaccgatcgagcagctcgaagagcggagacaacgactcgagaggcagatctcgcaggatgtcaaactcgaacccgacatccttctgcgggcaaagcaggattttctcaagacagacagcgatagcgacttgcagctctacaaggaacagggggaggggcagggcgaccggtcgctaagagaaagagatgtgttggagcgagagtttcagcgcgtcaccatcagtggcgaggaaaaatgtggcgtccctttcacagatctgctggacgccgctaagtcagtggtgcgcgctctttttatccgagagaagtatatggccttgagtctacagagcttttgtcctacgactagacgctaccttcagcagctcgcagaaaaacccctggaaacgcggacctacgaacaggggcctgatacaccagtgagtgccgatgctcctgtgcatccccctgcacttgagcaacatccgtatgagcattgtgagccaagcaccatgccaggtgatcttggcctcgggttgagaatggtgaggggcgtggtccatgtttacactcgcagggaaccagacgaacattgttcggaggttgagctcccgtatcctgatctgcaggagttcgtggccgatgtcaacgtcttaatggccctgattataaacggacctatcaaatcattttgttataggaggttacaatacctctcctctaaatttcagatgcacgtgctgctgaacgagatgaaagaattagcagctcaaaagaaagtgccccacagggatttctataacatccgcaaggtggatacccacatacacgcatcctcttgcatgaatcagaagcatttgttacggttcatcaagcgcgcaatgaaacgccacttggaggaaattgttcacgtggaacaaggccgtgaacaaactctcagagaggtgtttgagtctatgaatctcacggcctatgacctgtctgtagataccttggatgtacacgctgaccggaatacctttcaccgcttcgataagttcaacgccaagtataatccaattggcgaaagtgttctacgcgagatcttcattaaaacggacaaccgggtgtccggaaaatatttcgcacatatcatcaaggaggtcatgagtgacctggaagagtcgaagtaccagaacgccgaattgcggctgtcaatctacggacgctctcgcgatgagtgggataagctggcgcgttgggccgtcatgcaccgggtgcactctcctaatgttcggtggcttgtacaggtaccaaggctgttcgacgtgtacaggactaagggacagctcgcaaacttccaagaaatgttggagaatattttcctcccactcttcgaagctacagtacaccctgcttcgcaccccgagctccacctgttcctggaacatgtggacgggttcgattctgtcgatgacgaaagtaaacccgaaaaccatgtattcaatctcgaatccccactgcccgaagcctgggtcgaagaagataatcctccctacgcctactatctgtactacacctttgcgaacatggccatgttgaatcacctgcggcgacaacgaggcttccatacattcgtgctaaggcctcattgtggtgaggctgggcctatccatcacttggtctcggcgtttatgctggctgaaaacatctctcacgggctactgctgcgtaaagctccagtgctccagtacttgtactacctggctcagataggaattgcgatgtcaccattgtctaataattcactgtttctgtcttaccaccgaaacccccttccagagtacctgtctcggggattaatggtttctctatccacagacgatcccttgcagttccactttaccaaagaaccgctcatggaagagtacagcattgccacgcaagtgtggaagctgtcgagctgtgacatgtgcgagctcgcaaggaatagcgtgttaatgagcggattttcacacaaagtgaagtcccactggctgggtcccaactacacgaaagaaggccctgagggcaacgatatcagacgaaccaacgtgcctgatatcagggtggggtatcgatacgaaacgctgtgtcaggagctggcactgataacacaggctgtgcaatctgagatgttagaaaccattcccgaggaagctggaattaccatgagtcctggcccacagtag

SEQ ID NO: 213654 - DNA, 6 bp, Artificial Sequence
  Description of Artificial Sequence: Synthetic coding sequence
atgtag

SEQ ID NO: 213655 - DNA, 2640 bp, Artificial Sequence
  Description of Artificial Sequence: Synthetic coding sequence
atgcgaaatcgaggccaggggctttttcggctcaggagcaggtgcttcctgcaccagagtctgcccctgggtgcaggaagacggaagggcctggatgtggcggaacccggacccagccggtgccgaagcgacagccccgcagtcgccgcagtggtccctgcgatggcttcctatccctctggctctggcaaaccgaaggcaaaatatcccttcaagaagagagctagtctacaggccagcaccgctgcgccagaggcgcgaggcggactcggcgcacccccactccaaagtgcaagaagtcttccaggcccagcgccatgcctcaaacactttccgctcgacctacggacgagtatggacggtaaatgtaaagagattgcggaagagctatttacacggagccttgcagagagtgagctgcgcagtgccccttacgagtttcctgaggaaagtccaattgagcagctggaagaaagacgccaaagactcgagcgccagataagccaggatgtgaagctcgagccagatatcttgctccgtgccaaacaagactttctcaaaacggatagtgactccgacctccaattgtacaaggaacaaggagaggggcaaggtgatagaagtctcagggagcgcgatgtgctggagcgcgaattccagcgggtaacgataagcggcgaagagaagtgtggagtgccattcactgatctgcttgacgccgcaaagtcagtagtccgcgcattgttcatcagagagaaatacatggctctctctttgcagagcttctgtccaaccacacggaggtatctgcagcagttagctgaaaagcctctggaaacacgcacgtacgaacagggtcccgacacccccgtctccgcagatgctcccgtgcatccacccgcattggagcagcacccgtacgagcattgtgaacctagtacgatgcccggagatctggggctgggactgcgtatggtgcgcggagttgtgcacgtctacacgcgccgagagcccgacgagcattgtagcgaagtggagttgccttaccctgacttgcaggaattcgtcgccgatgtgaacgtgctgatggcactcattatcaatggacccattaagtcgttctgttatcgtaggttacagtatttgtcctctaagttccaaatgcatgtgcttctgaatgagatgaaggagctcgctgcccaaaagaaagtgccccatagggacttctacaacatcagaaaggtggacacccatatacacgcatcatcatgtatgaatcagaaacacctccttagatttatcaagagagctatgaagcgtcatttggaagaaattgttcatgtggagcagggcagagagcagaccttacgagaagtttttgaatctatgaacttgaccgcatatgacctgtctgtggatacgcttgatgtgcacgccgacaggaacacctttcacagattcgacaagttcaacgccaagtacaaccccataggggagtcagtgctgagggagatcttcatcaagactgataatcgggtttcaggaaagtatttcgctcacattatcaaagaagtaatgtcagacttggaggaatcaaagtatcagaacgccgaacttaggttgagtatctacgggagatcacgcgacgagtgggataagttagcacgctgggccgtaatgcaccgggtccattctcccaatgtgcgctggctagttcaggttccacgactgtttgatgtgtatagaaccaaaggacaactcgccaactttcaagaaatgctcgagaacatcttcttgcctctgttcgaggctactgtgcatcccgcaagccaccctgagttacacctctttctggagcacgttgatggtttcgacagtgttgacgatgagagtaaacctgagaaccatgtttttaacctagagtctcctcttcccgaagcgtgggtggaggaggataacccaccttatgcatactatttgtattatacgttcgctaatatggctatgctcaaccatctgcgtagacagagaggcttccacacctttgtgctgaggcctcactgcggagaagctgggcctattcaccatctagttagcgcgttcatgttagcggagaatatcagccatggactactattgcgaaaagcccctgtcttacaatatctctattatcttgcgcaaataggcatcgcaatgtcaccactctccaataattcactgttccttagctaccacagaaatcctttaccggagtatcttagccggggacttatggtcagtctatcgaccgatgacccattgcaattccacttcacaaaggagccacttatggaggagtactccattgccacccaggtttggaaactcagtagctgtgatatgtgtgaactggccaggaattctgtcctcatgtctggctttagtcacaaagtgaaatctcactggctgggcccaaactatacaaaagagggaccggagggcaacgacatccgcaggactaatgttcccgatatacgcgtgggttacagatatgagaccctgtgtcaagagcttgcgcttattacccaagcagtacaaagcgagatgctggagaccattccagaggaagcaggcattacgatgtcccccggtcctcagtag

SEQ ID NO: 213656 - DNA, 312 bp, Artificial Sequence
  Description of Artificial Sequence: Synthetic coding sequence
atggcctccgaagcacgcggaggcctcggggcacccccactccagagtgcgaggagtctgcctggcccagccccatgcttaaagcatttccctttagacctgagaacaagtatggacgggaaatgcaaggagatcgctgaggagctgttcactcggagtttagcagaaagcgagctgcggagcgcgccatatgaattccccgaggagagtcctatcgaacaactggaggaaagaagacagcggctggaacgccagatcagccaagacgtgaagctggaaccagacattctcttgcgtgccaagcaggactag

SEQ ID NO: 213657 - DNA, 2304 bp, Artificial Sequence
  Description of Artificial Sequence: Synthetic coding sequence
atgcccaggcaatttcccaagctgaacatttccgaggtcgacgagcaggtccgactactggccgagaaagttttcgcgaaagtactccgcgaagaagattccaaggatgccttgagtttattcaccgtgccagaggactgtcctattggccagaaagaagcaaaggagagagagctccagaaggagttagcagagcagaagtcggttgagactgccaagcgaaagaagtccttcaagatgattcgatcgcagtcactgagtttgcagatgccaccccagcaggattggaagggacctcccgctgcgtccccagctatgtcaccaaccacccctgtggtgaccggtgctacaagccttcccactcccgcaccctacgccatgcctgaattccagcgagtgactatttcaggagactattgtgccggtatcaccctggaggactacgagcaagcggctaagtctctcgcgaaagcactgatgattagggagaagtatgctcgactggcttatcaccggttccccaggattacgtcccagtaccttggccacccacgagccgacaccgcccctcctgaagaaggacttccagatttccaccctccacctctaccccaggaagacccatactgcctggatgacgcccctccgaacctcgactaccttgtccatatgcagggcggaatcctcttcgtgtacgataacaaaaagatgctcgaacaccaggagccgcattctctgccttatcccgaccttgagacgtatacagtcgacatgtctcatattctagccctgatcaccgacggtcctacaaagacatattgccaccggaggttgaattttctggagagcaagttttcacttcatgaaatgctgaatgaaatgtctgaattcaaggaattgaagagcaatccacatagggatttttacaatgttagaaaagtcgatacacacatccatgccgcagcttgtatgaaccagaagcatcttcttcgatttatcaaacacacctatcagactgaacctgatcggactgttgccgagaaaaggggacgaaaaatcaccctgcggcaggtttttgacgggctgcatatggacccatatgatctcactgtcgattctctagacgtgcatgctggacgtcagaccttccaccggtttgacaaattcaacagtaagtataacccagttggcgcttccgagcttagagatctgtatttgaaaacagagaattacctgggtggtgagtacttcgccagaatggttaaggaagtcgccagggagctggaagagtctaagtaccagtacagtgagcctaggctctccatttatggacgatcgccagaggagtggcctaacttggcctattggtttatccagcataaagtgtacagtcctaatatgcggtggatcatccaggtacccagaatttatgatatctttcgaagcaagaaactattacctaacttcggaaagatgctggaaaatatattcctgccactgttcaaagctacaatcaacccccaagatcatcgggaattacatttgtttctcaagtacgtgacaggcttcgactcagtggatgatgagtctaaacactccgaccacatgtttagcgacaagtctcccaatcccgacgtctggacctccgagcagaacccaccttattcttactacctgtattacatgtatgctaatattatggtgctcaataatttaagacgcgaaagagggctatccacctttctgttccggcctcattgcggtgaggcaggaagcatcacacatttggtgagcgcattcctgaccgctgacaatatctctcacggcttactgttaaagaaaagcccggtccttcaatacctgtactacttagctcaaattcctatcgccatgtctccgttatcaaacaattccctgtttctcgaatacagcaagaatccgctgagggagttcttgcacaagggattgcatgtttctctttcaacagacgacccaatgcagttccactacacaaaagaggctcttatggaggagtatgctatagctgcccaagtttggaaactaagcacatgtgatctgtgtgaaattgcccgtaatagcgtcctgcaatctggcttgtcacatcaggaaaagcaaaaattccttggacagaactactataaagaaggtccagagggcaacgacatcagaaagactaacgtggcccagataaggatggccttccgatatgagacgctatgtaacgagctgtctttcctgtccgacgccatgaaatcagaagaaatcactgctctgacaaattag

SEQ ID NO: 213658 - DNA, 2331 bp, Artificial Sequence
  Description of Artificial Sequence: Synthetic coding sequence
atggcgttgtctagcgaacccgctgagatgcccaggcaattcccaaaactgaacatcagtgaggtggacgagcaggtcagactgctggctgaaaaggttttcgccaaagtgttgagggaggaagacagcaaggatgccctaagcctgttcaccgtgcctgaagattgcccaatcggacagaaggaagcaaaagagagagaattgcagaaagagttggccgaacagaagtccgtcgaaactgcaaagcgtaaaaagagtttcaagatgatcagatcacagtctctgtcccttcagatgccaccccaacaggattggaaagggcctcccgcagcctctcccgcaatgtcccccaccactccagtggtcaccggggcaacatcactccctaccccagccccatacgccatgcccgagtttcagagagtcactatcagcggagactactgcgccggaattaccctagaggactatgagcaggctgccaaaagccttgcaaaagcactcatgattagagagaaatatgccaggctcgcgtaccacagattcccccgtattacatcccagtacttgggacatcccagggccgacaccgcgccacctgaggaggggctgcctgactttcacccccctcccctgcctcaggaagacccttattgcctggacgatgcgccacctaacctcgactatctggtgcatatgcagggtggcattcttttcgtgtatgacaacaaaaaaatgctcgaacaccaggagccacattcattgccctacccagatctcgagacatacactgtagacatgagccatatcctggcgctgatcacggatgggccaactaaaacttactgccaccgcagactcaattttctagagagcaagttctctctgcacgagatgctgaatgaaatgtccgagttcaaggagcttaaatccaacccacacagagacttctataacgtaagaaaagtggacacccacatacacgccgcagcctgtatgaaccaaaagcacctcttaagattcatcaaacatacgtatcagacggagcccgacaggaccgtggccgagaagcggggaagaaaaatcactcttcgtcaagtgtttgacggcctgcacatggacccctacgacctgacggtggattccctcgacgtgcacgccggtcggcagacgttccaccggttcgataaattcaacagtaagtacaatcccgtcggagcatcagagctgagggatctctatttaaagaccgagaattacttaggcggagagtattttgccaggatggtgaaagaggtggctagagagctggaggagtccaaataccagtatagcgagcccaggctgagtatttatggtcgctctccggaagagtggcccaatcttgcgtattggttcatccagcataaagtatattctcccaatatgaggtggatcattcaggtccctcgcatctatgatatatttcggtccaaaaaacttctgccaaactttggaaagatgctggagaacatattcctgcctctcttcaaggcaacaatcaatccacaggatcaccgcgagctgcacctttttctgaaatacgtgacaggattcgatagcgtcgatgacgagtccaaacacagtgatcacatgttctccgataaatcaccaaatcccgatgtctggacctctgagcagaacccgccatacagctactatctgtactatatgtacgccaacatcatggtgctaaataatctgagaagagagagaggactgtcaaccttcttgtttcggcctcactgcggcgaagccggtagtattactcatctcgtaagtgcatttctgaccgcagacaacatctctcacggcctgctcctgaaaaagtcgcctgtgctccagtacttgtattatttagcacagatccccatcgccatgagcccactttctaacaacagtctattcttagaatatagtaagaatcccctgcgcgagtttcttcacaaaggactgcacgtgtccttaagcaccgatgaccccatgcagttccattacactaaagaggcactgatggaggaatatgctatagctgctcaagtctggaagctctctacttgtgatctgtgcgaaatagccagaaatagcgtcttacagagcggcctgagccaccaagagaaacaaaagttcctcggccagaattattacaaagaaggaccagagggcaacgatataagaaaaaccaacgtagcccagatccgaatggcttttcgctacgagaccctgtgtaacgagctgagtttcctgtctgatgctatgaagtcagaggagattacagccctgaccaactag

SEQ ID NO: 213659 - DNA, 1827 bp, Artificial Sequence
  Description of Artificial Sequence: Synthetic coding sequence
atgataagagagaagtacgcacgcctggcataccatcggttcccccgaatcactagtcagtacctaggacacccacgcgcagacaccgcccctccagaagagggattgcctgattttcacccacctccactgccccaagaggacccctattgtctggacgatgctcctccaaatctcgactaccttgtgcacatgcagggaggcattctgtttgtctatgacaataagaaaatgctggagcatcaagaaccgcattctctcccatatcccgacttggagacatacacagtcgacatgtctcatattttggctctcatcactgatggcccaacaaagacctactgccatcgacggctgaatttcctcgagtctaaattctcccttcacgaaatgcttaacgaaatgagcgagttcaaagaattgaagagtaaccctcatcgggatttctataacgtgagaaaggtcgacactcacatccatgctgcagcttgcatgaatcagaagcacctcctaaggttcataaagcacacgtaccaaactgaacctgaccggaccgtggctgaaaagagaggacggaaaatcactctgcgtcaggtttttgatggcctccacatggacccctatgatctgactgtggattccctcgatgtgcacgcaggccgacaaacatttcatcgctttgacaaatttaactctaagtataatcccgtcggggcaagtgaactccgtgatctgtacttgaagaccgagaactaccttgggggagagtatttcgctcgaatggtgaaagaggtcgccagagaattggaggaaagtaagtatcagtactccgaaccacgactgagcatatacgggaggtctccggaagagtggcctaacctggcgtattggttcattcagcataaggtgtatagtcctaatatgcgttggatcatccaagtcccccgaatatacgacatttttcgtagcaagaaactactcccaaactttggaaaaatgctggagaatattttcctgcctttgttcaaagcgactatcaatccccaggaccatcgggaattacatctctttcttaagtacgtaactggctttgacagcgtcgatgatgagtcaaagcattccgaccacatgttttcagataaatccccgaacccggacgtgtggaccagcgaacaaaaccctccctattcgtattatctgtactacatgtacgccaacattatggtgctcaacaacctgaggcgggaaagaggtctgtctacctttttgttcagaccccactgcggcgaagcaggctccataacacatctggtgtccgcctttctcacagcagataacatttcccatggactgttgctgaagaagtcacctgttctccagtatctgtattatctcgcacagatacccattgccatgtcacctttgtctaataactctctttttctagaatattccaaaaacccacttagagaattcctccacaagggtctccatgttagcctctccaccgatgacccaatgcagtttcactacactaaagaggccttgatggaggagtacgccatcgcagcccaggtctggaaacttagcacttgtgacctatgcgagattgctagaaactccgtgctgcagtcaggattgagccaccaggagaaacagaagttcctggggcaaaactactacaaagaaggcccagagggcaatgacatccggaaaacaaatgttgctcagatccgcatggcgttccggtacgaaactctgtgcaatgagctgagctttctgagcgacgcgatgaaaagtgaagaaatcacagccctcaccaactag

SEQ ID NO: 213660 - DNA, 804 bp, Artificial Sequence
  Description of Artificial Sequence: Synthetic coding sequence
atgccaagacagtttcccaagctcaatatcagcgaggtcgatgagcaagttcggcttcttgcggaaaaagtgtttgcgaaggtgctgcgtgaggaagattccaaggatgcacttagcttgttcacggtgcctgaggattgtcccatcggacagaaagaggccaaagaacgcgaactgcagaaggaactagcagagcagaaaagtgtggagacagccaaacgtaaaaaaagcttcaaaatgatcagatcacagtctctatctctgcagatgcctcctcagcaggattggaagggcccacctgcggcttctcctgcgatgtcccctaccacgcccgtggtcacaggtgcaacaagcctgcctaccccggctccatatgctatgccagaattccaaagagtaaccatttctggggactactgtgccggaatcacattagaggattatgagcaagccgcaaagagtttagccaaggcccttatgatccgcgagaaatatgccagactggcgtaccaccggtttccgaggattacttcacaatacctggggcacccaagggccgatactgcaccccctgaagagggtcttcccgactttcacccaccaccactccctcaggaggatccatattgtttagatgatgccccaccaaacctggattatctcgtgcacatgcagggaggaattctgtttgtgtatgataataaaaaaatgctagaacatcaggaacctcattcgctgccttatccagacctagagacatataccgtcgatatgtcacacattttggctctcatcacagactag

SEQ ID NO: 213661 - DNA, 2325 bp, Artificial Sequence
  Description of Artificial Sequence: Synthetic coding sequence
atggaacctgggagcgcagagatgccaaggcagtttcctaagctgaatatttccgaggtggatgaacaagtgcgtctgctggcagagaaggtgttcgccaaagtgctccgggaggaggactcaaaggacgccttgtcgctgtttaccgtacccgaggattgccctataggccaaaaagaggcaaaagagcgggaactgcagaaggaacttgccgaacaaaagtccgtggagacagccaaacgaaagaaatcctttaagatgattcggtcccagtccctctctcttcagatgcctccacagcaggattggaaaggtccaccggcagcatctccagccatgagccctacaacccccgtggtcaccggtgctactagtctgccgacgccagcaccatacgccatgcctgagttccaacgggtgacaatctcgggggattattgtgcgggaatcaccctggaagattatgaacaggcagccaagtctctcgctaaagccctcatgatcagggaaaaatacgctcgactcgcctaccatcggtttccacgtattacttcgcagtacctcggccaccctagagctgataccgctccaccagaggaaggtttgccagatttccatccacctcccttgccccaggaggatccttactgtctggatgacgctccgcctaatttagactatctcgtgcatatgcagggaggcattctcttcgtttatgacaacaagaagatgcttgaacaccaggagccacactccctgccatacccagacctggagacctataccgtggacatgtctcatatactggctcttattacagacggccctactaaaacctactgtcatcgcaggctgaattttctggagtctaagttctcccttcacgaaatgttgaatgagatgtctgagttcaaggaactgaagtcaaacccgcacagagacttctataacgtccggaaagtggacacccatattcacgctgctgcctgtatgaatcagaagcacttactaaggtttatcaagcacacatatcagacagaacccgacagaaccgtagctgagaaacgagggcgtaaaatcacactgcggcaggtcttcgacggcctacacatggatccctatgatctgactgtggacagcctggacgtgcatgctgggagacaaacctttcacaggtttgataagtttaacagtaagtacaatccagttggtgccagcgagcttcgagacttatatctgaaaacggagaattacttaggcggtgaatacttcgcacgcatggtgaaggaggttgcaagggaattagaagaatcgaaataccagtattcagagcccagactgtccatctatggaaggtctcctgaagagtggcctaacctggcctattggttcatccagcacaaagtgtactccccaaatatgaggtggatcatccaggtgcccaggatctatgatatttttcgaagcaagaagttactaccaaatttcggaaaaatgctggagaacatttttttgccactgttcaaggcgaccatcaatccacaggatcacagggagctgcacttgttcttaaagtacgttaccggattcgacagcgtggacgatgaaagcaaacactcagaccacatgttcagtgacaaatcccctaaccccgacgtatggacatcagagcaaaacccgccttactcttactacttgtattatatgtacgccaacataatggtgctgaacaacctcaggagggagagaggcctgagtacgttcttgtttcgaccccattgtggagaagccggtagcataacccacttagttagcgcatttctgacagccgataatattagccacgggcttcttctgaagaaaagccctgtgctgcagtacttgtattacctggcccagatcccaattgcaatgagtcccttatcaaataactctcttttcctcgagtactccaagaaccctttgagggagtttctccacaaaggacttcacgtctcactgagtaccgatgatcccatgcagttccactataccaaagaagccctgatggaggagtatgccatcgcagctcaggtgtggaagctgagcacgtgcgatttatgcgagatcgccagaaatagcgtgttacaatctggcctgagtcatcaggagaaacaaaagtttctgggacagaattattacaaggagggacctgagggcaatgatattcgtaaaaccaatgttgctcagattagaatggcctttcgctacgagaccctgtgcaacgaactgtcttttctttcggacgccatgaagtctgaggagatcacagccttgaccaattag

SEQ ID NO: 213662 - DNA, 2304 bp, Artificial Sequence
  Description of Artificial Sequence: Synthetic coding sequence
atgcccagacagttccccaaactcaacatttctgaggttgatgagcaggttagattactcgctgaaaaggtatttgctaaggtgctgagagaagaggacagtaaggacgcactgtccctcttcacagtgccggaagactgccccatcggccagaaggaagccaaggagagggagctgcagaaagagttggcagaacaaaaatcggtggagacagctaaacgtaagaaaagttttaagatgatacgctcccaatcactttccttgcagatgccccctcagcaggattggaaaggaccacctgctgcgtcccctgctatgtctccgactactcccgtcgtgactggcgctacaagtctgcccaccccagcgccatatgccatgccagagttccagagagttaccatctctggcgattattgcgctggaattaccctcgaggattacgaacaggctgcaaaatcgcttgctaaggccctgatgattcgggaaaagtacgccaggctggcttatcacaggttccctcgaatcacaagccagtaccttggccacccgcgagcagatacggcccctccagaagaggggctgccagatttccatccccctcctcttccccaggaggacccctattgcctggacgacgccccacccaatctggactatctggtgcatatgcagggaggcatcctctttgtttatgacaataagaagatgttagagcaccaggagccgcatagtttgccgtatccagaccttgaaacttacaccgtggatatgtctcacatcctggccctcattacggacgggccaactaaaacctactgccaccgcagactgaatttcctcgaaagtaagtttagcctccatgaaatgctgaacgaaatgagtgaattcaaggagctcaaatcaaacccacatcgagacttttataacgtgcggaaggtagacacccacattcatgctgcggcatgtatgaaccagaagcatcttctgagatttatcaagcacacctaccagacggaaccagataggacagtcgctgagaagcggggacgcaagatcaccttgcggcaggtcttcgacggcttgcacatggatccttatgacttgaccgtcgactccctggacgtccacgccggtcgccagacttttcaccgctttgacaagtttaattccaagtataaccctgtgggcgcatcggagctgagggatctgtatctgaagaccgaaaactacctggggggtgagtatttcgcccgaatggtgaaggaagttgcaagggaactggaagagtccaaatatcagtatagtgagccacgattgtcaatctatgggcgatcccccgaggaatggcctaatcttgcatactggttcattcagcacaaggtgtacagtccgaatatgcgatggattattcaggtcccccgtatttacgatatcttccgctccaaaaaactgctgcccaacttcggcaaaatgctcgaaaatatatttctacccttgtttaaggctactataaatccacaggaccacagggaactgcatcttttcctgaagtatgtgaccggcttcgattccgttgatgacgaatccaagcattctgatcacatgttcagtgataagagtcccaacccagacgtgtggacctccgagcaaaatccaccttattcctactacctgtactatatgtacgctaatatcatggtgctgaacaacctcaggagagagagaggcctatcaacctttctatttcgtccgcactgtggagaagcaggaagtataacacacctggtctctgctttcctcactgctgataacatttctcacggacttcttctcaaaaaaagcccagttctgcagtacctgtactatttggcccagattcccatagccatgtcccccctcagtaataactcgctgtttctcgaatattctaagaaccccctcagggagttcttgcacaagggactacacgtgagtctgtcgaccgacgaccccatgcagttccattataccaaggaagcactgatggaagaatacgctatcgccgcacaggtttggaagttgtcaacctgcgatttgtgcgaaattgctaggaactctgtattgcagtccggccttagccaccaagaaaagcaaaagttcctggggcaaaattactacaaggagggcccagagggaaatgatattaggaagaccaacgtggcacagatccgtatggccttccgctacgagactttgtgtaacgagctttccttcttgagtgacgccatgaaatcggaggagatcacagcactgaccaactag

SEQ ID NO: 213663 - DNA, 336 bp, Artificial Sequence
  Description of Artificial Sequence: Synthetic coding sequence
atgccaaggcaattccctaagttaaatatttccgaggtggatgaacaagtccgccttctcgctgaaaaagtgttcgctaaggtgctgagggaggaggactccaaggatgcactatccctgtttactgtgcccgaagattgcccgataggacagaaggaggctaaggagcgtgagttacagaaagagctggccgagcagaaatccgtggagaccgctaagcggaaaaaaagtttcaagatgattagaagccagagtctttcgctgcagatgccaccacagcaagactggaaagggccacctgccgcatcccccgctatgagccctaccaccccatag

SEQ ID NO: 213664 - DNA, 426 bp, Artificial Sequence
  Description of Artificial Sequence: Synthetic coding sequence
atggcacggccactgtgcaccctgttactcctgatggcgaccctggccggtgccctggctagctccagcaaggaagaaaatcgcattattccagggggaatttatgacgcagatctcaatgacgagtgggtccaacgtgctctccactttgctatctccgagtataataaggccacagaggacgagtattaccgcagaccacttcaggttcttcgcgcacgtgaacaaactttcggcggagtaaattatttttttgacgtggaagtgggacgcacaatttgcacaaagagccaacctaacttggacacctgtgctttccacgagcagccagaactgcagaaaaagcaattgtgtagcttcgagatatatgaagtgccttgggaagacaggatgtcccttgtcaattctagatgccaagaggcttag

SEQ ID NO: 213665 - DNA, 1215 bp, Artificial Sequence
  Description of Artificial Sequence: Synthetic coding sequence
atgcccggactcatgcggatgcgcgaaaggtattccgcttccaagcctctgaaaggcgctaggattgccggatgcctgcatatgaccgtcgaaaccgccgtgctgatcgagactctagtgacactgggagcagaggtgcaatggagctcctgtaatattttttccacccaagatcatgccgcagctgcaattgcaaaagccggaatcccagtgtacgcttggaagggcgaaaccgacgaggagtatctgtggtgtatcgagcaaaccctgtactttaaagatggaccccttaacatgatactagatgacgggggagacctcaccaacttgattcataccaaataccctcagctcttgcccggtatcaggggtatcagtgaggaaacaacaaccggtgtccacaacctctataaaatgatggcaaacggcattttgaaagtacctgccatcaacgtgaatgactccgtgacgaagtcaaagttcgacaacttgtatggctgtagggaaagcctcatcgatggaatcaagcgggctacagacgtgatgatcgcaggcaaggtcgccgtcgtggccggttacggcgacgtaggtaagggctgcgcgcaggcgctcagaggtttcggggctcgagtcattattacagagattgatcccatcaacgcacttcaggcagccatggagggttatgaggtcacaacaatggatgaggcgtgtcaggagggtaacatttttgtcaccaccaccgggtgtatcgatatcatcctaggtcggcattttgaacagatgaaagatgacgcaatcgtgtgtaatattggtcatttcgacgtggagatcgatgtgaaatggctgaatgaaaacgctgtagaaaaagttaacattaaacctcaggtagacagatatcgcctcaagaacggccgacgcatcattctgctggctgaagggaggttggtcaatctgggatgcgccatgggacacccatctttcgtcatgagcaactcctttacaaaccaggtgatggcccagatcgagctatggacacaccctgataagtaccccgtaggggtccacttcctcccaaagaagttggatgaagcagtcgcagaggcacacctcggtaagttgaatgttaagctcaccaaattgaccgaaaagcaagctcaatacctgggcatgtcgtgcgacggcccttttaagcctgatcattaccggtattag

SEQ ID NO: 213666 - DNA, 798 bp, Artificial Sequence
  Description of Artificial Sequence: Synthetic coding sequence
atgttcgtgtccaaaagacgcttcatcctgaagacctgtggtaccaccctgcttctgaaggcccttgtgcctctgttgaagttggccagagactacagtggtttcgactctatccagtcgtttttttacagtcgaaagaatttcatgaagccttctcatcaaggctaccctcaccggaactttcaggaggagattgaatttctgaacgccatattcccaaacggtgccgcttactgcatggggaggatgaactcagactgttggtatctatacactctggattttcccgagagccgtgttatctcccagcccgaccagaccttggaaatccttatgtcagagttagaccctgccgtgatggaccagttctatatgaaagatggagttactgctaaggatgtgacacgagaaagtggcatcagagatctcatccctggaagtgtaatcgatgccaccatgttcaatccctgtggctactctatgaacgggatgaaaagtgatggaacctactggactatacacattacccctgaaccagaattttcttacgtgtcgttcgagaccaatctgtcccaaactagctacgatgatcttatcagaaaagttgtcgaggtgttcaagcccggtaagttcgtcaccactctgttcgtgaatcagagctccaaatgtagaaccgtgctcgcctccccccaaaaaatcgaagggtttaaacggttggactgccagtcagccatgtttaacgactacaatttcgtattcaccagtttcgccaagaagcaacaacagcagcagagttag

SEQ ID NO: 213667 - DNA, 918 bp, Artificial Sequence
  Description of Artificial Sequence: Synthetic coding sequence
atggaagccgcacattttttcgaagggaccgaaaaactgctcgaggtctggttcagccgccagcagcctgatgccaaccagggaagtggagatctgcgaacaataccttccgagtcctcaatgttcgtcagcaaaagacgctttattctgaagacgtgtgggacgactctgctgttaaaggcactggtgcccttgctcaaactggccagggactactcaggcttcgactccattcagtctttcttctattctcgcaaaaattttatgaaaccctcccatcagggctatcctcatcgaaactttcaagaggagattgaattcctgaatgcaatattccctaatggggcagcctattgcatgggacgaatgaactctgactgctggtatttatacaccctcgactttcccgagagccgggtgatttcacagccagaccagactcttgaaatcctcatgtccgagctggatcctgccgtgatggatcagttttatatgaaggacggcgtcactgcaaaggatgtgacgcgggaaagcggcattagggacctcatccctgggtccgtcatcgacgccactatgtttaacccatgcgggtactctatgaatgggatgaagagtgatggtacatactggactattcacatcaccccagagcccgagttctcgtacgtatcattcgagacaaatctctctcagacatcttatgacgacctcatccgaaaggtcgtggaagtatttaagcccggtaagtttgtgactactctcttcgttaaccagagctcaaaatgccgtacggtcctggcttccccccagaaaattgagggcttcaaaagattagattgccagagcgcaatgtttaacgattacaattttgtcttcacttcctttgcaaagaagcagcagcagcagcagtcttag

SEQ ID NO: 213668 - DNA, 561 bp, Artificial Sequence
  Description of Artificial Sequence: Synthetic coding sequence
atgggcaggatgaactctgactgctggtatctgtacacattagacttccccgaatcacgggttattagccagccagatcagacactggaaattctgatgagtgaactggaccccgctgtgatggaccaattctacatgaaagatggtgtaactgcaaaggatgtcacaagagagtcaggaattcgggatctcatccccggtagcgttattgacgcaactatgtttaatccttgcggatatagcatgaatggcatgaagtccgacggcacatactggacaatacacattactcccgaaccagaattttcgtacgttagctttgaaactaatttgtcccagaccagttatgatgatctcatccggaaagtcgtcgaggtctttaagcccggaaagttcgtgaccacactgtttgtgaaccaaagcagcaagtgcagaaccgtactggccagccctcagaaaatcgaagggtttaagcgactggactgccagagcgcgatgtttaacgattataactttgtcttcacaagctttgccaagaaacaacaacaacagcagagttag

SEQ ID NO: 213669 - DNA, 1005 bp, Artificial Sequence
  Description of Artificial Sequence: Synthetic coding sequence
atggaggctgcccactttttcgaaggtacagagaaactgctggaggtttggttctcacgtcagcaacctgacgctaatcaaggatcaggggacctccgaacaatcccccgttccgaatgggatatcctattaaaggacgttcagtgctccataatttctgtgaccaaaaccgataagcaggaggcatacgtcctctctgagtctagcatgtttgtctcgaaacggaggttcattttaaagacgtgcggcacaactcttttgttaaaagcactggtgccattgctcaagctggctcgtgattattcagggtttgatagtatccagtcattcttctactctcggaagaattttatgaaaccctctcatcagggataccctcaccgtaactttcaagaggaaatcgaattcctgaacgctattttccctaacggcgctgcctactgtatgggcagaatgaattccgactgctggtacctctacaccctggactttccagaatctcgcgtgatctctcagccggatcaaacactggaaattctgatgagcgaactggaccctgcagtgatggaccaattttacatgaaggatggggtaaccgcaaaggatgtgacacgagagtctggcatacgggacttgatccctggttcagttatcgatgcaacgatgttcaacccgtgcggctactccatgaatgggatgaaatctgatgggacatattggacaatccacatcacccccgaacccgaattttcctatgtcagctttgagaccaacctgagccagactagttatgatgatctgatccggaaagtagtggaggttttcaaacccggaaagtttgtgaccaccctgtttgtgaatcagagttccaagtgcagaaccgttctggcctcccctcagaagatcgagggctttaagcggctggattgccagagcgccatgttcaacgactataactttgtcttcacatcttttgcaaagaagcagcagcagcaacagtcttag

SEQ ID NO: 213670 - DNA, 645 bp, Artificial Sequence
  Description of Artificial Sequence: Synthetic coding sequence
atggaggccgctcatttctttgaggggactgaaaagctgctggaggtctggttcagtcggcagcagccagacgctaaccagggttcaggcgacttgcgcaccatcccaagatacctgtacacactcgatttcccagaatccagagtgatttctcaacccgatcagaccctagagattctgatgtcggaactagatcccgctgtaatggaccagttctacatgaaggatggcgtcactgccaaggatgtgaccagggaaagtggtatccgggatctgattcctggctcagtgatcgatgccaccatgttcaatccctgtggttattctatgaacggcatgaagtcagatggcacttattggaccatacacatcactcctgagccagaattttcttacgtgtcttttgaaactaacctaagccagacttcctacgatgacctgattcggaaggtggtggaagtctttaaacctggaaagtttgtgaccaccctatttgtcaatcaaagctccaaatgccgaacagtgcttgctagcccacagaagattgagggcttcaagcggctggattgccaatcagcgatgtttaacgattataatttcgtgtttacctccttcgccaaaaagcagcagcaacagcagagttag

SEQ ID NO: 213671 - DNA, 3360 bp, Artificial Sequence
  Description of Artificial Sequence: Synthetic coding sequence
atggccggagccccacggggaggcggtggtgggggaggtggagcaggagagcctgggggagctgagcgcgcagctggtacgagtcgccgacgcggactccgcgcttgcgacgaggaattcgcctgccccgaactagaggccctgtttagagggtacactttgcgcttagagcaggctgctacactgaaagccttggcagtgcttagtttgctggctggcgcactggcactggcagaattgctgggggctcccggtcctgcgcctggactcgccaagggaagccatccagtccattgcgtgttgttcttggccctattggtggtgacaaatgtgaggtctctgcaagtgccccaactgcagcaagtgggtcagctcgctctcctattctcactcacttttgctctgttgtgctgcccatttgcgcttggtggaccagctcgtggctccgctggggcagccggtggaccagctacggccgagcagggggtgtggcaactcctgcttgtcacgttcgtctcctatgctcttctccccgtgcggtccctactggcgatcggattcggccttgttgtggccgcatcacacctcttggtgaccgccacattggtgcccgcaaagagacccagactgtggagaacactgggagcgaacgcgctcttgttcgttggcgtcaatatgtatggcgtattcgtcagaattttgacggagcgttctcagcggaaggccttcttgcaagcgagatcatgcattgaggaccgactgaggctcgaggatgaaaacgaaaagcaggagaggttgctgatgtcgctgttaccgagaaacgtcgcgatggaaatgaaggaagattttctcaaaccgcctgaaagaatcttccataagatttatatacagaggcacgacaatgtcagtattctgttcgcagatatagtcggtttcactggacttgcgagtcagtgcactgcacaggagctcgtgaaacttctgaatgaactgtttggcaaatttgacgagcttgccaccgagaaccattgccgaaggatcaaaatcctgggcgactgttactactgcgtctctggactgacacagcccaagaccgaccacgcccactgttgcgtggagatgggacttgatatgatcgatacaattacctcagtcgctgaagctaccgaggtggatctaaatatgcgggttggcctgcatacgggacgcgtgctctgtggagtgctcggactccgtaagtggcagtatgacgtgtggtctaacgacgtcaccctggccaacgtcatggaagctgccggattgcccggaaaagtgcatataacaaagactacattagcctgcctgaacggcgactatgaagtcgaaccgggatacggccacgagcggaattcttttctcaagacacataatattgagacttttttcatagtgccctctcaccggaggaaaatcttcccgggacttattctttctgatataaaaccagctaagagaatgaagttcaagactgtttgttacctgctggttcagctgatgcattgtcgcaaaatgtttaaggctgagataccctttagcaatgttatgacctgtgaagacgatgataaacggagagcgctacgcacagcctctgagaaactacgcaataggagttcatttagcactaacgttgtatacactacacctggaacacgcgtgaatcgctacatctctaggctgctggaggctaggcaaacagagctggaaatggccgaccttaacttttttaccctgaagtataagcatgtcgaacgagagcaaaaataccaccagctgcaggatgaatacttcaccagcgcggtagtgttgactctcattttagctgcccttttcggcctagtgtatcttctgattttcccccaatctgtggtggtgctactgttacttgtgttttgcatttgcttcctggttgcttgtgtgctttacttacacataactcgggtacaatgtttccccggatgtcttacaatccagattagaactgtcttgtgcattttcatcgtggtgctgatctattcagttgcccagggttgcgtggtgggctgcctgccttgggcctggtcatcaaaacccaatagtagcttggttgtgctaagcagtgggggacagcggaccgcgttacccactctcccttgtgagtcaacccaccacgcactcctgtgctgcctggtgggaactcttcctctcgccatattcttcagggtctccagcctgcccaaaatgatcctcctgagtgggctgacaacgagctacattctcgttttagagctgtctgggtacacgcgaaccggcggtggagctgtgagcggccgaagttatgagcccattgtagccattttgttattttcctgcgcactcgccctccatgcacgtcaggtcgacatccgactcaggctggattacctgtgggccgcacaggctgaggaggagcgggaagatatggagaaggtaaagctggataaccgtcgcatcttgttcaacctcctccctgctcatgtggcgcagcactttttgatgtcaaatccacgaaacatggatctgtattatcagagctactcccaagtcggtgttatgtttgcatctattccaaactttaacgacttctacattgaactggatggcaataatatgggcgtcgaatgtctgagattactgaatgagatcattgcagattttgatgagctgatggagaaagacttttacaaggacatcgagaagatcaaaacgatcggctccacctacatggctgctgtggggctcgctcccaccagcgggactaaggcaaaaaaaagtatctcctctcacttgtccacattggccgattttgcaatcgagatgtttgacgtcttagatgagattaactaccagagttataacgactttgtgttgcgggtcggtataaatgtgggcccagttgtcgcaggcgtcataggagctaggagaccccagtatgatatctggggaaacaccgtcaatgtggcctcaagaatggactcaactggcgtccaggggagaatccaggttacggaggaagtccatcgcctcctccgccgatgtccataccacttcgtctgtagaggaaaagtctcggtcaagggaaaaggcgagatgttaacgtatttcctggagggcaggaccgacgggaacggttcccaaattaggtcgttgggccttgatcggaaaatgtgtccatttggcagggctggcctccaaggacggcgtccacccgtttgccctatgccaggcgtgagcgtgagggccggtctgccccctcactctcccggacagtacctcccttccgcagccgctggaaaagaagcatag

SEQ ID NO: 213672 - DNA, 3174 bp, Artificial Sequence
  Description of Artificial Sequence: Synthetic coding sequence
atggcaggagcccctcggggagggggaggcggtgggggaggcgcaggagagccgggaggtgccgaacgcgcagcaggaaccagccgacgcagaggattgcgagcctgtgacgaagaatttgcctgcccagagctcgaggctctatttcggggatatactctgcgcctggagcaggcagctacgctgaaggcgctcgccgtccttagtctgctcgcaggcgcactagcccttgcagagctgttgggcgctcctgggccagcaccgggtctggcaaagggatcccaccccgtgcactgtgtattgttccttgctctgctagttgtgactaacgttaggtccctgcaggttcctcaactgcagcaagtggggcaattagccctgctttttagcctgactttcgccctgttatgctgtcccttcgccctgggaggcccagcgaggggctctgctggcgctgctgggggacccgctaccgcggagcaaggcgtgtggcaactgctgcttgttaccttcgtcagctacgcactgctaccagttcggtctctattggcgattgggttcggactagtagttgccgctagccatctgctggtgaccgcgaccctcgtgccggctaagaggccccgtctctggcgtaccctgggagctaatgccctcctcttcgtgggagtgaatatgtatggtgtgttcgttcgaatcttaacagagaggagccagcgaaaggcatttcttcaggcacgctcgtgtatcgaggatagactgagattagaagatgagaacgagaagcaggaaaggcttctcatgtctctgctcccgagaaatgtcgccatggagatgaaggaagacttcctgaaaccacccgagaggattttccataaaatatatatccagagacacgataatgtttcaattttgtttgctgatattgtgggcttcacaggcctagccagccagtgtacggcccaggaattggtgaaactgcttaatgaattgtttggtaagttcgacgaactcgccactgagaatcactgcagaaggattaaaattcttggggactgctactattgtgtgtccggtctaacacagccaaagacagaccatgcccactgttgtgtggaaatggggctggatatgatcgacaccattacttccgtggccgaagctacagaggtggacctcaatatgagggtgggactccacacaggcagggtgctgtgcggggtgctgggtctgagaaaatggcagtacgatgtgtggagtaacgatgtgacattggccaatgtgatggaggcggctggactcccgggtaaggtccacattacgaagactaccttagcctgcctaaatggggattacgaggtcgaaccgggttatgggcacgagaggaacagctttttaaagacacacaatattgagaccttcttcattgtgccttcgcataggcgcaaaatcttcccaggactgatcctgagcgacattaagcccgctaaacgcatgaaatttaagactgtatgttacttgctggtgcagttgatgcattgtagaaagatgtttaaggccgagataccattcagtaatgttatgacctgcgaagacgacgacaagcgcagagccctcagaaccgcttccgaaaaattgaggaaccggagctcttttagcaccaacgtggtgtataccacccctggtacccgtgtaaacagatacatctccagactcctggaggccaggcagacggagttggaaatggccgaccttaacttctttactcttaaatataagcatgttgaaagggaacaaaaatatcatcagttacaggacgagtactttacgtccgcagttgttctgaccctcatccttgccgcactcttcggacttgtgtatctccttattttcccgcagagcgtggtcgtcctactgttgctggttttttgcatttgttttctcgtcgcatgcgtgctctacctgcacatcacgagagtccagtgctttcctggttgtctgaccatccagattagaaccgtactttgcatcttcatcgttgttttgatttactctgtcgcccagggctgcgtagtggggtgtctgccatgggcatggagcagtaagccgaattctagtctcgtcgtcctttcctcagggggacagcgtacagccttaccgaccctgccgtgcgagtcaactcaccatgccctgctgtgctgcctcgtgggaacgctgccactcgctatattttttagagtaagtagcttgccgaagatgatcctcctttctggcctgaccacaagctatattctcgtcctggagctatccggatacacccgaaccggcggtggagccgtgagcggccgatcttacgagccaattgttgcaattctgctgttctcctgcgccctcgccttacacgctagacaggtggacattcgtctgagattggactatctatgggcggcacaggcagaggaggaacgagaggacatggagaaggtcaagctggataatcgacgcatactgttcaacttgctgcctgcacatgtggcacagcactttctgatgagtaaccccagaaatatggatttgtactaccaaagttattcgcaagtgggggtcatgttcgcctccatcccaaatttcaacgacttctatattgaactggacggcaacaacatgggagtagagtgtctgcgcctgcttaacgagattattgccgatttcgatgagctcatggaaaaagatttttacaaagatatcgaaaaaatcaagacaatcgggtccacctacatggcggcagtggggctggcccctacatcaggcaccaaggccaaaaaatccatatcatcacacctgagtacacttgccgactttgctattgaaatgttcgatgtcttggacgaaatcaattaccaatcatataatgacttcgtcctccgcgtgggcatcaacgtagggccagtggtggcaggagtaatcggggctaggaggcctcaatatgacatctgggggaataccgtgaacgtcgcatcacggatggattctactggcgtccagggcagaatccaagtgaccgaagaggtccatcgcctgctgaggaggtgccccccactgtgtgtgcctcgccaatcccagtgtcagggtcagaggcgagacgttgatatcctgagtcgtaggcaggactag

SEQ ID NO: 213673 - DNA, 3276 bp, Artificial Sequence
  Description of Artificial Sequence: Synthetic coding sequence
atgtggcaagaggccatgagacgcaggaggtacctccgggaccggagtgaagaggccgcaggcggtggagatggtctgcctagatccagagattggctgtacgagtcatactattgtatgtcccagcagcaccccctcatcgtttttctcctactgattgtcatgggcagctgccttgcacttcttgcagtctttttcgcactggggttggaagttgaggaccacgttgcttttctcatcaccgtccctactgcattggctattttctttgctatctttattctggtgtgcatcgagtccgtcttcaaaaagctcctccgtctcttctcattggtcatttggatttgtctggtggcgatgggttacctcttcatgtgcttcggaggcactgtgagtccctgggatcaggtgtcttttttcctatttataatctttgtcgtgtacacgatgttgccattcaacatgcgagatgctatcatcgcctcggtgcttacaagcagcagtcatacgatcgtactctccgtctgcttatcagcgacccccggtggaaaagagcacttagtttggcagatcctggccaatgtgattatttttatctgtggtaacctggctggagcatatcataaacatctgatggagttagcactgcagcagacataccaggacacctgtaactgcattaaaagccgcataaaacttgaattcgaaaagcggcagcaggaacgcttactgctcagcctactgcccgctcatattgccatggaaatgaaagctgagattattcagagattgcagggacctaaggcgggacaaatggagaatacgaataacttccataacctgtatgttaagcggcatacgaatgtttccatcctatacgccgacatagtaggcttcaccagattggctagtgattgtagccctggagaactggttcacatgctgaatgagttatttggcaagttcgatcagatcgccaaggagaatgagtgcatgagaatcaaaatactgggagactgctactactgcgtttctgggttgcccatctccctgcccaatcacgctaagaattgtgtcaaaatgggtctcgacatgtgcgaagctattaagaaggtcagggacgccacaggcgtcgatatcaacatgagggtcggtgtgcattccggcaacgttctgtgcggggtgattggtttgcagaaatggcaatacgacgtctggagtcacgatgtgaccctcgcgaatcacatggaggctggcggagtgcccggtcgggtgcacatcagtagcgtgacactggaacacttaaatggggcttataaagtggaagaaggcgatggggacataagggacccatacctgaagcagcacttggtgaagacatactttgtcattaatcctaaaggcgagcggaggagtccccagcatctgttccgtccgagacataccttggacggagcaaaaatgcgggcatcagtcagaatgaccagatatctggaatcttggggcgcagcaaaaccttttgcacacctccatcatcgtgattctatgaccaccgaaaacggcaagatatccactaccgacgtccctatgggtcagcataatttccagaatcggacactgagaactaagtcacagaagaaaagattcgaagaagagctcaatgaaagaatgatacaggcaatcgatggcatcaatgctcagaagcagtggctcaagtccgaagatattcagaggatcagccttctgttctacaacaaggtgttggagaaggagtaccgcgcaactgccttgcccgctttcaagtactacgtgacttgtgcctgtttaatttttttctgtatctttattgtgcagattcttgtactccctaagacatctgtcttgggtatttcctttggcgctgcatttttgcttctagccttcatcctgttcgtgtgttttgccggacagctgttgcaatgcagtaagaaggcctcccccctgctgatgtggctcctgaagagcagcggcattatcgccaaccggccatggcctcgtatttccctgactattatcacaactgctatcattctaatgatggccgttttcaacatgttcttcctttctgactctgaggagaccataccacctactgccaacactacgaacacatccttctccgcaagcaacaatcaggtcgcaatccttagggcacagaacctctttttcctgccatattttatttatagctgcatcctcggcctgatatcctgtagcgtatttctccgcgttaattacgaactgaaaatgctgattatgatggtcgctctcgtcggttacaatacaatacttcttcatactcacgcccacgtgctgggcgactacagtcaggtgctcttcgagcgccctggaatctggaaggatttgaaaacaatgggcagtgtctcactgtcaattttctttatcacgctgcttgttctcgggcgacaaaacgaatattactgccgtcttgacttcttatggaagaataagttcaagaaggaaagggaagaaatagaaactatggagaacttgaatcgggtgctgctggaaaacgtgctcccggctcatgttgccgagcacttcctcgctcgctcattgaagaacgaggaactctatcaccagtcttacgactgtgtctgcgtaatgtttgcgtccatccccgactttaaggagttttatacagagagcgacgtgaataaggaggggttagaatgtctacgcctgctgaacgaaatcatcgcggactttgacgacttgctgtcgaaacccaaatttagcggggtagagaagatcaaaactatcgggtctacctatatggccgcaaccggactgagcgccgtaccttcgcaggagcatagccaggagcctgagaggcaatatatgcacattggaaccatggtggagttcgccttcgcattggttggcaagctggacgccatcaacaagcactcgtttaatgacttcaaattgcgcgtgggtattaatcatggccctgttattgctggggtcattggcgctcagaagccccagtacgacatctggggtaacaccgttaatgttgctagtagaatggactctacgggagtactagataagatccaagtcaccgaagagacatccctggtgctgcagaccttaggctacacatgcacttgccgtgggataataaacgttaaaggaaaaggcgatctcaagacttacttcgtgaacactgaaatgtcccgtagcttatctcagtcaaatgtggccagctag

SEQ ID NO: 213674 - DNA, 612 bp, Artificial Sequence
  Description of Artificial Sequence: Synthetic coding sequence
atggagaacctcaatcgggtgttactggagaatgttctgccagctcatgtggccgagcactttcttgccagatccctcaagaacgaggaactctaccaccagagctacgactgcgtatgcgtgatgttcgccagcatccctgactttaaggaattctataccgaaagcgacgtgaataaggagggtctggagtgcctccggttgctgaatgagatcatcgccgactttgacgacctgctctctaagcccaaattcagcggtgttgaaaagataaagaccattggctctacatacatggctgcgaccggtctgtctgcagttcccagccaagagcattcccaggagccagagaggcagtatatgcatatagggaccatggtggagtttgcctttgcccttgtggggaagcttgacgccatcaataagcactctttcaacgactttaaactgagggtaggggtgactgaggagacctctttggttttacagacacttggatatacatgcacatgtcgcggaatcatcaatgtaaagggcaagggtgatctgaaaacctacttcgtgaacaccgaaatgagtcgatctctgtcccagagtaatgtggccagttag

SEQ ID NO: 213675 - DNA, 2736 bp, Artificial Sequence
  Description of Artificial Sequence: Synthetic coding sequence
atggacctgagatgggcccgagatctgcacttaagagaggccagtcggtcagtcgcctttacaaccttgagattgggtgccgtgacaacgggtctgctgacatttagggagcctggcgacaaggaaaaaagcggaaaggggcttggtaaacggtggcgaatacagagagaggagtcccaggagcggttgctactttctctactgcccgctcacattgctatggagatgaaggctgaaatcattcagagacttcagggtcccaaagctggacagatggagaatacaaacaacttccataatctctacgttaagcggcataccaacgtgagtattctgtatgcagatatcgtgggcttcactagactggccagcgattgctcccccggtgagttagtgcacatgctgaacgagctttttgggaagttcgaccagattgccaaggagaatgaatgtatgcgtatcaagattcttggagattgctactactgcgtctccggattgcctatcagcctacctaaccatgcaaaaaattgcgtaaaaatggggttggatatgtgtgaggcgattaagaaagtgcgcgatgctaccggagtggatataaacatgcgcgtcggcgtccatagcgggaatgtcctatgtggagtgattggactgcagaaatggcagtacgacgtgtggagccacgatgttacactggctaatcatatggaggccggaggcgtccctggacgagtacacatttcaagcgtgacattagaacatctgaacggcgcatataaagttgaagaaggggacggggatatccgggacccatacctgaaacagcacttggtgaagacatatttcgtgatcaatccaaaaggtgaaagacgctctccgcagcacctgtttcgcccacggcacaccctagacggtgctaagatgcgcgcatcggtgaggatgacgcgctatctcgaaagttggggcgcagccaagccattcgcccatctgcaccacagggattccatgacaactgaaaacggtaagatctccaccacagatgttcctatgggccagcacaattttcagaaccgcacactacggaccaagtcacagaaaaaacgcttcgaagaggagctgaacgagcgcatgattcaggccatagacgggattaacgcccagaaacagtggctgaagtctgaagacattcaaagaatcagcctgttgttctacaacaaagttctcgaaaaggagtacagagccactgctctgcctgcctttaagtactatgtcacgtgtgcatgccttatctttttctgcattttcatcgtgcagattctggttttaccgaaaactagcgtcttaggcatttcattcggtgctgcctttttgctgctagcctttatactgttcgtgtgcttcgctggtcagctcctccaatgtagcaaaaaggcctcgcctttactgatgtggttgttaaagtccagtggaatcattgccaatcgaccctggccgcgtatttcccttaccattatcacaacagccattatcctgatgatggctgtctttaatatgttcttcttatccgatagtgaagaaactattccacccaccgcaaataccaccaatacttccttctcggccagtaataaccaagtcgctatactcagagctcaaaacctcttcttcctaccttatttcatctattcttgcattttgggtttaatttcatgctccgtgtttctcagggttaactacgaattgaaaatgctcatcatgatggtggccttggtgggctataatactatcctgcttcacacccacgcccatgtcttgggtgattattcccaggtgctgttcgagcggcctggcatttggaaggacttgaagaccatgggatccgtgtccctttctatcttttttatcacgttactggtgcttggcaggcagaatgagtactattgccggctcgattttttatggaaaaataagttcaagaaggagcgggaagaaattgagaccatggagaatctcaatagagtgttgttggagaatgtcctaccagctcacgtggccgaacattttctcgctaggtcactcaaaaacgaggaactgtaccaccaatcttatgactgcgtgtgcgtgatgttcgcaagcattcctgactttaaagagttctatacagagtctgatgtgaataaagaagggctagagtgtctgaggcttctgaatgaaatcattgctgactttgatgacttgctatcaaagccgaagttcagcggggtggaaaaaatcaagactatcggatcaacctacatggctgcaacgggactgagtgccgtgcctagccaggaacactcccaggagcctgagcgccaatacatgcatattggcactatggtggagtttgctttcgcactcgtcggcaaacttgatgctattaacaagcacagctttaacgactttaagctcagagtggggataaaccatggacctgtcatcgccggagtgatcggggctcagaagccgcagtatgatatttggggcaatactgtcaacgtggctagcaggatggactctaccggggtgctggataaaattcaggttaccgaggaaacctcgttagtgctccaaaccctgggatatacctgtacttgtcgaggcatcattaacgtgaaaggcaagggagatctcaagacatatttcgtgaacacggaaatgagtcgctctttgtcccagagcaacgtagccagttag

SEQ ID NO: 213676 - DNA, 2775 bp, Artificial Sequence
  Description of Artificial Sequence: Synthetic coding sequence
atgctccccttcaacatgcgcgacgcaataattgcttcagtattaacctcatcttcacacacaatagtcctgtcagtctgtttatcagccactcccggaggaaaagagcacttggtgtggcaaatcttggcgaatgtaatcattttcatttgtgggaatctagccggagcatatcacaagcatttgatggagctcgccctacagcagacataccaggacacctgcaactgcattaagagccggatcaaactggaatttgagaaacgccagcaggaacgcctattgctctccctgctgcccgcacatatcgctatggagatgaaggctgagattattcagaggttacagggtcctaaggccggtcaaatggaaaacaccaataactttcacaacctatatgtgaagcgccatactaacgtgtcaatcctctacgctgatattgtaggttttacccgactggcaagtgattgctctccaggcgagctggtccacatgctcaacgaactctttggcaagtttgatcaaatcgctaaggaaaatgaatgtatgcgcatcaagatccttggagattgctactattgcgtgtccggcctcccgatctccctgcctaaccatgccaaaaattgcgtcaaaatggggctcgacatgtgcgaggcaattaagaaagtgagggatgccaccggagtggatattaacatgcgcgtgggcgtacactcagggaacgttctatgcggagtgattggactccagaaatggcaatatgacgtctggtcacatgacgtaacactggcgaaccatatggaagccggaggggtccctggtcgggtgcacatctcctccgttacactggaacaccttaacggcgcttacaaggtcgaggagggcgacggcgatatacgcgatccctatctgaaacaacacctggttaagacgtacttcgtcatcaaccctaaaggcgaacgccgatctccgcagcatctgttccgccctcgacatacactggatggagcgaagccatttgcacatctgcaccaccgggactcaatgactaccgagaatggaaagatctccaccactgatgtgccaatggggcaacacaatttccagaatcggacactccgaaccaagtcccagaagaagagatttgaggaagagctcaacgagaggatgattcaagccattgacggaattaatgcacagaagcagtggctgaagtctgaggatatccagagaatatctctactcttctacaacaaagtgttggagaaagaatatagagccaccgcgctgcctgccttcaagtactacgtcacatgcgcgtgtctgatctttttttgtatcttcatcgtacagatcctcgtattgcctaagacatccgtgttgggcattagctttggcgctgcctttctgctcttggcgttcattctgttcgtttgtttcgctggccagctcctgcaatgcagcaagaaggcttccccgcttctcatgtggctgctcaagagtagcggaataattgccaaccggccatggccacgcattagcctcacaataatcacgaccgccatcatcctaatgatggcggttttcaatatgtttttcctgtcggactcagaggagaccatcccgcctacagcaaacactaccaacactagtttcagcgcctccaacaatcaggtggccatcctccgcgctcagaatctattttttctcccctatttcatctattcctgcatcctagggcttattagctgtagcgtgttcctgagggttaactacgaactgaaaatgctgatcatgatggtggctttggtcggatacaacactatccttctgcacacgcacgcccatgtgttgggcgactacagccaagtactcttcgagagaccaggaatttggaaggatctgaaaaccatgggctccgttagcctgtctatcttcttcattacattactggtactcggacgccaaaatgaatactactgccggctggattttttgtggaaaaacaagttcaagaaagagagggaagaaattgagacaatggaaaacctcaacagagtgcttctggaaaacgtgctgcctgcacatgttgccgagcacttcctcgctcgctcactcaaaaatgaggagctctatcatcagtcctatgattgtgtttgcgtgatgtttgctagcatccccgatttcaaagagttttacacggaatccgatgtgaacaaagagggcttggaatgtctgcggttattgaacgagatcatagctgacttcgatgacctgctctctaagccaaagttttccggagtcgaaaagatcaagaccatcggttccacatacatggctgcgaccggcctcagcgccgtccccagccaagagcactcccaggagcctgaacgccaatacatgcacatcggaactatggttgaatttgcattcgcactcgtcgggaaactcgacgcaattaacaagcactcctttaacgacttcaagctcagagtgggtataaaccacggccctgtgatagccggtgtaataggggcacagaagccgcaatacgatatttggggcaacacagttaatgtcgctagcagaatggactcaaccggcgttctagataagatccaagtgacagaggagacctccttggtcctccagacactcggctacacgtgcacttgccgcggaataatcaacgtcaagggtaagggggatctgaagacctacttcgtcaatactgaaatgagcagatcactttcacagtccaatgtggcctcctag

SEQ ID NO: 213677 - DNA, 3435 bp, Artificial Sequence
  Description of Artificial Sequence: Synthetic coding sequence
atgccccgtaaccagggctttagtgagccagaatacagcgctgaatattctgccgagtacagcgttagtcttcctagtgatccagaccgcggagtgggtaggacacacgagatttccgtcaggaactccggtagctgcctgtgcctgccccgatttatgcggttaacctttgtgcctgagtctctggagaacctgtatcagacctacttcaagagacagcgacacgagactctcctggtgctagtggtatttgccgctttattcgactgctatgtcgtcgtcatgtgcgccgtagtatttagctccgacaagctggctagcttagccgtagcgggaatcggactcgtgctagacatcatcctgttcgtgctctgcaaaaagggtctgctgcctgatagggtgacgcgccgtgttttaccctacgtgctttggctcctgattactgcccagatttttagctatctcggactgaacttcgctcgtgcccacgcagcttctgataccgtgggatggcaagtgtttttcgttttcagcttctttatcaccctgccgctgagcctgagccccatcgtaataatatcagtcgtcagctgcgtggttcatacattggtgctcggggtcacggtggcccagcagcagcaggaagaattgaaaggaatgcaactgctgagggagatactcgccaacgtatttctgtacttgtgcgctatcgccgtgggcatcatgagttattacatggccgatcgtaagcaccggaaagcctttcttgaggctcggcagtccttagaagtcaagatgaacctggaggaacagagtcagcaacaggagaatctgatgctctccatcctgcccaagcatgtagcggatgagatgctgaaggatatgaaaaaagacgagtcccaaaaagaccagcaacagtttaatactatgtatatgtaccggcacgagaatgtgagtatactgtttgctgatatcgtgggtttcactcagctcagctctgcttgcagcgcccaggagctcgtcaaactgcttaatgaactgtttgctcgatttgataagttggctgctaagtaccaccaattgcggatcaaaatcctgggggactgttactactgtatttgcggcttacctgactaccgcgaggaccacgctgtctgctcgatccttatggggctggctatggtggaagccatctcatatgtgcgcgaaaagacgaagaccggtgtggacatgcgagtgggggtccacacgggcacagtgctcggcggtgtcctgggccagaagagatggcagtacgatgtttggagcaccgatgtgactgtcgctaataagatggaggccggtggcatccctgggagggtccacatttcccaatccacaatggactgcctgaagggagaattcgacgtggagcctggtgatgggggtagtaggtgtgactacttggaggaaaaaggtattgagacatacctgatcatcgcctccaagccagaagtaaaaaagacagccactcaaaacgggctcaatggcagtgcactcccaaacggtgcgccagctagctccaaaagctccagtcctgcactcatcgaaactaaggaacccaatggctccgctcatagctctggctcaacctctgagaaaccagaggagcaggacgcccaggccgacaatccctctttccctaaccccaggcgacgactgcgcttgcaagatctcgctgaccgcgtggtagacgcatcagaagacgagcacgagcttaaccagcttctgaatgaagctctgctggagcgcgagtcggcccaggttgtaaagaagaggaatacttttttactgagtatgcggtttatggatccggagatggagacaagatattcagtagaaaaggagaagcaatccggcgctgcgtttagctgctcctgcgttgtgttgctctgcacggctctggtcgaaatacttatagacccgtggttgatgacgaactatgtcacttttatggtcggggagatcctgctgcttatccttaccatttgttctctcgccgctatttttccacgcgctttcccgaaaaaactagtggccttttcgacttggattgatcgaactcggtgggccagaaatacgtgggcgatgctggccatatttatcctggtgatggccaacgtcgtagacatgttatcatgtttgcagtactataccggtccatctaacgcaaccgcaggaatggagactgagggaagctgcctggaaaatcctaagtattacaattacgtagccgtgctgagtctgatcgccaccataatgttagtgcaggtgtcccatatggttaaactgaccttaatgctgctggtggctggcgcagtggccaccataaatctctacgcgtggcggcctgtgttcgatgagtatgaccacaaaagatttcgcgaacatgaccttcccatggtagccctggaacagatgcaggggtttaatcctggactgaatggcactgatagactacccctcgtgccttctaaatactcaatgacggtcatggtgtttctcatgatgctatccttttactacttttctagacatgtggagaaactggcgcgtaccctattcctgtggaagatcgaagtgcatgaccaaaaagagagagtctatgagatgagaagatggaacgaagcccttgtcacgaatatgttgcccgaacatgtcgccagacattttctcgggtccaaaaagcgggatgaggagctttactcgcagacctacgacgagattggggtgatgtttgcttcacttccaaatttcgcagacttttacaccgaggaatctattaacaatggcggaatcgaatgccttagatttctcaacgaaataatttccgattttgactcccttctggacaaccctaaattccgtgtgataacgaaaatcaaaacaatcggtagcacttacatggcggcatcaggagtgaccccagacgtaaacaccaatggcttcgcatcgagcaataaggaggataaatcagaaagggagaggtggcaacatctggctgacctagcagacttcgccctcgctatgaaagatacactgacaaacataaacaaccagtcctttaataatttcatgctgagaataggtatgaacaagggcggagtcctggcgggagtcatcggggcaagaaagccccactacgatatctggggaaataccgtgaatgtggccagcagaatggaatctacaggtgtgatgggcaacattcaggtggtcgaggaaacgcaagtgatcctgagagaatatggcttccgtttcgtgagaagagggccaattttcgtgaaaggaaaaggggagctactgacattctttttaaaggggagagacaaattagcgacttttcctaacggcccttcggtgactctgccccaccaggtggtggacaattcatag

SEQ ID NO: 213678 - DNA, 3360 bp, Artificial Sequence
  Description of Artificial Sequence: Synthetic coding sequence
atgccccgaaatcaggggttttccgagccagaatacagtgcggagtactcggcagagtatagtgttagcctcccccgatttatgagactgaccttcgtgcccgaaagtcttgaaaacctgtatcaaacctacttcaaacggcagcgccatgagacgctgctagtgctggtggtattcgccgctctgtttgattgctacgtggtggttatgtgtgcagtggtgttcagctccgacaagctcgcttcactggcagtggccggaattggtctcgtgctcgacataatcttgtttgtgttatgtaagaaaggcctgcttcccgaccgcgttactagaagagtccttccttatgtgctgtggctgctcataaccgctcagatattctcctacctgggacttaatttcgccagagcacatgcagcaagcgacacagtgggatggcaagtttttttcgtgttttccttttttattactctcccgttatccctgtccccaatagtgattatatcagtggtgtcctgcgttgtgcacaccctcgtgctcggcgtaaccgtggcccagcagcagcaggaggagttgaagggcatgcaactgctgagggaaattctagcaaacgtgttcctctacctttgcgccattgctgtagggatcatgtcttattatatggccgacagaaaacatcgcaaagcttttctggaagcccgtcagagcctagaggttaaaatgaatctagaggagcaatctcagcaacaggaaaacttaatgctgtccattcttcctaagcacgtcgcggacgagatgctcaaggatatgaagaaagatgagagtcagaaagatcagcagcagttcaataccatgtatatgtatcgacacgagaatgtgagtatcctgttcgcagacattgtgggattcacgcagctgagttccgcctgttcagcccaggagctggtcaaattgttgaatgaattatttgccaggttcgacaaactggcagccaaataccaccagctccgaattaaaatcctcggcgattgctattactgtatctgtggcctacctgactatagggaggatcatgcagtctgctcaattcttatgggtcttgccatggtcgaggcaatctcgtatgtacgggagaagacaaagaccggggtcgatatgcgcgtgggagtacacactggcactgtgcttgggggtgttctcggtcagaaacgctggcagtacgacgtgtggagtacagatgttacggtggcaaataaaatggaagccggtggcattccagggagagtacacattagccagagcactatggactgcctgaaaggcgagtttgacgtggagccgggagacggaggcagccggtgcgactacctggaagaaaaaggtattgagacctacctgatcatcgcaagtaagcccgaggtgaagaaaacagcaacccagaacggtttaaatggttccgcgctgccgaacggcgcaccagcctcttccaagagctcatcacccgctctgatagagactaaagagcctaacgggtctgcacattcctccgggagtacaagtgaaaagcccgaggaacaggacgcccaggccgacaatccatctttccctaatcctagaagacgactgagattacaagacctggctgatagagtagtcgacgcttctgaggacgaacacgagctgaatcagctgctaaacgaggccctgctggagcgggaatcagcgcaggtcgtcaagaagagaaacacctttctactgagtatgcggtttatggatccagagatggagacgcgttactcagtagaaaaggagaagcaatcaggtgcggctttctcctgctcatgtgtggtgctgctctgtaccgcattagtggagattcttatcgacccctggctgatgacaaactacgtgacatttatggtaggagaaatactcctactcattcttacgatttgttccctagcggcaatcttccctcgcgcatttcctaagaagttagtcgcattctctacctggatagacagaacgcgttgggcaagaaacacatgggcgatgctcgctatcttcatccttgttatggcgaacgtcgtcgacatgctgtcctgtttgcagtattacaccggccctagcaacgctacggcgggtatggagaccgaggggagctgtttggaaaacccaaaatactacaattacgtcgccgtcctttctctgattgcgactatcatgcttgttcaagtgtcccacatggttaaacttactctgatgctgctggtcgcgggtgcagtagccactatcaatctgtatgcatggaggcctgttttcgatgaatacgatcacaagagatttagggaacacgatttaccgatggtggccctggaacagatgcagggcttcaatcccggattaaatgggacagatcgtctccccctggtgccatctaaatattccatgacggttatggtgttcctcatgatgctcagcttttactactttagcagacatgttgaaaaactagccaggactctgtttctctggaagattgaagtgcatgaccagaaggaaagagtctacgaaatgagaaggtggaatgaggcgctcgtgacaaacatgctccctgagcacgtcgccaggcattttctcggtagcaagaagcgagatgaggagctgtactcgcagacctacgatgagataggagtgatgttcgcctctctgcctaacttcgccgatttttacaccgaggaatccataaacaatggtggaatcgagtgccttcgttttttaaatgagatcatcagtgatttcgattcactgctggataacccaaagttccgggtcataacaaagatcaaaacaattggttccacttatatggccgcatcaggcgtgacgcccgatgtgaataccaacggtttcgcatctagcaataaggaagataaatctgagagggagagatggcagcacttggcggacctcgcggactttgccctggcaatgaaagatacgttaactaatatcaacaaccagagttttaacaattttatgctacggattgggatgaataagggcggagtgctcgcaggcgtgattggagcacgcaaaccccactatgatatatggggaaacaccgttaacgttgccagtaggatggagtctacgggagtgatgggtaatattcaggtcgtggaagaaacacaggtcattctgcgagaatacggatttagattcgttaggcgagggccaatctttgttaaggggaaaggagagctgctcacatttttcctcaaggggagggacaagcttgctacctttcctaatggcccaagtgtcactctaccacaccaagttgtggacaatagttag

SEQ ID NO: 213679 - DNA, 339 bp, Artificial Sequence
  Description of Artificial Sequence: Synthetic coding sequence
atgcccagaaaccaagggttctccgaaccggaatacagcgccgagtactccgcggagtactcagtgagcttaccaagcgaccccgacaggggtgtgggtaggacacatgaaatctcagttcggaactctggctcttgcctgtgtttaccaaggttcatgcgactcacttttgtgccagagtctctggagaacctgtaccagacgtatttcaaaaggcaacgacatgagacgttactagtccttgtcgtgttcgccgctttgtttgattgctacgtggtcgtcatgtgtgccgtggtgttttcctctgataagctcgcctccctagctgtggctggctag

SEQ ID NO: 213680 - DNA, 3234 bp, Artificial Sequence
  Description of Artificial Sequence: Synthetic coding sequence
atggccaggttgttttcacccagacctccaccaagcgaggatcttttctacgagacatactattccctctcccagcagtacccactactcttactgttgctcgggattgtcctatgtgctcttgccgctttgctggcagttgcttgggcttctggacgagaattgacctctgatccatcgtttctcaccaccgtgctctgcgcgctgggaggtttttctttactattgggcctcgcctcgcgcgagcagagactgcagaggtggactcgaccgctctctggtctggtctgggttgccttgctcgccctggggcacgcatttttgttcactggcggtgtcgtctctgcatgggaccaagtcagttattttcttttcgtgatctttaccgcctatgccatgctgcccctcgggatgagggacgccgctgtagccggactcgcgagctccttgtcacatctgctggtgctgggactctacctcggccctcagcctgatagtcgtcctgccctcctgcctcaactagctgctaatgcggtcctatttctgtgcggcaatgtcgccggagtgtaccataaggctttgatggagcgagcccttcgcgctacctttcgagaggcgcttagttccctacactcaagacgcagactggatacggaaaaaaaacatcaagaacacctgcttttaagtatcctgccggcatatctagccagggagatgaaagctgaaatcatggctcgtcttcaggctggccagggaagtaggcctgagagtaccaacaacttccacagcctgtacgtgaagcggcaccagggcgtctccgtcctgtatgctgatatcgtagggtttactaggctggcctcggagtgttcgcctaaagaactggttctgatgctcaatgaactttttggcaaatttgaccagattgccaaggagcatgagtgcatgagaattaagatcctcggcgactgctactattgtgtgagtggacttccactatcacttccggatcacgcaattaactgcgttagaatgggtctcgacatgtgcagagcgatcagaaaactgagggccgctaccggagtagacatcaacatgcgagttggcgtgcattctggtagcgtgctgtgtggcgtaattggactacagaagtggcagtatgatgtgtggtctcatgacgttactctagccaaccacatggaggcagggggagtgcccggtcgcgtgcacatcacaggtgccacgctcgctttgctggcaggtgcatatgcagtggaggacgcagggatggagcaccgggacccttatcttagagagttgggggagccaacctaccttgttattgatcctagggccgaggaggaggatgaaaaaggcacagctggtggcctgttgagttctctggagggtctgaagatgcgaccaagcctcctgatgacccggtatctggaatcatggggagccgcaaagccattcgctcatctgtctcacggcgattcgcccgtgagcaccagtactcctctgccagagaaaacattagcatccttctctacccaatggagccttgaccgctccagaactccgcgaggcttggacgacgaattggacaccggggatgcgaagtttttccaggtcattgagcagctcaacagccagaagcagtggaagcaatctaaagacttcaatcctcttacattgtacttccgggagaaggaaatggagaaagagtaccgactgagcgcaatcccagcattcaaatactacgaggcgtgtacctttctagtgttcctttcaaactttataatccagatgcttgtcacaaaccgcccaccggctctggcaatcacctattcaatcacattcctgttgttccttctgatcctgtttgtctgcttcagcgaagatcttatgcgctgtgttctcaaaggtcccaagatgctacactggctcccggctctgtcaggcctggtagccacgcggcctggtctccgaatcgcactcggaacagcaaccattcttctggtgttcgccatggccatcacttccctgttttttttccccacatcctccgactgcccgttccaggctcccaatgtcagctctatgatctcgaatctgagttgggaactgcctggctctcttcctctgatctccgtaccgtactcgatgcactgttgtacccttgggtttctatcctgttcactcttcctccacatgtccttcgagctaaagctgttgttgctgctcctgtggttggcagctagttgcagcctattcctccacagccacgcctggctctccgaatgtctgattgtgcggttgtatctgggcccattggactccagacccggagtcctgaaggaacccaagctgatgggtgctatctcattttttatattcttttttaccctgctagttctagccagacagaacgagtactactgtcggctagatttcctgtggaagaaaaagctgcggcaggagagagaggagacagaaactatggaaaacctaactcggttactgctcgagaatgtgttacctgcccatgtagctccgcagttcatcggtcaaaatcggaggaatgaggacctgtaccaccaaagttacgaatgcgtgtgcgtactcttcgctagtgttcccgactttaaagagttttatagtgaatccaacatcaaccatgaagggctggagtgcctgcgactactcaatgaaataattgctgattttgatgaactgctgtccaaacccaaattttccggcgtggagaagattaagactattggatccacatacatggccgcaacgggattaaatgccacttcaggacaggacgcccagcaagacgccgagcggtcatgtagccacctgggcacaatggtggaatttgccgtggccctgggatccaaactagacgtgatcaataagcactcctttaacaatttccgcttaagggtcgggcttaatcacggcccagtagttgccggtgtgatcggagcccagaagcctcaatacgatatctggggtaatacagtgaatgtagcttcccggatggagagcacaggcgtgctgggcaagatccaggtgaccgaggagacagcatgggcactgcagtccctaggctacacctgctattctaggggggtgatcaaggtgaagggcaaaggacagctatgcacatacttcctgaataccgatctgaccagaactggtcccccatcagctaccctcgggtag

SEQ ID NO: 213681 - DNA, 1260 bp, Artificial Sequence
  Description of Artificial Sequence: Synthetic coding sequence
atgagccgtggcaccagagaatccgcatgctgcatgctgacttcttgggcctcacgtggttggcccgcatctgttcctctgcgttcttggtgcagctgttcgatgtcaagtcttgcctctagtacccggcttccaaggaagcttcgagccgcaactggggtcgacattaatatgagggttggggtccattctgggagcgtgctttgcggggtgatagggctgcagaaatggcaatatgatgtatggtcccacgacgtcacactggccaatcatatggaagctgggggtgtgcctggccgagtccatattactggcgcaactctggccttactggctggagcatatgccgtcgaggacgccggaatggaacatcgcgatccttacctgagagagttaggtgagccaacctacctggtgatcgatccacgggcagaggaggaggatgagaagggtactgcgggtggccttttatcttctcttgagggtttaaaaatgaggccttctcttctgatgacccggtaccttgaatcatggggagccgcaaagccatttgcacaccttagccatggcgactcaccagtatcaacttctactcctctccccgaaaaaaccctagctagtttctctacgcagtggagcctcgatcggtcccgcacccctagaggtctcgacgacgagttggataccggcgatgcgaagttcttccaggttatcgagcaactgaactctcagaagcaatggaaacagagtaaagactttaacccactgaccctgtacttccgagaaaaggaaatggagaaggagtacaggctgtccgctattcctgcattcaagtattacgaggcttgtacattcctggtctttctgagcaactttatcattcagatgctggtgactaaccggcctcctgcattggccataacgtattcaatcacattccttctgtttttacttattttattcgtttgcttttccgaggacttaatgaggtgcgtcttaaaggggccaaaaatgcttcactggctacccgcactgtctggactcgtggccacacgacctggacttcggatagccttggggacggctactatcctccttgtctttgctatggcgatcacctcactgtttttctttccgacttcctctgattgcccattccaggctcctaacgtgtcatctatgatcagcaacttgtcttgggagctgccaggaagtcttccactaatttctgtccccgtgtccgtcccgacatgcccatag

SEQ ID NO: 213682 - DNA, 3234 bp, Artificial Sequence
  Description of Artificial Sequence: Synthetic coding sequence
atggccagactcttttctcccagaccacccccatcagaagaccttttttatgaaacatactatagtctgtcccagcagtaccctctcctgctgttgctgctcggaatcgttttatgcgcgttggccgcactcttagcagtggcttgggcttccgggagagaactcacctcagatccttcttttttgaccactgtgctgtgcgccctgggaggtttttctctgctgttaggactcgctagccgagagcagcggctgcagcgatggacaagaccactgtcgggcctggtgtgggtggccctgttggccctgggtcatgccttcctctttacagggggagtggtctccgcgtgggaccaagtctcctactttctatttgtcatcttcaccgcttatgccatgctaccactcggcatgcgcgatgccgcagtagccggattagcatcaagcctctcccatttgctcgttttgggcctgtatctggggcctcagcctgactctaggccggctttgctgccacagctcgctgcaaacgctgtgttgttcctgtgcggcaacgtagccggagtttatcacaaagctctcatggaacgggcattgagggcgacatttcgggaagccttatcttcgctgcactcacgacggaggctcgacacagaaaagaaacaccaagagcacctactgctcagtatcctgccagcatatttggccagagaaatgaaggctgagattatggcccgtctgcaggccggacagggctctagacccgagtctacaaacaattttcattcattatatgtcaagcggcaccagggagtcagcgttctgtacgccgacattgtggggtttacccggcttgctagcgaatgtagtcccaaggagctggtgttaatgctaaacgagttgttcgggaagttcgaccagatagccaaggaacatgagtgtatgcgcataaaaatcttaggcgactgctactattgcgtgagcggcctccccttatctttgccggaccacgctataaattgcgtcaggatgggcctcgatatgtgcagggccatccgaaaattaagggccgctactggtgttgacatcaacatgagggtgggggtgcacagcggctcggtgttgtgcggcgtaatcggcttacaaaaatggcagtacgatgtttggtcccacgacgtgacgctcgccaatcacatggaggccggaggagtcccaggtagggtccacatcaccggtgcaactctagccttgctcgccggagcatatgcggttgaagatgcaggcatggaacaccgggacccctacttacgcgagctcggagagccgacatacctggtgattgacccgcgtgccgaggaggaggacgaaaaggggaccgcaggtggtctgctttcaagtcttgagggactcaagatgcgccctagtctcctgatgaccagatacttggagagctggggtgcggctaagcccttcgctcacctgagccatggcgactccccagtgagcacgtctaccccgcttccagagaagaccctcgctagtttcagcacccagtggagcctagatcgctctcgcaccccaagagggttggacgacgagctagatactggcgatgcaaaattttttcaggttattgaacagctcaattcccaaaagcagtggaaacagagtaaggactttaatcccctgacgttatattttagggagaaggaaatggagaaggagtaccgactttcagccatacctgcattcaaatattacgaggcatgcacattcctagtgttcctgtctaatttcattatccagatgctggtgaccaacaggccccctgccttagccatcacatattcgatcacttttttgctgttccttctgatattattcgtctgcttctctgaggacctgatgcgctgtgtcctgaaaggacctaagatgctgcattggctgccagctttgagtggcttagtggccacgcgacccggtctgcgaatcgcgctggggacagctacaattcttctcgtgtttgccatggccattacttcactttttttttttccgacgtcctctgactgtccctttcaggcccctaatgtatcatctatgatttccaaccttagctgggaactcccaggatcactgccactaatttccgtgccgtactccatgcattgttgtaccctcggcttcctttcctgtagtctctttctgcacatgagttttgaactgaaactgttgttgttactcctttggctggccgctagttgcagtttgttcctccacagccatgcatggctgtctgaatgcctgatagtgcgactgtacttagggccactggatagcaggccaggagtgctgaaggagccaaaactcatgggagctataagcttttttattttcttctttaccctattagtactggcaagacagaacgaatactattgccggctggatttcctttggaagaaaaagctgaggcaagaacgggaggagacggaaaccatggagaacttgactcgactcctcctcgagaacgtcctgcctgcgcacgtggcaccacaattcatcggccagaacagacgcaatgaggatctctatcatcaatcatacgagtgtgtgtgcgtgctgttcgccagcgtgcctgattttaaagagttttactccgagtcaaacatcaatcatgagggcctcgaatgtcttcggctccttaatgaaattatcgcggactttgacgagctgttgtcaaagcccaagtttagcggcgttgagaagattaaaactatcggaagtacatacatggcagcaaccgggcttaacgcaacatccggccaggatgcacagcaggatgccgaaagatcctgcagccatctcggaaccatggttgagtttgctgtagcactgggcagtaagctggatgtgatcaacaaacacagttttaacaactttcgccttcgagtcggcttaaaccatggacccgtggtggctggtgtgatcggggctcaaaagcctcaatatgatatctgggggaacaccgtcaatgtggcaagtcgcatggaatctacaggtgtgctggggaaaatccaggttactgaggaaacagcctgggccttgcagtccctaggctatacatgctacagcagaggggtaatcaaagtcaagggcaaaggacagttatgcacgtactttctcaacaccgatttgacccgcacaggcccacccagtgctacactgggatag

SEQ ID NO: 213683 - DNA, 3234 bp, Artificial Sequence
  Description of Artificial Sequence: Synthetic coding sequence
atggccaggctgttcagtcctcgcccacccccatccgaagatctcttttacgagacatattattccctcagccaacaataccctctgttactgctgctccttggcatcgttctctgcgccttagctgctctgttggcagtggcttgggcctcggggagagagctgactagcgatccatctttcctgaccactgttctctgcgcattaggagggtttagcctactgttaggcctggcttcccgggagcagcgcctgcaaagatggacccgccctctatcagggttggtatgggttgccctcctggccctggggcacgctttcctgttcactggaggcgttgtgagtgcctgggaccaggtcagctactttttgttcgtgattttcacagcatacgccatgttgccgcttgggatgagggatgcagctgtagctggattagcttcctccctgtctcacctccttgtgctgggactgtacctcggtccgcagcccgattctcggccagcattgctgccacagctagcggcaaacgcagtcctattcctgtgcggcaatgtggcgggagtctatcataaagccttaatggagcgggctctgcgcgcaaccttccgcgaggcgctgagtagtctccatagtcgaaggcgacttgacactgaaaaaaagcaccaggagcatctcctgctctctatcttgccagcctacctcgccagagagatgaaggcagagattatggcgaggttacaagcaggacaaggctcacgacccgaatccaccaataacttccattccctgtatgttaaaaggcaccagggggtttctgtgctgtacgcggacatcgtcggctttactcggctcgcttccgaatgcagccccaaggaactcgttctcatgctaaatgagctgttcgggaaattcgaccaaatcgccaaggaacatgagtgtatgcgtatcaaaattcttggtgattgttactactgcgtgagcggtctgccactctcactcccagatcatgccattaattgtgtgcgtatgggactcgatatgtgtcgcgctatccgcaagctgcgggctgcaacaggcgtcgacattaacatgagggtgggagtccatagcgggtccgtgctctgtggcgtcattggcctacaaaaatggcaatatgacgtttggtcgcatgacgtcactctagctaaccatatggaggccggaggagtgccaggtagagtgcatatcacaggggcaaccctggccctcttggcaggagcttatgccgtggaagacgcaggcatggaacacagggacccatatttgcgcgagttgggagaacccacctacttggtaatcgacccaagggctgaggaggaagatgaaaaaggcactgcgggaggcctgctaagctctctggaaggcttgaagatgagaccatccctgctgatgacaaggtacctggaaagctggggtgctgccaaaccttttgcccacctgtcccacggcgatagtcccgttagtaccagcactccccttcctgagaagacgctggccagcttttccacccagtggagtctggatagatcacggactcctcgtggtctcgacgacgagctggacaccggagacgctaaattcttccaggttatcgagcagctgaacagccagaaacagtggaaacaaagcaaggactttaatcccctgaccctttactttcgagagaaagaaatggagaaagaatacaggctctctgctattccagcctttaaatactacgaagcctgcaccttcctggtattcctcagtaattttatcatccaaatgctcgtcactaaccgcccaccagcattagcaattacatattcgattacctttctgctgttcttgctgatattgtttgtctgcttttcagaggatctgatgcgatgcgtcctcaaaggccctaagatgctgcattggttacctgccctgtccgggctcgtcgcaactcgtcccggactccgcatcgcactcgggaccgcaacaattctgctggtgttcgcgatggccataacctccctcttcttctttcccaccagctccgactgtccattccaggctcctaatgtaagttcaatgatctctaatctgagttgggagctacccggttccttgcctctcatcagtgtgccctactccatgcattgctgcactctcggttttctcagctgttcgctatttctgcatatgtctttcgaactcaagctgctactgcttctgctgtggttggctgcatcttgttccttattcttgcactcgcacgcttggctctcagaatgcctgattgtacgtttatatttaggccctctagacagccgaccaggagtgttgaaggagcctaaattaatgggagccattagctttttcatattcttttttaccctcctggtcctggctagacagaacgagtattactgtagactcgattttctgtggaaaaaaaaacttcgccaggagagggaagaaaccgagacaatggagaacctcacgcgcctgttgctggagaatgtcctccccgcacatgtggctccacagtttatcggacaaaaccgcaggaacgaggacctatatcaccaaagttatgagtgtgtatgtgtgctcttcgcttcagtaccagactttaaagaattctatagcgaatccaacattaaccatgaaggactggagtgtctgagattgctgaacgaaattattgcagatttcgacgagctactgtcgaagcctaagttctctggggtagagaaaattaaaaccattggttctacatatatggcagcaacagggctcaacgcaacttcaggccaggacgcccagcaggacgccgagcggagttgcagccatctgggaaccatggtagagtttgccgtggccctgggttcaaaactggacgtaattaataaacatagcttcaacaactttcgactgcgagttggacttaaccacgggccagtcgtcgcaggggtgatcggcgcacaaaagccacaatatgacatttggggcaacacggtgaacgtggccagtcggatggagtctactggagttttaggaaaaattcaggtaaccgaggaaacagcctgggctctccaatctttggggtacacctgctattcacggggagtgatcaaggtcaaaggcaagggccagctgtgcacatactttttgaatactgacctgacgcggactgggcctcctagtgcaacactcggctag

SEQ ID NO: 213684 - DNA, 348 bp, Artificial Sequence
  Description of Artificial Sequence: Synthetic coding sequence
atggcgcgactgttttcacccaggccgccaccgtctgaggatctgttttacgagacctattactcgctttcgcaacagtaccctctcctgctgctcctcctaggtatcgtgctgtgtgcactggcggcactccttgccgtcgcttgggcgagcggcagagagttaacttctgaccccagctttctgactactgtcctctgtgccctgggcggattcagtctacttctcggtctggcctcacgcgagcagcgactccagaggtggacccggccactgagcggtctcgtctgggtggcactgctggccctcggtcacgctttcctcttcacgggtggggtggtgtcctag

SEQ ID NO: 213685 - DNA, 2736 bp, Artificial Sequence
  Description of Artificial Sequence: Synthetic coding sequence
atgaagagccagaaagagggctgttgtagtagaggagatctcagcatccaaaccggccctggcggagagtgggctcccaggcgtctcgtgtctaatgtcctgatcttttcctgcaccaatatcgtcggcgtctgcactcactatccagctgaagtgtcacagagacaggccttccaggaaaccagggaatgcattcaggctaggctccacagccaaagagagaatcagcagcaggagcgcctgctgttgagcgtcctgcccaggcatgtggctatggagatgaaagcagatatcaacgctaagcaagaagatatgatgtttcataagatttacattcaaaagcatgataacgttagtatcctatttgctgatatcgaggggttcacaagcctagccagtcagtgtaccgctcaggagctggttatgaccctaaatgagctgtttgcgcgtttcgataagctggctgcagaaaaccactgtctccgtatcaagatcctgggcgattgctattactgcgtgtctgggcttccggaagctagggccgaccatgcccactgttgcgtggagatgggaatggacatgatcgaagctatctctttggttagggaggttaccggcgtaaatgtcaacatgagagtggggatacacagcggccgagtacactgcggcgtactgggcttgcgcaaatggcagttcgacgtatggtctaacgacgtgaccctcgcgaatcatatggaggccggaggaaaggccggtcggattcacatcactaaggcgaccttgaattatctgaacggcgactacgaggtggagcctggttgtgggggagaacgcaacgcctatctgaaggagcactcaattgagacgttcctcatcttaaggtgtacacagaaaaggaaagaggagaaggcaatgattgccaaaatgaatcgccagaggactaacagtatcggtcacaatcctcctcattggggcgctgagcggcctttctataaccaccttggcggaaatcaggtctccaaggaaatgaaaaggatgggtttcgaagatcctaaggataagaacgcccaggagtcagccaaccccgaagatgaggtggacgagttcttaggcagggccatcgatgcccgaagtattgatcgccttcgctctgaacacgtgagaaaatttctgcttacatttcgggagccagacctggaaaagaaatactctaagcaggtggatgacagatttggtgcttatgtagcttgtgcctcgctcgtgtttctgttcatctgtttcgtgcagattaccatcgttccacactcaatttttatgttgagtttttatctgacctgctcccttctgctgaccctggtagtatttgtctcggtgatttatagttgcgtgaaactctttccgtcccctctacagacccttagtcggaaaattgttcgctccaagatgaatagtaccttggtcggagtgttcacgatcacactggtattcttggcggctttcgttaatatgttcacttgtaacagtcgcgatctgttgggatgtttggcccaggaacataatatatccgcctctcaggtcaatgcctgccacgtggctgaaagcgccgttaattacagtctgggggacgaacaaggcttttgtggatcaccatggcccaactgcaatttccctgagtatttcacttacagcgtcctgttgagtctcttagcgtgttccgtgtttctgcaaatctcctgcatcggtaaactggtcttaatgctggccattgagctcatttatgtgctgatagtcgaagtccctggcgtaaccctcttcgacaatgcagaccttttggtaacggccaacgctattgatttctttaacaatggaacatcgcagtgccctgagcacgcaacaaaggtagcccttaaagtggtgactcctattattatctcagttttcgtcctagccctttacctacacgcacagcaggttgagtccaccgctagactggacttcttgtggaagctgcaagccaccgaggagaaggaagaaatggaggagctacaagcttacaatcgcaggctgctccataacattcttccaaaggacgtcgccgcacatttcctggccagagaacgacgtaacgacgagctttactatcagtcctgtgagtgcgtagctgtcatgtttgcatccatcgccaatttctcagaattttatgtagagctggaagctaacaacgaaggcgtcgagtgccttaggctactgaacgagatcatcgccgatttcgacgaaattatcagtgaggaccgctttcgccaactcgagaagatcaagaccataggatccacttatatggccgcttcaggtttgaacgatagtacctacgacaaggtgggcaagacgcacataaaggctctcgcggattttgccatgaagctgatggaccagatgaaatacatcaatgagcacagttttaataatttccagatgaaaatcggcctgaacattggtcccgtcgtggcgggagtaataggtgctcggaagcctcagtatgatatatggggaaacacggtaaatgttgcctctcgtatggattctaccggggtgccagataggatccaggtgacaaccgacatgtatcaggttttggccgctaacacttatcagttagaatgcagaggagtggtgaaggtgaagggcaagggagaaatgatgacgtactttctgaacggaggacctcctctgtcatag

SEQ ID NO: 213686 - DNA, 3786 bp, Artificial Sequence
  Description of Artificial Sequence: Synthetic coding sequence
atgagcggtagcaagtccgtgtccccaccagggtacgcggctcagaagacagcagctcctgctcctagaggcggtcctgagcaccgcagcgcttggggggaggctgactcacgcgcaaatggatacccccatgcccctgggggaagcgcgcgtgggtcaactaagaagccagggggagcggtgactccacagcagcaacagcggcttgcaagtcggtggagatctgacgacgacgatgacccaccattgtcgggcgacgacccgttggccggaggatttggtttttccttccggagcaagagcgcgtggcaggaacggggtggggatgactgcggtagaggctctagacgacagagacggggtgcggcatctgggggaagcacacgagctccacccgctgggggagggggaggtagtgcagcagcggcagcttccgccggtggcacagaagtgagacccaggagtgttgaagtgggcctcgaagaacggagaggaaaggggagggcagctgatgagcttgaagcgggagctgtggagggcggagagggatccggagatggcggtagtagcgctgattcagggagcggcgctggcccaggtgcagtgctctctctgggcgcatgctgcctggctctgttgcagatcttcaggagcaaaaaattcccaagcgacaagctggagaggctgtaccagaggtacttcttcagactcaatcaatcatcactaaccatgctgatggcagtgttggtactcgtttgcctagtcatgctggcgtttcacgccgcaaggccgcctttacagttgccttacctcgctgtcttggcagcagccgtcggagtcatactcatcatggctgttctgtgcaatcgtgctgccttccatcaggatcacatgggccttgcttgttacgcactgatcgcagtggtcttagccgtgcaagtagttggcctgcttttaccacagcctcgctccgcctccgagggcatctggtggaccgttttcttcatatatacaatctatacactgctccccgtgagaatgcgggctgcggttttgagcggagtcctgctatcagctctccacttagctatcgctctacggactaatgctcaggatcagtttttactgaaacagctggtcagcaacgtgctgatattttcctgcacaaatattgtcggtgtctgtacccactacccagcagaagtcagtcaacgccaggcttttcaggagacaagggagtgtattcaggcacggctgcacagccaacgggagaaccagcagcaggaacgccttctccttagtgttcttccaagacacgttgccatggagatgaaagccgacattaacgccaagcaggaagacatgatgttccataaaatttacattcagaagcacgacaatgtctctatcctattcgcggacattgaaggttttactagcctggccagccagtgcactgcccaggaactggttatgactctcaacgagctgtttgcaaggttcgacaaactcgccgctgagaaccactgtctgcggattaaaatactaggagactgttactattgtgtgtccggactccctgaggcgcgagctgatcacgcacattgctgtgttgagatgggcatggatatgatcgaggccataagcctcgtgagagaagtcaccggggttaacgtgaatatgcgagtgggaatccatagcgggagagttcactgcggagttcttgggcttcggaaatggcagttcgacgtgtggtctaatgacgtgacactggcgaaccacatggaagcgggtggaaaggccggacggattcatattacaaaagcgaccctgaactacctgaatggagattacgaggtcgaaccgggatgcggaggggaaaggaatgcatatctcaaagagcattccatcgagacattcctcattctgcgctgtacccaaaaacggaaggaggagaaagccatgatcgcaaaaatgaaccgacaaaggaccaactccataggccacaaccctcctcattggggtgccgaaaggccattttacaaccatcttggcggtaatcaggtgtccaaagagatgaaaagaatgggatttgaggacccaaaagataaaaacgctcaggagtctgctaatcccgaggatgaggtcgacgagttcctgggacgagccattgatgctcgttccatcgaccgccttagatctgagcacgtgagaaaattcctgctcacctttagagaacctgatctcgagaagaagtattcaaaacaggtggacgaccgcttcggcgcttatgttgcctgtgcctccctggtattcttgttcatttgctttgtacagatcacgatcgtacctcattctatattcatgctgagcttttatctgacttgcagtcttctgctgaccttagtggtctttgttagcgtgatttacagctgtgtcaaactcttcccttcgccgctccaaacgctgagtaggaagatcgttcgatctaagatgaatagcactctggtgggagtgtttaccatcacactggtgttccttgcagcatttgttaatatgttcacctgtaacagccgtgatctactgggttgtctggcacaggaacacaatatcagtgccagtcaggtgaacgcctgccatgttgctgagtctgcagttaattactcgttaggagacgaacaggggttctgtggctccccttggcctaattgtaactttcctgagtattttacatactcggtgctgcttagcctgttggcttgtagcgtgtttctgcaaattagttgcataggcaagcttgttctgatgcttgccattgagctgatctacgtcttgattgtggaggtacccggtgttactctgtttgacaacgccgatctgctggttaccgcaaacgctatagactttttcaacaatggcacctcccagtgtcccgaacatgctactaaggtagcactgaaggtggtcaccccaattattatctccgtgttcgttttagccctctacctgcatgcccagcaggtggagagtactgcccgactagattttttgtggaagctacaggctaccgaagagaaggaggagatggaggagttacaggcatacaaccgcaggctgcttcacaacatcctccctaaggatgtggccgctcattttctcgcaagagagcgccgaaatgatgagctctactatcagagctgtgagtgcgtggcagtgatgttcgcctccatcgccaacttcagcgaattctacgttgaactggaagcaaataatgagggggtggaatgccttagattgcttaacgaaatcattgccgacttcgacgagatcatatctgaggaccgcttcagacagctggagaagattaagacaataggcagtacctatatggctgcctcaggtttgaatgacagtacgtacgataaagtgggcaaaactcacataaaggcactcgccgattttgctatgaaactaatggaccagatgaagtacatcaatgaacacagctttaacaactttcaaatgaaaattggcctgaatatcggccctgtggtggcaggagtgataggcgctaggaaaccacagtacgacatttgggggaatactgtgaacgtcgcatcaagaatggactccactggtgtgcccgatcgcatccaggttaccacagacatgtaccaggtgctcgcagccaacacctaccagttggagtgtaggggagtcgtaaaggtaaagggtaagggggaaatgatgacttattttctcaatgggggtccacctttgtcttag

SEQ ID NO: 213687 - DNA, 2760 bp, Artificial Sequence
  Description of Artificial Sequence: Synthetic coding sequence
atggctcccagtcgcttcaggacacagctggagctcgtgagcaacgtgctgatatttagctgcacaaatatcgtgggcgtttgtactcactatccagcggaggtgagccagagacaggcttttcaggagacgcgggaatgtatccaggcgcgactgcattctcagagagagaatcaacagcaggaacgtctcctgctctccgttctgcctagacacgttgcgatggagatgaaggccgacatcaacgctaagcaagaagacatgatgtttcacaaaatttacattcagaaacatgataacgttagtattttattcgcagatattgaaggatttacctctctcgccagccaatgtaccgctcaggaactcgtcatgactttgaacgagctatttgccagatttgataaattagctgctgaaaaccactgtctgaggattaaaattcttggcgattgctattactgcgtctctggcctcccagaggctcgcgcagaccatgctcattgttgtgtggaaatgggtatggatatgatcgaggctatctctctcgtacgcgaagttaccggagtgaatgtaaacatgcgggtcgggatccatagcggccgagttcactgcggtgtcctggggctgaggaagtggcagtttgatgtttggtcaaatgatgtgactctggccaaccacatggaggcaggcggaaaagcgggacgcatacatatcaccaaggcaaccctgaattacctaaacggggattacgaagtcgaacccggatgcggcggagaacggaacgcgtatctcaaggagcattctattgaaacattcctgatactgagatgtacccaaaagcgcaaagaggaaaaagctatgatagccaagatgaaccgacagagaaccaacagcatcggccataacccaccacactggggcgcagagcggcctttctacaaccatctcgggggtaaccaggtgtctaaagaaatgaaacgcatgggatttgaggaccccaaagataaaaacgcgcaggaatcagcaaatccggaggatgaagtagatgagttcctaggaagggctattgatgcccgaagcattgatcgactccgatccgaacatgtgaggaagttcctattgactttccgtgagccggacctggaaaagaagtactcgaaacaggtcgatgatcgattcggtgcatacgttgcatgtgcttctttggtgttcttatttatctgtttcgttcagattaccatcgtcccacattccatcttcatgctgagtttctacttaacctgttccctgcttttgacactggtggtcttcgtgtccgttatctattcttgcgtgaagttgttcccttctcctctgcagaccctgtccagaaaaattgtgcgctctaaaatgaattccacactggtcggggtattcacgattacactggtctttctagcggcttttgtgaacatgttcacatgcaacagccgggatctgctgggatgcctcgctcaggaacacaatataagcgccagccaggtgaacgcctgccacgtcgccgaatcagccgtcaactatagtctcggggacgagcagggcttctgcggatccccatggccgaactgcaattttcccgagtattttacctacagcgttttgctgtccctgttagcatgtagtgtatttttgcagatcagctgtattggaaagctggtcttgatgctcgccattgagttaatttacgtgcttatcgtggaggttcctggggtgacattatttgacaacgccgatttgctcgtgacagctaatgctattgacttcttcaataacggtacatctcagtggtctttatgtgagaacctgagacatcggagaatggaggctggaacctacttccccagcggcgtcaaagagcagagtcccgagcacgcaactaaagtcgccctgaaggtggtgactcctattatcatcagtgtgttcgtactggctctgtatctacacgcacaacaagtggagtctacggcaagacttgactttttatggaagttgcaggctaccgaggagaaagaagagatggaagagttacaagcctataatagacggcttctccacaatatcctgcccaaagacgtggcagcccatttcttggcccgagaaagaagaaacgacgaactgtactaccaatcttgtgaatgcgtggccgttatgtttgcatcaattgcaaattttagcgagttttacgtcgaactagaggcaaataatgagggggttgaatgcctacgactcttaaatgagatcatcgccgactttgacgagatcatctccgaagaccgctttaggcagctcgaaaaaattaaaactataggttctacatatatggctgccagcggtttgaatgatagtacgtatgacaaggtgggaaaaacccacataaaagcacttgcagacttcgccatgaaactaatggaccagatgaagtacattaatgaacactcttttaataatttccagatgaagatcgggctgaacattgggccagttgtggcaggggttatcggtgcaaggaagcctcagtatgatatttggggtaacactgtgaacgtggcaagtagaatggactcaactggggtcccggacaggattcaggtaaccacagatatgtaccaggtcctggcagccaacacttaccagttggagtgtcgtggcgtggtgaaagtaaagggcaaaggtgaaatgatgacttattttctgaacggtggaccgcctttgagttag

SEQ ID NO: 213688 - DNA, 3507 bp, Artificial Sequence
  Description of Artificial Sequence: Synthetic coding sequence
atgagctggttcagcggtttgcttgtgcctaaggtcgacgaacggaagacagcgtggggggaacggaatgggcagaaaaggagccgccgtaggggaactcgggctggtggcttttgtaccccacggtatatgtcatgtttgcgtgacgcagagcccccaagccccacgccggctgggcctccgagatgtccctggcaagatgatgcctttatacgaaggggaggtcctggaaagggaaaagaactgggcctgagagccgtggctttggggtttgaggatactgaagtgacaacgacagccggaggcactgccgaggtagcgccagacgcagtccctaggtcagggcgatcgtgctggagacggctggtacaggttttccagtctaaacagttcagaagtgcgaagctggaacgtctttaccagcgctatttctttcaaatgaaccaatcttcccttacccttcttatggccgtccttgtactgctgactgctgtgctgctggctttccatgcagcccctgcgagaccccagcccgcttacgtagcactactagcctgcgctgccgctctcttcgttggcctcatggtcgtgtgcaatagacacagctttagacaagactccatgtgggtggtaagttatgttgtactggggattctggccgcagtacaggtggggggtgccttggccgctgatccaaggagcccctccgctggcttatggtgccctgtgttttttgtatatatcgcctataccctacttcccatcaggatgagagcagcggtactcagtggcctaggtctctctactctgcacctcatcctggcgtggcaactgaatcgcggagatgcattcctgtggaagcaactaggcgctaatgtgctcctcttcctctgcaccaacgttatcggcatctgcacccactaccctgccgaggtgtcccagagacaagcatttcaggagaccaggggctacatccaggcccgactgcacctgcaacatgagaacagacagcaggagaggcttctgctttctgttttgccccagcatgtcgccatggagatgaaggaggatatcaacacaaagaaggaggacatgatgttccataagatttacattcagaagcacgataacgtttcaatcttgtttgcagatatagaaggtttcacctcactcgcgtctcagtgtactgcgcaggaacttgttatgacactgaatgagctatttgcccgattcgacaagctggcagcagaaaaccattgcttgcgtatcaagatcctaggggattgttattactgcgtgtccgggctgccggaggccagagccgatcacgctcactgctgcgtagagatgggtgtagatatgatcgaggccatttcgctcgtccgcgaggttaccggggtgaatgtgaacatgcgcgtgggcatccattctggtagggtccactgtggcgtcctgggactcaggaaatggcaattcgatgtgtggtcgaacgacgttacgctggccaaccatatggaggccggaggtagggccggacggatacacataacaagagccaccctccaatatctgaacggagactacgaggtcgagcccggtcgtggcggagagagaaatgcatacttgaaggaacagcacatcgagactttcttgattcttggcgctagtcaaaagcgtaaggaggagaaggctatgctggccaagttgcaacggacacgcgctaattcaatggagggcctgatgcccagatgggtgcccgatagagcgttttcaagaactaaggactcaaaagcattcaggcagatgggaatagacgacagtagtaaggataacagggggacccaagacgcactgaatccggaggacgaggttgacgagtttctttccagagccatagacgcgcgatcaatcgaccagctgcggaaagaccacgttcggcgatttctgcttacgtttcagcgcgaagatctggagaaaaagtactctagaaaggtggatcctagattcggagcatatgtagcatgtgctctcctcgtcttttgtttcatctgctttatccagttgctgatcttcccccacagcactttgatgcttgggatctacgcgtctattttcctcctgctgctcatcactgtcctgatttgtgcagtctacagctgtggcagcctatttcccaaagccttgcagagactatctaggagcatagttcggtctagagcacactccactgccgttggaatttttagcgtacttttagtgtttacttccgcaattgcaaacatgtttacatgtaaccacacgccaattcggtcatgcgcagccagaatgttaaatcttaccccagcagatattacagcgtgccacctgcagcagctgaactatagcttgggactcgatgctccactctgtgagggaacaatgccaacctgttctttccccgaatactttatcgggaatatgcttctgtcattactcgcatcgtccgtttttctgcacattagctctataggcaagcttgctatgatctttgtactgggcctaatctatctggttctcctcttgctgggccctcctgctactatcttcgataattatgacttgcttttgggcgtccacggtctcgctagcagcaatgaaaccttcgatgggctggattgccctgctgccggacgggttgccctgaagtatatgaccccagtcatcttattggtgttcgctctagccctttacctgcatgcacagcaggtcgaatctaccgcaaggttggatttcctctggaagttgcaagcaactggagagaaggaggagatggaagagctacaggcatataataggagattactacataacatcctcccgaaggatgtggccgcacacttcttagcaagggagcggagaaacgatgaactgtactaccagagctgcgagtgtgtggccgtgatgttcgcatctatcgctaatttctcagaattttacgttgaactcgaagccaataatgagggggtcgagtgcttacggttactgaatgagattatagctgacttcgatgagatcataagcgaggagaggttccgccagctcgagaagattaaaacaattggctcaacttacatggccgcttccggattgaacgcttccacatatgaccaagtggggcgatctcacataacagccttggccgactatgcaatgcggttgatggaacagatgaagcatattaacgaacattctttcaacaatttccagatgaagattggcctaaacatgggacctgtcgtcgccggagtaataggggcaagaaagccgcagtacgacatatggggaaacacagtcaacgtgagtagcagaatggattccaccggggtgcccgatcgaatacaggtgacaaccgatttataccaagtccttgccgctaagggataccaactcgagtgcagaggggtcgtaaaggtgaagggaaagggggagatgaccacatacttcctcaatggcggtccgtcttcctag

SEQ ID NO: 213689 - DNA, 3348 bp, Artificial Sequence
  Description of Artificial Sequence: Synthetic coding sequence
atgtcctggttctctggcctgcttgttccaaaagtcgatgagagaaagaccgcatggggagaaaggaatggccagaaaaggtcacgccgaaggggtactagggctggaggattctgtaccccgagatacatgtcttgtttaagagatgccgagccgccttctccaacacctgccggaccccctcgatgcccatggcaggatgatgctttcattcggagggggggacctggaaaaggaaaggagctcggcctaagagccgttgcgctggggtttgaggatactgaagtgacaacgaccgccggaggtaccgcagaagtggcacccgatgcggtgccccgatccggacgctcatgctggagacgcctcgtgcaggttttccaaagtaagcagtttagatctgctaagttggaaaggctgtatcaaagatattttttccagatgaaccagagtagcctgaccctgcttatggccgtgctggtgctgctgactgccgttttgctggctttccacgctgctcccgcaagaccccagcctgcttatgtagctcttctagcctgtgcagcagccctcttcgtgggattgatggtggtatgtaatcggcacagtttccgccaggattccatgtgggtggtgtcttacgtggttctgggaatcttggccgctgtgcaggtcggcggtgctctggccgcagatccacgtagcccctcggcaggcctgtggtgtcctgtgttcttcgtgtacatcgcctacacattgctacccatcaggatgagggcagctgtgctgtctggcctgggcctctctaccctgcatctcattctggcctggcagctgaataggggcgacgcttttctttggaagcagttaggagccaatgtgctcttgtttctatgtacaaatgtcatcggcatctgcacgcactacccagccgaagtgagtcaacggcaggcttttcaggagacccgaggctatatccaggcccgtttgcacctccagcatgagaaccggcaacaagaacgcctcctgctgtcggttctgccacaacacgttgccatggagatgaaggaagacattaacacaaagaaagaagacatgatgttccataagatctatattcagaaacacgataatgtgtccatcttatttgcggacatagagggatttaccagtctggcttctcagtgtaccgcacaagagctcgtgatgacactgaacgaactcttcgcacgatttgataaactggcagctgagaatcactgcctccgaattaagattctaggggactgttactactgtgtctccggcctgccagaggcgagagctgaccacgcccactgttgcgtggaaatgggagtggacatgatcgaggcaattagtcttgtgcgtgaggtcactggagtgaatgttaacatgcgcgtgggcatccactccggcagagttcattgtggcgtcctgggcctcagaaagtggcagttcgatgtttggtccaacgacgtgaccctggccaatcacatggaggccggaggccgagctggcaggatccacataacacgagctactcttcaatacttgaacggcgactatgaggtcgaaccaggacgcggaggcgaacgaaatgcctacctgaaagaacaacatatcgagacatttttgattttaggtgcttcccagaaacgcaaagaagaaaaggcgatgctggccaagctccagcggacacgggcaaactctatggaaggtcttatgccacggtgggtcccagaccgcgctttctcccgcacgaaagacagcaaagcttttcgtcagatgggcattgacgattcgtctaaggataacagaggcacccaggatgccttgaaccctgaggacgaagttgatgaattcttgtcgcgcgctatagatgccaggagcatcgatcaactgagaaaggaccacgtgcgcaggtttctcctgacatttcagagagaagacctggagaaaaagtatagccggaaagtagatccgcgattcggcgcttatgtcgcatgcgcactgctcgttttttgtttcatctgctttatacagctcctgatatttcctcatagcacccttatgttaggcatctatgccagcattttcctgttactgttgataactgtgctgatctgcgcagtctacagttgtgggagcctttttcccaaagccctccagcggctctcaaggagtatagtgcggagcagagctcactctactgcagtcggaatctttagcgtactgctcgtgtttacttctgccatcgcaaacatgtactttatcggaaatatgctcctcagtctgctggccagttcagtattcctgcacatatcctcgattggaaagctagctatgatttttgttctggggctgatatatttggtgcttctgctgttgggacctcccgctactatcttcgacaactatgacctgctcctaggcgtgcacggcctcgcttcaagtaacgagaccttcgatggcctcgactgcccagcagcaggaagggtagctttgaagtacatgacaccagtgatcttattggtgttcgctttggctctctacctccacgcgcagcaggtggagtctactgcccgattagacttcctgtggaagctgcaagccacaggcgaaaaggaagagatggaggagttgcaggcgtacaaccggagactgctgcacaacattctcccaaaggatgtggctgcgcacttcctggccagagagcgtagaaacgatgagctctactatcagtcctgtgaatgtgtggccgtaatgttcgcctcaatagctaatttctcagaattctatgttgagctcgaggcaaataatgagggcgtcgaatgcctgaggctgcttaatgagatcatcgccgattttgacgagatcatctccgaagaaaggttccggcaactggagaagataaaaactattggttctacatacatggctgcatctggcttgaacgcgagtacctacgaccaggtggggcgttcacacatcaccgctctggctgactacgcgatgaggctcatggaacagatgaaacatattaatgagcatagtttcaacaacttccagatgaaaattgggctcaacatgggacctgtggtagccggagttataggtgctagaaaaccccagtacgatatttgggggaacaccgtgaacgtttcatcccgaatggacagcacaggtgttcctgatcgcatacaagtgaccacagatctctatcaagttctggccgcaaaaggctaccaactggagtgtcggggagtggttaaagttaaaggtaaaggcgaaatgacaacttacttcttaaacggaggaccttctagctag

SEQ ID NO: 213690 - DNA, 3348 bp, Artificial Sequence
  Description of Artificial Sequence: Synthetic coding sequence
atgtcttggttttccggactcctggtgcctaaagtagatgaaaggaaaaccgcatggggggagcggaacggacaaaagaggagtcggagaagagggacgagggctggcggattttgcaccccccgttacatgagctgcctaagagacgcggaaccaccaagccccacacccgctggtccccctcgctgcccatggcaggacgacgcattcattagacgtggaggtcccggtaaggggaaagaattaggtctgcgggctgtagccttgggtttcgaggacacagaagttactacaacagctggtggaacagcggaggtggccccagacgccgtcccacgctccggtcggagctgctggcgcagactggtgcaggtatttcagagcaagcagtttcggtccgctaaattggagcgcctgtatcagcggtacttctttcagatgaaccagtcttccctgaccttgctgatggctgtcctggtgttgctgacagcggtgcttttagcattccacgcagcacccgcacggccacagccagcctatgtggcattgttagcttgcgctgcggcactgttcgtgggcctgatggtggtctgtaaccgacattctttcaggcaggactctatgtgggtggtctcttacgttgtgttgggaatcttggctgccgtgcaggttggtggggctctggctgccgatccccgatctccctccgccggactgtggtgccccgtattttttgtctacattgcttacacgttgttacctatacgcatgagggctgcggtgctgtctgggctgggcctatcaacgcttcacctgatcttagcttggcagctgaaccgcggagacgcctttctctggaagcagctgggtgcaaatgtgcttctgttcctctgcaccaacgtaataggcatctgcacacattaccctgccgaagtgagtcaacggcaagctttccaggaaacacggggatatattcaggctcgactacatctgcaacacgagaacaggcagcaggaaagacttctgctgtctgtgctgccgcagcatgtcgcgatggagatgaaggaagacatcaacacaaaaaaggaggatatgatgttccataaaatatacatacaaaaacacgacaacgttagcattctgttcgccgacatcgagggatttactagcttggcatctcaatgtactgctcaagagctggtcatgacccttaatgaactgttcgcaaggttcgataagttggcggcagagaaccactgtctacggattaagatcctgggcgattgctattactgtgtgtctgggttgcctgaggccagggccgaccatgctcattgctgcgtagaaatgggtgtggatatgatcgaggcgatctctttagttcgtgaagtgacgggggttaacgtaaacatgcgcgtgggcatccacagtggcagagtacactgtggcgtattgggcttgaggaaatggcagttcgacgtttggagtaatgatgtgacgctggcaaatcatatggaggctggaggccgagccggaagaatccacattacgcgcgcaactctgcaatacctgaatggtgattacgaggtggagccaggaaggggaggagagagaaatgcctacctgaaagagcagcacatcgagacgtttctcatcctgggcgcaagccagaagcgtaaggaggaaaaagcgatgctggcaaaattacaacgcacaagagctaactcaatggaagggctaatgccacggtgggttcctgatcgggctttctctcggacaaaggactccaaggcttttcggcaaatgggaatagatgactcatctaaggacaaccggggtactcaggacgccctgaatcccgaagacgaggtcgacgaattcctcagccgagctatcgacgcacggtctatcgaccaactgcggaaagatcatgtgcgcagatttctcctcactttccagagagaagatctggagaagaagtacagcagaaaggtcgatcccaggttcggggcatacgtggcttgcgctttattagtattttgcttcatctgtttcatacaattgcttatctttccacactccactctgatgttggggatatatgccagcatctttttgttgcttctcatcacagttctgatttgtgcagtgtatagctgcggctctctgtttcccaaagctttgcagcgtctgtctagaagtatagtaaggagtagggctcattctacagccgtgggtattttcagtgtactgctcgttttcacatctgccatagccaacatgtattttatcggcaatatgctcttatccctcctcgcctcctcagtcttcctacacatttcctccatcggtaagctcgccatgatttttgttctgggactgatctatctggtgctgctactgcttggtccgcctgctaccatttttgacaactacgatcttctgctgggagtccatggtctggcgagcagtaacgaaacttttgacgggctggattgtccagccgcagggagggtggccctaaagtatatgacaccagtcatactgctggtgtttgcccttgccctgtatttgcatgcgcaacaggtggagtccacagcaaggctggattttctgtggaaacttcaagctactggggagaaggaggaaatggaagagctccaggcatacaacaggcgcctgctgcataacatactacctaaggatgtcgctgcgcactttctagcgagagagcggagaaacgacgagctgtactaccagtcatgtgaatgtgtcgctgtcatgtttgcttcgattgctaacttctcagagttctacgtagaactcgaggcaaacaatgagggtgtcgagtgtctgcgactactgaatgagataattgcagatttcgacgagattatttccgaggaacggtttcggcagcttgagaaaattaaaacaatcggctctacatatatggctgcttctgggctgaacgccagcacctacgatcaggtcggacgcagtcacatcacagctttggcagattacgctatgcggttgatggagcagatgaaacatattaatgaacatagcttcaataattttcagatgaagattggactgaatatgggtcctgtggtagctggagttatcggcgctcgaaaaccccagtatgacatttgggggaatactgtaaacgtgtcgtctaggatggactcgactggagttccggaccgaatccaagtaaccacagacctgtatcaagtgctggcagccaaaggctatcagttagagtgtcggggtgttgtgaaggttaaaggcaaaggagagatgaccacttactttttaaacgggggaccctcctcctag

SEQ ID NO: 213691 - DNA, 3243 bp, Artificial Sequence
  Description of Artificial Sequence: Synthetic coding sequence
atgcccgctaagggtcggtatttcttgaatgaaggggaggagggtcccgaccaggatgctctctatgaaaaatatcagctcacttcccagcacggccctctgctcctgactctcctcctggtggctgcaaccgcttgtgtggcccttatcatcatagcgttttcccaaggggatccgtcccgccaccaggccatcttgggaatggcttttttggtgctggcagttttcgcagccctttctgttctcatgtatgtggaatgcctgctgcgaagatggctacgggcattggcacttttgacctgggcctgccttgtggctctcggctatgtgctggtgtttgatgcttggacaaaggccgcatgtgcgtgggagcaagtccctttcttcctgtttatcgtgtttgtcgtctatacactactgcccttctccatgaggggagctgtcgctgttggggcagtgagcaccgcatcacacctgctcgttctgggtagtctgatgggaggattcacgaccccctcggtcagagtcggtctgcagctcctggctaacgccgtaatctttctctgcggtaacctgaccggcgcatttcacaaacatcaaatgcaggacgcatcccgcgatctgtttacatacaccgtcaaatgtatccaaattaggcgcaaactccggattgaaaagaggcaacaggagaatcttctcttgtcagtactgcccgctcatatctcgatgggtatgaagctcgcaatcatagagcggctgaaagagcatggggaccgtaggtgtatgcctgacaacaacttccatagcctgtatgttaaaaggcaccagaatgtaagcatcctttatgcggatattgttggctttacccaactggcgagtgattgctcacctaaggaactggtagtcgtcttgaacgaactgtttggcaagttcgaccagatcgcgaaagcaaacgagtgcatgcggattaagattttgggagactgctattactgcgtttccggactgcccgtaagcctccccactcacgctagaaattgtgtgaagatgggactggatatgtgtcaggccataaaacaggtgcgcgaagcgacaggagtggacattaatatgcgggtgggcattcactccgggaatgtgctttgtggggtgattggcttgagaaagtggcagtatgatgtttggtcccatgacgtgtcactcgcaaatcgcatggaagccgcaggcgtgcccggacgagtgcacataactgaagccacactaaagcacttagataaggcctacgaggtggaggacggtcacgggcagcaaagggatccctatctgaaagagatgaatatccggacatacctcgtgattgatcctcgcagtcaacagcctcctcccccttcccagcacctgcctagaccaaagggtgacgcagctctgaaaatgcgtgcaagtgtaaggatgacgcgctatctagagtcatggggggctgcacgaccattcgctcacctgaatcatcgagagagcgtttcctccggcgaaacccacgttcccaacggacggagaccaaagtctgtgccccaacggcaccggaggacccctgacaggtcaatgtcccccaaaggtaggtcagaggacgactcctatgatgacgagatgctgtcagcaatcgaggggctgtccagtacaagaccatgctgctctaagtcagacgatttctacaccttcggttccatatttctcgaaaagggtttcgaaagggaatacaggctggcaccgatccccagggccagacacgacttcgcctgcgcaagcctgatcttcgtgtgcatattattggtgcacgtgctcttgatgcctagaaccgcagccctgggagtatcattcgggcttgtggcctgcgtgctgggattggtgttggggctgtgcttcgccaccaaattttcacgttgctgtcccgcacgtggaaccctgtgcaccatcagcgaacgggttgaaacacagcctctgctgcgccttacgctggcggtgctcactatcggatctctgctgacagttgcgatcattaacttgcccttgatgccctttcaggtacctgaactgcccgtcggtaacgagaccgggttgctcgcggctagcagcaagacacgcgcactgtgtgagccactgccctactacacgtgttcatgcgttctgggcttcatagcttgtagtgtctttctgcggatgagcctcgaaccgaaagtggtgttactaacagtggctctggttgcatacctggttctgttcaacctcagcccttgttggcagtgggattgctgcggtcagggcttgggaaatcttactaaacccaacggcactacgagtggaactccttcttgtagctggaaggatctgaaaacgatgacaaacttttatctcgtgctattttatattaccttgctcaccctgtcacgacagatcgactattactgtcgcttggactgtctctggaagaaaaaatttaagaaagagcacgaagagttcgaaactatggaaaacgtcaacagactgcttcttgaaaatgtcctccccgcacacgtcgccgctcacttcattggcgataagctgaatgaggactggtaccaccagagttacgattgtgtctgcgttatgttcgcctccgtgcctgactttaaagttttctatacagagtgtgatgtaaacaaagaaggcctggaatgtttacgcctgctcaacgagattatagcagattttgacgaacttctgctcaagcccaaattttcaggtgtggagaagatcaaaacaattggctctacatacatggcggcagccggattatccgtggcctccggacacgagaaccaggaactggagaggcagcatgcacacattggagtcatggtggagttttccattgcactgatgagcaagctagatgggatcaaccggcactctttcaactcctttcggctgagagtcggtattaaccacggaccagtaatcgctggcgttatcggagccaggaaacctcagtatgatatctggggcaataccgtgaatgtcgcctccagaatggaaagtacaggggagcttgggaagatccaggtcactgaggaaacttgcaccattctgcaaggtttaggctattcttgtgagtgtaggggattaatcaacgtgaagggcaaaggtgaactcaggacgtattttgtgtgtaccgacactgccaaatttcagggccttgggctgaattag

SEQ ID NO: 213692 - DNA, 3243 bp, Artificial Sequence
  Description of Artificial Sequence: Synthetic coding sequence
atgcctgctaagggcaggtatttcctcaatgagggcgaggaaggtccggatcaagacgccttgtatgaaaaataccaactgacatcccagcatgggcctctgttgttaaccttattgttggtagctgccaccgcttgcgtggccttgatcatcatcgcttttagccagggagacccttcaagacatcaagctatccttggtatggcatttctggtgcttgcagtctttgccgcacttagtgtcctcatgtatgtcgaatgtctgctgaggcgctggttgcgcgctttggctttgcttacttgggcctgccttgtcgctttgggctatgtcctagtgtttgatgcctggacaaaagcagcttgtgcgtgggaacaggtgcctttttttttattcattgtttttgtggtttatactttactgccattcagtatgagaggagctgtggctgtcggagcggtgtcgactgcctcccacctattagtgttaggttccctgatgggtggctttaccactccttccgtgagagtcggattacagctgctggcgaacgcagttatctttttgtgcgggaacctgactggtgctttccacaaacatcagatgcaggatgcaagcagagatcttttcacctatacagtaaaatgcattcaaattcgccgtaaactgaggatcgagaagcgccagcaagaaaacctgctgctatccgtgctccctgctcacatttccatgggtatgaaattggccatcatcgaacgtttgaaggagcatggggatcggagatgcatgccagacaacaattttcattccctgtacgtgaaacgacaccagaacgtcagcatcctgtatgccgacattgttggcttcacacagttggccagtgactgttcccccaaagagcttgtagttgtgcttaacgaactgtttggaaaatttgatcagatcgctaaagccaacgagtgcatgcgaataaaaatcctgggggactgctactattgcgtctccggcctgcccgtttcgctacctactcacgctaggaattgtgttaaaatgggactggatatgtgccaagccataaaacaagtgcgtgaggcgacgggggttgatattaacatgagggtgggtatccattctggcaatgtcttatgcggtgtcataggtttaagaaagtggcagtacgacgtctggagccatgacgtctcactggccaaccgaatggaagcagcaggtgtgcccggtcgagtgcacataactgaggcaacactcaagcatttggacaaagcctatgaagtagaggatggccacggacagcagcgagacccttacctgaaggagatgaacatccggacttatctcgtgattgatcctcggagtcagcagccccctccgccttcgcagcacctcccacgcccaaaaggggatgccgcactgaagatgcgagcaagcgtgaggatgacaaggtaccttgaatcgtggggagcagctaggcccttcgcacacctgaatcacagagagtctgtctcttcgggtgaaactcacgtccccaacggacggagaccgaagtcagtgcctcagcggcaccgccgtacgcccgaccggtccatgagtccgaaaggcaggagcgaggatgattcctatgatgacgagatgctgagtgctatcgagggattatcatcaacacgtccatgctgttcgaaatctgatgatttttacacatttggctcaatcttcctggagaaaggttttgaaagggaatatagacttgcacccatccctagggccagacatgatttcgcctgcgcatcacttattttcgtgtgcatccttcttgttcacgtgctgctgatgccgaggacggccgctctcggggtaagttttggactggtcgcctgcgttcttggactcgttttgggcctgtgttttgccacaaaattttcacgctgctgtcctgctcggggaacactgtgtacaatatccgagagggtcgagacacagccccttcttcggctcactctggccgtcctcaccataggttctttactgacggtggctatcatcaacctgcccctgatgccgtttcaagttccagagctgcccgtggggaatgaaacaggacttttggctgcctcttcaaagacgagggctctgtgtgagccgcttccttactacacatgctcctgcgtgttgggcttcatcgcctgctcggtttttctccgcatgagtttagagcccaaggtcgttcttctcaccgttgcattagtcgcatacctggttttgtttaacctgtccccatgctggcaatgggactgctgtggacagggattgggcaatttaaccaaaccgaatgggacaacaagtggaactccgtcttgctcatggaaagacctgaagacgatgaccaacttctatttagttttgttctacataaccctgttaacgttgtctcgccaaatcgactactattgtcgcctagactgcctgtggaagaaaaagttcaagaaggagcacgaagagttcgagacgatggagaacgtgaatagactgctgctggaaaatgtcctccctgcccacgtcgccgctcactttatcggggacaagctaaacgaggattggtatcaccagtcctacgactgtgtgtgcgttatgttcgccagtgtgcctgatttcaaagtcttttacaccgagtgtgacgtgaacaaggagggccttgaatgcctgcggctcctcaacgagatcattgcagattttgacgagcttttacttaagcctaaattctccggcgttgagaaaatcaagaccataggaagcacttacatggctgcagcgggtctcagtgtcgcttctggtcacgaaaaccaggagctagaaaggcagcatgcacacatcggcgtaatggtggagttttccatcgcccttatgtcgaagctcgacggtataaaccgacactcctttaactcctttagattgagagttggaatcaatcacggacctgtgatagccggagtgattggcgctcggaagccacagtacgatatctgggggaacactgtgaacgtagcctctaggatggagtcaactggtgagctggggaagatacaagttactgaggaaacatgcaccatactgcaggggctggggtacagctgcgagtgccgtggactgatcaacgtaaagggcaaaggcgaactgagaacctacttcgtgtgtaccgatacagcgaagttccaggggctcggcttgaattag

SEQ ID NO: 213693 - DNA, 1302 bp, Artificial Sequence
  Description of Artificial Sequence: Synthetic coding sequence
atgccagcaaagggtcgttatttcttgaatgagggagaggagggacccgaccaggacgcactgtacgaaaaatatcagctaacaagccagcacggaccattgctgctgaccctgctgctggtcgccgcaactgcatgcgtggcgctgatcattatcgccttttcccagggcgacccttctcggcaccaagcgatccttggtatggcctttttagtcctcgctgtattcgccgcactctccgtcctgatgtatgttgaatgcctgctccgtagatggcttcgcgctctggccctgctcacgtgggcctgtctggtggcgctggggtacgtcctcgtttttgatgcctggacaaaggcagcctgtgcgtgggagcaagtcccgttttttttgttcatcgtgtttgtggtttacacgctgctgcccttctctatgaggggggctgttgctgtcggagcggtaagtaccgcttctcacctcctggtactggggtcactaatgggaggattcactacaccctctgtgcgcgtaggcttacagcttttagcaaacgccgtgatcttcctgtgtgggaatctgaccggagcattccacaagcaccagatgcaggacgcttccagggacttgttcacatacacagttaagtgtattcagataagacggaaactgaggatagaaaagaggcagcaagagaatttactgctgagcgtgctgccagcccatatctccatggggatgaagctggcaatcatcgaacgactcaaagagcatggagaccggcgatgcatgcccgacaataatttccacagtttgtacgtaaagaggcatcaaaacgtcagtatcctgtacgccgacatcgttggattcactcagctggcctctgattgtagccccaaggagctggtggtcgttcttaacgagctctttgggaaatttgaccagatcgccaaagctaatgaatgcatgcgcatcaagattttaggggactgctactactgtgtgtctggccttcccgtcagtcttcctactcatgctagaaactgcgtcaagatgggactggacatgtgtcaggcaatcaaacaagttagagaagccacaggggtcgatatcaatatgcgggtgggcattcacagtggcaatgtgctgtgcggcgtgattggactgagaaagtggcagtacgacgtttggtctcacgatgtgagcctggccaatagaatggaggcggctggggttcccggtagagttcacatcaccgaagccacattgaagcatttggataaggccctgctgctgcaggtcaggtag

SEQ ID NO: 213694 - DNA, 2205 bp, Artificial Sequence
  Description of Artificial Sequence: Synthetic coding sequence
atgccggcaaaagggcgttatttcctaaatgagggcgaagagggaccggatcaggacgcgctgtacgaaaaataccagctgacctcccagcacgggcctttattgctaactctgctgttggtggctgcaaccgcatgcgttgccctcataataattgcgttctctcaaggggacccttcccgacaccaggcaatactcggaatggcattcctcgtccttgcagtgtttgccgcactgagtgtcctgatgtatgttgaatgtctcctgcggaggtggctgagggcgctcgctctgctgacatgggcctgtctcgttgcacttggttacgtgctggtgtttgacgcctggacaaaggccgcttgtgcgtgggagcaggtgccttttttcctgttcattgtgtttgttgtctacactctgctcccgttttccatgagaggcgcagtggcggtgggcgctgtgtcgactgcttctcatcttctggtactgggaagcctgatgggtggctttaccacaccgtccgttagggttggattacagctgctggccaacgccgtgatcttcctctgcggcaatttgacaggcgctttccacaaacatcagatgcaagatgcttctcgcgatcttttcacctataccgtaaagtgcatacagatccggaggaagcttcggattgaaaaaagacagcaggagaatctgctgctctcagtgctgcccgctcatatcagcatgggtatgaagctggctattatcgagcgcctgaaagagcacggagataggcgctgcatgccagacaataatttccactctctgtatgtcaagcggcatcaaaatgtgtctatcttgtacgcagacatcgtgggctttacgcagttggcttccgactgctccccaaaggaattagtcgtggtgctgaacgagctgttcggtaaatttgatcagatcgccaaggccaacgaatgcatgcggattaagattctgggcgattgctactactgcgtctcaggtttgcccgtaagcctgcctacacacgccaggaactgcgtgaagatgggcctagacatgtgccaggctattaaacaggtgagagaggccaccggcgtcgatatcaacatgcgcgtaggcattcacagcgggaacgtcctctgcggagtcattggactcagaaaatggcaatatgatgtttggagccatgatgtctctttagcgaatcgcatggaggcagcgggtgtgcctggaagggtgcacattaccgaggcaacactgaaacatctggacaaggcatacgaagtggaggatggccacgggcagcagcgggacccatatttgaaagagatgaatattcgtacttacctagtgattgaccctcgctctcaacaacctccacccccttcccagcacctgccgagacccaagggcgacgctgcactgaagatgagagcaagcgtacggatgactcgatatttggaatcctggggcgcagcccgaccattcgctcacctgaaccacagagaatctgtaagctctggcgagacccacgttcctaacggaagacgtcctaagagtgtcccacagcggcatcgcagaacacccgaccggtccatgtcacccaaaggacgatccgaagatgactcttacgatgacgagatgctgagtgctatagagggattaagctccactcgaccatgctgctcgaagtctgatgacttttacactttcggttccatatttctcgaaaaggggttcgaaagggaatacagactcgcacctattccacgggctcgccacgacttcgcctgcgcgtccttgatctttgtttgcattctacttgtccacgtgctcctgatgcctaggactgccgctctgggagtgtcatttggcctggttgcctgcgtccttggtctggttctggggctgtgcttcgctacaaaattctccagatgctgcccagcccgagggaccctgtgcactatatccgagagagtcgaaactcagcccctgctccggttaacgctcgctgtgcttaccatcggaagcctgctgacagttgccattattaacctgccactgatgccctttcaggtgcccgagcttccggttggcaatgagactggacttctcgccgctagcagcaaaacaagggcactctgtgaaccactgccacatctgcacactgttttttctcgcctcaatgagctgacgtcctag

SEQ ID NO: 213695 - DNA, 3756 bp, Artificial Sequence
  Description of Artificial Sequence: Synthetic coding sequence
atggagctttcagacgtcaggtgtctgaccggctccgaggagttgtacactatccatcccacacctccggctggggacggccgtagcgcatcccgtccccaacggttgttgtggcagacagcggtcaggcacatcaccgagcagagattcatacacgggcatagagggggtagcgggtctgggagtggcggatccgggaaagcaagcgatcctgcaggcggaggtccgaaccaccacgccccacagctgagtggggactcagccttacctctctattcgttagggccaggagaacgagcgcactcaacttgcggaactaaggtgtttccagaacggtcaggctccgggagtgcctctggaagtgggggtgggggagatctggggttcctgcacctcgattgcgctccttccaactccgattttttcctcaatgggggttattcttaccgtggggtcatttttcctactctgcgtaacagctttaaaagtcgcgatttggaaaggctgtatcaacggtattttctagggcagcgcagaaagagcgaggtagtgatgaacgtgcttgacgtgctgaccaaattgactctgctggttcttcacctctctctcgcatctgcacccatggatcctctgaagggcatactgttgggcttcttcaccggtatcgaagtagtgatctgcgccctggtggttgtgcggaaagacactacttcacatacatacctgcagtattccggcgtggtgacgtgggtcgccatgaccacccagattcttgcagctgggcttggctacggcctattaggagatggcattggctacgtcttattcacccttttcgctacttactcaatgttgccactgcccctgacctgggctatactcgccggactgggaacgtctctgttgcaagttatccttcaggtagttatccctagattggcagttataagcatcaatcaagttgtggcccaggcggtcctgttcatgtgcatgaacacagccggtatttttatttcctacctgagtgatagggcccaaagacaggcctttctggagactagacgctgtgttgaggccagactgagactggagacagaaaatcaacgacaggaacgcctagtgctttcagtgctcccaagattcgtggtactcgagatgataaacgacatgacaaacgtcgaggatgaacatctgcagcaccaatttcatagaatctacatacacaggtacgagaatgtttcaattctctttgctgacgtgaaagggttcactaacctgtccactacattaagcgctcaggaattggtgcgaatgcttaatgaactgttcgccagatttgacaggttagcacacgagcatcactgcctccgaattaagatcctgggcgactgttactactgtgttagtggtctgcccgaaccccgacaagaccacgcgcactgctgtgtggagatgggactgagcatgataaaaacaatccgctacgtgcgttccagaactaagcacgatgtggacatgaggataggcatacactccggatctgttctgtgtggcgtgctgggccttcgaaaatggcaattcgacgtttggtcttgggacgtcgatattgcaaacaagctggaaagcggtggcatacctgggcgtatacacatctcgaaggcaacccttgactgcctgaatggcgattataacgtggaagagggacatggcaaggagcgaaatgaattcctcaggaaacacaatatcgagacgtaccttattaagcagcctgaggattctctcctcagtctgccggaggacattgtcaaggaaagtgtttcgtccagcgacagacggaattcaggagcaacttttacagagggctcatggtcccccgaactgccgttcgacaatatcgtcggcaagcagaacaccctggctgctctgactaggaattctatcaatcttctgcccaatcacttagcacaggccttgcatgtgcagagcgggcctgaagaaattaacaagcggatcgaacacaccatcgatctgcgatcaggcgataagctacggcgtgagcatatcaagcctttcagcctgatgtttaaggatagctcactggagcataagtactcacagatgcgcgatgaggtgtttaaatccaatctggtctgtgccttcatcgttctccttttcatcaccgctatccagtcactactgcccagcagccgggtgatgcctatgacaatccagttctccattctcataatgctgcactccgctttggtactgatcacaaccgcagaagattataagtgtctccctttaatcctgagaaaaacatgctgctggattaacgaaacctacctggctcgtaacgtgattatttttgcttccatcctgataaattttttaggggcaatcctaaacatcctctggtgtgatttcgataagtccatcccactgaagaacctgacctttaacagcagcgccgtgtttaccgacatctgcagctatccagagtatttcgttttcacgggtgttttggcaatggttacctgtgcggtcttcttaaggctaaacagcgtcctaaagcttgcagtactccttatcatgatcgccatctatgctctcctgacagaaacagtctacgcgggactgtttttgagatacgacaatctgaaccactctggcgaagacttcctggggacaaaagaggtgtctttgctactcatggcaatgtttctcttagcagtattctatcacggacagcaactcgaatacactgcaaggctggacttcctgtggagagtacaggccaaagaagagatcaacgaaatgaaggaattgcgggagcacaatgaaaatatgctcaggaatatcctaccctctcacgtggctcgtcactttttggagaaggatcgagataacgaggaactgtacagccaatcttatgacgctgtgggggtcatgttcgctagcatcccaggttttgccgatttctactcccagaccgaaatgaataaccagggtgtggaatgtcttcgactcctgaacgaaattattgccgacttcgatgagctcctgggcgaagacagatttcaggatattgaaaaaatcaagacaattgggtccacctacatggccgtgtctgggctgagccctgaaaagcagcagtgtgaggacaaatggggccacctgtgcgccttagccgacttttctcttgcactgaccgagagcatccaggaaattaataaacacagcttcaataattttgaactgagaattgggataagccacggttctgtcgtggctggcgtgattggtgcgaagaagccacagtacgacatctggggaaagaccgtaaacctggcgtctaggatggatagcactggcgtgagtggtcggatccaggtaccagaggagacatatctaattcttaaggatcagggctttgctttcgattacagaggcgaaatctacgtaaaaggcatttccgagcaggaaggcaaaattaaaacttattttctactggggagagtccagcccaacccctttatcctgcccccaagacggttgcctgggcaatattctctcgccgctgtagtcctggggcttgttcagtccctaaaccgccagcgccagaagcagctgttgaacgagaataataacacagggattatcaaagggcactacaataggagaactctgctgtctccttctggtaccgagccaggtgcgcaagcagagggtacagataagagcgacctcccatag

SEQ ID NO: 213696 - DNA, 4062 bp, Artificial Sequence
  Description of Artificial Sequence: Synthetic coding sequence
atggccagtccgccacaccagcaactgttgcatcatcactcgacagaagtcagctgcgattcgagtggggatagcaactctgttagagttaagatcaatccaaagcagctctcctctaattcacacccgaaacactgcaagtactctatttccagtagctgctcctccagcggcgatagtgggggagtgccccgaagggtgggcggaggcggaagactgcggcgacagaagaagcttccacagctgtttgagagagcctctagtagatggtgggatcctaaattcgatagcgtgaatctggaagaggcgtgcctggagcgatgttttccacagacacagcggcgattccggtatgcgctgttttacattggattcgcctgtctactgtggtcaatttacttcgcggtccacatgcgatcacgtttgatcgtgatggtggctccggctctttgtttcctcctcgtatgcgtcggcttctttctgttcaccttcacgaagctgtacgcaaggcactacgcctggacatctctggcactcactctgctggtgttcgcgcttaccctggcggctcaattccaggtgctaactcccgttagcggcaggggggacagtagtaatttgacggccaccgccaggcctactgatacatgtctgtcacaggtgggatcattcagtatgtgtatagaggtattgtttctactctatacagttatgcacctgcctctgtaccttagtctgtgcctaggggtggcctactccgtcttgttcgaaacgttcggctatcactttcgcgatgaggcgtgcttcccttctcctggcgctggtgcgttacattgggagctcctgagtaggggactgctgcacggatgcattcacgccataggcgtccatctgtttgtcatgtcccaggtacgatcaagaagtacgtttctgaaggtcggccagtctattatgcatgggaaagatttggaggtcgaaaaggctctgaaggaaagaatgatccattcagtgatgccacgcattatcgccgacgacttgatgaagcagggtgacgaggaatcggagaattcagttaaaaggcatgctacctcttcacccaaaaatcgcaaaaagaaatcaagcatccaaaaggcccctattgcatttcgcccttttaaaatgcagcagatagaggaagtcagtatcctgttcgccgacatcgtcgggttcacgaagatgagtgcgaacaaaagcgctcacgcactggtgggcctgctgaatgacctgttcggcagattcgatcggttgtgcgaggagaccaagtgcgagaagatctctaccctaggcgactgctactactgcgtggccggttgccctgaacctcgcgctgaccatgcttactgttgcattgaaatgggcctcggtatgatcaaggcaattgagcagttctgtcaggaaaaaaaagagatggtcaacatgcgcgtgggcgtccacacgggaacagtcttgtgcggtatacttggcatgaggaggtttaagtttgacgtgtggtctaatgacgtgaacctggccaatctgatggagcagctaggggttgccggaaaggtgcacatctccgaagccactgccaaatacctggatgatagatatgaaatggaggacggcaaggtcatcgagcggttgggacagagcgtcgtagcagatcaactcaagggccttaaaacttacttgatctctggacagcgggctaaggagtcgcgctgctcatgcgcagaagctctgctgtccgggttcgaggtaatcgacggctcacaggtatcaagtggacccagagggcagggtacagctagcagcggaaacgtgagcgatcttgcgcagacagtgaagacttttgacaaccttaagacttgtccctcatgcggcattacattcgctccgaagagtgaggccggagccgagggtggcgcacctcagaacggctgtcaagacgagcacaagaacagcactaaggcatccggcggacccaaccctaaaactcaaaatggcctgctttcacctcctcaggaagagaagctgactaactcccagacaagtctctgcgagatcctgcaggaaaagggcagatgggccggtgtgtctctggaccagtccgccctcctgcccttgagattcaagaatataagagaaaaaacagacgcccactttgtcgatgtaatcaaggaggattcactcatgaaagactatttcttcaaaccaccaattaaccagttctccttaaattttctcgaccaagagctggagcggagctaccgaacgtcataccaggaagaagtaattaagaatagcccagtgaaaacatttgcttctcctacgttcagttctctgttggacgtgttcctaagtaccacagttttcctgaccctgagtacaacttgctttttgaaatatgaggctgcaacagtgcctccaccgccagccgcacttgctgttttcagtgccgctctgctcctggaagttctgtcactcgcagtgagcatcaggatggtcttcttcctagaggatgtgatggcttgcaccaaacgcctgcttgagtggattgcaggatggctgcctagacactgcatcggcgctattctcgtctctctgcctgccctggctgtgtattctcacgtcacctctgagtatgaaacaaatatccatttccccgttttcaccggctcggcagccttgattgccgtggttcactactgtaatttctgccagctctcttcgtggatgagaagctctctcgcaacagtcgtgggggcaggtcctctgctccttctgtacgtctcactctgcccagactctagtgtcctgacatctcctctggatgccgtccagaacttttcctcagaacggaatccctgcaatagctcagtacccagggatctgaggcggccagcctcattgatcggccaggaagtggtcctagttttcttcttactgttgctcttggtgtggttcctgaatagagagttcgaagtgagctacagacttcattaccatggggatgtcgaagcagatctgcatcggacaaaaatacaaagcatgcgtgaccaagcagattggcttctgaggaatatcatcccttatcacgtagctgaacagctcaaagtcagccagacttattcaaaaaatcacgatagcggcggagtgattttcgctagtatcgtcaatttctctgagttttatgaagagaattacgaaggcggtaaggaatgttaccgagtactgaacgagctgatcggagacttcgacgagctactctctaagcccgattatagttcaatagaaaaaataaaaacgatcggagccacttacatggctgcaagtggactcaacactgcccaggcccaggacggctcacatccccaagaacatcttcagatattgttcgagtttgcaaaggagatgatgcgcgtggtggatgacttcaacaacaacatgctctggttcaacttcaagctccgtgtgggcttcaatcatggccctctgactgctggagtgattggcacaacaaagttgctgtacgatatttggggcgatacagtgaatattgcttctaggatggatacgaccggggttgaatgcaggatccaggtgagtgaggaatcctatagagttctgagtaaaatggggtacgatttcgactatcggggtactgtgaacgttaagggaaaaggtcagatgaaaacttatctgtatcccaaatgcaccgaccatcgagtcattcctcagcatcagctctctatcagccctgacatccgcgtgcaggtggacggcagcatcggtcggtctccaactgacgagatagccaacttggtaccgtcggttcagtatgttgacaaaacctctcttgggagtgatagttccacccaggctaaagatgctcacctctctcctaagcggccttggaaggagcccgtgaaggcggaggaaagggggaggttcgggaaggcgattgagaaggatgactgcgacgagacgggaatcgaggaggcaaatgagctgaccaagttgaacgtctccaagtctgtctag

SEQ ID NO: 213697 - DNA, 531 bp, Artificial Sequence
  Description of Artificial Sequence: Synthetic coding sequence
atgacaatgtgctcaggtgcacggctggccctgctggtatatggcatcatcatgcatagcagtgtatactcaagtcccgcagccgctggactacggttccctggcattcgcccagaagaagaagcctacggagaggacggtaatccccttcctgactttgacggctctgaaccgcctggcgctggatcgcctgcgtccgcacccagggcagcagctgcctggtaccggcctgcgggtagacgcgacgtagcccatgggatattgaatgaggcatatcgcaaggtgctcgatcagctctccgcgggtaaacacctgcaatcactcgtggcgaggggagtgggcggatcactggggggaggcgcaggagacgacgccgagccgctgagcaagaggcactctgatggcatctttaccgatagttatagtcggtacaggaaacagatggcagttaaaaagtacctggcggcagtattagggaaaagatataagcaacgggtgaagaataagggcaggagaattgcctacttgtag

SEQ ID NO: 213698 - DNA, 531 bp, Artificial Sequence
  Description of Artificial Sequence: Synthetic coding sequence
atgaccatgtgttcgggcgcacgcctggctctactagtgtatgggatcattatgcactcctcagtgtattctagccctgcagcagccggtctgcggtttcccggaatccggcctgaagaggaagcctatggagaagacggcaacccactgcccgactttgatggctcggaaccgcctggagccggatcacccgcttccgcccctcgagccgctgcagcgtggtacagacctgctggacgtagagacgttgcgcatggaattctgaacgaggcctaccgtaaagtgctggatcagctgagcgccggtaaacatctccagtctctggtggctcggggagtcggtggcagcctaggcggaggggctggcgacgacgccgagcccctcagcaagcgccattcagacgggatttttaccgactcgtactctcgatatcgcaaacaaatggctgtgaagaaatacctcgccgcagttcttgggaagagatacaaacaacgggtgaaaaacaaaggtaggagaatcgcctacctgtag

SEQ ID NO: 213699 - DNA, 948 bp, Artificial Sequence
  Description of Artificial Sequence: Synthetic coding sequence
atgcttacgaagcgtgctctgcagaaaccttgttcggatcggttcctccgtacagcgcaaattaaccggtcccgacgaccagtgacatccgtgacttccggctcctcatctagatctagggcaagcccacatcgcccattgttcctgtcttcagcatctttatccgcgcctcccagtctcagggtgactttgcccccaggcagcgccagactccagacgtttgagcagaacacatctctaggcaagagggtcccccagcttcttcttctactacctctcgtgcccgctgcttccgcacagacaccaaccccagacggtgatgcaagtcgagtggtgacacccgctcaggagctggaggaagccctgtgtcctccctcatacctggccgctctcctcgctgcgggtggtgtcgagggcatgaccatgtgttccggcgctcgcctggcacttctggtctatggcatcattatgcatagcagtgtctatagtagtccggcagccgcaggtctgcggttccccggtattagacccgaagaggaagcctacggcgaggatgggaacccgcttcctgactttgatggttcagaaccacccggagccggatctccagcttctgctccgagggctgctgctgcatggtataggcccgcaggacgcagagacgtggctcacggcattttgaacgaggcataccgcaaagtactcgaccagctcagcgcgggtaagcacctgcagagcctggtcgcacggggagtggggggaagcctgggaggtggggcaggtgacgacgcagaacccctgagtaagcgacatagtgatggcatttttaccgattcttactccagatacaggaaacaaatggccgtgaaaaagtatctggctgccgtcctggggaagcgctacaaacagcgtgtcaagaacaagggacgacgaatcgcctacctctag

SEQ ID NO: 213700 - DNA, 531 bp, Artificial Sequence
  Description of Artificial Sequence: Synthetic coding sequence
atgaccatgtgctctggggctagactcgccctgctcgtttacggcatcataatgcactccagtgtgtacagcagcccagccgcagccggacttaggtttccagggataaggcccgaggaggaggcatacggggaagatggaaacccactacctgactttgacggctcagagccacccggtgctggatctcccgcttctgctccccgagccgctgcagcgtggtatcgccctgccggtcggagagacgtggctcacgggatcctcaacgaagcttacaggaaggtcctagatcagctgtcagctggcaagcatctccaaagtcttgtcgcccgtggggttggtggctccctcgggggtggtgccggagatgacgcagaaccactgtctaaacgtcactccgacggaatatttaccgattcttactcaagataccgaaaacagatggccgttaaaaaatatctggccgcagtactaggcaagagatacaagcagcgcgtcaagaacaaaggtagacggattgcttacctgtag

SEQ ID NO: 213701 - DNA, 1407 bp, Artificial Sequence
  Description of Artificial Sequence: Synthetic coding sequence
atggccggagtggttcacgtttcccttgctgctctgctcctgctccccatggcccctgcaatgcatagcgactgtatctttaaaaaggagcaggctatgtgcttggagaagatccagcgagcaaatgagctgatgggctttaacgacagctcacctggctgcccaggcatgtgggacaatattacatgttggaagccagctcacgtcggcgagatggtcctggtgtcatgccctgagttgtttcgcatctttaaccctgaccaggtttgggaaacagagaccattggggaaagtgacttcggcgactctaacagcctggacctgagtgatatgggtgtcgtttcgcgtaactgtacagaggacgggtggagtgaaccttttccccattacttcgatgcctgcggatttgacgagtatgaaagcgaaacgggagatcaggattactactatctgagtgttaaagccctgtacacagtggggtactccacctctctggtaacgctgactaccgccatggtgatcctctgtaggtttcggaagcttcattgcactcgcaattttatccacatgaacttgttcgtatctttcatgctcagagccatttctgtgtttataaaagactggattttgtatgctgaacaggactcaaaccattgttttatcagtacagtggaatgcaaggctgtgatggtcttctttcattattgtgtggtcagcaattatttttggctcttcatcgaaggcctgtacctgttcaccctcctcgtggagacgttttttcccgagcgtagatatttctactggtatacaatcattggatggggaaccccaacagtgtgcgtgacagtgtgggctaccctcaggctctactttgacgacactggatgttgggacatgaacgattccactgctctctggtgggttataaaagggcctgtggtgggatctatcatggtaaacttcgtgctgtttatcgggattatagttatcctcgtgcagaagctacagtcacccgacatgggcggaaacgagtcttcaatttacctccgcttagccagatctaccctgcttctgatccccctgtttggcattcactacacggtgttcgccttcagccccgagaatgtgtctaaaagggagcgactggtgtttgaactgggactcggctctttccagggattcgtggtggctgtcctatattgctttcttaacggcgaggtgcaagcagagatcaagcgcaagtggaggagctggaaagtgaataggtacttcgctgttgattttaagcacaggcatccatctttggcctcatcaggggtgaacggtggaacccagctgagcattctgtcgaaatcctctagtcagattagaatgtcgggcctcccagctgacaacctggccacatag

SEQ ID NO: 213702 - DNA, 594 bp, Artificial Sequence
  Description of Artificial Sequence: Synthetic coding sequence
atggttttctttcattactgcgtggtctctaactatttctggttgtttatcgagggcttgtacctgttcactttgctcgtcgagaccttttttcccgagcgcagatacttctactggtacaccatcattgggtggggaacgccgacagtttgtgtcacggtctgggccaccctgaggctgtattttgacgacacaggttgttgggatatgaatgactctacagccctgtggtgggttattaagggcccagttgttggcagcattatggtcaatttcgtcctatttattggaatcattgtgatcctcgtgcagaagctgcagagccccgacatgggtggaaacgagtcgtcaatctacttgactaatctgtcccctcgggttccgaagaaagccagggaagatcccctgcccgtcccttcagaccagcattcgctgccgttcctgagttgcgtgcagaagtgttattgtaaaccccagcgggcacagcagcattcttgcaagatgtccgaactgtctaccatcacgctccgtctcgcaagaagcactctgttactcattcccttgtttggcatacactataccgtcttcgcttag

SEQ ID NO: 213703 - DNA, 1491 bp, Artificial Sequence
  Description of Artificial Sequence: Synthetic coding sequence
atggccggtgtggtccacgttagtttggctgctctcctgctgctgcctatggctcccgctatgcattccgattgcattttcaaaaaggaacaggcaatgtgtctcgagaaaatccagagagctaacgaattaatgggatttaacgacagttccccgggatgtccagggatgtgggacaatattacctgctggaagcccgcacacgtgggagaaatggtgctcgtaagctgtccagagctttttaggatttttaatcccgaccaagtttgggagacagagaccattggagagagcgattttggggactctaacagcctggatctatccgacatgggggtggtgtcccgcaattgcacggaggatggttggtctgagcccttcccccattattttgacgcctgtgggtttgatgagtacgagtcagaaacaggagatcaggattattattatctgtcagtcaaagctctgtatacagtcggttattcaacatctctagtaacattgacgactgcaatggtgatcttgtgccggtttcgtaaactccactgcacccgaaatttcattcacatgaatctgtttgtttcttttatgctgcgagcgatatcggtgtttattaaagattggatcctgtatgccgagcaggattctaatcactgcttcatatcgacggtggaatgcaaggcagttatggtgttcttccactactgcgtcgtgtcaaattacttttggctatttattgagggactctacctgttcactttattggtcgaaacatttttcccggagaggcggtacttctactggtacaccattatcgggtggggtacacctacagtatgcgtcaccgtctgggccaccctccgtctctattttgatgatactggatgctgggacatgaacgattctactgcattgtggtgggttataaagggccctgttgtgggttcaattatggtgaatttcgtgcttttcatcggcattatcgtgatcctcgtgcagaagctccagtcccctgatatgggaggtaacgagtcaagtatctacttctcttgcgttcagaagtgctactgcaagcctcagcgcgctcagcagcactcctgcaaaatgtcagaactttccaccatcacactgagactcgcacgcagcactttactcctcatacccctgtttgggatccactataccgtgtttgctttctcgccagagaacgtgtctaaaagggagcgcctggtgtttgagctggggctcgggtcttttcagggattcgtcgttgccgtgctgtactgcttcttgaatggagaagttcaggccgaaatcaaaagaaagtggcgctcatggaaagtgaataggtatttcgccgttgacttcaagcacaggcacccatctctggcctcctctggggtgaatggtggcacgcagttaagcatacttagcaagtcatccagtcaaatcaggatgtctggcttgccggcagacaatttagctacatag

SEQ ID NO: 213704 - DNA, 1575 bp, Artificial Sequence
  Description of Artificial Sequence: Synthetic coding sequence
atggcaggggttgttcacgtctcactggctgccctcctacttcttcccatggctccggctatgcattcggactgcatctttaaaaaagagcaggcgatgtgtttagaaaagattcagagagccaacgagctgatggggttcaacgactcttctccgggttgtcccggtatgtgggataacattacctgttggaagcccgctcacgtaggggaaatggtcctggtgtcctgcccggaactgtttagaatcttcaaccccgatcaggtttgggagacagagacaattggggaatcagacttcggggatagcaactccctggatctcagcgacatgggtgtggtcagcagaaattgcacagaggacggctggtctgagccgttcccccactacttcgatgcctgcggctttgatgaatacgaatccgagaccggtgaccaagactactactacttgtccgttaaggcgctctatacagtcggttactcgacttcacttgttacactgaccacagccatggtaatcctgtgtagatttcgcaaactccactgtaccagaaacttcatccacatgaacctcttcgtatccttcatgctgcgcgctattagtgtgtttattaaagattggattctgtacgctgaacaggactctaaccattgctttatcagcacagtggagtgcaaagcggtgatggtgttctttcattattgtgtagtgtctaattatttttggctcttcatcgagggtctgtatctgtttacgttgcttgtggagacattttttccagagcgaagatacttctactggtataccatcattggttgggggactccgacagtgtgtgtaactgtgtgggctaccctgcgcctatacttcgatgacacagggtgctgggatatgaatgatagcaccgctctgtggtgggttatcaaaggtcctgtggttggcagcatcatggttaactttgtcttgttcatcggtatcattgtcattctcgtccagaagctgcagagtcccgatatgggcggtaatgaaagttccatctacttaacgaatttaagccctagagtgccgaagaaggccagagaagatccgctcccagtgccttcagaccagcattcactgccgttcctgagctgtgttcagaagtgctactgcaaaccccagagggcacagcagcacagctgcaaaatgagcgagctgtctaccatcacactgaggctggctagatcaacccttttgctgatccccctgttcgggattcactacactgtcttcgctttctcgcctgaaaacgtgtccaaacgcgaaaggctcgtgtttgaactcggtctaggttctttccaggggtttgtcgtggccgtgctgtattgtttcctgaacggcgaagttcaggcggagattaaacggaagtggcgcagctggaaggtgaataggtattttgcagtggactttaagcatcgccacccgtctctggcctcctcgggcgtgaatggaggtactcagctgagcatcctcagcaaaagctcatcacagatacgcatgtcaggactgccggcagataaccttgctacctag

SEQ ID NO: 213705 - DNA, 225 bp, Artificial Sequence
  Description of Artificial Sequence: Synthetic coding sequence
atggccggagtagtgcacgtctctctggcagccttacttctcctccctatggctcctgcgatgcactcagattgtatcttcaaaaaagagcaggctatgtgtctcgaaaagatccaacgggctaacgaacttatgggattcaatgattcaagccctgggtgccccggtatgtgggataacataacctgttggaaaccagctcatgtcggagaaatggtgctctag

SEQ ID NO: 213706 - DNA, 447 bp, Artificial Sequence
  Description of Artificial Sequence: Synthetic coding sequence
taggcgacactccgactatatttcgacgacactggttgttgggacatgaatgattccacggcgctttggtgggtgatcaaaggcccagtggtgggctctatcatggtcaactttgtgctcttcatcggtatcatcgtcattctggtgcagaagctgcaatccccagacatgggagggaacgagtcctccatctaccttactaacctgtcacctcgcgttcccaagaaagctagagaagatccactaccagtaccctcagatcagcatagcctgcccttcttgaggctcgctaggagcaccctgctgctcatacccttgtttggtatccattatactgtgtttgcattcagtcctgagaatgtctctaagcgggagcgtctggtcttcgagctaggtctcggttcgttccagggcttcgtggtagcagtgctgtactgtttcctgtag

SEQ ID NO: 213707 - DNA, 1344 bp, Artificial Sequence
  Description of Artificial Sequence: Synthetic coding sequence
atggcaggagtcgtgcatgtatcacttgccgcactcctacttctgcccatggctcccgctatgcactccgactgcatttttaagaaagagcaggcaatgtgtcttgagaagatacaacgagctaatgagctgatgggattcaatgacagcagtcctggctgcccaggcatgtgggataatatcacatgttggaaacccgctcacgtcggtgagatggttttggtgagttgccccgaactgtttaggatctttaatcccgatcaagacatgggcgtagtgtctaggaactgtactgaggacggctggtctgaacccttcccacactactttgacgcgtgcggatttgatgagtacgagagcgaaaccggggaccaggattattactatcttagcgtgaaagcactgtacactgttggatactccactagcctagtgactcttactactgcaatggtaatcctgtgcagatttcggaaactccactgcaccaggaactttatccatatgaatctgtttgttagctttatgttgagggcaatcagtgtgttcattaaagactggatattgtatgctgagcaagatagcaaccattgcttcatctccacagtcgaatgcaaagcagtaatggtgttcttccattattgtgtagtgtcaaattacttctggctgttcattgagggcttgtacctctttacactattggtcgaaacttttttccctgaacggagatacttctactggtacacaatcatcgggtggggcaccccaactgtgtgtgtgacggtctgggcgaccctgcggctgtacttcgatgatactgggtgctgggatatgaatgactccactgcattatggtgggtgattaaggggcctgtggtgggtagcataatggtcaatttcgtgctgttcatcggtatcatcgtgattttagtgcagaagcttcaatcacctgatatgggcggaaacgagagttccatatacctccgactcgctaggtctacactgctgctaatccccctctttgggatccattacactgttttcgctttcagccctgaaaacgtaagcaaaagggagcggctggtgttcgagctgggcctcggatccttccagggcttcgttgtggctgtcctctattgcttcctaaatggagaggttcaggccgaaatcaagagaaaatggcgatcctggaaagttaaccgctactttgctgtagacttcaaacacagacacccttctttagctagtagcggtgtgaacgggggtacacagttgagcatcctgtctaaaagtagtagccagattcgcatgagcgggctcccagcggacaatctggccacgtag

SEQ ID NO: 213708 - DNA, 705 bp, Artificial Sequence
  Description of Artificial Sequence: Synthetic coding sequence
atggaccccggactgcagcaggctttgaatggcatggctcctcctggggacactgcaatgcacgttccagccggatccgtggcctcacatctgggaaccactagccggtcatacttttatctgacaacagctactctggctctctgcctcgtgtttaccgttgccacaatcatggtcctcgtcgtacagaggaccgatagtatccccaatagccctgacaacgtgccgctaaaaggcggaaattgtagtgaagacttgctctgcatattgaagcgggcaccctttaagaaatcctgggcctatctgcaggtagccaaacacttgaataagacaaaactgagctggaataaagacggcatcctgcacggggtccggtatcaggatggaaatctggtgatacagtttccgggactatatttcatcatttgccagctgcagttcttggttcagtgtcccaataatagcgtggatcttaaactcgagctgctaattaacaagcacatcaagaaacaggccctagtgactgtatgcgagtctgggatgcagacaaaacatgtgtaccaaaatctgtctcagttcctgctcgattatctccaggtgaacactaccatctccgtcaatgttgatacatttcagtacattgacacgagcaccttcccactagaaaatgtgttgagtatttttttatatagtaattccgattag

SEQ ID NO: 213709 - DNA, 585 bp, Artificial Sequence
  Description of Artificial Sequence: Synthetic coding sequence
atggaggaaaagctgaaaaagacaaaaatcatttttgtggtgggcggaccagggtctggcaagggtacccagtgtgaaaaaattgtccagaagtatgggtacacccacttaagcaccggcgatctgctgcggagtgaggtcagttcagggagcgcccgtggcaaaaagctgagtgagataatggagaaaggacaactggtgccgctagaaactgttctcgatatgcttagagatgccatggtggcaaaagttaatacctctaagggcttcctcatcgacgggtatcctcgtgaggtccagcagggggaggaattcgagcgacgaataggccaaccaacgctcctgctctatgttgacgcaggccctgaaactatgactcagcggctccttaaacgaggggagacttctggtagggtcgatgacaatgaggagacgattaaaaagaggctggagacatactacaaggccactgagccagtgatcgctttttatgaaaagagggggatcgttagaaaggtcaatgctgaagggagtgtagattcagtattcagccaggtgtgcactcacctcgacgcactgaagtag

SEQ ID NO: 213710 - DNA, 585 bp, Artificial Sequence
  Description of Artificial Sequence: Synthetic coding sequence
atggaggagaaacttaaaaaaacgaagatcatctttgttgtgggcggacccggtagtggtaagggcacacagtgtgaaaaaattgtccaaaaatacggatacacacatctctccacaggcgacctcctacgatcagaggtgagctcaggctccgccagaggaaagaaactgagcgagatcatggagaagggccagttagtacctctggagaccgtattggacatgttgagggacgctatggttgccaaagtgaacacttcaaaaggcttcttgattgatgggtaccccagggaggtgcagcaaggcgaagaatttgaacggcgtattgggcagcccactcttctgctctacgttgatgcagggccagaaacgatgacgcaaagactcctgaagaggggagaaacgagtgggagagtggatgacaatgaagagaccattaagaagagactggagacctactacaaggctacagagcccgtgattgctttttatgaaaagcgtggcatagttcgcaaggtgaacgccgagggcagcgtcgactcagtcttttcccaggtctgtacacatctagatgcacttaagtag

SEQ ID NO: 213711 - DNA, 720 bp, Artificial Sequence
  Description of Artificial Sequence: Synthetic coding sequence
atggcaccgagcgtgccagctgccgagccagagtatcccaagggcattcgggctgtcctgttgggtcctcccggagcaggtaaggggactcaggcacctcggttggccgaaaatttctgtgtctgccacctggccaccggcgacatgttacgtgctatggtcgcatcaggatcagagctcggaaaaaagctgaaagctaccatggacgccggaaagctggtgtctgacgaaatggtcgtggaacttattgagaagaatctggagacccctctctgcaaaaatggcttcttgcttgacggctttcctcgcaccgtgcgccaggccgagatgctggatgacctgatggagaagaggaaggaaaaactggacagtgtcatcgaattttccatcccagattcgttactcatcaggcgcatcaccggccgattaatccatcccaagagtggtcggtcttaccatgaagaattcaatccacccaaagaacccatgaaggatgacattaccggcgagccactgattcggcgaagcgatgataacgaaaaggcacttaaaattagactccaagcctaccatacccagacaacacctctgattgaatattataggaagagggggattcattcagcaattgacgcctcacagactccggacgtcgtttttgcctcaatcctcgcagcatttagcaaggctacctgtaaggatctggtgatgtttatctag

SEQ ID NO: 213712 - DNA, 699 bp, Artificial Sequence
  Description of Artificial Sequence: Synthetic coding sequence
atggcccctagcgtacccgctgcggagccggagtaccccaagggtatcagggccgttctcctcggtccacccggtgccggtaaggggacacaggctcctcgcctcgcagaaaacttctgtgtatgtcacctggctaccggcgacatgctccgcgctatggtggcctctggcagtgaactggggaagaagttaaaagcaacaatggacgccggaaaattagttagcgacgaaatggtggtcgaacttatcgaaaagaacctggagaccccactgtgcaaaaacggcttcctgctggatggttttcctcgcactgtgcgacaggccgagatgctggacgacctcatggagaagaggaaggagaaactggatagtgtaatagagtttagtatccctgatagcctgttgattcgaaggattactggccgacttattcacccaaagtctggacgatcttaccatgaggaatttaatccccctaaggagcccatgaaggacgacataacaggtgagccactcattagacgcagtgacgacaacgaaaaagcattgaagatcagactgcaagcataccacacccagactaccccattgattgaatactacaggaaacgaggcatccatagcgccatcgacgccagccagaccccagatgtcgtgttcgcaagcatccttgctgcattctccaaggcgaccagctag

SEQ ID NO: 213713 - DNA, 609 bp, Artificial Sequence
  Description of Artificial Sequence: Synthetic coding sequence
atggcaccttctgtgccagccgctgaacctgagtacccaaagggaatacgtgccgttctcctgggacctcccggagccggaaagggcacccaagctcccagattggctgagaatttttgtgtctgccatcttgctacaggggatatgctccgggctatggtcgcttccgggtcagaattaggcaaaaaactgaaggcaactatggacgccggaaagctggtgtctgatgaaatggtcgtggaactgatcgagaagaacctcgagacacccctgtgcaagaacggattcctcttggacgggttcccccgtacagtgaggcaggccgagatgctggatgacctgatggagaaaagaaaggaaaagctggactcggtgattgagttctcaatcccggacagtctcctgattagacggattactggtaggctgattcatccgaaaagcggacgaagttaccacgaagagttcaacccaccgaaggagcccatgaaggatgatatcaccggagagcccctcatcaggcggagcgtgatcggacaggctaaaaggtcgttcctgcgtctcgccaaaatatcatttgatgtgttgataaagaaggctttagcatag

SEQ ID NO: 213714 - DNA, 474 bp, Artificial Sequence
  Description of Artificial Sequence: Synthetic coding sequence
atgactaggctcgccctacatgaacttaagaatctcacacagtattcttggctgcttgatggctttcctcgaacgttgccgcaggctgaggccctagatagggcatatcagatagatactgtgatcaacttgaacgtgccttttgaagtaataaagcagcggctgactgcaagatggatacacccagcatccggtcgagtgtacaatattgaatttaacccccctaagactgtgggaatcgatgacctcacaggcgagcctctgatacagagagaggatgataaaccagaaaccgtaatcaagagactgaaggcgtacgaagaccaaacaaagccggtgctcgaatattaccagaaaaaaggcgttttggagaccttctctgggacggaaaccaataagatttggccgtacgtctacgccttcctgcaaacaaaagtgcctcagcgcagccagaaagctagcgtgacaccatag

SEQ ID NO: 213715 - DNA, 684 bp, Artificial Sequence
  Description of Artificial Sequence: Synthetic coding sequence
atgggggcttccgccaggctcctacgtgccgtgatcatgggcgctccaggcagcggcaaggggacagtcagtagccgtatcactacccacttcgagctaaagcacctgagcagtggcgatctgctcagggataatatgctacggggtacagagatcggagtactggccaaagcctttatagatcaggggaagctgatccctgacgacgtaatgactagactggcgctacacgagctgaaaaatctgacacagtatagctggttgctcgatgggtttccacggacccttccccaggcagaggctctagacagagcctaccagatcgacactgtaattaaccttaacgtgccattcgaagtgatcaaacagcgattaactgccaggtggatacaccccgcatccggtagggtttacaacattgagttcaatccaccgaagacagtggggattgacgatctcacaggcgagccacttattcaaagggaggacgacaaacctgagactgtaattaaacggttaaaagcctatgaggaccaaactaaacccgttctcgagtactaccaaaagaaaggggtcctggagaccttcagcggcactgagacaaataagatttggccgtacgtatacgcctttttacagaccaaggtgccccagagaagccagaaagcctctgttactccttag

SEQ ID NO: 213716 - DNA, 564 bp, Artificial Sequence
  Description of Artificial Sequence: Synthetic coding sequence
atgggggcttcagcaaggctgcttagggctgtgatcatgggggctccaggatctggcaagggcacggttagcagcaggataaccacccacttcgagctgaaacatctgagcagcggagaccttttacgtgataacatgctgcggggtaccggcttccctagaaccctcccgcaggctgaagccctcgacagggcctaccagatcgatacagtaatcaacctaaacgtacctttcgaggtaattaagcagcgcctgacggccaggtggatccatcccgcaagcgggagagtgtacaatatcgagttcaacccccctaaaactgtcggaattgatgacttgacaggggagcccctaattcagcgtgaggatgataaaccagagaccgtgatcaagcggttgaaggcttacgaggaccagaccaagcctgttctggagtactaccagaagaagggcgttctggaaacctttagtggaacagagactaataaaatttggccgtacgtgtatgcttttcttcagaccaaggtcccacagagatcccagaaagcgtcagtgactccttag

SEQ ID NO: 213717 - DNA, 474 bp, Artificial Sequence
  Description of Artificial Sequence: Synthetic coding sequence
atgacccggctggcccttcacgaactgaagaacctgacccagtacagttggctgctggatggattccctcggactttacctcaagccgaggctctggacagggcttaccagatagacaccgttattaacctgaacgtcccattcgaagtcattaaacagcgtctgacggcaaggtggatccacccggcttcaggaagggtctataacattgaattcaaccccccaaaaacagtcggcatcgacgatttgactggagagccattaattcaacgtgaggatgacaagccagagaccgtgattaagcgactgaaagcttacgaagaccaaactaagccggtcctcgagtattatcagaaaaaaggtgtgttagagactttcagtggtacagaaaccaataagatctggccgtatgtctatgcttttctccagacgaaagtgccacagcgatcccaaaaagcaagtgtcaccccatag

SEQ ID NO: 213718 - DNA, 1611 bp, Artificial Sequence
  Description of Artificial Sequence: Synthetic coding sequence
atgtgttcgaagcccgaagacccggtcgagtatctcgagtcgtgccttcagaaggtcaaggagctggggggatgtgacaaggtaaagtgggatacattcgtgagccaggaaaaaaaaacactgccaccactgaatggcggacagtcaagaaggagcttcctcagaaatgtaatgcctgaaaattctaactttccctaccgtagatacgatagattaccaccaattcaccaattttctatagagtccgacacagatcttagtgagacagctgaactcattgaagaatacgaggtcttcgacccgactcgaccacgccctaaaattatactggttatcgggggtccaggatcaggtaagggaacccaatcactaaagattgcggagcggtatggttttcagtatatctctgttggcgagttgttaagaaagaagattcactctacttcttcaaacaggaagtggtcactcatcgctaagatcatcacgactggcgagcttgcgccacaagagacaacaatcaccgagatcaagcagaaactgatgcagatcccggatgaagaagggatcgtcattgatggattcccccgtgacgtagcacaggctctcagtttcgaggatcagatttgcacccccgatttggtcgtgttcctggcgtgcgccaaccaaaggctcaaagaacggttgctaaagcgggctgaacagcagggcagaccagacgacaacgttaaggccacccaacggcgtctgatgaattttaagcagaacgcagccccacttgtaaaatatttccaggaaaagggtctcatcatgacctttgatgcagatcgggacgaggacgaggtgttttacgacattagcatggcagtggataacaagctgttccctaacaaggaagccgctgcaggatcgtctgacctggacccatctatgattctcgacacaggtgaaatcatcgacaccgggagcgactacgaagaccagggtgacgaccaactgaacgtgtttggtgaggacaccatgggaggcttcatggaagacctacgcaagtgcaagataatatttatcatcgggggtcccggttcaggtaagggcacccagtgcgagaagttagtcgaaaagtacggctttacacacttgagcaccggtgaactgctccgcgaggagctggcttctgagagtgaacgaagcaaactgatacgggatattatggaacggggagatctggtgcctagtgggatcgttttggagcttctcaaggaggcgatggttgccagtctgggagacacaaggggattcttaatcgacgggtaccctagggaagtgaagcagggggaggaattcgggaggcggataggcgacccacagctggtgatctgcatggactgctctgccgataccatgacgaacaggctcctgcagcgatcaagatcgtcattgccagtggatgatacaacaaagacaattgccaagcgtctcgaggcctactaccgggctagtatccctgtcattgcgtactacgaaactaagacacaactccacaaaatcaacgctgagggcacgcctgaggacgtgttccttcagctttgcacggctatcgactctattttttag

SEQ ID NO: 213719 - DNA, 1689 bp, Artificial Sequence
  Description of Artificial Sequence: Synthetic coding sequence
atgaatacaaatgacgcaaaggaatatctcgccagacgtgaaatcccccaactgttcgaaagcctgctgaacggtttgatgtgctctaaaccagaggatccggtcgagtatttggagagctgcctgcagaaagtcaaagaactgggcggatgtgataaagttaaatgggacacatttgtctcacaggaaaaaaagactctgcccccactgaacggaggccagtcgaggagaagctttttgagaaacgtgatgccagagaatagtaacttcccttaccggagatatgatcgtctgccaccaatccaccagttctccattgagtctgacaccgacctgtccgaaaccgcagagctgattgaggagtacgaggtgttcgacccaacaaggcctcggccaaaaatcattctagtcattggcggacccggaagcggcaaagggactcagtcactcaagatcgccgagcggtacgggtttcagtatatttctgtcggcgagctcctgcgcaaaaagatccattctaccagcagtaacagaaagtggtcactaatcgctaagatcattacaaccggagaactcgcaccccaggagacaactatcaccgaaattaaacagaagcttatgcaaatcccagacgaggagggaattgtcatcgatggtttcccccgagacgtggctcaggctcttagcttcgaggaccaaatatgtacgccggacctggtagtcttcttggcctgcgctaaccagcggcttaaggagcgtctactcaagcgggctgagcagcaggggcgaccggacgataacgtgaaggccacacagcggcgtcttatgaacttcaagcagaatgccgctcccctggtaaaatattttcaggaaaaagggcttatcatgactttcgacgctgatcgggacgaagacgaggtgttctacgacatttctatggcagtcgataataaactattcccaaacaaggaggccgcagctgggtcgtcggacctggatcccagtatgattcttgataccggcgaaatcatcgataccggaagtgactacgaagaccagggggacgaccagctgaatgtcttcggcgaggataccatgggagggtttatggaggaccttaggaagtgcaagatcatattcatcatcggtggacccggttccgggaaaggaacacaatgtgaaaaactcgttgagaaatatggattcacacatctatcaaccggcgaactgttgcgcgaagagctggcctcggaatctgagagatcgaaactaatacgggatatcatggaaagaggcgacttggtgccgtcaggtattgtgctagaactgttaaaagaggccatggtcgcctcactcggagatactaggggattcctcatcgacggctacccaagggaagtcaaacaaggcgaggagtttgggcgtcgcattggcgacccacagctcgtgatatgtatggactgcagcgccgataccatgacaaaccgtctcttgcaaaggtcccggtcatcccttcctgtcgacgataccaccaagacgatcgcaaaacgtcttgaggcatattatcgagcctcgatccccgtcatcgcatactacgaaaccaagacccaactgcataagattaatgctgaaggtacccccgaagacgtctttctccagctttgcacagccatagactccatattctag

SEQ ID NO: 213720 - DNA, 531 bp, Artificial Sequence
  Description of Artificial Sequence: Synthetic coding sequence
atgtgctcaaagcctgaagatccagtcgaatatctggagtcgtgcctccaaaaggtgaaagagcttggtggatgcgacaaggtcaaatgggataccttcgtgagtcaggagaagaagactttaccacccctgaatggcggacagagtaggaggagcttcctccgcaatgtcatgcctgagaatagcaacttcccgtaccgtagatatgacagattacccccaatacatcaatttagcatcgagtctgacacagatctgtccgagacagcagagctgattgaagaatacgaagtgttcgaccctactaggcctcggccaaaaatcatcctcgtaattggcggaccaggctccggaaaaggcacacagtcgctgaaaatcgctgaacgttacggattccagtatattagtgtcggcgagctcctgagaaagaaaatacactctaccagcagcaaccgcaagtggtcactgatcgcgaaaatcataaccaccggtgagctggctccccaggagaccaccatcacagaaatctag

SEQ ID NO: 213721 - DNA, 1647 bp, Artificial Sequence
  Description of Artificial Sequence: Synthetic coding sequence
atggccaaattcatgacgcctgtgatacaggataacccttccgggtggggaccctgcgcagtgcccgaacagtttagggatatgccttaccagccattctccaaaggcgataggctgggcaaagtggccgactggacaggcgctacctaccaggataagaggtataccaataagtacagctcgcagttcgggggtgggagtcagtatgcttatttccacgaggaagacgagagctcttttcagctggtggataccgccaggacgcaaaaaaccgcctatcagcgcaacagaatgcgctttgcccaacgaaacctccggagagacaaagaccgcagaaatatgctccagttcaacctgcagattcttcccaagtccgcgaaacagaaagaaagggaaagaatccggctacagaagaaattccaaaaacagttcggggtgcgtcagaaatgggaccagaagagtcagaagccacgggatagtagtgtcgaagtgcgatctgactgggaggtaaaggaggagatggattttcctcagttgatgaaaatgcgctatctggaagtgtccgaaccccaggacatcgaatgctgtggcgctctagagtattatgataaggccttcgaccggattacaacccggagcgagaagccccttaggagcattaagcggatctttcacacggtaacaactacagatgatccagtgattaggaaactcgcaaaaacacaggggaacgtttttgccacggacgcaattctagccactcttatgtcctgcacccgatccgtttatagctgggacattgttgtgcagagggtcgggtcaaagctctttttcgacaaacgggataatagcgactttgaccttctcaccgtctcagaaacagcgaatgaacctcctcaggatgagggaaactcctttaactctccacgcaacctggcaatggaagccacttacattaaccacaatttctcccagcagtgtttgcgaatgggcaaagaacgctacaacttcccaaaccccaacccctttgttgaggatgacatggacaaaaatgaaatagcgtccgttgcatataggtaccgcagatggaagctcggcgatgatatagatctgattgtacgctgcgagcacgatggcgtcatgacaggggctaatggtgaggtttcttttattaacattaagacattgaatgaatgggacagccggcactgcaatggggtagattggaggcagaaactagacagccagcgcggagcggtgatcgccaccgaactgaaaaacaactcatataaattggccagatggacatgttgcgctctcctcgctggaagtgagtacttgaagctcgggtatgtttccaggtatcacgtgaaagactcttcacgccacgtgatactcggaacccaacagtttaaacctaatgagttcgcatcacagattaacctgagtgtagagaacgcgtggggcattttgaggtgcgtaatcgatatatgcatgaagctcgaggagggcaaatacctgatacttaaagaccccaataaacaggtcatcagggtgtacagcttacccgacggaacgttcagctccgatgaagacgaggaggaagaagaggaggaagaggaggaggaagaggaggaggagacgtag

SEQ ID NO: 213722 - DNA, 1278 bp, Artificial Sequence
  Description of Artificial Sequence: Synthetic coding sequence
atggctgctggaggcgatcatggatcccccgattcctatcgcagccctttagcatctcgttacgcctcgcccgagatgtgttttgttttttcagatcgatacaagtttcgcacttggaggcagctgtggctctggcttgctgaggccgaacagaccctgggattgccgatcactgatgagcagattcaggagatgaaatcaaacctggaaaacatcgactttaagatggcagctgaggaagaaaaacggctccgacacgacgtcatggcacatgtgcatacgttcggccactgctgccccaaagcagcaggcatcatacatttgggagcaaccagctgttacgtgggggacaacactgacttgattattctgcggaatgcactggatttgctcctcccaaagttagcaagagttatttccaggctggctgattttgccaaagaacgggcttccctgcctaccctcggctttacacactttcagccggctcagcttactactgttggcaagcgctgctgtctgtggatccaggatctttgcatggacttgcaaaacctaaagagagttcgggacgatctaaggtttcggggtgtcaaggggacaaccggaacccaggcatccttccttcagctctttgagggcgatgatcacaaggtggagcagctcgataaaatggtgacggagaaagccggattcaaacgggcattcataataaccggacagacatatacaaggaaagtagatattgaagtactgagcgtacttgcaagccttggggctagtgtgcataagatttgcaccgacatccggcttctggccaatctcaaagagatggaggagccattcgagaagcagcaaattggcagcagtgcaatgccctataaacggaaccctatgaggtctgaaagatgttgttcactcgccaggcatcttatgaccctagtaatggaccccttgcagaccgcatctgtgcaatggtttgaacgaacgttggatgactcagccaacaggcggatttgtctggccgaggccttcctgactgcggataccattctcaacacactccagaatattagcgaaggcctggttgtgtatccgaaggttatcgaaagacggatccggcaagagctgccctttatggcaaccgagaacatcattatggccatggtaaaagcgggaggcagcagacaagttcagcgctttttggaggaggaagtgtaccctctgcttaagccgtatgaatcagtgatgaaagtgaaggctgagctgtgtttatag

SEQ ID NO: 213723 - DNA, 1497 bp, Artificial Sequence
  Description of Artificial Sequence: Synthetic coding sequence
atggccgctggcggtgatcacgggtcccccgacagctaccgaagtccgttggcctcacggtacgcatcccctgaaatgtgtttcgtgttttccgatcgctataagtttcgtacctggcgacaactctggctgtggctcgctgaggccgaacagaccttgggtctgcccataacagacgaacagatccaggagatgaaaagtaatcttgagaatatcgactttaagatggcagcagaggaggaaaaaagattgagacatgacgtgatggctcacgtgcacacatttggccactgctgcccaaaggccgcaggcattatccacctgggcgctacgagttgttacgtgggggacaatacgtctctgattctttccaggggtgtaatcaaagcgtactgtaacttaagacttcctgggtccgacagcagtcctgtttccgtctctcagttggccagagtgatcagtaggctagctgatttcgccaaggagagagcctcgcttcctactttaggttttacccattttcaacctgctcagctgaccaccgtcggaaaaagatgctgcctctggatccaggatctatgcatggatctgcagaacttaaagcgcgtgagggacgatctcagatttaggggggtcaaaggcaccaccgggactcaggcaagctttctgcagctgtttgaaggagacgatcacaaagtggaacagctggacaagatggtgaccgaaaaagctggcttcaagcgcgcattcatcatcactggccaaacttacacccgaaaggtggatattgaggtcctgtcagtcctggcctctctaggcgcttcagtgcacaaaatttgcacagatataaggctgttagcaaacctgaaggaaatggaagaaccattcgagaaacagcaaattggatcctctgccatgccatataagagaaatcccatgcgctctgaaagatgctgcagccttgccagacatcttatgacacttgtcatggatcctctgcagacagcatccgtccaatggttcgaaaggacacttgacgacagcgctaaccggagaatctgcttagctgaagctttcctgaccgcagacactatccttaatactttacagaacattagcgagggtcttgtggtataccctaaggtaatcgagagaagaatccgacaagaactaccattcatggccacagagaacatcattatggccatggtcaaggctgggggttcaagacaggactgccacgaaaagatacgcgtgctgagtcagcaggccgcttcagttgtaaagcaagaggggggtgataatgatctgatcgagagaatccaggtggacgcttatttctctccgatccattcccaactggatcacctgcttgaccccagctcgtttacagggcgagcgagccagcaggtgcagcgttttctggaagaggaggtgtaccccctgctgaaaccgtatgagagcgtcatgaaagttaaggctgaactgtgtctgtag

SEQ ID NO: 213724 - DNA, 915 bp, Artificial Sequence
  Description of Artificial Sequence: Synthetic coding sequence
atggacctgcagaacctgaaaagagtgcgggatgatcttaggtttcgtggagtcaaaggaaccacaggcacacaggcttcttttcttcagctcttcgagggagacgaccacaaggtcgagcaattggacaagatggttacggaaaaggcaggcttcaagcgggcattcatcattaccggacagacctacacaagaaaggtcgatatagaggtgctatctgtgctcgcctccctgggggcttccgttcataaaatctgcaccgacatcagactcttggctaacctgaaggagatggaggaacccttcgagaaacagcagattggtagctcagcaatgccttataagaggaatccaatgcggagcgagaggtgctgtagtctcgctcgccacctgatgactctagtgatggatcccctgcagaccgcatctgtgcagtggttcgagagaaccctggacgacagcgcaaataggagaatttgcctggccgaagcttttctgaccgctgacacaattctgaacaccctgcaaaacattagcgaaggtttggttgtttacccaaaagtcattgagcgtaggatccggcaggagcttccatttatggcaaccgaaaatatcattatggcaatggtgaaagcaggcggatcccgccaggactgccatgagaagattagggtgctgagtcaacaggcagccagcgtggtgaaacaggaggggggtgataacgacctgatagaaagaatacaagtcgacgcctacttttcaccaattcactcacaattggatcatctgctggacccttcaagttttaccggcagagcgtcacagcaggtccaacgcttcctggaggaggaagtctaccctttgctgaagccttacgagtctgttatgaaggtgaaggcagagctctgtctgtag

SEQ ID NO: 213725 - DNA, 384 bp, Artificial Sequence
  Description of Artificial Sequence: Synthetic coding sequence
atggccgcagggggagaccacggaagcccagatagctacagaagccccctcgctagccgctatgcctcgcctgagatgtgtttcgttttttccgataggtacaagttccggacttggaggcagctgtggctgtggctcgctgaggccgagcagacactagggctccctatcaccgatgaacaaatccaagagatgaaatccaacctggagaatattgacttcaagatggcagccgaggaggaaaaaagactgcgtcatgacgtaatggcccacgtccacacatttgggcactgctgcccaaaggccgctggcattatccatctgggcgctacctcatgttacgtgggcgacaacaccgtcggagcctgcgtggtgtacacatag

SEQ ID NO: 213726 - DNA, 1371 bp, Artificial Sequence
  Description of Artificial Sequence: Synthetic coding sequence
atggcgtttgctgaaacataccccgcagcttcctcactgccaaacggtgactgcggacgaccccgagctcgaccaggtggaaatagggtgacagttgtcctaggcgctcagtggggtgacgaggggaagggcaaagtcgtggatctgctcgcacaagatgccgacatcgtctgtcgctgtcaaggaggcaataatgccggacatacagtggttgtggattccgtagagtatgactttcacctgctgccgtccggtattatcaaccctaacgtgaccgctttcatcggaaatggggtcgtcattcatctgccaggactgtttgaagaggctgagaaaaacgtccaaaaaggcaagggactggagggctgggaaaagaggcttattatttctgatcgggctcacattgtgttcgactttcaccaagcagcggatggaatccaggagcagcagcggcaagaacaggccggtaagaatctgggtactacaaaaaagggcatcggtcccgtatactcatctaaagctgccaggtcggggctgcggatgtgcgacctggtgtctgattttgatggatttagtgagcggtttaaggtactcgccaatcagtataagtcaatttaccccacattggaaatcgatatagagggtgagctgcaaaaactgaagggctatatggagaaaatcaagccaatggtgcgggatggcgtctatttcctttacgaggcccttcacggaccccctaagaagattctagtcgagggcgcaaacgctgcactgctcgatatagactttggcacgtaccccttcgtgacctcatcgaattgcaccgtgggcggagtgtgtacaggccttggcatgcctccgcagaatgtgggggaagtgtatggtgtggttaaagcctataccacccgcgtagggattggtgcattccctactgagcaggacaatgagattggcgagctgctccagaccagagggagggagttcggcgtaaccacggggcgaaagcgccgatgcggctggttggacctcgttcttctgaaatatgcacatatgattaacgggtttacggcactcgcactcaccaagcttgatattctcgacatgtttacggaaattaaggttggggtggcctacaagctcgatggggaaattatacctcacatccccgctaaccaggaggtactaaataaagttgaagtccaatataagaccctccccggttggaatacagacatctccaatgctcgggcttttaaggaactaccagtgaatgcccaaaactacgtgcggttcattgaagatgaacttcaaatccctgtgaaatggattggagtaggcaaatcccgcgagagtatgatccagctcttctag

SEQ ID NO: 213727 - DNA, 1308 bp, Artificial Sequence
  Description of Artificial Sequence: Synthetic coding sequence
atggctttcgcagaaacttacccagccgctagctctttgccaaatggtgattgcgatgagggcaaagggaaggtggtggacctcctggcacaggacgctgacatcgtatgcaggtgccaggggggaaataacgcagggcacacagtagttgtggactcagtcgaatacgactttcatttactgccctcaggcattatcaaccccaacgttactgccttcattggaaatggggtcgtgatacacctacccggtttgtttgaggaggcggagaaaaatgtgcagaaagggaagggtctcgaggggtgggagaagagactaattattagtgaccgcgcacacatcgtgtttgactttcaccaagcagctgatgggatacaagagcagcaaagacaggagcaagccggaaaaaatttaggaaccaccaagaaagggataggacctgtgtactctagtaaggctgcgagatccggactgaggatgtgcgatttggtttcggattttgacggattcagtgagcgattcaaggtgcttgccaaccagtacaagtctatttacccaacactcgaaatcgacatagagggtgaactgcagaagcttaagggttacatggagaaaattaaacctatggtgcgagacggggtgtattttttgtacgaagcattacacgggccacctaaaaaaatccttgtcgaaggcgctaatgctgccctcctcgacattgattttggcacctacccctttgtgacttcatccaactgtaccgtgggcggagtgtgcaccggcctcggaatgccccctcagaacgtgggcgaagtgtatggggttgtcaaagcttacacaactcgagtgggaatcggtgccttccccacggaacaggacaacgagatcggagagctgttacagacacgaggccgagaatttggggtgacaacgggacggaaacggagatgtggatggctcgacttagtactattaaagtatgcacatatgattaatggattcaccgcgttggctctgaccaaactggatatcctggatatgtttaccgagattaaagttggtgtggcctacaaacttgacggcgaaatcatcccccacattcctgctaaccaggaagtattgaataaggtggaagtgcagtacaaaacacttcctggttggaacaccgatatctctaacgccagagcattcaaggagctgcccgtcaacgcacaaaattacgtgagattcattgaggatgagctgcagatccccgtgaaatggatcggcgtgggcaagagtcgcgagtcaatgatccaactcttttag

SEQ ID NO: 213728 - DNA, 1236 bp, Artificial Sequence
  Description of Artificial Sequence: Synthetic coding sequence
atgtggattcaacaactgttagggctgtccagcatgtccattcgatggcctgggagacctctgggaagtcacgcttggattctcattgccatgtttcagctggcagtagatctgcccgcatgcgaggcactggggcctgggccagaattttggctgctgcctcgaagtccgcctaggccaccacggctgtggagtttcagatcagggcagcccgcacgggtgcccgctccggtctggtctcctcgaccaccaagggtagaacggattcatgggcagatgcaaatgccgcgagctagaagggcccaccggcctcgcgatcaagccgcagccctggtgccaaaggctggactggcgaagcccccagcagcagcaaaaagttcgccatccttggcctctagttccagttcttccagttctgctgttgcgggaggcgctccggaacagcaggcccttctgaggcgcggaaagcgacacctgcaaggggatgggttgtcctcatttgattcaaggggaagtagaccaactaccgagactgagtttattgcttggggccctactggggacgaggaggccctggagagcaacacatttccgggagtatacgggcctaccacggtgtccatcctgcagacacgcaaaaccactgttgctgctactaccacaaccaccactaccgccaccccaatgacacttcagactaaaggtttcactgaatcacttgatccaagacgcagaatacctggcggtgtgagcacaaccgagccatccaccagtccgagcaataacggcgaagttacccagccgccacgcatccttggggaggcaagtggactggcggtgcaccaaatcatcactattaccgtgagtctgatcatggttattgcagccctgattaccaccttggttctgaagaactgctgcgcccagtctggaaacacacggagaaactcccatcagaggaagaccaatcaacaagaggaatcttgccagaatttaacagattttccgagcgctcgggtaccgagctcattggacatcttcaccgcttacaacgagacccttcagtgcagccacgagtgtgtgagggcgagcgttcctgtgtacacagacgagactcttcattccacaacgggcgagtacaagagcacctttaatgggaaccgtccatcgtcatctgacagacacctaatcccggtggcgttcgttagcgaaaagtggttcgaaataagttgttag

SEQ ID NO: 213729 - DNA, 1236 bp, Artificial Sequence
  Description of Artificial Sequence: Synthetic coding sequence
atgtggatccaacagcttctcggtctttctagcatgagcatccgctggcccggacgtcccctgggcagccatgcttggattctcattgcaatgttccaactggccgtggatctgcctgcctgcgaggcattggggccaggcccagagttctggttgctccctaggtctcctccacggccaccccgactctggtcttttaggtcaggacagcctgctcgcgtccccgctcccgtgtggagtcccaggcctccccgagtcgaaagaatccatggacagatgcagatgccaagagcgagaagggcccatagaccccgagatcaagccgctgccctcgtcccaaaagcaggattagcgaaacctccggctgccgcaaaatcatctccctctctggcaagctcaagtagttctagcagttcagcagttgccggtggggctcctgaacagcaggctctgctccgtagaggtaaaagacatctgcagggcgatggacttagttctttcgatagccgaggcagcaggccaacaacagagacagaatttattgcatggggcccaaccggagacgaagaggctctggagagcaatactttcccaggcgtgtatgggccaactacagttagtatactccagacccggaaaactacagtggccgcaacaacaacgactacaaccacagccacccccatgacactgcagacgaagggatttactgagtcgctcgaccctaggaggcggatacctggaggagtaagcacaaccgagccatccaccagcccatctaacaacggggaggttacacagccacctaggattctgggggaggcgtctggcctcgccgtccaccagattattacaatcacagtttcccttataatggtgatcgcagcactcattactactctcgtactgaagaattgttgtgctcagtctgggaatacccgacggaactcccatcagaggaaaaccaaccagcaggaggagagttgccaaaatctgacggactttcctagtgcacgggtgcctagcagcctggacatttttacagcttacaatgaaaccctccagtgttcccatgagtgtgtgcgagcgagtgtgccagtatacacagatgagacccttcatagtactacaggagagtacaaatctacctttaacggcaataggccttcctccagcgaccgacacctaatcccagtggcctttgtgtcggagaagtggtttgagatcagctgttag

SEQ ID NO: 213730 - DNA, 1155 bp, Artificial Sequence
  Description of Artificial Sequence: Synthetic coding sequence
atggtctctggtgactattcgctgggcctcaatgacctgaatgtcagccctcccgagctcacagtgcatgtgggagattcagcgcttatggggtgcgtgttccagtcaaccgaggacaaatgcatcttcaaaatcgactggaccttatctccaggggagcacgcaaaggacgagtatgtcctgtactattacagtaatctgtcagtccccataggacgcttccagaatcgagtgcacctaatgggcgacattctttgcaatgacggctctttgctactgcaggatgtgcaggaggcagatcagggtacgtacatctgcgaaatacggctgaaaggagagtcccaggtctttaaaaaagctgtggtgttgcatgtactgcccgaggagccaaaagaactgatggttcacgtaggaggcctgatccagatgggctgcgtgttccagagcactgaggttaagcacgttacgaaagtggagtggatctttagcggcagaagagcaaaggaggaaatcgttttccgttactaccataaactccgcatgtccgtcgagtacagccagtcatgggggcatttccagaacagggtgaatctcgtgggagatatttttcgcaacgacggatccatcatgcttcagggcgttagagaaagcgatggcggaaattatacctgctccatccacctgggaaacttggtgtttaagaagaccatcgtgctccatgtgtcccccgaggaacccaggactctagttaccccagcggcactgagacccctcgtgctgggaggcaatcaactggtgattatcgtggggattgtatgcgctaccatccttctgctgcctgtgctgattctgattgtcaagaaaacctgcggaaacaaatccagtgtgaatagtaccgttctcgttaaaaatacaaaaaagaccaaccccgagattaaggagaagccttgtcattttgagcggtgcgagggggagaagcacatctatagtcccattattgtgcgggaagtgatcgaggaagaggagccgtcagagaaatctgaggcaacctatatgacaatgcaccctgtctggccctcactccgatctgatcgaaacaatagtctcgagaaaaaaagcggcggagggatgccaaagactcagcaggctttctag

SEQ ID NO: 213731 - DNA, 1185 bp, Artificial Sequence
  Description of Artificial Sequence: Synthetic coding sequence
atgttttgccccctgaagctgatactgctgcctgtgctcctggactactcgttagggttaaatgatctcaatgtatccccaccagaattaaccgtccatgtgggcgactcagcactcatgggttgtgtttttcagtcaactgaagataagtgtattttcaagatcgactggaccctctcccccggagagcatgctaaagatgagtatgtgctttactattattcaaatctctccgtccctattggtcgatttcagaatcgggttcatttaatgggtgacatcctgtgcaacgatggtagcctgctcctacaggacgtgcaggaggcggaccaaggcacctatatctgtgagattaggctcaaaggtgagtctcaggtgttcaaaaaagctgtggttctacacgttttgccagaggagcctaaggaactcatggtccacgtaggtgggctgatccagatgggatgcgtgtttcagagcaccgaggtgaaacatgtcaccaaagtcgaatggatcttttctggcagaagggccaaggaagaaatagtgttcaggtactatcacaaattgcggatgagcgtggaatactcccagagttggggtcattttcagaatcgagtcaatctggtgggtgacatttttcggaacgacggcagcattatgctgcagggggtgcgggaatcggatggcggaaactacacttgttctatccacttgggcaatctcgtgttcaagaaaaccatcgtgctgcacgtaagccccgaagaacccaggaccctggtcacccctgctgcattgagaccgctggtgctaggaggcaatcagctggtgattatcgtcggtatcgtgtgcgctactatccttctattgcccgtactaattctgatcgttaagaaaacatgtggtaataaaagctccgttaactctacggtgctggtgaagaacactaaaaaaactaatccagaaatcaaagaaaagccatgtcatttcgagcgatgtgagggagagaagcacatctatagtccaattattgttcgtgaggtcatcgaggaggaggagccaagcgaaaagagcgaggcaacctatatgaccatgcatccagtttggccctcccttcgcagcgatagaaataactccctagagaaaaaaagcggaggtggtatgcctaaaacacagcaggctttttag

SEQ ID NO: 213732 - DNA, 468 bp, Artificial Sequence
  Description of Artificial Sequence: Synthetic coding sequence
atgttctgccctctgaagttaatattacttcctgtgcttctcgactatagtttaggtctgaacgatcttaatgtctcaccccctgagcttaccgtgcatgtgggggactctgcccttatgggttgcgtgttccagagtaccgaggacaaatgcattttcaagatcgattggacactgtcgcccggtgaacacgctaaggatgagtacgtgctctactactattcaaacctttccgtcccgatcggcaggttccagaatcgtgtgcacctcatgggcgacatcctctgcaatgatggctctcttttgttgcaggatgtccaggaggccgatcagggcacctacatctgcgagattagactcaagggcgagtcacaggtcttcaaaaaagccgtggtactgcacgtcctcccggaggagccaaaagaacttatggtgcacgtgggaggcctgattcagatgggctgctag

SEQ ID NO: 213733 - DNA, 663 bp, Artificial Sequence
  Description of Artificial Sequence: Synthetic coding sequence
atggggtgtgtgttccagtctactgaagacaagtgcatctttaagatcgactggacattatcaccaggcgagcacgccaaggatgagtatgtcctgtattattactcgaatctcagtgtgccaatcgggcgattccagaatcgtgtccacctgatgggagatatcctttgcaatgacggaagcctattgctgcaggacgtgcaggaggctgatcagggaacttacatctgcgagataaggttgaagggcgagagccaggttttcaagaaggcagtggtgctccatgtgctgcccgaagagccaaaagagctgatggtgcatgtcggcggactgattcagatggggtgtgtcttccagtcgacagaagtcaagcacgttactaaggttgagtggatatttagcggcaggagagcaaaggaggagattgtgttccgctactaccacaaactccgaatgtccgtggaatactcacaaagctggggccacttccagaatagggttaatctagttggagacatctttagaaacgacggttcaatcatgctgcagggcgtaagagagtcagacggaggcaactacacatgcagcattcacttaggtaatcttgtcttcaagaagactattgtgctgcacgttagcccagaagagcctagaaaatggtag

SEQ ID NO: 213734 - DNA, 1128 bp, Artificial Sequence
  Description of Artificial Sequence: Synthetic coding sequence
atgtcctcccataagggatcggtcgtggcacaaggaaatggggctccagcaagcaatagagaagccgatactgtcgagctggcagagctgggcccattattggaggagaagggcaagagggtcatcgcaaacccccctaaggctgaggaggagcagacttgtcctgtgccccaggaagaagaagaggaagtgcgcgtattgaccttgcccctacaagcacaccacgcgatggagaaaatggaggagttcgtctacaaggtttgggaaggacggtggagggtgattccttacgatgtgctgccggattggctaaaggataatgactacctcttacacggccaccgccctcccatgccctcgttcagagcttgctttaaatcaatctttcgtatccataccgagacggggaatatctggacgcaccttctcggctttgtgctcttccttttcttgggcattctgacaatgctgcggccaaacatgtacttcatggccccattacaggaaaaagtggtgttcggcatgtttttcctgggagcagttctgtgcttgtcattttcctggctcttccacactgtctattgtcactctgagaaggtctctagaaccttttccaaactggactatagtggcatcgccttattgatcatgggttcattcgtcccatggctctattatagcttctattgttctcctcaaccaaggcttatttatttaagtatcgtgtgcgttctgggtatcagtgctattattgtcgcacagtgggatcgcttcgccactcccaaacaccgccagacacgcgcaggagtgttcttgggtctaggcttaagcggagtggtgccaaccatgcacttcacaatcgcagaaggcttcgtcaaggctactacagtgggccagatggggtggttttttttgatggcggttatgtacataacaggggcaggcctgtatgcagcccgtatccctgagcgatttttcccgggaaaatttgatatctggttccagagtcatcagatcttccatgtgctggtggtcgcagcagccttcgtacatttttacggtgtgtccaatctgcaggaattccggtacgggctggaggggggttgcaccgacgacaccctcttgtag

SEQ ID NO: 213735 - DNA, 516 bp, Artificial Sequence
  Description of Artificial Sequence: Synthetic coding sequence
atgagttcccacaaaggtagtgtggtcgctcagggcaacggcgcacccgcttctaacagggaagccgataccgttgagctggccgagcttggaccattgcttgaggagaaggggaagagggtaattgccaacccaccgaaggcggaggaggagcagacatgcccggtgccccaggaggaggaagaagaggtccgcgtccttacactgccactgcaagctcatcacgccatggagaagatggaagaatttgtgtacaaagtctgggaggggaggtggcgggtcatcccttacgacgtattgcctgactggctcaaagataatgactatctgctgcacgggcaccgccctcccatgcccagttttcgcgcttgctttaagagtatctttagaatccataccgagaccgggaacatctggactcacctgctcgctactgcccacctcccactgcatagactctgtccgggacacttctgtcatcattgtggggctgtgggtccagtgtgtcatagctag

SEQ ID NO: 213736 - DNA, 801 bp, Artificial Sequence
  Description of Artificial Sequence: Synthetic coding sequence
atgtcttcccacaaagggagcgttgtggcgcaaggaaacggcgctcccgcaagtaacagagaagccgacacagtggaacttgcagaactgggcccattacttgaggaaaaagggaagcgtgtgatcgccaaccccccaaaggctgaggaagagcaaacctgcccagtcccccaggaagaagaggaggaagtgagagtcctaactctgcctctccaagcacaccatgccatggagaagatggaggagtttgtgtacaaggtatgggagggtcgctggagagtgatcccatacgatgtgctcccagactggctcaaagacaatgattacctcctccacggccacaggccgcctatgccctcgttccgcgcttgtttcaagagcattttccgtatccacactgagactggaaatatctggacacacctgctcggctttgttctcttcctgtttttggggatcctgaccatgctgcgccctaacatgtatttcatggcgccactgcaggagaaagttgtgttcggcatgtttttcttaggtgctgtattgtgcctatcattcagctggctgttccacaccgtgtactgtcactctgagaaagtcagtcgcactttcagtaaactagattattccggaatcgcactgctgataatgggatccttcgtcccatggctgtattattctttctactgtagccctcagccgaggctaatctatctcagtatcgtgtgcgtactgggcatatccgcaatcatcgtggctcagtgggacagatttgctactcccaaacatagacagacgtag

SEQ ID NO: 213737 - DNA, 618 bp, Artificial Sequence
  Description of Artificial Sequence: Synthetic coding sequence
atgagctcccacaaaggctctgttgtggcccagggaaatggcgcaccagccagcaaccgggaggccgacaccgtggagttggctgagctgggcccactgctggaagagaaaggaaagcgtgtgatcgctaatccacctaaagcggaagaggagcagacctgtcccgttcctcaagaagaggaggaagaggtgagggtgctcaccttaccgctccaggctcatcacgccatggagaagatggaagaatttgtctacaaggtgtgggagggcagatggcgcgtgattccttatgacgtattgcccgattggctgaaagacaacgactaccttcttcatgggcataggcctcccatgccttccttccgcgcatgctttaaatctatattccgtattcatacagagactggcaacatctggacccatctgctgggttttgtcttattcctattcctagggattcttacaatgctgaggcccaacatgtatttcatggctcccctgcaggaaaaggtggtctttggaatgttttttctcggagctgttttatgcctttccttcagctggcttttccatactgtgtactgtcattcagagaaagtctctcggactttctcctag

SEQ ID NO: 213738 - DNA, 1128 bp, Artificial Sequence
  Description of Artificial Sequence: Synthetic coding sequence
atgagctcccacaagggaagcgtggtggcccaaggcaacggggcaccggcttccaatcgagaagctgacactgtcgagctcgcagaattggggcctttgctggaagagaaagggaagcgggtgattgctaacccaccaaaagcagaagaagagcagacttgccccgtgccccaggaagaagaggaagaggtgcgagttcttaccttgcctctacaggctcaccacgccatggaaaaaatggaagagtttgtatataaagtttgggaggggcgatggagagttattccttacgacgtcctgcctgactggctgaaagataacgactacctcctccatggccatcgccctccgatgccttcattccgtgcctgtttcaaatctattttcagaattcacacagaaaccggaaacatctggacccacttgctcggtttcgttctgtttctcttcttgggtatcctgaccatgcttaggccgaacatgtatttcatggccccactccaggagaaagtcgtgttcggtatgttctttcttggggctgtgctgtgtctctctttcagctggctgtttcacacagtgtattgccacagcgagaaggtgtccagaaccttttctaaactcgactactctggtatcgccctactcattatgggtagctttgtgccctggctgtattactcattctactgttcacctcagccgagactgatctaccttagtatcgtatgcgtgctgggtataagtgcaatcatagtggcccagtgggaccgctttgcaacaccaaaacacagacagacgagggccggtgtcttcctggggctcgggctctcaggagtggtgccgactatgcacttcacaatcgcagaggggttcgttaaggcaacaacagtcggtcagatggggtggttttttttaatggctgtcatgtatattaccggcgcaggcctatatgcggcaaggatccctgagagattttttccgggaaaattcgacatttggtttcagagccatcagatctttcacgtgctcgtcgtcgccgctgcctttgtgcatttctatggagtgagcaaccttcaggagtttcggtatgggctggaaggcggatgtacagacgacacactgttgtag

SEQ ID NO: 213739 - DNA, 1161 bp, Artificial Sequence
  Description of Artificial Sequence: Synthetic coding sequence
atgaacgaacccacagaaaatagattgggctgtagcaggacaccggaacccgacattcggctcagaaaaggacatcaactggacggtacacgcaggggtgataacgattctcatcagggtgacctagagccaattctcgaagctagcgttctgagcagtcaccacaagaaaagctctgaggaacacgagtactccgacgaggcaccccaggaggatgaaggcttcatggggatgtcccctcttctacaggcccatcacgctatggagaagatggaggaattcgtctgcaaagtgtgggaagggcgttggagggtgatcccccatgacgtactaccagactggttgaaggacaatgactttttgctccacggccatcgccctcccatgccatcttttcgcgcatgcttcaagagtatctttcgaattcacaccgagaccggaaatatttggactcacctcctggggtgcgtgtttttcctatgtttgggaattttctacatgttccgacccaacatttcctttgtggctcctctccaggagaaggtggtgttcggcctgttcttcctcggagctattctgtgcctgtccttctcctggctttttcacactgtctattgccactcagaaggcgtgtcccgactcttttctaagctcgactactctggaattgccctcctgatcatgggctcttttgtgccctggctctactatagtttctactgtaatccccagccatgcttcatctacctcatcgttatctgcgtcctgggaattgccgctattatcgtgtcacagtgggatatgttcgctactcctcagtacaggggcgtccgcgcaggggttttcttgggcctggggttaagcggcattattcccaccttgcattacgtcatatccgaaggctttctgaaggccgcaactattggccagattggctggcttatgctgatggcaagtctgtacattacaggggctgccctgtatgcagccagaattccggagcgattcttcccaggcaagtgtgacatatggttccatagtcaccagctctttcatattttcgtagttgcaggagcctttgtccactttcacggcgtaagtaatttacaggagttcaggtttatgatcggcggaggctgttccgaagaggacgccctgtag

SEQ ID NO: 213740 - DNA, 735 bp, Artificial Sequence
  Description of Artificial Sequence: Synthetic coding sequence
atgcttctcctgggagccgtcctactgctcctggccctaccaggccatgatcaggagacgaccacacaggggcctggagtgctgcttcctctgcccaagggtgcgtgcaccggatggatggccggaatccccggtcaccccggacataatggagcccctgggagggacgggagggacgggaccccaggggaaaagggcgaaaagggggacccaggcctgattggccctaaaggtgatattggagagacgggggtgcccggagcggagggaccaagaggattccctggaatacagggcaggaagggcgagcctggggagggcgcttacgtttaccggtccgccttcagtgtagggctggagacctacgtgacaatccccaacatgccaatccggtttacgaaaattttctacaatcaacagaaccactatgatgggtccactgggaaattccattgcaacattcctggtttatattacttcgcatatcatatcacggtgtacatgaaggacgttaaggtgagcctttttaagaaagacaaagccatgctctttacctacgaccagtatcaggagaataatgtagaccaagcctctggatcagtacttctgcatctcgaagtgggcgaccaagtgtggttgcaagtgtatggagaaggcgagaggaacggtttgtatgcagacaatgataatgactcaacgttcactggcttcctcctttaccatgatacgaactag

SEQ ID NO: 213741 - DNA, 735 bp, Artificial Sequence
  Description of Artificial Sequence: Synthetic coding sequence
atgctgctccttggggctgtcctcctcctccttgcattaccagggcacgaccaggagacaacgacccagggccctggggtgctgctcccactgccgaaaggcgcttgtaccggatggatggccggaatccccggacaccctgggcacaacggggctcccggacgggatggtcgagacggtacaccaggtgagaagggcgaaaagggagatcccggactcatcgggccaaaaggggacatcggcgagaccggagtcccaggggctgaaggcccacgcggtttccccggaatccagggcagaaagggggagcctggggaaggtgcatacgtttatcggtcggctttcagcgtgggtttggagacatatgttacaatccctaacatgcccatacgctttaccaagattttctataatcagcaaaaccactacgacggcagcacgggcaaattccactgcaacattccgggtctctactacttcgcctatcacattacagtctatatgaaggatgtgaaggtgagcttattcaaaaaggataaagctatgctgtttacctatgatcagtaccaggagaacaatgtggatcaggccagcggcagtgttctactgcacttggaggtgggcgaccaggtctggctccaggtatacggagagggagaaaggaacggtttgtacgcagacaatgacaatgattctacattcactggattcctactctaccacgatactaactag

SEQ ID NO: 213742 - DNA, 735 bp, Artificial Sequence
  Description of Artificial Sequence: Synthetic coding sequence
atgctcctcctgggcgcagtattactgttgctggccctgccaggccacgaccaggagacgactacccagggccctggcgtgctgctaccactccccaaaggtgcttgtaccggctggatggcaggcatccctggtcacccaggacataacggggctccaggcagagatggaagagacggtaccccaggcgagaagggggagaaaggggacccaggcttgataggtcctaaaggggatatcggcgagaccggggtccccggagcggagggtcctaggggattcccgggtatacagggaaggaagggcgagcctggagaaggggcatatgtatatcgctctgctttcagcgtgggacttgaaacgtacgttaccatccccaacatgccaatcagattcacaaagattttttacaaccagcaaaaccattacgatggctctactgggaaatttcattgtaatattccgggactctactattttgcgtaccatataacagtgtacatgaaggatgtaaaagtgagcctgttcaagaaggacaaggccatgctgtttacctacgaccagtatcaagagaataacgttgaccaggcatcgggctcagtgctactgcatctcgaggtcggggaccaggtgtggctccaagtgtacggagaaggggaacggaatggtctttacgcggacaacgacaatgacagcacatttactgggtttctgctatatcatgacacaaactag

SEQ ID NO: 213743 - DNA, 1491 bp, Artificial Sequence
  Description of Artificial Sequence: Synthetic coding sequence
atggctctctggaggggttctgcgtatgcaggtttcttagccttggccgtcggctgtgtctttttgctcgagcctgaacttcccggatctgcactcagaagcctttggagttcactgtgtctgggcccagcaccggctcccccagggcctgtctctcccgaaggcagactcgctgccgcatgggacgcactgatcgtgcgtcccgttcggcgttggagaagagtggccgtgggcgtgaatgcttgcgtggatgtcgtactctctggggtgaagctgctgcaggctctgggactgtcccctggaaacgggaaagaccactccatcttacactctcggaacgaccttgaggaagccttcatccacttcatgggcaagggcgctgctgccgagcgattcttcagtgataaggagaccttccacgatattgcacaggtggctagcgagttcccgggagctcagcactacgtgggtggtaacgctgcacttattgggcaaaagtttgcggctaattctgatctcaaagttctactgtgtggtccagtcggccctaagcttcacgaattgttggatgataacgtctttgtcccaccggaatcactgcaagaggtggatgagtttcaccttattctggaataccaggccggtgaggaatggggtcagttgaaggcaccgcacgccaatagattcatctttagtcatgatctctccaacggtgccatgaacatgcttgaggtgttcgtcagctccctcgaagagtttcagcctgatttggtcgtgttgtccgggttacatatgatggaaggccagagtaaagagttgcagagaaaaagactgctcgaggtcgtcacctccatcagcgacatcccaacaggcatccctgtgcatctggaactcgctagtatgaccaatcgcgagcttatgagttccattgtacatcaagtgttcccggctgtgacttctctggggctgaacgaacaggaactgctgtttctaacgcagtccgcaagtggtccccacagttccctgtcatcatggaatggcgttccggacgtcggcatggtgagcgatattctgttttggatcctgaaggaacacggacgctccaaaagccgggcatcagatctcacgcgcatacatttccacaccctggtttatcacatccttgccaccgtggatgggcactgggccaaccagctggcagccgtggcagcgggtgcacgcgttgctggtacacaggcctgtgcaactgagaccattgacacatccagagtgagcctgagagcaccacaagaattcatgaccagccactctgaagcaggtagtagaatcgtgctaaatccaaacaaaccagttgtggaatggcatagagagggcatatcctttcacttcacaccagtgttggtttgtaaggacccaattcgaaccgtcgggttaggggatgctatttctgccgaaggcctcttctatagcgaggttcacccccactactag

SEQ ID NO: 213744 - DNA, 1041 bp, Artificial Sequence
  Description of Artificial Sequence: Synthetic coding sequence
atgggcaagggagccgctgctgaacgcttcttttctgacaaggaaacctttcacgatatcgctcaggtggcttcagagttccccggtgctcagcactatgttgggggtaacgccgcactgatcggtcaaaagttcgcggcaaactccgatctgaaggtgcttttatgcggccctgtgggacctaagcttcacgaactactggacgataacgtatttgtccctccagaatccttgcaggaggtcgacgagttccatctcatccttgaataccaggccggtgaggagtgggggcagcttaaagccccacatgctaaccgatttatcttctcacacgatctcagcaatggcgctatgaacatgctggaggtcttcgtgtcttccctggaggagttccagcctgacctggtggtgttatcaggcttgcacatgatggagggccagagcaaggaactgcaacgcaaaaggctgctggaagtggttacatcaatctcagacatccccacaggaatccctgtgcacttggagctagccagtatgacaaacagagagctgatgagttccatcgtccatcagcaggtcttccctgcagttacaagcctgggacttaacgagcaggaactcctattccttacacaatcagcaagtggacctcattcatccttgagttcttggaatggtgtaccagatgttggaatggtgagcgacatccttttttggattctgaaggaacatgggagatccaagtctcgggcttccgatctgaccagaattcacttccacactctggtttatcacatactggcaaccgtggacggccactgggccaatcagctcgcagcagtggcctcctcatgcggttgggatacagggctgagacatcggaatcatagacatcagccctccgtatctgaaggtaccccaagggtccacgatttccctttcggaggtaggcttcaagactgcattaaacccaaacaagccagctctaggatggcgcaacgaggaaacattctaccgcttcacacctctattggggtgtag

SEQ ID NO: 213745 - DNA, 1251 bp, Artificial Sequence
  Description of Artificial Sequence: Synthetic coding sequence
atggcactctggcgcggatccgcctacgcaggctttctcgccctgggcctgtccccaggcaatgggaaggatcattccatcctgcacagtagaaacgacctcgaagaggcgttcatccattttatggggaagggagcggcagccgaacgattttttagtgacaaagaaacctttcatgacattgctcaggtagccagcgaattcccaggagcccagcactacgtgggagggaatgcagcattaattggacagaaatttgccgcaaactccgatctcaaagtgctcctctgcgggccagtaggtcccaagctccacgagctgttggatgataacgtcttcgtcccccctgaaagcctgcaggaggtcgatgaattccatttaatcctggaatatcaggctggcgaagaatggggccaactgaaggcaccccatgctaaccgctttattttcagtcatgaccttagtaacggagctatgaacatgctggaggtgtttgtctctagtctggaggaattccagcccgatctcgttgtcctctctggcctacatatgatggaaggacaatccaaggagttgcagaggaaacggttgctggaggtggtcaccagtatctcggacatccccacggggatccccgtgcatcttgaacttgcgtctatgacaaaccgggaattgatgtcttccattgttcaccagcaagtttttcctgcggttacctctctggggctgaacgagcaggaactgttattcttgacccagagcgctagcgggcctcacagctccctgagctcatggaacggagtgcctgatgttggcatggtgagtgacatactgttttggattctgaaagagcatggccgtagtaaatctagggcgtccgatctcacgcgtatacacttccacactctcgtttatcacatcctcgcgaccgtcgatggccactgggccaatcagctcgcagctgttgcggcaggagcccgtgtcgcgggtactcaggcctgcgccactgaaactatcgacacttcccgggtgtcattgagggcgcctcaggagtttatgaccagtcacagtgaggccggttcacgaattgtactgaacccgaacaagccagtggttgaatggcatcgcgagggcattagtttccacttcactcctgtactggtgtgtaaagatcccataaggaccgtcggcctgggtgatgcaatttctgcagagggactgttctattccgaggttcatccgcattactag

SEQ ID NO: 213746 - DNA, 669 bp, Artificial Sequence
  Description of Artificial Sequence: Synthetic coding sequence
atggctgctagctgtagggttgtgacctcaatttctgatatccccactggtattccagtacacctcgagttggcaagcatgaccaatagggaactcatgtcatcgattgttcatcaggtctttcctgccgttaccagtcttgggctcaacgagcaggaactcctctttctcacacaaagtgccagtggaccccactccagcctttcctcctggaatggtgtgccagatgtggggatggtgtccgacattcttttctggatcctcaaggagcatggtaggtctaaaagcagagcctcagatctcaccaggatccactttcatacgctagtgtaccacatcctggctactgtggacggacactgggcgaaccagcttgccgctgtggccgcaggcgcaagggtcgccggaacgcaagcttgcgcgacagagaccatcgacacctcccgggtcagtctgagagctccacaagagttcatgacttcacattcggaggcaggtagtcggattgtgctgaaccccaataagcccgtcgtggagtggcaccgtgaaggtatatcttttcacttcaccccagtgctggtctgtaaggacccaataagaacggtcgggctgggggacgccatctccgcagagggcctattttactccgaagttcacccgcattactag

SEQ ID NO: 213747 - DNA, 546 bp, Artificial Sequence
  Description of Artificial Sequence: Synthetic coding sequence
atgggaaatatcttcgccaatctatttaaagggctattcggaaagaaggaaatgcggatattgatggtcgggctggatgccgctgggaaaacgacaatcctgtacaaactcaaattgggcgagatcgtgaccactatcccaacaataggttttaacgtcgagacagtcgaatacaaaaacatatcctttacggtgtgggacgtgggaggacaggataaaatccgccctctctggagacattatttccagaacacccagggtctgatatttgtggttgatagcaacgaccgggaaagggtgaacgaggcacgcgaagaattgatgaggatgttggcagaggatgagctgcgtgacgcggtgctcctggtttttgccaacaagcaggatctcccaaatgcaatgaacgcggcagagataactgataaactcggacttcactcactgcgccatcgcaactggtatatacaagccacatgcgcgacctccggcgacggactgtacgagggccttgactggctgagcaatcagttacggaatcagaaatag

SEQ ID NO: 213748 - DNA, 546 bp, Artificial Sequence
  Description of Artificial Sequence: Synthetic coding sequence
atgggaaatatcttcgctaacctattcaaaggtctcttcggaaagaaggagatgcggattttaatggttggcctcgacgccgctgggaaaacaaccattctgtacaaactaaagttgggtgagattgtaactacaatcccaacaatcggatttaacgtggaaaccgttgagtataagaacatttcctttacagtctgggacgttggaggccaggataagatcaggcccctttggcggcactatttccagaacacgcaaggactgatatttgtagtcgattctaatgatagagaacgagttaacgaagcaagggaggaactcatgcggatgctggccgaggacgaattgcgtgatgctgtcctgctcgtttttgcgaataagcaagacttacccaatgcaatgaatgccgctgagatcaccgataaactgggcctgcactcactgcgccacagaaactggtatatccaggccacctgcgccaccagtggagatggactgtacgagggcctggactggctctccaaccagctgcggaatcaaaagtag

SEQ ID NO: 213749 - DNA, 546 bp, Artificial Sequence
  Description of Artificial Sequence: Synthetic coding sequence
atgggaaacatctttgccaacttgttcaaagggctcttcggtaagaaagagatgcggattctcatggtcggcctggacgctgcaggcaaaactactatactatacaaactcaagctgggcgagatcgttactactattccaaccatcggatttaacgttgagacagtggaatataagaacattagctttacggtctgggacgtcgggggtcaagataagatcagaccactgtggcggcattatttccagaatacccagggactgatttttgtggtcgactccaacgatagggaaagagtgaacgaagcacgcgaggagctaatgaggatgctggccgaagacgagcttcgggatgcagtacttcttgtcttcgccaataagcaagacttacctaacgcgatgaacgccgctgagatcacagataaattgggactgcattccctgaggcatagaaattggtacattcaggccacctgtgcaactagtggcgacggattgtacgaaggactggattggttatctaaccagctgaggaaccagaaatag

SEQ ID NO: 213750 - DNA, 519 bp, Artificial Sequence
  Description of Artificial Sequence: Synthetic coding sequence
atgggtaacatctttgccaacttattcaagggcctctttggcaagaaagagatgcggatcctcatggttgggctggatgctgcaggcaaaaccaccattctgtacaaattaaaattgggcgaaatcgtcacaaccatccctacgatcggcttcaacgttgagacagtggaatataagaacatttcctttaccgtgtgggacgtaggcggtcaagataaaattcggccactgtggagacactattttcagaacacccagggtttaattttcgttgtcgattcaaacgaccgtgaacgagtaaatgaagcacaggatgaactaagggacgcggtgctgctcgtgtttgccaataagcaggatctgccaaatgctatgaatgcagcagaaattacagacaaactggggctgcactctttgcgacacaggaattggtacatccaggctacgtgcgcaactagtggggatggcctgtacgagggcctagactggctttcaaatcagcttcgaaatcagaaatag

SEQ ID NO: 213751 - DNA, 546 bp, Artificial Sequence
  Description of Artificial Sequence: Synthetic coding sequence
atgggtaacattttcggaaacctgttaaagtctttgatcggtaagaaggaaatgcgaatcctgatggttggcttagacgctgcaggcaaaactaccatcctttataagctcaaactgggagagatcgtaacaacaatcccaactatcggcttcaatgtggaaactgtagaatacaaaaatatatcattcaccgtttgggacgttggcggtcaggataaaatccgcccattatggcgccattattttcaaaatacacagggtctgatttttgtcgtggattccaatgatcgtgagcgcgtgaacgaggctcgagaagaactgatgcgaatgctcgcagaggacgagctgcgtgatgcagttctcctcgtcttcgcaaacaaacaagacttgccgaacgccatgaatgcagccgagattactgacaagctcggccttcactcccttcgacaccgtaattggtacatccaagctacatgcgccacttccggcgacggcttatacgaagggctagactggctggccaatcaactgaaaaataaaaagtag

SEQ ID NO: 213752 - DNA, 435 bp, Artificial Sequence
  Description of Artificial Sequence: Synthetic coding sequence
atgggtaatatattcggaaaccttcttaagtctctgatcggtaagaaggagatgagaattcttatggtgggtctcgatgcagctggcaagaccaccatattgtacaaacttaagctcggagagatcgtaaccacgattccaacaatcggcttaatatttgtagtagactcaaacgaccgagagcgagtgaacgaggcacgggaggagttgatgcgtatgcttgcagaggacgaactcagggatgctgtgttgctggtgtttgctaataagcaggatctgccgaacgcgatgaatgccgctgagattactgataagctcgggcttcactctctgagacatcggaactggtatatccaagcgacttgcgccacctcaggcgatggtctgtatgaaggcctggactggctggccaaccagttgaaaaataaaaagtag

SEQ ID NO: 213753 - DNA, 153 bp, Artificial Sequence
  Description of Artificial Sequence: Synthetic coding sequence
atgggtaatatattcggaaatctgttaaaaagtctgattgggaaaaaagaaatgcgtatccttatggtggggctggacgctgccggaaaaaccaccattttgtacaagctgaagctgggagagatcgtgaccacaatcccaacgattggatag

SEQ ID NO: 213754 - DNA, 309 bp, Artificial Sequence
  Description of Artificial Sequence: Synthetic coding sequence
atgggcaacatcttcggaaacctgctcaagagcctgattggtaaaaaagagatgagaattctgatggtgggcttggatgctgcaggcaagaccactatcttgtataaactcaagctcggggaaatcgtgactaccataccaactatcgggttcaacgtggaaactgtggagtataagaacatcagctttactgtatgggacgtgggcggtcaggacaagatccggccactgtggagacattattttcagaatacccagggcctgatcttcgtagttgattcaaacgatagagagagggtgaacgagtag

SEQ ID NO: 213755 - DNA, 546 bp, Artificial Sequence
  Description of Artificial Sequence: Synthetic coding sequence
atgggtaacatttttggaaatctgctgaagagcttaatcgggaagaaggagatgcgcatcctgatggtggggctggatgccgctggtaaaaccacaatactgtacaaattgaaattaggagaaatcgtcaccactatccctaccatcggattcaatgtggagacagtagagtacaagaacattagcttcaccgtgtgggatgtggggggacaggacaaaatcagaccgctctggcgccactactttcaaaacactcaaggcctgattttcgtggttgattcaaatgacagagagagagtaaatgaggcaagagaggaactgatgaggatgctggcggaggacgagctgagagatgccgtgttgctggtcttcgccaataaacaggacctccccaacgcgatgaatgctgcggaaattactgacaagttagggctgcacagcctcaggcatcgcaactggtacattcaggctacctgtgcgacttccggagacggcctctatgagggtctggactggttggctaatcaactgaagaacaagaaatag

SEQ ID NO: 213756 - DNA, 123 bp, Artificial Sequence
  Description of Artificial Sequence: Synthetic coding sequence
atggggaacatctttggcaatctgcttaaaagtttgattggaaagaaggagatgagaatcttgatggtagggctggatgcggctggtaagacaactattctatacaagctgaaacttggctag

SEQ ID NO: 213757 - DNA, 543 bp, Artificial Sequence
  Description of Artificial Sequence: Synthetic coding sequence
atggggttgactatatcttctttattttccagactattcggaaagaaacagatgaggatactcatggttggtcttgacgcagcgggaaaaaccaccatcctgtacaagctcaagctgggcgaaattgtgaccactatccccacaatcggcttcaacgtggagacagttgagtacaagaatatctgcttcacagtttgggatgtggggggacaggacagaatccggcctctgtggaagcactattttcaaaacacccaagggttgatattcgtggttgattctaacgacagagaacgcattcaggaggtggccgacgaactccaaaagatgctgctcgtggacgagctccgcgacgccgtcctcctgttgtttgctaataagcaggacctgcctaacgccatggcgatctccgagatgacagataaactcggcctacagtccctgagaaatagaacttggtacgttcaagcaacatgtgccactcagggcactggattatacgagggcttggactggctatctaatgaattgtccaaaagatag

SEQ ID NO: 213758 - DNA, 384 bp, Artificial Sequence
  Description of Artificial Sequence: Synthetic coding sequence
atgggacttacgatctcgagtttgttctcaaggttattcggcaaaaagcagatgaggatactcatggtcgggctggatgcagccggtaagaccaccatactttataaacttaagctgggcgaaattgtgaccaccattcccaccatcggctttaatgtcgaaactgtggaatacaagaacatctgttttacagtgtgggatgtgggtgggcaagaccgcatcagacccctttggaaacactactttcaaaacactcaggggctgatcttcgtggtggacagcaatgatcgtgaacggatacaggaggtagcagacgagctacagaagatgttgctagtagatgagcttagagatgccgtcctgctgcttttcgctaataagtag

SEQ ID NO: 213759 - DNA, 69 bp, Artificial Sequence
  Description of Artificial Sequence: Synthetic coding sequence
atgggactgactatctcttccctgttctccagattatttggcaaaaaacaaatgcgcattctgatgtag

SEQ ID NO: 213760 - DNA, 543 bp, Artificial Sequence
  Description of Artificial Sequence: Synthetic coding sequence
atgggcctgacagtttcagcactgttttcgcgcatctttggcaagaaacaaatgagaattctcatggtagggctggacgctgccggtaagactactattctgtacaagctcaagttgggtgaaatagtgaccaccatccccactattgggttcaacgtcgaaacggttgaatacaaaaacatttgtttcacagtgtgggatgtgggcggtcaggataagattcgcccactttggaggcactactttcagaacactcagggccttatcttcgtagtcgattcaaatgaccgggagagagtacaggagagcgctgacgagctgcagaagatgttgcaggaagatgagctgagagacgccgtacttctggttttcgcgaacaaacaggacatgccgaacgcaatgcctgttagtgagctgactgataaattaggtctccagcacctcaggagccgcacttggtatgttcaggctacttgcgccacacaaggaacagggctgtacgacgggttagattggctgtcacacgaacttagtaaacggtag

SEQ ID NO: 213761 - DNA, 1245 bp, Artificial Sequence
  Description of Artificial Sequence: Synthetic coding sequence
atggcaagcccacgtactcggaaggtactgaaggaagtacgcgtacaggacgagaacaacgtgtgtttcgagtgcggggctttcaacccgcagtgggtgtccgtgacgtacggaatctggatatgtctggagtgtagcggccgacaccggggactgggagtacacttgagcttcgttagatctgtgacaatggacaaatggaaggatattgaactcgagaaaatgaaggcaggaggaaatgccaagtttagggaattcctagaaagtcaggaggactacgacccctgctggagtctgcaggaaaagtacaacagcagagccgctgccctgtttcgcgacaaggtggtggcacttgccgaaggcagggagtggagcctggagagctctcccgcacagaactggactccccctcaaccgaggaccctgcccagcatggtgcatcgcgttagcggccagccacaaagcgtgactgctagcagcgataaggcgttcgaggattggctaaatgatgacctgggatcctaccagggcgctcaggggaatagatacgttggcttcggcaatactcccccaccacaaaaaaaagaagacgactttcttaataacgcaatgagtagtctgtatagcggatggtcctcctttactacaggagcatcccgcttcgcctccgcagctaaggagggcgctaccaagttcggttcccaggcatctcaaaaattttggggccataagcagcagcctgagccagcatcagagctgggacactcccttaatgagaatgtactcaagcccgctcaggagaaggtaaaagaggggaaaatcttcgacgacgtaagttctggggtctctcaactcgctagcaagggggtcgggtccaaaggttggcgtgacgttacgacattcttttctggtaaggctgaagggcctcttgacagtccctctgagggacacagctaccagaacagtggactggatcacttccagaattcgaatattgaccagtccttttgggagaccttcggatccgcagagcctactaagacacgcaaatccccttctagtgattcttggacgtgcgccgacacatccaccgagcgtcggtcgagcgacagctgggaggtctggggcagcgctagcaccaaccgcaactccaatagcgacgggggagagggtggggagggtactaagaaagcagtgccacccgctgtgccaacggatgacggctgggacaatcagaattggtag

SEQ ID NO: 213762 - DNA, 1212 bp, Artificial Sequence
  Description of Artificial Sequence: Synthetic coding sequence
atggccagccctaggactcggaaggtgctcaaggaagtacgcgttcaggatgagaacaatgtgtgttttgagtgcggtgcctttaatccccaatgggtgagcgtaacatacgggatttggatctgcctcgagtgttctggcagacaccgcggattgggtgtgcacctttctttcgtgaggtctgtcacaatggacaaatggaaggacatcgaactggagaaaatgaaagctggcggtaatgccaagttcagagaattcctggagtcccaggaggattacgacccttgttggtctctgcaagagaagtacaacagccgggcagctgccttgttcagggataaggttgtggccttagccgaagggcgagagtggtccctagaaagctcacctgcccagaactggacacctccccagccacgcactctgccctctatggtacacagggtatctggtcagccccagagcgtcacagcatcaagtgataaagccttcgaggactggctgaatgacgatctcggctcctatcaaggcgctcagggaaatcgttatgtggggtttgggaatacccctccgccacagaagaaggaggatgacttccttaacaacgcgatgagcagcctatatagtggatggtcaagcttcacaacaggggcatcacgctttgccagtgctgccaaggaaggagcaacaaagtttggctctcaagcatcccaaaaggcatccgagctggggcatagcctgaacgaaaacgttctgaaaccagcccaagagaaggtgaaagagggcaagatcttcgacgacgtgtcctccggcgtgtcacaacttgcaagtaaatgtcaacgtcgcctctgctgtcatcaaagccattgcagcgctggacacctgggtagggctttttgccccgtcagctggcacgaggctctgtgtgggcagactggaagggaggagcaagcgagcctactgccgcctaaacatgtggtaggggcactggaagtgtgcgctagggggtgcccgaggtgtcatgtgcctcacacacctggtacggctgctgagtggccgggaaggctttgtctgtctagggagagcgtcgtcagagatggcggtactagcccacctttttttcgagggaaacaaagggcaccttggactgcaccacggagagccacagtgatcagaactgcagtctggaccacctccaagacggctacctag

SEQ ID NO: 213763 - DNA, 1221 bp, Artificial Sequence
  Description of Artificial Sequence: Synthetic coding sequence
atggcctcgcctcgtaccaggaaggttcttaaggaagtgcgtgttcaagatgagaataacgtctgtttcgagtgcggagctttcaaccctcagtgggtttctgtaacctatgggatctggatatgcctcgagtgttcaggccgacatagaggtctgggagttcacctgagctttgtgcgaagcgtcaccatggacaaatggaaggatatcgaactggaaaaaatgaaagctggaggcaacgccaagttcagggagtttcttgagtctcaggaggattatgatccatgctggagtctccaagagaaatataattcacgtgcagcagccttgttcagagacaaggttgttgcccttgccgagggacgggaatggtctttagaaagtagccctgctcagaactggactcctccacagcctagaactttgcctagcatggtacaccgagtctccgggcagccccagtcagtgacagcaagtagtgacaaggcattcgaggattggctgaacgatgacctgggaagttaccagggcgctcaggggaaccgctacgtggggtttggcaacacacctcccccacagaaaaaggaagatgatttcctgaataacgccatgagttcactgtacagcggctggtcttcctttacaacgggagcttctagattcgccagcgcggcaaaggagggagctactaaatttggctcacaagcttcacagaaagcctcagagttggggcatagcctgaacgagaatgtgctgaaacctgcgcaggaaaaagtcaaggaaggaaaaatcttcgatgacgtctcatccggggttagccagcttgctagtaaggtacagggagtggggagtaaagggtggagggacgtgactacgttcttttctggcaaggctgagggcccacttgactcccccagtgaagggcattcttaccaaaatagtggattggatcactttcagaatagtaacattgaccagtccttctgggaaaccttcggcagtgccgaaccaaccaagacacggaagagtccatcttcagatagctggacatgtgcagacacaagcacagaacgcaggtctagtgatagctgggaggtctggggttcagcttccaccaatagaaatagcaactcagatggtggggaaggcggagagggaaccaagaaggctgttccgcctgcagtgcctacagacgatggatgggacaatcagaattggtag

SEQ ID NO: 213764 - DNA, 882 bp, Artificial Sequence
  Description of Artificial Sequence: Synthetic coding sequence
atgctgtcgagcgaaagttcttggagtcttcggcgtatcaccattttggctggtccctgccgcagaagcactacagccgagccgaggccgagtcttggtataagggtgagtggacagccacagagtgttaccgcttcctcggataaggcatttgaagactggttaaacgacgatctcggctcctaccagggagcacaagggaaccggtatgtcggttttggaaataccccaccaccacagaagaaggaggacgacttcctgaacaatgctatgtcttccttatacagcggctggtcgtcctttaccacaggagctagtaggtttgctagtgcagccaaagagggagcaaccaaatttgggtctcaagccagccaaaaggcctcagaactgggacactcgctcaatgagaacgtgcttaagcccgctcaggagaaggtcaaggaggggaaaatctttgacgatgtgtcaagtggcgtttcccaactggcttccaaggtgcagggtgtgggaagtaaagggtggcgggacgttacgacctttttctcaggaaaagctgagggtcccctagattctccttcggagggacattcctaccagaactctgggctggaccacttccagaactctaatatcgaccaatctttctgggagaccttcggatctgccgagccaacgaaaacccgcaaatctccgtcctcagattcatggacatgcgccgacacttctaccgagagacggtccagtgattcttgggaagtctggggatcagcgagcaccaataggaatagcaatagcgatggaggagagggcggtgaaggtacgaaaaaggcagttcccccagccgtcccaacggatgatggatgggataaccagaactggtag

SEQ ID NO: 213765 - DNA, 1086 bp, Artificial Sequence
  Description of Artificial Sequence: Synthetic coding sequence
atgcgcactacctttgtgaggtcagtgacgatggataaatggaaagacattgaattagagaagatgaaggctggtggtaacgccaaattcagggagttcctggaaagtcaagaggattacgatccctgctggtccctccaggagaagtataattctcgcgcagccgctctcttcagggacaaggttgttgcacttgccgaggggcgagaatggtctttggaaagcagtcctgcacagaactggactccaccccagccccgaacgcttccctctatggtccatagggtatcaggacaaccccagtctgttacagccagctccgacaaggcgttcgaggactggctgaatgacgatctaggttcctatcagggggcacagggcaacagatatgtggggttcggaaacactccaccaccgcagaaaaaagaagatgattttttaaataatgctatgagcagtttgtattccggatggtctagtttcactactggcgcatctcgattcgccagcgccgcaaaggaaggcgctaccaagttcgggtcacaggccagtcaaaaattttggggccataagcagcaacccgagccagcttctgagcttgggcattccttaaacgaaaatgtgctcaaacccgcacaggaaaaggtgaaggagggcaagatatttgatgacgtaagctccggtgtgtctcagctggcctctaaaggcgttggctccaagggatggagagacgtaaccacttttttttcaggtaaggctgagggccctctggatagccccagcgagggccatagttaccaaaatagcggcctcgatcacttccagaactccaacatcgatcagtcattctgggagacatttggatccgcggaacctactaagacacgaaaatctccaagcagcgactcctggacttgtgccgataccagcacggagcggagatcatccgattcgtgggaagtatggggtagcgcaagcacgaatcggaactcaaattcagatggtggtgagggcggtgaggggacgaaaaaggcagttccaccagccgtaccaacagacgatggatgggataatcagaactggtag

SEQ ID NO: 213766 - DNA, 786 bp, Artificial Sequence
  Description of Artificial Sequence: Synthetic coding sequence
atggccagtcccaggacacggaaggtactgaaggaagtgagagtacaggacgaaaacaatgtatgcttcgagtgtggtgccttcaatccacagtgggtttccgtcacatatggcatctggatttgcttggagtgtagcgggaggcacaggggcctgggcgtgcacttatcatttgtgcgatctgtcaccatggacaagtggaaagacatagagttggaaaaaatgaaggccggaggtaacgccaagttcagggagtttctcgagtcgcaggaggattacgatccatgctggagcctccaggagaagtataacagccgcgctgcggcactctttagagataaggtcgttgcgctggcagaagggcgtgagtggtcccttgaatcatcgcctgcccagaattggaccccgccacaacccagaaccctcccatctatggtgcacagagtctccggacagccccagtctgtgactgccagttccgacaaggcatttgaggactggctgaatgacgacctaggatcttatcagggggcacaggggaacaggtacgttggctttggcaacacacctcctccccagaaaaaggaagatgatttcttaaataatgccatgtcttcactctatagcggctggagcagctttacaaccggcgcatccaggtttgctagtgccgcaaaagagggggcaacgaaattcggatcgcaggccagccagaaggcctccgagctcgggcattcactcaacgagaatgtgctaaaacctgctcaggagaaagtgaaagaatag

SEQ ID NO: 213767 - DNA, 240 bp, Artificial Sequence
  Description of Artificial Sequence: Synthetic coding sequence
atggcatccccccgtactaggaaggtcctcaaggaggtgagagtgcaagatgagaataacgtctgctttgagtgtggagccttcaatccacagtgggtcagcgtgacatatggcatctggatttgtttggaatgcagcggaagacatcgtggactgggcgtgcatctgtcttttgtccgctctgtcacaatggataaatggaaagacattgagctggaaaaaatgaaggccggtggatag

SEQ ID NO: 213768 - DNA, 369 bp, Artificial Sequence
  Description of Artificial Sequence: Synthetic coding sequence
atggcttctccacgaacaagaaaggtactgaaggaagtgagggtgcaggacgagaataatgtctgtttcgagtgcggggcttttaatccccaatgggtgagcgtcacgtacggcatctggatctgtctggaatgctccggaagacatagaggtttaggtgtgcatttgtccttcgtccgctcagtgaccatggataagtggaaggatattgagctcgagaaaatgaaagccggaggaaacgctaagttccgggagtttctagaaagccaggaagactacgatccctgttggtcgcttcaggagaagtataactctcgagctgcagccctgtttcgagataaggttgtggccctagctgagggtcggtag

SEQ ID NO: 213769 - DNA, 759 bp, Artificial Sequence
  Description of Artificial Sequence: Synthetic coding sequence
atggtggcgagtatgaggttggcttaccaggagttacagatcgatcggaaaaaagaggagaaaaagctgcaaaacctggaagggaagaaacgggagcaagccgagaggctaggcatgggcctggtgagccggagttctgtgagccactcggtgttgagcgagatgcaggtaattgagcaagaaacacccgtgtctgctaagagttcccgcagccagttggacctattcgacgatgtcgggacatttgccagcggtccaccgaagtataaagataatcctttcagtctgggcgagagcttcggcagtcgctgggatacagacgccgcatggggaatggaccgggtagaggaaaaagagcccgaagttaccatcagctccattaggcctatttcagagagggcaacgaatcgtcgagaagtggaaagtagatcctccggcttggaatcttcggaggcacgacagaaatttgccggagccaaagctattagctctgatatgttttttggcagagaagtggatgcagagtatgaggcccgttcgcgcctgcagcagctgagtgggtcctcagccatttcgagctctgacctgtttggggatatggatggagcccacggggctggctctgtatctctcgggaatgtcttgcctaccgctgatatcgcccagttcaagcagggagtcaagtctgtcgccggaaaaatggctgtgctcgctaacggagtgatgaattctctccaagatcggtacgggtcttactag

SEQ ID NO: 213770 - DNA, 1245 bp, Artificial Sequence
  Description of Artificial Sequence: Synthetic coding sequence
atgcaggtcggagggaacgctaacgcgacagcatttttcagacagcacgggtgtacagccaatgacgcaaataccaaatacaactcccgagccgctcaaatgtacagagagaaaatcaggcagctgggaagcgccgctctggctcgccacggaaccgacccacctgcctgggatgctcccgcaaccgaacctagcgggactcagcaacctgcaccgtctaccgagtcttcaggccttgcccagcctgaacatggcccaaataccgacttgctcggcactagccccaaggcttcactggaactcaaaagctcaataatcggcaaaaagaaaccagccgctgcaaagaagggactgggtgcaaagaaggggctgggtgcacagaaggtgagctcgcagtcgttcagtgaaatcgagcggcaggcgcaggtagctgaaaaactgagggaacagcaagcagccgacgccaagaaacaggcagaagaaagcatggtggcttcaatgcggctggcctatcaggaactgcagattgatcgaaagaaggaggagaagaagctgcagaatcttgaggggaaaaaacgcgaacaggctgagcgcctcggaatgggcctcgtatccagatcttcagtgtctcattccgtgctcagtgagatgcaggtgattgaacaggaaacacccgtctctgctaagagttccaggtcccaactggacctcttcgatgacgttggcaccttcgccagtgggccacccaaatataaggataacccattctccctcggagagtcattcggttcacggtgggatactgatgctgcttggggaatggatagggtcgaagagaaggaaccggaggtcaccattagctctatacgcccaattagcgaaagagcgactaatagaagagaagtggaatcccggtcatccggcctcgagtctagcgaggcacgacagaagtttgctggagctaaggctatctccagtgacatgttcttcgggagagaggtggacgccgagtacgaagcaaggtccagactccagcagctgtcaggcagttcagccatttcaagttccgacttattcggtgacatggatggcgcacacggagcaggttccgtcagcttggggaatgttctcccaacagccgacattgcacaatttaaacagggagttaaatccgtagccggaaaaatggccgtcctggctaatggagtcatgaactcactccaggatcggtacggttcttattag

SEQ ID NO: 213771 - DNA, 1158 bp, Artificial Sequence
  Description of Artificial Sequence: Synthetic coding sequence
atggcggctgaaccaaataaaaccgagattcaaacgttgtttaagcgactccgtgccgtgcccacgaataaagcttgctttgactgcggagccaagaatccctcctgggcatcgataacatacggtgtatttctgtgcatagactgctctggggtccatcgctcattaggagtacatctatccttcatcaggtcaaccgagctggactcgaactggaattggtttcagctccgatgtatgcaggtcgggggaaacgccaacgccctgggtgccaaaaagggtttgggagctcagaaagtgagtagtcaatcattctcggagattgagcgacaggcccaagtggccgaaaagctgcgggagcagcaggcagccgatgctaagaagcaagccgaagagagtatggttgcttctatgaggctggcctatcaagaattgcagatcgataggaagaaagaagaaaaaaagctccagaatctggaggggaaaaagcgtgagcaagcagagcggctgggaatggggctggtgtccagaagcagcgtatcacatagcgtcctatccgagatgcaggtcatcgaacaagaaacgcccgtcagcgccaaaagtagcaggtctcaactcgacctgtttgacgacgtcgggacatttgcttcaggtcctccaaagtacaaagacaacccgttctccttaggggaaagcttcgggagccgctgggacactgatgctgcatggggcatggatcgagttgaggagaaggaaccagaggtgacaatatctagcatcaggcccatcagtgaaagggcaacgaaccggagagaggtggaatccaggagttccggcctcgagtcgtctgaggcccgacaaaaattcgccggtgcgaaagccattagttccgatatgttctttgggagagaggtggatgcagaatacgaagccaggtcaagactccagcagctctccggatcttctgcaatctcctcgagcgatctgttcggagatatggatggggcacacggagctggtagcgtgtctctggggaacgtactccctaccgcagatattgcccaattcaaacagggcgtcaagtcggtcgccggaaaaatggcagtgttggccaatggggtcatgaactcactgcaggaccggtacggctcctactag

SEQ ID NO: 213772 - DNA, 1566 bp, Artificial Sequence
  Description of Artificial Sequence: Synthetic coding sequence
atggccgcagagccaaacaagacagagattcagactctgttcaagcgactcagagcagtgcctactaacaaagcctgctttgactgtggcgctaagaatcccagctgggccagcataacttatggcgtgttcttgtgcattgattgtagtggtgtgcatagaagcctcggcgtccacttgtctttcatcagatccactgaactcgactcgaactggaattggtttcagttaaggtgcatgcaggtgggcggaaatgcaaacgcaacggccttctttaggcagcacggctgtaccgccaatgatgccaacaccaaatacaatagccgtgcagcccagatgtatcgcgagaagatccgccaactggggtcagccgcactggctcgccatgggaccgacctgtggatcgacaacatgagcagtgccgtgcctaaccacagccccgaaaagaaggattcggacttttttacagagcatacacagcctcccgcttgggacgcgcctgccacggagccctccggaacccagcagcctgctccaagtaccgagtcctccgggttggcccaaccggagcatggaccgaacacagatctgctgggcacatcgcccaaggcctctctggaactgaaatccagcatcataggcaagaagaaacccgctgctgctaagaaaggtttgggtgcaaagaagggattgggtgcgcagaaagtatcatcccagtcttttagcgaaatcgaacgacaggcccaggtggcagaaaagcttcgcgaacaacaggcggcagacgccaagaaacaggccgaggaatcaatggtggctagcatgcgtttggcctaccaagaactccagatcgatcgaaagaaggaggagaaaaagttacagaacctagagggtaaaaaaagggagcaggcagagcgcctgggcatgggactcgtcagccggtccagcgtgagccactctgtccttagcgagatgcaagtgatagaacaagagaccccggtgagtgccaaatcgagtaggtctcagttagatttgtttgacgatgtgggaacatttgcctctgggccacccaaatacaaggacaatcccttttcactgggggaatctttcggctcgcgctgggacactgacgccgcttggggcatggacagggtggaggagaaggaaccagaggtcaccatttctagcatcaggcctatctcagaacgggcaactaatagacgagaggtggaaagcagaagtagcgggctggagagttctgaagcacgacagaaattcgcaggcgctaaagccataagttcagacatgtttttcggccgagaagtggacgccgaatatgaggcaaggtcccggctacaacagctcagtggttcatccgctattagttctagtgacttgtttggagacatggacggagcgcacggcgcaggctcagtttccctgggtaacgtgttgcccactgcagacatcgcccaatttaaacagggagtcaagtccgtggctggcaagatggcagttttggcgaacggcgtaatgaactccctgcaagacaggtacggatcatactag

SEQ ID NO: 213773 - DNA, 1551 bp, Artificial Sequence
  Description of Artificial Sequence: Synthetic coding sequence
atgggggatccaagtaagcaggatatcctaacaatcttcaagagactgcgttctgtgcccaccaacaaggtctgttttgactgtggggcaaagaacccttcttgggcgtcgataacctatggcgttttcttgtgcattgattgttccggcagtcatcggtctctgggcgtgcacctgtcattcatccgctcaacagagctagactctaattggtcctggttccagctgaggtgcatgcaggtgggaggtaacgctagcgcttcctcttttttccatcagcacgggtgtagcaccaacgataccaatgccaagtacaatagccgggcagcccaactgtacagagagaaaattaaaagcttagcttcacaggccactcgcaagcacggaaccgacttatggctggactcctgcgtcgtgcctcccctgtcaccacctcctaaggaagaagacttttttgcttcccacgtgtctccggaggtgagcgacaccgcctgggcctcggccatcgccgaaccatcctccctgacatctaggccggtggagaccaccttagagaataatgaaggtggacaggaacaaggacctagtgttgagggtctgaatgtgcctactaaggcaacactggaggtgtcatcaataattaagaagaaacccaatcaagcaaaaaaaggactcggagcaaagaaggggtctctgggggctcaaaagcttgccaatacttgtttcaatgaaattgagaagcaggcgcaggctgccgacaagatgaaggaacaagaggatctagctaaagtggtcagcaaggaggagagtatcgtaagcagccttagactggcttataaagatcttgaaatacagatgaaaaaagacgaaaaaatgaatatttctggaaaaaagaatgtcgactctgatcgcctggggatgggatttggcaactgcagatcagtaatctcgcactctgtgacttccgacatgcagacgattgagcaggaaagcccgatcatggccaagccaaggaaaaaatataacgacgactctgatgattcatacttcacgagcagctcctcatatttcgacgaaccagtggaactgaggtccagttccttttcatcctgggacgatagttccgactcatattggaaaaaggagacttccaaagatacagagaccgtccttaaaactacagggtattctgatagacccacagcgaggcgtaagcccgattacgagccagtcgaaaacacagatgaagctcaaaagaaattcgggaatgtgaaggccatttcgtcagatatgtattttggcaggcaaagccaggcagactacgaaacgcgcgctcggttggagcggctctcggcatccagctcaatcagttctgccgacctctttgaagaaccgagaaagcagccagctgggaattatagtctgagctccgtgctccccaatgccccagacatggcacagtttaaacagggcgtgaggagcgtggcgggaaagttgtcagtgttcgccaacggagtcgtcacttccatccaggacagatatggatcctag

SEQ ID NO: 213774 - DNA, 1335 bp, Artificial Sequence
  Description of Artificial Sequence: Synthetic coding sequence
atgggcgatccctctaagcaagatattctcaccatctttaagaggctcaggtcagtgccaacgaacaaggtctgttttgattgcggagccaagaatccaagctgggcgtccataacatacggggtatttctatgcatcgactgctcaggctcccaccgcagtcttggggtacacctgagctttattcgctcgacagagctggatagcaactggagttggttccagctcaggtgcatgcaagtgggcggaaacgcaagtgcagtttcggatactgcgtgggctagcgccattgcggagccgtcaagtttgactagcagaccggtcgaaaccactctggaaaataacgagggcggacaggaacaggggcctagcgtcgagggcctgaatgttccaactaaggctaccctggaggtttcatctataattaaaaagaaacccaatcaggctaaaaaagggctgggagccaaaaaaggttcacttggggctcagaagctggccaatacctgctttaatgaaatagaaaagcaagcccaagctgctgacaagatgaaagagcaggaagatctggccaaggtggtctcaaaggaggagtccattgtgtctagcctgcggcttgcgtacaaggacctcgaaattcagatgaaaaaggacgagaagatgaacatttctggaaagaaaaatgttgactctgacaggctgggcatgggctttggcaactgccggtcagttatctcacatagtgtgacctcagacatgcagacgattgaacaggagagcccaatcatggccaaacctaggaaaaaatataacgatgacagcgacgacagctactttacatcatcgtcttcgtattttgatgaacctgtcgaactgcgtagcagcagtttcagcagttgggatgattcgtccgacagttactggaagaaagaaactagcaaggatacagagaccgtgctaaaaacaactgggtattctgacagaccaactgcacgtcgcaagccagactacgaacccgtggaaaacactgatgaagctcagaagaagttcggaaacgtgaaggcaatctcttcagacatgtactttggacgccagtctcaggcagattatgagacccgggctcggctggaacgtttaagtgcatcttcttccatttctagcgctgatctatttgaagaacccaggaaacaaccggcagggaattactcattgtctagtgtgctgcccaacgccccagatatggctcagttcaaacagggcgttcggtcggtggcgggtaaactcagcgtctttgccaatggcgtggtgactagtattcaggatcgctatggatcatag

SEQ ID NO: 213775 - DNA, 1419 bp, Artificial Sequence
  Description of Artificial Sequence: Synthetic coding sequence
atgggagatccctcgaagcaggatatcttgactatctttaagagactccgaagcgtgcctacgaataaggtgtgctttgactgtggcgctaaaaatccaagttgggccagtattacctatggcgtgttcttgtgtatcgactgcagcggatcgcatagatccttgggtgtgcacctctcattcatccgtagtacagaactggattccaattggagctggtttcaattacgctgtatgcaggtggggggtaacgctagcgcgctatggctcgactcttgtgttgtgccgcctctgtcccccccaccaaaggaagaggattttttcgctagtcacgtgtcccctgaggtgtccgacaccgcgtgggccagtgccatcgctgagcctagctcattgacctctcgacctgtcgagactaccctggaaaataatgagggtgggcaagagcagggccctagcgtagagggtttgaacgttccgacaaaggccacactggaagtgtcttcaattattaaaaagaagcccaatcaggccaaaaagggactgggagcaaagaaggggagcctgggcgcacagaaactggccaatacttgcttcaacgaaattgagaagcaggcccaagccgcagacaaaatgaaggagcaggaggatcttgcgaaggtggtgtctaaggaggagagtatcgtttcctcgctgaggctggcgtacaaagatctcgagatccagatgaagaaggatgagaagatgaacatatctgggaaaaagaacgtcgactcggacaggctgggtatgggattcgggaactgccggtccgtgatcagccatagtgtaacaagcgatatgcagaccatagaacaggaatctcccataatggcaaaaccccgtaagaaatataacgacgacagcgacgacagctacttcacatcctcctcaagctattttgatgaaccagtagaactgagatctagcagctttagctcttgggatgactcaagcgattcttattggaaaaaagagacttcaaaggatactgaaacagttctgaaaacgaccggttattcagatcgccctaccgctcgaaggaaacccgattatgaacccgtggagaatactgatgaagcacagaagaagttcggaaatgtgaaggccattagctcggacatgtattttgggagacagtcgcaggctgactacgagacccgcgctcgcctggagagactgagtgccagctcaagtatctcttccgctgacctgtttgaagaaccaaggaagcaacccgcagggaactactctctttcgtccgtcttgcccaatgctcccgacatggcccaattcaaacaaggggtaagaagtgtcgccggaaaactttctgtgttcgctaacggggttgttacctcaattcaggatagatacggaagttag

SEQ ID NO: 213776 - DNA, 822 bp, Artificial Sequence
  Description of Artificial Sequence: Synthetic coding sequence
taactggctctgtttcaagtctccgatacggcatgggcatcagctattgcggagccctcttcccttacctcccgtcccgtagaaaccactctcgagaacaatgaaggcggtcaggaacagggaccctctgtcgaaggattgaatgtgccgacgaaggcaactctggaagtcagtagtatcatcaaaaagaagccaaatcaggctaagaaagggctcggcgctaaaaagggctcactcggtgctcagaagctggccaacacatgctttaacgaaatcgaaaagcaggcccaggccgctgataagatgaaggagcaggaggacctcgccaaagtggtgtccaaagaggagagcatcgtgagttctcttcgtttagcctacaaggacctggagatacagatgaaaaaagacgaaaagatgaatatctctgggaaaaagaatgttgactcagatcggcttggcatgggttttggaaattgccgctctgttatctctcattccgtcacatcggacatgcagaccatcgaacaggaatctcctatcatggccaaaccacgtaaaaagtacaacgacgatagcgacgactcttatttcaccagcagttcccgccctaccgcacgcaggaaacctgactacgaacccgtggagaataccgatgaagcccagaagaagtttggcaacgtgaaggccatatccagcgatatgtacttcggcagacaatctcaggccgattacgagacccgtgctagattggaacgcctcagcgccagttcctccatatcctccgcagacctttttgaagagcctcggaaacagcccgcttag

SEQ ID NO: 213777 - DNA, 459 bp, Artificial Sequence
  Description of Artificial Sequence: Synthetic coding sequence
atgggggacccgagtaaacaggacattttgacaatctttaagaggctgaggtcagtgcctacaaacaaggtttgcttcgactgcggtgctaaaaatcccagttgggcctctattacctacggagttttcctatgcatagattgctcgggctcgcacagaagcctgggcgtgcacctgtcctttattcggtcgaccgagctcgactccaactggagctggtttcagctgcggtgtatgcaggtaggtggaaatgcgtccgccgtcagcgacacagcttgggctagtgccatcgctgagccatccagccttacatcccggcctgtcgagacgaccctggaaaacaatgagggcggacaggaacagggccctagcgtggagggtttgaatgtgcccacgaaagccaccctggaagtgtcttcaataattaaaaagaagcctaaccaagccaagaagggctag

SEQ ID NO: 213778 - DNA, 5550 bp, Artificial Sequence
  Description of Artificial Sequence: Synthetic coding sequence
atgtatgagggcaaaaagacaaagaacatgtttctgactcgggctttggaaaagatcttagccgataaagaagtgaaaaaggcccaccacagccaactccggaaggcctgcgaggtagccctcgaggagataaaagccgagaccgaaaaacagtcacccccacatggagaggcgaaggcaggcagttctaccctacccccagtgaagtccaagacgaactttatcgaggcggataaatatttccttccatttgagcttgcctgccaatcgaagtgccctaggattgtgtccacctctttggactgcctccagaaactaatcgcctacggccacctgactggcaacgcaccagatagcacaacccccggaaaaaagctgattgaccggataatcgagacgatttgcggttgcttccagggcccacagactgacgagggggtccagttgcagattattaaagctctgctgaccgctgttacatcacagcatatcgagatccatgaaggtaccgttctccaagcagtccgcacatgctacaacatttatctggctagcaaaaacctgatcaatcagacgaccgctaaggccaccctcacacagatgctcaatgtcatattcgcgaggatggagaaccaggctttgcaggaggccaaacaaatggaaaaggaacggcataggcaacaccatcacctgctacagagcccagtgtctcatcatgaacccgagagcccccagctgaggtacctccctcctcagaccgtggaccatatttcccaggagcacgagggcgatttggatctccacaccaatgatgtggacaagagtctacaggatgataccgagccggagaatggatccgacatctcatccgcagagaacgaacagacggaggcagatcaagcaaccgctgccgaaaccctgtccaaaaatgaggtgctatacgatggggagaaccatgactgtgaagaaaaaccccaggacatcgtccagaacatagtggaggaaatggtgaacatagtagtgggggacatgggcgaaggcaccactatcaatgccagcgctgatggcaacatcggtaccattgaggacgggtcagactcggagaacatacaggcaaatggcatccctggcacacctatttctgtggcgtacactccaagcctgcccgacgaccggctgtctgtcagcagcaatgatacccaggagtctggaaatagctctggaccatctccaggggctaaattttcacacatcctccagaaagacgcctttctggttttccggtctctgtgcaagttgtcgatgaagccactgtctgacggtccaccagatcctaagtcccatgagctccgttcaaagatcctgtccctacagctgctactgtctattctccagaacgccggtcccatttttcggacaaatgagatgttcatcaatgcaatcaaacaatatctctgtgtcgcactcagcaagaatggcgtctcttccgtcccagaggtcttcgagctgagcttgtctatttttctcaccctattgtctaactttaagacacatctgaagatgcaaatcgaggtctttttcaaagaaatatttttgtatattctggaaacgagcaccagctcattcgaccacaagtggatggtgatccagacgctcactcggatttgtgccgacgcccagtctgtcgttgacatttatgtgaattatgactgtgacctgaatgctgcaaatattttcgaaagactcgttaacgatctctcaaagatcgcgcagggtagaggaagtcaggagctgggcatgtctaacgtacaagagctgtctctgcggaaaaagggcctcgagtgtctcgtctcaattctgaagtgcatggtggaatggtccaaagatcagtacgttaaccccaactctcagacaactctggggcaggagaagccttccgagcaagagatgtccgaaatcaagcatccagaaacaatcaacaggtacgggtccttgaatagtttggaaagcacatctagctctggtattggctcatacagcacccaaatgagcggcacagataatcccgaacagttcgaagttctcaagcaacagaaggagattatcgagcaggggattgatctgttcaacaagaagcctaagcgcggaatccagtatttgcaggaacagggaatgctgggaacaacccccgaggacatcgctcagttcctccaccaggaagagcgcctggactctacccaggtcggagaattccttggagacaacgacaagttcaacaaggaagtcatgtatgcctacgtcgatcagcacgacttttcaggcaaggatttcgtttccgccttgagaatgttcttggagggctttagactccccggtgaagcccagaaaatcgaccgcctcatggagaagttcgccgctagatacctggaatgtaaccagggtcagaccctgtttgcctcggctgatacggcctatgtactggcctatagcatcataatgctcactaccgacctgcacagcccccaggtgaaaaacaaaatgacaaaggagcagtatattaaaatgaatcggggtattaatgactccaaagacctgccagaagagtacctctccgctatatataacgaaatagcagggaaaaaaatctctatgaaggagacaaaggagcttacaattcccactaaatcatccaaacagaacgtggcctctgaaaagcaaaggcgcctcctatataatctggaaatggagcaaatggcaaagactgccaaggccctgatggaagctgtgtcacacgtgcaggctccctttacgagtgccacccacctggaacatgtccggcctatgtttaaactcgcctggacaccattcctcgcagctttttctgttggcctccaggactgcgacgataccgaggtcgcctccttgtgccttgagggaatcagatgtgctattcgcattgcctgcatattcagcattcaactggaacgcgacgcctacgtgcaagccttggcgagattcactctcttgacagtgagtagtgggatcaccgagatgaaacagaagaacatcgataccattaagacattgatcaccgtcgcccatactgacggcaactacctaggaaattcatggcacgaaatccttaaatgcatatctcaattagaactagcccaactgattggaaccggagtaaaaccgagatacatttcaggcacagttagaggtcgtgagggtagtttgaccggtacaaaggatcaggcccctgatgagtttgtcggtctgggactggtgggaggtaacgttgattggaagcaaatcgccagtatccaggaatctataggggagacctcctcacagtccgtcgtggtggccgttgataggattttcaccggctctacgcggctggacggcaacgccatcgtcgactttgtgaggtggctatgtgctgtgtctatggatgaactactttctactacacatcctcggatgtttagcctgcagaagatagtggaaattagttactataatatgggacgcatcaggctgcaatggtctagaatttgggaagtcatcggcgaccattttaacaaagtcggatgcaatccgaatgaagatgtggccatattcgctgtagattccctgaggcagctttccatgaaattcctcgagaaaggagagctcgcaaacttcaggttccaaaaagacttcctgcgcccttttgagcatatcatgaagcgcaaccgctcacctactatcagggatatggtggtccggtgtatcgctcaaatggtcaattcgcaggccgcaaacattcggagcgggtggaagaacatttttagcgtattccacttggccgcttcagaccaggatgaatccatcgtggagctcgctttccagacaaccggtcacatagttaccctcgtctttgagaaacatttcccagctacgatcgattcctttcaggacgccgtgaaatgcctgtccgaattcgcctgtaacgcagccttcccagacacttcaatggaggccatacgccttattcgacattgtgcgaaatacgtttctgatcgcccacaggcctttaaggagtatacctccgacgatatgaatgttgcccctgaggatcgggtgtgggtacgtggctggtttcccatactcttcgagttaagctgcattatcaataggtgcaagttagacgtgcgcaccagaggactgactgtcatgtttgaaattatgaagacatacgggcacacatatgaaaagcactggtggcaggatctatttcggattgtgtttcgaatatttgacaatatgaaactcccagagcaacagacagaaaaggctgagtggatgaccactacttgcaaccacgctctgtatgccatttgtgatgtgttcacgcaatatcttgaagtgctctccgacgttctcttagatgacatattcgcccagttgtactggtgtgtgcagcaggacaatgaacagctcgcaaggtccgggaccaactgcttggaaaatgtggttatcctcaatggtgagaaatttacattggaaatctgggacaaaacctgtaactgcaccctcgatatctttaaaacaacaattccacacgcccttctgacttggagaccaaactcaggggagaccgcaccccctcccccttcacctgtgtccgaaaagccgctggatacgattagccagaaaagcgtcgatattcacgactctatccagcccaggtcagttgacaatcggccacaagcacctctcgtctctgccagtgctgtgaacgaggaagtctctaagataaaatctacagctaaattccctgagcaaaaactcttcgccgctcttctgataaagtgcgtggtccagctggagttaatccagactattgacaacatcgtgttttttcctgccactagtaagaaggaagacgccgaaaatctggccgctgcccagagggacgcagtggattttgatgtgcgtgtggatacccaggaccagggaatgtacaggttcttaaccagtcagcaactgtttaagttgctggattgtttactcgaatcacacaggtttgcgaaggcgtttaactccaataatgaacagcgcaccgcactttggaaagctgggtttaagggtaagtcaaaaccgaacttgctgaagcaggaaacatcttctttggcctgtggattgcggatcttattcaggatgtatatggacgagagccgggtgtcagcttgggaagaggttcagcagcggctgcttaacgtttgttctgaggccttgagttactttttaaccctcacatcagaatcccatcgggaggcttggacaaatctgctgctcctctttctgaccaaggtcttgaagatttccgacaataggttcaaggctcatgctagcttctactaccctctgttgtgtgagattatgcagttcgacctgattccggaactccgggcagtgcttcgacgcttcttcttgcgcatcggggtggtctttcagattagtcagcctccggagcaagagctcggaatcaataaacagtag

SEQ ID NO: 213779 - DNA, 5357 bp, Artificial Sequence
  Description of Artificial Sequence: Synthetic coding sequence
atgcaagagtcacaaaccaaatccatgtttgttagtcgagccctcgaaaagatcttagctgacaaagaggtcaagaggcctcaacactcacagctgaggcgcgcatgtcaggtcgccctcgacgagatcaaggccgagattgagaaacagcggttgggcaccgccgctccccctaaagcaaatttcatcgaagcggacaagtacttccttccatttgagctggcctgtcagtctaaaagccctcgagtcgtatccactagcctggactgcctacagaagctcatcgcatatggacatattaccggaaatgcgcctgacagcggggcacccggaaaacggctgatcgaccgcatcgtcgaaaccatttgctcttgctttcaagggccacagacagatgaaggggtacagcttcagattatcaaagccctgctcacagctgttacgtcaccacacatcgaaattcatgagggaactatcctccagacagttcggacgtgttacaatatctacttggctagtaaaaatctaattaatcagacaaccgccaaagccacgctcacccagatgttgaatgtaatctttacacggatggagaatcaggtactgcaggaagctagagagctggaaaagccgatccaaagcaaaccccagtctccagtaatacaggctgccgctgtctcacctaagtttgtgcgtctaaaacattctcaggcgcagagtaagcctactacacccgagaaaacggacctgactaatggcgagcacgccaggagcgactccggcaaagtgagtactgagaatggtgacgcacctcgcgagcggggttcatccttatccggcacagatgatggggcacaagaggttgtcaaagatattctggaagacgtcgtgacttccgctattaaggaggctgccgaaaaacacggccttactgaaccagagcgagttcttggggagctggagtgtcaagaatgcgctatcccccctggtgtggatgaaaactcacaaactaacggcatcgcagatgataggcagtcgctctccagtgctgacaatctggagagtgatgcccagggccatcaggtggccgcaaggttctctcacgtcctgcagaaagacgccttccttgttttccgcagcctgtgcaagctgtccatgaaaccactgggggaaggaccgccagaccccaagtcacacgaacttcgatccaaggtcgtctccctgcaactgctgctctcggtgctgcaaaacgccggaccggtgtttcgcacccacgaaatgttcataaacgcaataaaacagtacctctgcgttgccttatctaagaatggcgtttcctctgtgccagacgtgtttgagctgtcgcttgctatttttctgaccttgctctcaaattttaaaatgcacctgaagatgcagattgaggtcttctttaaggagatcttcttgaatattttggagacttcaactagctcctttgagcaccgatggatggtgattcaaacactcacgagaatctgcgccgatgcacagtgtgtggttgatatctacgtgaactacgactgtgacctcaacgccgcaaacatcttcgagcgcctggtcaacgacctgagtaaaatagctcagggaagatctggtcacgaattagggatgacacccctgcaggagctctcccttcggaaaaagggactggaatgcctggtgtcaatactgaagtgcatggtggagtggtcaaaggatctctacgtcaatccaaatcaccagaccagcttagggcaggagcgcttaacagaccaggagatcggcgatggcaagggcctggacatggcccgacgatgctctgtgactagtatggagtccactgtgagctcaggcacacagacaactgttcaagacgacccagagcagtttgaagttattaaacaacaaaaagagatcatcgagcacggcatcgaactgttcaacaaaaagccaaaaaggggaattcagtttctccaagagcagggcatgctagggacctctgttgaagatatcgcacaattcctgcatcaggaagaacggctcgattcaacacaagttggagattttctgggggatagcgctcggttcaataaggaagtgatgtatgcatacgtcgaccagctcgatttctgcgaaaaggaattcgtttccgctcttaggaccttcttagagggcttcaggctcccaggagaggcccaaaagatcgatagattgatggagaagttcgcagctaggtacatcgagtgtaatcaggggcagacactcttcgcatctgcggacacggcttacgtcttggcgtacagcatcatcatgctcacgaccgacctgcattcgccgcaggtgaaaaacaagatgacaaaggagcagtacatcaaaatgaacagaggcattaatgacagtaaagatctgcccgaagagtatctgtcctctatttatgaggaaatagagggtaaaaagattgcaatgaaagagacgaaagaactgacaatcgcaactaagtcaactaaacaaaatgtggcgtctgagaagcagcgcagattgctgtacaacttggagatggaacagatggccaaaactgctaaggctctcatggaagccgttagtcacgccaaggccccatttacctccgctacacacctggaccacgttcggcctatgtttaagttagtctggacccccctgctcgccgcttattctatcggcctgcagaactgcgatgacaccgaggtcgcaagtctgtgtctggaaggcattcggtgcgccatccgaatagcttgtatttttggaatgcagctagagagggacgcttacgtgcaggcccttgcacggttctcccttctcactgcctcctcatccattactgagatgaagcagaaaaatatcgacacgattaagaccttgatcactgtggcccatacagatggcaattatctaggcaactcgtggcacgaaatactgaagtgtatctcacagctcgagttagctcaactgatcggcacaggagtgaaaacgcgttatctgtctggaagtgggcgagaaagagagggcagccttaaggggcatacactggcaggggaggaattcatgggccttggattggggaatttggtgagtgggggagtggacaaacgtcagatggcaagcttccaagaatccgttggagagactagcagtcagagtgtggtggtggctgtggaccgcatctttaccgggagcaccagattggatggcaatgctattgtcgactttgttagatggctctgtgccgtgtctatggacgagcttgcttcccctcaccaccctagaatgttctcactacagaagatcgtggagatatcatactacaatatgaaccggattagactgcagtggtccaggatctggcacgtgatcggggaccattttaataaagtgggctgcaatcctaatgaagacgtcgctattttcgcagtggacagtctccggcagctgtccatgaaatttctcgagaaaggggagctcgccaatttcagattccaaaaagattttttaagaccattcgagcatattatgaagaaaaataggagccccacaattcgggacatggccattagatgtattgcccagatggtcaatagccaggctgctaacatcagaagcgggtggaagaacatcttcgccgtgtttcaccaggctgccagcgaccacgatgggaatatagtagaacttgcctttcaaaccacgtgccacatcgtcacaactattttccagcaccatttccctgctgccatcgactccttccaagacgctgttaagtgtctatcagaatttgcttgcaacgcggcttttcctgacacctctatggaggctatccgtttgatcagattttgcggcaagtacgtttcagagcgtcctcgcgttttacaggaatatacctctgatgatatgaacgttgctccgggagatcgcgtctgggtccgtggctggttcccaattctgtttgagctgtcttgtataatcaacaggtgcaagctggatgtccgcacccggggattgacagtgatgtttgaaattatgaagagttacggccacacattcgagaagcattggtggcaggacctatttagaattgttttcaggatcttcgataatatgaagttacccgagcagctttcagagaagagcgaatggatgaccaccacttgcaatcacgcactatacgcaatctgtgatgtttttacacagttctatgaagccctgaacgaggtgctactctcagacgtattcgctcaacttcagtggtgtgtgaagcaggataatgaacagctggctcggtccggtactaactgcctggagaatctggtcatttccaacggcgagaaatttagcccggaagtatgggacgagacttgtaattgcatgctggatatcttcaagactacaattccccatgttttgttgacatggaggcctgtaggaatggaagaagatagtagcgaaaagcacctggatgtagacctggacaggcaatcccttagtagtatagacaagaaccccagcgaacgaggccaaagtcagctgagcaatccaactgatgacagctggaaaggcagaccttacgctaatcaaaagcttttcgcgtccttgctcataaagtgcgttgtccagctggagctgatacagaccattgataacatcgtgttctacccggcaacgtctaagaaagaggacgcagagcacatggtggcggcacagcaggataccctggacgctgacatacatattgagacggaggatcagggcatgtataaatacatgtcttcccagcacctgttcaaactgctggactgcttgcaagaaagccatagtttctcgaaagcctttaactcaaactatgaacaacgcaccgtcctgtggcgggcaggtttcaagggcaaaagcaagcccaatctgttaaaacaggaaacctcttccctggcttgttgcctccgcattctcttccggatgtatgtggacgagaacagacgcgattcctgggaggagatccagcagcgactcctgacagtgtgttcggaagctctggcatacttcatcaccgtgaactccgaaagtcatcgcgaagcatggacatcactgctgctcctactgctcacaaagaccctcaagatcaatgatgagaaattcaaagctcacgcatccatgtactatccatacctgtgcgagatcatgcagtttgacctcatcccggagctccgagcggttttacgaaagtttttcctccgtataggggtggtgtacaaaatttggattcctgaagagccctctcaggtgccagctgctctgtctccagtgtggta

SEQ ID NO: 213780 - DNA, 2499 bp, Artificial Sequence
  Description of Artificial Sequence: Synthetic coding sequence
atgcaggagtcacagaccaagtcaatgtttgtgtctcgcgcattagaaaaaatcttggccgacaaagaggtgaaacggcctcagcactctcagcttcgacgcgcatgccaggttgcccttgacgagattaaagctgagatagagaaacagcgacttggaactgcagctccccctaaggcaaattttatcgaagcggataagtactttcttccttttgaattagcgtgtcagtctaagtcaccaagagtcgtgtccaccagcctcgattgtcttcaaaaacttatcgcttatggacacatcacggggaatgcccctgatagtggcgcacctggcaaaaggttaatcgacagaatcgttgagacaatatgtagttgctttcagggaccccagacagacgaaggtgtgcagctgcaaatcattaaggctctgcttactgcagtgaccagcccccacattgaaattcacgagggcacgattctgcagaccgtgaggacctgctataatatatacctggcctctaagaatctgattaatcagacaacggctaaagccactctcacgcagatgctgaacgtaatttttactcgtatggaaaatcaggtgctgcaggaggctcgtgaactggagaaacccatacagagtaagcctcagtctccggtgatacaggctgccgctgtgtctcccaaattcgtgagactaaagcactcacaggcccagtcaaagccgaccacgcccgagaagactgacctgacgaacggggagcatgcacgctctgactctggtaaagtctcgaccgagaacggtgatgctcccagagaaaggggatccagtctctcaggcactgacgatggtgcccaggaggtcgtcaaggatattctggaggacgtcgtgacttcggcaattaaggaggctgcagaaaaacatggattgacagagccagagcgggtcctgggagagctggagtgtcaggaatgtgccatccccccaggagtggacgagaactctcagaccaacggaatagctgatgataggcaaagtttgtcgagcgcagataatctggaatccgatgctcaaggccaccaggtggccgcaaggttcagccacgtacttcaaaaagacgcattcctggtgtttcgctcattatgcaagttatccatgaagccactaggggagggacccccagaccccaaatcccatgaacttcggtctaaagtagtgagcctgcaactcctgctttctgttctgcagaacgcaggacccgtctttagaacacacgagatgttcattaacgctattaagcagtatttgtgcgtagcattgtcaaagaacggggtgagcagtgtgccagacgtgtttgagctgagtcttgctattttcttgaccctgctgtctaattttaagatgcaccttaaaatgcagatcgaggtgtttttcaaggaaatttttctgaacatactggaaacctcaacaagttctttcgaacaccgctggatggtgatccaaacactgactcgcatttgtgccgacgctcaatgtgttgtggacatttatgtgaactacgattgcgatctcaatgctgcaaacatatttgaacgccttgttaacgatctgtccaaaatcgcccagggacgcagcggccatgaacttggcatgacacctctgcaggaactcagcctccggaaaaagggtcttgagtgcttggtgtccatcctgaagtgtatggtggagtggagtaaagatctatatgtaaatccaaatcatcagacatcactcgggcaggagcgactcaccgaccaagaaataggggacggcaaagggctcgatatggcaagaaggtgctctgtcacctctatggagtctaccgtgagctctgggacacagaccacggtccaggacgacccagaacagttcgaggtcataaagcaacagaaggagattatcgagcacggcatcgaactgtttaataagaaaccgaaacggggaatacagtttctgcaggaacaggggatgcttgggaccagcgttgaggacattgcccagttcctccatcaagaagaacgcctcgattcgactcaagtgggcgacttcctgggcgatagcgccaggttcaacaaagaggtgatgtatgcctacgtggaccagcttgatttctgtgaaaaggaattcgtatcagctttgagaaccttcctggaggggttccgactgcctggggaagcacagaagattgataggctgatggaaaagttcgcggctaggtacatagaatgcaatcagggccagacactcttcgcgtccgcagacactgcatacgtgcttgcctactccatcattatgctgaccaccgacttgcattcccctcaggttaagaataaaatgaccaaggagcagtacatcaagatgaaccgtggaatcaacgacagcaaggacctccctgaagagtacctctcaagcatctacgaagagatcgagggaaaaaaaatagctattaaaaagaattag

SEQ ID NO: 213781 - DNA, 591 bp, Artificial Sequence
  Description of Artificial Sequence: Synthetic coding sequence
atgggctcagttaactctaggggacataaagcagaggcccaggtggtcatgatggggctggattctgcagggaaaaccactttattatataagctaaagggccaccagctcgtagaaaccctgcccacagtgggctttaatgttgagcctctgaaagctccgggtcacgttagtctgacactctgggatgtgggtggtcaggcaccactccgcgcttcatggaaggattacctggagggcaccgatattttggtgtacgtgctcgatagcacagacgaggcacgtttacccgagtcagcagcagagctgacggaagtcttgaatgacccgaacatggcgggagtcccctttcttgtactggccaacaaacaggaggccccagacgcccttcccctgcttaaaatccgcaaccgcctcagcctcgaaaggtttcaggaccactgctgggaactccgtgggtgctctgctcttactggcgagggcctgcccgaagccctccagagcctgtggtctcttctcaaatcacggagctgcatgtgtctgcaggccagagcccatggcgcagaacggggtgactctaaacggtcttag

SEQ ID NO: 213782 - DNA, 966 bp, Artificial Sequence
  Description of Artificial Sequence: Synthetic coding sequence
atgttttcactcatggctagttgttgtgggtggtttaaacgctggcgggagccagtaaggttggctaataagcaagacaaggaaggggcactgggagaggccgatgttatcgagtgtctgagtctggagaagctagtcaatgaacacaaatgtctgtgccagatcgagccatgttctgccattagtggatacggcaagaagattgacaaaagcatcaagaaggggctttactggctgctccacgtcattgctcgagactttgacgcgctaaatgagaggatccagaaggaaaccacagagcagcgcgcactcgaggagcaggagaagcaagagcgcgctgaacgcgttcgcaagctgagggaagagagaaagcagaacgagcaggagcaagcagaattagacgggacatcggggttagccgaactcgaccctgagccgaccaaccccttccagcctatcgccagcgtgataattgaaaacgagggaaagttagagagagaaaaaaagaatcagaaaatggaaaaagacagtgatggctgtcacctaaaacacaaaatggagcacgagcagatcgaaacgcaggggcaggtgaatcacaacggtcagaagaataacgagtttggccttgtggaaaattacaaggaggccttgacccagcagttgaaaaatgaggacgaaaccgaccgcccaagcctagaatccgccaatgggaagaagaaaaccaagaaactccgcatgaaacggaaccatagagtggagccattaaacattgatgactgtgccccagaatcaccaactccccctcctcctcctccacccgtgggatgggggacccccaaggttacacggttacctaaactcgagccccttggagaaactcaccacaatgacttctaccgcaaacccctcccaccactcgccgttccccagaggcccaactcagacgcacatgacgtaatttcttag

SEQ ID NO: 213783 - DNA, 1287 bp, Artificial Sequence
  Description of Artificial Sequence: Synthetic coding sequence
atgttttcactcatggcatcatgctgcggatggttcaagagatggcgggagccagtgcggaaagttacgttgctcatggtgggccttgacaacgcaggaaaaacagcaaccgccaaagggatccagggggagtacccggaagacgtcgcccctaccgttggattcagcaaaataaaccttcgccaaggtaagtttgaggttaccatcttcgacttaggcggtggtatccggatccgcggtatttggaaaaattattacgccgaatcctacggtgttatttttgtggtagactcctctgacgaagagcgcatggaagagactaaggaggccatgagcgagatgctgagacatcctcggatttccggcaagcccatactcgttttggccaataagcaggataaggaaggtgcgctgggagaggcagacgtcatcgaatgcttgtcattggagaaattagtgaacgagcacaaatgtctgtgtcagattgaaccctgctctgccataagcggctatggcaaaaaaatcgacaagtcaattaaaaaagggctgtattggctgttgcacgttatcgctagagacttcgatgcactcaacgagagaattcagaaggagaccaccgaacagcgagcgctggaagaacaggagaagcaggagagggccgaacgcgtgcggaaactgcgggaagagaggaagcaaaacgaacaggaacaggcagagctggatggcacaagcggcctggccgaactagaccccgaacctacaaatccgtttcagcctattgcgtcggtcataattgagaatgagggcaaactggagagggagaaaaaaaaccagaagatggaaaaggacagtgacggttgccacctgaagcacaagatggagcacgaacagattgagacacaggggcaggtcaaccacaacgggcaaaaaaacaatgagttcgggctcgtggagaattataaggaggctctgacccagcagctgaaaaacgaggacgagacagatagaccatccttggagtccgcgaatggcaagaagaagaccaagaaattaagaatgaagcgaaaccatcgagtcgaacccttgaacatcgacgattgtgcccctgaatcgccaaccccgcctcctccacccccacctgtgggatggggcactcccaaagtgacacgcttgcctaaactggaacccctaggcgagacccaccacaacgacttctacagaaaacccctgccacctttagccgtgccgcagaggcccaactccgatgcccacgacgtgatctcttag

SEQ ID NO: 213784 - DNA, 1287 bp, Artificial Sequence
  Description of Artificial Sequence: Synthetic coding sequence
atgttcagtctgatggcatcgtgctgcggctggtttaaaaggtggagggagcctgtgagaaaagtgactcttctgatggtcggcctcgataatgcaggtaaaacagccaccgccaaaggtatccagggggagtatcccgaggacgtggcccctaccgtcggcttcagtaagattaacttgcggcagggaaaattcgaggtgaccatcttcgatctcggtgggggaattagaattagaggcatttggaagaattattacgccgaaagctacggggtcatcttcgtagttgactctagcgatgaagaaagaatggaagagaccaaagaagcaatgtcagagatgctaagacatccccgaatttctggcaagccaatactggtgctcgcaaacaagcaggacaaagaaggggcacttggggaggccgacgttattgagtgcctgtcactagaaaagctggtcaacgaacataaatgtctctgtcagattgagccatgctctgcaatctctggctatggcaagaagatcgataaatccattaagaagggcctctattggctcttgcacgtcatcgctcgagatttcgatgccttgaacgagagaattcagaaagaaacgacagaacaaagagcactggaggaacaggaaaaacaggagcgggcagaacgagtgcggaaactccgggaggaacgcaagcagaatgaacaagaacaggccgaactggacggtacgagcgggcttgccgagttggaccccgagcccactaacccctttcagcctattgcttcagtgattattgagaacgaaggcaagctggagcgagaaaaaaagaaccagaagatggaaaaagacagcgacggttgccatctcaaacacaagatggagcacgaacagatcgaaacacagggacaggttaatcataacggacagaagaataatgagttcggcctggtcgagaattataaagaagctctgacacaacaattaaagaacgaggacgagaccgatagaccttcgttggaatctgcaaatggtaaaaaaaaaaccaagaaactcagaatgaaacggaatcatcgagtggagcccctcaacattgacgattgtgccccagagtcgccaacccccccacctcccccaccgcctgtagggtggggcacccccaaggtgacgcgcctcccaaagctggagccgttgggcgagactcatcacaatgatttttaccgcaaacctctgccgccactcgcagtgcctcagcggcctaattccgacgcccatgatgtgatctcatag

SEQ ID NO: 213785 - DNA, 978 bp, Artificial Sequence
  Description of Artificial Sequence: Synthetic coding sequence
atggaagagaccaaggaagccatgtctgaaatgctgaggcatcccaggatctccggcaaaccaattttggtactggccaacaagcaggataaggagggcgctctaggggaggctgacgtgatcgagtgtttatcattagagaagctggttaacgaacacaaatgcctgtgtcagatcgaaccatgcagcgctataagtggttatggcaagaaaattgacaaatccatcaaaaaaggcctgtattggctgctccacgtcatagcacgcgatttcgacgctctgaatgagcggatacagaaggaaacaactgagcaacgtgctttggaagagcaagagaaacaagagagagccgagcgagtgcggaagctccgagaagagcggaagcagaacgaacaggaacaggctgagctcgacggaacaagcgggttagcggaactggatccagaacccaccaatccattccagccaatcgcttctgtgatcatagagaatgaaggcaagctggaacgggagaagaaaaatcagaaaatggaaaaggacagtgacggctgtcacctgaaacacaaaatggagcacgagcagattgagacccaagggcaggtcaaccataatggtcaaaaaaataacgagttcggactcgtggagaattacaaggaggcactgactcagcagctgaagaatgaggatgagaccgatagaccctccctggaatcagctaatggcaagaagaaaaccaaaaaactgcgtatgaagagaaatcaccgcgtggagcccctgaacattgacgactgtgcaccagagagtcccactcctccgccaccaccccctccagtgggctgggggaccccaaaggtgaccaggttgccgaaattggagcctctgggcgagacgcaccataacgatttttacagaaagcctcttccaccactggcagtacctcagagacctaactcagacgcacatgacgtgattagctag

SEQ ID NO: 213786 - DNA, 450 bp, Artificial Sequence
  Description of Artificial Sequence: Synthetic coding sequence
atggaaaaagacagcgatggctgccacttgaagcataagatggaacatgaacaaattgaaacgcagggtcaggtgaaccataacgggcagaagaacaacgaatttggtcttgtagaaaattacaaggaagccctcacccaacagttaaaaaacgaagatgagaccgatcgcccttcattagagtcagctaatggtaagaagaaaacaaagaaattgcgcatgaagcgtaaccatagggtcgaaccattgaacattgacgattgtgccccagagtcacccacccctcctcccccacccccaccagtcgggtgggggactcctaaagtgacccggctccccaaactagaacctctgggcgaaacgcatcacaacgatttctataggaaaccactcccaccccttgcggtacctcagagacctaactcagacgctcatgacgtgatcagctag

SEQ ID NO: 213787 - DNA, 579 bp, Artificial Sequence
  Description of Artificial Sequence: Synthetic coding sequence
atgggctctttaggctccaaaaatccgcaaactaagcaagctcaggtcctgctgctgggcctggactccgccggtaaaagcaccctcttgtacaagctgaaactggctaaggatatcaccactattcccaccatcgggttcaatgtggagatgattgaattagaaaggaacctgagtcttactgtgtgggatgtgggtggccaggagaagatgcgcaccgtatgggggtgttattgtgaaaacaccgatggcctggtttatgtggttgacagtactgacaagcagaggctggaggagtctcagcgccagtttgagcatattcttaagaacgagcacataaagaacgtgccagtggtgctgttggccaacaaacaggatatgcccggtgctctcaccgctgaggacatcacccgaatgtttaaagtgaagaaattatgcagcgacagaaattggtacgtgcaaccttgctgcgctcttactggagagggacttgcccagggctttcggaaactgacaggctttgtcaaaagccacatgaagagcagaggggatacactggcattttttaagcagaattag

SEQ ID NO: 213788 - DNA, 555 bp, Artificial Sequence
  Description of Artificial Sequence: Synthetic coding sequence
atggggcttctcactattctcaaaaagatgaagcagaaggaacgggagcttcgcctgctgatgttgggtctggacaatgccggaaagaccaccatcctaaaaaagttcaatggggaggacattgatacaattagtcctacgctgggcttcaacattaagaccctggaacaccgtggtttcaagctgaacatctgggatgtggggggtcagaagagccttcggtcctattggagaaattatttcgaaagtaccgatggccttatctgggtggtggattctgcagatagacaacgaatgcaggactgccagcgggagttacagagcctgctcgtagaagagcgacttgctggcgctaccctcttgatctttgctaacaaacaggatcttccgggagcattatcttccaacgcaattagggaagtgttggaattagatagtattcgtagccaccattggtgcatccaagggtgctctgccgtcactggggagaacctcctgccaggcattgattggctgcttgacgacattagtagcagaatattcactgctgactag

SEQ ID NO: 213789 - DNA, 555 bp, Artificial Sequence
  Description of Artificial Sequence: Synthetic coding sequence
atgggactgctgacgatccttaagaaaatgaagcagaaggagcgtgaattacgtctactgatgttaggcctggacaatgcgggaaaaaccaccattttgaagaaatttaatggggaggatatcgataccatttcaccaacactcgggttcaatatcaaaactcttgagcatagaggctttaagctgaatatatgggacgtgggaggacagaaatcattgcgtagttactggcgaaactactttgagagtaccgacggccttatatgggtggtggacagtgccgaccgccagagaatgcaagattgccagcgagaactgcagagcctgctggtagaagaacgccttgctggcgctacgcttcttatttttgccaataagcaggacttgcctggagcactttcctccaatgctatccgggaggtactggagttggactccatccggtcccaccactggtgcatccagggctgttccgccgttaccggggagaatctactacccggtatcgattggctgctcgacgatatctcaagcaggatatttacggctgattag

SEQ ID NO: 213790 - DNA, 474 bp, Artificial Sequence
  Description of Artificial Sequence: Synthetic coding sequence
atgggcctgcttactatcctgaagaaaatgaagcaaaaggaacgagagctccgcctgcttatgctgggcctggataacgcaggcaaaacgaccatcctcaagaaatttaatggcgaggacatagataccatatcccctacactcggttttaacattaagactctcgagcaccggggattcaaactgaatatatgggatgtcggcggtcagaagtcattacggagctattggcgaaactacttcgaaagcaccgacgggttgatctgggtagtggattctgccgatcgccagagaatgcaggattgccagagggagctccagtcactgttggtggaagaggtcctagaattggacagcataaggtcccaccactggtgtattcaggggtgtagcgcagtcaccggagaaaacttactgcctggtatcgactggcttttagatgatatttcatcgcggatttttacagccgactag

SEQ ID NO: 213791 - DNA, 549 bp, Artificial Sequence
  Description of Artificial Sequence: Synthetic coding sequence
atggggttgctgagcatccttcgtaaattaaagagcgctcccgatcaggaggtgcggattctcctgctgggcctggacaatgctggaaagactaccctcctgaaacagctcgcgtcagaggacatctcacatatcaccccaacccaaggcttcaatatcaaaagcgtgcaatcacaaggtttcaaactcaacgtctgggacatcggaggacagaggaaaatacgaccgtattggaagaactatttcgagaatacagacatcctgatctacgtaatcgatagcgccgataggaagcgttttgaggagaccgggcaagaattagcagagctcttggaggaagaaaagctttcgtgcgtgccagtactcatatttgcaaataaacaagatttgcttaccgccgctccagctagcgagattgctgagggcctgaacctgcatacgatacgtgacagggtttggcagatacaatcgtgttctgccctcaccggggagggcgttcaagacggaatgaattgggtatgtaagaatgtcaatgccaagaagaagtag

SEQ ID NO: 213792 - DNA, 606 bp, Artificial Sequence
  Description of Artificial Sequence: Synthetic coding sequence
atgggcaatcatctgacagaaatggcaccgactgctagctcttttctgccgcattttcaggctctgcatgtggttgtcattggactggatagcgccggtaagacttcactgttataccgcctgaagttcaaggagtttgtgcagtccgtgccaactaaaggcttcaataccgagaagatccgggtcccactcggcggtagcagaggtattactttccaggtgtgggatgtagggggtcaggagaaactgcggccactctggcgtagctacacacggagaaccgacgggctggtattcgtggtggacgcggctgaggctgagcggctggaggaggccaaagtagagctgcaccggatatctcgcgcttcagacaatcagggagtgcctgtgcttgtgctggctaataagcaggaccagccgggagcactgtccgcagctgaagtcgagaaacgcctggctgtcagagagcttgcggcagccaccctgacgcacgtgcaaggttgcagtgccgtggatggcctgggccttcagcagggactggaacggctctacgaaatgatcctaaaaaggaagaaagcagctcgcggaggtaagaagcgccgatag

SEQ ID NO: 213793 - DNA, 561 bp, Artificial Sequence
  Description of Artificial Sequence: Synthetic coding sequence
atggggctcttagaccgcctctcagtcctcctgggtctgaagaagaaggaggtccatgtcctctgtctcggactggacaactccggcaagaccaccatcattaacaaattgaaaccttccaacgcacagtcccagaatatcttaccaaccataggcttttcaatcgagaagttcaaatcatcttctttgtcatttaccgttttcgacatgagcggacagggacggtaccgtaacctctgggagcactactataaggaaggccaagctataatctttgtcatagacagttctgaccgactgcgcatggtggtggcaaaagaggagttggataccctgttgaaccatccggatattaagcaccgaagaatccctattctgttcttcgcgaataaaatggacctgcgcgacgcggtaacctctgtgaaagtgagccagctactatgtctggagaatatcaaagataaaccctggcacatttgcgcaagcgacgccatcaagggggagggtcttcaggaaggggttgattggcttcaggaccaaattcagactgtgaaaacttag

SEQ ID NO: 213794 - DNA, 561 bp, Artificial Sequence
  Description of Artificial Sequence: Synthetic coding sequence
atgggcctgctggatcgtctgtcagtattgcttgggctgaaaaaaaaagaggtacacgttttatgccttggcttagacaattctggaaagaccacaattatcaacaaacttaagcctagtaacgctcagagccaaaacattctacctacaatcggttttagtatcgagaagtttaaatcatcttctctgagctttactgtgttcgacatgtctggacagggtagatacaggaatctgtgggagcattactataaagagggccaggctattattttcgttattgatagctctgaccgcttgcgtatggtggttgccaaagaggagctggacacgctgcttaaccatcccgacattaaacatcgacgtatcccaattctgttctttgcgaacaaaatggacctgagagatgccgtgacctcagtgaaagtgagtcagctcctgtgtctggagaacattaaagacaagccttggcatatctgtgcctcggatgccataaaaggcgaaggcctccaagaaggcgtcgactggctgcaggatcagattcagacggttaagacttag

SEQ ID NO: 213795 - DNA, 366 bp, Artificial Sequence
  Description of Artificial Sequence: Synthetic coding sequence
atgggcctcctcgatcgactatctgtgttgctgggactcaaaaagaaggaggtgcacgttctgtgcttgggtctggacaactccggcaagactaccatcattaataagttgaaaccaagcaatgcgcagagtcagaacattctgcctaccatcggattctccattgagaagttcaagagcagctctctaagcttcaccgtgttcgacatgagcggtcaaggacgctatcgcaatctgtgggagcattactacaaagaggggcaagccatcatcttcgtgatcgacagttctgaccgcctgcgcatggtggttgccaaagaggagctcgatacactcctgaaccaccctgacatcaagcaccggtag

SEQ ID NO: 213796 - DNA, 561 bp, Artificial Sequence
  Description of Artificial Sequence: Synthetic coding sequence
atgggccttcttgaccggttgagcgtcctgctgggtctgaagaagaaggaagttcacgtgctttgccttggcctggacaatagcggcaagactacgataatcaataagttaaaaccttccaatgcacagagccagaatattttgcccacaattggctttagcatcgagaaatttaagtccagttcactgagctttacagttttcgacatgtcaggccaggggagatacagaaacctgtgggagcattattacaaggagggtcaagccatcatcttcgtgatcgactcatccgatcgactcagaatggttgtagcaaaagaggaactggatactctcctaaaccatccagatatcaaacatcgtagaataccaatcctcttctttgcgaacaagatggatctaagggatgctgtgacatctgtgaaagtctctcagctcctctgcttagaaaatatcaaggacaaaccgtggcacatctgcgcctcagacgccattaaaggagaagggctgcaggaaggagtggattggttacaagaccagattcagacagtgaaaacctag

SEQ ID NO: 213797 - DNA, 561 bp, Artificial Sequence
  Description of Artificial Sequence: Synthetic coding sequence
atgggactgctggataggttgtcagtgctgctgggactcaaaaagaaagaggtgcacgttctatgtctggggttggataacagcggaaagaccacaatcatcaacaagctaaagccctccaatgctcagtcgcaaaacatcttaccaacgatcggcttttctattgaaaaatttaagtcttcctccctgtcctttacagtgttcgatatgagcggtcagggacggtatcgcaacttgtgggagcattactacaaagaaggacaagcaattatttttgtgattgacagcagcgacaggttgcgcatggtcgttgcaaaagaagagcttgacacattgcttaatcacccagacattaaacacaggcggatcccaatcttgttctttgctaacaagatggatctgagagacgctgtgaccagcgtgaaagtcagccaactgctttgcttagaaaatatcaaggacaaaccctggcacatttgcgctagtgatgcgattaaaggcgagggtttgcaggagggcgtggattggttgcaggatcagatacagactgtgaaaacctag

SEQ ID NO: 213798 - DNA, 564 bp, Artificial Sequence
  Description of Artificial Sequence: Synthetic coding sequence
ctgcggccaacatggaaggcccttagccaccctgcctggccggaagaaaagaataaacagattcttgtgctgggtctggatggcgcaggcaagacttcagtactgcatagcctggctagcaacagggtgcaacatagcgtggcgcctacccaagggtttcacgctgtgtgcataaacactgaagattcacaaatggagttcttagagattgggggtagtaaacccttccgtagctattgggagatgtacctcagcaaaggcctgttactcattttcgtggttgactcagctgatcatagcagactgccagaggctaagaaatatctacatcaactgattgccgcaaatcctgttctgcctcttgtggtattcgccaacaagcaagacctggaagccgcatatcacatcaccgacattcacgaggcgctggcactgtcggaggtaggaaatgacagaaaaatgttcctgtttgggacctacctcacgaagaatggctctgagatcccaagcaccatgcaggacgccaaagacttaatcgcccaacttgccgcagatgtgcagtag

SEQ ID NO: 213799 - DNA, 1083 bp, Artificial Sequence
  Description of Artificial Sequence: Synthetic coding sequence
atggaaagagccggtcctgcaggcgaagagggaggagccagagaaggacgactgcttccacgcgctcccggagcctgggttctgcgggcttgtgctgaacgagccgcactagaggttggagccgctagcgcagacactggagtgcggggttgtggagctcgcggtccagccccactgctggcctccgccggaggaggccgagctcgggatggcacctggggtgtgaggacaaagggctccggtgccgctttgcctagtcggcctgcctcccgcgctgcacccagaccagaagcatctagccctccgcttcctctcgagaaagccagaggcggattgagcggtccgcagggcggtcgcgcacgtggtgccatggctcatgtcgggagcagaaagcgaagccgtagcagatcacgatcccgcggacgagggagcgagaagcggaaaaaaaagtcccggaaggacactagtcgaaactgctccgcatcaacaagccaaggtcggaaagcgtccaccgctcccggagccgaggccagcccgtccccttgcattacagaacgttcaaagcagaaggccagacgcagaactagaagttcatcttcaagttcttcatcttccagcagttctagctctagttctagctcttcctcctcaagtagctcttctgatggccgaaagaagcgtggaaagtacaaggacaaacggagaaagaagaagaaaaagcggaagaagctaaagaagaagggaaaagaaaaagctgaggcccagcaggtagaggctctgccaggtcccagcctagatcagtggcacaggtcggctggtgaggaggaggacggcccagtcctgaccgacgagcagaagagcagaatccaggcaatgaaaccaatgaccaaggaggaatgggacgccagacagagtatcatccgtaaggtcgtggatccagaaaccggccgtacccgtctcattaagggcgatggagaggtgctggaagagattgtcaccaaagagagacacagggagatcaacaagcaagccacccgcggtgattgcctggctttccaaatgcgggcaggcttgctgccctag

SEQ ID NO: 213800 - DNA, 1017 bp, Artificial Sequence
  Description of Artificial Sequence: Synthetic coding sequence
atggaaagggcagggccagccggtgaggagggcggagcccgtgagggcaggcttctcccgagagccccaggggcatgggtcctacgggcatgcgccgagagagccgctctggaggtgggtgccgcatccgccgatacaggagtccgcggatgcggcgctcgcggtcctgccccactgcttgcctcagccggtgggggaagagctcgagatggcacatggggcgtgcgcactaaaggatctggagcagccctccccagcaggccagccagccgagcggctcctaggccggaggcttcctcaccccctctcccacttgagaaggccagggggggactctccggtccacaggggggaagggctcgcggagccatggcacacgtgggctcaagaaagcgatccagatcccgatctcgctcacgcggacgtggcagcgagaaaagaaaaaagaaaagccgcaaagatacctctagaaattgctccgcatctacatcacaggaaagatccaagcagaaagcccgacggaggactcgctcgtcctcgagtagctccagttcttcttccagttctagctcatcttcttcctcgagctcctcgtccagttccagtgatggaagaaagaaaagaggaaaatataaagacaagcgacgcaaaaagaagaagaaaaggaaaaagctgaagaagaagggaaaggagaaagccgaagcccagcaggtggaggcccttcccggaccatctctggaccagtggcatcgttccgccggagaggaagaagacgggccagtcctgactgacgaacagaaatcacggatccaggccatgaagcccatgacaaaagaagagtgggacgccaggcagtccattatcaggaaagtcgtggaccctgaaaccgggcgaactagactgatcaagggcgacggcgaggtgctggaagaaatagttacaaaagagcgtcatcgtgagatcaataaggtgggggtggccccacttcccgctatccgtccacaactgtgtttgtag

SEQ ID NO: 213801 - DNA, 1059 bp, Artificial Sequence
  Description of Artificial Sequence: Synthetic coding sequence
atggagagggccggtcccgctggcgaggagggcggtgcacgtgagggtcggctcctgcctagagctccaggggcatgggtactgcgcgcttgcgcggagcgggctgcactagaagttggagccgcttctgcggatacaggagtgagaggctgtggtgccaggggcccagcaccgctgttggccagcgctggtggcggaagggcacgggatggtacttggggggtgagaaccaagggaagcggcgcagctttgcctagtcgcccagctagtagggctgcaccaagacccgaggctagctctcccccactgccattagagaaggcgcgtggcggtctgagtggccctcagggcggacgggcacgaggcgctatggcccacgtcggaagtaggaagaggtcaaggagccggagccggagtaggggtcgcggatcagagaagaggaagaaaaagagtaggaaggacacctcaagaaactgtagtgcatctacttcccagggacgtaaggcatctacagcccctggagccgaggaaaggagcaaacagaaagcacgaaggagaacgagaagttcctcgtcctccagttccagttcatctagcagctcatcttccagctccagctcctcaagttctagctcttcagatggtcgcaagaagagaggaaagtacaaagacaagcgccgtaaaaaaaagaagaaacggaagaagcttaagaagaaggggaaggagaaggctgaagctcagcaggtcgaggcactgcctggaccatccctggatcagtggcatcggagcgctggcgaagaggaagatgggcctgtcctgacggacgagcagaagagccggatccaagcaatgaaaccgatgacaaaggaagaatgggacgctaggcagtcaatcattcgcaaggtcgtggaccctgagactggcaggaccagactgatcaaaggcgatggcgaagttctggaagagatcgtgacgaaagaaagacaccgtgagattaataagcaggctacacggggtgactgtctcgccttccagatgcgcgctggtctgctaccctag

SEQ ID NO: 213802 - DNA, 1026 bp, Artificial Sequence
  Description of Artificial Sequence: Synthetic coding sequence
atggaaagggccggtccagctggcgaggagggcggtgcccgtgaaggacgcctgttaccgcgagccccaggcgcttgggttctgagagcctgtgccgaaagggccgctctcgaggtgggcgcagcttcagcagataccggagttagggggtgcggggcacgaggtcccgctcccctgctcgcctcggctggcggtggtcgcgctcgcgatggaacctggggggtgaggacaaagggctccggtgccgctctgccgtctcgaccagcatcaagggccgcacctaggccagaggccagtagtcctcctttacctcttgaaaaggcacgtggaggcctgtctgggcctcaggggggaagggctaggggggctatggcgcatgtgggcagtaggaagcgatcacggagtcgtagtagatctcgtggccgtggtagcgagaagcgaaagaaaaagtcgagaaaggacacgagccgcaactgtagtgcctcaacttctcaggaaagatcaaagcagaaagcccgtcgacgtacccggtcaagctcctcctccagcagctctagctcctcctcatcctcttctagcagcagttctagcagtagctcaagttctgacggaagaaagaagagagggaagtacaaggacaagcgacgcaaaaaaaagaagaagaggaaaaagctgaaaaaaaaaggtaaggagaaggcagaagctcagcaagtggaggccctccccggacctagcctagaccagtggcatagatctgccggagaagaagaggatgggccagtgctcacagacgaacagaagtccaggattcaagcaatgaagccaatgaccaaagaggaatgggatgctcgtcagtccataatcaggaaggtggtggatccagagaccgggagaacccggctcatcaagggcgacggagaggttttggaggaaattgtgaccaaggaacggcatagagaaatcaataagcaggccaccagaggggattgcttggccttccagatgcgggctggtcttctgccctag

SEQ ID NO: 213803 - DNA, 567 bp, Artificial Sequence
  Description of Artificial Sequence: Synthetic coding sequence
atggacgtcaatatagcgccactgagggcttgggatgatttcttccctggctccgacaggtttgcaaggccagacttcagggacatttccaaatggaacaaccgtgttgtgagcaatctgctgtattatcagacgaactaccttgttgttgctgctatgatgatcagcatagtgggattcctcagtcctttcaatatgatccttggaggcatagtagtggtgcttgtcttcacagggttcgtttgggctgcccacaacaaggacgtgctgcgacggatgaagaaaaggtatccaacaacattcgtgatggtggttatgctggctagttacttcctcataagcatgtttgggggagtcatggtttttgtgtttggcatcactttcccattgctgctgatgtttattcatgcttcattacgattaagaaatcttaaaaacaagctcgaaaacaaaatggaaggcattggactgaaacgaacacccatggggattgtgctcgacgcactggaacaacaggaggagggtatcaaccgtctgacagactacataagcaaagtgaaggaatag

SEQ ID NO: 213804 - DNA, 411 bp, Artificial Sequence
  Description of Artificial Sequence: Synthetic coding sequence
atggacgtcaatatcgccccacttcgagcctgggatgattttttccccggatcggatcggttcgcgcgtccggacttcagggacatctcaaagtggaataaccgggtcgtgtccaacctcctctactatcaaactaactacctcgtggttgcagctatgatgatttctattgtgggctttctaagcccgtttaatatgatcctcggcggaattgttgtggtcctggtattcacaggattcgtgtgggccgcacacgatgtgaggtatggcggtcacgtcggcgagttgtttccttacttgcacgtctggagaagtcacgggctctgtgtctggcactatttcagctttgcggtcgatgtgtatccctgtatcgtggaaaccagtgagccacaggaacagacgggagaatag

SEQ ID NO: 213805 - DNA, 819 bp, Artificial Sequence
  Description of Artificial Sequence: Synthetic coding sequence
atggtgcgctgttacgtggaaatcgtggaaaagctgcccgaaagaagaccagacccagccaccattgaagggtgcgctcagctgaaaccgaataattacctgctagcgtggcacaccccattcaacgagaagggctcgggattcggggcagccactaaagccatgtgcatcggcctgcgttattggaagcctgagcgcctggagactttaatagaagtgagtgtggaatgcggaagaatgacgcacaatcacccaactgggttcctgggtagcctctgcaccgcgttgttcgtcagcttcgcagcccagggtaagcccctcgtgcagtggggcagagatatgctccgcgcagtgccactggctgaggaatattgccggaaaaccatcagacacacggcagagtaccaagagcactggttttatttcgaagcgaaatggcaattctatctagaggagcgtaaaatctcaaaagattctgaaaataaggccatcttcccagacaactacgacgcagaagaaagagagaagacctacaggaaatggtctagcgaagggagaggaggccgtcgtggccatgacgctcccatgattgcttacgatgccctactagcagcaggcaattcatggaccgaactctgtcaccgcgcaatgttccacggaggagaaagcgctgccacagggactatcgcgggatgtctcttcggtcttctgtatgggcttgacctggttcccaaaggactctaccaggatctggaagataaagagaagcttgaggatctaggggctgctctgtatagattgtctacagaagaaaaatag

SEQ ID NO: 213806 - DNA, 1065 bp, Artificial Sequence
  Description of Artificial Sequence: Synthetic coding sequence
atggaaaaatttaaagcggcaatgctgctcggctctgtcggggacgcccttggatatcggaatgtatgtaaagaaaattcaaccgtgggaatgaaaatccaggaagagctgcaaagaagcgggggactggaccacctggtacttagtccgggtgagtggccggtgtctgataatacaatcatgcatatcgccaccgctgaagccttaacaacggactactggtgtctagacgacctgtatcgagagatggttaggtgttatgtggaaattgtggaaaagctgccggaacggcgacccgatccagccaccatcgagggttgtgcacaactgaagccgaacaactaccttttggcctggcacacaccattcaacgaaaaagggagcggcttcggggcagccaccaaggcaatgtgtatcggcctccgctattggaagcccgaacgtcttgagaccttgatcgaggtgagtgtggagtgtggacgcatgacacacaatcaccccacaggattcctagggtcgctctgtacagcgctgttcgtttcatttgccgcacaagggaagcccctggtgcaatgggggagagacatgcttcgggctgtcccactggccgaagagtactgccgtaaaactattagacacacggccgaataccaagaacactggttctattttgaagcgaagtggcagttctaccttgaagaaagaaaaatttctaaagatagcgagaacaaggcgatttttccagacaactacgacgcagaagaaagggagaaaacatacagaaaatggtcctcagaaggcagagggggacgtaggggccatgatgccccaatgatcgcctacgacgcacttcttgctgcaggcaattcgtggaccgagttatgtcaccgcgctatgttccacgggggagagtccgctgccacgggaactattgcaggatgtctgttcggactgctctacggccttgacctggtgcctaagggcctgtatcaagaccttgaggacaaagagaagttggaggacctgggtgcggctctgtaccgtctgtctactgaggagaagtag

SEQ ID NO: 213807 - DNA, 531 bp, Artificial Sequence
  Description of Artificial Sequence: Synthetic coding sequence
atggtccggtgctatgtcgagatcgtcgaaaaacttcctgagaggcgacctgaccccgctaccatcgaaggatgtgctcagttaaaacctaacaactacctacttgcttggcacactccctttaatgagaagggcagcggcttcggagcagccactaaggctatgtgcatcgggctgcggtactggaaacctgagcgccttgaaaccctgattgaagtgtccgtggagtgtggccgtatgacccacaaccatcctactgggttccttggttcgctgtgtaccgcattgttcgtcagtttcgcggctcaggggaaacctctagtccagtggggtagagatatgctccgcgcagtgcctctggctgaggagtactgtcggaaaaccatccggcacactgctgagtatcaggagcactggttttactttgaggccaagtggcagttttacttggaggagaggaaaatctctaaggattccgaaaacaaagccatcttcccggataactacgacgctgaggagagagaaaaatag

SEQ ID NO: 213808 - DNA, 1092 bp, Artificial Sequence
  Description of Artificial Sequence: Synthetic coding sequence
atggcagctgccgctatggccgcagccgctggaggcggagcaggggctgctaggagcctttcgcggtttagagggtgccttgcaggagcacttctgggcgattgcgtgggcagcttctacgaagcacacgataccgtcgaccttacctctgtcctccggcatgtgcagagcctggaacctgacccaggtacccctggatccgaacgcacagaagcgctctattacactgatgatactgcgatggccagagctctcgtgcaaagcttactcgccaaggaggcctttgacgaagttgatatggcccatcgtttcgcccaagagtataagaaagatcctgaccgcggttacggcgctggcgtggtgacagtgttcaagaagttacttaatccgaagtgcagggacgtctttgagcccgcacgcgcacaatttaacggaaaagggagttatggaaatgggggagcaatgagggtcgccggtataagcctcgcctacagctcggtgcaggatgtgcagaagttcgcgaggctgtcagcccagcttacccatgcgagttcactgggctacaacggcgcaattctgcaagctttggctgtccacctcgccctacaaggcgaatccagttccgagcacttcctgaaacagctccttggtcacatggaagacctggagggagacgcacagtctgtgcttgacgctagagaactggggatggaagagcggccttactcctcacgtcttaagaagatcggcgaactgctcgaccaggcttctgtgacccgagaagaggtagtcagtgagctgggaaatggtattgcggctttcgagtctgtcccaacagccatctactgtttcttgaggtgcatggagcccgatcccgagataccatccgcttttaatagcctgcagagaaccctcatttattccatttctctgggaggagacactgacacaattgcgacaatggcaggagcaatagcgggagcctactatgggatggatcaagtgcctgaatcgtggcagcagtcttgcgaggggtacgaagagacagacattttggcgcagagcctccacagagttttccagaagagctag

SEQ ID NO: 213809 - DNA, 852 bp, Artificial Sequence
  Description of Artificial Sequence: Synthetic coding sequence
atggccagggctcttgtccaatctctgctggccaaagaagcttttgatgaagtagacatggctcaccggttcgcccaggagtacaagaaggaccccgatcgcggatacggagctggcgtggtgaccgtgttcaagaaactgctcaaccccaagtgcagagatgtattcgaacccgcacgcgcacagttcaacggcaaaggaagctacggcaacggaggggctatgagagtggccggtatctctctggcctattcctctgttcaagacgtacagaaatttgcgcgtctttccgcccagctgactcatgcttcctctcttggctacaacggggcaatacttcaggctttggccgtgcacctcgccctgcaaggcgagagttcatctgagcactttcttaagcaactgctgggccatatggaagacctcgaaggggatgctcagagcgttctcgacgccagagaactgggaatggaggagcgaccctactcctctaggcttaaaaaaattggcgagctgttagaccaggcgagcgtgacgcgcgaagaggtggttagcgagctgggtaacggtatagcggcattcgaaagtgttcccactgccatttattgtttcctgcgctgcatggaacctgaccccgaaattccaagtgcttttaattctctccagcgcacactgatttacagtatctccctggggggagatactgacaccatagcgactatggctggcgctattgcaggggcttactacgggatggaccaagtgccagagagctggcagcagagctgcgaagggtatgaggagacggacatcctcgcacaatccctgcacagggtgtttcagaaatcctag

SEQ ID NO: 213810 - DNA, 630 bp, Artificial Sequence
  Description of Artificial Sequence: Synthetic coding sequence
atgagggttgccggaatttctcttgcctatagtagcgtccaggacgttcaaaagttcgctcggctatcagcccagctcacccacgccagctcactcggatacaatggagcaatactgcaagctcttgcagttcacctagccctgcagggggagtctagctccgagcatttcttgaagcagcttttgggacacatggaagatttggagggcgacgcacagagtgttttagacgccagagagcttggtatggaggagcggccttactctagccgactaaagaaaataggggaactgttggatcaggccagcgtcaccagagaagaagttgtatccgagcttggaaacggcattgcagccttcgaaagcgtaccaactgccatttattgcttcctgaggtgtatggagcctgaccctgagatcccttcggcgtttaactcccttcagcgcaccctgatctactccattagcctcggcggtgacactgacactatagccaccatggccggtgcaatcgctggcgcatattacggcatggatcaggttccagaaagctggcagcagtcctgcgaaggctacgaggaaacggacatcctggctcagtctttgcacagagtgtttcagaagtcttag

SEQ ID NO: 213811 - DNA, 984 bp, Artificial Sequence
  Description of Artificial Sequence: Synthetic coding sequence
atgcaaatgcctgccatgatgtccctgctcctcgtttccgtcggactcatggaggcgttgcaggctcagtcgcaccctatcacacgtagggatctatttagtcaggagatacagttggatatggccttagcttcctttgatgaccagtacgctggctgtgccgctgcgatgaccgccgcactccccgacctcaatcacactgaatttcaagctaaccaagtgtacgcagatagttggactcttgcttcttctcagtggcaggaacgccaggccaggtggcccgaatggagcctctcacctacccgacccagtccgccacccttgggttttagggatgagcatggcgtcgcactacttgcctataccgcaaattccccactccacaaggaatttaatgcagcagtgcgggaggcaggccgatcccgcgctcattacctgcatcacttctcatttaaaactctgcacttcctcctgacagaagcgctgcagttactcggtagtggacagcgcccacctaggtgtcaccaagtgttccggggagtgcacggcctcagattcaggcccgctggcccaagggctacagtgagactaggagggttcgcctccgcttctttaaagcatgtggcagctcagcagttcggggaagacaccttttttgggatctggacttgccttggtgccccaattaaaggatacagtttctttcctggcgaagaagaggttttgattcccccattcgagacgttccaggtgataaatgcctctcgactggcccagggacctgcaagaatttacctgcgcgcattgggaaaacattctacatataattgtgaatatattaaagacaaaaagtgcaagtccggcccttgccacctagataattccgccatggggcagagtcctctgagtgcggtctggagtttgttactgttgttatggttccttgtggttcgagcatttcccgacggccctgggctgctgtag

SEQ ID NO: 213812 - DNA, 1104 bp, Artificial Sequence
  Description of Artificial Sequence: Synthetic coding sequence
atgaagactgggcatttcgagatcgtgaccatgttgctcgctaccatgatcctggtagacatttttcaggtgaaagctgaggttctcgatatggcggacaatgcctttgacgacgaatacttgaagtgcacagatcggatggaaattaagtacgtgccccagctgctcaaagaagaaaaagcatctcaccagcagctggacaccgtctgggaaaacgcgaaggccaaatgggccgcacggaaaacccagatcttcctccccatgaattttaaagacaatcatggcatcgctttgatggcctatataagcgaagcccaagagcagacgcccttctatcacctgttttcagaagccgtgaaaatggccggtcaaagcagagaggattatatctacggattccagttcaaagcatttcacttctacttaacacgggcattacaactgctccggaaaccttgtgaggcatcgagcaagacggtggtttacagaacaagccaaggcacgtcgttcacgtttggcggtctgaaccaggccaggttcggtcactttacattagcctactcggccaaaccgcaagctgcgaatgatcagctgacagtactctccatctacacctgtctcggcgtcgacatcgagaatttcctggacaaggagtctgagcgcataacgctgatccccttgaatgaggtctttcaggtttctcaggaaggcgctggtaataacctaatcctgcagagtattaacaagacatgttcccattatgagtgcgcattcctgggaggactaaagaccgaaaactgcatagagaacctggagtactttcagcccatctatgtctacaatcccggagagaagaatcagaaattagaagatcattccgagaagaattggaaactggaagaccatggtgagaagaatcagaagctagaggatcacggcgttaagatcctggagcctacccagattcccgctccaggcccagtgccggtccccggtccaaagagccatccatctgccagttccgggaagctgctgctaccccagttcgggatggtgatcatattaatctccgttagcgccattaatctttttgttgcattgtag

SEQ ID NO: 213813 - DNA, 1137 bp, Artificial Sequence
  Description of Artificial Sequence: Synthetic coding sequence
atgaagaccgggcatttcgaaattgtaacaatgctgttggccactatgatccttgttgacatttttcaggtcaaggccgaggtccttgatatggccgacaacgctttcgacgatgagtatctcaagtgcactgaccggatggaaattaagtatgtgccccagctgctgaaggaggaaaaagcgtcgcaccagcaacttgacacggtgtgggagaatgcaaaggctaaatgggccgctagaaaaactcagatttttcttccaatgaactttaaggataatcacggaatcgccctcatggcttatatatcagaagctcaggagcaaacacctttctatcacctctttagcgaggctgtaaagatggctgggcagagtagggaagactatatctatgggtttcaattcaaagcctttcacttttatttgaccagagctctgcagctcctgcgtaagccttgcgaagccagctccaaaaccgtggtgtaccggacaagccaggggacctcatttaccttcggcggtctgaaccaggcaagatttggccatttcacactggcttattcggccaaaccacaggcagccaatgaccagctgaccgtcctgagcatttacacatgtctgggggtggatatcgagaacttcctggacaaggagagcgagcgtatcaccttgatcccactcaatgaggtttttcaggtctctcaagaaggagctgggaacaatctgatcctgcaaagtatcaataagacgtgttcccattatgagtgtgcatttctcgggggtctgaagaccgagaactgcatcgagaacctcgaatatttccagcccatctatgtatataaccctggagagaaaaaccagaaactcgaagaccattcagagaagaactggaagctggaagatcacggtgaaaagaaccagaaactggaagaccatggagtcaagatcctcgaacctacccagatccccgaagataaatcacagggcaacatcaacaatcccacccctggaccagtgcctgtaccgggacctaagtcacacccatccgcatccagcgggaagctcctgctgccacagtttgggatggtgatcattctcatttcagtaagcgctatcaatctcttcgtggccctgtag

SEQ ID NO: 213814 - DNA, 1170 bp, Artificial Sequence
  Description of Artificial Sequence: Synthetic coding sequence
atgaaaacaggacacttcgaaatagtcaccatgctcttggctacaatgattttggtggatatcttccaagtcaaagcagaagtgttagatatggcagacaacgcattcgatgacgaatatctgaagtgcactgataggatggagattaaatacgttcctcagctcctgaaggaagaaaaagcgtctcaccaacaactcgacacggtgtgggagaacgccaaggccaagtgggccgctaggaaaactcagatctttctgcccatgaactttaaggacaaccatggaattgccctgatggcatatatcagcgaggcccaggagcagacccctttttaccacctcttttcagaagctgtcaagatggccggacagagtcgagaagactacatttacggctttcagttcaaggcttttcacttctacctgacgcgagcactgcagcttctgcgaaagccttgcgaggcttcttccaagacagtagtatatagaacgagtcaggggacatcgtttacattcggcggtttaaaccaagctcgcttcggacatttcacgctggcttacagcgctaagcctcaggcagccaatgaccaactcaccgtcttgtccatatacacgtgcctcggtgtggacatcgaaaatttcttggataaggaaagtgaaagaatcaccctcatacctcttaacgaagtgttccaagtctcccaagaaggcgcaggtaataatctgattctgcagtcaattaacaagacatgctcccattacgagtgcgctttcctgggaggcttgaaaactgagaattgtatcgaaaatttggaatactttcagcccatttacgtctacaaccccggtgaaaagaaccaaaagttagaggatcatagcgagaagaattggaagttagaggatcatggggaaaaaaatcagaagctcgaggatcatggagtgaaaattttggaacccacgcagattcccggtatgaagattcctgagcctttccctttacccgaagataaaagccaagggaatatcaacaacccaacccccggaccggtgccagtgccaggcccaaagtctcatccatccgcctcaagtggaaagctcttgttgcctcagttcgggatggtgattatcttgattagcgtgagcgccattaacctgtttgtagcgctgtag

SEQ ID NO: 213815 - DNA, 390 bp, Artificial Sequence
  Description of Artificial Sequence: Synthetic coding sequence
atgaagactgggcacttcgagattgtaacgatgctgctcgctaccatgattttggtagacatttttcaggtgaaggcagaggtcctcgacatggcagataatgcctttgacgatgagtacctgaagtgcaccgatcggatggaaatcaagtacgtcccacaattgctgaaagaggagaaagccagtcatcagcagctagacactgtctgggaaaacgcgaaagccaaatgggctgcacgcaagactcagatattcctaccaatgaatttcaaggataaccacggcatagccctgatggcctatattagcgaggcgcaggaacaaacccctttctatcatctttttagcgaggcggtgaagatggccggacagagccgcgaagactactag

SEQ ID NO: 213816 - DNA, 528 bp, Artificial Sequence
  Description of Artificial Sequence: Synthetic coding sequence
atgaaaactgggcacttcgagattgtcaccatgctcctcgccaccatgattctggtcgacatcttccaggttaaggcagaagtcctcgacatggctgataacgccttcgatgacgaatacctgaaatgtacagacagaatggaaatcaagtacgtgccccagcttctgaaagaggagaaggcctctcaccaacagctggatactgtgtgggaaaatgcaaaagcaaaatgggccgcacggaaaacccagatctttctccccatgaatttcaaagacaaccacgggattgccttgatggcctacataagcgaggcacaggaacagactccgttttaccacttgttctcagaggccgtgaagatggctgggcagtctagagaagattatatttacggattccagttcaaggctttccatttctatcttactagggctctacaactcctacggaagccatgcgaggcaagttctaagaccgtcgtgtatcgaacatctcaaggtacgagcttcactttcggcggtctgtag

SEQ ID NO: 213817 - DNA, 609 bp, Artificial Sequence
  Description of Artificial Sequence: Synthetic coding sequence
atgaagaccgggcatttcgaaatagtgaccatgctgctcgcgacaatgattctggtcgatatattccaggtgaaagccgaggttttggacatggcagataatgcttttgacgacgagtacttaaaatgtacagacagaatggaaatcaaatacgttcctcaactcctgaaggaggagaaggcctcacatcagcagctggatacagtctgggagaacgcaaaggccaagtgggccgctaggaaaacccagatttttctccccatgaacttcaaagacaaccatgggattgctctgatggcttacataagcgaggctcaagagcagacccccttctatcacctcttttccgaggccgtaaaaatggccggtcagtcccgcgaagactacatatatggctttcaatttaaggcctttcatttctatctgactcgcgcactacagctgttgcgcaaaccttgcgaggctagctctaaaacagtggtctatcgcacttcgcaggggacaagcttcacattcgggggactgaaccaagccaggttcggtcatttcactttggcctatagtgctaaacctcaagccgcaaacgaccagttgacggttctcagctag

SEQ ID NO: 213818 - DNA, 324 bp, Artificial Sequence
  Description of Artificial Sequence: Synthetic coding sequence
atgaagacaggccacttcgagattgtcaccatgctgctggccaccatgatcctagtcgatatcttccaggtcaaagccgaggtcctcgacatggccgataatgcctttgatgatgagtacctgaagtgcactgaccggatggagatcaagtacgtgccacagctgcttaaggaagagaaagcatcacatcaacagctcgataccgtttgggaaaatgcgaaggccaagtgggccgctcgcaagactcaaattttcctgcctatgaatttcaaggacaaccatggtattgctctcatggcttacattagcgaggcccaggagtag

SEQ ID NO: 213819 - DNA, 456 bp, Artificial Sequence
  Description of Artificial Sequence: Synthetic coding sequence
atgagtggacggggaaagcagggtggcaaagttagagctaaagccaagagccgctcaagccgcgctggactgcaattccccgttggcagggtccatcgacttttacgtaagggaaattacgccgaaagggtcggcgcaggcgctcccgtctatctggcggctgtgttggagtatctgaccgcagagattttggaactggctgggaacgccgctcgggacaacaaaaaaactcgcatcatacctcggcatcttcaacttgctatccggaatgacgaggagctcaacaagctgctcggaaaggtcactattgcccagggaggggtcctcccaaacatacaggcagttcttttaccaatatgtgagcactcggggccaagttctgggaagatccccagcgatcgcgctgagctgggggctggctctgtgtgtgggcatatatttcaaaaggtggagtag

SEQ ID NO: 213820 - DNA, 177 bp, Artificial Sequence
  Description of Artificial Sequence: Synthetic coding sequence
atggggccattaattaatcgctgcaagaagatcctgcttcctacaacggtgcctccagcaaccatgcgtatctggctattgggtgggctgctgccctttctgctgcttctgagtggcctccagaggcctacagagggtagcgaactgccagctaggaacgcctccctgattctgtag

SEQ ID NO: 213821 - DNA, 876 bp, Artificial Sequence
  Description of Artificial Sequence: Synthetic coding sequence
atggctttggccgctctgatgattgcgctgggatcacttggcttacatacctggcaggctcaggctgtgcctatcctgccacttggacttgctcccgacacttttgatgacacatacgttgggtgtgctgaagagatggaggaaaaagctgccccattgctgaaggaagagatggcccaccatgctctcctgcgtgagagctgggaggccgctcaggagacctgggaagacaaacggaggggcttaaccctgccgccagggtttaaggcccagaatggcatcgccatcatggtctacacaaacagctcaaatacactgtattgggagctgaaccaggccgtcaggaccgggggtgggagcagggaactgtatatgcgccactttccgtttaaggccctccatttttacttaatcagggccctccaactattacgaggctcagggggttgctctagagggccaggagaagtagtctttagaggtgtcggaagcttaaggtttgagcctaaaaggttaggtgacagcgtgcgccttggccagtttgcctcgtctagtctagataaggctgtcgcacataggtttgggaacgctacacttttcagtctgaccacttgttttggcgctcctattcaggccttctcagtcttcccaaaagagcgcgaggtactgatccctcctcatgaggtctttttagtgacccgttttagccaggacggcgcacagtcactagtgacactgtggtcttacaatcagacctgcagtcatttcaattgtgcttacttgggaggagaaaaaagacggggatgtgtgagtgcccctggtgccctgggaaccggagatttgcacatgacgaagagacacctgcagcagccgtag

SEQ ID NO: 213822 - DNA, 720 bp, Artificial Sequence
  Description of Artificial Sequence: Synthetic coding sequence
atggcattagctgcactgatgatcgctttaggtagtttaggcctgcacacatggcaagcacaggctgtgccaatcctgccactcggcctggcaccggacacctttgatgacacctatgttggctgcgcagaggagatggaggagaaagccgctccactgctgaaggaggagatggcccaccatgcgctcctgagggagtcctgggaggccgctcaggaaacctgggaagacaagagacgaggtctaaccctccctcccggttttaaggcacagaatgggattgcaatcatggtgtacacgaactcctctaacacattatactgggagctaaaccaggccgtgcggacaggagggggatccagagagctgtatatgaggcatttcccctttaaggctctccacttctacctgattagagcactgcaattgctgcggggatcgggcggatgtagtcggggacctggagaggtcgtttttagaggcgtcggtagcctgagattcgaacccaagcgcttgggggattctgtccggctgggacaattcgcgagctccagtctggataaagcggtggcccatcgtttcggggagaagcggaggggctgcgtctcagccccaggggttcaactagggtctcagtctgagggggcttctagtctcccaccctggaagacgctactcctcgcccctggagaatttcagctgtccggcgtcggaccctag

SEQ ID NO: 213823 - DNA, 876 bp, Artificial Sequence
  Description of Artificial Sequence: Synthetic coding sequence
atggcgctggccgctctcatgattgcactaggctctctgggcctccatacatggcaagcacaagccgtccccatcctgcctcttggcctggcaccagacacatttgacgatacttacgtaggatgcgcagaggaaatggaggagaaagccgctcccttgctgaaggaggaaatggctcatcacgctcttctccgggagagctgggaagccgctcaagagacctgggaggacaagagacggggattaacactcccgcctggcttcaaagctcagaatggaatcgcaattatggtgtacacgaactcatcaaatacactgtactgggaacttaaccaagcagtgagaacaggaggtggaagccgggagctgtatatgcgccactttccctttaaagcgctgcacttttatttgatacgtgccttgcagttgctacgcggatccggtggctgtagtaggggtccaggtgaggtagtgttccgtggcgtcggttctctaagatttgagccaaagcgcttgggagattccgtgagactcggtcagttcgccagctcatccctcgataaggccgtggcacatcgtttcggcaatgcaaccctgttctccttgactacatgctttggggcacccatccaagcatttagtgtgttccccaaggagcgcgaggtgctgatcccaccacacgaggtgttcctcgtaacacggttctcccaggatggagcacagagcctggtgacactctggtcctacaatcagacctgtagtcacttcaactgtgcctatctcggcggagagaaaaggagaggttgcgtgtccgcccctggagccctgggaacaggcgatctgcacatgactaagagacatctgcagcagccgtag

SEQ ID NO: 213824 - DNA, 1401 bp, Artificial Sequence
  Description of Artificial Sequence: Synthetic coding sequence
atggtgtttctctctggtaacgcgtctgattccagcaattgcacccagccgccagcacccgtcaacatatcaaaggctatcctcttgggagtcattttagggggtcttattctttttggagtcctgggtaacatcctggtgatcctgagcgttgcatgccataggcacttgcactctgtaacccactattacattgttaatctagcagtagctgacttgctgctgacaagcacggttctaccattttctgctattttcgaagtgttgggctactgggcattcgggagagtcttctgcaatatatgggccgctgtggacgtattgtgctgtaccgctagtattatgggtctgtgcattattagtatcgatcgatatatcggggtgagctaccccctcagatacccgactatcgtgacccagcggcgtgggttgatggcacttctgtgcgtgtgggccttatctctggttatcagcatcggacctctgtttggttggagacagcctgcccctgaggatgagactatctgtcaaataaatgaggaacccggatatgttctgtttagcgccttgggctccttttaccttccactggccattatcttggtgatgtattgccgtgtgtacgtggtggccaagcgagaatctcgtggcctcaaatccggcttgaagacagataagtccgattccgagcaggtgaccttaaggattcaccgcaaaaatgctccagcaggaggctctggaatggccagcgccaagaccaagacacatttctcagtgagacttttgaagtttagcagagagaaaaaggccgctaaaacgttgggaatagtagtaggttgcttcgtgctctgctggctgcccttcttccttgtgatgcccatcggcagtttctttcctgactttaaaccttctgaaactgtgtttaagatcgttttctggcttgggtacctgaactcttgcatcaaccctataatttatccatgttccagccaagaatttaaaaaggcctttcagaatgtgttaaggatacagtgtctgtgccgcaagcagagctccaagcacgccctcggatacacattacacccaccaagccaggcagtcgaagggcagcacaaagatatggtccggatccctgtgggaagtcgggagacattttaccggatcagcaagaccgacggggtttgcgagtggaagttcttctctagcatgccaagggggagtgcacgtattactgtgtccaaagaccaatcttcgtgcactacggcgagggttaggagcaagtcctttttgcaagtgtgttgttgcgtagggccaagcacgcctagcctcgataagaaccatcaggtgcccacaatcaaggtgcacacaatctcgctttcggaaaatggtgaagaggtctag

SEQ ID NO: 213825 - DNA, 1368 bp, Artificial Sequence
  Description of Artificial Sequence: Synthetic coding sequence
atggtgtttctatcaggtaatgcctccgacagctctaattgtacccaaccgccagccccagtgaacatcagcaaggccatcctcttaggcgtcatcctgggcggattgatcctgtttggggttcttggtaacatcctagtgattctgtctgtcgcctgtcacaggcatctgcactctgttacccactactacatcgttaacttagctgtggccgatcttctgttaacatcaactgtcctgcctttttctgcaatctttgaagttttgggctactgggcattcggaagggtgttctgtaacatttgggccgcagttgatgtgttgtgttgcacagcatcaatcatgggtttgtgtatcatcagtatcgatcgatacattggggtctcatacccactccgctatcctactatcgttactcaacgcagagggttgatggcactgttgtgcgtctgggcgctcagcctcgttataagcatcggcccactgttcgggtggcgccagcccgctcccgaagatgaaaccatctgccagattaacgaagaacctggctacgttctgttctcagcactaggatcgttctatctccccctcgcaatcattctagtgatgtattgcagggtgtatgtcgtggccaaaagggaaagcagggggttgaaaagtggcctcaagactgacaaaagcgacagtgaacaggtaacacttcgcattcatcgcaagaacgcccctgctggcggatctggcatggcaagcgcgaaaacaaagacccacttctcagtgaggcttctgaaatttagtagagagaaaaaggcagcgaagaccttgggtattgttgtcgggtgtttcgtactttgttggctgcctttttttctagtgatgcctattggcagcttctttcccgactttaaaccctccgagacagtgtttaaaattgtcttctggttggggtacttgaactcctgcatcaatcccatcatctatccgtgcagttctcaagaattcaaaaaggcctttcagaatgtgcttcgtattcaatgcttatgccgtaagcaatcctccaaacatgcactggggtacacgcttcaccctccatcgcaggccgttgagggccaacataaagatatggtgcgtatccctgtgggcagccgggaaaccttttacagaattagcaaaacagatggagtttgtgaatggaagttcttctccagtatgcctcgcggtagtgcacgtatcacagtgtcaaaagaccagtccagttgtaccacagcccgtcggggtatggactgtagatattttaccaagaactgccgagagcatatcaaacacgtcaactttatgatgcctccatggagaaaaggaagcgagtgttag

SEQ ID NO: 213826 - DNA, 975 bp, Artificial Sequence
  Description of Artificial Sequence: Synthetic coding sequence
atggtctttctgtctggcaatgcttccgatagcagcaattgcacacagccgcctgctcctgtcaacattagcaaagccatattgttaggagtcatcctcggcggtctcattttattcggcgtgctgggtaacattttggtgattttgtctgtggcatgccacagacaccttcactccgtcacacattactatatcgtcaacctcgcagtggcagacttgctgctaacctccacggtcctacctttctcagcaattttcgaagtgcttgggtactgggccttcggccgagtcttctgcaacatatgggccgctgtcgacgtcctgtgctgtacagcaagcattatggggctctgtattatctccattgaccgatacattggagtgagctaccccctgcgctacccaaccatagtgacacaacgtagaggcctcatggccttactctgtgtctgggctctgtcattggtcattagcatcgggcctctgtttggctggaggcaaccagcccctgaagatgaaaccatctgccagatcaatgaggagcccggttacgtgctgtttagcgcgctcggctccttctaccttccgctcgcaatcattctggttatgtactgtcgggtgtatgtggtggcaaagagagagtctcgcggattgaagtccggtttaaaaacagataaatcagactcagaacaggtaaccctgcgcatccatcggaagaacgccccagccggaggctccgggatggcctctgcaaaaactaaaacccatttctcagttcggctgctgaagtttagcagagaaaaaaaggcagcaaagactcttggaattgttgtagggtgctttgtcctttgttggctgcctttctttctggtgatgcccatcgggacatatatcttgaaatacgacgtgttgttctggcgcaaggggctgagcgtctgcacccgtctgcgggaacggaaagaaatcaagaattag

SEQ ID NO: 213827 - DNA, 1029 bp, Artificial Sequence
  Description of Artificial Sequence: Synthetic coding sequence
atggttttccttagtgggaacgcctctgactcatcaaattgtacacagccgccagcgcctgttaatatcagcaaagccatcctcctaggggtgatccttggcggactgatcctgtttggcgtcttaggaaatatcctcgttatcttaagcgtagcatgccatcgacatctgcatagcgtgacccactattatatcgtgaatctggccgtggctgatctccttctgacctctacggtgcttcctttttcagcaatcttcgaggtgcttggatattgggcctttggcagggtcttttgcaacatttgggccgctgtcgatgtgctctgttgcactgccagtataatggggctttgtatcatcagcatagaccgctacattggtgtgtcatacccattgcgttatcccacgattgtgacccagaggaggggattaatggcacttctgtgtgtatgggccttgtctctggtgattagtatcggaccgctcttcggttggcgccaacccgcacctgaagacgaaacgatatgtcagattaatgaagagccagggtacgtgttgttttctgctttggggtctttttatcttcctctggctataatacttgtgatgtattgccgcgtgtacgtggtcgcaaaaagagagagtcgaggccttaaatctggtctgaagaccgataagtcggatagtgagcaggtgactctccgaattcaccgcaagaatgcaccagccggaggtagtggaatggcttccgccaaaacaaaaacacacttttccgtcagattgcttaaattcagccgtgagaagaaggcagcgaagactcttgggattgtggtaggctgtttcgtgctgtgttggctgccattttttctggttatgcccatcgatgaagagaccgaagcgcaggaaggtaaaaatgacagtcccagtttcaaacagccagtccatcacgcggcagttcttggcctggaggtaatggagaaggaaaatttggaaggcgtcagccgaaaagatacgtgcggggtctggtag

SEQ ID NO: 213828 - DNA, 1401 bp, Artificial Sequence
  Description of Artificial Sequence: Synthetic coding sequence
atggtcttcttgagtggcaacgcctcagattcaagcaactgtacccaacctcccgctccggtcaatatctccaaggcaatactgctcggagtcattctgggaggattgatcttatttggggttctgggcaacatcttggtgattctgtccgtggcttgccaccgccatctacacagcgtgactcattactacattgtgaatctggctgtggcagacctacttcttacatccactgtccttcctttctctgctatctttgaggtgcttgggtattgggctttcggcagagtcttttgcaacatttgggccgctgtcgacgtgctgtgttgcacagcttctatcatggggctgtgtattatcagtatagaccgctacattggcgtctcgtatccgcttcgctaccccactatcgtgacacagcgcagggggttaatggctctcctctgtgtatgggcactttcactcgtcatcagcataggtcccttgttcggctggagacagccagcacccgaggacgaaacaatttgccagattaacgaggagccgggatatgttctattcagcgcattgggcagcttttatctacccctcgccattatcctggtgatgtattgtagggtctacgtggttgcgaaacgggagtcaaggggtctcaaaagcggtctgaagactgacaaatccgattctgaacaagtgaccctgaggatacatagaaaaaacgctccagccggtggaagcggcatggcctcggccaagacaaaaacgcactttagcgttagactgctaaagttttcccgagaaaaaaaggctgccaaaaccctgggcattgtcgttggttgtttcgtcttgtgttggctccctttcttcttagtgatgcctatcggtagtttctttcccgacttcaagccctccgagacggtgttcaaaattgtcttttggctcggctacttaaactcctgcattaatcctatcatctacccatgttcctctcaggagttcaagaaagcctttcagaacgtgcttagaatccagtgtctttgtagaaagcagagctctaaacacgcactggggtacactttacatcccccaagtcaggcagtggagggccagcacaaggatatggtgcgcatccctgtaggctcaagagagacattctatcggatctcgaagaccgacggtgtgtgtgagtggaagttcttctcctcaatgccacggggatctgcgagaataaccgtgtccaaggaccaatctagctgtacaaccgctcgtgtcagatctaagagttttctccaggtgtgctgctgtgttggaccatcgaccccttctctggataaaaaccaccaggtgcctaccatcaaggtgcacaccatctcactcagcgaaaatggagaggaagtgtag

SEQ ID NO: 213829 - DNA, 1119 bp, Artificial Sequence
  Description of Artificial Sequence: Synthetic coding sequence
atggtctttctgtcaggcaatgctagcgattccagcaattgcacacagccaccggcacccgtaaacatatccaaggcaatcctattgggggtgattcttggaggcttaattctgttcggtgttctgggcaacatacttgtgatcctgtctgtcgcttgccatcgtcacctgcacagcgtgacacactactacatcgttaacttggcagttgccgatctcttgttgacatcaaccgtgctgccctttagtgctatatttgaagtactggggtactgggcattcggacgcgttttctgcaacatctgggccgctgtcgatgtcttatgctgcacagccagcatcatggggctgtgtatcatctcgatagacagatacatcggtgtgtcctaccctctccgatatcctacaattgtgactcagcgtcgcggtctgatggctctgctttgtgtttgggccctatccctcgtcatctccattggaccactttttgggtggcgacaacccgctccagaggacgagacaatctgtcagattaacgaagaaccgggttacgtgctgtttagtgcacttggatccttctacttacccttggccatcattctggtgatgtactgcagggtatacgtggttgccaaaagggagagtagggggctcaaatcaggcttaaagaccgataagagtgattctgaacaggtaacattgcgtattcacagaaaaaacgctccagccggtggaagcgggatggcctctgcgaagacgaagacccatttttccgttcgcctcctcaaattctctcgtgaaaaaaaagccgcaaaaaccttaggaatagtggtggggtgtttcgtgttgtgttggcttccattctttctggtaatgcccatcgggacccatacccacgatatgaagccggcaagcaggccaaggctgctgagccttttacccaaggagggggaacatgaaacccaccattggtcatgtgaccccctgtccctggagagtacccccggagcccaggaaccctgcctcacattgggcttcacttccctcagcagcatccatctcaccaaagcccagattcagcatgtgaccgtcacagacacggggaagacagtgacatag

SEQ ID NO: 213830 - DNA, 1290 bp, Artificial Sequence
  Description of Artificial Sequence: Synthetic coding sequence
atggtgttcctgtccgggaacgctagtgacagcagtaactgcacccagccacccgctccagtcaatatctctaaggccatcctattgggtgtgattctaggcggtttgattctttttggtgtgctcggtaatatcctcgtgatattgtccgttgcctgccataggcacttgcactctgtaacccactactatattgtgaatctggccgtcgccgatctcctgctgaccagcactgttctgccctttagcgctatctttgaggtgctgggatattgggctttcggacgtgttttttgtaatatctgggcggctgtggacgtcctttgttgtacagcctccataatgggactatgcattatttctatagatagatatatcggagtatcgtatcctctgagataccctacaatcgtgacacagagacgcggactgatggcactactgtgtgtgtgggctctgtcactcgttatttccattggcccactgttcggatggcgccagcctgctcctgaggacgagactatatgtcagattaatgaggagccaggctatgttctctttagtgcattggggagtttttatctgccgctcgccataattctggttatgtactgccgagtttatgtggttgcaaaaagagaatccagaggcttgaaatcaggtctaaagacagataagagcgacagcgaacaggtcacactgagaatccataggaagaatgctccagcaggaggtagtggaatggcgagtgctaagactaagacccactttagcgtgcgtctcctcaagttctcaagagagaaaaaggccgcaaaaacactgggcattgtagtaggatgcttcgtcctgtgctggctaccctttttcctagtgatgcctataggcagctttttccctgacttcaagccttctgagacagtatttaaaatcgtgttctggttgggatatctgaattcatgtatcaaccccatcatatatccatgcagcagccaagaattcaagaaagccttccagaacgtcctgcgcattcagtgtctatgccgtaagcaatccagcaaacacgccctcggctacacattacatccaccgagtcaggcggtggagggtcagcataaagacatggttagaatacctgtgggcagtcgggaaaccttttataggatctctaagacggacggcgtctgcgagtggaagtttttttcctccatgccaagagggtcagccagaatcaccgtgtccaaggaccagtccagctgtacaaccgcaaggggtcacacacccatgacttag

SEQ ID NO: 213831 - DNA, 1428 bp, Artificial Sequence
  Description of Artificial Sequence: Synthetic coding sequence
atggtttttctctccggcaatgcctctgatagctccaattgcacacagccacccgctcctgtcaatattagcaaagctatactgttaggcgtcatcctgggaggcttgattttatttggggtccttgggaacatcctggtgattctgagtgtcgcatgccaccgccatctgcactctgtgacccactactacatcgtcaatctggctgtagctgatttattgctaacttcgaccgtactcccattttcagccattttcgaggtgctgggctattgggcgttcggcagggtcttctgcaatatctgggccgctgttgacgtgctctgctgcacggcgagcatcatgggcctgtgcatcattagtattgatcggtatatcggggtgtcatacccactgcgctatcctactatagttactcagcggaggggcctcatggcgctgctctgtgtgtgggcactgagcctggttattagcattggacctttattcggctggagacaaccggcaccggaagatgagacgatctgccaaatcaatgaggagccaggctacgtcctcttttccgctctggggtctttctatctgcctctggccattattctcgtgatgtactgccgtgtttacgttgtggctaagagagagagccgcggtttgaaatccggccttaaaaccgataaaagtgactctgagcaggtcacccttcgcatccatcgcaagaatgcaccagcaggaggtagcggcatggcctctgccaagaccaaaactcacttctctgtacggctgctgaaattcagtagggaaaagaaggctgcaaaaaccttaggaatagtcgtgggctgctttgtgttgtgttggctccccttttttctggtgatgccaatcggttcattctttcctgatttcaaaccctcagaaaccgtgttcaaaatcgtgttctggctgggatatctgaattcctgcatcaacccaattatctatccgtgttcttctcaagagtttaagaaggccttccagaacgttctacggattcagtgtttatgcagaaagcagagttcaaagcatgcactcgggtataccctccacccaccaagccaagcagtggaagggcagcataaggatatggtgaggattccagtgggttctagagagaccttctatagaatatccaagacagacggagtttgcgagtggaagttttttagtagcatgcccagagggagcgccaggatcacagtgtccaaggatcagagttcttgcaccactgccaggacaaaatcacgttccgttactcgattagagtgctcaggcatgattttggctcattgcaacctgcgattaccaggttcacgggattctccggctagtgcatctcaggctgctggaacaacagggatgtgtcaccaggctgatgcgacccgaccatcatag

SEQ ID NO: 213832 - DNA, 1113 bp, Artificial Sequence
  Description of Artificial Sequence: Synthetic coding sequence
atggtcttcctgagcggcaacgcaagtgatagttccaattgcacccagcctcctgcacccgtcaacatttctaaggctatcttgctaggggttatcctgggtggcttaatcctctttggcgtgttgggaaacattcttgtgattctgtccgtggcctgtcatagacacctgcattccgtgacacactactatatcgtgaacctggctgtcgcggacctgcttctgacatcaaccgtgctacctttctcagctattttcgaggttctgggatactgggccttcggcagagtgttctgtaacatctgggccgctgtggacgttctttgctgcaccgcctccattatgggcctttgtatcatctctatagacaggtatataggcgtctcatatcctctgaggtacccaactattgtgactcagcgcaggggtcttatggccctgctgtgtgtgtgggccctctctcttgtcataagcattgggccattattcggctggcgccagcctgcacctgaggatgaaacgatctgtcagatcaatgaagagccaggctatgtactgttctctgcgctaggaagcttctatctgcccctagcaatcattcttgtaatgtactgccgggtttacgtcgtggcaaagcgcgagtctagaggacttaagtcgggacttaagactgacaaaagcgactcagagcaagtgaccctccgaattcaccgtaagaacgcgccagcaggcggttctgggatggcatccgcaaaaacaaaaacacacttttctgtgcgcctgctgaagttcagcagggagaagaaggccgctaaaaccctagggatagtcgtgggctgttttgtactatgctggttaccttttttcttagtgatgcccatagatgaggtaagcctgtgtcaccaggctggggttcagtggcacgaccttggcagcctgcagccccctcctcccggatttaaaaggttctcatgcctgagcttgccttcttcatgggactacagggacgtgcctcccggaagacgtcatcaggctcagctgattttcgtgttcttggtagaaacaggctttcaccacgttggtcaagacgatctcgatttactgacctcgtag

SEQ ID NO: 213833 - DNA, 1284 bp, Artificial Sequence
  Description of Artificial Sequence: Synthetic coding sequence
atggtatttttgtcaggaaacgcatcagatagttctaattgtacccagccacctgctcctgtgaacatctctaaggccatcctcctcggtgtgatactgggcggtttgatacttttcggcgtcctggggaatatcctagtgattctgtccgtggcctgtcatagacacttacattcagtaacgcattactacatcgtaaacctggctgtggctgacctcctgctgacgtccaccgtccttccatttagtgcgattttcgaggtgttagggtattgggcttttggtagagttttttgcaatatttgggcggctgtggacgtcctgtgctgtaccgcatcaatcatgggtctctgcataatcagcattgatcgctatatcggagtgagttaccccctccgctaccccacgatcgttacacagagaaggggactgatggcgctgctctgtgtgtgggctctttctcttgtaatttcaatcgggccattattcggatggcggcagcccgcacccgaagacgaaaccatctgtcaaatcaacgaagaaccaggctacgtactttttagtgccttgggaagcttttacttacctcttgcgatcatactcgtgatgtactgtcgggtgtatgttgtagccaagcgcgagtcgcgaggattgaaatcaggattgaaaacagacaagagcgattcggagcaggttaccctgagaatccatagaaagaacgcccctgccggaggatccggcatggcctcagccaaaacgaagacacatttctccgttaggctcttgaaattctcaagagagaagaaggcagcaaagacactgggaattgtggtaggctgtttcgtgttgtgttggctgcctttctttctggtgatgcctattggaagcttctttcccgactttaaacccagcgaaaccgtcttcaagatcgttttttggctagggtatctgaatagctgcattaatcccattatttatccatgctcgtcccaggagtttaagaaggcctttcagaatgtgttgcgcatccagtgcctgtgcagaaaacagtcctcgaagcacgctctgggttataccctccatcctccatctcaggctgtcgaaggacaacacaaagatatggtacgaatccctgtgggttctagagaaacattctaccgaatctcaaagactgacggggtatgtgagtggaagtttttctcttcaatgccgcgagggagcgctaggatcaccgtttctaaggaccagagcagctgcacaaccgccagatcctcaggattctag

SEQ ID NO: 213834 - DNA, 1563 bp, Artificial Sequence
  Description of Artificial Sequence: Synthetic coding sequence
atgaacccagacctggataccggacacaacacgagcgcaccagcacattggggtgagctcaaaaatgccaatttcaccgggcctaatcaaacaagtagtaacagcacccttccccagctggacatcacccgggcaatcagtgtagggttagtactgggagcatttatcctgtttgctatcgtgggtaatatactagtaatcctgagtgttgcatgcaaccgccacctacgcaccccaaccaactattttattgtaaatttggccatggcagacctgctgttatcttttaccgtgctgccctttagcgccgctctggaagtgctcggatactgggtattgggacggatcttttgcgacatttgggctgccgtggatgtactgtgctgtaccgcatcaatcttaagtctctgtgccatctctatcgatagatatattggtgttcgctacagtctccagtatccaaccctcgttacgaggagaaaagcaatcctcgcactcctgagtgtgtgggtgctgtccactgtaataagtatcggcccactgctaggatggaaagagccagctccaaatgatgataaagaatgtggggtcaccgaagagccattttacgcattgttctcttcattaggttccttttacatccctttggcagtgatcttggtcatgtactgcagagtgtatatcgtggcgaagaggactactaaaaatttagaggcaggagtaatgaaagaaatgtctaattctaaagagcttactctcaggattcacagcaagaacttccatgaggatactctgtcttccacaaaggccaaaggccacaatccgcgttctagcatcgccgtgaagctctttaagttttctagggaaaagaaagcagctaagacgctcggcattgtagtcgggatgtttatactgtgctggctgccgtttttcattgcattacccctgggctctttgtttagtaccctgaagccccctgacgccgtgttcaaagtcgtgttctggctcggctacttcaattcttgcctgaatcccataatatacccctgcagctcgaaggagttcaaacgagctttcgtgcgcattttgggctgccagtgtaggggcagaggccgaaggaggagacggagaaggagacggctgggtggctgtgcttatacttatcgcccatggacccgagggggaagcctggagcgatcccaatcccgcaaagactccctggatgacagtggatcctgcctctccggaagccaacgcaccttgccttccgcatcaccctctcctggctatctggggcgaggggcaccccctcctgtggagctatgtgccttccccgagtggaaggcccctggagctcttctgagcctccctgctcctgagccccctggaagacggggacgacatgatagcggcccactcttcacattcaagcttttgacagaaccggaatctccaggaaccgatggaggcgcaagcaatggcggttgtgaagccgcagctgatgtcgctaatggtcagcctggcttcaagagcaatatgcccctggctcccggtcagttctag

SEQ ID NO: 213835 - DNA, 1719 bp, Artificial Sequence
  Description of Artificial Sequence: Synthetic coding sequence
atgacgttcagggatcttctctcagtttcatttgagggcccacgtccagactctagcgcaggaggcagtagcgcagggggtgggggagggtccgcgggtggagcagccccaagcgaggggccagcggtcgggggtgtccccggtggtgcagggggtggcggtggcgtggtgggagcaggaagcggggaagacaatcgatcctctgccggagagcccggaagcgccggtgccggaggtgacgttaatgggaccgccgcagttggcggactcgttgtgagtgcccagggcgttggcgtgggcgtgttcctcgccgcatttatactgatggccgtcgcaggtaatcttctggtcatcctttcagtggcctgcaacaggcatctgcagacggtcaccaactattttatagtgaatctcgccgtggcagatctgttgttgtcagctactgtactgccattttccgccactatggaggtactgggcttttgggccttcggccgtgcattctgtgacgtgtgggccgctgtggatgtactgtgctgcactgcatcgattctctctctttgcaccatttctgtcgacaggtacgtcggcgtccggcacagtctcaagtaccctgctataatgacggaacgcaaagctgcagccatcctcgcccttctgtgggtagtcgcattggtggtatctgtgggcccactgctggggtggaaagagcccgtgccacctgacgagcgattttgtggaatcacagaggaggctgggtatgcggtcttttccagcgtttgtagtttttatctgcccatggccgtgatagtggtgatgtattgccgcgtgtatgttgtggcacggtctaccacaaggtccctcgaagcaggagtgaaacgggagcggggaaaagctagcgaagtggtgctcagaatccactgtcggggagccgctaccggagcagatggcgcacacgggatgagaagcgcaaaagggcataccttcaggtcgtctttgtcagtacggctgctcaaattttccagggaaaaaaaggctgcgaaaactttggccatagtggtcggcgtgtttgtgctgtgttggtttcctttcttttttgtgctgcctctcggatcactgttcccccagcttaaaccttccgaaggcgtttttaaagtgattttctggcttggctactttaattcctgtgtaaacccgctcatctacccttgctcaagcagagaattcaagagggcatttttacgactcctgcggtgtcagtgccggcgtaggaggaggcgcagaccattgtggcgggtttatggacaccactggcgcgcatctacatccggccttaggcaggactgcgctccttcgtctggcgatgcccctcctggcgctccattagcgttgacagccctcccagacccagatccagaaccacctggcacacctgaaatgcaggccccagtggctagcaggagaaagcctccgtccgcatttcgggagtggaggctgcttggtccttttcgtcggccaacgactcagttacgggctaaagtcagcagtctgtctcataagatacgcgcaggcggtgcccagcgcgctgaggccgcttgtgctcagcgatcagaagttgaagccgtttctctgggagtcccacacgaggtcgctgagggcgctacctgccaggcttatgaactggcagattattccaatctgcgtgaaacggatatttag

SEQ ID NO: 213836 - DNA, 1344 bp, Artificial Sequence
  Description of Artificial Sequence: Synthetic coding sequence
atggatcaccaagacccttacagcgtgcaggccacagcagccatagccgctgctatcacgtttttgatcctgttcaccattttcggaaatgcactggtaatcctagccgtgctgacgtcccggtctctaagagcgccacagaatctgttcctggtgagcctagccgctgcagatatcctggtggccacattgatcatccctttttccttagccaacgagctcttgggttactggtattttcgtaggacctggtgcgaggtgtacttggcgttggatgttctgttctgcacatcatccattgtccacctatgcgctatcagcctcgatcgctattgggcagtgtcaagggcgttggagtataattctaaaaggaccccgcgtagaattaagtgcattatcctgactgtttggttgattgcagcggtgatatctcttccacctctaatctacaagggagaccaagggcctcagccccgtggcagacctcaatgcaagttgaaccaggaggcctggtatattctcgccagctcgattggttccttttttgccccttgcctcattatgatcctggtgtatttacgcatttacctcattgcaaaacggtccaaccgtcgcggtccaagagccaaaggtgggccaggacagggtgaatcaaaacagccccgacccgatcacggtggagccctcgccagtgccaaactacccgcactggcttcagtggcctccgcacgtgaggtgaatggccactccaagtccactggcgagaaggaggaaggggaaactccagaggataccggaactagagccctccctccctcatgggccgctttacctaactccggccaaggtcaaaaggaaggggtgtgcggagcctcgccggaggatgaggccgaggaagaggaggaagaagaggaagagtgcgagccccaagccgtgcctgtgtccccagctagtgcatgtagcccccctcttcagcagccccagggcagtcgcgtgctggctaccttgagaggccaagtgctgctgggcagaggcgttggcgctatcgggggtcagtggtggcgcaggcgggcacagcttacacgagagaagaggtttacctttgtgcttgcagtggtgattggcgtatttgtgctctgttggttccctttctttttctcttattccctgggagcaatttgccccaaacattgcaaagtaccacatggactgtttcagtttttcttctggataggctactgtaattcatcgcttaaccccgtaatctatacaatattcaatcaggacttccgtcgcgctttccgacgaatcttgtgtcggccttggacacagactgcatggtag

SEQ ID NO: 213837 - DNA, 1389 bp, Artificial Sequence
  Description of Artificial Sequence: Synthetic coding sequence
atggcatccccagctctagctgctgcactggcagtggccgcagccgctggccctaatgcctctggcgcaggtgagagaggatccgggggtgtggctaacgcatcaggggcaagctggggcccaccgagagggcagtactcagctggggctgtagccggacttgccgcagtggttgggtttcttatcgttttcaccgtagtgggcaatgtgttggtcgtgatcgccgttctgacctctagagctttgcgagcacctcagaacctgttcctggtgtctctggctagtgcagacatcctcgttgccactctggtgatgccattctccctcgccaatgaattaatggcatactggtacttcgggcaggtctggtgcggcgtttacctcgcgcttgatgtcttattctgcacaagctctatagtgcatctgtgtgcgatatctctcgataggtactggtctgtgacacaggctgtggaatacaatttaaagagaactcccaggcgcgttaaggccactattgtcgcagtgtggcttatctccgcggtaatctctttccctcctcttgtttctctgtacaggcagcctgacggagccgcttacccacagtgcggactcaacgacgagacatggtatatcttgtctagttgtattggctcattcttcgccccttgtctgatcatggggttggtatatgctcggatttatagagtggccaagcttcgtaccagaaccctgtcggaaaagcgggcacctgttggcccagacggagcctcacctactaccgagaacggattgggggctgctgccggagccggtgaaaatggacattgcgcaccacctcctgccgacgttgaacctgatgagagttctgccgcagccgaacgacgcagaagacgcggtgctttgcggcgagggggaaggcgacgcgctggggcagagggaggtgcgggaggggctgatgggcaaggtgccggacccggagccgctgaaagcggggcactgactgcatcgaggagtcctggtccagggggacgcctttccagagccagctctcgcagtgttgaattttttttgagcagacggaggcgagcgaggagtagcgtgtgtcgccgtaaggtggctcaagccagggaaaagcgttttacttttgtgctggctgtcgtgatgggagtctttgtgctgtgctggtttccattctttttcagctactcgctttatggtatttgtagggaggcctgtcaggttccaggccctctgttcaaattcttcttttggatcggctattgcaactcttctctaaacccggttatctacaccgtatttaatcaggattttcggaggtccttcaagcatatccttttccgccgacgcaggagagggttcagacagtag

SEQ ID NO: 213838 - DNA, 2070 bp, Artificial Sequence
  Description of Artificial Sequence: Synthetic coding sequence
atggcggatcttgaggctgtactggcggacgtcagctatcttatggctatggagaaaagcaaggcgacacctgccgctagagccagcaaaaaaattcttctgcctgaacccagcataagaagcgtaatgcagaagtacttggaggacagaggagaggtgacttttgagaagatcttctctcagaagttgggctacctgctctttagagatttttgtctgaatcacctggaagaagcacgcccactggtcgagttttatgaggagatcaagaagtacgaaaaactggagacagaagaagagagggtggcgaggagcagggagatctttgactcttacattatgaaggagctgctggcatgctcacatcccttctcgaaatcagccacagaacacgtgcaaggacatcttggcaaaaagcaggtccctccagatctgtttcagccttacatagaagagatctgtcagaacttgcgcggagacgtgttccaaaaatttatagaaagcgacaaattcacacggttctgccagtggaaaaatgttgagctaaacattcaccttacaatgaacgatttctccgtgcaccgtattattggcagaggcggttttggagaggtatatggctgtcggaaagccgatacaggcaagatgtacgccatgaaatgcctcgacaaaaaaagaatcaaaatgaaacagggcgaaaccctcgcactgaatgagcgcatcatgctgtcgttggtctcaacaggtgattgtcccttcatagtctgcatgtcctatgccttccatacacccgataagctgtcatttatcctagatctgatgaatgggggagatctccattatcacctatctcagcacggtgtgttttcagaagcagacatgaggttctatgcggctgaaatcattctggggctggaacacatgcacaaccggtttgtcgtgtatagagacctcaagcctgctaacatcctcttggatgagcacggtcatgtgcgtatctctgacctggggctggcgtgtgacttctcaaaaaaaaagccacacgcgtctgttggcacacatggatacatggccccagaggtcctgcagaaaggcgtggcctacgactcaagcgctgattggttttctttaggctgcatgctattcaagttgctgaggggccattcccccttccggcagcacaaaactaaagacaagcatgagatagaccgaatgacccttacaatggccgtagagctgcccgacagcttttcccccgagctgcgctccttgctggagggcctcttgcagcgcgacgtcaacagaaggctgggatgcctgggacgcggtgcgcaggaggtgaaagaaagccccttttttcgaagcctggactggcagatggtgttcttgcagaagtacccaccgccattgataccccctagaggagaggtaaacgcagccgatgcctttgatattggatcctttgacgaggaggacacaaagggcataaagttgctcgattctgaccaggagctgtaccggaattttcctctgactatcagcgaacggtggcaacaggaggtggccgaaaccgttttcgatactattaatgctgagactgaccgactcgaagcaaggaagaaggctaaaaacaagcagctgggtcatgaggaggactacgcactaggcaaagattgtatcatgcatgggtacatgtcaaagatggggaatcccttcctcactcagtggcagagacgatatttctacctatttcctaaccgccttgagtggcgcggtgagggcgaggccccacagagcctgctcactatggaagagatccaatccgtggaggagacacagattaaggaacgcaagtgcttgctcctgaagatccgcggaggtaaacaatttatcttacagtgtgattcagaccccgaacttgtccagtggaaaaaggagcttagggatgcctatcgtgaagcacagcaactggtccagcgggtgcctaagatgaaaaacaagccgcgttcccccgtcgtggagctgagtaaggtccctcttgtccagcggggttcagcaaacggcctatag

SEQ ID NO: 213839 - DNA, 2067 bp, Artificial Sequence
  Description of Artificial Sequence: Synthetic coding sequence
atggctgaccttgaagcagtgcttgcggatgtcagctaccttatggcgatggagaaaagtaaggcaaccccagcagcaagagcttcaaagcggatcgttctgccagaacctagtattcgcagcgtcatgcaaaagtatttagctgaaagaaacgaaattacctttgacaagatcttcaaccaaaaaatcggatttctgctctttaaggacttctgcctgaatgagattaacgaggcagttccacaggtgaagttctatgaagaaatcaaagaatacgagaagctggataacgaagaagaccgtctatgccgatcacgccagatctatgacgcatatatcatgaaagagctgctgagttgtagccacccctttagtaaacaggcagtggaacacgttcagagtcatctgtcaaaaaaacaagtcacatcaactttgttccagccctacatcgaggagatatgcgaaagcctccgaggagatatcttccaaaaattcatggaatcggataagttcacgcggttctgccagtggaagaacgtggagctgaacattcacctcacgatgaatgagtttagtgtccatcggatcataggacgcggagggttcggcgaggtttacgggtgtcgcaaagcagatacgggcaagatgtacgcgatgaaatgtctcgacaagaagcggatcaagatgaaacagggcgaaacccttgcactcaatgaaagaattatgctgtcactggtgagcaccggtgattgtcctttcatcgtgtgcatgacatacgcattccacacacctgacaagctctgctttattctcgacctgatgaacggtggagacctgcactaccaccttagccagcatggagtgtttagcgagaaggaaatgcgattctatgctacagagatcattctgggcctggaacatatgcacaatagattcgtggtctacagagatctgaaacccgctaacatcctgctggacgagcatgggcatgcccgtatttcagatttgggactggcctgtgatttctcgaagaagaagccacacgccagtgtgggtacgcacggctatatggctccggaggtgctgcaaaaagggacagcctacgactcctctgcagattggttttccctggggtgtatgctttttaagctcttaaggggtcactcccctttcagacagcacaagaccaaagacaagcacgaaatagataggatgacactgactgtgaacgtggaactgccggacaccttctcaccagaactcaagagcctgctcgagggtctgctgcagcgcgatgtctctaaaagacttggatgtcacggcggtggcagccaggaggttaaagagcactccttttttaagggcgtggattggcagcacgtatacctgcaaaagtatcctccacctctgataccccctaggggtgaagtgaacgccgcagacgcctttgatatcgggagcttcgacgaggaggatacaaaaggcataaaactgctggactgtgaccaggagctctataaaaactttcctctcgtcatttctgagagatggcagcaggaagtgacagaaacagtgtacgaggctgtgaatgctgacactgacaagatcgaggcacggaagagggccaagaataaacaactggggcacgaagaagattatgcgttggggaaggactgcatcatgcacggctacatgctgaaactaggcaatccctttttgacccagtggcagagacgatacttttatttattccctaaccgattggaatggcgcggagagggcgaaagtaggcagaatctcctgacaatggaacagatcctttctgtggaagagacacaaatcaaggataagaagtgcattctgttccgcatcaagggtggaaaacagttcgtcctgcagtgcgagagcgatccagagttcgtgcagtggaagaaggaactcaacgaaacttttaaggaggctcagaggctcctgagacgtgcaccaaaattcctcaacaagcccaggagcgggaccgtggagttgcctaaaccttccctgtgtcataggaattcgaatggcctttag

SEQ ID NO: 213840 - DNA, 1164 bp, Artificial Sequence
  Description of Artificial Sequence: Synthetic coding sequence
atggccgacttggaagcagtactggcggacgtcagctatcttatggccatggaaaagtccaaagccacccccgcagccagggccagtaaaagaatcgtgctgccggaacccagcatccggtccgtgatgcagaagtaccttgctgagagaaatgaaattaccttcgacaagattttcaaccagaagatcggctttctcctgttcaaagatttttgtttgaatgagatcaacgaagccgtcccacaggtgaaattttatgaggaaatcaaagaatatgagaagctggacaacgaagaggaccggctgtgtaggtcacgtcagatctacgatgcctacataatgaaagaacttctgagctgttcacatccattttccaaacaggcagtcgagcacgtgcagtctcacctgtccaaaaagcaggtcacgtcaaccctgttccaaccctatatcgaagagatttgtgagtctctacgaggcgatatcttccagaagtttatggaatccgacaagtttactagattctgccaatggaagaatgtagagctcaacattcacctaacaatgaatgagttctcagtgcaccgcattatcggtaggggtgggttcggagaggtgtacggatgccgcaaagctgataccggcaaaatgtacgccatgaaatgcctggacaagaaaagaatcaagatgaagcagggtgaaactttggccttgaacgagcgcattatgctatccctagttagcaccggcgactgtccgttcatcgtgtgtatgacatacgccttccacactcctgacaaactgtgttttattctggatcttatgaatgggggagacctccactatcatctttctcagcacggagtgtttagcgaaaaagagatgcgcttttacgcaacagaaatcatcctgggccttgagcacatgcataatagattcgtggtatatcgcgacttgaagccagcaaatatcctattagacgagcatgggcacgcaagaatttcagacttgggtttggcttgcgacttttctaagaaaaagccgcatgcctcggtgggcacgcatggctacatggccccagaagtgcttcagaaaggtacggcctacgattcctccgccgactggttctctctggggtgcatgctgttcaaacttttacgagggtag

SEQ ID NO: 213841 - DNA, 1434 bp, Artificial Sequence
  Description of Artificial Sequence: Synthetic coding sequence
atgggcgcaggtgtgctggtgttaggggcaagcgagccgggaaacctttccagcgctgcccctcttcccgacggagccgcaacagccgctcgactgttagtcccagcgtccccccctgcttccctgctccctcccgctagcgagtctcctgagcctttgagccaacagtggacagcgggtatgggcttgctaatggctctcatcgtgctgttgatcgtggccggtaatgtactggtcatcgttgccatcgccaaaaccccgaggttacagacactgaccaatcttttcatcatgagtttggcgtccgcggacctggtgatgggtctgttggtggtgccgtttggcgcaacgatcgttgtttggggaaggtgggaatatgggtcatttttctgtgagctgtggacatccgtggacgtactatgtgtaacagcctcaatagagacgctttgcgttattgccctggacagatatttggcaatcacatccccctttaggtatcagtccctccttactagggccagggccaggggattagtttgcaccgtatgggctattagcgccctggtgtcctttcttccaatccttatgcattggtggcgcgcagaaagcgatgaggccaggagatgttacaacgatcccaaatgctgtgacttcgttaccaacagggcctatgctatcgccagcagtgtcgtctccttctacgtgcctctgtgtatcatggctttcgtgtatctgagggtgttcagggaagctcagaagcaagtcaaaaaaatcgactcatgcgaaaggcggtttctaggaggtcccgcaagacccccttccccctctccaagcccggtacccgctcctgcaccacctcccggtccccctcgcccagctgcagccgctgccaccgccccactggcgaacggacgggcaggtaagagacggccatctaggctggtggcattgagggagcagaaagccctgaagacgctaggtatcataatgggggtgtttacactgtgctggttaccgtttttcttggccaacgtggtgaaggcttttcaccgcgaacttgtacccgatcgactgttcgtgtttttcaattggctcggttatgcaaactctgcgttcaatcctatcatctactgcagatccccagattttcgaaaggcttttcagggcctactctgctgtgcaaggcgggctgcacgccgtcgacatgccactcacggcgacagaccacgcgcatcggggtgtctggccagaccagggccaccaccctctcctggcgcagcttcagatgacgatgacgacgatgtcgttggggcaaccccgccagccagattactcgagccttgggccggatgcaatggcggagcagcagccgacagtgactcatcgctggatgaaccctgtcggccaggcttcgccagcgagtctaaggtgtag

SEQ ID NO: 213842 - DNA, 1242 bp, Artificial Sequence
  Description of Artificial Sequence: Synthetic coding sequence
atgggccagcctggaaatggcagtgcgttcctgctggcacccaatgggagccatgcaccagaccacgatgttacacaggagcgcgacgaagtctgggtagtcggcatgggaatcgttatgtctctgattgtcctggctattgtgttcggcaacgtcctcgtaattactgccatcgccaaatttgagagactccaaaccgtcactaactactttattacctcactggcgtgcgcagatctggtgatggggttagcagtggtaccttttggcgctgcgcacattttaatgaagatgtggacatttggtaatttttggtgtgaattttggacgtctatcgatgtgctgtgcgtgactgcctcgattgaaactttatgcgtaattgcagttgacaggtattttgcaattacatctcctttcaagtatcaatccttattaaccaagaataaggctcgagtgatcattctgatggtctggatcgtaagtgggctgaccagctttttaccgattcagatgcactggtacagagccacccaccaggaggccatcaattgttatgccaacgaaacttgctgcgactttttcacaaatcaggcgtatgccattgcttcatctatcgttagcttctatgttccactggtcataatggtgtttgtctacagtcgggttttccaggaggcgaagagacagctgcaaaaaatcgacaagagcgaaggcagattccatgtgcaaaatctgtctcaagtcgaacaagatggcagaacaggacatggtctgcggagaagcagtaaattctgcctcaaagaacataaagcacttaagacactgggtataatcatggggacctttactctttgctggctcccattcttcattgttaatatcgtgcacgtcatccaggataatctgattcggaaagaggtttatattctgctcaattggatcggatacgtgaacagtggattcaaccccctcatttattgtcgttcccccgactttcgaatcgcctttcaggaattgctgtgcctgagaagaagctccctcaaagcttacgggaacggctacagctctaacgggaatactggagagcagagcggatatcacgtggagcaagaaaaggagaataagcttctttgcgaagatcttcctgggacagaagattttgtgggccaccagggtacagtgccaagcgataacatcgacagccaaggacgaaactgttcgactaacgacagcctactgtag

SEQ ID NO: 213843 - DNA, 1227 bp, Artificial Sequence
  Description of Artificial Sequence: Synthetic coding sequence
atggccccatggccacatgaaaattcttcactcgcgccatggcctgacctccctacgctagcccctaataccgccaacacgtctggtcttccaggcgtcccttgggaagcagctcttgccggtgccttgctggcactggcagtgctagccactgtgggaggcaatctgctggtcattgtggccattgcctggacacccaggttgcagacaatgacaaacgtgttcgtgaccagtctggctgcggcagacctggttatgggcttgctggtagtgccccctgctgccacgctagcgctgactgggcattggcccttaggagctaccggctgcgagttgtggacatctgtggatgtgctatgcgtgactgcatctatcgagactctttgcgctctcgccgtcgaccgttatctggccgtcaccaacccactgagatatggtgccctagtgacaaaaaggtgcgcaagaactgccgtggtgcttgtatgggtggtaagcgcggctgtttcttttgccccaataatgagtcagtggtggcgggtgggagctgatgccgaagcacagagatgtcattcaaatcccaggtgctgcgcgttcgcatcaaacatgccttacgtgctactcagcagcagcgtttctttttatctgcctttgcttgtgatgttgtttgtttacgctcgggttttcgtggtcgctacaaggcagctgcggctgttgcgtggagaattgggtcggttccctcccgaggaaagtcccccagcgccttcacgcagtctggcccctgcccctgtgggaacttgtgctccgccagagggtgtgcctgcctgtggccgtagaccagccagattgctgccactaagagaacatcgggcactgtgcaccctgggactgattatgggcacctttactctgtgctggctgcctttcttcctggccaatgtgcttagagctctaggcggaccctcattggtccctggtccagccttcctcgcattgaactggctcggctacgccaactctgccttcaatcctctgatttactgtcggagtcctgacttccgatcagcttttcggcgtctcctgtgccgctgcggtagaaggctgccccctgagccatgtgccgctgccaggcctgccttgtttccttcaggagtgccagctgcccgttcctcacccgctcagcctaggctttgccagcggttggatggtgcttcatggggcgtgtcctag

SEQ ID NO: 213844 - DNA, 1044 bp, Artificial Sequence
  Description of Artificial Sequence: Synthetic coding sequence
atggctgcagggacagctgtaggcgcttgggttttggtgcttagcctgtggggagctgtggtcggtgcgcagaatatcaccgccaggattggtgagccactggttctgaagtgcaaaggtgctcctaagaagccgcctcagcgccttgaatggaagctaaatacgggtaggacggaggcctggaaagtgttgagtccgcagggcggtgggccttgggatagcgtggctagagtgttgccaaatgggtccctgtttctgccagccgtcgggattcaagacgagggaattttcaggtgccaggctatgaataggaacggaaaagaaaccaaatccaactatagagtaagagtctaccagatcccaggcaagccagagattgtcgactccgccagcgaactcacagccggagtgccaaataaagtcggaacatgtgtaagcgaaggatcataccccgcaggaactctgtcgtggcacttagatggcaagccacttgtcccgaacgagaagggggtgagtgtgaaagagcagacccggagacacccagaaactggactcttcactctgcagtctgaattgatggtcacaccggctcgcggaggggaccctagacccacgtttagttgtagcttttctccgggacttccgagacatcgcgcactgaggaccgctcctatccagccacgtgtttgggaacccgtcccactggaggaggtgcagttggtcgtggaaccagaaggtggcgctgtcgctccagggggtaccgttacactaacctgcgaagtccctgcccagcccagccctcagattcattggatgaaggatggggtccccctgcctcttcccccatcgcctgttctgatcttgccagagatcggcccacaggatcagggcacctattcatgtgtcgccacccactcctctcacgggcctcaggaatcgagagccgttagcatttcaatcatcgaaccgggtgaagaaggtccaaccgccggtgaggggtttgataaagtgagggaagccgaggacagtcctcagcacatgtag

SEQ ID NO: 213845 - DNA, 702 bp, Artificial Sequence
  Description of Artificial Sequence: Synthetic coding sequence
atggctgctggcactgctgtaggcgcttgggttctcgtgcttagtctctggggtgccgttgtaggggcacagaacattacagcaagaatcggcgaaccccttgtcttaaaatgcaagggtgcccctaaaaaaccacctcagaggctggagtggaaactgaataccgggaggaccgaagcctggaaggtgctgagccctcaagggggtgggccttgggattctgtcgctagagtccttcctaacggctcgttgttcctgcccgctgtcggaattcaggatgaaggcatctttcggtgccaggcaatgaatcgcaatgggaaagagaccaagtccaattatcgtgttagagtgtaccaaatcccaggtaagccggagattgtggacagtgcatcagagctcacagccggtgtgcccaataaggtggtcgaggagagccgcaggtctcggaagagaccttgcgaacaggaggtaggcacctgtgtcagcgagggctcgtaccccgcaggcactctgagctggcatcttgatggaaagccattggtcccaaacgaaaaaggcgtttctgtgaaggagcagacaagacggcatccagaaacagggctcttcacactccagtcggagctcatggtgacccccgcacgcggaggtgaccctaggcccacattctcttgtagttttagccccggactcccgcgtcactag

SEQ ID NO: 213846 - DNA, 402 bp, Artificial Sequence
  Description of Artificial Sequence: Synthetic coding sequence
atgaaggacggagtgccactgccgctccctccatcaccagtgctgatacttccagaaatcggaccccaggaccagggaacgtacagctgtgtggcgacacacagtagccacggaccacaggaaagcagagctgtgagcatcagcattatagagccaggggaagaggggccaactgctgggtcggtgggagggtccggactcgggaccctagcactggcgcttgggattctgggcggtctgggcactgcagcccttttgatcggagtgatcttgtggcagcggaggcagagaaggggagaggagcgaaaagccccagaaaatcaggaggaagaggaagaacgcgcagaacttaatcagtccgaggagcccgaagcaggggagagtagtactgggggaccttag

SEQ ID NO: 213847 - DNA, 366 bp, Artificial Sequence
  Description of Artificial Sequence: Synthetic coding sequence
atggcagcaggtacagccgtgggggcttgggtgctcgttctatccctttggggcgcagtagtgggcgctcagaatatcaccgcccgaattggtgaaccactcgttctcaagtgcaagggagcccctaagaaacctccgcagcgcctcgaatggaaactgaacacagggaggaccgaggcctggaaagttctgtccccacagggcggagggccatgggactcagtcgccagagtgctgccaaatggtagtttgttcctccccgcagtaggaatccaggacgaggggatctttagatgccaggctatgaatcgcaatggcaaggagaccaaatccaactggtggtggagccagaaagttgagcagtag

SEQ ID NO: 213848 - DNA, 1029 bp, Artificial Sequence
  Description of Artificial Sequence: Synthetic coding sequence
atggcagccggaacagctgtcggcgcatgggtcctggtactgagtctgtggggagccgtagtcggcgctcagaacattacagccagaatcggggaaccgcttgtgcttaagtgcaagggtgctcccaaaaagcctcctcagaggctagagtggaaacttggcggaggaccatgggatagcgtggctcgtgttctccccaatggatctctctttcttcccgcagtgggaatccaggacgaaggcatcttccggtgccaggcaatgaacagaaacggcaaagaaaccaaaagcaattatagggtgagggtataccagattcccggtaagccggagattgtagatagcgcatcagaacttaccgcaggtgtgccaaacaaagtggggacatgcgtgtcagaaggtagctatcctgctggaaccctgagctggcacctcgacgggaagccactggtgccgaatgaaaagggcgtatctgtgaaagagcagacccgcagacacccggagaccgggctattcacactccaatctgaattgatggtgactccagctcgagggggtgacccacggccaacgttcagctgttctttcagcccaggactgcctaggcacagggcactgcgcacggccccaatccagcccagggtttgggaaccagttcctctggaagaggttcagttggtggtggagccagaaggaggagcagtagccccagggggtacagttaccttaacctgtgaagtgcctgctcagccctcacctcagatccattggatgaaggatgttagcgacctggagagaggagccggtcgtacccgcaggggaggcgcaaattgcaggctgtgtgggcgtatcagagccggaaatagtagccccggtccaggagacccaggccgacctggagattcacgccctgctcattggggccatctcgttgcaaaggccgctacgccacgccgtggagaggaggggcctaggaaaccagggggacggggaggagcctgtcggacagagtccgtggggggaacctag

SEQ ID NO: 213849 - DNA, 885 bp, Artificial Sequence
  Description of Artificial Sequence: Synthetic coding sequence
atgaacagaaatggaaaagagacaaagagcaattaccgcgtaagggtgtatcagattcccggtaagcccgagattgtggatagcgcatctgaactcacggccggtgttcccaataaggtgggaacctgcgtgtccgaaggttcctaccccgcaggaaccctgtcgtggcatttggatggcaagcccttagtccctaacgaaaagggggtcagtgtgaaggagcaaacccggagacatcccgaaactgggctattcaccctccagagtgaactaatggttacacccgcacgcggaggagaccctcgacctacattttcatgctcgtttagtcctggtcttcctcgtcatagagcgctgaggacagcacccatccagccgagagtttgggaaccagtgcccctggaagaggttcaactcgtggtggagcccgagggcggtgccgtagccccaggtggcacggtgactctgacatgcgaagtaccagctcagccttccccgcagatacattggatgaaggatggagttccgctcccactccccccatcccctgtgcttatcctgcctgaaatcggccctcaggatcagggcacatatagctgcgttgcaacacactctagccatggcccacaagagagccgcgcagtgtccatttctattattggcagcgtggggggatctggtctaggtactcttgcgctcgcactgggaatcctggggggtttgggtaccgccgctctgctgattggggtgatcttatggcaacggcgtcaaaggagaggagaagaacgaaaggctcccgaaaaccaagaggaggaagaggaacgcgcagaattaaaccaatccgaggagccggaggccggagagtcaagtaccgggggaccatag

SEQ ID NO: 213850 - DNA, 1308 bp, Artificial Sequence
  Description of Artificial Sequence: Synthetic coding sequence
atgggcgctggggaacgggtgcaggctcccccaagggctgaggcgacagcaggtcgtggcgctgatcgggctagaactttggagggatcccgcatggccgctggaaccgccgtgggagcttgggtgctggtactgtccctttggggggcagtcgtgggagcccagaacatcacggccagaatcggcgaaccgttggtgctgaaatgtaagggagcccctaagaaaccgcctcagcggttggaatggaaactaaataccgggagaacagaggcttggaaggtcctgagtccccaaggcggtggaccttgggactccgtggctagagtgctccctaacggatccctttttcttcccgctgtagggattcaagacgaaggaatcttcaggtgccaggcaatgaaccggaatgggaaggaaacaaaatcaaattaccgagtgagggtttatcagatacctggcaaacctgaaatcgtggactctgcctcggaacttaccgctggcgtgccaaacaaggtcggtacttgcgtctctgaaggtagctatcctgcgggtaccctgtcatggcacttagatggaaagccccttgtgcctaatgagaagggcgtgagcgtcaaagagcaaacgcgtcgtcaccccgagaccggtctgtttacgttacagagtgagctgatggtcaccccagctcgcggtggcgacccgcgtccgacgttctcgtgttcgttctcacccggtctccctaggcaccgcgcactgaggacggcacccatccaacccagagtgtgggagcccgtgcccctcgaggaagtgcagctggtggtggaacctgagggcggagctgttgcccctggcggtacagtgactctgacatgtgaggtgcccgcacagcctagccctcaaattcactggatgaaggacggcgtgccgctgccattgcccccttcccctgtgttgatcctcccagagattggccctcaggaccaggggacgtattcgtgtgtcgccacccattcatctcatggaccccaggaatctcgcgctgtttccatttccattattgaaccaggcgaggagggtccgacagcaggcagcgttggcggttcaggactgggaactttggccctcgccctcggaattttggggggtctaggtaccgcagcacttctcattggagtgatcttatggcagcgacgccagaggcggggtgaggagaggaaagctccagaaaatcaggaggaggaagaagaacgggcagaactcaaccagtccgaggagcccgaagccggagagagctctacaggtgggccttag

SEQ ID NO: 213851 - DNA, 1215 bp, Artificial Sequence
  Description of Artificial Sequence: Synthetic coding sequence
atggctgccggaaccgcggtgggcgcatgggtcctggtccttagtttgtggggggctgtcgttggagcccagaatatcaccgctaggattggcgagcctctcgtcctgaaatgtaaaggagctcccaaaaagccccctcagcgattagagtggaagctcaacactgggaggacggaggcctggaaggtcttgtcacctcaaggaggtggcccatgggactctgtcgccagggtgttgccgaatggatctctcttcttgcccgcagtgggtattcaggacgaaggtatcttccggtgtcaggctatgaataggaatggaaaggaaaccaagtcgaactaccgtgtgcgggtgtaccagatccccggaaaacccgagatagtggattctgcttctgagctcactgctggagtaccaaataaagtcggaacgtgtgttagcgagggtagctacccagcgggaaccctgagctggcaccttgatggcaagcccctagttcccaatgagaagggagtgagtgtgaaagaacagacccgtcgacacccagaaacaggcctgttcacgcttcagtcagagctgatggtgactcccgcacgtgggggtgacccccgaccgaccttctcatgttccttctctccaggtcttcccagacatcgcgcactgcgcacagcacccatccagcctagggtatgggaacctgtgcccttggaggaggtccaactggttgtggagcccgaggggggagccgtggcccctggaggaacggtgaccctcacatgtgaggtccctgcccagcccagtccacagatccattggatgaaggacggtgtgcctttgccgctccctcccagtccagtcctgatcttgcccgaaatcggtccccaggatcagggtacatactcatgtgtggcaacacactccagccacggaccccaagagagccgggctgtgagcattagtattatcgaacccggagaggaagggcctactgccggaagtgtcggcggaagcggcttagggaccttggcactggctttggggatcctgggagggctgggcaccgcggctttgctgatcggcgtgatcctttggcagaggcggcaaagacgcggagaggagcgtaaggctccagagaaccaggaggaagaggaggagcgggcagagctgaatcagtctgaggaacctgaagccggtgagagtagcacaggcggaccatag

SEQ ID NO: 213852 - DNA, 1044 bp, Artificial Sequence
  Description of Artificial Sequence: Synthetic coding sequence
atggcagcaggtacggccgtgggagcttgggttctggtgttgagcctctggggggcagttgttggcgctcagaacattacagcaagaatcggggaacctttagtcctgaagtgtaagggtgcaccaaagaaacctccacagaggctggaatggaaactcaacacaggcaggaccgaggcctggaaggtgctgtccccccaagggggtggaccatgggactctgtggctcgcgtcctcccaaacggcagcctgttcctaccagccgtaggaatacaggacgaggggatctttaggtgccaggctatgaatcgtaacggtaaggaaactaagagcaactaccgggtgcgagtctaccagattcctggtaagcctgaaatagttgattcagcaagcgaactaacagctggagttccaaacaaagttggaacttgcgtttccgaagggtcttacccagctggaactttgtcctggcatctggacggcaaaccactcgttcctaacgaaaaaggcgtttctgtcaaggaacagactagaagacatcccgaaaccggcctttttactttacaatccgaacttatggtaacccctgcaagagggggtgatcccagacccactttctcatgcagttttagtcccggactgcccaggcaccgcgctctgcgaacggctcctattcagcctcgggtttgggaaccagtgccgctagaagaagttcaactcgtcgtcgaaccagagggaggagcagttgccccaggaggcaccgtgactctgacatgcgaagtccccgctcaaccctccccacagatccactggatgaaagacggagtgccgctgccactcccacctagtcctgttttgatcctgcccgaaattgggcctcaggatcaggggacttacagctgcgtggcaacccactcttctcacggcccacaagagagccgagccgtttccatcagtatcatagaaccaggagaggaaggcccaactgccggagaagggtttgataaagtccgggaagcggaggatagcccccaacacatgtag

SEQ ID NO: 213853 - DNA, 1029 bp, Artificial Sequence
  Description of Artificial Sequence: Synthetic coding sequence
atggcagccggaacagcagtgggggcatgggtgctggtactgtctttatggggggcagtcgtgggggctcagaacatcaccgcacgcatcggagaacctctggtactgaaatgcaaaggtgctcctaagaaacccccacagcgactcgaatggaagcttggtggcggaccgtgggattccgtggccagagtgctaccaaatggcagcctgttcctgcccgcagtgggcatccaggacgaggggatcttcaggtgtcaagcgatgaatcggaacggcaaagaaaccaaaagtaattatagagtgcgtgtttaccagatccccggaaagcctgagattgtcgatagcgcaagcgagctgactgctggcgtcccaaacaaagtgggtacctgcgtctcagaaggttcttaccctgcaggcaccctcagctggcacctcgacgggaagccgctcgtgccgaacgaaaaaggcgtgagcgttaaagaacagaccaggcgccaccctgagactggcctatttactctgcagtctgagctcatggtcacgcccgctcggggaggagatcccaggccaacattcagttgcagtttttcccccggacttccgaggcatcgggctctccgaacggcacccatccagccacgagtatgggagccggtgcctctggaagaagtgcaactggtagtggagcctgaggggggagcagtcgccccaggtggaacagtgactctgacttgcgaggtaccagcccagccatctccacagatccattggatgaaggacgtgtccgacctggaaagaggagctggccgaactcggaggggcggagccaattgccgcctgtgtgggcgtatcagagcgggaaactccagcccaggccctggcgatcctggcagaccaggagactcacgaccagctcattgggggcacctggtggctaaggctgcaacaccacgacgaggcgaggaggggcctagaaaacccggaggaagaggaggcgcttgcagaactgagtctgttgggggaacatag

SEQ ID NO: 213854 - DNA, 1029 bp, Artificial Sequence
  Description of Artificial Sequence: Synthetic coding sequence
atggccgcagggacggccgttggggcttgggtgttagtactcagcctgtggggagctgtcgtgggcgcacagaatataacagcccgaatcggcgaaccacttgtgctgaagtgtaagggtgcacccaagaagccccctcaacgactcgagtggaaactgggcggaggaccctgggattccgtagcgagagtgctgccaaacggatccttgtttttgccagccgtgggaattcaggacgaaggaattttcaggtgccaggccatgaaccggaatgggaaagaaacaaagtcaaactacagggtgagagtataccagatccctggcaaacctgagatcgtcgactccgctagcgaactgaccgcaggagtccctaataaagtgggaacgtgtgtaagcgaaggatcctacccagccggtacactgtcttggcatttggacggtaaaccgctcgtgcccaacgaaaaaggagtgtccgttaaagagcagactaggaggcaccctgagaccggactgttcacgctgcagtctgagttgatggtcaccccggcacggggaggcgatccgcgacctaccttcagctgcagcttttcacctggcctgccaagacatagagccctccgtaccgcccctattcagcctcgggtctgggaaccagttccgctggaagaagtgcaattggtagttgaacctgaggggggagccgtggcgcctggcggaactgtcacactgacttgcgaagttccagcacagccctctccccagatccactggatgaaggacgtaagcgacctggagcgaggcgcaggtcgaactagacgaggaggcgctaactgccggctctgcggacgcatccgggcagggaatagttccccaggccctggagatccaggacgtccgggagatagcaggcctgcacactgggggcacttggtggcaaaagcagcaacaccaagacggggtgaagaagggcctcggaagcctggaggtaggggaggcgcatgtagaaccgaaagtgtgggagggacatag

SEQ ID NO: 213855 - DNA, 702 bp, Artificial Sequence
  Description of Artificial Sequence: Synthetic coding sequence
atggcggcaggaacggccgttggcgcatgggtcctcgtgctgtcgctctggggggcagttgtcggggcacagaacatcaccgctagaataggcgaaccacttgtgctcaaatgtaagggggcaccgaaaaaaccacctcagcgattggagtggaaactgaacacaggtcgtacagaagcttggaaggtcctcagtccgcaagggggagggccttgggacagcgttgcgcgagtgctgcctaatagttcactcttccttccagcggtgggaatacaggatgaaggcatcttcagatgtcaggcaatgaacagaaacggcaaagagacaaaatcaaactatagggtgcgcgtttatcagatccctgggaagcccgagatagtcgactcagcaagcgagctcactgcgggtgtccccaataaggttgtcgaggagagccggcgaagcagaaaaaggccttgtgagcaagaggtgggcacttgtgtgtctgaggggagctacccggcaggcacgctctcatggcacctcgacggtaagccactcgtgccaaacgaaaagggtgtgagcgtgaaggaacagactagacggcaccccgaaaccgggttgtttactctgcagtccgagttgatggtcaccccggctagggggggagatccacgccctacattttcatgcagttttagtcctggcttacccaggcattag

SEQ ID NO: 213856 - DNA, 705 bp, Artificial Sequence
  Description of Artificial Sequence: Synthetic coding sequence
atggccgctgggactgcagtgggggcttgggtgctcgtcctctccctgtggggcgctgttgttggcgctcaaaatatcactgctcggattggtgaaccactcgtactcaagtgcaaaggagcccctaagaagcccccacagaggttggagtggaagctgaatacaggacgcacggaagcctggaaggtattgtctccacagggtggtggaccatgggactccgtcgcaagggtgttgccgaacggcagcctgtttctgcctgcagttggtatccaggacgaagggatatttagatgccaggccatgaataggaatgggaaagagaccaagtctaactatcggagcctgagaactttcactattaccgcctccgactggatttttccgcctagtgaaattccagggaagcccgagattgttgatagcgcttccgaattgacagcaggtgtgcccaacaaggtgggaacttgcgtctcagagggcagttatccggcaggcacactgagctggcacctggacggcaaaccccttgttcctaatgaaaagggagtcagcgtgaaggaacaaaccaggagacatccagaaaccggattgttcacactgcagtccgagctaatggttacccctgccaggggtggcgaccctcgtcccacattcagttgttctttttctccaggcctgcccaggcacagggccctgcggtag

SEQ ID NO: 213857 - DNA, 705 bp, Artificial Sequence
  Description of Artificial Sequence: Synthetic coding sequence
atggctgccggaactgctgtaggtgcctgggtgctcgtgctctcgctgtggggagctgtggtaggagctcagaatattaccgccaggataggtgagcctctcgtgctgaaatgcaagggggctcctaagaagccgcctcaaagattggagtggaagcttaataccgggaggacggaagcttggaaagtgttatcgccccagggcggaggcccttgggacagcgtcgcgagagttctcccaaacggcagtctgttcctgccagccgtggggattcaggacgagggcattttccggtgccaggcaatgaaccgcaacggcaaggaaaccaagtctaactaccgctctctgaggacattcaccatcactgccagcgattggatcttccccccatctgagatccctggcaaaccggagattgtggacagtgcctcagagttgaccgcaggggtaccaaacaaagtgggaacctgtgtgtccgaaggttcatatcccgcagggacactatcatggcacctggatggaaagcctttagttcctaatgagaaaggcgtgtctgtgaaggaacagacacgcaggcatcccgagacagggctctttacactccagtcagaactgatggttacacccgcacgagggggtgacccccgacccacatttagttgcagctttagcccagggcttcctagacaccgtgccctgaggtag

SEQ ID NO: 213858 - DNA, 702 bp, Artificial Sequence
  Description of Artificial Sequence: Synthetic coding sequence
atggccgctggtactgccgttggtgcttgggtgctggtcctatcattgtggggcgctgtggtgggagcacaaaatattacagcgaggatcggggagccccttgtcctcaagtgcaaaggtgccccaaaaaagccacctcaaagattagaatggaaactgaatacaggcaggacagaagcttggaaggttttaagcccccagggaggaggcccttgggatagtgtggcccgagtgctccctaacgggagcctctttctgccagccgtggggatccaggatgaaggaatctttagatgtcaagctatgaaccgcaacggtaaggaaaccaaatccaattatagagtccgtgtataccagattccgggaaaaccagaaatcgtagattcagcctcggaactgacagcaggcgtcccgaacaaggtggtcgaggaaagcagaagaagccgcaagcggccttgtgaacaggaggtcgggacctgcgtgtctgaaggctcttatcccgctgggacactgtcatggcatcttgatggcaaaccactggtacccaacgagaagggagtctcagtgaaagagcaaaccagacggcatcctgagaccggcctttttaccttacagtccgagctaatggtcactccagcgcgaggaggcgatccaaggcccacattcagctgttcctttagccctggcctacccaggcactag

SEQ ID NO: 213859 - DNA, 1215 bp, Artificial Sequence
  Description of Artificial Sequence: Synthetic coding sequence
atggcagcaggcacggccgttggcgcttgggtgcttgtgctttctctctggggtgccgttgtcggtgcccagaatattactgcacggataggggagcctttggtactcaagtgtaagggggcacccaaaaaacctcctcaacggctggagtggaagctcaacacaggcaggactgaggcatggaaagttctgtcaccccagggaggtggcccttgggactccgtggctcgggtgctgcctaactcttctctgttcctccccgcagtaggtatccaggatgagggtatctttaggtgccaggctatgaatcgtaacggcaaagagaccaagagcaattatagagtgcgtgtgtatcaaatccctggtaaacccgaaatagttgactctgcaagcgagctaactgcaggtgtccccaacaaggtcggcacctgtgtgtccgaagggtcttatcccgctgggactctgtcctggcacctagatggaaaacccttggtccctaatgaaaagggtgtttcagtgaaagagcagactcgccgtcaccccgaaactggcctttttaccttacagtccgagctgatggtgacacccgctcgcggaggcgatcctcgacccaccttctcttgctcatttagccctggcctcccacgtcatagggcactccgtaccgctcccatccaacctagggtttgggagcctgtaccgctggaggaggtgcagctagttgttgaaccggaaggtggagctgtcgcacctggagggacagtgactctcacctgtgaggttccagcccagccctctcctcagatacattggatgaaggacggcgtccctctaccgttgcccccttctccggtattgatcctccctgagatcggaccacaggatcagggcacctattcctgtgtggccacgcatagctctcacggcccacaggagagtagagccgtgagtatctctatcattgagcccggagaggagggaccgaccgcgggatctgtcggtggttctggccttggaaccctggctttggctctggggatcctaggcggattaggtacagccgcactgttgatcggagtgatcctgtggcaacggaggcaacggaggggtgaggagcggaaggctcccgagaatcaggaagaggaggaggagcgggcagaactgaaccaatcggaagaaccagaggcaggcgaaagtagcacagggggaccgtag

SEQ ID NO: 213860 - DNA, 1044 bp, Artificial Sequence
  Description of Artificial Sequence: Synthetic coding sequence
atggctgccggaacagcagtcggagcttgggtcctggtcctgtctttatggggagcggtggttggagctcagaacataaccgccagaatcggagagccgctagttctaaaatgtaaaggagctcccaaaaagccaccccagcgcctggaatggaaactgaatacaggtcgcaccgaagcctggaaagttctgtctccccagggaggcggtccctgggacagcgtggccagagtcttaccaaacgggagcttgtttctccccgcagtgggcatccaggatgagggtatcttccggtgccaggccatgaaccggaatggtaaagagaccaagtctaactacagggtaagggtctatcagattcctggtaagcccgagatcgtggattccgcttccgagcttacggccggagtgcctaacaaagtaggaacctgtgtgagcgagggaagttaccctgctggtactctttcttggcatttagacggcaaaccgcttgtgcccaacgagaaaggtgtgagtgtgaaagagcagacccgccgtcatcctgagaccggactctttaccctccagtctgagctaatggtcacaccagccaggggaggcgaccctcgtccgactttctcttgctccttctcgcccggactgcccaggcacagggccctgaggacggctcccatccagcctagagtatgggagccagtcccattagaagaagtgcagcttgtcgtcgaacctgagggcggtgctgtcgcgccaggcggtacggtcaccctgacctgcgaggttccagctcagccttccccccaaatccactggatgaaggatggcgtgccgctcccactgccaccttccccagtgctaattctcccagagattgggcctcaggatcagggaacttactcttgcgtggccacgcactcctctcacggccctcaagagtcccgcgcagtcagtatcagtattatcgagcccggagaggagggaccaaccgcaggtgaagggtttgataaggtgcgcgaggctgaagactcaccacaacacatgtag

SEQ ID NO: 213861 - DNA, 702 bp, Artificial Sequence
  Description of Artificial Sequence: Synthetic coding sequence
atggcagcaggcactgccgttggagcgtgggttctcgtgctgagcctttggggagcggtcgtcggggcacagaatattactgcaaggattggggagccactggtcctcaagtgcaaaggcgcaccaaagaaacctccccagcgtctcgaatggaagctaaacactggtcgcaccgaagcctggaaagttctgagcccacagggcggtggcccttgggacagcgtggcacgtgtgctgcctaatggttccctgttcctccccgctgtggggattcaggatgaaggaatattcagatgtcaagctatgaatcgcaatggtaaggaaacaaaaagtaattatcgcgtgagagtttaccaaatcccgggaaaacccgaaatcgtcgactccgcctcagaattaacagcaggggttcccaacaaagtagttgaagaaagtaggcgtagcagaaaacgaccctgcgagcaggaagtgggcacatgcgtttccgaggggtcgtaccctgctggaaccttgagctggcacttagacggtaaaccattggtccccaatgaaaaaggtgtttcagtgaaagaacaaacaaggcggcaccctgaaactggattatttacactgcagtctgagctaatggtaaccccagccaggggcggtgatcccagacctacttttagttgctccttctccccaggcctcccccgacattag

SEQ ID NO: 213862 - DNA, 1215 bp, Artificial Sequence
  Description of Artificial Sequence: Synthetic coding sequence
atggctgctggcaccgccgttggcgcatgggtgctcgtcctgtctctttggggggctgtcgtcggagcacagaacattaccgcgagaataggagagccattggtgctgaaatgcaagggcgcaccaaagaaacccccacaaaggttagagtggaaattaaatacgggcaggaccgaagcttggaaggtcctgtcaccccagggaggaggtccttgggacagcgttgctcgagttcttccaaacggcagtctcttcctccccgcagtggggattcaggacgaggggatctttcggtgccaggcgatgaaccgaaatggtaaggaaacgaagtcgaactatagggttcgagtctatcaaattcccggtaagccagagatcgtggactccgctagtgaacttacagccggtgttccaaataaagtcggtacatgcgtgagcgagggctcttaccctgctggaaccctctcatggcaccttgacgggaagccactcgtgcccaacgaaaagggagtgagcgtgaaagaacaaacgaggcgccaccccgagaccgggttgtttaccctccagagcgaacttatggtgactcctgcacgcggtggcgaccctcgacccacttttagctgctcctttagccctggactgcccaggcaccgggctttgaggacggcacccatccagcccagggtctgggagcccgttcctctcgaagaggtgcaactggtggtcgaaccagaagggggtgccgtggcccctgggggtactgtaactcttacctgtgaagtcccagcgcagcctagcccccagattcattggatgaaggatggagtcccacttccactccctccctccccggtgctgattctccccgagatcggccctcaggatcagggcacctactcttgcgtggccacacacagcagccatggccctcaggaatctagagccgtgagtataagcattattgagcccggagaggaaggcccaaccgccggatccgtggggggatccggccttgggaccctggccctggccttaggcatcctgggtggcttggggaccgctgcgctgttaataggtgtgattctatggcagcggcgacagcgcagaggtgaagagagaaaggcacctgagaatcaggaagaagaggaggaaagggctgagttgaaccagtcagaagaacctgaggcaggtgaaagttccaccgggggtccctag

SEQ ID NO: 213863 - DNA, 705 bp, Artificial Sequence
  Description of Artificial Sequence: Synthetic coding sequence
atggccgctggaacagccgtaggagcatgggttcttgtcctgtcactctggggggcagtggtgggtgcgcagaatattaccgctcgcatcggagaacccctggtccttaaatgtaagggcgctcccaagaaaccacctcagcgactggaatggaagttaaatactgggaggactgaagcttggaaagtcctgagtccacagggaggtggcccttgggatagcgttgctcgagtcttgcctaatagcagcctattcctgcctgccgtgggtatccaggatgagggaatcttccgatgccaggctatgaatagaaacggcaaagaaaccaagagcaactaccggagtttaagaacgttcaccatcaccgctagcgactggatcttccctccgtccgaaatccccggtaagccagagatcgtagattcagcttcggaactgacagcaggagttcctaataaagttgggacctgcgtatctgaaggctcatacccggcaggcaccctgtcttggcatctggacgggaaacctctggtcccaaatgaaaaaggcgtcagcgtgaaagaacaaacaaggcgtcaccctgaaacaggactgtttaccctccagagcgagttgatggtaactcccgctagaggtggggacccgaggcccacattctcctgttcattcagcccagggctaccacggcaccgggctctccggtag

SEQ ID NO: 213864 - DNA, 1092 bp, Artificial Sequence
  Description of Artificial Sequence: Synthetic coding sequence
atggcagccggaaccgccgtgggggcatgggtcctggtgctgagcctctggggagcggttgtgggtgcacaaaatattactgcaaggatcggggagccattggtcctgaaatgtaagggagctccgaagaagccaccccaaagactagaatggaaattaaacaccggccgtaccgaagcttggaaggtgttgtcacctcagggcggtggaccctgggatagcgtggctagggtactgcccaatggctcattgtttctgccagcggtcggtattcaggatgagggcattttccgttgtcaggccatgaatcgaaacggaaaggaaaccaagtcaaactatcgcgtgagagtgtaccaaatccccggaaagccggagatcgtggacagcgcatcagagctcactgctggagttcccaataaggttgtcgaggagagcaggcgttctcgcaaaagaccttgcgagcaggaggtggggacttgcgtgtccgagggaagctatcctgccggaactctttcatggcatcttgacgggaagccactggtcccaaacgaaaagggagtaagcgtgaaagagcagactaggcggcatccagaaaccggcctgtttactttgcaaagcgagttaatggtaacaccagccaggggaggtgatcccagacccacattcagttgctctttcagccctgggctgccgagacatcgggctctaaggaccgccccaatacaacccagagtgtgggagcccgtgcctctggaagaagtgcaactagtggtcgagccagaggggggagcggttgcaccagggggtacggtgactctgacctgcgaggtgccagcccagccatctcctcagatccactggatgaaggacggggttcccttgcctctgcctccgtctcccgttttgatcctgcccgagatagggccacaggaccaaggcacctattcttgcgtcgccacacacagctcccatggccctcaggaatcacgagctgttagcatttctatcatcgaacccggagaagaaggacccaccgcgggagagggctttgacaaggtgagggaagcagaggactcgccgcagcatatgtag

SEQ ID NO: 213865 - DNA, 1029 bp, Artificial Sequence
  Description of Artificial Sequence: Synthetic coding sequence
atggctgctggcaccgccgtgggcgcatgggtcctggtcctgtccctgtggggcgctgtggtcggcgctcagaatatcactgcccgaataggggaaccattggtgcttaagtgcaaaggggctccgaagaagccccctcagaggctagaatggaagttgggaggcggaccttgggattcagttgcccgagtgctgccgaatggatctttgtttctgcccgcagtgggaattcaggacgagggcatctttcgctgtcaggcgatgaatcgaaacggcaaggagactaaaagtaattaccgcgtgagagtctaccagattcctggcaaaccggagatcgtggactccgcatcggagcttactgcaggcgtgccaaataaagttggcacttgtgtctccgagggatcctacccagcaggcactttgtcctggcacctggacggaaaacccttagtgcccaatgaaaagggggtttcggttaaggaacagacgcggcgacaccctgaaaccggactgttcactctccagagcgagcttatggttacacccgctagaggcggagatcccagaccgacttttagctgttcttttagccccggactgcctcggcatcgggctctacgaacagcaccgattcaacccagggtgtgggagcccgtacctctcgaagaagtgcaactcgtcgtggaaccggaggggggtgccgttgccccaggtgggacggtcaccctcacctgcgaggtccccgctcaaccctcaccacagatccactggatgaaggatgtttctgatttggagaggggtgcagggagaacaaggagaggcggtgccaactgcagattgtgcgggaggatacgggctggaaattcgtctccaggaccaggtgatcctggaaggccaggcgactccaggcccgcacactggggccatttggtcgccaaggcagcgaccccacggagaggcgaggaagggccacggaaaccaggcggacgcggaggtgcatgccgcaccgagtccgtcggagggacatag

SEQ ID NO: 213866 - DNA, 702 bp, Artificial Sequence
  Description of Artificial Sequence: Synthetic coding sequence
atggcagccggaaccgccgtgggagcatgggtgctggtgctttccctgtggggcgcagtggtgggagctcagaatataaccgcgaggattggggagcctctggtgctgaagtgcaagggggctcccaagaaaccaccgcagagactggagtggaagctgaacactgggaggaccgaggcctggaaggttctgagccctcagggcggaggcccttgggactcggtggctcgggtgttaccaaatggaagtctgttcctccctgctgtaggaatacaggacgaaggaatatttcggtgccaggccatgaacagaaatggtaaagagaccaaatctaattaccgggttcgggtgtatcagattccgggaaagcctgagatcgtcgattcagcttcagaactgaccgccggtgttcctaacaaagtggtcgaagaatcaagacgaagccgaaaacggccttgtgagcaggaggtgggcacctgcgtaagcgagggaagctatccggctggaacgctgtcttggcatctagatggaaagcccctggttcctaacgaaaagggagtgtccgtgaaagagcagacccggaggcaccccgagacagggctgttcactctccagagcgagctgatggtgactccggcaagagggggagatcctcggcctaccttttcttgcagtttcagccccggactgccacggcattag

SEQ ID NO: 213867 - DNA, 1029 bp, Artificial Sequence
  Description of Artificial Sequence: Synthetic coding sequence
atggctgcgggaacagccgtgggcgcatgggtactcgtgctcagcctgtggggcgcagttgtgggcgcacagaatatcaccgcgaggatcggcgaaccacttgtcctcaagtgcaagggcgctccaaaaaagccccctcagcgtctcgaatggaaactgggaggaggcccttgggacagtgttgctcgagtactgcccaacggaagtttatttttgccagccgtcgggattcaggatgagggtatcttccggtgccaagcgatgaaccggaacggcaaggaaactaaatcaaactatagggtgagagtgtatcagatccctggcaagccagaaattgtggactctgcttccgaattaacagctggtgtgccaaacaaagtggggacgtgtgtttcagagggctcataccccgctggtacattgagttggcatttggacggcaagccgctggtgccgaacgagaaaggcgtaagcgtcaaggaacaaaccagacggcatccggaaacagggcttttcaccttgcaatcagagcttatggtcaccccagccaggggtggagaccccagacctacctttagttgctcattctcccctggattgcccaggcatcgagccctgaggaccgccccaattcagccaagggtgtgggagccagtgcctctggaggaagtgcagcttgtcgttgagccagaaggaggcgctgtggccccaggcggtacagtgaccctcacatgcgaagtcccagcccagccttccccccagattcattggatgaaggacgtctctgaccttgaacgcggagccggaagaacacggagaggcggtgctaactgcagactttgcggaaggattcgagcaggcaacagctcacctggtccaggagatcccggtcgcccaggtgactcccgtcccgcacactggggccacctcgttgcaaaggctgctacccctcggaggggcgaggagggcccacgaaagccagggggacgcggaggggcatgtcggaccgaaagtgtgggaggcacttag

SEQ ID NO: 213868 - DNA, 705 bp, Artificial Sequence
  Description of Artificial Sequence: Synthetic coding sequence
atggctgcgggaactgcagtgggtgcttgggtgctggtcctgagtttgtggggcgctgtagttggcgcacagaatatcacagcaaggattggagagcctctcgttttgaagtgtaaaggcgctccaaaaaaaccgccacaacgattagaatggaaactcaatacaggccgaacagaggcctggaaagttttatcaccccaggggggaggaccttgggacagcgtggcgcgtgtcttacctaacggcagccttttcctgcctgcagtaggaattcaggacgaaggtatcttccggtgtcaggccatgaacaggaatgggaaagagactaaatcaaactacagatctctgcggacgtttacaatcaccgcgtctgattggatttttcccccatccgaaattccaggaaaacccgagatcgtcgattctgcttctgagctgacagcaggagtacccaacaaggtgggaacttgtgtttcagagggctcctatccagcagggactctgagttggcatctggacggcaaaccacttgtcccaaacgaaaagggcgtctcggttaaagagcagacacggaggcaccctgagactgggctgttcactttgcagtcagagcttatggtgactccagctagaggaggagaccctcgccctaccttttcgtgtagcttctctcctggactgccaaggcaccgggcactgaggtag

SEQ ID NO: 213869 - DNA, 1215 bp, Artificial Sequence
  Description of Artificial Sequence: Synthetic coding sequence
atggccgcaggcacagctgtgggcgcatgggtgctagttctctccctgtggggtgctgttgtcggcgcacagaacatcaccgcacggatcggggaaccgttggtcctcaaatgcaaaggtgccccaaaaaaacctcctcagaggctggagtggaagctgaacactgggagaaccgaggcgtggaaggtgctgtccccccagggcggaggcccttgggactctgtagctcgcgtgctgcccaatggtagtctcttcctgccggctgtgggtatccaggatgagggcatatttcggtgtcaggccatgaaccgcaatgggaaggaaacaaaatcaaactacagagtgagggtctaccagatccctggcaaacccgaaatagtggactctgcgtcagaactaaccgcaggcgtcccaaataaggtggggacgtgtgtgtctgaaggctcatatcccgctgggacactgagttggcacttggatggcaaacccctggtgcctaacgagaagggagtgagcgtgaaagagcagacacggagacatcccgagactggcctgttcaccctccaatccgaactcatggtcacacctgctcggggaggcgatcctcggccaactttcagttgttcattcagtcctgggctgccacggcacagagctttgcgcaccgctcctattcagcccagggtgtgggagccagtcccgctcgaggaagtgcagctcgtggtggagcccgagggaggagctgttgctcctggcggaacagtgacccttacctgtgaggtgcccgcacagcccagtccacagatccactggatgaaagatggcgtgccactgccacttccccctagccccgtgctcatcctccccgaaatcggtccccaggaccagggaacctactcatgcgtcgcaacacattcctcccacggaccacaagagtcgcgtgccgtgtcaattagtattatagagcccggtgaggagggcccaaccgccggatccgtaggcggttctggcctcggtacactggccctggccctcggcatccttggagggctgggcaccgccgctttgctaatcggagttatattatggcaacgcaggcaaagacgtggggaagagagaaaggcccctgaaaatcaagaggaagaggaagaacgggcagagctgaatcagtctgaggagccggaggctggcgagagcagtacgggcggaccttag

SEQ ID NO: 213870 - DNA, 1029 bp, Artificial Sequence
  Description of Artificial Sequence: Synthetic coding sequence
atggcggctgggacagcagtcggggcatgggtgttagtactgtcactatggggggctgttgtgggcgctcagaacataacggcacgcattggggaacccttggtgttgaagtgtaagggtgcgcctaaaaaacctccccagagactcgaatggaagctcggaggcggtccgtgggattctgtcgcccgagtgttgcccaacagctcacttttcctgcccgcagtgggaatccaagacgaaggcatattcagatgccaggccatgaatcgtaacggaaaagagaccaaaagtaactatcgggttcgggtgtatcagattcccggtaagcccgagatagtcgatagcgcttctgagctgacagcgggtgtaccaaataaagtggggacttgtgtgtctgaaggttcatacccagccggaactctgagctggcaccttgacggaaaacccctcgtgccaaatgaaaagggggtaagcgtaaaagaacagactaggagacatcctgagaccggtctttttactctacagtccgagcttatggtcaccccagccagggggggagacccacggccaaccttctcctgctcctttagtcccggactacctagacacagggctcttcggacagcacccatccagccacgagtttgggagcccgtccctctggaggaagttcagcttgtggtagagcccgaggggggagcagtagctcccggaggcaccgtgacactgacttgcgaagtccccgctcagccgtcaccccaaatacactggatgaaagatgtctccgacctggaacgtggcgctgggagaacccgcaggggcggagccaattgccgtctgtgcgggcgtattcgagccggaaattctagcccagggcctggggatccaggaaggccaggcgactcccgccctgcccactgggggcacctagtagccaaagctgctacaccaaggcgaggtgaagaggggcctcggaagcctgggggacgcggtggcgcttgccggaccgaatcagtgggaggcacatag

SEQ ID NO: 213871 - DNA, 1044 bp, Artificial Sequence
  Description of Artificial Sequence: Synthetic coding sequence
atggcagctggcaccgctgtgggggcttgggtgctagtgcttagtctgtggggcgctgtagtgggcgctcagaatatcactgcgcgaataggtgagcctctggtgctcaaatgtaagggggcacctaagaaaccccctcaacgcctggagtggaaactgaacaccggaagaacggaagcttggaaagtgctttctcctcagggtggcggtccttgggattctgttgccagagttctccctaatggtagtctattcctgcctgcagttgggatacaggacgagggcatttttagatgtcaagcgatgaatcggaatggcaaggagacaaaaagcaattatcgggtacgggtttatcaaatccccggaaagccagagatcgttgatagcgcttccgagttgacagccggtgtgccaaacaaagtaggcacttgcgtctccgaaggttcttatcccgcaggcaccctctcctggcatctggacgggaagccactagtccccaacgaaaaaggcgtcagcgtgaaggaacagacccgacgccaccccgagacagggcttttcacacttcaatcagagctcatggtaactccagccagaggcggtgatcccaggccgactttttcttgcagcttctctccaggcttgccgcgacatcgagctctccggacggccccaattcaacccagagtgtgggaaccggtgccactagaggaagtccagttagttgtggagcctgaaggcggtgccgttgcccctggtggtaccgtaacattgacatgcgaggttcctgctcagccttctccacagatccattggatgaaggacggcgtgccacttccattgcctccctctcccgtcctgatccttccagaaataggaccgcaagatcagggcacctatagctgcgtagctacacactctagccacggaccgcaggaatcaagagcagtgtcgatctctatcatagagccaggagaggaaggacctacagccggagagggtttcgacaaggtccgagaggccgaagatagcccgcagcacatgtag

SEQ ID NO: 213872 - DNA, 705 bp, Artificial Sequence
  Description of Artificial Sequence: Synthetic coding sequence
atggctgccggtactgccgtcggagcatgggtgctggtactatctctatggggcgcagtagtgggggcacagaatatcacagcacgaattggagaacctcttgtgctgaagtgcaagggggcacctaaaaagcctccacagcgcctggagtggaagctgaacaccggcaggacagaggcgtggaaagtcctttctccgcaaggtggaggcccttgggattccgtagccagggtcctgcccaatgggagcctctttttgcccgcagtcgggatccaggatgaaggcatttttcgctgtcaggcaatgaacaggaatgggaaagagactaagagcaactataggagcctgcgcacctttactattacggcgtcagactggattttcccaccaagcgagattccaggaaaaccggagatcgtggactccgcttccgagttaaccgccggagttcctaacaaggtgggtacttgcgtttcagagggctcgtaccccgctgggaccttgtcctggcaccttgacggcaagccattggttccgaatgagaaaggtgtaagtgtgaaagaacaaaccaggaggcatcccgaaacgggcctgttcacattacagagcgagctgatggtgaccccagcccgaggaggagaccctagacccaccttctcttgttcattcagcccaggtctgccaaggcaccgagccctgcggtag

SEQ ID NO: 213873 - DNA, 1215 bp, Artificial Sequence
  Description of Artificial Sequence: Synthetic coding sequence
atggctgctggcacagctgtgggcgcttgggtgctggttctctcactttggggcgctgtggtaggagctcagaatatcactgcacgtattggtgagcctcttgttcttaagtgtaaaggcgcaccaaagaaaccaccacagcggttagagtggaagctgaatacggggagaacagaagcctggaaggtcctctccccacaaggaggaggtccttgggattcagtcgcccgagtgctgcccaatggctcactcttcttgccggcagtcggtatccaggatgagggtatatttcggtgccaggcaatgaacaggaacggaaaagaaactaaaagtaattatagggtcagagtctatcagatccccggaaaacctgagattgtcgacagtgcaagcgagctaacagctggtgttcccaacaaggtcggaacctgtgtgagcgagggaagctatccagcaggcacactttcctggcatctggacggcaaacccctagtccctaatgagaagggagtatcagttaaggaacaaacccggcgtcatcccgagaccggtctgttcacactccaaagcgaactcatggtaaccccagcacgcggaggtgaccctcgccctaccttttcttgtagcttttcacccggactacctcgacaccgcgctcttcgaacagcgcctatccagccgagagtgtgggaaccagtcccactggaggaggtgcagctggtagtagagccggagggcggtgcggtggcaccgggagggactgtcacattaacttgcgaagttcccgctcaaccatctccgcagatacattggatgaaagatggcgtccctctaccccttccaccatcacctgtgctcatcctacccgagatcggaccccaagaccagggaacctatagctgcgtcgccacccacagtagccatgggccacaggagtcccgcgcagttagcatctctatcatcgaacccggagaggagggccctaccgcaggctcagtcggcggatccggcctcggtaccctggcactggccctcggcatcctcggaggactagggactgcggcactgttgattggcgtgatcctctggcagcggagacagagaaggggggaggaaagaaaggccccagagaatcaggaggaggaagaagagagagctgaactgaaccagagcgaagaacctgaggcgggagagtcctccaccggtgggccatag

SEQ ID NO: 213874 - DNA, 1044 bp, Artificial Sequence
  Description of Artificial Sequence: Synthetic coding sequence
atggcagcaggaactgccgtgggtgcgtgggtgttagtgctgtctttgtggggtgccgtggtgggggctcagaacataaccgctagaattggggaaccactggtacttaagtgtaagggcgcacctaagaagcccccacagcgcttggaatggaagcttaatacaggcaggactgaggcctggaaagttttgagtccacaggggggtggcccttgggactccgtcgcgagggttctgccaaacagttctctgttcttgcctgcggtcgggattcaggacgaaggcatttttaggtgccaggctatgaatcgtaatgggaaggagaccaaatcgaactaccgcgtgagagtttatcagattccaggcaaacctgaaattgtagactctgcgtcagagcttaccgcaggagtgcctaacaaggtgggaacttgtgtatccgagggatcctatccagccggaaccttgtcctggcacctcgatgggaagccactggttcccaatgaaaagggagtttctgtcaaagagcagacacgtagacatcctgaaactggtctctttacattacagtccgagctgatggttaccccagctagaggcggagacccgcgaccaactttttcctgcagtttctcacccggactgccacgacaccgtgctctcagaactgctcctatacagccaagagtttgggagcctgttccgctcgaggaagtgcaactggttgtggaaccagaggggggagcagtggcccctggcggtactgttacgctgacttgcgaggtccccgcacagccctccccccagatccattggatgaaggacggagtacctctgcctcttccgccatccccagtattaattctgccggagattgggcctcaggatcagggcacctactcttgcgtcgcaacccattccagccatggacctcaggaatctcgcgcagtgagcatctccatcatcgagcccggtgaagaaggtcccaccgctggagagggatttgataaagtgagggaggctgaagactctccacagcatatgtag

SEQ ID NO: 213875 - DNA, 702 bp, Artificial Sequence
  Description of Artificial Sequence: Synthetic coding sequence
atggcagcaggcacagccgtgggcgcttgggtgctcgtgctttccctgtggggggctgtggtaggggctcagaacatcacagctaggataggtgaacccctggtcctaaagtgtaaaggcgcaccaaagaaacctccgcagaggctggagtggaagcttaatacgggcagaaccgaggcatggaaggtgttaagcccccagggcggaggtccttgggacagcgtggccagggtcttacccaacggctcactgttcctgccagcagtgggcattcaggatgaggggattttccggtgccaggctatgaacaggaatgggaaggagacaaaaagcaactacagagtgcgcgtttatcagatacctgggaagcccgagatcgtggattccgccagcgaactcaccgccggtgtgcccaataaggtggtggaggagtccagacgctctagaaaaaggccatgcgaacaggaagttggcacctgtgtgtccgagggcagctacccggctggcaccctgtcctggcatttggatgggaagccactggtaccaaacgagaagggggtgtctgttaaggagcagacacggaggcatcctgaaacgggattatttaccctgcagagtgagttgatggtgacccctgcacgcggaggtgaccctcggcctacgtttagctgtagtttcagccctggactccccagacactag

SEQ ID NO: 213876 - DNA, 1044 bp, Artificial Sequence
  Description of Artificial Sequence: Synthetic coding sequence
atggctgcgggaacagctgtaggcgcatgggtcttggtgctgtcactgtggggtgctgtggtgggtgctcaaaatatcactgcacggattggcgagcccctcgtgctcaaatgcaaaggcgcaccaaaaaaaccgcctcagcgcctcgaatggaaactgaataccgggagaacagaggcttggaaggtgctgtctccgcaaggcggaggtccatgggattcagtggccagagttttgcccaacggttctttgttccttcctgccgtgggaattcaagacgaaggtatcttcagatgtcaggctatgaacagaaatggtaaagagacaaagtccaactatagagtcagggtttatcagatacccggaaagcctgaaatcgtagattctgcaagcgagctaaccgccggagtgcctaacaaggtgggcacatgtgtcagcgaaggatcctaccctgcaggaaccctgtcctggcacttagatggcaaacccttggtgcctaatgaaaagggagtttcagtgaaagagcagacgaggcggcatccagagaccggtctattcactcttcagtctgagctgatggtgacaccagccagaggaggggatccaaggcctacgtttagctgctcattttcccctggactaccccgacaccgtgccctgcggaccgctccaattcagcctagagtctgggaacccgttcctctagaagaagttcagctggttgtggagcccgaggggggtgccgttgccccaggaggaaccgtaacgctgacttgtgaagtacccgcacagccctcaccccagatccactggatgaaggacggtgtccctctccctttaccgccatcacccgtcctcatactccctgaaatcggcccacaggaccagggcacttactcttgcgtagcgacacactcaagccatgggccacaagaatcccgcgctgtgtcaataagcatcatcgagcctggcgaggagggaccgacagcaggcgagggtttcgacaaggtccgagaagcagaggattcccctcagcatatgtag

SEQ ID NO: 213877 - DNA, 705 bp, Artificial Sequence
  Description of Artificial Sequence: Synthetic coding sequence
atggcggctggaacggcggtgggagcctgggtgcttgtgttgtctctttggggcgcagtggttggagcccagaatatcacagcacgcatcggagagccactggtcctgaagtgtaaaggtgctccaaaaaaaccaccccagcgactcgagtggaagctgaacactggcaggaccgaggcatggaaggtgctctctccacaaggaggcggaccctgggactccgtagcaagagtgctgcctaacggctcactctttctgcccgctgtggggattcaagacgagggtatctttaggtgccaagcaatgaacaggaacgggaaagaaacaaagtccaattacaggtcactcagaacctttacgataactgccagcgactggatcttcccccctagtgagattccagggaagccagagatcgtggacagcgcgtcagaactgaccgcaggagtgcccaacaaagtaggcacctgtgtcagcgaaggttcctatccggcagggaccctcagctggcatctggatgggaagcccctggtccccaatgaaaaaggcgtatcggtcaaggaacaaactcgacgacaccctgaaaccggccttttcacattacaaagcgaactcatggtcactccagccagaggtggtgatcctcgtcctaccttcagctgtagctttagccccggattaccacgccatcgtgctttgcgttag

SEQ ID NO: 213878 - DNA, 1215 bp, Artificial Sequence
  Description of Artificial Sequence: Synthetic coding sequence
atggccgcaggtaccgctgtgggagcctgggtgctcgttctgtctctatggggggcagttgtcggagcacagaatattaccgcaagaataggcgaaccgttggtcttgaaatgcaaaggtgcaccaaaaaaacctcctcagaggttagaatggaaattaaatactggacgcaccgaggcctggaaggtgctctcccctcagggcggtggcccatgggactccgtagctcgcgtgctgcccaacggttccttgtttttgcccgcagtaggtatacaggacgagggcattttcagatgtcaggcaatgaaccgaaacggcaaagaaactaaatctaactatagggtgcgagtgtaccagatccctggaaagccggagatcgtcgactccgctagcgagcttactgccggagtgccgaataaggtcgggacttgcgtgtccgagggcagttatcctgcaggcacgctttcttggcatctcgatggaaagccactggttcccaacgagaagggcgtgtctgttaaagagcagacccgtagacaccctgaaactgggttgtttacgctccagtctgaacttatggtcacccccgcaagaggaggcgaccccagacctactttttcatgtagtttctcccccggtctgcccaggcaccgtgcactccgcactgcccctatacagcccagagtgtgggagcccgtgcctctggaggaagtccagctcgtagtcgagcccgaaggtggcgcagtggcccctggcggtaccgtgactctgacttgcgaggtccctgcccagccctcgccacagatccattggatgaaggacggagtgccattgccgttacctcctagccccgtccttatcctaccggagatcggcccacaggaccagggcacctattcctgcgtagcaacacactcaagtcacggcccacaggaatcgagggcggtctcgatttcgattatagaacctggggaggagggaccaacggccggatctgtcggcggatctggcctgggcaccctagccttggcactcgggatcctcggaggcttgggaacggcagcccttctcatcggggtgattctgtggcagaggcgccagcgccgaggggaagagcgcaaagcaccagagaaccaggaagaagaggaggaaagagctgagctaaatcagtccgaggaacctgaggcaggagaaagcagcactggcggaccatag

SEQ ID NO: 213879 - DNA, 387 bp, Artificial Sequence
  Description of Artificial Sequence: Synthetic coding sequence
atggccgcagggacagctgtgggcgcttgggttctggtcttgagcctctggggagctgttgtgggggctcagaatattacggcgaggataggcgagcctttagttttgaaatgtaagggagcacctaagaaaccgccacaacgcctcgagtggaaattgaacacgggaagaactgaggcttggaaagttctaagtccacaaggcggaggaccctgggattccgttgccagggtcctgccaaatggctcactgttcctgccagctgtgggcatccaagatgaaggaatttttcggtgccaggcgatgaacagaaatggtaaggagacaaaaagcaattatcgagttcgagtgtaccagtttgaaaacctgcataactacagcctctag

SEQ ID NO: 213880 - DNA, 462 bp, Artificial Sequence
  Description of Artificial Sequence: Synthetic coding sequence
atggccgctggcactgctgttggggcttgggttcttgttctgagcctgtggggcgcagtggtgggcgcacagaatattaccgcccgaatcggggaacctctggtgttgaagtgtaagggtgctcctaagaagccgccacaaaggctcgaatggaagctcaataccggaagaaccgaggcatggaaagtcttaagccctcagggaggcggaccctgggattctgtcgctcgagtcctgcccaacggtagcctcttcctcccggcagtgggcattcaggatgaaggaatactaggcggactgggaaccgcagcgttactcataggagtgatattgtggcagcgccgacagagaaggggggaggagagaaaagccccagagaaccaggaggaggaggaagaacgcgctgagctcaatcagtctgaagagccagaggctggagagtcatccacgggcggaccctag

SEQ ID NO: 213881 - DNA, 885 bp, Artificial Sequence
  Description of Artificial Sequence: Synthetic coding sequence
atgaaccgcaacggaaaggaaacaaagagcaattaccgcgtgagagtttaccagatcccaggtaaacccgagattgtcgactctgcatctgaactgactgccggtgtgcctaataaagtgggcacgtgcgtgtctgagggtagttacccagcaggcactctgagctggcacttggacggaaagcctctggtccccaacgagaagggtgtgagcgtaaaagaacaaacccgacggcatcctgagaccggcctctttaccctccagtctgagctcatggttactcccgctcggggtggagatcctagacccaccttcagctgctctttcagcccaggcctgcccagacatagggcactgaggactgcccctatacagcccagggtttgggagcctgtgccattagaagaggtgcagctggtggtcgagcccgaggggggtgccgtcgcaccgggtggcaccgtcaccctcacttgtgaggtacccgctcagccgagccctcagattcattggatgaaggatggcgttcctctgcccctgcctccatctcctgtgcttattctgcctgaaatcggtcctcaggaccagggcacctattcctgtgtggcaacacactctagccacggcccacaggaaagcagagctgtaagtatcagcattattggcagcgtcggcggttcaggcctcggcaccctagcactggcgctaggaattctcggtggactgggaactgctgcccttctgattggcgttatattgtggcagcggagacagagacgcggagaagaaagaaaagcccctgagaaccaggaggaggaggaggagcgagctgaactgaaccagtccgaggagccggaagccggtgagagctcgaccgggggtccttag

SEQ ID NO: 213882 - DNA, 885 bp, Artificial Sequence
  Description of Artificial Sequence: Synthetic coding sequence
atgaacagaaatggcaaggaaactaagtcaaactaccgtgtacgcgtctaccagatccccggaaagcccgagattgtcgatagtgcctcagaactcaccgccggagtccccaataaggtcggcacctgcgtgtccgaggggtcttatccagccggaaccctgagctggcacctggacggaaagcctcttgttccaaatgagaagggcgtgtcagtgaaggagcagacacgcaggcatcccgaaacagggctcttcacactgcagtccgagctgatggtcacgcccgctcgcggaggcgatcccagacctaccttcagctgttcattcagtcccggtttaccccgacatagggctcttcggaccgctcctattcagcctcgggtgtgggagcctgttccactggaagaagtacaactcgtagtggaacccgaagggggagcagtagcacccggtggcaccgtcacactgacttgtgaggtccctgcccagccttcaccacagatccactggatgaaggacggagttcctctgcctctccctccttcaccagttctcattctgccagagatcggacctcaggatcagggcacctactcttgtgtagcaactcactccagtcatggtcctcaggaaagtagggccgtgtccatttcaatcatcggctctgtgggcggttctggtctaggaacgctggcactggcactgggcatcctcggcggattaggaaccgcagctcttcttatcggagtgattctctggcagcgcaggcaaagaagaggggaagagcggaaagcgcctgagaaccaggaggaagaggaggagagggcagagctcaaccaaagcgaggagcctgaggccggtgaatcatccactggcggtccatag

SEQ ID NO: 213883 - DNA, 366 bp, Artificial Sequence
  Description of Artificial Sequence: Synthetic coding sequence
atggccgcaggaaccgcagtgggcgcttgggtcctagttcttagcctctggggcgcagttgtcggtgctcagaatatcactgctcgaatcggcgagcctctggtgttgaaatgcaagggagcccctaagaagccccctcagagactggaatggaaactcaacacaggcaggaccgaggcatggaaggtgttaagtcctcaaggcggaggcccttgggacagcgtcgctcgagtactccctaacggctccttattcttgccagctgtgggcatccaagacgagggcatattcaggtgtcaggccatgaatcgcaacggaaaagagactaaatccaattggtggtggtcccagaaagtggagcagtag

SEQ ID NO: 213884 - DNA, 1308 bp, Artificial Sequence
  Description of Artificial Sequence: Synthetic coding sequence
atgggcgctggcgaacgggtacaagcaccaccacgagccgaagccaccgctggccgaggcgcagatcgcgctcgaacccttgaggggagccgcatggccgcaggcacagccgtcggtgcgtgggtcctggtgttgtccctttggggcgctgtcgtcggcgctcagaatattacggctaggataggcgagcccctcgttttaaagtgtaagggggcaccaaagaaaccaccccagcgcctggagtggaagctcaacaccggacgcacagaggcatggaaagtgctatcccctcaggggggagggccatgggatagtgtggcgcgagtcctgcctaatggctcgctgtttcttccagcagtcggcatccaggatgaaggcatcttcaggtgtcaagccatgaacaggaacgggaaagaaaccaagagtaattacagggtcagggtgtaccagatccctggcaagcccgaaattgttgactctgcaagcgagctcacagcaggagtgccaaataaggtgggcacatgcgtgtccgaaggcagttatcctgcaggaacactcagttggcacttagacgggaagcctttagtgccgaacgaaaagggcgttagcgttaaggagcagacgaggcgtcatcccgagaccggactgtttacactgcagtccgagctgatggtgactcccgcacgcggtggagaccccaggcctacgttcagctgcagcttcagtcccggtctcccacgccatagggcgcttaggacagcccctatccagccaagagtgtgggaaccagtgccgttagaagaggtgcagctggtggtagagcccgaaggaggtgctgtggcacctggcggaacagttacactaacctgcgaggtgccggctcagccatcccctcagattcactggatgaaagacggggtgcccctccctcttccaccttcacctgtgttaatcctcccagagatcggaccacaggaccagggcacctatagctgcgtggctacccattccagccatgggcctcaggagtccagggccgtttctatatcaattattgagcctggagaggagggcccaacggccggtagcgtgggcggatcggggctcgggacgttagccctcgctcttggcattctgggaggactgggtactgcggcacttctcattggagtgattttatggcaacggaggcagagaaggggcgaggagagaaaagcccctgaaaatcaagaggaagaagaggaaagggcagaattgaatcagagcgaggaacccgaagcaggcgagtctagcaccggaggcccatag

SEQ ID NO: 213885 - DNA, 1092 bp, Artificial Sequence
  Description of Artificial Sequence: Synthetic coding sequence
atggcggctggcacagcggtgggcgcttgggtgctggtgttgagtttgtggggcgcagtcgtgggagctcagaacatcactgctcgcataggagagcctttggttttgaaatgcaaaggtgccccaaaaaaaccaccccagagactggagtggaagctgaatacaggacggactgaggcttggaaggtgctaagcccacagggtggcggtccgtgggactccgtggcacgagtgttgccaaatggaagcctgtttcttccggctgtgggcattcaagacgaagggatctttaggtgtcaggccatgaatcgaaacgggaaggagacaaagagtaactatcgcgtgcgcgtgtatcaaatccccggaaaacccgaaatagttgacagcgcctctgaactgaccgccggagtcccaaataaggtggtggaggagagtcgcagatccaggaaaagaccttgcgagcaggaagtgggaacatgtgtttccgagggttcgtatcccgctggaaccctgagttggcacctggacggtaaacccctggtgccgaatgagaaaggggtgtcagtgaaggaacaaacccggcgtcacccggagaccggtctttttacactgcagagcgagttgatggtcactccggctcgcggaggggaccctaggccaaccttctcctgcagcttcagtcctggattacctcgtcaccgcgctttacgcaccgcccctattcagccaagggtgtgggagcccgtgcccctggaagaagtccagctggtggtggagccagagggcggagctgtggcccctgggggaacagtgactttaacatgtgaggtgcctgcccagccatcacctcaaatccactggatgaaggatggcgtcccactgccactgccgccaagccccgtgttaatcctacctgaaattggaccccaggatcaaggtacttatagctgcgtggcgacacatagctcccatggccctcaggagagcagagcagtgagtatttcgatcatcgagccaggagaggagggccctactgcaggtgaggggtttgacaaggttcgtgaggccgaggattctccccaacatatgtag

SEQ ID NO: 213886 - DNA, 402 bp, Artificial Sequence
  Description of Artificial Sequence: Synthetic coding sequence
atgaaagatggggtgcctctgccattgccaccatcccctgtcctgatcctgcccgaaatcggacctcaagatcaaggaacttattcctgcgtcgccacgcattctagccatgggcctcaagagtccagagctgtaagtattagcatcattgaaccaggcgaggagggacctaccgctggtagcgttggagggtcaggcctggggactttagctctcgcactaggcatattgggcggactcggtaccgcagcactgttgataggggtcatcctgtggcagagaagacagaggcgcggagaagaacgcaaggccccagaaaaccaggaggaagaagaggagcgggcagagctgaaccagagtgaggaaccggaggccggagaatcaagtactgggggaccctag

SEQ ID NO: 213887 - DNA, 387 bp, Artificial Sequence
  Description of Artificial Sequence: Synthetic coding sequence
atggcagccggaaccgccgttggggcttgggtgcttgttctcagcttatggggcgctgtggtgggagcgcagaacatcactgcccgtatcggggagccattagtgttaaaatgcaagggggcacccaagaagcccccacaacgtctggagtggaaactcaacacaggacgaacggaagcctggaaggtcctttctcctcagggtggaggaccctgggactcagtggctcgggtactgcctaatagcagccttttcctaccagccgtaggaatccaggatgagggcatcttccggtgtcaggctatgaatcggaacggtaaggagacaaaatccaactacagggtcagggtgtatcaatttgaaaatttgcacaactacagtctttag

SEQ ID NO: 213888 - DNA, 462 bp, Artificial Sequence
  Description of Artificial Sequence: Synthetic coding sequence
atggccgctgggacagccgtgggggcttgggtgcttgtgctatcactgtggggtgctgtagtgggggcacagaacatcacggctcggataggagaacctctcgtgctgaaatgcaagggcgcacccaaaaaacctccccaaaggctggaatggaagctgaacaccggcagaactgaggcctggaaagtgctgtccccccagggcggtgggccatgggatagcgtagcccgtgttttgcccaatggaagtctgttcctgccagcggtcggcatccaagatgaaggcattctgggtggattaggcacggctgctttactaatcggtgtgatcctatggcagcgtcgccaaagacggggtgaggaaaggaaagccccagagaatcaggaagaagaggaggagcgggcagaactgaaccaatcagaggagccagaagcaggcgagtcgagcacaggtggaccatag

SEQ ID NO: 213889 - DNA, 1308 bp, Artificial Sequence
  Description of Artificial Sequence: Synthetic coding sequence
atgggtgccggagaaagggtacaagctccacctcgcgcagaagctaccgctgggcgtggcgctgatcgcgcacgtaccctggagggttcacggatggctgctggcactgccgtgggcgcatgggtgttagtcctttcgctgtggggagctgtcgtcggagcccagaatattaccgccagaatcggagagcccctcgttctcaaatgtaagggggcacccaagaagcctccacagcgactggaatggaaactgaatactggtcgaacagaggcctggaaagtgttgtccccccagggtgggggaccttgggacagcgtggcgcgtgtactgcccaacggatccctgttcctgccagcagtcggtattcaggacgaaggtatcttcaggtgccaggccatgaatagaaacggcaaagaaacaaaatcaaattacagggtccgggtgtaccagatacccggtaaacccgagatcgtagattctgcttctgagttgacagcgggagtgcctaataaagtaggcacctgcgtgagtgagggcagttaccctgccggtacactaagttggcatctggacggtaaacccttggtgccgaatgagaaaggcgtttctgtgaaagagcagacacgccgacatcccgaaactggtttgttcaccctgcagagtgagttgatggtaacaccggcaagggggggtgatcccaggccaacattcagttgctcgttcagcccgggactgccaaggcacagggcccttcggactgcaccgattcaacctagagtgtgggagcccgtgccgcttgaagaagtgcaactggtcgtggaacctgaagggggagcggtcgctccaggtgggaccgtgacattgacctgcgaggttcctgctcaaccttctcctcagatccactggatgaaagacggggtgcctttacccctccccccatcgccagtcctgattctgcccgagatcgggccacaggatcaaggcacatacagttgcgtcgctactcactcatcacacggacctcaggaatcacgggctgtgagcatttccattatcgagcctggggaagaaggcccaacagctggcagcgtcggcggaagtggactgggaaccctcgctctggccctcggcatcctgggaggactgggcacagccgctctgctgattggggtgatcctgtggcagagacgacagaggaggggtgaagagagaaaggctccggaaaaccaggaagaggaggaagagcgcgcagaactgaaccaatccgaggaacccgaggcgggagagagctcaactggcggaccatag

SEQ ID NO: 213890 - DNA, 366 bp, Artificial Sequence
  Description of Artificial Sequence: Synthetic coding sequence
atggccgcaggaacggcagtgggggcttgggtactggtgctcagcctgtggggcgcagtcgtcggtgcacagaatatcaccgccaggattggtgaacctctggtactcaagtgtaagggggctcccaaaaaaccaccccagcgccttgaatggaagctgaataccggaaggactgaggcatggaaagtcctgtcaccacagggaggaggcccttgggacagtgtcgcaagggtgcttcccaatggttccctgttcctccctgccgtaggaatccaggacgagggtatcttcaggtgtcaagccatgaacagaaatggtaaagaaacaaagagtaattggtggtggtcacaaaaagtggagcagtag

SEQ ID NO: 213891 - DNA, 387 bp, Artificial Sequence
  Description of Artificial Sequence: Synthetic coding sequence
atggccgctggcactgccgtcggtgcatgggtgctagtgctgagtctgtggggggcagtagtgggagcacaaaacataactgcccgtataggagaacctctcgttctcaaatgcaaaggagccccaaaaaagcctccacaaagattggagtggaagctaaacacaggcaggacagaggcttggaaagtgctttctccccaggggggaggcccttgggactccgttgcccgagttctgcccaacggatccctcttcttaccggcagtggggatacaggacgaggggattttcaggtgtcaggctatgaatcgcaacggcaaggagacgaagtccaattacagggttcgggtgtatcagtttgagaatcttcacaattactcactttag

SEQ ID NO: 213892 - DNA, 885 bp, Artificial Sequence
  Description of Artificial Sequence: Synthetic coding sequence
atgaacagaaacggaaaagaaactaaaagcaattacagggttcgcgtttaccagatacccggaaagcccgagatcgttgactctgcctctgaattaacggccggagtgcccaacaaggttggtacctgtgtcagcgagggatcttaccccgcaggcacgctgagctggcacctggacggcaaaccactcgtgcctaacgaaaagggtgtcagcgtcaaagaacagaccaggaggcacccggaaactggtctgttcacactgcagtctgagctgatggtcactccggcaagaggaggggacccccgacctactttttcctgctctttctctcctggtctccctaggcaccgcgctctccgaacggcacctatccaacctcgtgtatgggaacctgtccctctggaggaggttcagctcgtggttgaacccgaaggtggtgccgtggctcccggtggtaccgttaccctgacctgcgaagtccccgctcaaccctcacctcaaattcattggatgaaggatggggtaccattgccccttccaccttccccagtccttatcctgccagaaatcggccctcaagatcagggcacatacagttgcgtggccacccactcctcacatggtcctcaagagagcagggccgtaagtatctcgataatcggtagcgtgggtggcagcggactgggaactttagcgctggccctggggattctcgggggactgggtaccgccgcattgctaattggcgtgatcctttggcagcgcaggcagcgacggggagaggaacgaaaggctccggaaaatcaggaggaagaggaggagagggcggagctaaatcagtcagaggagcctgaggccggagagagttccacaggcggaccctag

SEQ ID NO: 213893 - DNA, 366 bp, Artificial Sequence
  Description of Artificial Sequence: Synthetic coding sequence
atggccgcagggacagctgtgggtgcctgggtgctcgtcctgagcctgtggggtgctgttgttggtgcacagaatatcacggcacgaatcggtgagcctttggtgctgaagtgcaaaggggcacccaagaagcctccacagcggttagagtggaagctgaacaccggccgtaccgaagcctggaaggtgctgtccccacaaggcggaggaccttgggatagcgtcgccagagttctgcccaattcctcactgtttctgcctgccgtgggtatccaggatgagggcatattccggtgccaggccatgaaccgaaacggaaaagaaaccaagtcaaactggtggtggagtcagaaggttgaacagtag

SEQ ID NO: 213894 - DNA, 462 bp, Artificial Sequence
  Description of Artificial Sequence: Synthetic coding sequence
atggcagcagggacggctgttggagcgtgggtgctagtcctgtctttatggggcgcagtcgtgggtgcccagaacatcacagcaagaattggagaaccattagtactcaaatgtaaaggagcacccaagaaacccccacagcgtctggagtggaagctaaatacaggcaggaccgaggcctggaaggtgctgagtcctcagggagggggtccctgggatagtgtagctcgtgtgcttcctaatggctcactgtttctgcctgcagtagggatccaggatgaggggatcttgggaggtctcgggaccgccgcacttctgatcggcgtaatcctgtggcaacgcagacagcgcaggggggaagagaggaaggcacccgagaaccaggaggaagaggaggagcgggctgaattgaaccagtccgaagagcctgaagctggcgagtcctcgacaggaggtccctag

SEQ ID NO: 213895 - DNA, 1308 bp, Artificial Sequence
  Description of Artificial Sequence: Synthetic coding sequence
atgggtgcaggagagagggtgcaggcgccacctagggccgaagctactgccggacggggtgcggacagagcgagaaccctcgaagggtccagaatggccgcaggcaccgccgtgggcgcttgggttctagtgctgtctctctggggcgcagtggtgggagcacagaatatcactgcgaggatcggtgagcccctagtgctgaagtgcaagggtgctcctaaaaagcccccacaacgcctcgagtggaaactgaataccgggagaactgaggcatggaaggtgctaagcccacaaggcggaggcccatgggacagcgtcgccagagtcctgcctaacggatccctgtttctgcctgctgtcggaattcaggacgagggcatcttcaggtgccaggctatgaatcgaaacggcaaggagactaaatccaactatagggttcgagtataccagattcctgggaaacccgagatcgtggactcggcttccgagcttaccgctggtgttccgaataaagtgggtacatgcgtttccgagggcagctaccctgcagggactttatcatggcatctggacggaaaaccattagtaccaaatgagaaaggagtgtcagtcaaggaacagacacgtagacacccggagacaggtctgtttacattacaatctgaactgatggtaacacctgcccgaggcggagatccacgtccaaccttctcttgcagcttctcgccaggtctgcccagacaccgagctcttagaaccgcccctatccagcctagagtttgggagcctgtcccgctggaggaggtgcagctagtggtggaaccagaaggaggggctgtagctcctgggggaactgtgacactgacttgcgaggtacctgcacagccatcaccccaaattcattggatgaaggacggagtgccactgcccctgcctccttctcctgtcttaatactgccagagattgggcctcaagaccaaggcacttacagttgcgtcgctacccattcatcacatggcccacaagagagtagagccgtgagcatcagcatcatcgagcccggagaggagggaccaaccgcgggaagcgtgggtggaagcggcctgggtacactagcccttgccctgggtattttaggcggacttggcaccgctgcgcttcttataggggttatcttatggcaacggagacaaaggagaggtgaagagcgcaaggcacccgaaaatcaggaagaagaagaggaacgcgcagagctcaatcagagtgaagagcctgaggcgggagagagctctaccggaggaccctag

SEQ ID NO: 213896 - DNA, 366 bp, Artificial Sequence
  Description of Artificial Sequence: Synthetic coding sequence
atggccgctggcaccgcagtaggggcttgggtcctcgtgctttccctgtggggcgcagtggtgggagcacagaatatcactgctagaatcggcgaaccattagtgcttaagtgcaaaggggctccaaaaaaacccccacaaagactggaatggaagttgaacaccggcaggaccgaggcctggaaagtactgtcaccccagggagggggtccctgggacagcgttgccagggtgctcccaaacgggtcattattcttaccagccgtgggtatccaggacgaaggcatcttccgttgtcaggccatgaatcgcaatgggaaagagaccaaatccaactggtggtggtcgcaaaaggtggagcagtag

SEQ ID NO: 213897 - DNA, 402 bp, Artificial Sequence
  Description of Artificial Sequence: Synthetic coding sequence
atgaaagacggggtacctctccctttgccaccatcaccggtgctgatcctgcctgaaattggacctcaggaccaaggaacctatagttgcgtcgctacacatagcagccatgggcctcaggagtcacgcgctgtgtccatcagcataatcgagcccggagaagaagggcctacggctggatccgtggggggaagcgggttaggtactcttgccctggctctgggaatactcggtggcctgggcactgcggctttattgataggggtgatcttatggcagagacggcagaggagaggcgaagagaggaaggcgcctgaaaatcaagaggaggaggaagagcgggcagaacttaaccagtcggaagagcccgaggcaggagagtcctccactggcggaccttag

SEQ ID NO: 213898 - DNA, 885 bp, Artificial Sequence
  Description of Artificial Sequence: Synthetic coding sequence
atgaaccgcaacgggaaggaaactaaaagcaactatagagtgagggtctaccagattccaggcaagccagagatcgtggattccgcttccgagctgacggctggcgtccccaacaaagtcggaacttgtgtgagtgagggaagttatcctgccggtacactgtcctggcatctggatggcaagcccctagtgcctaatgagaaaggcgttagcgtcaaagaacagacgcgcagacaccctgagacagggctgtttacactgcagtctgaactgatggtaacaccagccagaggtggcgaccccagaccgactttctcatgctcttttagcccaggcctgcctcgacacagagcgctccgtaccgcacccattcagcccagggtttgggagcccgtccccttggaagaagtgcagttagtagttgagcctgaaggcggagctgtggccccaggcggaaccgtaaccctgacgtgtgaggtgcctgcccagccttctccacaaattcattggatgaaagatggggttcctctccccttgccccctagtcccgttttgattctgcctgaaatcggacctcaggatcagggaacctactcctgtgtcgccactcactcaagtcacggccctcaggaaagccgtgcagtgtccattagcatcattggaagcgtcgggggatcaggcctgggaactttggctctcgcattaggcatcttgggaggtctaggtaccgccgcattgctgattggcgtaattctgtggcagcgcagacagaggagaggcgaggagcggaaggctcccgaaaaccaagaagaggaagaggagcgcgcagagttaaaccaaagcgaggagcctgaagctggcgagtcaagcaccggtggcccttag

SEQ ID NO: 213899 - DNA, 402 bp, Artificial Sequence
  Description of Artificial Sequence: Synthetic coding sequence
atgaaggacggcgtgcctctccctctccctccaagccctgtcctgattctaccagagatcggaccccaggatcagggcacctattcctgtgttgccactcactccagccacggtcctcaggaaagtcgcgctgtctcaatttctatcatcgagccaggcgaggaaggcccaaccgccggatcagtgggcggaagtggcctcggcactctggcgctggccctgggaattctggggggtctcgggaccgctgcactgttaattggcgtgatcctgtggcagcgcagacagcggaggggggaggagcgcaaagcccctgaaaaccaggaggaggaagaagagagggccgaattaaatcaatctgaggagccagaggcaggtgaaagctctaccggtgggccatag

SEQ ID NO: 213900 - DNA, 1092 bp, Artificial Sequence
  Description of Artificial Sequence: Synthetic coding sequence
atggccgcaggtaccgccgttggcgcatgggtgctcgtgttgtccctttggggagccgttgtgggcgcacagaacattacagccaggattggggagcccttagtcctgaagtgtaagggtgcccctaaaaagcccccacaaaggctggaatggaaactcaacacaggtcgcactgaggcctggaaagttctgtccccgcaagggggaggtccttgggattcagtggccagggtgctgccaaatggttctctttttctacctgctgtggggattcaagacgaagggatttttcgatgccaagccatgaaccggaatggaaaggaaacaaagtcaaattacagggttagagtgtatcagattcccggaaagcccgaaatcgtggattccgcgtcagaacttaccgccggagttccaaacaaggtcgtggaagaaagcagaagatccaggaaaaggccctgtgaacaagaggtgggcacgtgtgtgtcggaaggcagttatccagctggaacactttcatggcaccttgacgggaagccactggttcctaacgaaaagggcgtctctgttaaggaacagacacgtagacaccccgaaactggcctcttcaccctgcaatcagaattgatggttactcctgccagggggggagatcccagaccaactttctcctgcagcttttctccgggattgcctcgacaccgggctttgcgaactgctcctattcaaccacgggtgtgggagcctgtcccacttgaggaagtccaactggtggtggagccagagggcggagctgtggctccaggaggcacagtcacattaacctgcgaagtgcccgcacagccaagtcctcagattcattggatgaaagatggggtgcctctgcccctgcctcctagtcctgtcctcatactcccagaaatagggccacaggatcagggtacctactcctgcgttgccacacactcatcgcatggaccccaagaatcccgagctgtatccattagcatcatcgaacctggcgaggagggcccaacagctggggaggggtttgataaggtacgtgaagctgaggacagtccgcaacacatgtag

SEQ ID NO: 213901 - DNA, 1308 bp, Artificial Sequence
  Description of Artificial Sequence: Synthetic coding sequence
atgggagcaggcgagagggtccaggcaccccctcgggctgaagcgacagccggtaggggagccgacagggccaggactctggagggctcacgcatggctgccggaaccgcggtaggggcatgggttctggtcttgtctttgtggggcgcagtggttggcgctcaaaacataaccgcccgaataggcgagcccctggtattaaaatgcaagggtgcccctaagaagccgcctcaaaggttggaatggaaactcaacaccgggaggaccgaagcatggaaagttctgtcccctcagggaggcggaccctgggactccgttgccagagtgctgcccaactccagcttgttcttacctgctgtgggcatccaggacgaggggatctttcgctgccaagctatgaaccgcaatggcaaggagaccaagtctaactatagagtgagagtataccagatcccaggtaagcccgaaatcgtggatagtgcgtcagagttgacagcaggagttcctaacaaagtcggcacttgtgtgtccgagggttcctatccagcgggaactctgtcctggcatctagacggaaaacctctggtgcctaatgaaaaaggagtttcagtgaaagagcagacaaggaggcaccctgagacggggttgttcactctgcagtccgaactcatggttacgccagctaggggaggggatccgaggccaacgttctcgtgttctttcagtcccggtctccctcgccaccgggctttacgtactgctcccatccaacctcgtgtatgggaaccagtccccttagaagaggtgcagctggttgtggagcctgaagggggagccgtcgcccctggcggaactgttaccctgacatgcgaggttccagctcaacccagcccacagatccactggatgaaggacggtgtgccactacccctgcctcctagcccagtgctgatccttcccgaaatcggaccacaggaccagggaacgtacagctgcgtggctacgcacagttcacacggaccacaggaatccagggcagtgtccatttctattattgaacctggtgaagaaggacctacagctggttccgttgggggatctgggctgggtacgttggccttggctctgggcattttggggggattgggtaccgcagccctgctgattggcgtcatcctttggcaaagacgtcaacggagaggcgaggaacgcaaggcacccgaaaaccaggaggaagaagaggagcgggcagaactgaaccagtccgaagaacccgaggcaggggaaagtagcaccgggggaccctag

SEQ ID NO: 213902 - DNA, 387 bp, Artificial Sequence
  Description of Artificial Sequence: Synthetic coding sequence
atggctgctggaactgccgttggcgcttgggtactagtgctctctctctggggagcggtggttggagcacagaatattactgcccgtattggcgaaccccttgtactcaaatgtaagggcgctccaaaaaaacctccccagagattagagtggaagctgaatacaggtcggacagaggcctggaaggtgctgagtccccaaggcggaggcccatgggacagtgtggctagggtgctacctaatggctctttgttccttcccgcagtggggatccaggacgagggcatcttcaggtgccaggccatgaacagaaacgggaaagagaccaagtcgaattaccgggtcagagtttaccagttcgagaatctacacaattactctttgtag

SEQ ID NO: 213903 - DNA, 462 bp, Artificial Sequence
  Description of Artificial Sequence: Synthetic coding sequence
atggcagccggtaccgctgtgggggcatgggtactggtactgagcctttggggcgcagtagttggggctcagaacattacagccaggatcggagaacccctcgtcctgaagtgcaagggcgctccgaagaagccgccacagcggttggagtggaagctcaacacgggtcgtacggaagcctggaaagttctctccccacagggcggaggaccctgggactccgtggccagggttctgcctaacggctctctgtttttgcccgctgtcggcatccaagatgagggcatcctgggcggtctgggcaccgctgctctcttgattggcgttatcttatggcaacgcagacagaggcggggtgaggaacgcaaagcccctgagaaccaggaggaagaggaggaaagagccgagctcaatcagagcgaggaacccgaagcaggggaatcttctacagggggtccttag

SEQ ID NO: 213904 - DNA, 1092 bp, Artificial Sequence
  Description of Artificial Sequence: Synthetic coding sequence
atggcggctgggactgcggtgggcgcttgggtgctggtcctgtccttgtggggggcagtcgtaggagcccagaatatcactgccagaattggcgagcccctcgtcctcaaatgtaaaggagctccaaagaaaccccctcaacgactggaatggaaactcaacactggccgtactgaggcttggaaggtgttgtctccccagggaggcggaccttgggacagtgtggctcgtgtgttaccaaacggtagtctgtttctgcctgccgttgggatacaagatgaaggcattttcaggtgtcaggccatgaacagaaatggaaaagagacaaaatcgaattatcgcgtgagagtctaccaaatccctggcaaaccagagatcgtagacagtgcctctgagcttacagccggagtgcctaataaggtcgtggaagagtctcgcagaagccgaaaaagaccttgcgagcaggaagttggcacatgtgtgagtgagggttcttaccccgcaggcaccttgagttggcatcttgacggcaaacccctagtccctaacgagaagggcgtgtccgtgaaggaacaaactcggaggcaccccgaaactggccttttcactctgcagtccgaattaatggtgactccggctcgtggcggtgacccacgccctaccttctcatgctcattttccccaggtctgcccagacaccgcgcactgcgtacagctcccatccagcctcgcgtttgggaacccgtgccattggaggaggtacagttggtcgtcgagccagaaggaggggcagtggcgcctgggggaactgtgacacttacttgcgaagtgcctgcccagccttcaccccagattcactggatgaaggacggagtaccactccccctacctccaagccctgtcctcattttgcccgagattggacctcaagatcaagggacgtacagctgcgtcgctacccatagctctcatggcccacaagaatcgcgggctgtgtccatttccatcatagaacctggcgaggaggggccaaccgcaggcgaggggttcgataaggtcagagaggctgaggactctccacaacacatgtag

SEQ ID NO: 213905 - DNA, 366 bp, Artificial Sequence
  Description of Artificial Sequence: Synthetic coding sequence
atggctgcaggcaccgctgtgggggcttgggtgctcgtactcagtctttggggtgcggtcgtgggagctcaaaatatcaccgcgagaatcggggagcctctggtgttaaagtgcaagggcgcacctaaaaagccaccacagcgtcttgagtggaagttaaacacgggacgtactgaagcctggaaagtgctgtctcctcaggggggagggccttgggattccgtcgccagggttctgccaaacgggagtcttttcctgcccgcagtgggtattcaggacgagggtatattcaggtgccaggccatgaataggaatggaaaggaaacgaagtcgaactggtggtggagccagaaagtagaacagtag

SEQ ID NO: 213906 - DNA, 402 bp, Artificial Sequence
  Description of Artificial Sequence: Synthetic coding sequence
atgaaggacggcgtccctttaccgctgcccccatctcctgtgctgatcttgcctgaaatagggccacaggaccagggtacctacagttgcgtggccacccattcttctcatgggcctcaggagagtagggccgtgagtatctcaataattgagccaggtgaggaagggcctacggcaggttccgttgggggaagcggcctcggcaccctggctttggcgctggggattcttggaggactcgggaccgctgcattgcttatcggagtgatcctgtggcagagacggcaacggaggggtgaggagcgtaaggctcccgaaaaccaggaggaagaggaagaacgggcagaactgaaccagtcagaggaacccgaggccggagaatcatccacagggggtccttag

SEQ ID NO: 213907 - DNA, 387 bp, Artificial Sequence
  Description of Artificial Sequence: Synthetic coding sequence
atggccgctggaaccgcagtcggggcatgggtcctagttcttagcctgtggggggcagtcgtgggggctcaaaatatcacagctcgtattggagagcccctggttctcaagtgtaaaggagcgcctaagaagcctccccagagactggaatggaagctgaatacaggcagaaccgaggcttggaaagtgctgtccccgcagggaggcggaccttgggatagcgtggctagggtgctgccaaacggttctctcttcctgccagcagttggcatccaggacgaagggatctttcgctgtcaggccatgaatcgcaatgggaaggagactaagtccaattacagagtgcgggtttaccagttcgagaacctccataattacagcttgtag

SEQ ID NO: 213908 - DNA, 1092 bp, Artificial Sequence
  Description of Artificial Sequence: Synthetic coding sequence
atggctgcgggtactgctgtgggggcttgggtcctggtgctgtctttgtggggcgctgttgtcggcgcacagaacatcacagccagaatcggagaacccctggtgctgaaatgcaaaggcgctcccaaaaagccaccacagcgtctcgagtggaaactgaacaccggtagaactgaagcatggaaagtcctgagccctcagggcggaggcccatgggattccgtggcacgcgttttgcccaatgggagcctttttctgcccgctgttggaatccaagatgaaggcattttccgttgtcaggctatgaatcgcaatggaaaagaaaccaaatcaaactaccgggtgagggtgtatcagatcccgggaaagcctgagatcgttgactctgcctcggagctaaccgctggcgtccctaataaagttgttgaggagagtcggaggagccgtaaacggccatgtgagcaggaggttgggacgtgtgtaagtgaaggttcctacccagctgggaccctctcatggcacctcgatggtaaacccctcgttcctaatgagaaaggagtgtccgtaaaagagcagactcgacggcacccggagaccggactgtttacattgcagtctgaacttatggtaaccccagcccgtggcggtgatccgagacctacctttagctgctcatttagccccggtcttcctcggcaccgagccctacggaccgcacctatacagccaagagtctgggagccagtgcccctggaagaggtccagctggtggtcgagcctgagggaggtgccgttgcccctggcggaaccgtaaccttgacatgcgaggtgcccgcacagccctcacctcaaatacactggatgaaggacggagtcccccttccacttcccccatctccggtcctcattttacccgaaatcgggccacaggaccaaggaacatactcgtgtgtcgcaactcattcctcacatggaccccaggaatcgagggcagtctctatctctatcattgaacctggcgaagaagggccaacggccggtgagggatttgataaggtacgtgaggcagaggattcaccccagcacatgtag

SEQ ID NO: 213909 - DNA, 1308 bp, Artificial Sequence
  Description of Artificial Sequence: Synthetic coding sequence
atgggtgccggtgaaagggtgcaggccccaccacgggctgaggccactgctggaaggggcgctgatcgggcaagaactctcgagggctcgagaatggccgctggcaccgcagtgggagcttgggtcttagtgttgagtctttggggcgctgttgtcggtgcccagaacatcacagctaggatcggggagcccttggtgctcaaatgcaaaggagcgcctaaaaaacccccacaacgcctagaatggaaactgaatacgggtcggaccgaggcttggaaggttctgtcaccacaaggagggggaccgtgggactccgtggccagggtactgccaaatggttcccttttcctgccggcagttggcatacaagatgaggggatcttccggtgccaagcaatgaatcgaaacggcaaagagacgaaatctaactatagggtccgcgtgtatcagatacctgggaagccggaaatcgtagactctgccagcgaattgaccgccggagtgcccaacaaggtgggcacatgcgtaagcgagggcagctatccagcgggaacgttatcatggcatcttgatggaaaaccgttggttcccaatgaaaagggagtctctgtaaaggaacagacacggcgtcatcctgagacaggcctttttaccctgcagagtgaactgatggtaacacctgccaggggtggcgacccacgaccgactttcagctgctcattttcccccggactgcctcggcaccgagctctgcggaccgctccaatacagcccagggtgtgggaaccggtccctttggaggaagtgcagctggtcgtcgaacctgaagggggagcggtagctccaggcggtaccgtgacactcacatgtgaagtccctgcccaaccttctccccagattcattggatgaaagacggagtgcccctccccctgccaccctccccagtcctcatcctgcccgaaattggtccacaggaccagggtacatactcttgcgtagcaacacactcttcccacggacctcaggagagccgcgcagtcagtatcagtattatcgagccaggagaagagggtcccactgcaggatctgtcggaggctcagggctcggaacactggccctagcactggggatcctagggggtctagggacagctgcactgctgattggtgtgattctgtggcagcgcaggcagagacgaggggaagaaagaaaggcgccagagaaccaggaggaagaggaggagcgggctgagctcaatcagagtgaagaaccagaggcaggcgagtcctcgaccggcggaccatag

SEQ ID NO: 213910 - DNA, 462 bp, Artificial Sequence
  Description of Artificial Sequence: Synthetic coding sequence
atggccgcaggcaccgccgtgggtgcttgggtcctggtgctctcgctgtggggtgctgtggtcggagcacagaacatcaccgcacgcataggcgagcccttagtgctaaaatgcaagggcgctccaaagaaaccacctcagagactcgagtggaaattgaacacaggcaggaccgaggcatggaaggtactgagccctcagggcggtggtccatgggactccgttgcccgtgttctcccaaactcgtccctcttccttccggcagttgggatccaggacgaaggaatcctcggcggactggggacggccgcactcctgatcggagttatattgtggcaacggagacagcggagaggagaggaacgcaaggctccagagaatcaggaagaggaagaggagagagctgagctcaatcagagcgaggagcccgaggcaggcgaatccagtactggagggccatag

SEQ ID NO: 213911 - DNA, 402 bp, Artificial Sequence
  Description of Artificial Sequence: Synthetic coding sequence
atgaaagacggcgtgccactgcctttgcccccttcccccgtcctgatccttccagagatcgggccacaggatcaggggacgtattcgtgcgtcgccacccactcctcgcatggcccacaggagtctcgggcagtaagtattagtatcatcgaaccaggcgaggagggacctactgcaggcagcgtcggaggctcaggactgggaaccctcgccctggctctggggatcctgggcggtctgggaaccgccgctctgctgataggggtgatcctgtggcagcggaggcagagaaggggtgaggagaggaaggcccctgaaaaccaagaggaggaggaagaaagagctgaattaaatcagagtgaggagcccgaagctggggaatccagcacgggagggccatag

SEQ ID NO: 213912 - DNA, 885 bp, Artificial Sequence
  Description of Artificial Sequence: Synthetic coding sequence
atgaaccgaaatggcaaggagactaagtctaactatcgcgtgcgcgtctaccagattcctggaaagccggaaatcgttgattctgcttctgaactgaccgccggagtaccaaataaagttggaacctgtgtgagtgaaggtagttatcctgcgggaaccctgagctggcatctggatggcaagccacttgtacccaacgaaaagggggtttcagtgaaggaacaaactaggcgacatccggaaaccggcctgttcactctccaaagcgagcttatggtcactcccgctcgcggtggagaccccagacccacattctcgtgctccttttcgcctggtctccctcgccaccgggcactgcgtaccgccccaattcagcctagagtgtgggagccagtgcctttggaggaggtccagttggttgttgagcctgaaggcggagccgtggcgcctgggggaactgtgaccctgacctgcgaagtaccggctcaaccaagtccccaaatccattggatgaaggatggggtcccattacctctgcctccatcccctgtgcttattctccctgagataggaccccaagatcaggggacctattcttgcgttgcaacccattcgtcccacgggcctcaggagagccgtgctgtgtccattagcatcataggtagtgtcgggggatctggactggggacattggccctagccctgggaatattggggggtctcgggaccgccgcattgctgatcggggttattctgtggcaacggcgtcaacgtcgtggggaagaacgaaaggcccctgagaaccaggaagaagaagaagagagagccgagctcaatcagtcggaggagccagaggccggagagtcctccacaggcggaccctag

SEQ ID NO: 213913 - DNA, 1092 bp, Artificial Sequence
  Description of Artificial Sequence: Synthetic coding sequence
atggctgcagggaccgctgtgggcgcttgggtgttagtcttgtccctgtggggcgctgtggttggggctcagaatattacagcacgcatcggagaacctctggtactgaagtgcaaaggcgctccaaaaaaaccgccacagcggctagagtggaaattaaatacaggaaggacagaggcttggaaagtgttaagtccacaggggggtgggccatgggattcagtcgctcgggtgttgcctaatagctcgctgttcctgcctgccgttgggattcaggacgaaggcattttccgctgccaagcgatgaaccggaacgggaaggaaacgaagagcaattaccgggtcagggtgtaccagattcccggtaagcctgaaatcgtagattcagcttctgaactgacggctggcgtcccaaataaagttgtcgaggaatcccggcgatcccgcaaaaggccttgcgaacaggaagtaggaacctgcgtttcagagggcagttacccagccggtacgttgtcatggcacctcgacggtaagccgttagtcccaaacgaaaagggggtaagcgtcaaagaacagactagacgtcacccagaaactgggctctttactctgcagagcgaactcatggtcacgccagctcgaggcggtgacccaagaccaactttcagttgctcattcagtccaggacttccccgacaccgcgcactgcgtaccgcccctatccagcccagagtgtgggaaccagtgcctctggaggaagtacagcttgttgttgaaccagagggcggagctgtagccccaggtggtacagtcaccctcacctgcgaagtgcctgctcagccttcaccgcagatacattggatgaaggacggagtacccctccccctccccccaagccccgtcctgatccttcctgagattgggccacaggaccagggcacctactcctgtgtcgcaactcattcatcgcacggaccccaggagtctagggctgtgagcatctcgataatcgaaccaggagaggagggtccaacagccggtgaggggttcgacaaggtgcgggaggcagaggattcgcctcagcatatgtag

SEQ ID NO: 213914 - DNA, 462 bp, Artificial Sequence
  Description of Artificial Sequence: Synthetic coding sequence
atggctgctggtacggcagttggcgcttgggtcctcgtgctgtcactttggggcgcagtggtcggcgcacagaatattacagccagaatcggggaacccctggtgctgaaatgtaagggggctcctaagaagcccccacaaagattggagtggaagctgaacaccggcaggaccgaggcctggaaggtgctgagcccacaggggggaggaccttgggacagcgttgcaagggtgcttccaaatggcagcctttttctacctgccgtgggaatccaggatgaaggtattctgggcggactcggcacagctgcgctgctcatcggtgttattctgtggcagagacgtcagcggagaggcgaagagcgtaaggctcccgagaaccaggaggaagaggaggaacgcgctgagctcaaccagagcgaggaacccgaagccggagagtcttctaccggcggtccatag

SEQ ID NO: 213915 - DNA, 387 bp, Artificial Sequence
  Description of Artificial Sequence: Synthetic coding sequence
atggctgcaggcaccgccgtcggagcctgggtgcttgtcttatccctctggggcgctgttgttggagctcagaatattaccgccagaatcggagagccgctcgttctgaaatgtaagggagctccaaagaagccgcctcagaggttggagtggaaactgaacacagggagaaccgaagcatggaaagtgctgtcaccacaaggcggtggcccttgggactccgtcgctagagtactgcccaatggttctctctttctacccgctgtgggaattcaagatgagggaatcttccggtgtcaggccatgaaccgcaatggaaaggagacaaagtctaattatagggtgagggtgtatcagtttgagaatttgcataactatagtttgtag

SEQ ID NO: 213916 - DNA, 2460 bp, Artificial Sequence
  Description of Artificial Sequence: Synthetic coding sequence
atgcccctgacctctgcctttagagcggtggacaacgatcccggaatcattgtgtggagaatcgagaaaatggagctagcacttgttccagtctctgcacatggcaacttctatgagggtgattgctacgtgatcttgtctacaagaagagtggcctcccttctgtcccaggatatccatttctggattggaaaggatagcagtcaggacgaacagagctgcgccgcaatctataccacccaattagacgattacctaggcggttcacctgttcagcaccgagaagtccagtatcatgagtctgacacattccggggatattttaaacaaggaataatctataaacagggtggggttgcctccggtatgaagcacgtggaaactaacacttatgatgtcaaaagactgctacatgtgaagggcaagcgtaatattcgtgccacagaggtggagatgtcttgggattcctttaatcgaggagatgtgttcttgctcgacttgggaaaggtgattatccaatggaacggtccagagtccaacagcggtgaacgactgaaggcaatgttacttgctaaggacattagggatcgcgaacgaggaggaagagccaaaattggtgtgatcgagggtgacaaggaagccgcttcaccagagctaatgaaggtccttcaggacactctgggacggcgtagcatcatcaagcctacagtgcctgatgaaattatagaccagaagcagaagtccaccattatgctataccatatctccgattctgcaggccagctggccgtgacagaagtggctactcggcctctggtccaggacctgctgaatcacgacgactgttacattttagatcagtctgggaccaagatctacgtctggaagggcaaaggggctactaaggctgagaaacaagcagccatgtcgaaagcactcggattcatcaaaatgaaatcttacccttccagcactaacgtggaaaccgttaacgacggtgctgagtcagcaatgtttaagcagcttttccagaaatggtcagtgaaagaccagactatggggttggggaaaacattctcaatcggaaagattgctaaggtattccaggataagtttgacgtgaccctgttgcatacaaaacccgaagttgcagcccaggagagaatggttgacgacgggaatggcaaggtagaagtgtggcggattgagaatttggaacttgtgcccgtggagtatcaatggtatggcttcttctacggtggcgattgctacctcgtcctctacacctacgaagtgaatgggaagccccaccacattttgtatatatggcaggggaggcacgccagccaggacgagttggccgctagtgcctatcaggccgtggaagtggaccgccagttcgatggtgccgctgtgcaggttcgcgtccgtatgggcaccgaacctcgccactttatggcgatttttaaggggaagcttgtcatctttgaaggaggcacaagtcgaaagggaaatgccgaacctgatccacccgtgcggctgtttcagattcatggcaacgataagagcaacaccaaggcagtggaggtccctgcgtttgcctcctcgctcaactcaaatgatgtattcctactgaggactcaggccgaacactacctgtggtacgggaagggctcgagtggggacgagcgcgctatggcaaaagagttggcttctttgctgtgcgatggatccgaaaacacagtggctgaaggtcaagagccagctgaattctgggatttacttggcggtaagacgccatatgccaacgacaagcggcttcagcaagagatactagacgtgcagtctagactgtttgaatgcagcaacaagacaggccagtttgtcgtgacagagattaccgacttcactcaggacgacctaaaccccacagatgttatgctgcttgacacttgggaccaggtgttcttgtggattggagccgaagctaatgccaccgaaaaagaaagtgccctcgcaaccgcacagcagtaccttcacacacacccatccgggagagacccagatacacccatcctaattatcaaacaaggcttcgaaccacccatattcacagggtggttcctggcatgggacccaaatatttggtccgccggtaagacttatgaacagctgaaggaagaactgggggacgccgctgcgatcatgcgcatcacagccgacatgaaaaacgccactctctccttaaatagtaacgattcagagcctaaatattatccaatcgcagtcttactgaagaatcagaaccaggagctacctgaagatgtcaacccagcaaagaaggagaactacctttctgagcaggatttcgtctccgtgttcggaataacacgtggacagtttgcagctctcccagggtggaaacagttgcaaatgaaaaaggaaaaggggctcttttag

SEQ ID NO: 213917 - DNA, 2439 bp, Artificial Sequence
  Description of Artificial Sequence: Synthetic coding sequence
atgagcagcaccggccatccgggatcttacaaaatctggggggagaaaatggagctagccctggtgcccgtgtcagctcatggtaatttttacgagggtgactgttacgtgattctgtctacaaggcgggtggcttcactgctaagccaagacatccatttttggattgggaaggatagcagccaggatgagcaatcttgtgcagcaatttatactacacagcttgatgactatctcgggggttcgcctgtccagcaccgtgaggtacaatatcatgaaagcgatacgttccgaggatatttcaagcaaggcattatatacaaacagggcggagtcgcatccggaatgaaacacgtggaaaccaacacatatgacgtgaagcgccttctccacgtgaagggcaagagaaacatccgggcaaccgaggtagaaatgtcttgggattcatttaatcggggagatgtctttctcttagacctgggaaaggtcatcatccagtggaatgggcctgaatctaacagcggcgagcggctgaaagcaatgcttcttgccaaagatatccgggaccgcgaaaggggtggtagagctaagattggggtgattgagggggataaagaggcagcctcccccgagttgatgaaagtgctgcaagatacgctgggacggcgaagtattattaaaccaacagtgccggatgaaatcatcgaccaaaagcaaaagtccacaattatgttgtaccatatcagtgacagcgccggacagctcgccgttaccgaagtggctacaaggccactagtgcaggaccttctgaatcatgacgattgctacatcctcgatcagtccggcaccaagatttacgtgtggaagggtaaaggggctaccaaagcggagaagcaagcagctatgagcaaggcactcggattcattaagatgaagtcctacccctcttcaaccaacgtggagactgtgaacgatggcgctgagtcagcaatgtttaaacagctttttcaaaagtggtccgtcaaggaccagactatgggcttgggcaagaccttcagtatcggaaaaattgctaaggtatttcaggacaagtttgatgtcactttgttacataccaagccagaggtggcagcccaggagagaatggtagacgacggcaatggaaaagtggaagtctggcggattgaaaacctggagctagtgccagtggaatatcagtggtatggtttcttctatggaggcgattgctacctggtgctgtatacgtacgaggtgaacggtaagcctcaccatatcctctacatatggcagggacggcacgctagtcaggacgaactagcggctagcgcataccaggccgtggaagtggatcggcaattcgatggagctgctgtgcaagtgagagtgcgtatggggactgagcctaggcattttatggccattttcaagggaaagttagtcatcttcgaggggggtacctcccgcaagggcaacgctgaaccagatccccctgtcaggcttttccagattcatgggaatgacaagagtaacacgaaagccgtggaagtcccagcctttgcctcctccttaaattctaatgacgtgtttttactgaggacccaggcggagcactacctgtggtatggcaagggctcgtctggagatgagcgggctatggctaaagagctcgcctcactgctctgcgatggttcagagaataccgtggccgagggccaggaaccggctgaattttgggatttactggggggaaagacaccttatgccaatgacaagcgcttgcaacaggagattctcgacgtccagtcaaggttgtttgagtgctccaataaaaccggccagttcgtggtcaccgaaattaccgattttacccaagacgatctgaacccgacagatgtgatgttgctggatacctgggaccaggtgttcctgtggatcggagctgaagccaatgcgacggagaaagagagcgccctggctacagcgcaacaatatctccacactcacccttcaggtagggatcccgatacgcccatcctgatcatcaagcagggcttcgagccccctatctttaccggctggtttctcgcctgggaccccaatatttggtctgctggaaaaacatacgaacagctgaaggaggagttaggggacgccgctgccatcatgagaatcacagccgacatgaagaacgctactctcagcctaaatagtaatgactccgagcctaagtattaccctattgccgtgcttctgaagaatcaaaatcaagagctgccggaagatgtcaatccagccaagaaagaaaactacctttccgagcaggattttgtttcagtctttggtattacaagaggccagttcgccgcactgcctggttggaagcaacttcagatgaagaaagaaaaagggctattttag

SEQ ID NO: 213918 - DNA, 474 bp, Artificial Sequence
  Description of Artificial Sequence: Synthetic coding sequence
atgcctcttacaagcgcatttcgcgcagttgataatgacccaggtataatcgtctggagaattgaaaaaatggaattggccctggtccccgtgtcagcccacggtaacttttacgaaggagactgctacgtgatcttaagcacaagaagggtggcatctctcctgagccaggatatacacttttggattggcaaagactcctcacaagatgaacagagttgcgccgctatttatactacacagttagacgactaccttggtggcagcccggtgcagcatcgggaagtgcaatatcacgagagtgatactttccgaggttactttaagcaaggcatcatctacaaacagggtggcgtcgcttccggcatgaaacatgtggaaaccaacacttatgacgtgaagcgtctgttgcacgttaaggggaagcgcaatattagggcgacagaagtggagatgagttgggattccttctag

SEQ ID NO: 213919 - DNA, 2859 bp, Artificial Sequence
  Description of Artificial Sequence: Synthetic coding sequence
atgaaattcaagcgcagacatcaggccttcccttcttttttcaagatgaaagtctctcttccaagtgatccaagctgtgtagaggagattctgcgagagagccagcatctgacgccaggcttcacactgcagaagtggaacgatccaacaacgcgggctagcacaaagtccgtgagcttcaagagtatgctggaagacgatctcaagctgagctcagacgaggacgatttagagccggtcaagaccttgaccactcagtgtacagccaccgagttataccaggccgtggagaaggctaaaccgaggaacaaccctgtcaacccccctctggcgactcctcagccaccgcctgctgtgcaagcctctggcggaagcggaagttcatctgagtcagagtctagcagtgaaagcgacagcgacacagaaagctcaacaacggattccgaaagtaacgaggcacctcgggtcgctacgcccgagccagaaccaccatccacaaacaagtggcagctcgataaatggctcaataaggtgaccagtcagaacaaaagcttcatttgtggccagaatgaaacgccaatggagacaatatcgcttcccccaccgattatccaaccaatggaagtccagatgaaggtcaaaacgaatgcctcacaagtccccgctgagcccaaagaaaggcctttgttgtcgctcatcagagagaaggcaaggccgcgaccaactcagaagattccagaaactaaggccctgaaacataagctgtccactacctctgaaaccgtgtcccaacgcactatcggaaagaagcagcctaagaaggtggagaagaacacctcgacagacgagttcacttggcccaagccgaacatcacgtcttctactcctaaagaaaaagagagcgtcgagctgcacgacccccctaggggtagaaataaggccacagctcataaacctgctccacgcaaggaacccaggcctaatataccactggccccagaaaagaagaaataccgcggaccgggaaagattgtaccaaaatctagggaattcattgagaccgactcttcaaccagcgactcaaatacggaccaggaggagacccttcaaatcaaggtattacccccttgtataatctctggcggaaacacagcaaagagtaaagagatctgtggggctagtcttacactcagtacactcatgagttcctctgggagcaataacaacctctcaatatctaacgaggaacctaccttttcccccatacccgttatgcaaacagagatcctctcacccttgcgcgatcatgagaacctgaaaaacctctgggtgaaaatcgatttggatctgttgagtcgggtgcccggacactcaagcctccacgctgcacctgctaagccagatcacaaggagacagcaaccaaaccaaaaagacagacggccgtcacggcagttgagaaacctgccccaaagggaaaacgcaagcataaacccatcgaggtggctgagaaaattcctgagaagaaacagaggctggaagaagctacaacaatatgcctacttccaccttgcatatcccccgctccccctcataagcctccaaacaccagggaaaacaactcgtcaagaagggctaataggcgtaaggaggagaaactgttccccccaccactatcaccactgccagaagatcccccacgccgacggaacgtgtctgggaataacgggcctttcggacaggacaagaacattgccatgaccggacagatcacatccaccaaacctaagcggaccgagggcaagttttgcgcaacatttaaagggatatccgtgaatgagggtgacactccgaagaaggccagtagcgccacaattactgttaccaacacagctatcgcaacagccaccgtaaccgctactgctatcgtgaccacaaccgttaccgcgacagccactgccacagcgacaactacaactactacaacaaccatcagcacaattacaagcaccattacaactggtctaatggattcctcccacctggagatgactagctgggcggctctgcccctcctgagctctagttcaaccaacgtgaggcgacccaagctgactttcgatgattctgtgcacaatgcagactactacatgcaagaggccaaaaagttgaagcataaggccgacgctttattcgaaaagtttgggaaagctgttaattatgccgacgctgcactaagttttactgaatgcggaaatgccatggaaagggatcccttggaagcgaagagcccctacaccatgtactctgagacagtcgaactgctgaggtatgctatgcggctgaagaattttgcttcccccctcgccagtgacggggacaagaagttagcagttctgtgttatcgctgcctgagcctcctttaccttaggatgttcaagctaaaaaaggatcacgccatgaagtactcccggtcactgatggaatactttaaacaaaatgcttctaaggtggcccagattccctccccctgggtatccaacgggaagaataccccttcgcctgtatctctgaataacgtgagtcccattaatgcgatgggcaactgtaacaacggacctgtgacaattccacaacggatccaccacatggcagcctcacatgtcaatatcacgtccaatgtgttgcgaggttacgagcactgggacatggccgacaagctaaccagggagaacaaagagtttttcggcgatctggataccttgatgggccctctgactcagcactcatctatgacaaacttggtgcggtacgttagacaaggcctttgttggttacgtattgacgcccacctactgtag

SEQ ID NO: 213920 - DNA, 3837 bp, Artificial Sequence
  Description of Artificial Sequence: Synthetic coding sequence
atggatctgtttgattttttccgggactgggacctggagcaacagtgtcattacgagcaggatagatcggcgctcaagaagagggaatgggaaaggagaaatcaggaagtgcagcaggaggatgaccttttttcatccggcttcgacctttttggggaaccatacaagactaataaaggcgatgcattggccaatagagttcagaacacgcttggaaattacgacgagatgaagaacctcttgaccaatcactctaaccaaaaccacctggtggggataccaaaaaactccgtgcctcagaatccaaataacaagaatgagccaagctttttcccagaacagaaaaacagaataataccaccacatcaggataacactcatccgagtgctcctatgccacccccttcagtcgtgatactcaatagtacactgatccacagtaacaggaagtcaaagccagagtggtcccgagactcccataatccctccactgtattggcgagccaagcctcaggtcaacccaacaaaatgcagacactgacacaggatcaatcccaggccaagctggaggatttttttgtgtaccctgccgaacaacctcagatcggtgaggttgaagagtctaaccccagcgccaaggaggatagcaacccaaatagcagcggggaggatgctttcaaggagatttttcagtctaattcgcccgaagaatccgaatttgctgtccaagccccagggtcaccactggtggcctcgagtctgctagcaccaagctccgggttgtctgtgcagaattttcctcctggtctgtattgtaagacatccatgggccagcaaaagcccactgcatatgtcaggcccatggacggccaggaccaggcgcctgatatctcccccactttaaagccctcaatcgagttcgaaaactcctttgggaacctcagcttcggcactctcctggatggtaagccgtccgcagcctcttctaagaccaagctaccaaagttcacgattttgcagacttctgaggtctccctgcccagtgatccctcttgtgtagaagaaatcctgagggaatcacagcatttaacaccaggcttcaccctacagaagtggaacgaccccacaacgcgggctagcacaaagtcggtgtcgtttaaaagcatgctggaggacgacttaaaactatcgagcgacgaagacgatttggaaccagtaaaaactctgacgacccaatgtaccgccactgaattatatcaggccgtggaaaaggcaaaaccgaggaacaatcccgtaaaccccccactagcaacccctcagccccctccagccgtgcaggcgtccggaggttccggttcttcctccgagtccgagtcttcatctgagagcgatagcgatacagagtcttctactacagactccgaatcaaacgaagcacccagggtcgccacacctgaaccagaaccaccctcaactaacaagtggcagctggacaagtggctcaataaggtgacgagtcagaacaagtcctttatttgcgggcagaacgaaaccccaatggagaccatttcgctgcctccgccaatcatccagcccatggaggtccagatgaaggtgaagacaaatgcttcccaggttccggctgagcccaaggagagacccctgctcagcctgattcgagaaaaagccaggcccagacccacgcaaaagatacccgagactaaagccctgaagcacaagttgtcgactacatcagagactgtgagccagcgcactatcggaaaaaaacagcccaagaaggtcgaaaaaaacacgagtactgacgaatttacatggcccaagcctaacatcactagcagtacccccaaggaaaaggagtcagttgagctgcacgatccccctcggggaagaaataaagcaactgcgcacaagcccgctcctagaaaggaaccgagacctaatattcctctggcccctgagaagaaaaaatatcggggaccaggtaaaatagttcccaaaagcagggaattcatcgagaccgattcaagcaccagcgactctaacacggatcaggaggaaaccctccagatcaaggtgttaccgccatgcataatctcaggcggaaacacagcaaagagtaaggaaatttgcggcgcttctctcaccttatccacccttatgagtagtagtggaagcaataacaacttatccattagcaacgaagagcctactttcagccccatccccgttatgcaaaccgaaattctcagcccattacgcgatcatgagaacctgaaaaacctgtgggttaaaatcgatcttgatctactctcaagagttcctggccactcttccctgcatgcagcccctgctaagccggaccataaagagaccgccaccaaaccgaagagacagacagccgtcaccgccgtagaaaaacctgcaccgaaggggaagaggaaacacaaacctattgaagttgcagaaaaaatccccgaaaagaagcagcgcctggaggaggctaccaccatttgccttcttcccccatgtatctcccctgcaccaccacacaagccccctaatactagggagaataactccagccgacgcgcaaaccgacggaaggaagaaaagctctttccaccgccattatcaccgctgccggaggatccacccaggcggcgaaacgtaagtggcaataatgggcctttcgggcaggacaagaatatcgccatgacagggcagatcacaagcaccaaacccaagcggaccgaggggaagttttgtgctaccttcaaaggaatttccgtcaatgagggggacacccccaagaaagccagcagtgcgacaataacagtcaccaacactgcgatcgcaaccgcgactgtgaccgctaccgcgattgtcaccacaaccgttaccgctacggcaacagctaccgctactactacaacaacaacaaccaccatctccacgataacttccactatcaccaccgggttgatggatagcagccacctggagatgacttcatgggcagcactccctctgttaagttcaagttccactaatgtgcgcaggccgaaactgacattcgacgacagcgtccacaatgccgattattatatgcaggaggcgaaaaagctgaagcataaggcagatgcactcttcgaaaaattcggtaaggcagttaattacgccgatgccgctctgtcctttacagagtgtggcaatgctatggaacgcgatcctctggaggccaaatccccttataccatgtacagtgagaccgtggaactattaagatacgccatgcgcctcaaaaactttgcctcaccactggccagcgacggagataagaagctggcagtgctatgctatcgctgtttgtctctgctttatttacgaatgtttaagctcaagaaggaccatgccatgaaatacagccggagcttgatggaatatttcaagcagaacgcgtccaaggtcgcccagatcccctcaccctgggtttcaaatggaaagaatacgccttctcctgtgtccctgaacaacgtgtctcctattaatgccatgggcaactgtaacaatggtcctgtcacaatcccgcaaaggattcatcatatggcggcttcgcatgtgaatatcaccagcaacgtactgcggggttatgagcactgggacatggctgataagctgaccagggaaaataaagagttcttcggcgatttggatactcttatgggtcctcttactcagcacagttctatgactaatctggtgcgatatgtacggcaaggtctttgttggttacgaattgatgctcacctactttag

SEQ ID NO: 213921 - DNA, 3830 bp, Artificial Sequence
  Description of Artificial Sequence: Synthetic coding sequence
atggatctctttgatttctttcgcgactgggacctggagcagcagtgtcattacgagcaagacagatctgctctgaagaagagggagtgggagcggaggaaccaagaggtccagcaggaggatgatctattttctagcggctttgacctttttggagagccctataagactaataagggagacgctctggcgaacagggtccagaatacactcggaaattacgacgagatgaagaatctactgacaaaccatagcaatcaaaatcacctggtcggaattccaaaaaattcagtgccgcagaaccctaacaataaaaacgaaccgtctttctttccagagcaaaaaaaccgtatcatccccccacaccaagacaatacccacccaagtgctcctatgccaccaccatctgttgttattctgaacagcaccttgatccatagcaaccgtaaaagtaagcccgaatggtctagagacagtcacaatcccagcacggtcctggcctctcaagcttctgggcagcctaacaagatgcagacactgacacaggaccagtcgcaagccaagctggaagactttttcgtctaccccgctgagcagcctcagatcggcgaagtggaggagagcaacccgagtgcaaaggaggacagtaaccccaactcctccggcgaggacgcctttaaggaaatcttccagtcgaactcgccagaggaaagcgagtttgcggtgcaggcaccgggatcccctctggtggcttcaagtcttttagcaccttcctcaggcttatccgttcaaaactttccacccggattgtactgcaagacgagcatgggccagcaaaaacctacagcctacgtgcgccctatggacgggcaggatcaggctcctgatatttcgcccaccttgaaaccaagcattgagttcgagaattctttcggcaatctgagcttcggcacactgctggacgggaaaccatccgccgcatccagtaaaacaaagttacccaagttcaccattttacaaacctccgaagttagcttgcctagcgatcctagctgcgtggaggaaatccttcgcgaatcccagcacctcacacctggattcacactccagaagtggaacgacccgaccacgagagctagtacaaagagtgtaagcttcaaaagcatgctcgaggacgacctgaagctgagtagtgacgaggatgaccttgaacctgtgaagacgttgactactcaatgtaccgccactgaactgtatcaggccgttgaaaaggccaagcctaggaacaaccctgtgaatcccccattagcaacccctcaacccccacccgctgtccaggcatccggcggaagcggatctagttccgaaagtgaatcctcttccgagtctgatagtgacaccgagtcaagcacgactgatagtgagtcgaacgaagcacctcgggttgccaccccagaacccgaaccgccttctaccaataagtggcagttagacaaatggcttaacaaagttacatcccagaacaaaagcttcatctgcgggcagaacgagacaccaatggagactataagcctgccaccacccatcattcagccgatggaagtgcagatgaaagtgaagactaatgcctctcaggttccagccgaacctaaggagaggccgctcctgtcgctgatacgcgaaaaagccaggccaaggccgacccagaagatcccggaaacaaaggcactcaaacacaagctgtccacaacttctgagaccgtgagccaaaggaccattggcaaaaagcaaccaaaaaaggtcgaaaaaaacacctcgaccgacgagtttacatggcccaagccgaatattacatcttctacaccaaaagaaaaggagtccgtggagctgcatgatcccccaaggggaaggaataaggcgaccgctcacaagcccgcacccaggaaggaaccgaggccaaacatcccactagctccggaaaagaagaagtaccgtgggcctgggaaaatcgtcccaaaatctcgcgagtttatcgagacagacagctcaacaagtgactcgaacaccgaccaggaggagacccttcagattaaggttttgccaccatgcataatttctggcggaaataccgccaaatcaaaggaaatttgtggcgcttctttgactttgtcaaccctcatgagctccagcggatccaataataacctgtctatatcaaacgaagagccaacattcagtcctattcccgtgatgcagactgaaattctgagccccctccgtgatcacgagaaccttaagaacctatgggtgaagattgacctggacctgttgtcaagagtgccaggccatagcagtcttcacgcggctcctgccaaacctgatcacaaagaaaccgccaccaagcccaaacggcagaccgctgtgacagccgtggagaaacccgctcccaagggaaaacgaaaacacaagcccatagaagtagccgaaaaaattccagaaaagaaacaacgtctggaagaagccacaacgatctgtttactgcccccatgtattagcccagctccccctcacaagccaccaaacacccgcgagaacaattcaagtcgcagagccaataggcgtaaggaggaaaagttatttccaccacccctgagtcctcttccagaggatcctccacggcgaagaaatgtatcagggaataacgggccattcgggcaggataagaacattgctatgactgggcagatcacatccacaaaacccaagcgtactgaagggaagttttgtgcaactttcaaaggcatcagtgagggcgataccccaaaaaaggcttcttctgcaactatcacagtgactaatactgcaatagcaactgccaccgtgaccgccaccgctattgtaaccaccaccgtgactgcaactgctaccgcaacagccaccacgaccactaccaccactactatctctaccataacatcaacaatcacaactggattgatggattcctctcacctggagatgacgtcatgggccgcattgccactactcagttctagttccactaacgtgcgtcgacccaagcttacctttgatgattctgtacacaatgctgattattatatgcaagaggccaagaaactgaaacataaggccgacgccttgttcgagaagtttggaaaggcagtgaactatgccgatgcagcactgtctttcactgaatgcggaaatgccatggaaagggatccgcttgaggccaagagtccgtatactatgtacagcgaaaccgtggagctgttgagatacgcaatgaggctgaagaacttcgcctctccgctggcatcagatggcgacaaaaaactggccgtactttgctacagatgcctatctttactatatcttaggatgttcaagttaaagaaagaccatgcaatgaagtacagtaggtcattgatggagtattttaagcagaacgcctctaaagtagcccaaattccgagcccgtgggtgagtaacggaaaaaacactccatctccagtgagtttaaacaatgtctcaccgatcaatgcaatggggaactgcaacaatggaccagtgaccatcccacaacggatccatcacatggcagcctcccatgtaaacatcactagcaacgtgctgcgcggttacgaacactgggacatggcggataagttaacaagggaaaataaagagttttttggggatctggatacacttatgggacctctgacacagcattcctcgatgaccaacctggtacggtatgtgcgccagggcctgtgttggctgagaatcgatgctcaccttcttta

SEQ ID NO: 213922 - DNA, 1284 bp, Artificial Sequence
  Description of Artificial Sequence: Synthetic coding sequence
atggacttgttcgattttttcagagactgggacttggaacagcagtgccactacgagcaggacagaagtgcattaaagaagcgggaatgggaacgccgaaaccaagaagtgcagcaggaagatgatctgttcagttcagggttcgacctgtttggcgagccttacaaaacgaataaaggtgatgcacttgcgaatcgcgtgcaaaacactttgggaaattacgatgagatgaaaaacctacttacgaaccattccaaccagaatcatctggtgggaatccccaaaaacagcgtgcctcaaaaccccaacaataagaatgaacccagtttttttccagaacagaaaaacaggattattcccccacaccaggacaacacccatcccagcgcccctatgccccctccatctgtggtcattctgaattctaccctaatccatagcaaccgcaagagcaagcccgagtggtctcgggatagtcataatcccagcacagtcctggcatcacaggcttcgggccagcccaataagatgcagactctgacccaggaccaatcccaagccaagcttgaggatttctttgtgtatccagccgaacaacctcaaattggtgaagtggaggaaagcaacccctctgcgaaggaagatagcaatcctaactcatccggagaggacgcttttaaggaaatttttcagagtaacagtcccgaggaaagcgagtttgctgtgcaggccccagggagccccctcgttgcttcaagcctgctggcaccctcctctgggctatccgttcaaaatttccctccaggtctgtactgtaagacctctatggggcagcagaaacccactgcgtatgtacgcccaatggatggtcaggatcaggccccagacattagtccaaccctcaaacctagcatcgagttcgaaaattcttttggaaatctgtcgtttggaacactgctggacggaaaaccatccgcggcaagcagcaagaccaagttgcccaagtttacaatcctccaaacaagtgaggtgagtctgcctagtgatccctcttgcgtggaggaaatactgagagaatcacagcatctgactcccggatttacactccagaagtggaacgatccgacaactcgcgcatccaccaagatgctggaggatgatctcaagctgagttccgatgaggatgacctagagccagtgaagacgctgaccacgcagtgcaccgcaaccgagctttaccaggccgtcgaaaaggccaaaccaaggaataacccggtcaagtag

SEQ ID NO: 213923 - DNA, 3935 bp, Artificial Sequence
  Description of Artificial Sequence: Synthetic coding sequence
atggacttgtttgacttctttagggactgggatctggaacagcaatgtcattacgagcaggaccgctcagccctcaaaaagagagaatgggaacggcgtaaccaggaggtgcagcaggaggatgacctgttctcaagcggtttcgatctgtttggcgagccttataaagtcgccgagtatactaacaagggtgacgcgctggccaacagggtgcagaatactctgggcaattatgatgaaatgaagaacctcctcacaaatcattccaaccaaaatcaccttgtcgggattcccaaaaattctgtgccgcagaatccgaacaataagaatgaacccagcttcttcccggagcagaaaaacaggataatcccaccacaccaggacaacacccaccctagtgcccctatgcccccaccctccgttgttattctgaacagcacactgattcacagcaatagaaagtctaaacctgagtggagccgggattctcacaacccctcaacagttctcgcttctcaggcttctggccagcccaacaagatgcagaccctgacccaggaccagtcccaggcgaagctagaagacttttttgtgtaccctgctgagcagccacagatcggcgaagtcgaagagtcgaatcccagcgctaaggaggactccaaccctaattcttccggcgaagacgcctttaaggaaatatttcagtccaacagccccgaagagtcggaattcgctgtgcaggcccctgggagccctctggtggcaagttccctgctggccccttcttctggactcagtgttcagaactttccaccaggactctactgtaaaacatctatgggacagcaaaagcccaccgcctatgtcaggcctatggacggccaggatcaggctcccgatatctcccctacactcaaaccctcaattgagttcgagaattcttttggcaacctaagcttcggcactctcctggacggtaaaccatctgcagccagctcaaagaccaaactccccaagtttactattttacagacaagtgaagtctcgctgccttctgatccaagttgtgtcgaggaaattctgcgcgaaatgactcactcgtggcccactcctctgacctccatgcacaccgccggacacagtgaacagtccaccttctcaataccaggtcaagaatcacagcacctgacacccggatttaccctgcaaaaatggaatgatcccactacacgcgcttccactaaatcagtgagtttcaaatccatgcttgaggacgatttgaaattatcgtcagatgaagacgacctagagccagtcaagacattgactacccagtgcacagccaccgaactgtaccaagctgtcgagaaggccaaaccacgtaacaatcctgtgaacccccctctagccacaccacagccaccaccagctgtgcaggcttctggagggagcggaagctcaagcgaaagcgagagtagcagcgagagtgactctgacacagaaagttctactacagatagcgaatctaatgaggctcccagagtggcaacccccgagccggagcctccgtctaccaacaaatggcagctcgataaatggctcaataaggtgacgagtcaaaacaagagtttcatatgcggtcagaacgagacccctatggagaccatcagcttacccccaccgatcatccagcctatggaggttcagatgaaagtgaagacgaacgcatctcaggtacctgctgaacctaaagaacgccctctcctgagtctgattcgcgagaaggcgagaccacggcctacccagaaaattcctgagacgaaggcgctgaagcataagctgtccacgacttcagagacagtgtcacagcgaactattggaaaaaaacaacctaagaaggtggaaaagaacacgtccactgatgaattcacctggcctaagcctaatataacaagctccaccccaaaggagaaagagagtgtagagcttcacgatcctccgcgagggcgtaacaaagcaactgcccataaacctgccccacgaaaagaacccagacccaatatcccgctggcacccgagaaaaaaaagtatcggggtccgggaaaaatcgtgcctaagtctagggagttcatagagactgacagcagcaccagcgacagtaatactgaccaagaagaaacattgcagattaaggttctgcctccctgcataatcagcggaggaaacacagctaagagcaaggagatatgtggcgcaagccttacactttcaacgttaatgtctagctctgggagcaacaataatctgtcaatctcaaatgaggagccaactttttctcccatccccgtgatgcagacagaaattcttagcccccttagagaccatgagaatctgaagaatctctgggtgaagatcgacctcgacctccttagtagagtgcctggtcactcctccctacatgccgctcctgcaaagccagatcacaaagagacagccactaagcctaagcgccagacagccgtcaccgcagtcgagaaaccggcaccaaaaggcaagaggaagcataagcccattgaagtggccgaaaagattcccgagaagaaacagcggctggaagaggccacaacaatctgcctgctcccaccctgcataagccccgctccgcctcataagcctcctaatacaagggagaacaatagcagtaggcgagccaatcggaggaaggaggaaaagctgtttcccccacccctgtctcctcttcccgaagaccccccaaggcgcaggaatgtgtctggaaacaatgggcctttcggccaggacaagaacatcgctatgaccggccaaattacatccacaaagcccaagagaacagagggtaaattctgtgccacatttaaaggcatttcagtgaacgaaggcgatacacccaagaaagcctcctccgccaccatcacagttacaaatactgccatcgccaccgcaactgtgacagcgactgccatagttaccaccactgtgacagctacagcgaccgccactgctaccactaccactaccaccactaccataagtacaatcacctcgactattacaaccgggctgatggactctagccatcttgagatgacatcctgggccgctctgcccctgctgagttcttcttcaacaaacgtgaggcgacccaaactaacatttgatgattcagtgcacaacgctgactattacatgcaggaggcaaagaaactgaaacataaagctgatgccctgtttgagaaatttggcaaggccgttaactatgccgacgccgctttatccttcacagagtgcgggaatgccatggaacgcgatcctctggaggctaaatctccgtacaccatgtattcagaaaccgtggagctgctgcggtacgcgatgcgtctcaaaaattttgcctccccgttggccagtgacggggataaaaagttggccgtgttgtgttatcgttgtctgtctctgctatatctgcgtatgtttaagctgaaaaaggatcatgctatgaagtattcacgaagcctgatggaatacttcaagcaaaacgcaagcaaggtggcgcagataccttctccatgggtgtccaacggaaaaaatactccctctcctgtctctttaaacaacgtctcccctataaatgcgatgggcaattgcaacaacgggcctgtgactataccccagagaatacaccatatggccgcatctcatgtcaacattactagtaatgttttgcgtggatatgaacactgggacatggccgacaaattaacgcgggaaaacaaagaattctttggagatctagatactctgatgggcccactgacccagcacagttctatgactaatcttgtccggtacgtgcggcaggggctctgctggctgaggatagacgctcatttactgta

SEQ ID NO: 213924 - DNA, 1410 bp, Artificial Sequence
  Description of Artificial Sequence: Synthetic coding sequence
atgtctgcactgacaccaccaacggacatgccaactcccacaaccgacaagataacacaggcagctatggagacaatatacctttgcaaattccgcgtctcaatggacggcgaatggttgtgcctgagagaattggatgacatatctctgacccctgaccctgaacctacacatgaggatcctaattacctaatggcaaacgagcgaatgaatttaatgaatatggctaaactgagcattaagggcttgatcgaatccgccctgaatcttgggaggacactagacagcgattatgcacccctgcaacagttttttgtcgtcatggaacattgcttgaagcacggtctgaaggccaaaaagacctttctgggacaaaataaaagtttttggggacctctagagctagtggagaaactggtccctgaagctgctgaaatcactgcatcagtgaaagatctccccggtctaaaaacacctgtcggcagaggacgggcatggctgaggctggccctgatgcaaaaaaagctgagcgaatatatgaaagcgctgattaataaaaaagagttgctgtccgaattttacgaacctaatgccctcatgatggaagaggaaggggcaatcattgccggattgctggtcggcctgaatgtgattgatgcaaatttttgcatgaaaggtgaagacctcgattctcaggtcggtgtgattgacttctccatgtatctcaaagatggtaactcatccaagggaaccgaaggcgacggccagattactgccattcttgaccaaaaaaactatgtggaggaattgaaccgacatctgaatgctaccgtcaacaatctgcaagccaaagttgacgcattggaaaagtccaacactaaattgaccgaagaactggccgtcgccaacaacagaatcataacactgcaggaggagatggagcgggtcaaggaggagtccagctacatcctggaaagtaaccgcaaggggccaaagcaagacagaaccgcagaggggcaggcattatctgaggctaggaagcacctcaaagaggagacccagctgaggctggatgtcgaaaaagagctggaaatgcagatctctatgaggcaggagatggaactggcaatgaagatgctcgagaaggacgtttgcgagaagcaggatgcacttgtttccctgcgacagcaactggacgacctaagggcactgaagcacgaactcgccttcaagcttcagtcttcagacttgggcgtgaagcaaaaaagcgagctcaactctcgattagaggagaaaactaatcaaatggccgctaccatcaagcagttggaacaatctgagaaagacctggtcaaacaggccaagaccctgaattctgccgcaaataagctgatccccaaacaccattag

SEQ ID NO: 213925 - DNA, 2394 bp, Artificial Sequence
  Description of Artificial Sequence: Synthetic coding sequence
atggcacatcggtgtctgaggctgtgggggaggggcggatgctggcccaggggactccagcaactcctagtccctgggggagtgggtcccggagaacagccttgcttgcgcacgctgtacagattcgtgactacacaggcccgagcatcgcggaattcactgctaacggacatcattgccgcttaccagcgcttctgctctcggccacccaagggcttcgagaaatacttccctaatggtaagaacggcaaaaaagcgagcgagcctaaggaggtgatgggcgagaaaaaggagagtaagcccgctgccaccacgcggagtagcggcggtggcggaggcggaggcggaaaaagagggggaaagaaggacgactcccactggtggtccagattccaaaagggggacataccatgggacgacaaggacttcaggatgttctttctgtggaccgctctgttctggggaggggtgatgttttacctgcttctaaagaggtccggcagggagatcacatggaaagacttcgtgaacaactatctgtcgaaaggagtcgtcgacagactggaggtagtgaataagcgcttcgtgcgggtcacgttcaccccaggcaagacacccgtggatgggcagtacgtgtggtttaatattggcagcgtggacacgtttgagcgcaaccttgaaacccttcagcaggagctgggcatcgagggcgagaaccgggtgcctgttgtgtatatagcagagtctgatgggtcctttttattaagcatgctgcccacagtattaataattgcattcctcttatacacaatccgccgtgggcctgccggaatcggaagaaccggaaggggaatggggggtcttttttcagtcggagagactacagcaaaggttcttaaggatgaaatcgatgtgaagtttaaagatgtggccggttgcgaggaggccaagctggaaatcatggagtttgtcaatttcttgaaaaaccctaaacaataccaggatctgggtgctaagatccccaagggagccattctgacaggaccgccaggtaccggaaagaccctgctggctaaagctaccgcaggagaggctaacgtccctttcatcacagtctccggatcggaattcctggaaatgttcgtgggtgtgggaccagctagagtgcgcgacctttttgctctagccaggaaaaacgccccttgcatcctgtttatagatgaaatagacgctgtcggcagaaagcggggaaggggaaatttcggcggtcaatctgagcaagaaaatacgctgaaccaactgctcgttgagatggatggttttaatactacaacaaacgtggtgatccttgctggaacaaatcgaccagatatcctggaccccgctttgttgcgcccagggcgtttcgaccgtcagatcttcatcggacccccagatattaaaggaagagcgtcgatcttcaaagtacatctacgaccactcaaactggactctaccttagaaaaagacaagctcgcccgtaagttggcttcattgactccaggtttctccggagccgacgtcgctaatgtgtgcaatgaagcagccttgatcgcggcacggcacctgtctgacagcatcaaccagaagcatttcgaacaggcaatcgagcgggtaatcggagggctggaaaaaaagacacaggtgctgcagccggaagagaaaaaaactgtggcataccatgaagctggacatgctgtagccggatggtatctagaacatgcagatccccttctgaaggtgtccatcatcccgcgtggcaagggactgggctacgcccagtaccttccgaaggaacagtacctctacactaaggagcagctccttgatcggatgtgcatgaccttaggagggagggtcagcgaggaaattttttttgggagaatcacaactggagctcaggacgacctccgcaaagtgacacagtccgcctatgcacagattgttcagttcgggatgaacgaaaaagtcggtcagataagttttgatctcccgaggcagggagacatggtgttggaaaagccttatagcgaggccaccgcacggctcatcgacgacgaggtgcgcatcctgatcaacgatgcctacaagcgaacagtggcattactaacagaaaaaaaagcagatgttgagaaggtggccctacttttgcttgaaaaagaagtgctcgacaaaaatgatatggtggaattgctcggccctagaccattcgctgagaaatcaacctatgaggagttcgtagaaggtacggggtcgctcgatgaagacacctccctgccagaggggctgaaggactggaacaaggaaagagaaaaggagaaggaagagccgcctggagaaaaagtggccaattag

SEQ ID NO: 213926 - DNA, 2439 bp, Artificial Sequence
  Description of Artificial Sequence: Synthetic coding sequence
ggggctggtggccgacggagaagggtcgaatcactggggtcctcagtctccaggcgccgagcttccctcccgggaggcttatctcctagtcgcgctcgtttcccacgcccacccgtagttgcttgtccaaggcttcgcgagcagccatgtctacggaccctgtaccggtttgtaaccacacaggctcgcgctagccgcaactcactcctgacagatatcatcgccgcttaccaaaggttctgtagccgtcctccaaaagggttcgagaaatattttcccaatggcaagaacggcaaaaaggcctctgagcccaaggaggtcatgggcgagaagaaggaatctaaaccggctgccaccactagatcatctggagggggtggaggaggaggtgggaagagaggtgggaagaaagacgatagccactggtggtcgaggttccagaagggcgatattccgtgggacgataaagacttccgaatgttcttcctctggacagccctgttttggggtggagttatgttctatctccttttgaagagaagtgggcgagagatcacttggaaagatttcgtgaacaattacctgagcaagggcgttgtggataggctggaggtagtgaacaaaagattcgtcagagtcacctttacaccaggcaaaactcccgtggatggccaatatgtgtggttcaacattggtagtgtggataccttcgagaggaacctcgagacgttgcaacaggagctggggattgagggcgaaaatcgggtacctgttgtgtatatcgccgagtccgatggatcgttcctcctcagcatgctaccaaccgttttaatcatcgcttttctgctgtataccatccgcaggggccctgctggtattgggagaaccggcagaggtatgggtggtctcttctctgtgggcgaaacaactgccaaagttctcaaggatgagattgatgtcaaatttaaagatgtggccggatgcgaagaagctaaattagaaatcatggagtttgttaattttttaaaaaatcctaagcaataccaggatctgggcgctaagatccccaagggcgcaatcctgaccggccctccgggaactggaaagactcttctggcaaaagccactgccggtgaggcgaacgtaccatttattactgtgagcggctcagaatttttggaaatgtttgttggtgtgggacccgctagggtgcgtgatcttttcgcactcgctcgcaagaacgcgccatgcattctgttcatcgacgagatcgatgcagtcggacgtaaaaggggtcgcggaaacttcggcggacagagcgagcaggagaacacacttaatcagctactggttgaaatggacgggtttaataccacaaccaatgtcgtcatcttggctggaacaaacagacccgacatcttggacccagctctgctaaggccaggaaggttcgacaggcagatcttcataggacctccagacatcaagggtagagcgagcatctttaaagtccatctgcgcccactgaaacttgactccacccttgagaaagataagctggctagaaaactggccagtctaacccctggcttctctggggcagatgtcgctaacgtctgcaacgaagctgccctgattgcggctcgtcacctgtccgactcaatcaatcagaaacacttcgaacaagctatcgaaagggtgatcgggggactggagaagaaaacacaggtgcttcagccggaggaaaagaagacagtggcctaccacgaggccggtcacgctgttgcgggatggtacttggagcatgcagatccgctcctgaaggttagcataattccacgcggtaaaggcctggggtacgctcaatatcttcctaaggagcagtacctttatacaaaagagcagcttctggaccgaatgtgcatgaccctgggaggccgagtcagtgaggagattttttttggacgaattacaacaggggctcaggacgatctccgcaaggttacccagtcagcttacgcccagatcgtccaattcgggatgaatgagaaagtcgggcagatatctttcgacctccccagacagggagacatggtgctcgagaagccttatagtgaggccacggctcggctgatcgacgatgaggttaggatcttaatcaatgatgcgtataaacgtaccgtggcccttttaacagagaagaaggcagacgttgaaaaagtggccctcttactgcttgagaaagaagttctcgataaaaacgatatggttgagctgctggggccacggccattcgctgaaaaaagcacctacgaagagtttgttgaagggacaggctcattagacgaggatacctccctgcccgaaggactcaaagactggaataaggagagagagaaggagaaggaggagccgccaggtgagaaggtcgccaactag

SEQ ID NO: 213927 - DNA, 7250 bp, Artificial Sequence
  Description of Artificial Sequence: Synthetic coding sequence
atgaccacactgctttgggtctttgtcacccttagagtgattacagcagcagtcacagttgaaacatccgatcatgataatagtctctctgtgtctattcctcagccctcccccctgcgcgtcctgctgggtacatctctgacaattccctgctacttcatcgatccgatgcaccccgtcacaacagctccatccacagctcccctggcgccacggatcaagtggagtcgggtgagcaaggagaaagaagttgtgctgttggtcgctactgagggcagggtcagggtgaactcagcttatcaggacaaggtgtcccttcccaactaccctgcaatcccctctgacgccaccctagaagttcagtctctgcggagcaatgatagtggggtatatcgatgcgaggtcatgcatggtattgaggactcagaagccacccttgaagtggtggttaaagggatcgtctttcactaccgggctataagcactcggtataccttggacttcgacagggcccagcgcgcttgtctgcagaattccgccatcatcgcaaccccagagcaattacaggcagcatacgaagacggcttccatcaatgcgatgccggttggttggctgatcagaccgtgcgctacccgattcatactcctagagaggggtgctacggagataaggatgagttccccggagtcagaacttatgggattcgagataccaatgagacctacgatgtgtactgcttcgctgaggaaatggaaggggaggtcttttacgctacatccccagaaaaatttacattccaggaggcagccaatgaatgccgtcgactgggggcacgtctggcaactaccggacagctttacctggcgtggcaggccggaatggacatgtgctccgccggatggttagcagaccgtagtgttaggtacccgatttctaaagcacgccctaactgtggcggtaacctgctcggcgtgcgcacggtctacgtacatgcgaaccagaccggctatccagatccctcatccaggtatgatgccatttgttacaccggtgaggatttcgtcgatatcccagagaatttctttggggttgggggagaagaagatatcaccgttcagacagtgacgtggcctgatatggaactgcccctgccacgcaacatcaccgaaggtgaagctcgcggttccgtcatcctgacggttaagcccatttttgaggtgtctccttcaccactggaacccgaagagccatttacctttgccccagaaatcggagccacagccttcgccgaggtcgagaatgagactggagaggccacccgcccatgggggttcccaacacccggtctcggacccgcaactgcatttacctcagaggaccttgtggtacaggtgactgcagtgccgggacagccccatctacctggcggagtggttttccactacagacctggaccgaccagatacagcctgacgtttgaggaggctcaacaagcctgcctccgcaccggagcagtgatagcgtctcctgaacagttgcaggccgcatatgaggctggatatgagcaatgcgacgcaggctggctcagggaccagaccgtgcgctatcctatcgtttccccccgaacaccgtgcgtcggagacaaggatagttcacctggcgtgaggacgtacggcgttaggccttctaccgaaacctacgatgtatactgctttgttgataggttggagggagaggtattttttgctacccgtttggagcaatttacatttcaagaggcactagagttctgtgagtctcacaacgctacattagcaacgactgggcagctctatgctgcctggtcaagagggttggacaagtgttatgctgggtggctggcagatggctccctgcggtatccgattgtgacacccagacccgcttgtggaggtgataaaccaggcgtcaggaccgtttatttatatcctaaccaaaccggtctgcccgatccactgagtcgacaccacgccttttgtttccgcggtatctccgctgtcccatcccccggagaagaggaggggggtacccccacttctccatccggcgtggaagagtggatcgttacccaggtcgtaccaggggtcgccgctgtgcccgtggaagaggagacgactgcagtgccgagcggtgagactaccgcaatccttgagttcaccacggaaccagagaaccaaacagagtgggagcccgcatatacccctgtgggtacatctcctctccctggcatactgccaacttggccacccactggtgctgccactgaggaaagcacagaggggccttctgccaccgaagtgccttcagccagtgaagagcctagcccaagcgaagtcccatttccgagtgaagaaccttccccctccgaggaaccttttccatctgtccgtccctttccgtccgtggagctgtttcccagcgaagaaccctttccttcaaaagaaccttcaccctctgaagaaccatcagcgtcagaggagccttacacaccttctcctccagtaccatcttggacagagctgccctcgtcaggagaagagagtggagctcctgacgttagcggtgactttacaggatccggggatgtctccgggcatctggacttttctgggcagctgtcaggagacagggcttccgggttgcccagtggtgacttggattcctcaggcttgaccagcacagtgggttccgggctgcccgtcgagtcagggttgccttcaggcgacgaggaacgaatcgagtggcctagcacccccacagttggggagcttccaagcggcgctgagattctggagggcagtgccagcggcgtaggcgatctgtctgggctcccttctggcgaggtcctcgaaacctctgcttcaggtgtgggagatctaagtggcctaccaagtggagaagtgttggaaactactgctccaggagtggaagatatctctggcttgccgtcgggcgaagtgctggagaccacagcacctggggtggaggacatatccggactgccgagcggggaggttctggagactactgcacccggtgtggaagatatcagtggactgccttccggggaagtactggagacaaccgctccaggggtggaggatattagcggccttcctagcggtgaggtgctggagacaactgcgcctggcgtggaagatatcagcggtctgccctccggagaagtacttgagactgccgctcccggtgtcgaggacatttcagggcttccttcaggggaggtgctggagacagcagcaccaggagtcgaagatattagtgggctgccatctggggaggttttagaaacagccgcaccaggcgttgaggatatttcgggtctgcccagcggagaggtgctggaaactgctgcacctggagtagaggatatttccggcctgccctccggagaggtccttgaaactgccgcacctggcgtcgaagatatttctggtctccctagtggggaagtcctggagacagccgctcccggagtggaagacatttccggtctcccttctggcgaagttttggagactgccgcacccggagtcgaggacatttccggtctgcccagtggcgaggtccttgaaaccgctgccccaggcgtggaagatatctctgggctgccttctggagaggtgctggagactgccgctcccggagtagaagatatctccgggttgcccagcggcgaagtcctggagacggccgctcctggcgtcgaggatatttccggcctgccaagtggtgaggtgctcgagacagcagctcccggagtggaggatatcagtggccttccctcaggggaagtcctagagacgactgctccgggtgtggaggaaatatcgggcttaccctccggtgaggtattggaaactaccgccccaggcgtggacgagatttcaggactgcccagtggcgaggtgctggagactaccgcccctggtgttgaagaaatttctgggctccccagtggcgaggtgctcgagacatcaaccagtgcagtgggggacttgtcagggctcccgagcggtggagaagtgctcgagatatcagtctcgggcgtggaagatatcagcgggctccccagtggcgaggtggtcgagacctcagcgagtggcattgaagacgtgtctgaactgccaagtggggaaggcctggagacgtcagcgtccggcgtcgaagacctatcaagattgccttcaggggaagaagtgctagaaattagtgctagcggctttggagacttgtctggattgccttccggcggtgagggcctggagacctccgccagcgaggttggcaccgacctcagcggcctcccctcagggagagaggggctggaaacctcggcttcgggtgccgaggacctgagcggattgccgtccggcaaagaagatctcgtagggagcgctagcggcgacctggatttgggtaagctgccctctggaacccttgggtccggccaagcaccagagacctctggactgccctccggattctcaggcgagtactcaggcgttgatcttggctcaggacctcccagtggtctccccgacttttcaggcctgccgagtgggtttcctaccgtcagtttggtcgattcgacactggtggaggtggtcacagcatccacagcgagcgagttggaagggcgaggcaccatcggaatttctggcgctggagagatctctgggttgccgtccagtgagttggatatctcgggcagggcttccgggctcccatccggcactgagctgtctgggcaggcctccggctctccagatgtgagcggtgaaatcccagggttgttcggagtgtcaggtcagcctagcggtttcccagatacctctggtgaaacttcaggcgtgacagagctgtctgggctctccagcggccaacccggaattagcggagaagcttcaggcgtcctttatgggacttcccagccattcggaattacggatctgtcgggagaaacatcaggggtgccagacctgtccggccaaccttccgggctgccaggcttcagcggggctacgagtggggtgcctgatctggtatcaggcacaacctctggctccggggagagtagtgggattacctttgttgatacttccttagtggaagtagctcctaccaccttcaaagaggaggaggggctcggctctgtagagctgtccggcttacccagtggcgaagcagatcttagcggcaaatctggaatggtcgacgtaagtggtcagttctctgggactgtcgactcttctgggtttaccagccagactcctgaattctcgggcctcccttctggcatagccgaagtgtcaggggagtctagccgcgcagagatcggatcgtcccttccttccggcgcttattacggcagtggcaccccctcttcattccctacagtatccttagtggacagaacccttgtggagagcgtaactcaagcaccaaccgcccaggaggccggtgagggcccatccggcatcctggaattgagcggtgcacatagtggtgccccagatatgtccggggagcactccgggttcctagaccttagtgggctgcagtctggcctcatcgaaccaagcggtgaacctcctggtaccccctatttctccggggacttcgcctcaactactaacgtttccggcgaatctagtgtggccatgggtacctctggcgaagcatctggactccctgaagtgacacttatcaccagtgaatttgtggagggcgtgactgagcccacgatttctcaggaactgggccagagaccacctgtgacgcacacacctcagctcttcgagagcagcggaaaagtgtccaccgccggtgacatctctggcgctactccagtgttgcccggtagtggagtggaagtgagttctgttcctgagtcctcatccgagacttccgcctacccggaggccggattcggggcttcagctgccccagaagcttctcgggaggatagcggatcccccgacttaagcgagactacctcagctttccatgaagcaaacctggagcgctcttccggactgggtgtcagcggctctaccctcacctttcaggagggggaagcctcagccgctcctgaagtcagcggcgaatctacaaccacctccgatgtcggcaccgaagcaccaggcctcccaagtgcaacgcctaccgcctcaggtgacagaacagagatctctggggacctgtcaggccacactagccagctcggcgtggtgattagtacctctattcctgagagtgagtggacccagcaaacgcagcggccagctgagacccacctagaaatcgagtcctcaagccttctctattcaggggaagaaacccatacagttgagacggctaccagcccgacagatgccagcatcccggcttcgccggaatggaaaagggaatccgagagtacagcagcagctcccgcaagatcctgcgcagaagagccctgtggcgctgggacgtgtaaggaaaccgaagggcacgtgatttgtctctgtccgccaggttataccggtgagcactgcaacatcgatcaggaggtgtgcgaggagggctggaataaataccagggccattgttatagacacttcccggatcgcgagacatgggtagacgcggaacgcagatgtcgggagcagcagagtcacttgagctcaattgtgacgcccgaggagcaggagttcgtgaataataatgcccaggactaccaatggatcggactaaatgacaggacaattgaaggagattttagatggagcgacggacaccccatgcagttcgagaattggcggccaaaccaaccagataactttttcgccgcaggcgaagactgcgtggtgatgatctggcatgagaagggtgagtggaatgatgtgccatgtaactaccacctcccatttacatgcaagaaaggtactgttgcctgtggcgagcccccagtggtggagcacgctagaacttttggacagaaaaaggatcgctacgaaattaatagtttggtgaggtaccaatgcacagagggattcgttcaacggcacatgcccacgatccgatgtcagcccagtggccactgggaggaacctcagattacctgcacagatcccactacatacaaaaggcgactccagaagcggtccagcagacatccgaggcgttccaggccgagcaccgcccatta

SEQ ID NO: 213928 - DNA, 7296 bp, Artificial Sequence
  Description of Artificial Sequence: Synthetic coding sequence
atgacaacactcttgtgggtattcgtcacgctgagagtgattactgccgcagtgacggtcgagacctccgatcacgataactctttgtctgtatcaattccgcagccatcccccctaagggtgctgctcggtacttcattgacgataccctgttacttcattgatcctatgcaccccgtgactacagcgccatccaccgctccactggcgccaaggattaaatggtcccgcgtgtccaaagagaaggaggttgtactgttggtcgccacagagggtagggtgagggtgaacagcgcctatcaggacaaggtcagcttgccaaattaccccgctattccttcagatgcaacacttgaggtgcagtccctgagaagtaacgacagcggagtgtatcgatgcgaggtaatgcatgggattgaagacagcgaggccactcttgaggttgtggtcaagggcattgttttccactaccgcgctattagcacccgttataccctagatttcgaccgtgcccagcgggcatgccttcaaaacagcgcaattatcgccacccctgaacagctccaggcagcctatgaggacgggtttcaccagtgtgacgccggatggctcgcagaccaaaccgtgcgctatcctatccacactcccagagagggatgctacggggataaagacgagtttcccggagtgagaacttatggtatccgcgataccaacgagacctatgacgtgtactgcttcgctgaggagatggagggcgaggttttttatgcaacatctccagagaagttcactttccaggaggctgccaatgaatgtaggcggcttggggcacggctggctactaccggccaactgtacctcgcctggcaggctggcatggacatgtgttcagcaggatggctggctgaccggtcggtacggtaccctattagcaaagctcggcctaattgcggaggcaatctgctaggcgttaggaccgtctacgtgcacgctaatcagacgggatacccagatccctcatcacgatacgacgccatctgctatactggagaggacttcgtagacataccagagaattttttcggggtggggggagaggaggatattactgtacagacagtgacatggccagatatggagttgccgcttccccgtaacattaccgagggggaggcccgaggatctgtgattctgacagtaaaacccattttcgaagtgagccctagtccactggagcctgaggaaccatttacttttgccccagagattggagcaacggccttcgccgaagtggaaaatgaaacaggtgaagcaaccaggccatggggcttcccaactcccggtctgggtcctgccaccgcattcacgagcgaggacttggtggtccaggtgacagccgtcccgggacagccacacttaccaggaggcgtagtctttcactatcggcctggcccaactcgctacagcctgacgttcgaggaggctcagcaggcttgccttcgcactggcgctgtaatcgccagccctgaacagcttcaagcagcatatgaggctggctacgagcagtgtgacgctggctggttaagggatcagacagtgcgctaccctattgtaagcccacgcacaccatgcgtgggagataaagacagtagcccgggtgtaagaacctacggtgtgcgcccatccactgaaacgtatgatgtttattgttttgtcgatagattagaaggcgaggtgtttttcgccactcgtttggagcagttcactttccaagaggctctggagttttgcgaaagtcataatgcaaccctggcaactaccggccagctgtatgctgcatggtcaagggggctagataaatgttacgccggatggctggccgatggttcactgcgctatccgattgtcacacccaggccagcctgcggtggcgacaagcctggtgtccgtacagtatacctctacccaaaccaaactggtcttcctgaccctttgagtcggcaccacgctttctgcttccgcggtatcagtgcagtcccttcccctggcgaggaggagggcggtacacctacatctccttccggtgtggaagagtggatcgtgacccaggtcgtgccgggtgtggcagcggtgccagttgaggaagagactacggcagtgcccagcggtgaaacaaccgcgattctggagttcaccaccgaacccgaaaaccagaccgagtgggaacctgcatacacgccagtgggcacatctcccctacccggtattcttcccacatggccccctaccggcgctgctacggaggaaagtactgaagggcctagcgctactgaggttcctagtgccagtgaggagccatcccctagtgaagtgcctttcccgtcggaggaaccatccccttctgaggagcccttcccaagtgttcgcccattcccctccgtggagcttttcccaagcgaggaacctttcccctccaaagaaccctcaccatctgaggagccctcagctagcgaggagccgtacacaccctcgccccctgtgccatcctggacggaactcccaagttccggggaggagtctggtgctcccgatgtatcaggcgactttacagggtctggcgatgtttccgggcatctggacttttccgggcagttgtccggggaccgtgcctcgggtctcccgtcaggtgatctggactcctctggtctgacaagcacggtgggctcgggtcttcctgtggagtctggactgcccagtggcgacgaggagcgaatcgaatggccgagcaccccgactgtcggggaactgccatcaggagccgaaattctcgaaggatcggccagtggcgtgggagatctttccggtcttccatcaggagaggtgctggaaaccagtgcctccggggtgggcgacttgtccggcctgccgtcgggcgaagttctggagacgaccgcccctggagtagaggatatttcaggattgccgtccggggaggtgctggagactactgctccaggtgttgaagacatcagcggacttccaagtggagaggtgctggaaaccacagcacctggtgtggaggacatctccggcctgcccagtggcgaggtgctggagaccactgcccctggcgttgaagacatttccggcctcccctcaggcgaagtgttggaaaccaccgccccaggcgtggaggatattagtggattgcctagcggggaggtcctagagactaccgcccctggcgtagaggatatcagtggactgccctccggggaggtgctggaaaccgcagctcccggtgtagaggacatcagcggactgcccagtggagaagtgctagagacggccgctcctggcgtagaggatatttcaggactgccttcaggggaggtgctggagacagctgccccaggggtggaggatattagtggccttccgagtggtgaggtgctggaaacagccgcacctggagtcgaggacatctcaggtcttccctccggtgaggtgctcgagaccgctgccccaggagttgaagacatcagcggacttccgagtggtgaggttcttgagacagctgctcctggcgttgaggacatcagcggcctgccctcaggcgaggtactggagacagcggcacccggagtggaagatatctccgggctcccgagcggggaagtgctggaaacagccgcaccaggagttgaggacatctccgggctccctagcggagaggtcttggaaaccgctgctccaggtgtggaagacatcagcggcttaccaagcggcgaggtgctggaaacagccgctcctggggtggaagacattagtggactgccgtctggagaagttctcgagacagctgcccctggcgtcgaggatatctctggcctgccatcaggagaagtattagagaccgctgcaccgggtgtcgaagacattagtggcctgccttccggagaagtgttggagactgccgctcccggagtcgaggatatttctgggctgccaagtggcgaggtcctggagacggctgcaccaggggtggaagatatctccgggctcccatccggggaggtgctcgaaacggccgcacctggcgtagaagatattagcggtcttccaagcggtgaggtcctggagactgcagctccaggggttgaggacatctccggactcccgtccggcgaagtgcttgaaacgaccgcacctggagtggaagaaattagtggactgccttccggcgaggtgctggaaactacagcacctggcgtagatgagatctctggcctgcccagtggggaggtgcttgaaacaaccgctccaggtgtcgaggaaatatccggcctacctagcggggaagtcttggagacatctacttcagctgttggggaccttagtggtctgcccagcggcggagaggttcttgaaatttcggtgtcaggagtggaggatatcagtggtctgccatctggagaagtcgtggaaaccagtgctagcggtatagaggatgtctcggagttgccgagcggagagggcctggagacttccgcgtccggcgtagaggacctgtctcgactaccctcaggcgaggaggttctcgagattagtgccagtggttttggggatctcagcggcctgccctccggcggtgagggattagagacatcagcttcagaagtggggactgacttgtcgggcctgccctccggcagagaagggctcgagacttccgccagcggcgcagaggacctgtcaggcctgccatcaggtaaagaggatctagtgggtagcgcctccggagacttagacctgggcaagcttccctcagggactctaggttcggggcaggcgcctgagaccagcggattgcctagcggcttcagtggtgagtactctggagtggaccttggctctggccctccctcaggactcccagacttttctggattgccaagtggcttcccaaccgttagcctagtggattcaaccctggtggaggttgtgacggcttccacggccagcgaactcgaaggccgaggtacaatcggaatctctggtgctggcgagatttcaggactgcctagttccgaactcgacatctcaggacgggcaagcggtcttcctagtgggactgagctgtccggccaggcaagcggtagcccagatgtatccggcgaaatcccaggcctcttcggggtcagcggacagccatccggattccccgacacctcaggagaaaccagcggcgtgaccgaactgagtggcctctcttctgggcagccaggcatctctggggaagcttctggtgtgctgtatggaacctcacagccgtttggtattactgacctgtccggcgagacatctggcgtgcccgatctgagcggacagccaagtggactaccaggatttagcggggctacctccggcgtgcctgatctggtatcaggaaccaccagcgggtcgggagaatccagcggcatcaccttcgtggacacttccctagtcgaggtagcacctaccacatttaaggaggaggagggattaggctcggttgagctgtctggcctgccatctggcgaggccgatctctcgggcaagagcggcatggttgatgtttccggacaattcagcggaactgtggattcttctggcttcacatcccaaacacctgagttctcagggttgccatctggaatcgccgaggttagcggggaatcttcgcgggctgagataggctcctcgctgcccagcggggcatactacggctcagggacaccctcctcttttccgaccgtaagccttgtagatcggaccctcgttgaatctgtgacgcaggcaccaacagcccaggaggccggtgaagggccttcgggcatcttagaattgagcggggcacactcaggggctcctgacatgagcggagagcattcgggatttctggacctcagcgggctacagtcaggattgatcgaacctagcggcgaaccacctgggacaccctacttctccggggattttgccagtaccaccaacgtatctggtgaatcttccgttgccatggggacgtctggcgaggcctcaggacttcctgaggttactctgattacatccgaattcgtagagggcgtcacagaacccaccattagtcaggaattaggacagcggcctcccgttactcacactccccagctgttcgagagtagcggcaaggtgagtactgccggtgacatctccggcgcaaccccagttttgccgggaagcggggtggaggttagtagtgtgcccgaatcctcgagtgaaaccagtgcctatccggaggccggatttggggcatccgccgcacccgaggcatcgagagaggacagcggctctcccgacctgtctgaaactacttctgcctttcacgaggctaatctggagcgctcctccggcctcggagtctcaggttctacactgacattccaggagggcgaggcaagcgccgcaccagaagtgagcggagagtctaccacaacctctgacgtggggaccgaggctcccggtctccctagcgccaccccgaccgcatctggtgatcggactgagatttctggggacctctctggacacacctcccagcttggcgttgttatctctacctccatccctgagagtgagtggacgcaacaaactcagcgacccgctgaaacgcatcttgagatagagtcttcctcgctgctgtattcaggcgaggaaacccatactgtggagacagctaccagccctaccgatgcatctatcccggcatcccccgagtggaaacgtgaaagcgagagtacagcggcagaccaggaagtctgtgaggagggatggaacaagtaccaggggcattgttatcgacacttccccgaccgcgaaacctgggtggatgctgagcggcgttgcagagaacaacaatctcatctatcctctattgtgacccctgaagagcaggaattcgtaaacaataacgcccaggactatcaatggatcgggttaaatgacagaaccattgaaggggacttcaggtggtcggatggccacccaatgcaattcgaaaattggagacccaatcagccagataactttttcgccgcaggagaggactgcgtcgtgatgatctggcatgagaaaggcgaatggaatgacgtgccttgcaattatcacctccctttcacatgcaagaaggggaccgcgacgacctacaaacggcgtctacagaagcgctcttcacgccaccctagaaggtctaggccaagtaccgctcactaa

SEQ ID NO: 213929 - DNA, 7593 bp, Artificial Sequence
  Description of Artificial Sequence: Synthetic coding sequence
atgaccaccttgctttgggtgttcgtaactcttcgggtgattaccgcggcagttacagtggagacttcggaccatgataactccctctctgtatcgataccccaaccaagcccgctgcgggtgctacttggtacctctcttacaataccctgctacttcattgacccaatgcaccccgtgacgacggcaccttcaacggctcctctggccccaagaatcaagtggagtagggtctccaaggagaaagaagttgtgctgctggtcgctacagaaggacgcgtgcgcgtgaactctgcataccaggacaaggtgagtttgcccaactaccctgccatcccttctgacgcaactctagaggtgcagtcgctgcggagtaacgactcaggcgtgtaccgatgcgaagtgatgcacggaatagaggactctgaggctaccctggaggtggtcgtcaaaggcatagtgttccactacagggccatcagtactagatacacacttgattttgacagagcacagagagcttgtttacagaattccgctattatcgccacgcctgaacagctccaagccgcttacgaggacggttttcatcaatgtgacgccggatggctcgccgatcaaaccgtgcggtatccaattcatactccccgtgagggatgctacggggacaaggatgaatttcccggagtacgcacttatggaatcagagataccaatgagacttatgatgtgtactgctttgctgaagagatggagggagaggtgttctacgcaacttctccagagaaatttacatttcaggaagccgctaatgaatgcaggcggctgggggctaggctagccactacgggccagctgtatttagcctggcaggcaggaatggacatgtgttcggctggatggttagccgatcggagtgtgaggtaccctatttccaaggccaggcctaattgcggcggtaatctactaggggttcgaaccgtctatgtgcacgccaaccagactgggtatcccgatccttccagccggtacgacgccatctgctacaccggagaagattttgtcgacatcccagagaatttcttcggggtggggggagaagaggatatcactgtacagaccgtcacgtggcctgatatggagttgcctctgccacggaatatcaccgagggggaggccagaggttctgttatcctgactgtgaaaccaatctttgaggtgtctcccagccctttggagcccgaggaaccgtttactttcgcgcctgagataggcgcaaccgcttttgccgaggtggaaaatgaaaccggcgaagctactcggccatgggggttccccaccccgggtctgggtcccgctacggcatttacaagtgaagaccttgttgttcaagtgaccgccgtaccaggacagccacatctgcccggaggagtggtgtttcactacagaccaggacccacaagatacagtttaactttcgaagaagctcagcaggcctgcctgcgcaccggggcagtgatcgcaagtcccgaacagctgcaggctgcctacgaggctgggtatgagcagtgtgatgccggttggctacgcgatcagaccgtgcggtatcccatcgtatcccctcggacgccgtgcgtgggcgataaagattcatctccaggcgtgcgtacctatggagtcagaccctctactgagacttacgacgtctactgcttcgtcgatcgcctggagggagaggtgtttttcgcgactcgcctggagcaatttacattccaagaggctctagaattttgtgaaagccacaatgcaactctggcaaccactggccagctgtatgcagcctggagcaggggactcgataagtgttacgccggatggcttgcagacggatccttgcggtaccccatcgtgactcctcgcccagcctgtgggggagataagcctggcgtgagaacagtgtatctttaccccaatcagaccggcctacctgaccccctgtctaggcatcatgcgttctgcttccgaggcatttccgcagtgccttcacccggagaggaggagggtggtacacccacctccccaagtggtgtggaggaatggatcgtcacacaggttgtccctggagtggcagctgtgcccgtcgaagaggaaacgacagccgtgccttccggtgaaaccaccgcgatacttgaattcacaactgaacccgaaaaccagacagaatgggaaccagcatatacccctgtgggtacgtcacccctgccagggatcctgcctacctggccccctaccggagcggcaactgaggagagcactgaggggccatcagctactgaggtaccctcagcaagcgaggagcccagcccatctgaggtacccttcccatcagaagagcccagcccttcagaggagccctttccttctgtgagaccatttccctccgttgagctgtttccttccgaagaaccattcccgagcaaggagccatcgccatccgaagagcctagtgcttcagaggagccctacaccccctctccgcctgtgccatcttggactgaactgcctagctccggcgaggagtccggagcccctgacgtttcaggggactttacaggcagtggagatgtgtctggccatctcgatttttctggacaactatctggagaccgtgcaagcggtttgccatctggcgatctggattcaagcggtctgacctctaccgtgggcagtggacttcccgtcgaatctggattgcccagcggcgacgaagagcgcatcgagtggccctccacacctactgtcggcgaactaccttcgggcgctgagattctggaaggaagcgcctcaggtgtcggcgacttgagtgggctcccgtcaggtgaggttctggagacgtccgcttcgggcgtgggtgacctgtcaggccttccgagcggagaagtcctcgagaccaccgccccaggcgtcgaggacatttctgggctgccgtctggtgaagtgctcgagacaaccgccccaggcgtggaagatattagtggtttgcccagcggagaagtcctggagaccactgccccaggcgtagaggatatatcaggcctcccaagcggtgaggtgctggagacaacagcccctggagtcgaggacatctctggcctcccctctggcgaagttctggaaactacagctcccggtgtcgaggacatttccgggttgcccagtggcgaggtcctcgaaacaaccgcacctggagtggaagatatctctgggcttccaagcggtgaggtattggagacggctgctccaggggttgaagacatctccggactcccgagcggagaagttctcgaaacggccgcaccaggcgtggaggacatctctggcctgcctagcggagaagtgctggaaacagcagctcctggggtggaagacatcagtggtctgccgtcaggagaggtgctggagactgccgctcctggtgtggaggacattagcggattaccttccggagaagtactagagaccgccgcaccaggggtggaagacattagcggactgcccagtggggaagtgctggagaccgcggctcccggagtggaagacatctcaggccttccgtccggcgaagtgttggagacggctgcccctggcgtggaagacatttcaggcctcccctccggagaggtcctcgaaaccgctgctcctggggttgaagatattagtggcttgccatcaggtgaggtactggagactgccgctcctggggtcgaggatatctccgggcttccttctggtgaggtacttgagacagctgcacccggtgtcgaggacatctccgggcttccatcaggcgaagttctggagaccgcagctcccggtgtggaggatatcagtgggttgccttcgggtgaagttctggaaaccgccgctcccggagtggaggatatctctggcttgccgtctggggaagtcctggaaacagcagcaccaggggtggaagatatctccgggctcccctcaggcgaagttctggagacagctgcccctggcgtggaagatatctcaggtctgcctagcggagaggtcttggaaaccgccgcaccaggggttgaggacatttctggactgccatccggggaagtcctggagacagcggctccgggagttgaagatatcagtggtctgccttccggggaggtattggagacgaccgcaccgggtgtagaggaaatctcaggactgcccagcggggaagtgctcgaaaccaccgctcccggtgtcgacgaaataagcgggctgccgtctggcgaagtcctcgaaactaccgctccaggcgttgaagaaatctcagggctgccttcaggagaggtgttagaaacatcaacaagcgcagttggggacctgtccggcctccctagtgggggtgaggtgcttgagataagcgtgtctggagtggaagatatcagtggcctccctagcggcgaggtggtggagacttctgcatctgggatagaggatgtaagtgaattgccatctggcgaagggctggaaacgagcgcatcaggagtggaggacctgagccggctaccctctggagaggaagttttggagatttcggcatctggatttggcgacttaagcggcctgccaagcgggggagagggactggaaacatccgccagcgaggtcggaacagatctctctggcctgccctccggcagggaaggtctggagaccagcgcttccggcgctgaggatctgagtggattgccgagcggcaaggaagatcttgttggatctgctagcggggacctggaccttgggaagctgcccagcggtacactcggctctggccaggcccctgagacttctggcctgccgagtgggtttagtggcgagtactctggtgttgatctgggttctggccctccctctggcctgcccgacttttccgggctcccctcaggcttccccacagtgtcactcgtcgactcaaccttagtcgaggtggtcacagcgagtacggcatcagaactggagggacggggtacgattggtatcagcggcgcaggagaaatatccggattgccatcctccgaactcgatatcagtggacgggctagtggacttcctagtggcactgagttatccggccaggcttccggctctcccgatgtgagcggagagattcctggcctctttggagtatcgggccaaccatctggcttccctgacacgtccggagagacatccggtgtaacggagctctcgggactttcatcgggtcagccgggaatttccggcgaggcaagcggcgtattgtacggaacatcccagcctttcggaatcacagacctgagcggcgaaacaagtggtgtcccagacttaagtggacaaccaagcggattgccaggcttttcgggtgctactagcggagtgccagatctggtaagtggcaccactagcggcagtggagagagttctggaattacctttgtggatacatcgttggtggaggtggctcccacaacattcaaagaggaagaaggcctgggctcagtggagttgtcgggccttccgagcggcgaggccgacctttccggaaagtcaggaatggtggacgtgtcaggccaatttagtggcactgtcgacagctcgggcttcacatcgcagacccccgagttcagtgggttgccctccgggatcgcagaagtgtctggcgagtctagccgcgctgagatcggctcatccttgccttccggagcctattacggctccggcacacccagcagtttccccacggtttctctcgtggacaggacattggttgaaagcgttacacaagctcccactgcacaagaagctggcgaggggccatccggaattcttgagctgagcggcgctcacagcggcgcaccagacatgagcggcgaacattcaggcttcctggacttgtccgggttacagtctgggcttatagaaccctccggggagccaccgggaacaccgtatttctccggagattttgcttctacaacaaacgtcagcggagagtcctccgtcgctatggggacctcaggcgaggcctctggcctacctgaagttacacttatcacctctgagtttgtggagggcgtgactgaaccgaccatctcgcaggaactcggacagcggcctccagtgacccacactccgcagctgttcgagtccagcggtaaggtatctaccgccggagacatcagcggagcaactcctgtactcccgggatcaggtgtggaggtgtcatcagtgcccgagagctcaagcgaaacaagtgcttacccagaggcaggcttcggagccagcgcggcacccgaagcgagccgcgaagactctggttcgccagacctctctgaaacaacctccgccttccatgaggcgaacttggaacggtcctctgggttgggcgtgtcgggaagcaccctgacttttcaggaaggggaggcatctgctgctcccgaagtgagtggggagtccacaacgacctccgatgtcggcacagaagccccaggactgccctcagctacacccactgcatcgggcgaccggacagagatttcgggcgacctaagtggtcacacctcacagttgggagttgttatctctacctcaattcctgaatctgagtggacccagcagactcagcgaccagcagaaacgcatctggaaattgagtccagtagccttttgtactcaggagaggagacccataccgttgaaacagccactagcccaacggatgcatctatccccgcaagcccggaatggaagagagaaagtgagtctacggcagcagcacctgcccgtagctgcgccgaagaaccttgcggggcagggacctgcaaagagacagagggccacgtgatttgtttatgccccccaggctacactggcgaacactgcaacattgaccaagaagtgtgcgaggaaggatggaacaagtatcaagggcattgttaccggcattttccagacagggagacatgggtcgatgcagagaggcgatgccgtgaacaacagagccatttgtcatcgatcgtcaccccagaagagcaggagttcgttaacaataatgcccaggactaccaatggatcggcttgaatgaccgtacaatagaaggagatttcaggtggtctgatggtcaccccatgcagttcgagaactggcgacctaaccaacccgacaatttctttgccgctggagaagactgcgttgttatgatctggcacgaaaaaggggagtggaacgacgttccttgcaattaccacctgcccttcacctgtaagaaaggcaccgtggcatgtggtgagccgcctgtcgttgaacatgcaaggaccttcggccaaaaaaaggatcgctatgaaattaattccctggttcggtatcagtgcacggagggcttcgtccagcgtcatatgccaacaataagatgccaaccatccggtcactgggaggagccacagattacctgtaccgaccctactacttataaacgtcggctgcagaaacggtcttcacggcacccgagacgcagcagaccctcgacagcccactag

SEQ ID NO: 213930 - DNA, 7479 bp, Artificial Sequence
  Description of Artificial Sequence: Synthetic coding sequence
atgaccacgctgctttgggtgtttgtgacgctgagagtgatcacagccgctgtgactgtagaaacttccgatcacgacaacagcctgagcgtgagtatcccacagccatcccccttaagagtgctccttggcacttcactgactattccatgctactttattgatcctatgcatcccgtgaccactgcaccttccacagctccgctcgcacccaggattaaatggagccgcgtctccaaagagaaggaggtagtcctgttggttgccacagaaggccgtgtaagagtaaactctgcttaccaggataaggtttcactgcctaattatcctgctattccttcagatgcaacactcgaggttcagtctcttcgtagcaatgatagcggtgtgtatcgctgcgaagtcatgcatgggatagaagattcagaggcgaccctcgaggtggtggtgaaaggaatcgtcttccattaccgtgctatctctacgcgatacacacttgattttgaccgcgcacagagggcctgtctacagaactcagctattattgcgacccccgagcagctgcaggcagcgtatgaagacgggttccaccagtgtgatgcgggttggctagccgatcaaacggtcaggtacccaatccataccccaagggaaggctgttacggtgataaagatgagttcccaggcgtgcgcacctatggtatcagagacacaaatgaaacatacgacgtttactgctttgctgaggaaatggagggagaagtgttttacgcgacgtcgcctgaaaagttcactttccaagaagcggcaaacgaatgtagaaggctcggcgcacggctggcgacaactggccagctttatctggcttggcaggccggaatggatatgtgctctgcagggtggctggcggaccgctccgtccggtaccctatctccaaggcaagacccaactgtggcggaaatttgcttggcgtccgcacggtgtatgtgcacgccaatcagaccggttatccagaccccagctctagatacgacgccatttgttataccggggaagattttgtcgatattcccgagaatttctttggtgtcggcggagaggaggatatcactgtccagaccgtgacctggcccgacatggaattgcctctgccgagaaacatcacagagggtgaggcaaggggctcagtgatactgaccgtgaagcccatattcgaggtgagccccagcccactggaacccgaggagccatttacctttgcgcctgagattggagccaccgccttcgctgaagtcgaaaatgagactggtgaggctaccagaccgtggggcttcccaactcctggcctaggtcccgcaaccgctttcacctctgaggatctcgtagtgcaggtaacggcagtgcccggacagccacatctacctggcggagttgtcttccactataggcccggaccgacgcggtacagtcttaccttcgaggaagcccagcaggcctgcctgcggaccggcgctgtcatcgcctccccggaacaactgcaggctgcatacgaggccggttatgagcaatgcgacgcagggtggctgcgcgaccaaacggtaagatacccgatcgtctccccacgaactccctgtgtgggtgataaagattcaagtcccggagtgcggacttatggtgtgagaccctctactgaaacctatgatgtatactgcttcgttgatcgcctggagggcgaggtctttttcgccaccagattagagcagtttaccttccaggaagctctagaattttgcgagtcgcacaacgcgactctcgccaccacaggtcagctctatgccgcttggagtcgcggacttgacaagtgctacgccggttggctcgccgacggctccttacgctatcctatagttaccccacggcctgcttgtggtggggataaaccaggtgtgcggacagtctatctctatcctaaccaaactggtctccccgatcccctcagcaggcaccatgctttctgcttccgtggtatcagcgcggtgccgtctcccggagaagaggaaggcggaactccgaccagtcctagcggtgttgaggagtggattgtaactcaggtagtgccaggagtcgccgctgtccccgtcgaggaagagactaccgctgtgccaagtggcgaaactactgctattttggaattcaccaccgaaccagaaaatcagacagaatgggaacctgcctatacaccagtgggtacatctcccttgccgggtatcctcccaacttggcctcccacaggcgcagccactgaagagtcaactgagggcccatctgcaactgaggttccctctgccagcgaggagccatccccctctgaagtgcctttcccctcggaggaaccatcaccctcggaggagccgttcccatcagtacgtccattcccctcagtggagctcttccctagcgaagaaccttttccaagcaaggagccctcccctagcgaagagccttccgcatccgaagagccttacaccccctccccccctgtgccctcttggactgagctgccttcttcaggagaagaaagtggtgcacccgatgtatccggcgactttaccggcagcggcgacgtctcaggccacttggactttagtggtcagttgagcggcgaccgagcctccggcctgccaagcggcgatttggacagcagcggtctgacttcaactgtaggctccgggttgccggtggaaagtggactgccttcaggcgatgaagagcgcatcgagtggcctagcacccccacagtgggtgaattgccctccggggctgaaatccttgaaggttccgcatcaggtgttggtgatctgtctggcttgccctccggagaggtgttagaaacaagtgccagtggcgttggcgatttgtcggggctcccctctggtgaggtgctcgagacaacagcaccaggcgtggaggatatttccggcttgcccagcggagaagttctggaaactacagcccctggagtcgaagacatctccggcctacccagtggcgaagtgctggaaaccacggccccaggggtggaggacattagcggtctgcccagtggagaggttctggaaaccaccgcaccaggcgtagaggatatcagtggtcttcctagcggcgaggtgctcgaaactaccgcaccgggtgttgaggacatttcagggctcccttctggggaagtactggaaacgacagcccctggagtggaggacatttccggcctgccatctggggaggttctggagacagctgcccctggcgtggaggacatatcaggccttccgagcggtgaggtcctagagaccgcggcacccggagtagaagacatctcaggactacccagtggtgaagtgctggaaactgctgcaccaggagtggaggatatatcaggcttgcccagcggtgaggtgctggaaaccgccgcacccggtgtcgaggacatctcagggttgccctccggtgaggtgctcgagacagctgctcccggtgtggaagacatcagcgggctcccctctggggaggtactcgaaacagctgccccaggagtggaggacatcagtgggctgcctagcggagaagtgctggaaaccgctgctcctggcgtggaggacatatcaggcctaccctctggggaagtgttagagaccgccgcaccgggagtggaagatatctctggcctgcctagcggtgaggtgctcgagaccgctgccccaggtgtcgaggacatctcggggcttcccagtggggaggtgctcgaaacggctgcgccaggggttgaagacataagtgggttgccgtctggcgaggtcctggagactgccgctccaggcgtggaggacataagcggcctcccctccggggaggtgctggagacggcagcacccggtgtagaggacatcagcggcctgccgagcggagaggtgctcgaaaccgccgctcccggtgtggaagacatttccggactacctagcggggaagtcttagaaaccgcagctcccggagtggaagacatatctggattgccctctggcgaggtcctggaaacggcagcaccgggagttgaggacatttccggcctgccttccggagaagttctggagacggcagctccaggagtggaagacatcagtggtctgccttccggggaagttctggaaacaactgctcctggagttgaagaaatcagtggactacccagtggagaagtgctggagaccacagcgccaggagtggatgaaatatcaggcctgccaagtggcgaggtgctggagactaccgctcccggtgtagaggagattagtggactgccctccggagaagtgctggaaacatctacatctgccgtgggggatctgtccggtctcccgtccggaggagaggttctggagattagcgtcagtggggtggaagacatcagcggcctgccaagcggggaagttgtcgaaacatccgcaagtgggattgaggacgtctctgagctgccttcaggtgagggcctcgagacgtcggcatcaggggtggaagacctttcccggttgcctagtggagaggaggtgctggagatatccgcatccggctttggtgacctcagtggactgccttctgggggagaggggctggagacctcagcctctgaagtcggaactgacctatccggactgccatccggcagagaagggctggaaacgagcgcgtctggtgccgaggatttgtccggactaccatccggtaaagaagacctggtgggcagcgcgagcggggacttagatctcggcaagctgccatccggtacgcttgggtctgggcaggccccagaaacctcagggctgccatccggcttctcaggagaatactccggcgttgatttaggttctgggcctccttcaggtttaccagatttcagcggacttcccagcggattccccaccgtatcattggtggattcaaccctagtggaagtggtcacagcaagtaccgcttcagagctggaaggcaggggaaccattggcatctccggtgcgggtgaaatttccgggctaccctcaagcgaacttgatatttcggggcgagccagcggactgccgagcggcacagagctcagtgggcaagcgagcggctccccggatgtgtcaggggagatcccgggtctcttcggcgtcagcggtcaacctagcggttttccggacacttccggggagactagtggggtcactgaactctctggactttcctcagggcagcccggaatcagcggggaggcgtcaggcgtgctatacggcaccagccagccattcggaattaccgatctctcaggtgagacgagtggggtaccagatttatccgggcagccctcaggactaccgggtttttcaggggcaacaagtggagtgcctgatttggtctctgggaccactagcggatccggcgagtcaagcggaattacatttgttgacacatcccttgtggaggtggcccctacgacgtttaaggaagaagaagggctgggttcggtagaacttagcggcctcccttctggagaggctgatttatcagggaaatcaggcatggtggacgtttccgggcagttctcgggcactgtggattcctccgggttcaccagccagaccccagaattcagcggattaccttccggtatcgcggaagtgagcggtgaaagctctcgagccgagattggctctagcttaccaagtggggcttactacggctctgggacaccatcatccttccccactgtaagcctcgtggaccgcaccctggtcgaatctgtgacacaggctccaaccgcccaagaggcaggtgaaggaccttctggcattctagagctcagcggcgcacactccggcgcacccgacatgtcaggtgaacactccggctttctcgacctgagcggtctacaaagtggattaatcgagccatctggggaaccacccggtactccatatttttcaggcgacttcgcttccacaaccaacgtgtctggtgagtctagcgtggcaatggggacctcgggagaagcgagtggcctcccagaagtcaccttgataacctcagagttcgtggagggagtcaccgaacctacaatctcgcaagaacttggccagcgacccccagttacacatacgcctcagcttttcgagagctcaggcaaggtgtctaccgccggtgatattagtggggcaactcccgtgctgccaggctcgggtgtcgaagtgtctagcgtgcccgaatcttctagtgaaacatccgcctatccagaagccggattcggtgcttcagctgcaccagaggctagtagagaagacagcggttcccctgacctgagcgagacaacctccgccttccatgaagctaaccttgaacgcagttctggtctcggggtgagtgggtctaccttaacctttcaggaaggagaagcgtccgccgctccggaagtgtcaggcgagagcactactacctctgatgtgggcactgaggcccctggactccccagcgctactccaacggctagcggagaccggactgaaatcagcggcgacctctctggccacaccagtcagctgggcgtggtgattagtacatcaatccccgagtccgaatggactcagcagacccagcgcccagccgagacccacttggaaatagagagctcttcactgctctattccggggaggagactcatacagttgagaccgcaacatctcccaccgatgcttccatccccgcttcccccgaatggaagagagaaagcgaatctaccgcggcagatcaggaggtctgcgaagagggctggaataaataccagggccattgttataggcatttccccgaccgggaaacatgggtggatgcagaaaggcggtgtcgagaacaacagagccacctctcttccattgttacgcctgaggagcaggagtttgttaacaacaacgctcaggattaccagtggattggactgaatgatagaacaattgagggcgatttcagatggagcgatgggcatccaatgcagttcgaaaattggaggcccaaccagcccgacaattttttcgctgctggtgaggactgcgtcgttatgatatggcatgagaaaggggaatggaacgatgtcccttgcaattaccaccttcctttcacatgcaagaagggcaccgtcgcctgcggtgaacctcctgtcgtggaacacgccaggacctttggtcagaaaaaagataggtatgaaatcaattccctggttcggtatcaatgcactgaagggtttgtgcaaagacatatgcccactatccgatgccagccttccggccactgggaagagccccaaatcacttgcacagatccgaccacctataaaaggcgcctgcaaaaacgcagctcaaggcaccctcgccgttcaagaccctcaacagctcattag

SEQ ID NO: 213931 - DNA, 7593 bp, Artificial Sequence
  Description of Artificial Sequence: Synthetic coding sequence
atgaccaccttgctatgggtgtttgtgacactcagagttattacagccgcagtgaccgttgagactagtgaccacgataacagcctctctgtctcgattcctcaacctagtcccctacgtgtactgctgggtaccagccttacaattccctgttattttatagacccaatgcatcccgtgacaaccgcaccctctacagcccctctggcacctagaataaaatggagccgcgtttctaaggagaaggaagttgtacttctggtggccactgaggggagagttcgcgtgaattccgcctatcaggataaggtaagcctccccaattaccccgctatcccatcagacgcgaccctggaagtgcagagtctaaggagcaacgacagcggcgtgtacaggtgtgaggtgatgcatggcattgaagactcagaagcaaccctggaggtagtcgtgaaggggatagtgtttcattatagagcaatcagcacacggtacacactcgacttcgaccgggcacaacgcgcatgtcttcagaattccgccatcatcgctaccccagagcagttgcaggctgcctacgaagatggcttccatcagtgcgacgcgggttggctcgccgatcagaccgtgcggtatccaattcacacacctcgggagggttgttacggagacaaggacgaattcccaggggtcaggacgtacggaattagagacacgaatgagacgtacgacgtgtattgctttgccgaagagatggagggggaggtgttctacgccacatcacctgagaagttcacttttcaagaagccgctaacgagtgccggagactgggtgccagactggcaactaccgggcaactgtacctagcatggcaggctggcatggatatgtgttccgcaggttggttggctgacagaagtgtccgctaccccatcagcaaggccagacctaactgcggcggtaatcttctgggggtgcgcactgtgtatgtgcacgcaaaccagacaggatatccggatccatcttcacgatacgacgctatctgttacactggtgaagattttgtggatattccggaaaatttctttggagtcgggggtgaggaggacataacagtacagacagtgacatggcctgacatggagctgcctctgccacgaaatattacggaaggagaagcgcgtggcagcgtcatactgacggtgaagccaatcttcgaggtttctccgtccccgctggagcctgaggagcccttcacctttgcgcctgagatcggcgcaacggcctttgccgaggtggagaacgagacaggtgaggctactcgaccatggggatttccgacccctgggcttggtcctgccaccgcttttacctccgaggatcttgtcgtccaggtgaccgctgtgccaggtcagcctcatctgccaggcggtgtcgtgttccattaccgcccaggcccaactaggtacagcctcacatttgaggaagcgcaacaggcttgccttcgcacaggggcagtgatcgctagccctgaacagctccaggcagcctatgaagccggatatgaacagtgcgacgcaggctggctcagggatcagaccgtacgttatccaatagtgagccccagaacgccttgcgtcggcgacaaggattcttcaccaggggtgcgaacctacggagtccgccctagcacggagacgtatgacgtgtattgttttgtggaccgacttgaaggtgaggtttttttcgctaccaggcttgagcagtttacattccaggaagctctagagttttgtgaaagtcacaacgcgaccctagctacaactggccagctgtacgcggcttggagcaggggattggacaaatgctatgcgggatggctcgccgatggctctctgcggtaccccatcgtcaccccacgccctgcgtgtggaggtgacaagcctggggtgcggaccgtttatctctatcctaaccagacaggtttaccagaccctcttagcagacatcacgcattctgcttccgaggcatctctgctgtgccatcacccggtgaagaggagggcggtacccctacctccccctcaggtgtagaggagtggatcgtgactcaggtggtcccaggcgtcgccgcagtccctgtggaagaggagactaccgctgtgccatccggggagactacagcgattctcgaattcaccacagagccagaaaaccaaacagaatgggaacctgcatacacccctgttggcacgagccccttacccggtatccttccaacatggccacccacaggggctgctactgaggagtccacagagggccctagtgcaaccgaagtgccttccgccagcgaagagccatccccctcagaggtgccgttccccagcgaggagcccagcccaagcgaagagcctttcccaagcgtgcggcctttcccttccgttgaactcttcccgtctgaagagcctttcccctcaaaagagccttccccttcggaagaaccttccgcttctgaggagccctatactccttctcctcccgttccaagttggacagaattgccctctagcggggaggaatctggtgcaccagacgtcagcggcgactttactgggtccggagacgtcagtggccatctagacttctccgggcagctttcaggtgacagggctagtggactcccctcgggagaccttgacagttccggccttaccagtaccgtggggtcagggctgccggtggagtctgggctccccagcggtgatgaggaaaggattgagtggcctagcactcccacagttggagagctgccatctggagcggagattctggaagggagtgcgtctggcgtgggtgatctttccgggcttccatctggagaggttctagagacctccgcctccggggttggtgatctgtcaggattgccttcaggcgaggtattggaaactaccgcacccggagttgaggacatctcaggcctgccatcgggagaggtcctggagacaaccgcccctggagtggaggatatttccgggctcccctctggcgaggtactggaaacaaccgcaccaggcgttgaggacattagtggactgccctcgggcgaagtgctggagactacagctcctggagtagaggatatcagcggactgccgagcggagaggtgctagagaccacagctccaggcgtagaggatattagcgggcttccaagcggcgaggtcctggagacaactgcccctggagtagaggatatcagtggtctcccatctggggaagtgttagaaacagccgctcctggcgtggaagacatttctggccttcccagcggggaagtattggagacggctgctcccggtgtggaggacatctccgggcttccatctggtgaggttctagaaaccgccgctcctggggtggaggacataagcggccttccgagcggcgaagtgttggaaaccgctgcccctggggttgaggatatcagcggccttcccagtggagaagttctagagaccgcggctcccggagtggaggacatcagcggtctgcctagtggagaggtgctcgagaccgcagcgccaggcgtggaggacattagtggcttgccaagcggagaagtgctggaaaccgccgctccaggggtggaggacatctccggcctgcccagtggggaggtattagagacagcagcccctggggtggaagatatctctgggttgccttcgggagaggttctggagactgccgctccaggggttgaggatatcagcggacttcccagcggagaagtcctggagactgcagctcctggagtggaagatatctcgggactgcccagcggagaggtgttggagaccgcagccccaggtgtcgaagacattagcggtttgccctccggtgaggtgctggagacggctgctccaggtgtcgaggatatctccggtctgccgagcggggaggtactggagacagccgctcctggagtggaagacatttctggactcccatccggggaagtattagaaacggcagctccaggggtggaagacattagcggacttccaagtggggaagtacttgagacggcagcgcctggcgttgaagacatttcaggcctcccttccggtgaagtgctcgaaaccgctgcccctggtgttgaggacatctctggccttcctagcggggaggtgctcgaaactaccgcacccggtgtggaagagatatcagggctccccagtggagaggtgctggagactaccgcgcctggagtggacgaaattagcggtctgcctagtggggaggtcctggagaccacagctcccggtgtcgaggagatatccggtctgcctagtggggaggtgctggaaacctctacctcagccgtaggcgacttaagcgggcttcctagcggtggggaagtgctggagattagcgtgtccggtgtcgaggatatttccgggttaccgtccggcgaggtggtagagaccagtgcctcagggatagaggacgtgagtgaactgccctcaggcgagggcctggagacttcagcatccggcgtggaggatttgtcacggcttcccagtggagaggaggtgctggaaatctcagcctctggctttggggatctctccggcctaccctcaggcggagaaggcttggagacgagcgcctcggaagtgggaacagacttatcaggcctgccgtccggtcgggaaggtctcgagacctccgcctcaggggctgaagacctcagtggcctgccatcaggcaaagaagatctggttggcagcgcctccggagatcttgatctgggaaagttaccatcggggactctggggagtggccaggccccagaaaccagcggcctcccatcaggcttctctggcgagtattctggcgtagatctcgggagcgggcctccctcagggttgccagattttagtggcttgcccagtgggtttcccacagtcagcctggtcgacagtacactcgtcgaggtcgtgactgcctctacagcctccgagttggaggggaggggtacgattggtatttctggagcaggagaaatctctgggctgccatcctcagagctcgacatttccggacgtgcgtccggtctcccctccgggacagagctgagtggccaagcaagcggcagtcctgacgttagtggagagatccccggactgttcggcgtcagtggccagccgtccggctttccggacacgagcggagagacctccggcgttactgaactctccggcctgagcagtgggcaaccgggtattagcggcgaagcatctggggtgctttacggcacaagccaaccatttggtatcaccgatttgagcggagagactagcggtgtccctgatctgtcagggcagcccagtggtttacctgggttttctggagccacaagcggcgtccccgatctggtgagtggtacaactagtgggagtggtgaatcaagtggtattacttttgtggacacctctttagtggaagtggcccctactacatttaaggaagaagaaggcctgggaagtgtggagctcagtggactgcccagcggagaggctgacctttccgggaagtcaggcatggtggatgtttcaggccagttctctggcaccgtggactcctctggatttaccagtcagactccagagttttcaggtttaccctctggcatagctgaggtttctggagagtcctctcgagccgagattgggagttcattaccttccggagcctattacggaagtggtaccccttcatcctttcctactgtgagcctggtagataggaccctggtggagtctgtgacccaggcccctacggcacaggaagccggtgagggaccctcgggcattctggaactctcgggcgctcacagtggggcaccagacatgtcaggcgaacattctggatttctggacttgagcggccttcagtccggtttaattgagccctccggggagccacctggtaccccctattttagtggggatttcgcgagcacgacgaatgtctccggcgagtcttcagtagctatggggaccagtggtgaggccagcggcctcccggaggtaaccctgattacatctgaatttgtggagggggtgacagaaccaacaatcagccaggaactgggccagcgccctccagtcacccacacgccacagcttttcgaatcatctggcaaggtctccaccgccggagacatttctggtgctactccagttctgcctggcagcggcgttgaggtgtcttccgtgcccgagtcctctagcgaaaccagcgcatacccagaagctggtttcggcgcttcagcagccccagaggcaagccgggaagacagcggcagcccagatctgtcagagacgactagcgcttttcacgaggccaacctagagcggagctccggactgggagtgtctggttcaacccttacttttcaggaaggcgaagctagtgccgcacctgaagtatctggggagagcacaactacttccgatgtggggacggaggctccgggactgcccagcgctactccgactgcctccggggacagaactgaaatctccggcgaccttagcggccatacaagccaactcggcgtcgtcatctcaacgagcattcctgagtcggagtggacgcagcagactcaacgtcctgcagaaactcatctcgagatcgagagcagctcattgctttactcaggcgaagagacccacacagtcgagaccgccacgtcaccaaccgatgcgtccattcctgcttcacccgaatggaaacgggaatcagagtcaaccgccgcagcccctgcacgctcgtgcgcggaagagccatgcggggctggaacttgtaaagaaacggagggacatgtgatttgcctgtgcccccctggatatacaggagaacactgtaacatcgatcaggaggtctgtgaagagggctggaacaagtaccaggggcactgttacaggcattttccagatcgcgagacctgggtagacgcagagaggcgctgcagagagcagcaaagccatctgtcctctattgtgactcctgaagaacaggagttcgtgaataacaatgcacaggattaccagtggatcggcctgaacgacagaactatcgaaggggactttcgttggagtgacggccatccgatgcagttcgagaattggaggccaaatcagcccgataacttttttgcggcaggagaggattgcgtggtgatgatttggcacgaaaaaggagaatggaacgatgttccatgtaactaccatttacccttcacctgtaagaaagggactgttgcctgtggcgagccacctgtcgttgagcatgcgcgaacctttggtcagaaaaaagatagatatgagataaactccctcgtgcgataccaatgcactgaagggtttgtacaaaggcatatgcccaccatacgatgtcagccaagtgggcactgggaggagcctcaaatcacatgcacagaccctacaacctataaaagaagattgcagaaaagatcatctagacaccccaggcgctctagacctagcaccgcccactat

SEQ ID NO: 213932 - DNA, 399 bp, Artificial Sequence
  Description of Artificial Sequence: Synthetic coding sequence
atgctgaccgccgctgtactcagttgcgcgttgctgttggccctgcctgccacccgtggcgcacaaatggggctggcccctatggaaggaattagaaggcccgaccaagctctgctgcctgaacttccgggactaggtctgcgggctcctctgaagaagactacagctgagcaggccgaagaggacctgctgcaggaagcccaggccttagcagaggtccttgacctgcaggaccgggagcccaggtcttccagaagatgcgtgcgcctgcatgagagctgcctgggacaacaggtcccctgctgcgatccctgcgcaacctgctattgtagattctttaatgccttctgctattgtcggaaactggggacagctatgaatccctgtagccgaacatag

SEQ ID NO: 213933 - DNA, 399 bp, Artificial Sequence
  Description of Artificial Sequence: Synthetic coding sequence
atggatgttactcgcctgctgctggctactctgttggtcttcctgtgcttcttcacagcaaactcccacctaccacccgaggaaaagttaagggacgatcgcagcctccgttcaaatagttccgtgaaccttctcgatgtgcctagcgtttctatcgtggctcttaacaaaaagtctaagcagattggcaggaaggccgctgagaaaaagcggtcctccaagaaagaggcgagcatgaaaaaggtggtgcggccaagaacgcccttgtctgccccttgtgtggcgactcgaaatagttgcaagccaccagccccagcctgttgcgatccatgcgctagttgccagtgtcgattctttagatctgcatgcagctgtcgagtactgtcccttaattgttag

SEQ ID NO: 213934 - DNA, 936 bp, Artificial Sequence
  Description of Artificial Sequence: Synthetic coding sequence
atggcactggaagtggtgtttctggccagaggaccaagtggtctgttgctgtataatgggcagaagaccgacggcaaaggcgactttgtgtcgctggccctccgcgatcgcaggcttgagttccgatacgaccttgggaaaggcgctgccgtcatcagaagtcgcgaaccggtaaccctgggtgcgtggacccgggtcagcctcgaaaggaatggacgaaagggtgctctgagagtgggagacggcccacgagttctcggcgaatccccgaagtcaagaaaagtgccccacaccgtgctgaacctcaaggagccactgtatgttgggggagcccctgacttttcaaaactggccagggccgctgccgtgtcttcaggatttgatggagccatccaactagtatcactcggaggccgacagctgctgacgcctgagcatgtgctgaggcaggtggacgttacctctttcgccggacatccttgcactcgggcatcggggcacccatgcctcaacggcgcttcctgtgtgccccgagaagccgcatacgtctgcctctgtcccggtggcttctcgggtccgcattgcgaaaagggacttgtcgagaagtctgctggcgacgtggacacgctcgccttcgacggtcgtaccttcgttgagtatcttaacgcagtcacagaaagcgagttggctaacgagatccccgtgccggagacccttgatagtggtgcattacactccgagaaggccctgcagagcaatcactttgagctgtcactgcgcaccgaggccactcagggcttagtgctctggtcagggaaagccaccgagagggccgattacgtggcactcgcgatagtcgatggacatctgcagctttcatataacctgggatcccagcccgtagtactccggtcaactgtgcccgttaatacctag

SEQ ID NO: 213935 - DNA, 6137 bp, Artificial Sequence
  Description of Artificial Sequence: Synthetic coding sequence
atggcaggaaggagtcatccgggtcctcttcgaccactcttacccctgctggttgtggctgcctgtgtcctccctggagcaggagggacctgccccgaacgggctctcgagcggagagaagaggaggccaatgtagtgctgaccggcaccgtggaagagatacttaatgttgatcctgttcagcatacctactcatgtaaagtgcgtgtctggaggtacctgaaaggcaaggacctcgtagccagggaatcattgctggacggcggaaataaggtcgtgataagtggatttggcgatcctttgatttgcgacaatcaagtgtcaactggggacacgcggattttctttgtaaacccagctccgccatatctctggcccgctcacaagaacgagctgatgttgaacagctccctgatgcgcatcacactgagaaacctggaggaggtcgagttttgcgtggaagacaagccgggaactcacttcacaccagtccccccaacgcccccagatgcctgtcgcggtatgctgtgcggattcggcgctgtctgtgagccaaatgctgaaggccctggacgggcttcctgcgtgtgcaagaagagtccctgtccttcggtagtggctcctgtctgcgggagtgacgcctctacttattcgaatgaatgcgaattgcagcgggcacagtgtagccagcagaggaggattaggctactgtctaggggtccctgcgggagtcgggatccatgttccaatgtaacttgttcatttggctcaacctgcgcgaggtcagcggacggtttaacagccagctgcctgtgcccagcgacctgtaggggagcccctgaaggaaccgtctgcgggtcagacggagcggattaccctggcgagtgccagctccttagacgcgcttgtgcacgtcaagagaatgtgtttaaaaaattcgatggtccttgcgacccctgccagggtgctctgcccgatccctctagaagttgccgagtcaatcccaggacacggagaccagagatgctgctgcgaccagaaagctgccctgccaggcaggccccagtgtgtggggatgatggtgtgacctacgagaacgattgtgtgatgggacgctccggcgcagcgcgaggactccttttgcaaaaggttcggtctggacaatgtcaagggagagatcagtgcccagagccgtgcaggtttaacgccgtctgcctgagccggagagggaggcctcggtgctcttgcgatcgcgtgacctgcgacggcgcataccgccctgtgtgtgcacaggacggcaggacctatgattccgactgttggcggcagcaagctgaatgtcggcagcagagagctattccctcaaagcaccagggtccttgtgaccaggcccctagtccttgtctgggagtgcagtgtgccttcggtgctacctgtgcagtaaagaacggccaggccgcatgtgaatgtctgcaggcttgctctagtctgtacgatccagtctgcggctctgacggagtaacctacgggtccgcttgcgagcttgaggcaaccgcctgtaccttgggccgtgaaattcaggtcgccaggaaagggccttgtgatcgctgtgggcagtgtcgctttggggctctgtgcgaagcggaaacgggcaggtgtgtttgtccttcagaatgtgtggctctcgcccaacccgtatgtggtagcgacggccatacctatccatctgagtgcatgctgcatgtgcacgcctgcacacaccagatcagtctgcatgttgcctctgctggtccttgcgagacctgtggcgacgcggtttgcgcctttggggcagtgtgctcggcaggtcagtgcgtgtgccccagatgcgaacaccctccaccgggtcctgtttgtgggagcgatggcgtaacatatgggtccgcctgcgaactgcgggaagccgcttgtctccagcagacccagatagaagaagcccgtgcgggaccctgcgaacaggctgagtgtggcagtggcggaagtggttcgggtgaggacggggactgtgagcaggaattatgtcgccagaggggcggaatctgggacgaagattctgaggacggaccttgtgtctgtgatttttcttgtcaaagcgtgcccggatcgcccgtatgcggcagcgatggagtcacctacagcaccgaatgcgagctaaaaaaggctcgctgtgagagccagcgcggactgtatgtcgcagctcagggggcttgcaggggtcccacctttgcaccattacctccagtggctccccttcactgtgcacagactccttatggctgttgccaagacaatatcaccgcagccaggggtgtggggctggcagggtgcccctcagcttgccaatgcaatccccatggctcctacgggggtacttgtgatccggctacaggtcagtgctcatgccgccctggcgtgggcggactgaggtgcgacaggtgtgagcctggtttctggaatttccggggaatcgtcactgatggcagaagcggttgcaccccttgctcctgcgatccacagggcgcagtgcgggacgactgcgaacagatgacaggactgtgctcctgtaagcctggcgtggccggaccgaagtgcggacagtgccctgacggcagagctctgggacctgccggatgcgaggcggacgccagcgcacctgctacttgcgccgagatgagatgcgagtttggcgcacggtgcgttgaagagtctggcagtgcccactgtgtgtgccccatgctcacctgccccgaagcaaacgcgacgaaggtgtgtgggagcgatggcgtgacttacggcaatgagtgtcaattgaaaacgatcgcatgtcgtcaggggctgcagattagcattcagagcctgggcccttgccaggaggcagtggcaccatcaactcacccaaccagcgctagtgttaccgtgaccacgcctggtcttctgctgagtcaggctctccctgcccctccgggtgcactcccactggcacccagttctactgctcattctcaaactacccctccaccaagctccagacctcggacaactgcaagcgttccaagaaccaccgtgtggccggttctgaccgttcccccaaccgctcccagcccagcaccgtctcttgttgccagtgcctttggcgaatctggatcaacagacggatccagtgacgaagaattgtctggcgaccaagaggctagtggaggcggttcaggaggcctggagcctctggaaggatctagtgtagccaccccaggccctccggtcgagagagcatcctgctataactctgccttgggctgctgttcagatgggaaaacccctagccttgacgcagaggggtctaattgtcctgcaacgaaggtctttcagggggttttggagctggagggagtcgaaggccaggagctgttttacactccagaaatggcagatcctaaatctgaattatttggagaaacggctcgttcaatcgaatccactttggatgatctgttccgaaatagcgatgtcaaaaaggattttcgatctgtgaggctccgggacctcggacccggaaaatccgttcgtgcaatcgtcgacgtgcattttgatccaacaaccgcgttcagggcccctgacgtcgctagagcgctgttgaggcagatacaagtgtcgcggaggcgctcgctgggggtgaggcgcccactccaggaacatgtccgttttatggatttcgattggtttccggcttttatcacaggagcaacaagcggcgctattgcagccggtgccacagcgagagccaccactgcctccaggttacctagtagcgcagtcactcctagagccccacatccatctcatactagtcagcccgttgctaagacaaccgcggctccaaccaccagaaggccacctacaaccgccccatcaagggtgcctgggcgtcgccctccggcaccccagcagccacccaagccttgtgatagtcaaccctgctttcacggcggaacctgccaggattgggctctgggcggaggctttacttgctcatgcccagctggcagaggtggcgctgtctgcgagaaagttcttggtgccccagtgccagccttcgaaggtcgaagtttccttgccttcccaacactacgggcttaccacacactgaggctggctttggagttcagagctctggagccgcaggggctgctactgtacaacggcaatgcaagaggtaaagacttcctcgcattggcacttttggacggcagggttcagctccggtttgacaccggctccggccctgctgtgcttacctcagccgtgcctgtagagccaggtcagtggcatcgcctcgaactatcacgccactggaggagagggacactctctgtcgacggggaaacccctgtgctaggcgagagtccatcgggtaccgacggactcaacctggacacagacctgttcgtggggggtgtacctgaggaccaggcagccgtggctttagagaggacatttgttggagctggcctcaggggctgcatccgcctgctcgacgtcaacaatcaacggttggagctgggaatcggcccaggcgctgccactcgcggtagtggcgtgggcgagtgcggggaccacccctgcctgccaaatccttgtcacggcggtgcaccatgccagaatctggaggcagggagatttcattgccaatgccctccagggagagtgggccctacgtgtgccgacgaaaagagcccatgccaaccaaatccttgtcacggggcagccccatgccgagtcttacctgaagggggtgcccagtgcgagtgccccttggggagagaaggcaccttctgtcagaccgcctctgggcaagacgggtctggcccatttttagcggattttaatggcttttcacacctggagttaaggggactgcataccttcgcacgggatctgggagagaaaatggccctggaagtggtattcctggccaggggaccaagtggccttcttctatacaatggccaaaaaaccgacggcaagggggactttgtatcactcgcactgagggacaggcggttggaattccgctatgacctgggaaaaggtgccgctgtgattcggtccagagagcccgtgaccctaggggcatggacgagagttagtttggaacgaaacgggagaaagggcgcacttcgggtgggagacggacccagggtgctgggtgagtcacccgtcccacacaccgtgctgaacctaaaggagccactttacgtcggcggtgcacctgatttctcaaaattagccagggccgcagccgtttccagtggatttgatggcgcaatccagcttgtgtctttgggaggcagacagttactgacacccgagcacgtactccgccaagtcgatgttactagctttgccggtcacccatgcacccgcgcatccggccatccatgtctgaacggcgcatcctgtgtgccacgggaagcagcctacgtgtgtctatgcccaggcggatttagcggaccacactgcgaaaaagggctcgtcgaaaagtcagcgggtgacgttgacacattggccttcgatggcaggacatttgtagaatatctaaatgcggtcactgagtcagagaaagcgctgcagtcaaaccacttcgagctgtcattgcgcactgaagcaacacagggcctggtgctctggtcaggcaaggccaccgaacgcgcagactatgtcgctttggctatcgttgacgggcatttgcaactgagctataatttggggtcacagcccgtggtcctaagatccactgtcccagtcaatacgaaccggtggctgcgggttgtggctcacagagaacagagagagggatccctacaggtaggcaacgaagcccctgttacaggctcatcaccactcggagccacccaactcgacactgatggagcactatggctcgggggtcttcccgagctgccggtgggccctgctctgcctaaggcatacggcacaggattcgtcggttgccttagagacgtcgtcgtgggaaggcaccctctgcacctcctcgaagatgctgtaaccaaaccagagcttcgcccttgtcctacccctta

SEQ ID NO: 213936 - DNA, 816 bp, Artificial Sequence
  Description of Artificial Sequence: Synthetic coding sequence
tagcggtacgatctcggtaagggagctgccgtgattcgctcgagggaacccgtgacgttgggggcatggactcgtgtgtccctggaacgaaatggcaggaagggagcactgcgggtgggcgacggccctcgtgtcctcggggagtcccccaagagccgcaaagtaccacacaccgtcttaaacctgaaagagcccttgtatgtggggggtgctcctgatttttcaaagctggcacgtgccgcagcagttagttctggcttcgacggggctattcagctggtgagccttgggggaaggcagttgttgacaccagaacatgtgttgagacaagtcgatgtaacttcttttgcaggacacccgtgcacaagagcgtcaggccatccttgtcttaacggcgcaagttgtgtgccccgtgaggcagcttatgtatgtctttgtccagggggtttcagtggacctcattgcgagaaggggcttgttgagaaaagtgccggagatgtagacacgctcgcttttgatgggagaactttcgtagagtacctcaatgctgtaaccgaatccgagttggctaacgaaattcctgtgcccgagacactggattcaggggcactgcactccgagaaggccttacagagcaaccacttcgagctatctctgcgaaccgaggcaactcaggggctggttctctggagcggaaaggccaccgaacgcgcagactatgttgcacttgccatcgttgacgggcatctgcagttgtcatataatttggggtcacaacctgtagtgcttcggtcaaccgtgcccgtgaatacctag

SEQ ID NO: 213937 - DNA, 462 bp, Artificial Sequence
  Description of Artificial Sequence: Synthetic coding sequence
atggcattggtttttgtgtacggaaccctgaaaagggggcagccaaatcatcgggtccttcgggatggggcacacggttcggcagcattcagagctcgcggtcgtactttggagccctaccccctggttatagccggagagcacaacatcccctggctgctgcacctgcctggatccggtagactggttgaaggcgaggtgtacgccgtcgacgaacggatgctccgttttctggacgattttgaatcttgccccgctctttatcaacggaccgtgcttcgggtgcagctcctcgaagacagggcccctggagcagaggagcccccagctcccacagctgtccagtgctttgtctactccagagccacttttccccctgaatgggcccagctgccccatcacgattcctacgactctgaaggcccacatgggctgcggtacaatccaagagaaaaccggtag

SEQ ID NO: 213938 - DNA, 462 bp, Artificial Sequence
  Description of Artificial Sequence: Synthetic coding sequence
atggcgctggtcttcgtctacggcacactgaagcggggacagccaaaccatcgcgtcctccgagacggtgcacatgggtcggcggcatttcgggctagaggtagaaccctcgaaccttatccacttgtgatcgctggcgaacacaacattccctggctcctgcatctgcctggaagtggcagacttgtcgagggggaagtgtacgctgtcgatgaacggatgcttcgctttctcgatgactttgagtcttgtccggcactctaccagaggacagtcctacgcgtgcagctgcttgaggatagggccccaggtgctgaagaaccccctgctccgactgccgtccagtgtttcgtgtattcccgagctaccttcccgcctgaatgggctcagctgcctcaccacgattcttacgacagtgaaggaccacatggtctgaggtacaacccacgggagaacagatag

SEQ ID NO: 213939 - DNA, 879 bp, Artificial Sequence
  Description of Artificial Sequence: Synthetic coding sequence
atgaatccattttggtctatgtctacaagctccgtacggaagaggtccgaaggcgaggaaaagaccttgactggagacgtgaaaacctcgcctccgaggacagcgcctaagaagcagctgcccagtataccaaagaacgccctccccattactaagccaacatcacccgctccagccgcacaatccactaacgggacccatgcgtcctatgggccattttatctggaatactctctgctggccgaattcaccctggtcgtgaagcaaaaactgcccggagtctatgttcagccgagttatcggtccgcactgatgtggtttggagtgatctttattaggcatgggctttatcaggacggggtgtttaaattcacagtgtacatacccgataattacccagatggagactgcccaagactggttttcgacatccctgtgttccacccattggtggacccgacctccggtgagctggatgtcaaaagggccttcgctaaatggaggcgcaaccataaccacatttggcaggtcctgatgtatgcccgtagagtgttctacaaaatcgacaccgcctcaccattgaaccctgaggcggcagttctgtacgagaaagacattcagctcttcaagagcaaggtggttgattccgtgaaggtgtgcacagcacggctgtttgaccaaccaaagattgaggacccctacgctatttcattcagtccgtggaaccctagtgtgcacgacgaggctcgggagaagatgcttacccagaagaagcctgaagagcagcacaacaagtccgtccacgttgccggactctcgtgggtcaagccaggatcagtgcaaccattctctaaagaggagaagaccgtggctacttag

SEQ ID NO: 213940 - DNA, 879 bp, Artificial Sequence
  Description of Artificial Sequence: Synthetic coding sequence
atgaacccgttctggtctatgtccacctcttccgtgaggaaaaggtcagagggagaggaaaaaactcttacgggcgatgttaagacctcacccccaagaacagccccaaaaaaacaattgccaagtattcctaagaacgcactcccgatcactaaaccaaccagtcccgctcccgctgctcagtccacgaatggcacccacgcttcatacggccctttctacctcgaatactccctgttggccgaatttactctcgttgtaaagcagaaattacccggagtgtatgtgcaaccctcttacaggagtgccctgatgtggtttggagtgatttttatcaggcacgggctctatcaagacggggtctttaagtttactgtgtatattcccgataactaccccgatggcgactgtcccaggctggtttttgatatcccagtttttcacccactggtcgaccctacaagtggggagttagatgtcaagagggcattcgctaaatggcgacgcaaccacaaccatatttggcaggttctcatgtacgcgcgtagggtgttctacaaaatcgacaccgccagcccactaaatcccgaggccgctgttttatacgaaaaagacatccaattgttcaaatctaaggtcgtggattccgtgaaagtatgtaccgccaggctttttgatcaaccaaagatcgaggacccgtacgccattagcttctccccctggaatccttcggtacacgacgaggcaagagaaaaaatgctgacgcagaagaaacctgaggaacagcacaataagtctgtacatgttgcagggctctcgtgggtaaagcccggtagtgtgcaaccctttagcaaggaagagaagacagttgctacctag

SEQ ID NO: 213941 - DNA, 1179 bp, Artificial Sequence
  Description of Artificial Sequence: Synthetic coding sequence
atggcctcccataagctgctggttaccccccctaaggccctcttgaaacctttaagcattccaaatcaattactgctcgggccaggtcctagtaatctgccccctcgaataatggccgctggtggtctgcaaatgatcgggagtatgtccaaggatatgtaccagatcatggatgagatcaaagaaggaatacagtacgtcttccagacgagaaatccgctcactctggtaatcagcggctctgggcattgtgcactggaggcagcactggtgaatgtgctggagccgggtgacagctttttagtgggtgctaatggcatctggggccagagagccgtggacatcggggaaagaatcggcgctcgcgtgcatccaatgacgaaagacccagggggacattataccctccaggaggtagaagagggccttgctcaacacaaacccgtgctcctgtttttgactcacggagaatcctccacgggagtgcttcagcctcttgacggatttggcgagctttgccatcgctacaaatgcttgttgctggtggattcagtggcatctcttggtggcacacccctgtatatggatcgccagggcatcgacatcctctattcaggcagtcagaaggctctgaacgcaccgccaggaaccagtctcatcagttttagcgacaaggcaaagaaaaagatgtattcccgtaagacgaaacctttttctttttaccttgatatcaagtggcttgctaatttttggggatgcgacgaccagccaaggatgtaccatcatactatacccgtgatttccttgtattcattgagggagtctctggctctcatcgccgaacaaggtcttgagaactcatggcgacagcacagggaagcagcagcctacctccacggcaggctccaagccttgggcctgcagctgttcgtgaaggaccctgccctgcggctaccgaccgtgacaacagtggctgtgccagccggatacgactggcgggatattgtctcctacgttatcgatcatttcgacattgaaatcatgggcggtctgggccctagcactgggaaggtgcttcgtattggattgcttggatgcaacgctaccagagagaatgttgacagagtgaccgaggctcttagagccgcacttcagcattgccctaagaaaaagttatag

SEQ ID NO: 213942 - DNA, 3078 bp, Artificial Sequence
  Description of Artificial Sequence: Synthetic coding sequence
atggagccgttcaccaacgataggttacagctgccaagaaatatgatcgagaacagtatgtttgaagaggagcctgatgtggtcgatctggcaaaggagccatgtcttcatcccctcgaacctgacgaagttgagtatgaacctagaggctcccgattgctggtacgtgggctcggcgagcacgagatggaagaagacgaggaagattatgaatcttcagccaagctcctaggtatgtcctttatgaataggagttctggactccgcaatagcgcgacaggctatcggcaatctccggatggagcatgtagcgtgccttcagccagaaccatggtagtttgtgcctttgtcatagtggtggcagtaagtgttatcatggtgatctacctgctgcctaggtgcaccttcacaaaagaggggtgccacaaaaaaaaccaatcgatcggactcattcagccatttgccacaaacggcaaattgttcccctgggcccaaattcggctgcccactgcggtggttcctttgaggtacgagctcagccttcacccgaatctaacttccatgaccttcagagggagcgtaaccatttccgttcaggccctgcaggtgacctggaacatcattctccactctactgggcataatatatctcgggtcacctttatgtccgctgtatcctcacaagagaaacaggcggagatcctggagtatgcctaccacggccagatcgctatcgtggcacctgaggccctcctggctggccacaattacaccctgaagatcgagtattcagccaacatatcatcctcttattacggtttttacggatttagttataccgacgagagcaacgagaaaaaatactttgcagccacccagtttgaaccccttgccgcacgttcagccttcccgtgctttgatgagcccgctttcaaggctacttttattattaaaatcatccgtgacgaacagtacacggctctatccaatatgcctaaaaaatcgtccgtggtgctcgacgacggactggtccaggatgaattttcagaatctgtgaagatgtcaacgtatctcgtggcctttattgtgggtgaaatgaaaaacttgtcacaggatgtgaacggcacactggtctcaatttatgctgtgccggaaaagatcggacaggtgcactacgctctggaaaccaccgtgaagctgctggagttcttccagaactattttgaaatacagtatcctctcaaaaaactagacctggtagccatacctgacttcgaggccggtgcgatggagaactggggactacttacatttagagaggagaccctgttatacgacagcaacactagtagcatggccgatagaaaactcgttacgaagattattgcccatgagctcgcacaccagtggttcgggaacctggtgactatgaaatggtggaatgacctgtggcttaatgagggttttgccacatttatggagtattttagcctggagaagatcttcaaggagctgtcctcatacgaggatttcctagatgccaggttcaaaacgatgaagaaggactcactgaatagcagccaccctatttctagtagcgttcagtccagcgagcaaatcgaggagatgttcgacagcctcagttattttaagggctccagtctgcttctgatgctgaagacgtacctaagcgaagacgtcttccagcacgccgtggtcctgtacttgcacaaccacagctacgcttccattcagtccgatgacctatgggactcctttaatgaagtgactaatcaaaccctagacgtgaaaaggatgatgaaaacatggactcttcaaaaggggtttccactggtgacagtgcagaagaagggcaaggagctgttcatccagcaagaaagattttttctgaacatgaaacccgagatccagccatccgatactagttacttgtggcatattcccttatcttatgtgacagagggtaggaactactcaaagtatcagtctgtgtcactgttagataagaagtcaggcgtcatcaatcttaccgaggaagtgctgtgggtcaaggtgaacatcaatatgaatggctactacatcgtgcattatgctgacgatgactgggaggccttaattcatcagctgaaaattaatccctacgtgctgtccgataaagatcgggctaatctcatcaataacatattcgaactcgccggactcggcaaagtgcctctgaaaagagctttcgacctgatcaactatctcggtaacgaaaatcacactgcccctattaccgaggcacttttccaaacagacttgatatacaatctgctggagaaactagggtatatggacctagcctctcggctcgtgacgagagtatttaagctactgcagaatcagattcagcaacaaacgtggaccgacgagggtactccgtccatgcgcgagctgcggtctgcgctgctcgagttcgcatgcacccataacctaggcaattgttctacaaccgcaatgaagctttttgatgattggatggcatctaatggtactcagagcctgcccacagacgtgatgacaacggtcttcaaagtaggggcaaaaactgataaggggtggagcttcctgttgggtaaatatatatccataggtagcgaagcggaaaaaaataaaatccttgaggctctcgcctcttccgaggacgttaggaagctctactggctcatgaagagcagcctgaatggggataacttccgcacccagaaactgtctttcattatcagaaccgttggaagacattttccaggccacttacttgcgtgggactttgtgaaggagaactggaacaaactggtccagaagttccctctcgggtcttataccatacagaatatcgtcgctggcagtacctatcttttcagtacaaagacacacctgtccgaagtgcaggcctttttcgagaaccagagcgaggccactttccggctaagatgcgtgcaagaggctctggaagtgatccaactcaacattcagtggatggaaaaaaacctgaagtctctgacctggtggctatag

SEQ ID NO: 213943 - DNA, 2907 bp, Artificial Sequence
  Description of Artificial Sequence: Synthetic coding sequence
atggacagcacacttaccgcgtcagagatacgccaacgctttatagacttctttaagaggaacgaacatacttatgttcactcctcagccactattcctctggacgatcctaccctgctgtttgccaatgccggaatgaatcagttcaagcccatttttctcaataccatcgacccgtcccatcccatggccaaattatcacgagccgcaaacacccagaagtgcataagggccggtggaaaacacaatgacctagacgatgtaggaaaagacgtataccaccatactttctttgagatgcttgggtcttggtcctttggggactattttaaggagctcgcatgcaaaatggccctggagctgcttacacaagagttcggtattcccattgagagattgtacgtcacttattttggcggagacgaggccgcaggtctggaggcagacctggagtgcaaacagatttggcagaatctcgggctggacgatacaaaaattcttcctggcaacatgaaagataacttttgggaaatgggcgacacaggaccctgtggcccttgcagcgaaatccattacgatagaatcgggggtagggacgctgctcacttagtgaatcaggatgatccgaacgttcttgaaatatggaatttagtcttcattcaatacaatagggaagctgatggcatcctaaagccactgccaaagaagtcaatcgatacgggaatgggactggagcggctcgtgagtgtgttgcagaacaaaatgtccaactacgatactgatctttttgtaccttacttcgaggccattcagaagggtactggggctcggccttatacaggtaaggtgggagccgaggacgctgatgggattgacatggcctaccgagtgctggcggatcatgctaggaccattaccgtggctttagcagacggtggcagacctgataacactggacgagggtatgtcttgcggaggattctgcgaagagcagtgcggtacgcacacgagaaactcaatgcctcacgaggcttcttcgccacattggtcgacgtggttgtgcaatcactaggtgacgccttccccgaactgaaaaaagacccggacatggtgaaggatatcattaatgaggaggaggtccagttcctgaagaccctcagccgcggacggaggatcctggataggaaaattcagtcactcggtgactctaagactatcccaggcgatacagcctggcttttgtatgacacttacgggtttccagtagacttgactggcttaatcgctgaggagaagggcctggttgtggatatggatggatttgaagaagaaagaaaactggcccagctcaagtctcagggcaagggtgccggaggcgaggatctgatcatgctggatatctacgcaatagaggaactgcgggcaagggggctggaggtgactgacgatagcccgaagtacaattaccatctggactccagcggatcctacgtgttcgagaataccgtcgccactgtcatggccttgaggagggagaaaatgtttgtcgaagaggtctccacaggccaggaatgcggtgtcgttttggataagacctgtttctatgctgaacagggagggcagatatacgacgaaggatatctggttaaggtggatgattcaagtgaggataagaccgaatttacagtgaagaatgcccaggtacgaggaggttatgtgctgcatataggcactatctacggagaccttaaagtcggtgaccaggtgtggctgtttatagacgagccacgccgacgccctatcatgtctaaccacaccgccacgcatattctaaatttcgcactgcggtctgtgcttggcgaagcagatcagaaggggtctctcgtcgcgcctgacagactgaggttcgattttaccgcaaaaggcgcaatgagtacgcagcagattaaaaaagcagaggagattgcaaacgaaatgattgaggcagccaaggctgtctacacccaggattgtcctcttgcagctgccaaagcaattcaagggctgagagccgtgtttgacgagacctaccctgatcctgttcgggttgtcagcataggtgttccagtgtccgagctgctcgacgacccctccggacccgcaggaagtctgacaagcgtggaattttgcggtggtactcaccttaggaattcttcccacgcaggcgcattcgtgattgtgaccgaggaagctattgcaaaaggaatcaggcgcatcgtggccgttactggggcagaggctcagaaggcccttcggaaagcggaatcgctaaagaaatgtctttccgtgatggaagctaaggtgaaggcacagactgcgccaaataaggacgtgcagcgggagattgcagatctgggagaggcccttgctaccgccgtgattccacagtggcagaaggacgaactgcgggaaaccctgaaatcacttaaaaaagtgatggacgatctggaccgcgcaagtaaagctgacgtgcagaaaagggtcctggagaagacaaaacagttcatagattccaatccaaaccagccactggtgatactcgagatggagagcggcgcatccgctaaggccctcaatgaagcgttaaagctcttcaaaatgcattccccgcagacaagcgccatgctatttaccgtagacaacgaggcaggcaaaataacctgtttgtgccaagttcctcagaatgccgctaaccggggattaaaagcgtccgagtgggtgcagcaggtttctggcctcatggatggcaaaggtggaggaaaggacgtgagtgcgcaggccaccgggaagaatgttggctgcctgcaggaggccctacagttagcgacctccttcgcacaactcagactaggagacgttaagaattag

SEQ ID NO: 213944 - DNA, 2958 bp, Artificial Sequence
  Description of Artificial Sequence: Synthetic coding sequence
atggccgcttccgtggcagcggctgctcgacggctgagacgggcaatccgacgttctccagcttggcgtggcttgtcccatagaccattgtcgtcagagcccccagcggctaaagcgtccgccgtgcgcgctgcgtttctgaattttttccgagaccgccacggccaccgcctcgtcccttctgcttcggtcaggcctcggggtgatccctctctcctctttgtgaatgcaggcatgaatcagtttaagccaatcttcctgggcacagtggatcctagatctgagatggctgggttccgcagagtggccaattcacagaaatgtgtacgcgcaggagggcatcataatgacctggaagatgtgggcagggacctctcccaccacacatttttcgagatgctgggcaattgggcctttggaggcgaatacttcaaggaggaggcttgcaatatggcttgggagttactgacccaggtttacggcatacccgaggagcgcctctggatttcttactttgacggtgatccaaaggccggactcgatcctgacttggagacacgcgacatttggctgtctctcggggtgcccgcatcaagagttctgagttttggaccacaggaaaacttttgggagatgggagacactggtccatgtgggccatgcacagagatacattacgatctggctggaggtgtaggcgcaccccagttggtcgagctgtggaacctcgtgtttatgcagcacaaccgggaggctgatggcagcctccagccactgccacagcgtcatgtggacaccggcatgggtcttgaaaggttggtggccgttctccaggggaagcattccacatacgatacagatctgttcagtcctctcctaaacgccattcagcaaggctgtcgcgcacccccatatctaggccgtgtaggcgtggccgatgaaggcaggactgacacagcctacagggtagtggctgatcatatccgaacccttagtgtctgcatttcagacggaatcttccccggaatgtcaggtcccccactggttctcaggaggatactccgtcgcgcagtgaggtttagtatggagattctcaaagcgccacccggtttcctggggtctctggtgccagtggtcgtggagactttgggtgacgcctacccggaacttcaacggaactctgcccagattgctaacctggtgagcgaggacgaagcggcatttttggcctctctggaacggggacggaggatcatagacagaaccctacgcactctgggcccttccgacatgtttcctgctgaggtggcatggtctctgagcttatgtggcgacctggggctcccgcttgatatggttgagcttatgctggaggaaaagggcgtacagctggactccgccggtctggagcggcttgcccaagaagaggcccagcacagagcacgccaggccgagcccgtgcagaaacagggactatggctggatgtccacgctctcggggaattacagcggcagggagtcccgcctacggatgattcccccaagtacaattacagcctgcggccatcggggagttacgagttcggaacttgtgaagcccaggttctccagctgtacacggaagacggcacagccgtggctagcgtcggcaagggacaaaggtgtggcttactgctggataggactaatttctacgcagaacagggaggccaggccagtgaccgagggtacttagtccgcgcagggcaggaggacgttctgtttcccgtcgctcgggcacaggtttgcggaggcttcatcctgcacgaagccgtggcccctgaatgtcttcgattaggcgaccaagtacagttgcacgtcgacgaggcctggcgcttagggtgcatggcgaaacacaccgcaacacacctcctcaactgggcactcagacaaactttaggaccgggaactgagcagcagggttctcatctaaatcctgagcaactacggctggacgtcaccacgcagacacctttaactcccgaacagcttcgggcagtagaaaataccgttcaggaagccgtaggacaggacgaggccgtctacatggaggaggttcctctggcattgactgcccaggtgccaggactgagaagtcttgacgaagtctacccagaccctgtgcgggtggtatcagtgggcgtgcctgtggcacatgcactcgacccagcaagccaggccgctctgcagacatctgtagagctgtgttgcgggacccacctgctccgtactggcgctgtaggcgacctggttattatcggcgaccgacagctcagcaaaggcaccacgaggctacttgcagttactggagaacaggcacagcaagcaagggaactgggtcagagtcttgctcaagaggtcaaggctgcaactgagcggctctcgctgggatcccgggacgtggcggaggccctgcgtttatccaaggacatcggacggcttatcgaggcagtcgagacggccgttatgccgcagtggcagcggcgagaactgcttgctaccgtgaagatgctccagcggagagctaataccgcgatcagaaagctgcagatgggccaggctgcaaagaagacacaggaactgctggagcggcactctaagggacctctcatcgtggatactgtgtcggcagaatctttgagcgttctggtgaaggtggtaagacaactttgcgaacaagccccttcaacatcagttctgttgctctctccgcagccaatgggcaaagtgctttgtgcgtgtcaggtggcacagggcgcaatgcctacctttaccgctgaggcttgggctctggcagtctgctcccacatgggcggaaaagcgtggggcagcagagtcgttgcgcaggggaccggcagtactacagacctggaggcagctttgtctattgcacaaacctatgcactttcacagctgtag

SEQ ID NO: 213945 - DNA, 1578 bp, Artificial Sequence
  Description of Artificial Sequence: Synthetic coding sequence
atggagttctgcgtggaggattccaccgatgtgcacgtactcatagaggatcacagaattgtgttctcctgcaagaacgccgacggcgtggaactttataatgagattgaattctatgccaaagtgaactctaaggactcccaggataaaagatccagcagaagcattacgtgctttgtgaggaagtggaaggagaaggtagcctggcctcgattgacaaaagaggacattaagcctgtgtggctgtcggtggactttgacaattggcgagattgggagggggacgaggaaatggaactagcccacgtggaacactacgcagagcttctgaaaaaagtgtccactaagcgccctccaccagcgatggacgatttagacttcactaccaccgtcgtgtcttgctgcccagccgagctgcagacagagggatctaacggaaagaaagaggtgctaagcggctttcaagtggtgctcgaggacaccgtgctcttccccgagggaggaggccagccagacgaccggggaaccatcaacgatatatcggtgctgagagtaactcgacgaggcgagcaggccgaccatttcacccagactcctcttgaccctggatcccaagtgctcgtgcgcgtggattgggagcgccgttttgatcacatgcagcaacattcaggccagcatttaataaccgctgtggccgaccacctgtttaagcttaaaaccacaagctgggaactgggacgcttcaggagcgcgattgaactggacactcccagtatgaccgcagagcaggtagctgccatagaacaatctgtaaatgaaaagattagagataggcttcccgtaaacgtcagggagctaagcttagatgaccccgaagtggagcaagtctccggccgtgggctgcccgacgatcatgccggtccaattcgagtggtgaacattgagggggtcgattcaaatatgtgttgcggaacccacgtctccaatcttagcgaccttcaggtgatcaagatcttgggaactgaaaaagggaagaaaaatcggacaaatctaatatttttgagcggcaacagggtgttaaagtggatggagcgcagccacggtaccgagaaggctcttaccgcactcctgaagtgcggcgcagaggatcacgtagaagcagttaagaagctacagaattcgactaaaattcttcagaagaacaacctcaacttactccgggaccttgcggtgcacatagctcactccttgaggaactctccagattggggaggtgtcgtcattttacaccgtaaggaaggagactcagaatttatgaatattatcgctaatgaaattgggagcgaggaaaccctgttgttcttaactgtcggcgatgagaaaggcggagggttgtttttgcttgccggacctcctgcatcggtggaaactctaggcccacgtgtcgctgaggtgttagaagggaagggggcaggcaagaaagggagatttcaggggaaagcaaccaagatgtctaggcggatggaagctcaggccctgctgcaagactacatctccacacaatccgcaaaagaatag

SEQ ID NO: 213946 - DNA, 1761 bp, Artificial Sequence
  Description of Artificial Sequence: Synthetic coding sequence
atgttcagcctgcccttaaattgtagcccagaccacattaggcgtggcagctgttggggacgccctcaggatcttaagatcgctgccccagcatggaacagcaagtgccaccccggagctggcgcagcgatggctcgtcaacacgctaggacactgtggtacgatagacctagatatgtgttcatggagttttgcgttgaagatagtacagatgtgcatgtactaatcgaggatcatagaatcgtcttcagctgcaagaatgccgacggggtagaactctacaatgagatcgagttttatgccaaagtgaattctaaggattcccaggacaagcggagcagccgctcaatcacctgctttgtcaggaagtggaaggagaaggtcgcttggcctcgcctaacaaaagaagatataaagcccgtttggctgagcgttgattttgacaactggagggactgggaaggtgatgaggagatggaactcgctcatgtggagcattatgccgaactccttaaaaaagtgtctaccaaaagacctccaccagccatggatgacttggattttaccaccaccgtggtctcgtgctgccccgcagaactgcaaactgaaggctctaatggcaaaaaagaggtgctcagcggttttcaggtcgttcttgaagatacagtgttgttcccagaaggaggtgggcagcccgacgataggggtacaatcaacgacatttcagtgctgagagtgactcgaagaggcgagcaggccgatcacttcacgcagacacctcttgatccagggagtcaagtcctagtgcgagttgactgggaaagaaggtttgaccatatgcagcagcacagcggccagcatttaatcacagctgttgccgaccatctgttcaaactcaagactactagctgggaattggggagatttaggtccgccatagagttggatacacccagcatgactgcagaacaagtggccgcaattgagcagagcgtgaacgagaaaatcagagaccgactacccgttaacgtgagagagctcagtctggacgatccagaagtggaacaggtctcgggtagggggctgcccgatgaccatgctggtccaatacgggtggtgaacatcgaaggggttgatagtaatatgtgttgtggaactcacgtgtccaatttgagtgatctgcaagtgatcaaaatcttgggaactgaaaaaggaaaaaagaatcggaccaaccttatttttttgtctgggaaccgcgtcctcaagtggatggaacggagccacggaacagagaaagcccttaccgcactgctgaagtgcggcgcagaagaccatgtggaggcagtgaagaagctgcagaacagtaccaagatcctgcagaagaacaatttaaaccttctgagggatttggctgtccacatcgctcactctctgcgcaattcaccagattggggaggagtcgtaatcttgcatagaaaggagggcgattccgaatttatgaatatcattgccaacgagatagggtccgaggagacgttactctttctaaccgtgggagatgagaaaggcggtgggctctttctgcttgctgggcctcctgcatctgttgaaactctgggcccaagggtcgcagaggttttggaggggaagggtgctggcaagaagggcaggttccaaggcaaagcaactaagatgtcccggagaatggaggcccaggcgctccttcaggattacatttccacacagtcagccaaagagtag

SEQ ID NO: 213947 - DNA, 1761 bp, Artificial Sequence
  Description of Artificial Sequence: Synthetic coding sequence
atgttttcgctgccactgaactgttccccagatcatatcagaagggggtcgtgttggggacgcccacaagatttaaagatcgccgcaccggcatggaattccaagtgtcaccccggagctggtgcagcgatggcaaggcagcatgccaggacgctctggtatgatcggcctcggtacgtgttcatggaattctgtgtggaggacagcactgacgttcatgtgctgatcgaggaccacagaatcgtgttttcttgcaaaaatgctgatggggttgagctatacaacgaaatcgagttttacgccaaggtgaattcaaaagatagtcaggataagagatcatctcgcagcatcacgtgttttgttcggaaatggaaggagaaggtcgcctggccccgtctgaccaaggaggacattaagccagtatggctcagcgttgactttgacaactggcgcgattgggaaggagacgaggaaatggaactggcccacgtcgagcattacgccgagctgctgaaaaaggtgagtacaaagcggccaccgcctgccatggacgatctggacttcacaactaccgtagtcagctgctgcccagcggaactgcagacagaaggatccaatggaaagaaagaggtgctgtctgggtttcaggtggtgttggaagatacagtcctttttcccgaaggtggcggacagccggacgacagaggtacaatcaatgatatatccgtattacgagtcacccggaggggtgaacaggccgatcactttacacagacgccactggatccgggttcacaggtgctcgttagagttgattgggaacgcagatttgatcacatgcaacagcatagcggtcagcacctcataactgccgttgcggatcatttattcaagctgaagacaactagctgggagctgggccgattcaggagcgcaatcgaactcgatacccctagcatgacggcagagcaggttgccgcaatagagcaatcggttaacgaaaagattcgcgaccggctacccgttaatgtgcgggaactatctctggacgaccctgaagtggaacaagtgagtgggcgaggcctgcccgacgatcacgcaggtcctatcagagtggtcaatattgaaggggtggactccaacatgtgctgtggcacccacgtgtcaaatctctcagaccttcaggttatcaaaatcttagggacagagaaagggaagaagaaccggaccaatttgattttcctctcgggaaaccgcgtcttgaaatggatggaaaggtcacacgggacagagaaggcacttacagcccttctgaaatgtggagctgaagatcatgtcgaggccgtcaagaagctgcagaattctactaagattctccaaaaaaacaacctcaacctccttagggacctggcagtacacattgcacactccttgcggaactcaccggattggggaggggttgtaattctgcaccgtaaggagggggattcagaattcatgaatatcatcgcaaacgaaatcgggagtgaagagaccctactattcctgacagtgggggatgagaaagggggaggcctgtttcttctggccggaccgcctgcaagcgttgagacactcggaccacgtgtggccgaggtgctggagggtaagggtgcaggtaaaaagggaaggtttcaaggcaaggcaacaaagatgtcacggaggatggaggcccaggcactgctgcaagactacatcagtacgcagagcgcaaaggaatag

SEQ ID NO: 213948 - DNA, 1239 bp, Artificial Sequence
  Description of Artificial Sequence: Synthetic coding sequence
atggccttctggtgtcagcgcgattcctacgccagggaatttactactacagtggttagctgctgcccagccgaattacagactgaaggatccaacggaaagaaagaagtgctgagtgggtttcaggtggtcctggaggacactgttctgttccctgaggggggaggacagcccgatgatcgagggaccataaacgacatcagcgtattgagggtgactagacggggtgaacaggccgaccactttacccagacccctttggacccaggcagccaggtcctcgttcgcgtggattgggaacgcagatttgatcatatgcagcagcactctggacagcacctcattaccgcagttgctgatcacctgtttaagctgaaaactacatcctgggagcttggccgattccgttccgctatcgagcttgacacgccttcgatgactgcagagcaagttgccgcaattgagcagagcgtcaacgaaaaaattagggatcgcttgcccgtgaatgtgagagaacttagcttggatgaccctgaggtggaacaggtttctgggaggggtctgcccgacgatcatgccggtcccatccgggtggttaatatcgaaggtgtggacagcaacatgtgctgtggaacgcacgtgtcaaatctatctgacctgcaggttatcaagattctcggcacagaaaaaggaaaaaagaaccgtactaatctgatctttctttctggcaacagagtattgaagtggatggaacgatcacacggaacagagaaagcccttactgccctactgaagtgtggagctgaggatcacgtggaagccgtaaaaaaattgcagaactcgacaaaaattctgcagaaaaacaatctcaacctccttagagatctggccgtgcacattgcacacagccttagaaacagcccagactggggcggagtagttatcctgcatcgcaaggaaggagactctgaatttatgaacatcattgccaatgagattggctctgaagagacattgttgttcctcaccgtgggggacgaaaagggcggaggtctgttcctgttggcgggaccgcctgcctcggtcgaaacactcggaccacgcgtagcagaggtcctagaagggaaaggcgcaggaaagaaaggcaggttccaggggaaagccacgaagatgagccggagaatggaggctcaagccctgctgcaggactatatctcgacacagtccgccaaagaatag

SEQ ID NO: 213949 - DNA, 501 bp, Artificial Sequence
  Description of Artificial Sequence: Synthetic coding sequence
atgttcagcttaccacttaattgttcccccgaccatatccgcagaggcagttgctggggtcggccacaggatctgaagattgcagcccctgcctggaactctaagtgtcaccccggtgccggagcggctatggctagacagcacgcccgtactctttggtatgacagaccaaggtatgtctttatggaattctgtgtagaggactcgacggatgttcacgtactaattgaagaccatagaatagtattttcctgcaagaacgcagacggcgtggagctgtacaacgagatcgagttttacgccaaagtgaattccaaaccagtgtggctgtccgtcgacttcgacaattggcgcgactgggagggggatgaggaaatggaactggcccatgtagagcattacgccgaactgctgaagaaggtgtcaactaagcgacctccgcctgcgatggatgacttagacgatgattcagattccgcagacgacgccacaagtaattag

SEQ ID NO: 213950 - DNA, 399 bp, Artificial Sequence
  Description of Artificial Sequence: Synthetic coding sequence
atggaattctgcgttgaggactcaacagacgttcacgtgctgatcgaagatcacagaatagtgttttcttgcaaaaatgctgacggggtggaattgtataatgagattgagttctacgctaaagttaattccaaagattcccaagataaaaggtccagccgctccattacttgtttcgttaggaaatggaaggaaaaggtggcttggccgagactgactaaggaggacatcaaaccagtgtggctgagtgtcgacttcgataattggcgagactgggagggcgatgaagagatggaactagcccacgtagagcactacgcagagctgttgaagaaagtgtccaccaagagaccaccacccgcaatggacgatctggactttactaccacagtagtgtag

SEQ ID NO: 213951 - DNA, 1830 bp, Artificial Sequence
  Description of Artificial Sequence: Synthetic coding sequence
atgaaatgggtcaccttcataagcctgctttttctcttcagcagtgcctatagcaggggagtatttaggcgtgatgcgcacaagtcggaagtggctcatcgattcaaggacctaggcgaagagaatttcaaggcactggttttgattgctttcgctcagtacctgcagcagtgcccttttgaagaccatgtcaaacttgtcaatgaggtcacggagtttgctaaaacctgtgtcgctgatgagtccgcggaaaattgtgacaaatcccttcatacactcttcggagataagctttgcacagtcgccacgctccgggaaacatacggtgaaatggcggattgttgtgccaaacaggagccagagcggaacgaatgtttcctgcagcacaaggacgataaccccaacttgccccgattggttcggccagaggtggacgtaatgtgtacagccttccacgataacgaggaaacattccttaagaagtacctttacgagatcgccagacggcatccctacttctatgccccagaactgctgttttttgctaagaggtataaagctgctttcactgagtgttgccaggcggcagacaaggcggcatgccttttacccaaactcgacgaactgcgcgacgaaggcaaagcgagctctgcaaaacaacgcctgaagtgtgcatctctgcaaaaattcggggaaagggcgttcaaggcttgggccgtggcccgtctgtcccagagattccctaaggctgagtttgccgaagtttccaagctcgtcacggacttgacgaaggtgcacacagagtgctgccacggcgatctactagagtgtgccgacgatcgcgctgaccttgccaagtatatatgcgaaaaccaagattctatctcttcgaaacttaaggagtgttgtgaaaaacccctgctagagaagtcacattgtattgcggaggtcgagaacgacgagatgcccgcagacctgccatctctggctgccgactttgtcgaatctaaagacgtgtgcaagaattacgctgaagcaaaggacgtgtttctggggatgtttctgtacgagtacgcacgccgtcaccctgattactccgtggtgctattgttgcgcttagccaagacatacgagactactctcgagaagtgctgcgccgctgccgaccctcatgagtgttatgccaaggtatttgatgaattcaagcccctggtggaagaaccccagaaccttatcaagcagaattgtgaactgttcgagcagttgggagagtataaatttcagaacgctctccttgtacggtacacaaagaaagtaccacaggtgagcacgccaactcttgtcgaggtgtcacgaaatctggggaaagttggtagcaagtgctgcaagcaccccgaggccaagaggatgccttgcgccgaagactacctatctgtggtgttgaaccagctctgtgttctacatgagaaaactcccgtgtcagaccgggtcactaagtgctgtacagagtccctggtcaacaggaggccttgtttctcagccctggaagtggacgagacgtacgtgccgaaggagttcaacgccgagacctttacttttcacgccgacatttgtacgttgtcagaaaaagagcgccagatcaagaagcagactgccctcgtggagttggttaaacacaagcctaaagctaccaaagaacaactgaaagcagtgatggacgattttgcggcttttgttgagaagtgttgcaaggccgatgataaagagacctgtttcgctgaagagggcaagaaattggttgctgccagccaagcagccctggggctttag

SEQ ID NO: 213952 - DNA, 1191 bp, Artificial Sequence
  Description of Artificial Sequence: Synthetic coding sequence
atgaagtgggtgacattcatctccctgctttttctattttctagcgcttactcaaggggggtcttccgacgagacgcccacaaatctgaagtggctcaccgatttaaggacttaggggaagaaaactttaaagccctggtgctcattgccttcgcccaatatcttcagcagtgccccttcgaggaccatgtaaagttagtgaacgaggtgaccgagttcgcaaaaacctgcgttgctgacgaatccgccgagaactgcgataagtctttgcatacactgtttggagataagctgtgcactgtggctacacttagggaaacttacggagaaatggcagactgctgcgcgaagcaggagcccgaacgcaatgagtgctttctgcaacacaaggacgataatcctaatctgccaagactggtgcggcctgaggtggatgttatgtgcacagcttttcacgataacgaggagacgttccttaagaaatacctttacgaaacgaccttagaaaaatgttgtgctgcagcagaccctcatgagtgctacgccaaggttttcgatgaatttaaacctctagtcgaggagccccagaacctaataaaacagaattgtgagttgttcgagcagttaggcgaatacaaattccaaaacgccttgctcgtgcggtacactaaaaaagtgccccaggtcagcaccccaacgctcgttgaggtttcaagaaatttaggcaaggttgggagcaagtgctgcaagcacccggaggcgaagcggatgccgtgtgccgaagactatctcagcgtggtcctcaatcaactctgcgtgttgcacgagaaaacccctgtgtctgaccgcgtgacaaagtgctgtacggagagtttggtgaatagaagaccctgcttttccgccctggaggttgatgagacctatgtgccaaaggaatttaacgccgagactttcacttttcacgccgacatctgcaccctgagtgaaaaggagcgacagataaagaagcagaccgcactggttgaactcgtgaagcacaaacccaaagctaccaaggagcagctgaaggctgttatggacgacttcgcagctttcgtggagaaatgctgcaaggctgatgacaaggagacttgtttcgccgaggagggaaaaaagttagtggctgcatctcaggcggctttagggctgtag

SEQ ID NO: 213953 - DNA, 1254 bp, Artificial Sequence
  Description of Artificial Sequence: Synthetic coding sequence
atgaagtgggtgacatttatctcactgttattcctgtttagttccgcctactcacgtggcgtgtttaggagggatgcacacaagtccgaggtggcgcatcgcttcaaagacttaggggaggaaaattttaaggccttggctgttgcgcgactctcgcagcggttcccaaaagccgaattcgccgaggtgagtaaattggtgactgaccttactaaggtccatactgaatgttgccatggagatctcctcgagtgcgctgacgacagggcagacctggccaagtatatctgcgagaatcaggacagcataagcagcaaacttaaggagtgttgcgagaagcctcttcttgagaagtctcattgcatcgctgaagtggagaatgacgagatgcccgcagacctgccctccctcgccgctgacttcgttgagtccaaggacgtctgtaaaaattacgccgaggcaaaggacgtttttctcggcatgttcttgtatgagtacgcccgacgccacccggattactctgtggtgctgttgctgaggctagcaaaaacttacgaaacgaccttggaaaaatgctgcgccgcagccgatcctcacgaatgctatgccaaagtttttgacgagttcaaacctctggtagaggagccccaaaacctgatcaaacagaactgcgagctttttgagcagctgggcgagtataagttccaaaacgcactgctggttcgctataccaaaaaggtgccgcaggtaagcactcccactctggtagaagtttccaggaacctaggtaaggtgggatccaaatgctgtaagcatcctgaggctaagcgaatgccatgtgcggaggactatctgtccgtagtgcttaaccaactctgcgttctccacgagaagaccccagtctctgaccgtgtcacaaaatgttgtacagagagcttggtaaaccggagaccctgtttttcggcgctggaggttgatgaaacctatgtgcccaaagagtttaatgccgaaacctttacgtttcacgcggatatctgcacgctgtctgaaaaagagaggcaaatcaagaagcagacagctttggtcgagctggtcaagcacaaacctaaagcaaccaaagaacagttgaaagctgtcatggatgatttcgcagcattcgtggaaaagtgctgtaaggccgatgacaaagagacctgcttcgcagaagaaggtaaaaagctggtggctgcctcccaggctgctcttggactatag

SEQ ID NO: 213954 - DNA, 1857 bp, Artificial Sequence
  Description of Artificial Sequence: Synthetic coding sequence
atgaagtgggttacttttatatcactgctatttctgttttcaagtgcctactcaaggggtgtgttccgcagggacgccctgtttctcttttttttcccctgcccagataagtccgaagtggcccatagattcaaggacctaggtgaagaaaacttcaaggccctcgtgctaatcgccttcgcacaatacctgcaacagtgcccattcgaggatcatgtgaaacttgttaacgaagtcaccgaatttgccaagacttgtgtggctgacgagagcgccgagaactgcgataaatccctgcacacactgttcggagacaaattatgtaccgtggccacactgcgagagacttacggtgagatggcagactgttgcgcaaagcaggagccagaacgtaacgaatgctttctgcaacacaaagatgacaatcctaacctaccgcgactggtccggccagaagtcgacgtaatgtgcactgcgtttcacgataacgaggaaacttttctgaaaaagtacttatatgaaattgctagacgccatccatatttttatgccccagaactgctgttttttgccaagaggtacaaggcggcattcaccgaatgttgtcaagcagcagacaaagcagcttgtctgctccctaaactggatgaactcagagatgagggcaaagcctcttctgccaagcagcgcttgaagtgcgcgtccctgcaaaaattcggcgaaagagcttttaaagcatgggctgtggctcggctttctcagagattccccaaagccgaatttgcagaagtgtctaagctcgtgaccgacctgaccaaagtgcacacagaatgctgccatggtgacctactggagtgcgccgatgatcgcgctgacctggcaaaatacatctgcgaaaaccaggactccattagctccaagctgaaagagtgctgtgagaaaccccttctagagaaaagtcattgtatcgcggaagtcgagaacgacgaaatgccagccgatctacccagtctggctgccgactttgtcgaatctaaagacgtctgcaaaaactacgcggaggccaaggacgtcttcttgggaatgttcctatacgagtatgccagaaggcacccagactactctgtggtgttgttactgagactcgcaaaaacctatgaaacgaccctagaaaaatgctgtgctgcggcagacccacacgagtgttacgcaaaagtatttgatgaatttaagcctcttgtcgaggagcctcaaaatctgatcaagcagaactgcgaattatttgaacaactgggcgagtataaattccagaacgcgcttcttgttaggtatacgaagaaagtgccccaggtgtcaactccgacactggtggaggttagcaggaacttgggcaaagttgggtccaagtgctgcaagcatccagaagctaagagaatgccctgcgcagaagattatctgagcgttgtgcttaatcagttgtgcgtcctgcatgaaaaaactcccgtgagtgacagagtgaccaagtgttgcactgagtccctggtgaataggaggccctgcttctctgcacttgaagttgatgagacttacgtgccaaaggagttcaatgcggagaccttcacttttcacgcagatatatgcaccttatccgagaaggagcggcaaataaagaaacagactgcattagtggagctcgtgaagcacaaacccaaagcaaccaaagaacaactcaaagccgttatggacgatttcgccgcatttgtagaaaagtgctgtaaggccgatgacaaggagacgtgctttgctgaggagggtaagaaactggtggcagcctcccaggccgctctgggcctttag

SEQ ID NO: 213955 - DNA, 1161 bp, Artificial Sequence
  Description of Artificial Sequence: Synthetic coding sequence
atgtttgccgagatccagatccaggacaaggacaggatgggcaccgctgggaaggtaataaagtgcaaggcagcggtcctgtgggagcaaaagcaacccttctccattgaggaaatcgaggttgctccaccaaagaccaaagaagtccgcatcaagatcctggccacggggatctgccgtaccgacgaccatgtcattaagggcactatggtgagcaagttccctgtgatcgttggacacgaggcgaccggcatagtagagagtatcggggagggggtaactacagtgaagcccggtgataaggtgatacccttgttcctacctcagtgtagagagtgtaatgcctgtcggaatccagacggcaacctatgcattcgatctgacatcaccgggcgtggcgtcctggccgatggaaccactaggttcacatgtaaaggaaaacctgttcaccactttatgaacacctccaccttcacagaatataccgtggtggatgagagtagcgtagcaaagatcgacgacgcagcccctcctgaaaaggtgtgtctgattggctgcggcttcagcacaggctatggcgctgcggtaaagacaggaaaagtgaagcctggatctacatgcgtagtttttggccttgggggagtcggcctcagtgtgatcatgggctgcaaatccgccggagcttctcgaattatcgggatagacttgaataaggacaagtttgagaaggccatggctgtgggggctaccgagtgtatatcaccaaaggacagtaccaagcccatttccgaggttctttcagaaatgaccgggaacaatgtgggctacacttttgaagttatcggccatctggaaacgatgatcgacgcattggcttcctgtcacatgaactatgggacatctgttgtggtaggggtgcccccttccgctaagatgctgacctatgaccccatgttgctgtttaccggcagaacttggaagggttgcgtgttcggtggactgaagtcacgagacgatgttcctaaactcgttacggaattcctggccaaaaagttcgatctggaccagctgataacccacgtgctgcccttcaagaaaattagcgaagggttcgaattgctgaacagtggacagtcgattaggacggttctgaccttttag

SEQ ID NO: 213956 - DNA, 1128 bp, Artificial Sequence
  Description of Artificial Sequence: Synthetic coding sequence
atgagtacagcaggcaaagtgattaaatgtaaagccgctgttctgtgggaagtaaaaaagcccttcagcattgaggatgtcgaagttgcccctccgaaggcttacgaagtgcgtataaaaatggtggcggtgggcatctgccataccgacgaccatgtagtgtccggaaacctcgtgacacccctgcctgtgattctgggccatgaagccgcaggaattgtcgagtccgtaggtgagggagtgactaccgtaaagcccggtgataaggttattccgctctttacaccgcagtgcgggaaatgtagggtgtgtaagaacccagaatccaactattgccttaaaaacgacctgggcaatcctcgcggtacattacaagatggtaccagacggttcacttgcaggggcaaaccaatccaccattttctgggcacctcaacctttagccagtacacagtcgtggacgagaacgccgtagctaagatcgatgctgctagcccgctggagaaagtctgtcttattggctgcggcttctccactggctacggatcagcagtcaatgtggctaaggtcacccccggaagtacatgcgcagttttcgggttaggtggtgtcggcctgtctgccgtgatgggctgtaaggctgctggggcagcgcgaatcatcgcagtggacatcaacaaagataagttcgccaaggcaaaggagctgggtgccaccgagtgcattaatccccaagattataaaaaacctatacaggaagtgctgaaggaaatgactgacggtggtgtggacttctcattcgaggtcatcgggagattggacaccatgatggcttcgctgttgtgctgccacgaggcatgcgggaccagcgtaatcgtcggggttccacccgcttcacagaatctgtcgattaatccaatgcttctcttgactggcagaacctggaagggcgctgtgtacgggggattcaagtccaaagagggaatacctaagctggtggctgattttatggctaagaagttttctctggacgctctgatcacccacgtgttgccatttgagaagattaatgaggggttcgatctgctccattctgggaagtcaattagaacggtgctcactttttag

SEQ ID NO: 213957 - DNA, 1008 bp, Artificial Sequence
  Description of Artificial Sequence: Synthetic coding sequence
atggtggcagttggcatttgtcacacggacgaccatgtggtatctggaaatctggtgactccgcttcccgttatacttggccacgaggccgcaggtatagtcgagtccgtgggcgaaggagtcacaacagtgaagcctggcgataaggtcatccctctatttaccccgcaatgcgggaagtgcagggtctgtaagaatccggaatcaaattactgtctgaagaatgatctggggaatcccaggggaactcttcaagacggaacccgcagattcacttgcagaggcaagcccattcatcactttcttggcacatccaccttctctcagtatacagtggtggatgagaatgctgtcgcaaagatcgacgccgcatccccgctcgagaaagtgtgcctgattggatgcggatttagtaccggatacggtagtgccgtgaatgtggctaaggtgacaccaggcagtacatgcgcagtgtttggtctggggggagtcggacttagtgctgtgatggggtgcaaggcagccggtgccgctcggatcatcgcggtggacattaacaaggataagtttgcaaaggcaaaagagctcggcgcaacagagtgcattaatcctcaggattacaaaaagccgatacaggaagtcctgaaggagatgacagacggaggtgtcgatttctcctttgaggtgatcgggagactggataccatgatggcatccctgttatgttgccacgaagcttgcggaacaagcgtcatcgtgggcgtgcctcccgcaagccagaaccttagtataaacccaatgttactgctgactggaaggacgtggaagggcgctgtttatggcggtttcaagtctaaagaggggatccccaaacttgtggccgactttatggctaagaaattctctctggacgcgctaataacccatgtgctgccttttgagaaaataaacgaaggatttgatctgctgcattctggtaagagcattcgcacagttctgacattctag

SEQ ID NO: 213958 - DNA, 1089 bp, Artificial Sequence
  Description of Artificial Sequence: Synthetic coding sequence
atgagcactgctggaaaggtcatcaaatgcaaagccgctgtcctgtgggaagtgaaaaagcccttctctattgaggacgtcgaagtggcaccccctaaggcctacgaagttcgaattaagatggtcgctgtgggaatctgtcacacggacgatcatgttgtgtcagggaatctggttactccactgcccgttattcttggccatgaggccgctggcattgttgagagcgtcggagaaggcgtgacgactgtgaaacctggggataaagtcattcccctgttcactcctcagtgcggtaagtgtcgggtttgcaagaacccagaatcaaactactgcctgaagaacgatctcggcaatcccagaggaaagccgattcatcattttcttggcacatcgactttctcacaatatacagtggtggacgagaacgcagtggccaagattgacgccgcatctcctctagagaaagtgtgcctaatcggatgtgggttcagcacaggttatggatccgccgtgaatgttgccaaagtgacacctggcagtacttgcgcagtttttgggttaggcggagtgggtcttagcgcagtgatgggttgtaaagctgcaggagctgcgaggatcattgctgtggatataaataaggacaagttcgcgaaagctaaggagctgggggctacagaatgtattaacccacaagactataaaaaacccattcaggaagtactgaaggagatgacagacggaggggtggattttagctttgaggtgatagggaggctggacactatgatggcatctctactttgttgccatgaggcatgtgggacctctgttatcgttggcgtgcccccagcctctcagaacctgagcatcaatcctatgctgttgctgacaggtaggacctggaaaggagcggtgtatgggggttttaagagtaaggagggcatccccaaacttgttgcagatttcatggcaaaaaagttttcacttgacgcactgattacgcacgtactcccgtttgaaaagatcaatgaagggttcgacctgctgcattctggcaaatctattaggacggtcctgaccttctag

SEQ ID NO: 213959 - DNA, 1143 bp, Artificial Sequence
  Description of Artificial Sequence: Synthetic coding sequence
atgggcaccaaaggcaaggtcattaagtgcaaggctgccatcgcctgggaagccggaaagccactgtgcatcgaagaggtggaggtggcaccacctaaggcccatgaagtccggattcagatcattgctaccagcctatgtcacacagacgcgactgtcattgactccaaattcgagggtcttgctttccctgtgatcgtgggccacgaggccgctggtattgtcgagagcattggcccaggggtcacgaacgtgaaaccaggagataaggtgattccattatacgcccctctgtgcagaaaatgtaagttctgtctgagccctctcactaacctctgcggcaagattagcaacttaaagtccccggcatctgatcagcagctcatggaagataaaacatccaggttcacatgtaagggtaaacctgtgtaccacttttttggtacaagcactttcagccagtatactgtggtaagtgatattaacctggcaaaaattgatgatgatgcaaatttggagagggtctgcctgctagggtgtggcttttccaccggatatggtgcagccatcaataacgccaaagtcacccccggatcaacttgtgctgtctttgggctcgggggtgtgggcctcagtgcagttatgggctgtaaagcagccggtgcctctcgaatcattgggatagacattaattccgagaagtttgtaaaggctaaagccctgggagctactgattgcctcaatccaagggaccttcacaaaccaattcaggaggtcatcatcgagctcaccaaggggggagtcgattttgccctggattgcgcaggcggatcggaaactatgaaagcggctcttgattgcacgactgccggatggggctcttgtacattcattggggtggccgctgggtccaagggcctgacaattttccccgaagaattgattataggcagaacaatcaatggcacattcttcggcggttggaaaagcgtagactcaattcccaagctagtcaccgactacaagaataagaagtttaacctcgacgcactggtgactcacactttgccatttgacaagatctccgaagccttcgacctgatgaatcaaggtaagtccgttcgcacaattctaattttctag

SEQ ID NO: 213960 - DNA, 1200 bp, Artificial Sequence
  Description of Artificial Sequence: Synthetic coding sequence
atgcttgtcaggggccctcacttcgaactgcagagatgcaagacccatctgttctcttctaattatctcacacaggtcattaaatgcaaggccgcaattgcatgggaggccggaaagcctctgtgtattgaagaggtagaggtagcgcctcctaaggcacatgaggtgcggatacagattatcgcaaccagcctgtgccatactgacgcgaccgtgatcgattccaagttcgagggactggccttcccagtaatagtgggccacgaggcggctggaatcgttgaatctataggtcctggcgtcacaaatgtgaaaccaggggacaaggtgataccactttacgctcccttgtgccgtaaatgcaaattctgcctgagccccctcactaatctgtgtggtaagatcagcaatttgaaatctcccgcatccgaccagcagctgatggaggataagaccagtcgctttacctgcaaagggaagcccgtgtaccatttcttcgggacaagcactttctcccagtacaccgtcgtgtcagatatcaacttagccaaaatcgatgacgacgctaatctcgaacgtgtgtgcctactgggttgtggattcagcactggctatggggcagcaatcaacaatgcgaaggtgacccctgggagtacatgtgcagtcttcggacttggcggtgtcgggctgtccgccgtgatgggttgcaaagccgcaggtgcgagcagaataatcggtatcgatattaacagcgaaaaattcgttaaagcgaaggctctcggagccactgactgtttaaatccacgtgacctgcataagcccatccaggaggttattatcgagctgaccaagggcggagttgattttgccctggattgtgcaggcggttctgagacaatgaaggccgctctcgactgcactaccgctggctggggtagctgtacttttatcggagtggctgctggcagtaaaggccttactatattcccagaagaactcattattggcaggacaattaatgggactttctttgggggatggaagtcggtagacagcattcccaagttggtgactgactacaagaataaaaagtttaaccttgacgccctggtgacccacaccctgccttttgataagatctccgaggccttcgatcttatgaaccagggaaagagcgtccggacgattttgatcttctag

SEQ ID NO: 213961 - DNA, 1125 bp, Artificial Sequence
  Description of Artificial Sequence: Synthetic coding sequence
atggctaatgaggtgatcaagtgcaaggccgctgttgcatgggaggctggcaaacctctgtctattgaggagatcgaggtggcaccccctaaggcacacgaggtgcggatcaagatcatcgccactgctgtgtgtcatacagatgcatatacactgtccggagccgaccccgagggttgctttccagtaatcctcggacacgagggggcaggcatcgtcgagtctgtgggcgagggggtgaccaaattaaaggcgggagacaccgtaattccactgtacatcccacagtgtggcgaatgcaagttttgccttaatcccaaaactaatctgtgccaaaaaatccgtgtgactcagggaaaagggctcatgccagacggcacctcccggtttacatgcaagggcaagactatccttcactatatgggcacatccacattttctgagtacactgttgtggcagatatttctgttgcaaagatcgatcctctggccccactagacaaggtttgtctgctgggatgtggtatcagtaccggctacggagctgcggtgaacacggccaagttagaaccaggatccgtttgtgccgtttttggcctagggggtgtcgggctggccgtgatcatgggctgtaaggtcgcaggggctagccgcataatcggtgtggacatcaataaagacaaatttgccagagctaaagaattcggggctaccgagtgcatcaaccctcaggacttttctaaacccatccaggaagtgctcattgagatgacagatggtggcgttgactacagttttgaatgtatcggcaatgtcaaggtcatgcgtgccgctctggaagcatgccacaagggatggggcgttagtgtggtggtgggagtcgctgcctcaggggaagaaatcgcgacgcggcctttccaattagtcacaggtcgcacatggaaggggacggccttcggcggatggaagtcggtggaatctgtgccaaaacttgtgtccgaatatatgtctaagaagattaaagtggacgaattcgtgacccacaatctttctttcgacgaaatcaacaaggcctttgaattgatgcacagcggtaagagcattcggactgttgtgaagatctag

SEQ ID NO: 213962 - DNA, 1107 bp, Artificial Sequence
  Description of Artificial Sequence: Synthetic coding sequence
atgtgtaccaccgggcaggttattcggtgtaaagccgctatcctttggaagcctggcgcacctttctcaattgaggaggttgaggttgcccctccgaaggccaaagaggttagaatcaaggtggttgctacgggattgtgcgggacagaaatgaaggtcctgggctccaaacatttggacctactctatccaactatcctggggcacgagggcgcaggcattgtcgagtctattggagaaggggtttctaccgtcaagcccggagataaggtcatcacactgtttctgccgcagtgcggggaatgcaccagctgcttaaactcagagggaaatttctgcatccagttcaagcagtctaagacacaacttatgagtgatggtacctcccgatttacatgtaaggggaaatccatataccacttcgggaacacgagcaccttctgcgaatatacagtcattaaggagatttctgttgccaagatcgacgctgtcgcaccgctggaaaaggtgtgtctcatctcctgtggattttctaccggctttggcgctgccatcaataccgcaaaggtgacccccggttctacctgcgccgtgtttggtcttggcggtgtaggcttgagtgtcgtcatgggatgcaaagctgccggtgcagcgaggattatcggagtggatgtgaacaaagagaagtttaagaaagcccaggaattgggagcgactgagtgcctcaaccctcaggacctgaagaagcctatccaagaggtgctgtttgatatgacggatgccggaatcgatttctgcttcgaggctataggcaatttggacgtcctggcagccgcactcgcgagttgcaacgaaagctacggagtttgtgtagtagtgggtgtgctccctgcctctgtacagctcaaaataagtggacagctgtttttctcgggaagaagccttaagggctcagtcttcggagggtggaaaagcaggcagcacatcccgaagttggttgctgactatatggcagaaaagctgaacctggaccccctgataactcacacattaaacctggataagatcaacgaagcagtggaacttatgaaaacaggcaaatggtag

SEQ ID NO: 213963 - DNA, 1128 bp, Artificial Sequence
  Description of Artificial Sequence: Synthetic coding sequence
atgtgcaccaccggccaggtgattcgttgcaaagcagctatcttatggaagccgggagcaccttttagcattgaggaggtggaggtcgcgcctcccaaggctaaagaagttaggatcaaagtggtggcgactgggctctgcggcactgagatgaaggtgcttggttccaagcatctggatctgctttaccctaccatcctgggacatgaaggtgctgggatagtggagagtattggggagggcgtctcgacggttaagcccggagataaagtcatcacactcttccttcctcaatgcggagaatgcacttcttgccttaactccgaaggtaatttctgcatccaattcaagcagtccaaaacccagctgatgagtgacggcacctccagattcacctgtaagggcaaatctatatatcatttcggcaacacctctaccttctgcgagtatacagtgattaaagaaatcagcgtcgctaaaatcgacgccgttgcccctttagaaaaggtatgccttatatcgtgcggcttttctactggtttcggcgctgctattaataccgccaaggtgacacctggcagcacatgcgcagtgttcgggctcggcggagtgggcctcagcgttgttatggggtgcaaggcggcaggagccgcacgtatcatcggagtcgacgtgaataaggagaagttcaagaaggcccaggagctgggcgctacggaatgtctgaatcctcaggacttgaaaaagcctatacaggaagtcctttttgatatgactgatgctggaattgacttctgtttcgaggcaattggcaacctcgatgttttggcggcagccttggcttcctgtaatgaatcttatggagtttgcgtggtggtgggggtcctcccagcttccgttcagctgaaaatcagcgggcagctctttttctctgggaggtcgctcaagggatccgtgttcggtgggtggaaatctcgacagcatatcccaaaactcgtcgcagattatatggccgagaagctaaaccttgacccactgattacacacacgttaaacttggataagatcaatgaggccgtagaattaatgaaaactggcaagtgcatccgctgtattttgttgctgtag

SEQ ID NO: 213964 - DNA, 501 bp, Artificial Sequence
  Description of Artificial Sequence: Synthetic coding sequence
atgggctgtaaggcagctggagccgctcgtattataggagttgacgtgaataaagagaagtttaaaaaggcgcaagagttgggcgctaccgagtgtctgaacccccaggacctgaaaaaaccaatccaggaagtactgtttgatatgaccgacgcagggatcgatttctgtttcgaagcgattggaaatttggatgtcctggcagccgctttggcctcctgtaatgagagttacggagtgtgcgttgtggtcggtgtattgcctgccagcgtccagctcaagatatcagggcagctgttctttagcggtcgcagcctcaaggggagtgtcttcggaggctggaaaagtagacagcacatccctaagctggttgcagactacatggctgagaaactcaacttagacccactgatcacacacaccctcaatctggataagattaatgaagctgtagagctgatgaagactggaaaatgcatacgatgcattcttctactatag

SEQ ID NO: 213965 - DNA, 1068 bp, Artificial Sequence
  Description of Artificial Sequence: Synthetic coding sequence
atggaacccgagaaacagactgaaatctcagagttcttccttcagggtttatccgagaagcctgaacaccagactctcctcttcactatgtttcttagtacctacctcgtgacaatcataggcaatgcattaatcattctggctattataactgattctcacctgcacacccccatgtatttctttcttttcaaccttagtctggtcgacacattgctgtcctcaaccaccgtcccgaagatgttggccaacatccaggctcaatcccgggcaatcccgtttgtcgggtgcctgactcagatgtatgcatttcacttgttcggcacgatggattcttttctactggctgtcatggccatcgacagatttgtggccatagttcatccccaacggtacctcgtgcttatgtgctcacccgtttgcggcctgttgctgggagcctcctggatgatcacaaatctgcaatccttgatccatacttgcctgatggcccagctgacattttgtgccggttcagagattagccacttcttttgcgacctcatgcctctgcttaagctgagcggctctgacacacacacgaatgagctggtgatcttcgccttcggcatcgtcgtaggcacatcacctttcagttgcatattattgtcttatatacgcatattttggaccgtgttcaagatcccatctaccagaggaaagtggaaggccttctcaacatgcggcctgcatctgaccgtggtgtccctcagctacgggaccatctttgcagtgtatctccaaccgacttctccatcatccagccagaaggataaagcagcagccttaatgtgtggggtttttattcccatgcttaatccattcatttattccattcggaataaagacatgaaagccgctctggggaagctcataggtaaggttgctgttccctgtcctcgcccagagcagctgctagatgtttatcatgtcccaggctcactgttagctgctcgcgacacggaaatgcatcctatcccctaccccggaggggtgcaatcccttgcgggaaatcgggacatggaatag

SEQ ID NO: 213966 - DNA, 1125 bp, Artificial Sequence
  Description of Artificial Sequence: Synthetic coding sequence
atgggcaccgcaggcaaggtaattaaatgcaaggccgctgtgttgtgggaacaaaaacagcccttttccatagaggaaattgaagtggcacctccaaagaccaaagaagtgcggattaaaatcctggctaccggaatttgccgcaccgatgaccacgttattaagggtaccatggtttcaaagtttccggtcattgtgggccatgaagccaccggcatagtggagagtatcggagaaggagtgacgacagtaaaacctggcgataaagtgatcccactgttcttacctcagtgtagagagtgcaatgcctgtcgtaacccagacgggaacctgtgtatcaggagcgacatcaccggaaggggagtgctggcggatggcacaactagattcacctgcaagggtaagccagtgcaccatttcatgaacactagcaccttcacagagtacactgtggtcgacgaatcgagtgtggccaagatcgacgatgcagctccacctgagaaggtctgcctgattgggtgtggcttctctaccggatatggggctgccgtgaaaaccggaaaggttaagcctggatctacttgcgtagttttcgggcttggtggcgtggggctgagcgttattatgggatgtaagtcggccggtgcctctcgtattataggaatagatctgaataaggacaagtttgagaaggctatggcagttggcgctacggagtgcatcagccctaaggattcaaccaagcccatttctgaggtcctgtcggaaatgacaggcaataacgtgggatacacctttgaggtaattggacacctcgagacaatgatagatgccctcgccagctgtcacatgaattacggcacttcggtggttgtgggggtccccccatccgcgaagatgctcacatatgaccctatgctgttgttcactggcagaacttggaagggctgtgtgttcgggggtctaaagagcagagatgatgtccctaaactggtaaccgagttcctggcgaagaaatttgatctagaccaacttatcactcacgtactgcccttcaagaagatctccgaaggctttgagctattaaacagcgggcagtccattcgcaccgtactaacattttag

SEQ ID NO: 213967 - DNA, 1185 bp, Artificial Sequence
  Description of Artificial Sequence: Synthetic coding sequence
atgaaatgcttagtgagccgacacacggtacgagaaacgctcgatatggtgtttcagaggatgtcggtcgaagcgggagtgatcaaatgtaaggccgctgtcctttgggaacaaaagcaacccttttcgattgaggagattgaggtagcacctcctaagacaaaggaggtgcgaataaaaatcctggctactggcatttgccgcaccgatgaccacgtgatcaaaggcacgatggtgtcgaagtttccagttatcgtggggcatgaggcaaccggcatcgtggagagtattggggagggcgtcacaacagtgaaaccgggtgacaaggtgatcccactattcctgccacagtgtcgtgagtgcaacgcctgccgaaacccagacggcaatctgtgtattagaagtgacatcaccggccgaggggttctggccgacggcactaccaggtttacatgtaaggggaaaccagtccaccacttcatgaatacctcaacttttaccgaatacactgtggtggatgaatcatccgtcgctaaaatcgacgacgcggcaccacctgaaaaggtgtgtcttattggctgtggcttttctaccggctacggcgcagcggtcaagaccgggaaagtgaaacctggaagcacatgcgttgtatttgggctcgggggagttggattatctgtgatcatgggatgcaagtcagcgggtgccagcagaatcattgggatagatttgaataaagataagtttgaaaaagcaatggcagtgggagctactgaatgcattagtcccaaggattccactaaacccatttcagaagtgctcagtgaaatgacaggcaataatgtgggctacaccttcgaggtaatcggacacctggagactatgatagacgccctcgcatcgtgtcatatgaactacgggaccagcgtggttgtgggagtacctccgagcgccaagatgctcacttatgatccgatgctcctcttcaccggacgcacctggaagggctgcgtttttgggggattgaaatccagagacgatgtgcccaagctcgtaactgaattcctggctaagaagttcgacttagaccagttaattacgcacgtcctgccattcaaaaagattagcgaaggcttcgagttgttgaacagcggccagagtatccgcaccgtcttgactttctag

SEQ ID NO: 213968 - DNA, 954 bp, Artificial Sequence
  Description of Artificial Sequence: Synthetic coding sequence
atggtgagtaagttcccagtgatagtggggcacgaagcaaccggtatcgtggaatcaataggcgagggagtgacaacagtgaagcctggggataaagtgatacctctgtttctgcctcaatgtcgggaatgcaacgcatgtcggaatccagatgggaacttgtgcatccgcagtgatataacggggaggggtgtgctggctgacggaactactcggtttacttgcaagggaaagcctgtgcatcacttcatgaataccagtacatttacagaatacaccgtagtcgacgaatctagtgtggctaagattgacgatgcagcgcctcccgagaaggtgtgtttaattggctgtggtttctccaccgggtacggcgcagctgtaaagactggcaaggtgaaacccggatctacctgcgttgtgttcggcctgggcggagtgggactgtcagtaataatgggatgtaagagcgcaggcgcttcccgcatcattggcatcgaccttaataaagataagttcgagaaggcaatggccgtgggcgctaccgagtgcatctctcctaaagattccactaaacctatttctgaagttctgagcgagatgacaggaaacaacgtaggttatacttttgaggtaatcggacatctggaaactatgatagatgcactcgcctcatgtcatatgaattatggcacctccgtagttgtgggggtgcctcctagcgcaaagatgctgacgtatgacccgatgctccttttcacaggacgaacatggaaaggatgcgtgtttggcggtctgaagtcgcgggatgacgtccccaaactcgtgaccgaattcttagctaagaagtttgatctcgaccaactcataacacacgtgcttcccttcaagaaaatttccgagggcttcgaattactgaactctgggcagtcaatccggacagtgctgaccttctag

SEQ ID NO: 213969 - DNA, 912 bp, Artificial Sequence
  Description of Artificial Sequence: Synthetic coding sequence
atggccgctgcagctagagctcgcgtggcctacttgctcaggcagctgcagcgagccgcttgccaatgtccgacgcattctcacacctacagtcaggcgcctgggctgtccccctctggtaagaccacagactacgctttcgaaatggccgtcagcaacatcaggtacggtgcggcagtcactaaggaggtaggcatggacctcaagaacatgggcgctaagaatgtgtgtcttatgaccgacaagaacctgtccaaactacctccggttcaggttgctatggactctttagtgaagaatggcattcctttcacagtctacgacaacgtgagggtggaacccactgatagcagcttcatggaagcaattgagttcgcgcagaagggagcttttgacgcctatgttgcagtggggggtgggtcaacaatggacacctgcaaggccgcaaatctgtatgcttcaagtccccacagcgacttcctggactacgtcagcgcccctatcggaaagggaaaaccagttagtgttcctctcaagcccctaattgccgtccccaccactagcggcactggaagcgagacaactggagtcgcaatattcgattatgagcatctgaaggtgaaaatcggtataactagccgcgcaatcaaacccaccctggggctgatcgaccccttacacactctccacatgccagcacgagttgtggcaaattccgggttcgatgtgctatgtcacgctctcgaatcttataccacactaccttaccatcttcggtctccttgcccctccaaccctatcacccgaccagcataccaaggcagtaacccaatcagcgatatatgggccattcacgcactcaggatagtcgccaaatacctgaagagagccgtgaacagtaccgacaaatag

SEQ ID NO: 213970 - DNA, 1404 bp, Artificial Sequence
  Description of Artificial Sequence: Synthetic coding sequence
atggcggctgcagctcgcgctcgggtagcctatctgttgcggcagctccagcgcgcagcatgtcagtgccctactcattcccatacttacagccaggcccctggcctatcaccgtccggcaaaaccactgactatgctttcgagatggcagtctctaatatccgatatggcgctgctgtcaccaaagaagttggaatggacctgaaaaatatgggagcgaagaatgtgtgcctcatgaccgataaaaatctgagcaagttgccccctgtccaagttgctatggattcattagtcaagaacggcatcccattcaccgtctacgataatgtgagggtcgagcctaccgattcaagctttatggaggcaatagaattcgcccagaagggagccttcgatgcttatgtggccgtgggcggaggcagtacaatggacacttgtaaggccgcaaatctgtatgcctcttccccccatagcgatttcctggactacgtctcagcgccaatcggcaaagggaaaccagtatctgttcctcttaaaccacttattgccgttcccacaacaagcggaactggttcagaaacgacgggtgtggctattttcgactatgagcacctgaaagtgaagatagggatcacaagcagagcaataaagcccaccctgggactgatagatcctctccacactttacatatgcctgcacgggtagttgctaacagtggatttgatgttttgtgtcacgcactggagtcttataccacactgccataccacttacgatcaccatgtcccagtaatcctataacgagacccgcttaccagggatccaaccccataagcgatatttgggccattcacgctctccgaatcgtggccaaatacctgaaacgagctgtcagaaaccccgatgacctggaggctaggtctcatatgcatctggccagtgctttcgccggaatcggtttcggaaatgcaggagtgcatttgtgccatggcatgtcatatcccatcagcggattagtgaagatgtataaagccaaggattacaacgtcgatcacccgctggtcccacacggtttatcggtggtgctcacaagcccggcagttttcacttttactgctcagatgttcccagagcgccatttagaaatggccgagatcctcggggctgacacgaggaccgccagaatccaggatgctggattggttctggcagacactctgaggaagttcctgttcgacctcgacgtggacgacggcttggctgccgtgggatacagcaaagcggatattcctgctcttgttaaagggaccttgcctcaggagagagtaacaaagctcgcaccatgcccacaatctgaggaagacctggccgcattgtttgaggcgtccatgaagctgtattag

SEQ ID NO: 213971 - DNA, 2406 bp, Artificial Sequence
  Description of Artificial Sequence: Synthetic coding sequence
atgaaaatcgctgttatcggccagtccctgtttggacaagaggtctactgtcacctgcgtaaggaaggacatgaggtggtgggcgtttttactgtgcccgacaaggacggcaaggccgatccactgggcttggaagccgagaaagacggagtgccagtatttaagtactctcgctggagagctaaaggccaagctctaccggacgttgtagccaagtatcaagctctcggggcagagctgaacgttctcccgttctgttctcagtttatccctatggagattatctccgcccctcgccacgggtctattatctatcatccaagcctgttacctagacacaggggagcctctgcaatccataactggatccgcggaaatgacaaggttcctggggcatggaccgaggcatgtgagcagaagttgacattctttaactcaactttgaatacctctggtttggtcccggaaggggacgccctcccaatccccggagctcaccgacctggggtagtcacaaaagctggcttaatcctatttgggaacgatgacaagatgctgctggtaaagaacatacagttagaggacggcaaaatgatcctggcctcgaattttttcaaaggagcagcctcatctgtgttggaattgactgaggccgagctcgtgaccgccgaggcagtgaggagcgtttggcaacgcatcctgcctaaggtgctcgaggtggaggatagcaccgacttcttcaaaagcggggctgcatcagtcgacgttgtccgacttgtggaagaggtgaaagagttgtgcgacgggcttgaactggagaacgaggacgtctacatggcctccacatttggagactttattcaattactcgttcggaagctccgcggtgacgatgaggaaggggagtgtagcatagactacgtggagatggctgtcaataagagaaccgttagaatgccccatcagctgtttattgggggagagttcgtagatgctgaaggcgcaaaaaccagcgagaccatcaatccgaccgacggttccgtgatatgtcaggtcagcttggctcaggtaacagacgtcgacaaggccgtagctgctgctaaggatgccttcgagaacgggagatggggaaagatcagcgccagagatcgcggtcgccttatgtacagactcgccgacctgatggagcagcaccaggaagagttggctaccattgaagctcttgatgccggtgccgtgtacacattagcgctgaagacacatgtcggcatgagcatccagacattccgctacttcgccggttggtgtgacaagatccagggttctaccatacccattaatcaggcccgtcccaatcgtaacctgacattaaccaggaaagagccagtcggcgtgtgtggaatcattataccatggaactatccattaatgatgttgtcctggaagactgctgcttgtctggcggcaggcaacaccgtggtgatcaaaccagctcaggtgactcccctgaccgcactgaaattcgctgaactaactttaaaggcaggcattcccaagggtgtggtcaatgtcctgccagggagtgggtcgctcgttggacaaaggctgtcagaccatcctgatgtgaggaagattggtttcacaggctccactgaggtcggtaagcacattatgaaatcttgtgccataagcaacgtcaagaaggtgagtcttgagttgggcggaaagtccccccttattatctttgcggactgtgacctcaacaaggcggtacagatgggcatgagctcagtgttttttaataaaggggagaattgtattgccgcaggacggctgttcgtggaagacagcattcatgatgagttcgtccggagagtggtcgaggaagtgaggaaaatgaaggtgggcaatccattggacagagacactgatcacggacctcagaatcatcacgcacatttagtaaagctgatggagtactgtcagcacggggtcaaagagggcgctaccttggtttgcggtggaaaccaggtgcccaggccaggatttttcttcgagcccacggtcttcacagacgttgaggaccatatgtttatcgcgaaagaggagtcattcggtcctgtgatgatcataagcagatttgccgacggagacctggacgcagttctttcccgggctaacgccaccgaattcgggctcgcctcaggagtctttactcgcgacatcaataaagccctgtatgtgtcagacaaactgcaggccggaacagtctttgtgaacacgtacaacaagacagacgttgcagcaccgttcggtgggttcaaacaatccggttttgggaaggacctcggagaagctgcactgaacgagtatctccgggttaagactgtgacctttgagtattag

SEQ ID NO: 213972 - DNA, 1506 bp, Artificial Sequence
  Description of Artificial Sequence: Synthetic coding sequence
atgtcgagcagtggaactcctgatctgccagtcttactcaccgatttgaagatccagtacacaaagatttttatcaacaacgaatggcacgactcagtcagcggtaagaaattccctgtgttcaatcccgcaactgaagaggagctgtgccaggtagaggagggtgataaggaggatgtcgacaaggcggtgaaggcagcaagacaagcatttcagattggttctccctggagaactatggatgcttccgagcggggacgactgttatataaattagcagacttgatagaaagagaccgtttgctgctggccaccatggagagcatgaacggaggtaaactgtattcaaacgcctatctcaacgacctcgcaggatgcattaaaaccctcaggtactgcgctggatgggccgacaagatccagggacggaccattcccattgacggcaacttcttcacatatactaggcacgagccaataggcgtatgtgggcagattattccatggaattttcctctagttatgctgatttggaaaattggaccagctctcagctgtggaaacaccgtggtcgtcaagccagccgaacagacgcctcttaccgccttacacgtggccagcttgatcaaagaggccggatttccacccggagtcgtgaacattgttccagggtacggacctactgcaggagccgcaattagcagccacatggatattgataaggtggccttcacggggagtactgaggtcggcaaactgattaaagaagcggctggaaaatccaatctcaagcgtgtcacactggagctcgggggtaagtctccatgtatagtgctggccgatgctgacctcgacaacgccgtggagttcgctcatcacggcgtattttatcatcagggtcagtgttgtatcgctgcctcccgtatttttgtggaggagagcatttacgacgaatttgttcggaggagcgtggaacgtgccaagaagtacattttaggtaatccgctcacaccgggagtcacccagggaccacagatcgataaggagcagtatgacaagatcctcgacctgatcgagtctggaaagaaagagggtgcaaagctagaatgcggcggaggtccatggggaaacaagggatattttgtgcagccgacagttttcagcaatgtgactgacgaaatgagaatcgctaaagaggagatcttcggcccagtgcagcagatcatgaagttcaagtccctggatgacgtgatcaaaagggctaataacacgttctatgggctctcagcgggtgtctttaccaaagatattgataaggctatcaccattagctccgccctccaagccggaacggtctgggtaaactgttatggcgtggtgagtgcacaatgtcccttcggtggcttcaaaatgagtggaaacggcagggagctgggggaatacggctttcacgagtacaccgaggtcaaaactgtcacggtaaagataagccagaagaatagttag

SEQ ID NO: 213973 - DNA, 693 bp, Artificial Sequence
  Description of Artificial Sequence: Synthetic coding sequence
atgagtagctccggcacccctgacctgccagtcctcctgaccgacttgaaaatacagtacacaaaaatattcattaacaacgaatggcatgacagtgtcagcgggaaaaagttcccggtgttcaaccctgcaaccgaagaggaactctgtcaggtggaggaaggggataaggaggacgtcgacaaggctgtaaaggctgcaaggcaggcttttcaaatcgggagtccctggagaaccatggacgcaagcgagcgagggaggctactttacaagctggcggatctgatcgagagagaccggttgcttctggctaccatggaaagcatgaacggcggtaagctgtattctaacgcatacttgaacgatctcgcagggtgtattaaaactctgagatattgtgctggctgggcagataaaatccaggggagaacaattcccatagatggcaatttttttacctacacgcgccacgagcccatcggggtttgcggtcagatcatcccttggaatttcccactagtcatgctgatctggaagatcggacccgcactgagctgtggcaatactgtggttgtaaagccagcagagcagacacccctgacggcccttcacgtcgccagcctgattaaggaagcagggtttccacctggtgtcgttaacatagttcctgggtatggagcttcagtggtctag

SEQ ID NO: 213974 - DNA, 717 bp, Artificial Sequence
  Description of Artificial Sequence: Synthetic coding sequence
atgtcatcctccggcacccccgatctccccgtgctgctcaccgatctcaagatccagtacaccaagattttcattaacaacgaatggcacgatagtgtgagcggcaagaaattccctgtgtttaaccccgctaccgaggaagagctgtgccaggtggaggaaggtgataaggaggatgtggataaggcggtgaaggcagctcgacaagcatttcagattggatctccttggcgaaccatggatgccagcgagcggggacggctactctataagctggctgaccttatcgagcgagacagactgttgctagctaccatggaaagcatgaatgggggaaagttgtactccaatgcttatttgaatgacctcgcgggatgcattaaaactctgaggtactgcgccggttgggcagataaaattcagggcagaaccatccctatagacggcaatttctttacatatacgcgacacgagcccattggggtctgcggacaaatcatcccctggaacttcccactggtgatgctgatctggaagatcggtcccgcactttcctgtggaaacacagtagtggtgaagcccgctgagcagactcccctgacagcattgcatgtggcttcacttattaaagaggccggtttcccacctggagttgtgaacatcgtgcccggttacgggccaacggccggagccgcaatcagctcccacatggattag

SEQ ID NO: 213975 - DNA, 990 bp, Artificial Sequence
  Description of Artificial Sequence: Synthetic coding sequence
attgccgaaccagtgacctgcgtgcctggcgctgaaagcgagatgtctagctcaggtacccccgacctgcctgtgctgctcactgatcttaagatccaatatactaagatctttattaataacgagtggcatgatagcgtgtctggaaagaagttccctgtgttcaaccctgccactgaagaggaactctgtcaagtagaagagggcgataaagaggacgtggataaggcggtaaaggctgcacggcaggcctttcagatcggtagcccgtggcgcactatggacgcatccgagcgagggcgactcctgtataaactcgcagatctcattgagcgcgaccgcctcttgctggccactatggagagcatgaacggaggaaagctgtactcaaatgcatatcttaatgacctcgcagggtgtatcaagacacttagatactgcgctggatgggctgataaaattcagggccgtacgattcctatagacgggaatttttttacctatacccgccacgagcctattggggtgtgtggacagatcatcccctggaattttcctttggttatgctgatctggaagataggaccagcattgagctgtggtaacacagtcgtcgttaagcctgctgagcaaacgcccctgaccgctttacatgtggcttccctcattaaagaggcagggttccccccaggagttgttaatattgtcccaggctacggacctactgctggggcagccatatcttcgcatatggatatagataaagtggcttttacaggcagtaccgaggtcggtaagctgattaaggaagctgcaggaaagagcaacctgaagcgcgtgacacttgagctcggaggaaagtctccgtgtatcgtgctggcagatgcagacctagataacgccgtggagtttgcacatcatggcgtgttctaccaccaggggcagtgttgtatagctgcaagccgattctgcggcaggataaatttgtag

SEQ ID NO: 213976 - DNA, 612 bp, Artificial Sequence
  Description of Artificial Sequence: Synthetic coding sequence
atgtcttcgtctggaaccccagatctcccggtgttgctgaccgacctaaaaattcagtacacaaaaatctttatcaacaacgagtggcatgacagtgtgtccggcaagaaattcccggtgtttaatcccgcaactgaagaggagttgtgccaggttgaagagggagataaagaggacgtggacaaggccgtgaaggccgcaagacaagccttccagatcggctcaccttggcggactatggacgcttccgaacgtggccgtctgctgtataagttagccgatctgattgaaagagacaggcttcttctggctacgatggaatccatgaacggagggaaactctacagtaacgcctatctcaacgatttggctggttgcatcaagacccttaggtactgcgcaggctgggctgataaaattcaaggcagaacaatcccaattgatggcaattttttcacctacactcgccatgagcctattggcgtttgtggtcaaatcatcccctggaattttccactcgtgatgttgatctggaaaatcggcccagctctgtcttgcggcaacaccgtcgtcgtcaagcctgctgagcagacacccctgacagctctgtag

SEQ ID NO: 213977 - DNA, 1557 bp, Artificial Sequence
  Description of Artificial Sequence: Synthetic coding sequence
atgacatccagtaagatcgaaatgcctggggaggttaaggcagatccggcagccctcatggcctcactgcacctgctgccgtcccccacccccaatctcgagattaagtataccaaaatctttatcaataatgagtggcagaattcagaatctgggcgtgtgttccctgtgtacaatcctgcgaccggggaacaggtatgtgaggtccaggaggctgataaggcagacattgacaaggctgtgcaagctgcgcgtctggctttctcgctcggttccgtgtggcgacggatggacgctagcgagcgcggaaggttgttggataaactggccgatctcgtggagcgggaccgcgctgtattagccactatggagtctttgaacgggggaaagcctttcctccaggccttttacgttgacctccaaggcgtgatcaaaaccttcagatattacgctggatgggccgataagattcacgggatgacaattcctgtcgacggcgactactttactttcactcgacacgagccaatcggcgtgtgcggccagattattccttggaactttccgttgctgatgtttgcctggaagatcgccccagctctctgctgtgggaacaccgtggtgatcaagcccgcagaacagacaccactctcagccttgtatatgggcgctctgattaaggaagctggattcccccctggagtgattaacattctacccggatacggtccgactgctggcgcagccatcgcctcccatatcggcatcgataaaattgcttttactggatcgactgaggtgggcaagctgatccaggaggccgcaggtagatctaacctgaagcgcgttactttggaactcggtgggaagtccccgaatattatttttgccgatgccgatcttgactacgctgttgagcaggcccaccagggagtcttcttcaaccagggccagtgttgtactgccggttcccgaatcttcgtcgaggaatccatttatgaggaatttgtacgtcggagtgtcgaacgagcgaagaggagggttgtagggagccctttcgatccgacaaccgagcagggtccacagatcgataaaaagcagtataataagattctagaactgatacagtctggcgttgccgaaggcgctaagcttgagtgcggcggtaagggcctggggaggaagggcttctttatcgagccaaccgtgttcagcaatgtgaccgatgatatgaggatcgctaaagaggaaatatttggcccagtccaggagattctgcggtttaagacaatggatgaggttattgagcgggcaaacaacagcgacttcggcctggtggcagcagtgtttaccaacgacattaacaaggccctgaccgtcagctcggctatgcaggccggaaccgtgtggatcaactgttacaatgcgctgaacgcgcagtcaccatttgggggattcaagatgtctggtaatggcagggagatgggtgagttcgggctgcgggaatatagtgaggtcaagacggtgaccgtgaagatccctcagaaaaatagttag

SEQ ID NO: 213978 - DNA, 1443 bp, Artificial Sequence
  Description of Artificial Sequence: Synthetic coding sequence
atgaccagctctaaaattgagatgcccggtgaagtcaaggcggaccccgctgcattgatggcaagtctgcatctcctcccctctccaacaccaaatctcgagattaaatatactaagatcttcattaataatgagtggcaaaatagcgaatctggccgagttttccctgtgtacaatcccgcaactggggagcaagtctgtgaagtccaggaagccgataaggctgacatcgacaaggctgttcaagcagccagattggctttcagcctgggcagcgtttggaggagaatggacgccagcgagcgaggtcgtttactggataagctggccgatctggtggaaagggacagagcggtcctggctacaatggaaagtcttaacgggggaaagccattccttcaggccttttacgttgatcttcaaggggttattaagacttttcggtactacgcaggctgggcggataagatccatggtatgactatacccgttgacggagactacttcacctttaccaggcacgaaccaataggcgtgtgtggccagattatcccctggaacttccccctgctgatgttcgcatggaaaattgcgcctgcactgtgctgtggcaacaccgtggtcatcaagcccgcagaacagacaccattaagcgccttgtatatgggggctctgattaaagaggtagggaagctgatacaggaagccgctggacgctccaacctgaaacgcgttaccctggaattgggtggtaagtcccccaatatcatattcgctgatgccgacctggactacgccgtagagcaagcgcaccagggcgtcttcttcaatcaggggcagtgttgcacagcgggttctcgtatattcgtagaggagtccatttatgaagaatttgtccggcgaagcgtggaaagggcaaaacggcgagtagtcggctcacccttcgaccccactacagagcaaggcccacagatcgataaaaaacagtataacaaaattttggaactgattcagtctggggtggctgagggcgcaaagcttgagtgtggcggtaagggattaggtcggaaggggttcttcatcgagccaaccgtttttagtaacgttacagacgatatgcgaatcgctaaagaggagatattcggtcccgttcaggaaatcttgcgcttcaagacaatggatgaggtgattgagagggccaataattccgattttggcctggtggctgccgtgttcactaatgacattaacaaagccctcacggtctcctccgctatgcaagccggaaccgtatggatcaactgttataatgccctcaacgcccagtcacctttcggaggctttaagatgtctggcaacgggagggaaatgggcgagtttggactccgagaatactctgaggtgaagacagtcaccgtgaaaattccacagaagaactcctag

SEQ ID NO: 213979 - DNA, 1494 bp, Artificial Sequence
  Description of Artificial Sequence: Synthetic coding sequence
atgaaaaaccagtgtgaaaccgtatggttgaaaagcccgattaaattaaagttaatcttcattaataatgagtggcagaattccgagagcggccgtgtgtttccagtgtacaaccctgctacaggtgaacaagtttgcgaggtacaggaagctgacaaggccgacatcgataaggctgtgcaggccgctcggctggcgttcagcttggggtctgtgtggagacgcatggacgcatcagaaaggggacgccttctggacaaactagcagatctcgtcgagagagatagagcggtgcttgcgaccatggagagcctcaacgggggtaaaccctttctgcaggcgttctatgtggatctccaaggtgttattaaaaccttcaggtactacgccggatgggccgataaaattcatggcatgaccataccggttgacggcgactacttcactttcacaagacacgagcctataggagtttgcggacagattataccttggaattttcctcttcttatgttcgcctggaaaatcgccccagcgctgtgttgtggaaatacagtcgtcattaagcccgctgagcagacccccttatccgccctgtacatgggcgcattgattaaagaggctggctttcctcctggggtcatcaacattcttccgggatatggcccaactgctggagcggctatcgcgtcccatatcggaatcgacaagatcgcattcaccggctccaccgaggtcggtaagcttattcaggaggccgctggaagaagcaacctgaagcgcgtgacattagaattgggcggtaagagccctaacatcatattcgccgacgcagatctggactacgcagtggagcaggcccatcaaggcgtgttctttaaccaggggcagtgctgcacagctggcagtcgtattttcgtcgaagaaagtatctacgaggaatttgtcaggcgtagtgttgagcgagctaagcgcagggtggtggggtctccgtttgacccaaccaccgagcagggccctcagatcgacaaaaagcaatacaataagattctagagctgattcagtccggggtggccgaaggcgcaaaattggagtgcggcggtaaggggttaggaaggaaggggtttttcatcgagccgaccgtgtttagtaatgtgacggacgacatgcgcatagccaaagaggagattttcgggccagtgcaggaaattctgcgcttcaaaactatggacgaggtaatcgaaagagctaacaactctgattttgggctggtggcagcggtttttactaacgatatcaacaaagcacttaccgtgtccagcgcgatgcaggccggtactgtgtggattaactgttataatgcgctaaacgcccaaagtcccttcggagggttcaagatgtccggtaacgggagggaaatgggagagtttggactgagggagtacagcgaagtgaagacagtcactgtcaagatcccccagaaaaacagctag

SEQ ID NO: 213980 - DNA, 1470 bp, Artificial Sequence
  Description of Artificial Sequence: Synthetic coding sequence
atgaaaggtaagaattgtaacgacgttaaaatcttcatcaacaacgaatggcagaactcagagtcagggcgagtattccccgtgtacaatccagccaccggagaacaggtgtgtgaagtgcaggaggctgataaggctgatatagacaaagccgtgcaggccgcaaggctcgccttctccctcggtagcgtgtggcgcagaatggatgcttctgaacgcggacgactactggacaaactggccgacttggtggagcgggacagagctgttctggccaccatggagtctttaaacggcggtaaaccttttctgcaggccttttacgtggatctgcagggcgtgattaagacattcaggtactatgccggatgggcagacaagattcacggtatgacgattccggtcgatggcgattatttcacatttaccaggcacgagcctataggtgtgtgtgggcagattattccatggaatttccccctcctgatgtttgcatggaagatcgccccagccttatgttgtggcaatactgtggtgatcaaacccgcagagcagacacccctgtccgcactgtatatgggagcgctcatcaaagaggcgggtttcccacccggtgtcattaatatcctgccaggatatggaccaaccgccggagcagccatcgctagccacattggtattgataagatagctttcacgggctccactgaggtaggcaagttaattcaggaagccgctggtcgttccaatctcaagcgagtgacattggagctgggtggcaaatcgccaaatatcatctttgcagacgctgatctggattatgcagtcgagcaggctcaccagggggtcttcttcaatcagggccagtgttgtacagctgggtctcggatcttcgtggaagagagcatctatgaggagttcgtgcgccgatccgtagaaagagcaaagcgacgtgtggtgggatctccattcgatcctacaaccgagcagggaccacagatcgacaaaaagcagtacaataaaattttggaactgattcagtccggtgttgccgagggagcaaagctggagtgtggcggtaagggcctgggacggaagggatttttcattgaacctacagtgttcagcaatgtaactgacgacatgcgcatcgcaaaggaggaaatcttcggaccagtccaggagatactgagatttaaaaccatggacgaagtgattgaacgcgctaacaactccgactttggtctggtcgccgcagtgtttaccaatgacattaacaaggctcttactgtgtcatccgcaatgcaggcgggtaccgtatggataaattgttataatgctctcaacgcgcaaagtccattcggtgggtttaagatgtctggaaacggcagagagatgggagaattcggcctgagagaatattcagaggtgaaaaccgtgactgtgaagatccctcaaaagaactcctag

SEQ ID NO: 213981 - DNA, 30 bp, Artificial Sequence
  Description of Artificial Sequence: Synthetic coding sequence
atggacgcttcagaacggggaagactgtag

SEQ ID NO: 213982 - DNA, 1470 bp, Artificial Sequence
  Description of Artificial Sequence: Synthetic coding sequence
atgaaaggtaggaattggaagaccaccaagatttttattaacaacgagtggcagaacagcgagtccgggcgtgtgtttcctgtgtacaatccagccaccggagagcaagtgtgtgaggtccaggaagctgacaaggcagatatcgacaaggccgttcaagcagctcgcctggctttctccctcggctcggtgtggaggaggatggatgcctctgaacgcggtagactgctcgacaagctagctgacctggtggagagagatcgggctgtgttggcaaccatggagagcctgaacggtgggaaacccttcttgcaggccttctacgtggatttgcaaggcgtgatcaaaacttttcggtattatgcaggatgggcagataaaatccacggcatgacaatccccgtcgatggagattattttactttcaccaggcacgagccaataggggtctgcgggcagatcatcccttggaacttccctttgttgatgttcgcttggaagattgccccagctctgtgttgtggcaataccgtggtcatcaagcccgcagagcagacacctctgtccgccctttacatgggtgccctaatcaaagaggctggcttcccccctggcgtgatcaatatactccccggatacggaccaactgccggagccgcaatcgcgagccatataggcatcgataagatcgcctttacgggttcgactgaagtgggcaaactgatccaggaggctgccggtcgcagcaatctgaagcgggttactctggagctggggggaaagagccccaacataatattcgctgatgctgatctcgactacgccgtcgagcaggcccatcaaggggtgttctttaaccaggggcagtgctgcacagccggaagccgtatcttcgtggaggaatcaatctatgaggaatttgttaggcgaagtgtagaaagggccaaacggcgtgtagtgggatccccgttcgacccgaccaccgaacagggccctcaaattgacaaaaagcagtacaataaaatccttgagctgatccagagcggggtcgctgagggtgccaagttggaatgtgggggaaagggcttgggcagaaaagggttcttcatcgagcctacagtgttttcaaacgtgaccgatgatatgaggatcgcaaaggaggaaattttcggcccagtgcaggagatcctgagatttaaaaccatggacgaggtgattgagagagctaacaacagcgactttgggctggttgctgccgtgttcacaaatgatattaataaggcgctgacggtgtcaagcgccatgcaagcagggacagtctggattaattgctataatgccctgaacgcccagagcccctttggcggtttcaaaatgagcggtaacggccgagagatgggagagtttggcctgcgggagtacagtgaagtgaagacagtgaccgtcaaaatacctcagaaaaacagctag

SEQ ID NO: 213983 - DNA, 78 bp, Artificial Sequence
  Description of Artificial Sequence: Synthetic coding sequence
atggacgcctctgagagaggacgtctcctggataaactggccgacctagtggagagggacagggcagttctggcatag

SEQ ID NO: 213984 - DNA, 1269 bp, Artificial Sequence
  Description of Artificial Sequence: Synthetic coding sequence
atggatgccagcgagcgaggcaggctcctggacaagctcgcagatttggtggagagagatcgagccgttttggccacaatggagagcctgaatggcggaaaacctttcttgcaggcattctatgtggacttgcagggcgtgattaagacctttcggtattacgcgggttgggccgacaaaattcatggaatgaccatcccagttgacggggattatttcacttttacccggcacgaacctataggagtgtgcggacagatcatcccttggaactttccacttttgatgttcgcttggaaaatcgccccagccctctgctgtgggaacactgtcgtgattaagcctgcagagcaaactcccctgtccgcactgtatatgggagcactcattaaggaggccggttttccacccggagtcatcaatatccttccagggtatggccctacggccggagccgcaatcgcctcacacatcggtatcgacaagatcgccttcacagggagcacagaagtggggaagttgattcaggaggctgcagggcgatctaacctgaagcgtgtgaccctcgaactagggggtaagtctccaaatattatttttgccgacgccgacctggactacgcagtggaacaagcacaccagggcgtgtttttcaatcaggggcagtgctgcaccgcaggctctcgaatctttgtagaggagagtatttatgaagagtttgtaagaagaagcgtagagagggccaagaggcgagtggtgggctcccctttcgaccccaccacggaacagggaccccagattgacaaaaagcagtataacaagattctggagctaatacagagcggagtggcagagggggctaagctggagtgcggaggcaaaggcttgggcagaaagggtttctttatcgagccgactgttttcagcaacgtgacagatgatatgcggatcgcaaaggaagaaatcttcggccctgtgcaggagatacttcgcttcaagacaatggatgaggtcatcgagagagcaaacaattccgacttcggtttggtcgccgcagtgttcaccaatgatattaataaggctctaaccgtgagcagtgctatgcaggcagggacggtgtggattaattgttacaatgccctgaatgcacagtccccgttcggtggcttcaaaatgtccggaaacgggagggaaatgggcgaattcggactgcgagaatacagcgaggtcaagacagtaactgtgaaaattccccagaagaactcatag

SEQ ID NO: 213985 - DNA, 258 bp, Artificial Sequence
  Description of Artificial Sequence: Synthetic coding sequence
atggatgccagtgagcggggaagattactggacaaattggcagatttagttgaacgcgatcgtgccgttttagcgactatggaatccctgaatggcggaaagccgttccttcaagcattttacgtggatctacaaggtgtcattaaaactttccggtactacgctggttgggccgataagatccatggcatgactatacccgtggatggcgactacttcaccttcaccaggcatgagcctatcggtgtgtgcggctag

SEQ ID NO: 213986 - DNA, 1539 bp, Artificial Sequence
  Description of Artificial Sequence: Synthetic coding sequence
atggccacggcaaacggggcagtggagaacggacagcccgaccgtaagccccctgctctcccacggcctattaggaacctggaggttaaatttaccaagattttcattaacaatgagtggcacgagagcaagagtggcaaaaaatttgctacttgtaacccttccactcgggagcaaatatgcgaggtggaggagggtgacaagcctgacgttgacaaggcggtggaggctgctcaggttgcatttcagagggggtctccctggcgacgcttggacgccctgtccaggggcagattactgcatcagctggctgacctcgtggagcgggaccgtgcaacactcgctgccttagaaaccatggacacagggaaaccattcttacatgccttctttatagacctcgagggatgcatacgcactctgcgctacttcgccggatgggctgacaagattcagggcaaaacaatccctacagatgacaacgtcgtctgttttacaagacatgagcctataggcgtgtgcggagccatcaccccttggaattttcctcttctgatgttggtgtggaagctggcccctgctttgtgttgcggaaatactatggtattaaagcccgctgaacagacccctctgacagctctatatctaggctctctcataaaggaggccggatttccgcctggagtagtgaatatcgtgccgggtttcgggccaaccgtgggggctgctataagcagccacccgcaaatcaataagatagctttcactggcagcaccgaagtggggaagctggtgaaggaagcagccagtcgctcaaacctgaaaagagtgaccctcgagctggggggaaaaaacccatgtattgtgtgcgccgatgcggacctcgatttagctgtagagtgtgcacaccagggggtgttcttcaatcaaggacaatgttgcactgccgcttcgcgagtatttgtggaggagcaggtctactccgagttcgtacgccgttctgttgaatatgccaaaaagcgacccgttggggatccgttcgatgtgaagaccgaacagggacctcagattgatcagaagcagtttgataaaattctcgagctgattgaaagcggcaagaaagaaggtgccaaactggagtgtgggggtagcgctatggaggacaagggcctgtttatcaaacccaccgtgtttagtgaggtcaccgacaacatgcgtattgcgaaggaagaaatctttggacccgtccagccaatcctaaaattcaagagtatcgaagaagttataaaaagagccaatagtaccgattatggccttaccgctgcagtcttcaccaaaaacctggacaaagctctgaaactggcttccgcgctggaatctggaacagtctggatcaactgttataacgccctgtatgcccaggccccattcggcggattcaagatgtctggcaacggtcgggagctcggtgagtatgctcttgcagagtacaccgaagtcaagaccgtgactatcaaattaggtgacaagaacccttag

SEQ ID NO: 213987 - DNA, 456 bp, Artificial Sequence
  Description of Artificial Sequence: Synthetic coding sequence
atggccacagccaatggagctgttgagaatgggcaacccgaccgaaaacctcctgccctgcctagacctattagaaacctcgaggtcaaattcacgaagatattcatcaacaacgagtggcatgagtcaaagtcgggtaagaagtttgctacatgcaatccatctactagagagcagatctgtgaagtggaggagggcgacaagcctgacgtggacaaagccgtcgaagccgctcaggtggcctttcagcgcggatctccatggcgcagactggacgcgctgagtcgtggccgtctgctacatcagctcgcagacctggtcgagagggaccgggcaacactagcggctctcgagaccatggacaccggaaagccttttctgcacgcgtttttcatcgacctggaaggctgtatcagaacactgcggttaataaaaagcagcagcaccaagagttag

SEQ ID NO: 213988 - DNA, 1554 bp, Artificial Sequence
  Description of Artificial Sequence: Synthetic coding sequence
atgctgcggtttttagcacccagactcttatcactccagggcaggactgctagatatagcagcgccgcagcgctgccttctcccatccttaatcccgacataccctacaatcaactgtttattaacaatgagtggcaggacgccgtgtccaaaaaaacctttcccactgtcaaccccactacaggcgaggtgataggccacgtggcggaaggggatagggccgacgtggaccgcgctgtgaaggccgcaagggaggcctttcgcttgggatcaccttggagacgaatggacgccagtgagcgcggacgcctgcttaacagattggctgacttagtggagagagatcgtgtttacctggcctctttggaaacccttgacaacggaaagccttttcaggagagctacgccttggatcttgacgaggtgattaaggtctaccggtattttgctggctgggccgacaagtggcatgggaaaactatccctatggacggccagcatttttgctttacaagacacgaacctgtgggagtctgtggccagatcattccctggaacttcccgctggtaatgcagggctggaagctcgcccctgcacttgctaccggaaataccgtggtcatgaaggtggctgagcaaacacctctgagtgctctgtatcttgcctctctgatcaaggaggcaggatttccaccaggcgtggtgaacattattactgggtatggccctacagccggagctgcgatcgctcagcacgtcgacgttgacaaggtggcattcaccggatccaccgaggtaggtcacttaattcaaaaggccgctggcgacagtaacctcaagcgagtgactctcgaattgggagggaaatcaccaagtattgtactggccgacgcagatatggaacacgctgtcgagcagtgtcatgaagcattgttctttaatatgggacaatgctgttgtgccggtagtcgtactttcgtggaagaatccatttacaatgaattcttagagcgcactgttgagaaagccaagcaacgcaaagtcggaaacccttttgagcttgatacgcaacaaggtccccaggtcgacaaggagcagtttgaacgagtacttgggtatatacagctcgggcagaaggaaggggctaagctcttatgcgggggtgagcgtttcggagagcgaggtttcttcatcaaacctacagtgttcggaggagtacaagatgatatgagaattgctaaggaagaaatctttggtcctgtgcaaccgctctttaaattcaaaaaaatcgaggaagtcgtggagcgagccaataacactcgttacggactggcggcagccgttttcactcgtgacctcgacaaggccatgtactttacacaggccctgcaagcaggaactgtctgggttaatacatacaacatcgttacctgtcacacaccatttggcggatttaaggaatctggaaatgggagagagctaggcgaagacgggttgaaagcctataccgaagtcaaaaccgtcacaattaaagttcctcaaaaaaattcatag

SEQ ID NO: 213989 - DNA, 657 bp, Artificial Sequence
  Description of Artificial Sequence: Synthetic coding sequence
atggaacacgccgttgaacagtgccacgaggccctctttttcaacatggggcagtgttgctgcgctggatctcggactttcgtggaagagtcaatatacaatgaattcttggagaggactgtggagaaagcaaaacagcggaaggtcgggaatccattcgagctagacactcaacagggaccgcaagttgataaggagcagttcgaacgtgttttgggctatattcaactgggacagaaggaaggcgcaaaactgctctgcggaggagagaggttcggcgagcggggtttcttcatcaaacccacggtgttcggcggtgtgcaagacgacatgcgcattgccaaggaggagatctttggcccagtgcagccactgttcaaattcaaaaaaatagaggaggtcgtggagagagccaataacacccggtacggtctggcagcagcagtatttactagggacttggataaggcaatgtatttcacccaagcactgcaggctggaacggtgtgggtgaatacctacaacatcgtgacatgccacactccatttggaggctttaaagagagcggcaacgggagagagctgggcgaggacggcctgaaggcctacacagaggtcaagaccgtgaccataaaggtaccccagaagaacagctag

SEQ ID NO: 213990 - DNA, 2739 bp, Artificial Sequence
  Description of Artificial Sequence: Synthetic coding sequence
atggcaggaccaagcaatcccccagccacgatgaagattgcagtgatcgggcagtcactgtttggacaagaagtgtactgccatcttcggaaagagggacatgaagtggttggggtgttcacagtgcctgacaaggacggcaaggcagacccattggggttggaagccgaaaaagatggggttccagtctttaagtattcacgttggcgggctaaaggtcaggcactgccggatgttgtggccaaatatcaagccctaggcgctgagctgaacgtcctacctttctgtagtcagtttatacccatggagattatatcagcccctaggcacggatccattatctatcatccttctctgttgccacggcacagaggcgcttccgcaatcaactggaccctgattcacggcgataagaagggcggatttagcatcttttgggctgatgacgggctggacaccggagatctcctgctccagaaagagtgcgaggtcctccctgatgataccgtgagcaccctgtataatagatttcttttcccggaaggcataaaagggatggtgcaggcagtacgactgatagccgaaggcaaagccccaaggcttcctcagccagaggaaggtgccacgtacgagggcattcaaaaaaaggagactgccaagataaactgggaccaaccagcagaggcaatccacaattggatccgaggtaacgataaggtcccaggcgcttggactgaggcctgcgagcaaaaactgacgttctttaactctacgctcaacacaagtggcctggtgccagagggggatgcgctgcccatcccaggagcgcacagaccaggggttgtgactaaagccggtctcattctatttgggaatgacgataagatgctgctcgtgaaaaacattcagctggaggacggaaagatgattctggccagtaacttcttcaaaggtgctgctagtagcgttctggaattgacagaagccgaacttgtaactgctgaggcagtccggtccgtgtggcagagaattctgcccaaggtccttgaagtagaggacagtacggatttcttcaaaagcggggctgccagcgttgacgtggtccgcttggtagaagaggtgaaggaactgtgtgacggtctagaactcgaaaacgaagatgtctatatggcctctactttcggagactttatacagctactggttcgcaagctcagaggggatgatgaggagggcgagtgctcgattgattatgttgaaatggccgtgaacaagagaaccgttcgtatgccacaccaactctttattggcggagagttcgttgatgctgagggcgctaagactagcgaaacgattaacccaacagacggctccgtcatctgccaggtttcacttgcacaggtcaccgacgttgacaaagcagtggctgctgctaaagacgccttcgaaaatggaaggtggggaaagatctcagcccgtgacagaggtagattaatgtacagactcgcggatctcatggagcaacatcaggaggagctggccactatcgaggccctggacgcaggagccgtgtacacactggcgttaaaaacgcatgttggcatgtctatacagaccttccgttactttgccggatggtgtgacaaaatccagggttccaccatcccaattaaccaggctaggccgaacaggaacttgactcttacacgtaaagagcccgtgggggtctgtggcatcatcataccttggaactacccattgatgatgttgagctggaagacagccgcttgcctggccgcagggaacacagtggtcattaaacccgcacaggtgacacctctgactgctcttaagttcgcagagctcacgctgaaggcaggaatcccgaaaggcgtggtaaatgtcttgccgggaagtggttctctcgtcggtcagcggcttagcgatcatcccgacgtacggaaaatcggcttcacaggttccactgaagtgggcaagcacatcatgaaatcttgcgccatcagcaatgtgaagaaggtgtcgctggagctcgggggaaagtcccctctgatcatctttgctgattgcgatctcaacaaggccgtgcaaatggggatgagcagtgtcttttttaacaagggagagaattgcatcgctgctggcaggttgtttgtcgaggacagcatccacgatgaatttgtgcgcagggtggtggaagaagtgcgcaaaatgaaagtgggcaaccctcttgatagagacaccgaccacggtccccagaaccatcacgctcacctcgtgaaactgatggagtactgtcagcacggcgtcaaagaaggtgcaaccctggtctgtggagggaatcaggtgcctcggccaggcttcttcttcgagccgacagtgtttacagacgtggaagatcatatgtttatcgccaaagaggagagctttggacctgttatgattatatctagatttgccgacggggaccttgacgcagttttgtcccgcgcaaacgctaccgaatttggactggcctccggggtattcacaagagacattaataaagccctctacgtgtccgataaactgcaggccggtacggtgtttgtgaatacttataataagactgatgtcgctgccccatttggaggatttaaacagtccggttttggtaaagacctaggagaggccgcactgaacgaatatctgagagtaaaaacagtcacattcgaatattag

SEQ ID NO: 213991 - DNA, 1518 bp, Artificial Sequence
  Description of Artificial Sequence: Synthetic coding sequence
atgaaaatcgccgtcatcggccagtctctctttggacaagaagtgtactgtcacttgcgaaaggaagggcatgaggtcgtcggtgtgtttactgtaccagacaaggatgggaaggcggaccctttaggcctggaggccgaaaaggatggggtccctgtttttaaatactctaggtggagagcaaaaggtcaggcattgcccgatgtcgtggccaaatatcaggcactgggtgctgagttgaatgttctgcccttttgttctcagttcattccgatggagattataagcgctccccgacacggcagcatcatttatcatccctcgctccttccccgacatcggggtgctagcgcaataaattggaccctcatccacggggataagaagggagggttctccattttctgggcagacgacggcctcgataccggcgacttgctactgcaaaaagagtgcgaagttctgccagacgatacagtgtcaacgctatataaccgattcctgttcccagagggcattaaaggaatggtgcaggccgtccgcttgatagctgagggtaaggctccaaggctgccccagccagaggagggcgctacatacgagggcatacagaaaaaggaaacggccaagatcaactgggaccaacctgccgaagcgattcacaactggattagagggaacgacaaggtgccaggtgcctggactgaagcatgtgaacagaaactgaccttttttaactctacactgaacacatctggcctggtccccgagggggatgccctgcccatcccaggagcgcacaggcccggagttgtgaccaaggctggactgattctctttgggaatgatgataagatgctgctcgttaaaaacatccagctggaggatgggaagatgatcttagcctcaaacttcttcaagggtgccgcttcatcagtcctcgagctgacagaagccgaactcgtgaccgctgaagcagtccggtcggtgtggcagagaattctacctaaagtgctggaggtggaggactctaccgatttctttaagagtggcgcagcttcggttgacgtggtgcgactggtggaagaagtgaaggagttgtgtgacggtctggaacttgaaaacgaagatgtctatatggctagtaccttcggagacttcatccaactcctagtgcggaagctccgaggtgatgatgaagaaggggaatgctcaatcgactacgtcgaaatggccgtgaataaaagaactgtgcgtatgccccatcagttattcatcggtggcgagttcgttgacgccgaaggcgctaaaacctccgaaacaattaaccctacagacgggtccgtaatctgtcaggtatccctggctcaagtcacggacgttgacaaggcagtcgcagctgctaaggacgctttcgagaacgggagatggggcaaaatttctgctcgcgatcgtggtagattaatgtaccgcgctccaccttcaccttctactcgtcccgatcctaccgctacctag

SEQ ID NO: 213992 - DNA, 2709 bp, Artificial Sequence
  Description of Artificial Sequence: Synthetic coding sequence
atgaaaattgccgttattgggcagtccctgttcgggcaggaagtgtactgtcatttaagaaaggaggggcacgaggtggtcggtgtgttcacagtgcccgataaggatggcaaggcagacccactgggactggaagctgagaaggatggggtgccagtttttaagtactcaagatggagggccaaagggcaagctcttcctgatgtggttgctaagtatcaagcattgggcgcagagttgaatgttctgccgttctgctcccagttcattcccatggaaatcatctcggctccccgacacggctcaataatctatcatcccagtttgctccctcggcataggggcgctagcgcaatcaactggactctgatccatggcgataaaaaaggtggattctcaatcttctgggcggacgacgggcttgacaccggcgatcttctgctgcagaaggagtgtgaggtcctccctgatgacacagtaagcactttgtacaataggttcctgtttcccgaaggcatcaaggggatggtgcaggctgtacgactgatcgctgaaggcaaagcacccaggttgcctcagcctgaagaaggtgcgacctatgaggggatccagaaaaaagaaaccgccaaaataaattgggaccagcccgcagaggctatccacaattggatccgcggaaacgacaaggtgcctggggcttggactgaagcctgcgagcagaaacttacattcttcaactctactttgaacacctcaggtttggtgccagagggagacgccttgcccattccgggtgcgcataggcccggtgtggtcaccaaggcgggtctaatcctgtttggcaatgacgataagatgctgttggtcaaaaacattcagctagaagacggaaaaatgattcttgccagcaatttcttcaaaggggcagctagtagtgtcttagagctgaccgaggctgaattagttaccgccgaggccgttagaagtgtgtggcaacgtatcctccctaaggttcttgaggtggaggattccaccgactttttcaagtccggcgcagcctcagtggatgttgtgcgtctggtcgaggaagttaaagagctgtgtgacggcttagaattggaaaacgaagacgtgtacatggccagtactttcggagactttattcagctgcttgtgcgtaagctccggggagatgacgaagaaggcgaatgttcaatcgattacgtcgagatggccgtgaacaaacgcacagtgagaatgccccatcagttgttcataggaggtgagtttgtggatgcagagggagccaaaacctccgagacaattaacccaacggacggatctgttatttgtcaggtgagtctcgcacaggtcacagatgtagacaaggcagtggctgctgcgaaagacgcttttgagaacggcaggtggggtaagatcagcgcccgtgatcgaggcagactcatgtacagattggcagaccttatggagcaacaccaggaggagctagctacaattgaggccctcgacgccggtgccgtgtatacactcgccctgaagactcacgtgggaatgtccattcaaaccttcagatatttcgcaggatggtgtgacaagattcagggcagtacgatcccgattaatcaggctcgcccaaataggaacctgaccctcacgagaaaggaaccagtgggggtctgcggcattattataccttggaattatcctctgatgatgctgagctggaaaacagccgcttgtctggctgccggaaataccgttgtgatcaagcctgcacaagttaccccgctaacagccctcaagtttgctgagctcacacttaaggctggtattcccaagggagttgtaaacgttctgcccggatccgggagtctggtgggacagagactgagtgatcaccctgatgtgcgcaaaatcggttttacagggtccacggaggtcggtaagcacattatgaagagctgcgccataagcaatgtgaagaaagtctccctcgagttgggaggcaagtcccctctgatcatttttgccgactgtgatctaaataaggctgttcagatgggtatgagcagcgtgttcttcaataaaggcgagaattgcattgccgcaggtcgactgttcgtagaggactcgattcacgatgagttcgttcggcgagtggttgaggaggtgcgaaaaatgaaagtgggaaatcctctggaccgcgatactgatcacggtccacaaaatcatcacgcgcatttggtgaaattgatggaatactgccaacatggggtgaaggagggtgccactttagtgtgcggaggcaaccaggttcctcgacctggattcttctttgaacccaccgtgtttacagatgttgaagaccacatgttcattgccaaagaagagagtttcggcccagtgatgatcatttctagatttgccgatggagaccttgacgctgtgcttagcagggccaatgctacagaatttgggttagcctccggcgtcttcaccagagacatcaacaaagccctgtacgtgagtgacaagctgcaggctggcaccgtgttcgtcaacacttacaacaaaacagatgtcgccgctcctttcgggggtttcaagcagagcggctttggcaaagacctgggggaggccgctctcaacgagtatctgcgcgtgaagactgtgacctttgaatactag

SEQ ID NO: 213993 - DNA, 483 bp, Artificial Sequence
  Description of Artificial Sequence: Synthetic coding sequence
atggttcaggcggtccgacttatcgcggagggaaaggctcctcgcctgccgcagcccgaagaaggggcaacctacgaaggcatccaaaagaaagaaactgctaagattaattgggatcaacctgctgaagctattcacaattggatccgcggaaacgacaaggttcccggagcatggactgaggcgtgcgaacagaagttgacgttctttaatagcaccctgaatacaagtggcttagtgcctgaaggcgacgcactgccaatcccaggcgctcacagacccggagtagtgactaaagcaggcctcatcctatttggaaacgatgataaaatggtgcgcgctagactttgggtgacatgcctactgaaggccacacatgcgccagttcttgggctgcggccacatcgaaagaccctgggttccagcggcgagaacgggaaaaaccagacacaggaggggactcttacgctgatttgtccatag

SEQ ID NO: 213994 - DNA, 507 bp, Artificial Sequence
  Description of Artificial Sequence: Synthetic coding sequence
atgaagattgccgtgattgggcaatcactttttggacaggaggtatactgtcacttaaggaaagagggccatgaggtggtgggcgtctttaccgtccctgataaagacggtaaggccgacccattgggactggaggcggagaaagatggagtgcctgtgttcaagtatagtcgctggagggcaaaaggtcaggccctaccagatgtggtggcaaagtaccaagccctgggagccgagctcaacgtgctccccttctgttcccagtttatccccatggagatcatctcggccccaagacatgggtctattatttaccatcccagcctgctccccagacacagaggtgcttctgcaatcaactggactcttatccatggtgataagaagggaggcttctcgatcttttgggcagatgacggcctggacacaggcgatctccttttgcagaaagaatgtgaggtcctgcccgatgacaccgtaagcaccctgtacaatcggttcctttag

SEQ ID NO: 213995 - DNA, 2709 bp, Artificial Sequence
  Description of Artificial Sequence: Synthetic coding sequence
atgaaaattgccgtgatcggccagtccctttttggccaggaagtgtactgtcacctgcgtaaagagggccacgaggtcgtgggcgtcttcacggtccccgataaagatggcaaggccgaccctctgggtctggaggcagagaaggacggagtcccagtgtttaaatatagccggtggagagcaaagggccaggccctgcccgatgttgtggcgaagtaccaagccctgggagctgagctgaacgtgctgcctttctgtagccagtttatccctatggagatcatcagtgcgccacgccatggctctattatctaccaccctagcttgctcccccgacatcggggagcatcagctatcaactggacactgattcacggggataagaaaggcggattctccatcttctgggcagacgatggtctggacaccggcgatctgctgctccagaaggagtgcgaggtgttgcccgacgacactgtcagcaccctgtacaatagatttctgttccccgagggaataaaagggatggtgcaggccgtgagactgatcgctgagggcaaagcgccacgcctaccgcaacctgaagagggcgctacgtatgagggaatacagaaaaaagaaacagcaaagatcaattgggaccagcccgcagaagctatacacaactggatcagaggcaacgataaggtgcctggagcgtggactgaggcatgcgagcagaagttgaccttttttaacagcactctgaatactagcgggctggtccctgagggagatgctctgcctattcctggagcccatcgccctggggtcgtgacgaaggctggcctcatcctgttcggtaacgacgacaagatgttgttagtgaaaaacatccaactggaagatggcaagatgatcctcgcctccaatttcttcaagggggcagcttcaagtgtgttggaactgaccgaggcagaacttgtcaccgccgaagctgtacgttcggtgtggcagcgcattctgcctaaggttctggaggtggaggattctactgacttcttcaaatctggcgcagccagcgtagatgttgtacggcttgtggaggaggttaaggaactgtgtgatgggctggaactggaaaatgaagacgtgtatatggcgtctacgttcggagacttcatccagctgctggttcgaaagctcaggggcgacgacgaggagggggagtgttccatcgattatgtagaaatggcggtaaacaagcggaccgtgagaatgccacaccagctgttcattggaggcgagtttgtggacgccgaaggcgcaaaaactagtgaaacaataaatcctacagatggtagtgtcatctgccaggtgtctcttgcgcaggtgactgacgtggacaaggccgtggccgcagccaaggacgcctttgaaaacggcaggtggggcaagattagtgcacgtgataggggcaggctgatgtataggctcgccgaccttatggagcagcatcaggaggagttagccaccatcgaggcactagacgccggagctgtttataccctggccctgaagacacatgtcggaatgagtatccaaaccttccgatattttgctggttggtgtgacaaaatccaggggagtacgatccctattaatcaggctcgacccaaccgcaacctgacactcacaagaaaagagccagttggggtgtgtggaatcataattccatggaactacccattaatgatgcttagttggaaaacggccgcatgcctcgccgctgggaacaccgtggtcatcaaaccggcacaagtgacgcccctgaccgccctgaaattcgccgaacttactctgaaggccggtataccaaagggtgttgttaatgtgttgcctgggagcggctcattggtcgggcagaggctgtccgatcaccctgatgtacgtaagattgggttcaccgggtctacagaggtggggaaacacattatgaaaagttgcgccattagcaacgtgaagaaggtatccctggagctcggcggaaagtctccactcataatctttgccgactgcgacctgaacaaagcagtgcagatgggtatgagtagcgtcttttttaacaaaggcgagaattgtatagctgcaggtcgactatttgtggaagacagtatccacgacgagtttgtccgaagagtggttgaggaggtccgtaaaatgaaagtggggaatccactggaccgggataccgatcacggccctcaaaaccatcatgctcaccttgtcaagctcatggagtattgtcaacacggggtcaaagaaggagccactttggtgtgcggcggtaatcaggtaccacgtcccggattcttcttcgagcccactgtttttactgatgtggaagaccacatgtttatcgctaaggaagagagtttcgggccagtgatgatcatcagccggttcgccgatggcgaccttgacgctgtcctttcccgcgctaacgctactgaattcggactggcctccggcgtttttacccgcgatataaacaaagccttgtatgtctcagacaaattgcaggctggcactgtgtttgtgaacacttacaacaagacagacgttgctgctccttttggcggttttaagcagtccggatttggtaaagatctgggcgaggcagcattaaatgagtatcttagggtaaaaaccgtgactttcgaatattag

SEQ ID NO: 213996 - DNA, 474 bp, Artificial Sequence
  Description of Artificial Sequence: Synthetic coding sequence
atgaagatagcagtcatcggtcagagcctcttcggacaagaggtttactgccacctgcgcaaggaggggcatgaagtcgtgggagtgttcactgtacctgacaaggacgggaaggcagaccctctgggtctggaggcagagaaggacggggtgccagtgttcaaatattcaaggtggagggccaaaggtcaggcactgcccgatgtcgtggctaaatatcaggccttaggggctgaactcaatgtgctacctttctgctcacagtttattcccatggagatcatctcagctcctagacatggctctatcatctatcaccctagtcttttgcctagacacaggggcgcaagcgccattaattggaccctgatccacggagacaagaagggtggtttttcaatcttttgggctgacgatggccttgatactggggacctcctgctgcaaaaggagtgtgaagtactgccagactag

SEQ ID NO: 213997 - DNA, 534 bp, Artificial Sequence
  Description of Artificial Sequence: Synthetic coding sequence
atgaagattgccgtgatcggccaatccctgttcggccaggaggtgtattgccacctgagaaaagaagggcatgaggtcgtgggagtcttcaccgtgcctgacaaagacggaaaagctgaccccttgggcctcgaagctgagaaggatggcgtgccagtgttcaagtattcccggtggagggccaaaggccaggccctcccagacgtggtggctaaataccaagctctgggggctgagctaaacgtccttccattctgttcccaattcatcccaatggaaattatctctgcaccacggcacggatctattatctatcatccaagtctgctgcccagacataggggcgcttcagcaattaactggaccctcatccatggagacaagaaggggggtttctctatcttttgggccgacgacgggctggatacaggcgaccttttgttgcagaaggaatgcgaggttttacctgatgatacagtttcaacgctgtacaaccgctttctgttcccagagggcatcaaggggatggtgtag

SEQ ID NO: 213998 - DNA, 303 bp, Artificial Sequence
  Description of Artificial Sequence: Synthetic coding sequence
atgaaaattgccgttatcggacaatctttatttggacaggaagtgtactgtcacctgcgaaaggaggggcatgaagtggtgggcgtgttcaccgtccccgataaggatggcaaagctgatccattggggctggaagcagaaaaggatggtgtccccgtcttcaaatacagccgctggcgcgctaagggccaagcacttcccgatgtggtagccaaataccaggcattgggtgccgagttaaacgtccttcccttttgttcacagtttattcctatggagattatttccgctcctcgacactag

SEQ ID NO: 213999 - DNA, 2409 bp, Artificial Sequence
  Description of Artificial Sequence: Synthetic coding sequence
atggccgcaacacgggctggacccagagccagagagattttcacatccttagagtatgggcctgtgccagaaagccacgcatgcgctttagcttggctcgatacccaggaccgctgtctcgggcattacgttaacggcaaatggctgaagcctgagcacaggaactccgtaccttgccaggacccaatcaccggcgaaaacttggcgagctgtttgcaggcccaggcggaggatgtggccgctgccgtcgaagcggctcgtatggcctttaaagggtggtccgctcatcccggtgtggtgcgcgctcagcacctgacccgcctggccgaggtcatacagaagcaccagcgcctcctatggaccctcgagagcctggttacaggcagggcggtgcgggaagtgcgggacggggatgtgcagttggcacagcagcttctgcattaccatgccatccaggcaagcactcaagaagaagccctggctgggtgggagccaatgggagtgattgggctcatcctcccccctactttctcctttcttgaaatgatgtggagaatttgtcccgctcttgccgtgggctgtacagtcgtggccttggtcccacctgcctcacccgctcccttgctcttagcccagttagcaggggagttgggcccattccccggaatactgaatgtattgagcggaccagcttctctggtccccatattggcttcccagcctggcatccggaaggtggctttctgtggtgctcctgaggagggcagggctctccgacggagtctggctggcgagtgtgcggagttggggctcgccctgggcaccgaatcgctcctactgctgacagatacagctgacgtcgatagtgcagtggaaggtgtcgtggacgctgcctggtctgaccgaggtcccggtgggctcagactgctcatccaggagagcgtctgggatgaggctatgaggagactacaggagcggatgggccgtttaagaagcggaagggggttggatggggctgtggacatgggggctcgtggagctgctgcgtgcgatctggtgcagcgattcgtgagggaggcccagtcacagggggctcaggttttccaggccggagacgtgccaagtgaaagaccattctacccacccacactggtttctaatcttcctcctgctagcccctgcgcgcaggtggaggtgccatggcccgtcgtggtggcatcaccgttccgcactgctaaggaggcattgctcgtcgccaacgggacgcctcgcggaggatctgcgagcgtctggagtgaacgcttgggtcaagcactggaactcggctacggtctacaagtgggtacagtttggatcaatgcacacggactgcgggatcctagtgtccctacgggcggatgtaaagagtctggatgttcatggcacggtggtccagacggactctatgaatacttgagacctagcgggacacccgcaaggttatcttgtttatcgaaaaatctgaattatgacacatttggtctggccgtccccagcactctgcccgcaggacccgaaattggaccctctccagccccaccatacgggctgtttgtcggcggaaggttccaggcgccaggtgcccgatcctcaagacctatccgcgattctagtggcaacttgcacggatatgtagcagaaggcggagctaaagacattaggggcgctgttgaagccgctcaccaggcattccctggctgggcgggacagtcccctggggcacgggcagcgctgctttgggctctcgcagctgcactcgaacgtcgaaagagtactctagccagcaggctggaaaggcaaggggctgagctgaaagcagccgaggccgaagtcgagctatctgctcgcagacttcgtgcctggggagccagagttcaggcccagggccacacattgcaagttgccggactcagggggcctgtactcaggctacgtgaacctctaggcgtgctggccgtagtatgccccgatgagtggccgctactggcatttgtgtccctcctggccccagctctggcttatggtaacacagtcgttatggtccccagtgcagcctgcccactgctggcattggaggtgtgccaggatatggcaaccgtgttcccggcaggacttgctaatgtggtcaccggagaccgggatcatctcaccagatgtctggctctgcaccaggatgtacaggccatgtggtactttggttccgcccagggcagtcagttcgtcgaatgggcgtctgccggaaacctgaagcccgtttgggctagtcgcggatgtccgagggcctgggaccaggaggcggagggtgcaggtccagagttgggcttacgagttgccaggacgaaggctctgtggctccccatgggagactag

SEQ ID NO: 214000 - DNA, 1914 bp, Artificial Sequence
  Description of Artificial Sequence: Synthetic coding sequence
atgggggtgatcggcctcatccttccccctacattctcgttccttgagatgatgtggcgcatctgtccagctctggccgtcggctgtaccgtcgtcgccctggtgccaccagcctcaccagcccctcttctgctcgctcagctagcaggcgaactggggcctttccctgggatcctcaatgtactctcaggccctgccagtctagtccctattttagcaagtcagccaggcattagaaaggtggcattttgcggagctcctgaggaggggcgtgctcttcggaggagcctagcgggagaatgtgctgagttaggcctggccctcgggactgagagtctattactgctgactgacacagcagacgtagactctgcagttgaaggggtggttgatgccgcttggagcgacaggggcccaggaggactgcgtctcctcattcaggagtccgtatgggacgaggccatgcggagacttcaggagagaatggggagactgaggagtggacgcggtctcgacggggctgtagatatgggggctagaggagccgctgcatgtgatttggttcaacgcttcgtgcgcgaggctcaaagccagggggcacaggtatttcaggctggggacgtgccatctgaaagacctttttatccacccaccctagtgtccaacctgccgccagctagcccttgcgctcaggttgaggtgccctggcccgtagtggtggcatccccctttcgaaccgccaaagaggctctcctggtggctaatggcaccccgagagggggatcggcaagcgtatggtccgagcgactcggccaggccctggaactgggctacggattacaagtcggtacagtgtggatcaacgctcatgggttgcgtgatccatccgtccctacgggtggatgcaaggaatctgggtgtagttggcacggagggccagatgggttgtatgagtatcttcgtccatcagggacccccgcaaggctcagctgcctgtcaaagaacctgaattatgatacctttgggctcgcagtccctagcacactacccgcagggcctgagataggtccttcgcccgctcctccctatggcctgttcgtgggtggccgattccaggcgccaggggctaggtcatctcggcctatccgggattctagcgggaatctgcacggttacgtggctgaggggggagcgaaagacattagaggtgccgtggaagcagcccatcaagccttcccgggatgggccggtcaatcgccaggggcacgggcagccttactgtgggcccttgctgctgccctggagcgcaggaagagcacgctggcctctaggctagagagacaaggagcggagctcaaagcggctgaagctgaggtggagctgtccgcccgtagattgcgggcatggggagcacgggtccaggcacagggtcacactttacaggtggccggattacggggacccgtgctgagactccgcgagcctctcggggtacttgcagtggtgtgcccagatgaatggcctctcctggcctttgtctcactgcttgcacctgctctggcttacggcaataccgtggtaatggttccctcagctgcttgtcccctcctcgctctcgaggtgtgtcaggacatggctacggtattccccgctggtttagcaaacgtagtcacaggcgacagagaccaccttactcggtgtctcgcgctccatcaagatgttcaggcaatgtggtattttgggtcggcccagggcagccaattcgtggagtgggcttcagctggaaatcttaagccggtctgggccagccgaggttgtccacgtgcctgggatcaggaggctgagggggctggtcccgaacttggccttcgcgttgctagaacaaaagctctttggctgcctatgggagattag

SEQ ID NO: 214001 - DNA, 2256 bp, Artificial Sequence
  Description of Artificial Sequence: Synthetic coding sequence
atggcagctacgagggccggaccacgggctcgcgaaatctttacaagcctggagtatggcccagtgcccgagtcacatgcatgcgcccttgcctggctggacacacaggatcggtgtctgggacattatgtgaacggaaaatggctcaagccagagcatagaaacagtgtgccatgccaggatcccattacgggcgaaaacctggcatcgtgcctccaggcccaggcagaggacgtggccgcagccgtggaagctgctcggatggctttcaaggggtggtctgcgcacccaggggtggtaagggcccagcacctgacccgcctagccgaagtgattcaaaaacaccagaggctgctttggaccttggaatctcttgtcacaggccgtgcggttagggaggtgcgcgacggagatgtacagcttgctcagcagctgttacattatcatgccatccaggcaagtacacaggaggaagccctcgccggatgggaaccaatgggcgtgataggcctgatacttccccctacattctcattcctggaaatgatgtggaggatctgcccggctctcgcagtgggatgtaccgttgtcgctctggtgcctcctgcctctccggctcccctgctgctcgcgcagctagccggagagctgggacctttcccaggaattctgaatgtgctgagtggaccagcatcactggttcctattctggcttcacagcctggcattagaaaagtcgccttttgtggagccccagaaggaggactgcgcctactgatacaggaaagcgtttgggacgaggcaatgcggaggctgcaagagagaatgggaagactaaggtcgggccgaggattggatggcgctgtggatatgggggcacgcggagcggctgcatgtgacctcgtgcagcgatttgtccgtgaagctcagtctcagggggctcaggttttccaggcaggtgacgtgccatctgaacgccctttttacccccctaccctcgtctccaacctgccgcctgcaagtccatgcgcccaggtggaggtgccttggcctgtcgtggtggcctccccattcagaaccgctaaggaggctcttctggtggccaatggaactcccaggggaggctctgcgtccgtgtggtccgagcgtctgggacaggctctagaattgggctacggtctccaggttggtacggtctggatcaatgcccatggactccgtgatccctcagtgcctaccgggggttgcaaggagtccggctgttcgtggcacggtgggccagatggcctttatgaatatctgagaccttctgggacccctgccagactgtcttgcctgagcaagaacctcaactacgacacttttgggctggcagtgccctccactctacctgcaggcccagagatcggcccttcacctgctccaccatacggtctgtttgtgggtgggcgtttccaagccccaggcgctaggagttctcggccaattagggactcttcaggcaacctccatggatacgttgcagagggaggagccaaagatatcagaggagcagtggaagcagcccatcaagccttccctggttgggcaggtcagtctcctggcgctcgcgctgcgctcctgtgggccctggccgcagcgctggagagaagaaaatccacattggcgagtcgactagagaggcagggagccgagctcaaggccgctgaggccgaggtcgagttgtccgctaggcgattgagagcgtggggagcgagagtgcaggctcagggacacaccctgcaggtcgctggtcttaggggacccgtgcttaggttaagagagcccctgggagtgttagctgtcgtttgcccagacgagtggccactcctggccttcgtaagcctgcttgcccctgctctggcctatggcaacactgtcgttatggtgccctcagccgcatgccctctcctcgctctggaggtgtgccaggatatggccactgtctttcctgcagggcttgctaacgtcgtaacaggtgatcgagaccacctaacacgctgtttggctcttcaccaggacgtccaggcgatgtggtacttcggctctgctcaaggctcccagttcgtggagtgggcttctgccggaaatctgaagccagtgtgggcatccagaggatgtccaagagcctgggaccaggaggccgaaggggctggaccagaactaggcctgcgagtggctagaacaaaagctctgtggcttcccatgggagattag

SEQ ID NO: 214002 - DNA, 1920 bp, Artificial Sequence
  Description of Artificial Sequence: Synthetic coding sequence
atgagaactggtgttattgggcttatcctccctcctaccttttctttcctggagatgatgtggagaatctgcccagcccttgcagtgggttgtaccgtagttgctctggtgcccccagctagtcccgcaccgttacttctcgcgcaactggccggagaactggggccttttcctggaatcctgaacgtattgtccggccctgcctctcttgtgcctatcctggcttcccagcctggcatacgtaaagttgcattttgtggggcaccggaagaagggcgagcattgcggcgatctcttgccggagagtgcgcagagctgggcttagccctggggacagagagtctcttgcttctgacagacaccgccgacgtcgatagtgctgttgaaggcgtagtggatgctgcttggtcggatcggggacctggaggactccgcctgctgatccaggaatccgtatgggacgaagctatgcgaaggctccaagaaaggatgggacgcttgcggagtgggcgtggtttagatggtgcagtggatatgggggctcggggtgccgcagcgtgcgacctggtccagcggttcgtccgagaggcccaaagccagggggcacaagttttccaggctggagatgtaccaagtgaaagaccattttaccccccaaccctcgtctctaatctaccacctgcctctccatgcgcacaagtcgaggtgccgtggcctgtcgttgtcgcttcccccttccgaaccgccaaggaggccctcctggtagcgaacgggacaccacgtggaggcagtgcatctgtctggagtgagagactcggccaggctctcgaactggggtatggcctacaggttggcacggtgtggatcaatgcacacgggctacgggatccttcggtgcccactggcggatgcaaggagagtggttgctcatggcacgggggtccggatggtctatacgaatacttgagaccctcaggcacaccggctagactcagctgtctgagcaagaacctgaactatgacaccttcggcctcgccgtgccatcgaccctgcccgctggacctgagatcggcccatctccagcaccgccatacggactgtttgtaggaggccgtttccaggcaccaggcgctcggagcagccggccaatcagagactcatcagggaatctgcacgggtatgtggctgagggcggagctaaagacatccgaggggcagtggaggccgcacatcaggcatttcctggatgggcagggcagtccccgggagcccgagcggctttactttgggcgttggcagccgctttagagcgccgtaagtccacgctggcctctcgtctggagcggcaaggtgccgaactcaaggccgcagaagccgaagtcgaactttcagctcgtagactacgtgcatggggagccagagtacaagctcagggccacacgttgcaggtcgctggattacgagggccagtcctccggctcagagagcctctgggagtgcttgcggtggtctgtccagacgagtggccacttctggcctttgtgagtctgctggcccctgcacttgcatacgggaacacagtggtcatggtccccagtgctgcatgtccgctgctcgcactggaggtctgtcaggacatggccacagtgttccctgctggcctcgctaacgttgtgacgggagatcgcgaccacttgaccaggtgcttagccctccaccaggacgttcaggcaatgtggtatttcgggtccgcccagggcagccagttcgtcgagtgggcatccgcaggtaacctaaagccagtctgggcatccagaggatgcccccgtgcatgggatcaggaggcagagggcgcaggcccagagcttgggctcagggtcgccaggaccaaggctttgtggctgcccatgggggactag

SEQ ID NO: 214003 - DNA, 2382 bp, Artificial Sequence
  Description of Artificial Sequence: Synthetic coding sequence
atgctctcgcaggtctatagatgtggctttcagcctttcaatcagcatcttctgccttgggtaaagtgcacgacagtgttcagatctcattgcattcaaccttccgtgatcagacatgtgaggtcatggtccaacataccgttcatcactgtccccttatcaaggacccatgggaagtcttttgcccataggtctgaactgaaacacgcaaaaagaatagtggtgaagctgggtagtgctgtggttacacggggtgacgagtgcggccttgctctgggtagactggcctccatagtagagcaggtatcggtgctgcagaatcagggaagagaaatgatgcttgtgaccagtggagcagttgcatttgggaaacaacggctgcggcacgaaatcctcctgtcccaatccgttcggcaggctttgcatagtgggcagaaccagcttaaagagatggcgataccagttctcgaggcacgcgcttgtgcagcggcaggacaatcgggtctgatggctctctacgaggcaatgttcacacagtatagtatctgtgcagcacagatcctagtcactaatctggacttccacgatgagcaaaagcgccgaaacctaaatggtaccctgcatgaacttcttcggatgaatatcgtgcccattgttaacacaaacgacgctgtcgtgccaccggcagaacccaacagcgatctgcagggtgtcatctccgtcaaggacaacgactctttagctgcaaggctcgcagtggagatgaagaccgacctattgattgtgctgagcgacgtcgagggcttgttcgatagtcctcctggctcggacgatgcgaagctgattgacatcttttaccctggtgaccagcagtctgtcacattcggtacaaaaagtcgcgtggggatggggggaatggaagccaaggtgaaagccgcactctgggctctgcagggaggaacctccgtcgtgatcgcaaacggaactcatcctaaggtgtctggacacgtaataactgacatcgtggaaggcaaaaaggtcgggacgtttttttcagaagtgaagccggctgggcctaccgtggaacagcagggcgagatggctaggagcggaggacgtatgttggccaccttagagccagagcaacgggctgaaatcatacatcaccttgcggaccttttgacagatcagcgtgacgagatactgcttgccaataaaaaggatctcgaggaggcagaaggccgactagccgcaccattactcaagagactttctctcagcacatctaaactgaattccctggcaatcggacttcggcagattgcagccagctcacaggatagtgtgggacgagtcctcagacggacccgaattgccaagaatctggaactagagcaggttacagttcctattggcgtgctcctcgttatctttgagagccggcctgactgtcttcctcaggttgccgctctggccattgcttctggaaatggactgctcctgaaagggggtaaggaggcggctcattcaaatcgcatcttgcacctgttgacacaggaggccttatctatccatggtgtcaaagaggccgtccagctggtcaatacgcgcgaagaggtggaggacttgtgccgccttgacaaaatgattgacctgattatccctagggggagctcccagctggttcgcgacatccagaaggcagctaaaggtatacccgtgatggggcattcagaagggatctgtcatatgtacgttgactctgaggccagcgtagacaaagtgaccaggctggtgagggatagcaaatgtgagtaccctgctgcctgtaacgccctcgagactctgcttatccaccgcgaccttttgcgcaccccgttgtttgaccagatcatcgacatgctgcgtgtggagcaggtcaagatccatgccggacccaaattcgcctcctacctgacattctccccttcagaggtgaaaagtctgcgcacagagtacggcgatctcgaattgtgcattgaggttgtagataatgttcaggatgcaatagaccatattcacaagtatggctcttcacacactgacgtgattgtgaccgaggatgagaatactgctgagttctttctgcagcacgtcgatagtgcatgcgtattttggaatgccagtacacgtttctccgacggatataggtttgggcttggcgcagaggtagggattagtaccagccggatccatgcaaggggacccgtagggcttgagggattgctaacaactaaatggctgcttcgaggcaaggaccacgtggtgagtgacttttctgaacatggctctctaaaatacctacacgaaaatcttccaatcccccagagaaacactaactag

SEQ ID NO: 214004 - DNA, 2388 bp, Artificial Sequence
  Description of Artificial Sequence: Synthetic coding sequence
atgttatcgcaagtgtatagatgcggattccaacctttcaatcagcacttactgccgtgggtcaagtgcaccacagtgtttaggtctcattgcattcagcccagtgttattcggcatgtccggtcctggagtaatattccgttcatcactgttccactatctagaacacatggaaagtcctttgcccacagatccgagcttaaacacgccaaacgcattgtggtgaagctcggctctgctgtcgttactcgtggtgacgagtgcggcctagctctcggtcgcttagcttctattgtcgagcaggtgtcagtgctgcagaatcagggaagagagatgatgttggtaacctctggagcggtagccttcgggaagcagcgtctaagacacgagatccttctgagccagtcagtgcggcaggccctgcattccggccaaaaccagcttaaggaaatggccatcccggtcctcgaagccagagcctgtgcagccgcagggcagagtggtttgatggctctttacgaagccatgttcactcagtacagcatttgcgcagcccagatcctcgtcaccaacctcgactttcacgacgagcaaaagcggagaaacctcaatggcactctccatgaacttctccgcatgaatatcgttccaatcgtcaataccaatgatgctgtggtccctcctgccgaacctaacagtgatctccaaggggtcaacgtgataagcgttaaggacaatgacagccttgctgcacgcctcgcagtggagatgaagaccgatctattgatcgtgcttagtgacgtggaaggcctcttcgattctccgccagggagcgacgacgctaagttgatcgacatcttttacccaggtgaccagcagtcagtcacctttgggaccaaatctagagtcgggatgggtggcatggaggccaaagtcaaagccgctctgtgggcacttcagggcggtacatctgtggtcatcgcaaatggcacccatcctaaggtgtctgggcatgtgatcacagacattgtggagggtaagaaagtgggcacctttttctctgaggtgaagcctgcagggccaactgtggagcagcagggtgagatggcgcgatcaggcggacgaatgctcgccacccttgagcccgagcaacgggcagaaatcatccaccatctggctgatctgcttacagaccagagagatgagattctcctggccaacaagaaggatcttgaagaggcggagggacggctagctgcccctctcctaaagagactgtccttatctacttcaaagctcaactctctcgctatcggactgaggcagatcgccgcatcatcacaggatagcgtaggcagggtgctccgcagaaccagaattgccaagaacctagagttagaacaggttacagtcccaataggagtcctgttggtcatctttgagtctcgacccgattgtctcccacaagtggctgcccttgccatcgctagcgggaacgggctgttgctgaagggcggtaaggaggctgcacacagtaatcgtatcctacatctgttgacgcaggaggcactgtcaattcacggagtgaaggaagcagtccaactggttaatacccgggaggaggtggaggatctgtgcaggctggacaagatgattgatttaattataccgcgagggagctcccagctagttcgcgacatacagaaggccgcaaaggggatcccagtgatgggccattccgaaggcatctgtcatatgtacgtggattctgaagctagtgttgataaggtcacacgactcgtgcgggatagcaagtgtgagtatccagccgcatgtaacgcactggaaaccctactcatacatagagacctcctgaggacccctctcttcgatcaaataatagacatgttgcgcgtggagcaagtcaaaatccacgcaggaccgaaatttgcctcttatctcaccttctccccctctgaggtcaaatctctcaggacagagtatggcgatctagaactttgcatcgaggtggtggataacgtacaggatgccattgaccatatccacaagtacgggagcagtcacacagatgttatcgttactgaggacgaaaatactgccgaattcttcttgcaacatgtggatagtgcatgtgttttctggaacgccagtaccagattttcagatgggtataggtttgggctcggggctgaggttggcatctctaccagccgtatccacgctcgtggcccagtcggccttgaaggattgttgactactaagtggctcctccggggaaaggaccatgtggtgtcagacttttcggagcacggttcactgaaatatctgcacgaaaacttaccgatccctcagcgaaacacgaattag

SEQ ID NO: 214005 - DNA, 1554 bp, Artificial Sequence
  Description of Artificial Sequence: Synthetic coding sequence
atgctgcgggctgccgctcgttttgggcctagacttggccgtcggttattgagtgcagccgctacgcaggctgtgccagcccctaaccaacagccagaggttttctgtaaccagattttcattaacaacgaatggcacgatgccgtcagcaggaaaactttcccgactgtgaacccaagtactggcgaggtcatttgccaagtagccgagggagataaggaagatgttgacaaagccgtcaaagcggctcgggcagctttccagctcggaagcccatggagacggatggatgcctctcatcggggtcggctgttaaaccgcttggccgacctgatcgagcgggataggacctacctcgccgctctggaaaccctcgataacgggaaaccgtatgtcatatcctacctggtggacttggatatggtattaaaatgtcttaggtactatgccggatgggccgacaagtaccatgggaaaaccattcctatagatggagactttttctcatatacgaggcacgagcccgtgggcgtctgtggacagataattccttggaactttcctctgttaatgcaggcttggaagctgggcccagccctcgctactggaaatgtggtcgtgatgaaggtcgctgaacagacacccctgaccgccctgtacgtggccaacctgattaaagaagccggttttcctcctggagtggtgaatattgtgcccggatttggccctaccgctggcgctgctattgcttcccatgaggacgtggacaaagttgccttcacaggaagtaccgagattggcagagtgatacaggttgccgcagggagctctaacctaaagagggtgaccctggagcttggcggaaagtctcctaacattatcatgagtgacgcggatatggactgggcagtcgaacaggctcacttcgcacttttcttcaatcaaggacagtgctgttgtgctggctctcgcactttcgtgcaggaagatatctatgacgaattcgtagagcgttccgttgcccgtgcgaagtcacgagtggtcggcaatccgtttgacagcaagaccgaacagggtcctcaggtggatgagacacagtttaagaaaattctgggttatattaacacggggaagcaagaaggcgctaagctcctgtgcggagggggtattgctgctgatcgtggctacttcatccagccaacagtctttggtgatgttcaggatgggatgacaatagcaaaagaggagatattcggcccagttatgcagatcctgaaattcaaaactatcgaggaggtggtgggcagagcaaataactccacatacggcctggccgctgctgtgtttactaaagacctggataaagctaactatctgtctcaggccctgcaggcgggaactgtgtgggtgaactgctacgacgtattcggcgcacagtctccatttggagggtacaagatgtcaggcagtggaagggagctcggcgagtacggattacaggcctataccgaggtaaagacagtcaccgtaaaggtcccccagaaaaacagttag

SEQ ID NO: 214006 - DNA, 1413 bp, Artificial Sequence
  Description of Artificial Sequence: Synthetic coding sequence
atgctgagggccgcagcgaggtttggcccacgcctggggagacggctcctgtcggccgctgccactcaggctgtacccgctcctaaccagcaacctgaggtcttctgcaatcagatttttattaacaatgagtggcatgatgcggtgagtcgtaagactttcccaactgtgaatccgtctacaggcgaggtgatctgccaggtcgcagaaggcgacaaggcactcgagactctcgacaatgggaaaccttacgttatttcgtacctggtggatcttgatatggtgctgaagtgccttcgatactacgcgggatgggctgataagtaccacggcaaaaccattcccattgacggagactttttcagctacaccaggcacgaacccgttggcgtgtgcgggcaaattatcccctggaattttccactgctgatgcaggcctggaagctcggaccggctttagccaccggaaatgtggtggtgatgaaagtggctgaacaaactccccttacagccttatacgtcgcaaacctgatcaaggaagccggatttccacccggtgtcgtcaacattgtgcctggctttggaccgactgcaggtgcggcaatcgcatcgcacgaagacgttgataaggtcgctttcacgggttcaactgagattggcagagtgatccaagttgccgctgggtcgtcaaacctgaagcgcgtcactttagaacttgggggaaagagcccaaacattattatgtccgacgctgatatggactgggctgttgagcaagcccacttcgccctgtttttcaatcagggccagtgctgttgcgcgggttctcggacattcgtgcaggaagatatctatgacgagttcgtagagagatcagtggcccgtgcgaagagcagggttgtaggaaatccctttgattcaaaaactgaacagggcccacaggtcgacgaaacccagttcaagaagatcctgggctacataaatacaggtaaacaagagggggctaagctcctgtgtgggggtggcattgccgcagacagggggtactttatccagcccacagtattcggtgatgtccaggatggtatgacaatcgccaaggaggaaattttcggacctgtgatgcagatcctgaaatttaagacaatcgaagaagtggttggacgagcaaacaactctacgtatgggttggccgcagccgttttcactaaggacctggataaagctaactatctctcgcaggcccttcaggctggcacagtctgggtgaactgctatgacgttttcggagctcagtcccctttcggcggttacaaaatgtccgggagcggaagggaactgggcgaatatgggcttcaggcatataccgaggtgaagacagtaaccgtgaaagtccctcaaaagaatagctag

SEQ ID NO: 214007 - DNA, 1989 bp, Artificial Sequence
  Description of Artificial Sequence: Synthetic coding sequence
atgcggggagcaggtccttccccgagacagagcccacgcacgctccgaccagacccaggacccgctatgtctttcttccgcagaaaggtgaaaggcaaggaacaggaaaaaacttcagatgttaaatcaatcaaagctagcattagcgtgcacagtccacagaaatccacaaagaaccacgctcttctggaagctgctgggccatcccacgtggctataaacgccatctcggctaatatggattcgttttcatccagtaggaccgctacgctgaagaaacagcctagtcacatggaagcagcgcacttcggagatctggggaggtcatgcctcgattaccagactcaggagaccaagtcctccctctcaaaaactctggagcaagtcctgcacgataccattgttctgccttactttattcagttcatggaattgcgcaggatggagcacctggtgaagttttggcttgaagcagagagtttccatagcacaacatggtcaaggattcgggcacactcacttaacacggtgaagcagtcctcgctggccgagcccgtgtcgccaagcaaaaaacatgagacaactgcttctttcctgactgacagcctggataagcgcctggaggactcaggaagtgcacagttgttcatgacccactccgaaggtattgatttaaacaataggactaattcaacccaaaaccatttactgttaagccaggagtgtgatagcgcacattctctaaggctcgaaatggcaagggcaggcacccatcaggtctctatggaaacgcaggaaagcagtagcacccttaccgtggctagccggaactccccggcaagtcccctcaaggagctatccggtaagctgatgaagagcattgagcaagatgctgtcaacacttttacaaagtacattagccctgatgctgctaaaccaatccctatcaccgaagccatgaggaatgacataatcgccagaatctgcggagaggacgggcaggtggacccaaattgttttgtcctagcgcaatctatcgtttttagtgccatggaacaggaacatttttccgaatttctgaggtctcatcacttttgcaagtaccagatcgaggtgctgaccagtgggaccgtctacctggcagatattttattctgcgagtccgcccttttttatttttctgaatatatggagaaagaggacgccgtgaatattttgcagttctggctggccgctgataacttccaaagccagctggcagcgaagaaagggcagtatgatggtcaggaggcgcagaatgacgccatgatcctgtatgataagtacttcagcctccaagccactcatccacttggattcgatgacgtggttagactggaaatcgaaagtaacatatgtcgtgaaggaggccctctccctaattgtttcaccacccctttgcggcaagcttggactaccatggagaaggtctttcttccaggctttctttccagcaacctctactacaagtatctcaatgacctgattcatagcgtccgtggcgatgagtttcttgggggaaacgtgtccttgacagcacccggatccgtcggacctcctgacgaatctcacccaggcagttcagatagctctgccagtcagtcttctgtcaaaaaagccagtataaagattctcaagaattttgacgaggcaattatagtggatgcggcaagtctggaccccgagtcactgtaccagaggacgtatgctggtaagatgacttttggccgtgtgagtgatctggggcagttcattcgagaaagcgagcccgagcccgacgtccggaaaagcaaggggtccatgtttagccaggcaatgaagaagtgggtgcaaggcaacacagatgaagcgcaggaggaactcgcatggaaaatagccaagatgattgtttctgatattatgcaacaagctcaatacgatcagcctctggagaagtcgaccaaattatag

SEQ ID NO: 214008 - DNA, 1536 bp, Artificial Sequence
  Description of Artificial Sequence: Synthetic coding sequence
gaggttcagcggacccctcaccctacttttgaatacttcttctttctgtcacggaagttacctggtcaggagctgcaagggctgaacggtcgcgaagctggaagcctgaacacgtcccccctcggcagttgtcgaagtcgttcaccaagctatcgcgagcgactgtgtcaaaggcgccatgagcaggaccagaggggtagggaggcacgccctagaaggctgcagggtaggactcgtcctctgcagttcaggatccagcagcttgaagcactgcagagactgatccaggaacaggagcaggaactggtcggagctctggccgctgacctgcacaagaacgagtggaacgcctattacgaagaggtggtgtacgtgcttgaggaaatagaatacatgattcaaaaactccccgagtgggcagcggacgagcctgtagagaagacacctcaaacacagcaggacgagctttatatccatagtgagcccctgggcgtggtgctggtgattgggacctggaactacccattcaatctcaccattcaaccaatggtcggcgctatcgccgctggaaatagcgtcgttctcaagccttccgagctgtcagagaatatggcatccctgctggcaaccattataccacagtatctcgacaaggatctgtatccagttataaatggcggagtcccagagaccactgagctgctaaaggaacgcttcgaccacattctgtatacaggtagcaccggggtggggaagatcataatgacagctgccgctaagcacctgacacctgtaacattggagttgggcggaaagtctccttgttatgtagacaaaaattgtgatctcgatgtggcctgccggagaatcgcttgggggaagttcatgaacagtggacagacttgcgtggctcccgactatatactgtgcgaccctagtatccagaaccagattgtggagaaacttaaaaagtctcttaaagagttttacggtgaggacgccaagaagtccagggattatggtcgcatcattagtgccagacattttcagcgagtgatgggcctcatagagggccagaaggtagcttatggaggaactggcgacgccgcaacgcgatatattgctcctaccatcctgaccgacgtggatccccagtctcctgtcatgcaagaggagatctttggcccagtcctgcctattgtttgtgtgcgaagtctggaggaggcgatccagttcatcaatcaacgggagaaacccctagctctgtatatgttcagctctaatgacaaggttattaaaaaaatgatcgcagaaacgtccagcggtggcgttgccgcaaatgatgttatagtgcacataaccttacatagcctgccgtttggaggcgttgggaattcaggaatgggatcctatcacgggaaaaagtccttcgaaacattcagccacagaagaagctgtctagtcagacctctcatgaacgatgagggcttaaaggtgagataccccccttcacccgcaaagatgactcagcactag

SEQ ID NO: 214009 - DNA, 1170 bp, Artificial Sequence
  Description of Artificial Sequence: Synthetic coding sequence
atgtcaaaaattagcgaagccgtgaagagggccagagccgctttcagttctggccgtactcgacctctacagtttaggatccagcagctagaggccttacagaggttgatccaagagcaggagcaggaattagtcggtgctctggccgctgatttgcataagaatgagtggaatgcctattatgaggaggtcgtctacgtgctggaagagatcgagtatatgatccagaagctccccgaatgggcagcagacgaaccagttgaaaagaccccgcagacccaacaagatgaactctatattcactctgaacccctgggggtcgtgctcgtcatcggcacctggaattacccattcaacctcacaatccagcctatggtcggggctattgcggctggcaacagtgtggtgctcaagcccagcgagttgagcgagaatatggcttccctattagcaaccattataccccagtacctcgacaaagatctgtatcccgtaattaacggaggagtaccagagactacggagctgttaaaagagcgcttcgatcatatcttgtataccggcagcactggggtagggaagatcattatgaccgctgcagccaagcacctcacccctgttactctcgagttgggaggcaagagcccctgttatgtcgataagaactgcgatctggatgttgcgtgcagacggatagcttggggaaagttcatgaattctggacagacctgtgtcgctccagattatatcttgtgtgaccctagcattcaaaatcagatcgtggagaagcttaagaagtctttaaaagagatatttggtccggtcttacctatcgtgtgtgtccgctccctggaagaggcgatccagttcattaatcagcgggagaaacccctggccctgtatatgttctcatcaaatgacaaggtgatcaaaaagatgattgccgaaacaagctcaggcggagtcgccgcaaacgacgtgatagtacacattacactgcattccctgcccttcgggggtgtgggcaattctggcatggggtcctaccacggcaagaagagtttcgaaactttcagccaccggaggtcttgcctggtaagaccattaatgaacgacgagggacttaaagttagataccctcctagcccggcaaaaatgacacagcactag

SEQ ID NO: 214010 - DNA, 693 bp, Artificial Sequence
  Description of Artificial Sequence: Synthetic coding sequence
atgtcaaagatctcggaggctgttaaaagggctagagcggctttctcttcagggcgaacaagaccactgcaatttaggattcagcaattggaggcgctgcagcgcttgatccaggagcaggagcaagaattggtgggagctctggccgcagatctgcataaaaatgagtggaatgcctactatgaggaggtggtctatgtgctcgaagaaatcgagtacatgatacagaagcttccagaatgggctgcagatgagccagtggagaagacccctcaaacccagcaggatgaactctacattcacagtgagccacttggcgtcgtgcttgtgatcggaacttggaattaccctttcaacctcaccatccaacccatggtgggagcaattgctgcaggaaactctgtggttctgaaaccctccgagctttctgaaaatatggccagcctgcttgcaaccataatcccacaatatttagataaggacctatacccagttatcaatggcggagttccggaaacaaccgagctgctaaaggaacgctttgaccatatattatacacgggttcgaccggtgttggcaaaattatcatgacagccgctgccaaacacctaacaccagtaaccctcgaactgggagggaaaagcccctgttatgttgacaaaaactgcgacctcgacgttgcgtgcaggtag

SEQ ID NO: 214011 - DNA, 1119 bp, Artificial Sequence
  Description of Artificial Sequence: Synthetic coding sequence
atgtcgaaaatctcagaggccgtgaagagagccagagctgctttttcctccggtcggacacgcccactgcagttcaggattcagcaattggaggctttacagcgcctgattcaagaacaagagcaagagttggtgggagctcttgcagctgacctccacaaaaatgagtggaatgcgtactatgaagaagttgtgtatgtcctggaagagattgaatacatgatccagaaactccccgaatgggccgcagatgagcccgtggagaaaacgccccagacccagcaagatgagctgtatatacactctgaacctctgggcgtggtgcttgtaattggaacttggaattacccatttaacctcactattcaaccaatggtgggagcgatagccgctggaaactccgtagtgttaaaacctagcgagctgagcgaaaacatggcgagtctgctcgctacaattattccccagtatctagacaaggatctgtaccccgttatcaatggtggagtacctgagaccaccgaactgctgaaggagcggttcgatcatattctctacacaggatcaacaggcgtgggaaaaattataatgaccgccgcagccaagcatctgaccccagtgacactggagcttggaggcaaatctccatgttacgtggataaaaactgcgatctggacgttgcttgccgcagaatcgcatgggggaaattcatgaactcaggacagacatgtgtggcccctgattatatattatgcgaccctagcattcagaaccagattgtggagaagctgaagaagtctctgaaagagttttacggggaggatgcaaagaagagccgtgactatgggaggataatctccgccagacacttccagcgcgtcatgggactgattgaaggtcagaaagtggcgtacggcggaacaggcgatgccgcaactagatatatcgctccaactatattgacagacgttgacccgcagtctcccgtaatgcaagaggaaatctttggtcccgtcctgcccatcgtgtgcgtgagaagcttagaagaggcaatacagttcataaaccagagagagaaacccctggcactttacatgttctctagcaatgacaagtag

SEQ ID NO: 214012 - DNA, 1362 bp, Artificial Sequence
  Description of Artificial Sequence: Synthetic coding sequence
atgtcaaagatctccgaggcggtgaagcgtgctagagccgctttctctagcgggaggacaagaccccttcagtttcgaattcagcagctggaagctcttcagcgtctgattcaagaacaggaacaggaacttgtcggagcgctcgctgccgatttacataaaaatgaatggaatgcctattacgaggaagtggtctatgttctggaagagattgagtacatgatacagaagctccctgagtgggctgcagatgagccggtcgagaagacccctcagacccagcaggacgaactgtacatccacagtgagccccttggagttgttctggtgatcggcacctggaattatccattcaatctgactatccagcctatggtgggtgcaatcgcggcaggcaactccgttgtactcaaaccatcagaacttagtgaaaatatggctagcttgctcgcaacgatcatcccccaatacctcgacaaggatctctatccggtcattaacgggggagtgcctgagaccaccgagctcttaaaagaaagattcgaccacattctctacactgggagtacaggagtaggaaaaattatcatgactgctgccgctaagcatttgactcccgtgaccctagagctcggcggtaagtccccctgctatgtggacaagaactgcgacctggatgtggcctgcagacgcatcgcctgggggaagttcatgaatagtggacagacttgtgtggctccagattatatattgtgcgatccctcaattcagaatcagatcgtcgagaagctaaaaaaatcattgaaggagttctacggggaggatgctaaaaagtcgcgggactatgggaggattatctcagcacggcatttccagcgcgtgatgggtctgatcgaaggccagaaggtcgcctatggagggacaggcgatgccgctacacgctatatcgctccaactatcctgactgatgtggatccacagagcccagtcatgcaggaagaaatctttggcccagttctccctatcgtgtgtgtgagatcacttgaggaggccattcagtttattaaccagagggagaagccactcgccctttatatgttcagttctaatgataaggtgatcaagaagatgatcgcggaaacgagctccggcggagttgcggcaaacgatgttatcgttcacatcacactgcactcgctgccttttggcggagttgggaattccggcatgggttcttatcatggcaagaaatcttttgaaacattcagccatagacgctcttgtctggtacgccctctgatgaacgatgagggcctgaaggtccgctacccaccaagcccagccaagatgactcagcactag

SEQ ID NO: 214013 - DNA, 1362 bp, Artificial Sequence
  Description of Artificial Sequence: Synthetic coding sequence
atgagtaagataagcgaggccgtgaagagagctagagcagccttcagtagtgggaggactaggcctctgcaattccgcatacagcagttagaagccctccagcggttgattcaggaacaggagcaggaactggtgggcgcacttgctgctgatctgcacaagaacgagtggaacgcatattacgaggaagtcgtctatgtgctagaggagatcgaatatatgatccagaagctacccgagtgggcagctgacgagcccgtagagaagaccccccaaactcaacaggacgaactgtacatccattctgagcccttaggagtagttctcgtcattggcacgtggaattatcctttcaacctgactattcagccaatggtgggggcaatagccgctgggaactccgttgtgctgaagccctccgagctgagcgaaaacatggccagcctgctagcgaccattatcccacaatacctcgacaaggacctttatccggtaatcaacggcggagtccccgaaaccacagagctgctgaaggaaagatttgatcacattctgtataccggttcgaccggggttggaaaaatcatcatgactgccgctgccaagcatctgaccccggtcaccttggaactcgggggtaaatctccctgctatgttgacaaaaactgcgatcttgatgtagcctgccgcaggatcgcatggggaaagttcatgaactcaggccagacttgcgtcgccccagattatatcctgtgtgacccaagcatccagaaccaaattgtcgagaaactgaaaaagagtctgaaggaattctacggagaagacgccaaaaagtcccgtgattacggaagaatcatctctgcaagacactttcagagggtgatgggactgattgagggccaaaaggttgcatatggagggactggcgacgccgcaacccggtacattgcacctaccatcctgacagacgtggatccccagagcccagtaatgcaggaagaaatctttggcccagtgttgccaatagtctgcgtgaggagcctggaagaggcgattcagttcataaaccagagggagaagcccctggccctttacatgttctctagcaatgataaagtaatcaaaaaaatgattgctgaaactagctctgggggagtcgccgctaatgatgttatagtgcacattaccctccattccttaccttttggtggcgtgggaaactcaggcatggggagttatcacggtaaaaaatctttcgaaaccttctcacatcggagatcctgccttgtgaggcctctcatgaacgatgaaggtcttaaggttcgctacccaccttcgcctgccaagatgactcaacactag

SEQ ID NO: 214014 - DNA, 1203 bp, Artificial Sequence
  Description of Artificial Sequence: Synthetic coding sequence
atgattcagaagttgcctgagtgggccgctgacgaaccagtcgagaagactccacagacccaacaggacgagctgtatatccattccgaaccgctcggggttgtcctggttataggcacgtggaattatccttttaatctgactatccagccgatggtgggggctatcgccgcaggtaatagcgtggttctgaagcctagcgaactgagcgagaacatggccagcctgctggctaccattattccacaatatctcgataaagatctttacccagtgattaacggaggcgtccccgaaacaaccgagctgttgaaagagagattcgaccacatactatacaccggcagcacgggagtgggaaagatcatcatgaccgctgccgcaaagcatttaacaccagtcacactggagctcggcggtaagtctccatgttacgtggataaaaactgtgacctcgacgtggcctgtcggcgtatcgcatggggtaaattcatgaattcagggcagacgtgtgtagcgcctgactacatcttatgtgacccttctatacagaaccagatcgttgaaaagttgaagaagagcttgaaggaattttacggtgaagatgccaaaaagagcagggactacggccgaattatctcagcaagacactttcagcgagtcatgggccttattgagggacaaaaagtggcctatgggggaactggggacgctgctactaggtatattgcacctaccattcttaccgacgttgacccccagtctcctgtgatgcaggaggaaatcttcggaccggtcctgccgatagtgtgcgtgcgctcgctggaggaagctatccaattcatcaaccagcgcgaaaaaccacttgcattgtatatgtttagttctaatgacaaggtgatcaaaaagatgatcgccgagacttcctccggtggcgtggcagctaacgatgtcatcgtgcacatcacgctgcacagcctaccgttcggaggtgtgggaaacagtggtatggggtcctatcacggcaagaagtctttcgaaacatttagccatcggaggagctgcctcgtgagaccgctgatgaatgacgaggggctgaaagtcaggtacccgccatctcctgccaaaatgacccagcactggctatcatggccctgggaaaatcggtcctgtagcccgtcccctgcccctctcttgtgttag

SEQ ID NO: 214015 - DNA, 1458 bp, Artificial Sequence
  Description of Artificial Sequence: Synthetic coding sequence
atggaactcgaggttcgccgtgtgcggcaggcattcctgagcggtcgctctcgacctttgaggtttcgtctgcaacagttggaagcactgcgacgcatggtgcaggagcgcgaaaaggacatactgacagctattgctgctgatttgtgcaaatcggagtttaacgtttattcacaggaggttattactgttttgggcgagatcgacttcatgctggagaacctaccagaatgggtgacagccaagcccgtgaaaaagaacgtcctgaccatgctggatgaggcttacattcagccacagccccttggcgtggttctaatcatcggggcatggaactatccgttcgtactcacaattcagccactaatcggagctatagccgcaggaaatgcggtcataattaaaccatccgagttatctgaaaacacagccaagatcctcgccaaactgcttcctcagtatctggaccaggatttatatatagttattaatggcggagtggaagagacaactgaactcttgaaacagaggttcgatcatatcttctacaccgggaacactgctgtgggcaagattgtgatggaagccgctgccaaacacctaactcctgtcacattggaactaggcggtaagagcccgtgttacatagacaaagattgtgatttagacatagtttgccggaggattacatggggcaaatacatgaattgtggccagacctgcattgccccagattatatcctgtgtgaagcaagcctccagaaccagattgtgtggaagataaaagagaccgtgaaggagttctatggagaaaacatcaaggagtcccccgattacgagagaatcatcaatctccgccatttcaagaggatccttagtctgctggaaggacagaagatcgccttcgggggtgagactgatgaagccacgcggtacattgcgccaaccgtgttgactgacgtcgaccctaagaccaaggtgatgcaggaagaaatcttcggacctattttgccgatagtcccagtgaagaatgttgacgaggccatcaatttcattaatgagcgagagaagcccctggccctttacgtcttttcccacaaccacaaactgataaagcgtatgattgacgaaacttcgtcgggcggagttaccggcaacgacgttattatgcattttaccctgaacagcttccccttcgggggagtcgggagtagtggtatgggcgcatatcacgggaaacactcattcgacactttctcacaccagagaccatgtctcctgaagagtttgaagcgggagggggcaaacaaactgcgctaccctcccaactcccaatccaaagtcgattgggggaagttctttttactgaagaggttcaacaaggaaaaactggggctgctcctcctgactttcctcgggattgttgccgctgtgctcgtgaaagcagaatattactag

SEQ ID NO: 214016 - DNA, 1527 bp, Artificial Sequence
  Description of Artificial Sequence: Synthetic coding sequence
atggaacttgaagttcgtagggtcaggcaggcctttctgagtggcaggagtagacctcttagattccgactgcagcaactggaggcattgcgacgcatggtgcaagagagggaaaaggacatcctgacagccattgccgctgatttgtgtaagagtgaattcaacgtctactcccaggaagtgattacagtgctgggtgaaattgatttcatgcttgaaaatctgccagaatgggtgactgccaagcccgttaaaaaaaatgtactgaccatgctggatgaggcctacatccagcctcagcctctgggtgttgtccttattatcggagcctggaattatccatttgttttgacaatccaacctttgattggagcgatagccgctggcaatgctgtgatcatcaagccctccgagctgtccgagaacactgcaaagatcctggctaagctcctgcctcagtatctggaccaggatctgtacatcgttatcaacggaggggtcgaggaaacaaccgagctgctcaaacagaggttcgaccacatattctacaccggcaacaccgccgtgggtaagatcgttatggaggccgctgcaaagcacctcacaccagtgacgctcgagctgggtggcaagtctccctgttatatagataaggattgcgacctagatattgtgtgccgtagaataacctgggggaaatacatgaattgcggccagacctgtatagcccctgattacatcctgtgtgaagcttccttacagaatcaaatagtgtggaagatcaaggagaccgtgaaggaattttatggcgagaacatcaaagaaagccccgactacgaaagaatcattaatctgcgccactttaagcggatcctgagcctgctcgaagggcagaaaatcgccttcggaggagaaactgacgaagctaccagatatattgctccaaccgtactcaccgacgtggacccaaagaccaaagtcatgcaagaagaaatttttggtcccattctgcctatcgtccctgtcaaaaatgtcgacgaagcgataaattttataaatgaaagagaaaaacctttagcactctatgtgttttcccacaaccacaagctaatcaagcgcatgatcgacgagacaagctccggaggggtgaccggaaatgacgtgatcatgcatttcactctcaacagctttccattcggaggcgtggggtcctccggtatgggcgcttaccacggtaagcattcctttgacaccttctcccatcagaggccctgtctgctcaagtctctgaaaagggagggagctaacaaactccggtaccccccaaactcccagagcaaggtggattggggcaagttctttttgttgaaacgctttaacaaggaaaagttgggcctgttgctcttgactttcctcggaatcgtggcagctgtgttggtgaaaaagtatcaggccgtcctgagaagaaaggcccttctgatatttttggttgtgcatcgcctgaggtggtcaagtaagcagcgatag

SEQ ID NO: 214017 - DNA, 1458 bp, Artificial Sequence
  Description of Artificial Sequence: Synthetic coding sequence
atggaacttgaagtccgaagagtgcgacaggccttccttagcggcagatctcgaccgctgagatttcgcttgcagcagctcgaggctctccgcagaatggtccaggagagagagaaagatatactcactgctatcgcagcagatctgtgtaagtcggaattcaacgtgtacagccaggaagttataacggtgctcggcgagatagactttatgctcgagaatttgcccgagtgggtcactgcaaagccagtgaagaagaatgtcctgaccatgctggacgaagcctacattcaaccccaacctttgggcgtggtgctcatcattggagcttggaactatcccttcgtgctcacaatccaaccattgattggcgctatagccgctggaaacgcagtgataatcaagccaagcgagctgtccgagaacaccgcaaagatcctcgctaagctgctgcctcagtatttggaccaggacctgtatattgtgatcaatggaggagtggaagagacaaccgagctgcttaagcagcggttcgaccatattttctataccggaaatactgcagtgggtaagattgtgatggaagcagctgccaagcatctgacacctgtcacgctggagctgggcggaaaatccccgtgttacatcgacaaggattgcgatttggacatcgtgtgcaggaggatcacatggggtaagtacatgaactgtgggcagacctgcatcgctcccgactacattctttgtgaagcctcactccagaaccaaattgtctggaagataaaagagactgtgaaggaattttacggggagaacataaaagagagtccagactacgagaggatcatcaacctaagacactttaaaagaatcctatccttattggaaggccaaaaaattgcatttgggggagaaacagacgaagccacccgctacattgcaccaaccgttctgacagatgttgatccgaagaccaaagtcatgcaggaagaaatttttgggcctattctcccaatcgttcctgttaaaaatgtggacgaggcaattaatttcattaacgaacgggagaagccactggctctgtacgtgttttctcataatcataagcttatcaaaaggatgattgacgagacttcttccggaggcgttaccggtaatgatgttattatgcatttcaccctgaacagtttcccctttggcggagtggggtcaagcggtatgggtgcctaccacggaaaacacagcttcgacactttttcccatcagcgaccttgtttattgaaatctctgaaacgagagggagccaacaaactcagatatccccctaacagtcagagtaaggtcgattggggtaaattcttccttctcaagcgctttaacaaagaaaagctggggcttcttctcctcacatttttgggcatcgtggccgcagtgcttgtcaaggccgagtactattag

SEQ ID NO: 214018 - DNA, 501 bp, Artificial Sequence
  Description of Artificial Sequence: Synthetic coding sequence
atggaattagaagtcagacgtgtcagacaggcattcctgagcgggagaagccggccactccgattccggctgcaacagctagaggcgctgcggaggatggtccaggagagagaaaaggacatcctgacagcaattgctgccgacctgtgtaaatctgagttcaacgtgtacagtcaggaagtcatcacagtgcttggtgaaatagacttcatgctcgagaatctgccagagtgggtaaccgccaagcctgtcaagaagaatgttctgaccatgctggatgaggcatacatccaaccacagcctctgggagttgttttaatcatcggagcctggaattatcccttcgtgctaaccatccaaccactgatcggcgctatagccgctgggaacgcggtgataataaaaccgtcagaattaagtgagaacactgccaaaatcctggcgaagctcctgcctcaatacttggatcaggacttgtacattgtgataaacggcggatag

SEQ ID NO: 214019 - DNA, 1158 bp, Artificial Sequence
  Description of Artificial Sequence: Synthetic coding sequence
atgaaagatgaaccccgatccactaacctgtttatgaagttggacagcgtttttatctggaaggaaccctttgggttagtactgatcatagctccttggaactatccattgaacctgacactcgtgctgctggtgggggctctggccgctgggagttgcgtggtccttaagccctccgaaatatctcaggggactgagaaggtgctcgcagaggtcttaccacaatacctcgaccagtcatgcttcgctgtggtgctgggcggaccccaggagacaggccagctgttagaacataagctcgattacatctttttcactggctctcccagagtaggcaagatcgtgatgacagccgcaaccaagcatctgacaccagtgactctggaactaggaggcaaaaatccctgttatgtcgacgacaactgcgatcctcagacagtggctaaccgcgtggcatggttttgctacttcaatgccggacaaacctgcgttgcccctgattatgtactgtgcagccccgagatgcaggagagactactgcctgccttgcagagtacgattacccgcttctacggggatgacccccaatcttcacctaatctcgggcacatcatcaaccagaaacaattccagaggctgcgagctttgctcggctgcagccgcgtagccatcggaggccaaagtaatgaatctgacaggtatatcgctcccactgtgctcgtcgacgtccaggaaacagagcctgtaatgcaggaggaaatattcgggcctatcttgcctatcgtcaacgtgcagagtgtggatgaggccatcaaattcatcaatcgtcaggagaagcccctagcactatacgcctttagcaatagcagccaagttgtcaaccagatgcttgaacgaacgtcatcaggatcattcggcggaaatgaaggattcacatacatcagcttgctcagtgtcccctttggcggagtaggacactccggaatgggtcgctaccacggtaaattcacattcgacaccttctcccatcaccgcacctgtctcctggccccatcaggactggagaaactcaaggagatccactacccgccttataccgactggaaccaacagcttctgcgatgggggatgggctcccaatcctgcacacttctgtag

SEQ ID NO: 214020 - DNA, 447 bp, Artificial Sequence
  Description of Artificial Sequence: Synthetic coding sequence
atgaaagacgaaccacggtcaacaaatctttttatgaagttggattctgtgtttatctggaaggagccttttggcctggtgcttattattgcgccatggaattacccactgaatctcacactagtcctgctggtcggtgcccttgcagctggcagttgcgtggtcctgaaaccctctgagatttcgcaggggactgaaaaagttctcgcagaagtgctgccacaatatctcgaccagagctgttttgctgtggtgctgggtggccctcaggagaccggccaactcttagaacacaaactcgactacattttcttcacaggttcgccaagagtagggaagatagtgatgacggcggctaccaaacatttgaccccagtcactctggaactgggtggcaagaacccatgttatgtggatgacaactgcgacccccagactgtggcatag

SEQ ID NO: 214021 - DNA, 288 bp, Artificial Sequence
  Description of Artificial Sequence: Synthetic coding sequence
atgaaggacgagccaagaagcaccaacctgttcatgaagctcgactcagttttcatctggaaggagccattcgggctggtgctgatcattgcaccatggaattaccctttaaacttaactcttgttctgttggttggcgcattagcagctggttcatgtgtagttctgaaaccgtctgagatcagccagggcacagagaaagttctagcggaagtacttccccagtatcttgaccagtcctgcttcgccgtcgtgctgggaggcccacaggagaccggacagctttag

SEQ ID NO: 214022 - DNA, 1158 bp, Artificial Sequence
  Description of Artificial Sequence: Synthetic coding sequence
atgaaagacgaacccagaagcaccaatctgtttatgaagcttgactcagtcttcatttggaaggaaccctttggattagtgctaatcatcgctccctggaattatcctttgaatttgacgctggtcttgctcgtgggcgctctcgccgcaggaagctgcgtagttctcaaaccttcagaaataagtcagggtacggaaaaagttcttgcagaggtgctgccccagtatcttgaccagtcctgttttgcggtggtcctcggcggtccacaggaaacagggcagctgctagagcacaagctggattacatttttttcactgggtcccctcgtgtcggaaagatagtaatgaccgcggctaccaagcatctgaccccagtcaccctggagttgggtgggaaaaatccatgttacgtggacgataactgtgatccgcagaccgtcgcaaaccgcgttgcttggttttgctactttaacgccggacagacatgcgtggcccctgattatgtgctatgttcaccagagatgcaagagaggctgctccccgctcttcaatctaccatcacgcgtttctacggcgacgatccacagagttctcctaaccttggacacataatcaaccagaaacagttccaaagacttagagccctgctcggctgttcccgagtagctatcggagggcaatcaaatgagtcagacagatatatagcccctacggtactggtagacgtgcaagagaccgaacccgtgatgcaggaagagatcttcggtccaattctgccaatcgtaaacgttcagtctgtagacgaggccatcaaattcataaataggcaagaaaaaccactcgctctctatgctttcagcaacagttctcaagtggtgaaccaaatgctcgaacggacatccagcggctccttcggcggtaacgaaggattcacttatatttctctcctgtcggtcccattcgggggagttggtcactctggtatgggcaggtaccacggtaaattcacattcgatacattctcccaccatcggacatgccttttagctccaagcgggctagagaagctaaaggagatccattaccctccctacaccgactggaaccaacagctgcttcgatggggaatggggtcacaaagctgcacgttactgtag

SEQ ID NO: 214023 - DNA, 1692 bp, Artificial Sequence
  Description of Artificial Sequence: Synthetic coding sequence
atgctgctccccgcacctgcactcagaagagccctgcttagcaggccatggactggcgctggcctgcgttggaagcatacgagtagcctaaaggtggccaacgagccagtactagcatttacacagggctcgccggagagggatgcattgcaaaaggccctgaaagatctgaaaggacgtatggaggccatcccttgcgtcgtcggcgacgaagaagtatggacctcagatgtccaataccaggttagtcctttcaaccacgggcacaaagtcgccaaattctgctatgctgataagtccctgctgaacaaggcaatcgaggcagccctcgcggctagaaaagaatgggacttgaaacccatagcagacagggcacagatttttctgaaggctgcagacatgttaagcggtcccaggagggccgaaatactcgctaaaactatggtggggcaaggcaagacagtgatccaagcagagattgacgcagctgctgagctcatagacttcttcagattcaacgcaaaatatgctgtggagctggaaggccagcaaccaatctcagtgcctcccagcactaactccacggtttatagaggactggagggattcgtggcagctatctccccgtttaacttcactgccatcggaggtaacctcgctggcgctcctgccctcatgggaaatgtcgtcctgtggaagccgtccgataccgctatgctggcctcttacgccgtgtatagaatactgcgtgaggccggattgcctccaaatattatccagtttgtcccagccgacggacccctattcggtgatactgtgacatcttccgagcatctttgtgggattaacttcactggtagcgtcccaacctttaagcacttgtggaaacaggtcgcccaaaacctggaccgctttcatacttttcctaggttggccggtgagtgtggcggaaagaattttcatttcgtgcaccggtcggccgatgtggagtctgtggtttcaggaaccctgagaagtgcttttgagtacggcggacaaaaatgtagtgcctgctctcggctttatgtgccccactctctatggccgcagatcaaggggcgacttttggaggaacactcgcggataaaggtaggtgacccagccgaggactttggcactttcttcagtgcagtgattgacgccaaatcttttgcacgcattaagaaatggctggagcacgctcgatctagccccagtctgacaatactagccggaggcaaatgtgatgattcagttgggtacttcgtcgagccatgtatcgtggagtccaaagatcctcaggagcccatcatgaaagaggagatttttgggcctgtgctctctgtgtacgtttatcccgacgacaagtacaaggagaccctccaactcgtggattctacaacatcatatggtttgaccggtgccgtgttctcacaagataaagatgtggtgcaagaagccactaaggtgctacgaaatgccgcagggaatttttacattaatgataagtctaccggatctattgtggggcaacaacccttcgggggagccagagcatctggtacgaatgacaagcctggagggcctcattatattctgaggtggacctccccacaggtgataaaggagacccataaacctctgggggactggtcctacgcatatatgcagtag

SEQ ID NO: 214024 - DNA, 588 bp, Artificial Sequence
  Description of Artificial Sequence: Synthetic coding sequence
atggaggcaatcccttgcgtcgttggagacgaggaggtttggacatccgacgtacagtaccaggtatccccatttaatcatgggcacaaggtggccaagttctgctacgctgacaagagcttgttaaacaaagcgatcgaagccgctctggcggctcgaaaagagtgggacctcaagcctatcgccgacagggcccagatattcctcaaggctgctgacatgctgtcgggtcccaggcgcgctgaaattttagccaagactatggtgggccagggcaagactgtgatacaggctgagattgacgctgccgctgagctgatcgactttttccggttcaacgccaaatacgccgtagaacttgaaggccaacagccgatctctgtccctccaagcaccaactcaaccgtgtatcgaggccttgaaggtttcgtcgccgcaatctcccctttcaactttactgctatcggcggtaacctagcgggagctccggctttgatgctgcgcgaaggcgtggtgaccctcccactatgtcaaatgactaagctgagacataccgctgtaacctatctcgctaggttgagcgattag

SEQ ID NO: 214025 - DNA, 633 bp, Artificial Sequence
  Description of Artificial Sequence: Synthetic coding sequence
atgttactgcccgcacccgctctcaggagggcactgctatccagaccctggactggtgccggacttagatggaaacacaccagttccttgaaggtggcgaacgaaccagtgctggctttcacgcaggggtcaccagagagggatgccctgcagaaggctctgaaagacctgaagggaagaatggaggcgataccttgcgttgttggcgatgaggaagtttggacaagtgacgtgcagtatcaagtatcttctctgttgaacaaagccatcgaggcagctttagcggcacgcaaagagtgggacctaaagccaattgctgatagagctcagatctttctcaaggctgccgacatgctgagtggtccccgacgcgctgagattttggccaaaaccatggtcggacaggggaagaccgtgatccaggcagaaattgacgccgcagcagagctgattgacttctttcgcttcaacgctaagtatgcagtggagctggaaggacagcagcctattagtgtccctcccagtactaattcgaccgtgtatcggggtcttgagggctttgtggccgctatctcaccctttaactttacggctatcggcggaaatctggcgggtgcgccagcgctgatgtag

SEQ ID NO: 214026 - DNA, 1692 bp, Artificial Sequence
  Description of Artificial Sequence: Synthetic coding sequence
atgttgctaccagcacctgctctcagacgagctctgctctctcggccatggaccggggctggtcttcgctggaagcacacctcatcgttgaaggtggctaacgaacccgtcctggctttcacccaagggtctcccgaacgcgatgcacttcagaaagcgttgaaggatctgaagggtagaatggaggccataccctgtgtggtcggcgacgaagaggtgtggacatctgacgtgcaatatcaggtgtcaccctttaaccacgggcataaagtggccaagttctgctatgccgacaagtccctattaaacaaggccatagaagctgccctggcagctagaaaggagtgggacctcaagcctattgctgaccgggcacagatctttctgaaggcggcagacatgctgtcagggcctagaagggccgagattctggcaaagacaatggtggggcaagggaaaacagtcatacaggcagagatcgacgctgccgcagagttaatcgactttttccggttcaatgctaagtacgcggtggaactggaggggcagcagcctatctcagtccctccatcaaccaactccacagtctaccggggtctcgaagggtttgtcgcagcaattagtcccttcaacttcacagcaatcggcggtaatctagctggtgcgcctgctctcatggggaacgtcgtcctttggaaaccttctgacactgctatgctcgcgagctacgccgtttaccgtatcctgagggaagccggtcttcctccgaatatcattcagtttgtgcccgcagatggaccgctgtttggcgataccgttacgtcttcagagcatctttgcgggattaattttacaggaagcgtccccacttttaaacacttgtggaaacaggtggctcagaatttggatcgtttccacacgttccctagattggctggggagtgcggaggaaagaacttccatttcgtgcaccggtccgctgatgtggaatctgtggtcagcggtacgctgcgctccgcttttgagtacggtgggcagaagtgttcagcgtgttcgaggctttacgtcccacattccctgtggcctcagatcaagggacgtttgctggaagagcattcccgaatcaaggtgggggaccccgctgaagacttcggaactttctttagcgcagtgattgatgctaagtctttcgctcgtatcaaaaaatggcttgagcacgctaggagttctcctagtctcactatactcgcagggggtaagtgcgacgacagtgtaggatattttgtcgagccgtgtattgtagagtcaaaggatccgcaggaaccgattatgaaggaagagatcttcggacctgtgctatcagtgtacgtgtatcccgatgacaaatacaaggagaccctgcaattagtagatagcacaacctcatatgggctgaccggagccgtgttttcgcaggataaagatgtggtgcaggaagcgactaaggtcctgaggaatgcagctggaaacttttatatcaacgacaaaagcaccggatcaattgtgggacagcagccattcgggggtgccagggctagtgggactaatgataaaccgggtggaccacactacatcctcagatggacatccccccaagtaatcaaagaaacccacaagcctcttggcgactggagttatgcttacatgcagtag

SEQ ID NO: 214027 - DNA, 645 bp, Artificial Sequence
  Description of Artificial Sequence: Synthetic coding sequence
atgctcctgccggctcctgcactacgcagagcgttattgtccaggccttggacgggcgctggcctccggtggaagcatactagttccctgaaagtcgctaatgagcccgttctggccttcactcagggctcccccgagcgggacgctctgcagaaggctttaaaagaccttaaggggaggatggaggccataccgtgtgtagtgggagacgaggaggtctggacatccgacgtgcagtatcaggtgtcaagtctgctgaataaagctatagaagctgctttggccgcaagaaaagaatgggacttgaaacccatcgccgatagggcccaaattttcctgaaggctgctgacatgctgtccggaccgagaagggccgaaatattggcaaagactatggttggccagggcaagaccgtgattcaggctgagatcgacgcagccgcagagctcatcgacttttttagattcaatgccaaatacgcagttgaactcgagggacagcaacctatctctgtcccaccatcgacaaactccacagtgtaccgcggtctcgagggttttgttgcagcaattagtccgttcaacttcacagctattggcggaaatctggctggcgcaccagccttgatggtccgatgcggctag

SEQ ID NO: 214028 - DNA, 462 bp, Artificial Sequence
  Description of Artificial Sequence: Synthetic coding sequence
aataaagccatcgaggcagcattggctgccaggaaagagtgggacctgaaaccaatcgcggatcgagcccagatcttcttgaaagctgccgacatgctgtcaggccctcgcagagcagaaattcttgccaaaactatggtgggacaggggaagactgtaattcaggctgaaattgacgccgcagctgaactcatcgatttctttcgttttaacgctaaatacgcagtcgaactagaggggcagcaacctatcagcgtccctccatcaactaactcaaccgtgtatagggggctcgaggggtttgtggctgctatcagcccatttaattttactgccatcggaggcaatttagctggcgcaccggctcttatgctgcgggagggtgtggtaaccctgcctctgtgccagatgactaaactacggcacaccgccgtgacttatctggctcggctgagtgattag

SEQ ID NO: 214029 - DNA, 1512 bp, Artificial Sequence
  Description of Artificial Sequence: Synthetic coding sequence
atggaggcaatcccatgtgtggttggcgacgaagaggtctggacctccgacgttcagtaccaggtgagccctttcaatcatggtcacaaagttgcaaagttctgctatgctgacaaatctctgctgaacaaggcaatcgaggccgctctagctgcaagaaaagaatgggacctgaaaccaattgcagacagggcccagattttcttgaaggcagccgatatgttgtcgggccctcgccgagctgaaatcctggctaaaacaatggtcggacagggtaagaccgtaatccaggcagagatcgacgccgctgcggagctgattgatttctttcgatttaacgccaaatatgccgtggagctggagggtcagcaaccaatatccgttcctccgagtaccaattctacagtatacaggggccttgagggattcgtagcagcaatctcgcccttcaacttcacagcaatcggaggaaacctcgctggggctccggctcttatgggcaacgtcgttttgtggaaaccgtctgacactgcaatgctcgcttcatacgccgtatataggattctcagagaagccggtctgccaccaaacataatacagtttgttccggctgatggtccactgttcggagatacagtaaccagcagtgagcatctctgtggcatcaattttaccggaagcgtacctacttttaaacatctctggaagcaggttgcacaaaatttagatagattccatacttttccgcgactcgctggagagtgcggcggaaaaaatttccacttcgtgcaccggagcgccgatgtggagtctgtggtgtcaggcactttaagatccgctttcgagtacggaggtcagaaatgttcggcctgctcccggctgtacgtcccacatagcctgtggccgcagatcaaaggccgactgctggaggagcactcccggataaaggtgggagatcctgccgaggattttggaacgtttttcagcgcggtcattgacgctaagtctttcgccagaattaagaagtggctggagcacgcgaggtcttccccgtccctgaccatactggcgggaggaaagtgcgacgactctgtgggctattttgttgaaccatgtatagtggaatctaaggacccgcaggagccgattatgaaagaagagattttcgggccagtcctgagtgtatatgtctaccccgatgacaagtacaaggaaacacttcaactggtagatagcactacatcctacggcctgactggggctgtcttctcccaagacaaggatgtcgttcaggaggctaccaaagttctccgcaatgccgcaggcaatttctacatcaacgacaaatccacgggttccatcgtgggacaacagccctttggtggggctcgcgcttctggcacaaacgataagcccggtgggccacactacattctcaggtggacctctccccaggtcatcaaggagacccataaaccgctgggagattggagctatgcgtatatgcagtag

SEQ ID NO: 214030 - DNA, 1539 bp, Artificial Sequence
  Description of Artificial Sequence: Synthetic coding sequence
atgctcttacctgctccggctctgcgaagggctcttctgtccaggccttggacaggggctggcttgcggtggaagcatacgtcatctctaaaagtggcaaatgagccagtcctagcctttacacaaggtagccctgaaagagacgctctgcagaaagccttgaaagacctcaaaggcaggatggaggccatcccatgtgtcgtgggcgacgaggaggtgtggacctcggatgtacagtaccaggtgtccccattcaaccacgggcataaagttgcaaaattttgttatgcagacaagagtttattgaataaagcaatagaggctgcgttggccgctagaaaggaatgggatttaaaacccattgcggatcgggcacagatctttctcaaggcggcagacatgctctcggggcctcgaagggctgagatcctagctaagaccatggtgggtcaagggaaaactgtaatacaggcagagatcgacgctgccgcagaactaatcgattttttccggtttaatgccaaatatgcagtagaactggaaggccagcagccaatcagcgtgcctccgagtacaaattccaccgtgtatagaggactggagggattcgtagccgctatctctccattcaactttacggccatagggggaaacttagctggagccccagctctaatgggaaatgtcgtcctttggaagcccagcgacaccgccatgttggctagttacgctgtatacaggattcttagggaggccggactacccccaaacataattcagtttgtgcctgctgatgggcctcttttcggtgatacagtgaccagctctgagcacctttgcggaattaattttactggcagcgtgcccacatttaagcatttgtggaagcaggtggctcagaatttagatcgatttcacacattccccaggctggccggagagtgcggcggaaagaactttcacttcgtgcaccgaagtgcagatgtcgagagtgtcgtgtcaggaactttgcggagcgcgtttgaatacggcggtcagaagtgtagtgcctgttcacggctgtacgtgccacactccctgtggcctcaaattaagggacggctgttggaggaacatagccgaattaaggtgggggaccctgctgaggatttcggcacgttcttcagtgccgtcattgacgccaaggaaatttttggtccagttctttcggtgtatgtgtaccctgatgacaagtacaaagaaactctgcagttggtggattcaactacctcctatgggcttaccggcgcagtttttagccaagacaaggacgtggtacaagaggccaccaaagttctgcgaaatgccgctggcaacttttacataaacgataagtctactggatccattgtcggccaacagccttttggcggtgccagagccagtggtaccaacgacaagcctggtggacctcattacattctcaggtggacctcaccgcaagtgataaaggagactcacaaaccgctcggagactggtcatatgcttatatgcagtag

SEQ ID NO: 214031 - DNA, 1647 bp, Artificial Sequence
  Description of Artificial Sequence: Synthetic coding sequence
atggccacctgcatttggctacgatcctgcggcgcacgccgtttggggagcacattccccggttgccgcctccggccacgggctggaggattggtgcccgctagcgggccagcaccaggacctgcacagctccgttgctacgcagggaggctggccggtctcagtgctgccttgttgcgcactgactctttcgtgggcggacgctggctgcccgcagctgctaccttcccagtgcaagaccccgcatccggggcagccctggggatggtggcggattgtggcgtacgagaagctcgcgctgcagttagagccgcttatgaggccttctgccgttggcgcgaggtaagtgccaaggaacgctccagtctgcttcgcaagtggtataacctgatgatacagaacaaggacgatctggcaaggattatcacagcggagtctggcaagcccctcaaggaggctcatggggagatcctctacagcgcattctttctggaatggtttagcgaggaagcgaggcgtgtctacggggatattatccatactccagctaaagatcgaagagcgctggtattgaagcagccgatcggtgtggccgcagtgatcacaccatggaactttcccagcgccatgatcacgcggaaggttggagctgccctggccgctgggtgcacagtcgtcgtaaaaccagctgaagataccccattttcagccttggcactagcagaagttaaccaaggctttttactggacctggacccactcttgctcgcctcccaggctggcatcccgtctggtgtatacaacgtgataccctgctccaggaagaatgcaaaagaggtcggggaagccatctgcacggatccactcgtctcaaaaatttcatttacaggctcaactactacaggcaagattctcttacaccacgcagcgaacagcgtcaaaagagtttcaatggagttgggtggactggcacccttcattgtatttgactcggctaatgtcgatcaagccgttgccggtgccatggcttccaaattccgaaacactgggcagacctgcgtgtgctcgaaccaatttctcgtgcagcgcggaatccatgacgcgttcgtgaaggccttcgccgaagctatgaagaaaaatttgagagtcggaaatgggttcgaagagggaacgacacaggggccattaatcaatgaaaaagcggtagagaaagtggaaaaacaagtgaatgatgctgtcagtaagggcgctacagtagtgactgggggaaagaggcaccagctcggaaagaacttttttgagccaactttgctgtgtaacgttacacaggatatgctgtgtacgcatgaggaaacgttcggtcctctagcccctgtcatcaagttcgacaccgaggaagaggcgattgccatcgccaatgctgcagacgtggggctcgcagggtatttctattctcaggatcccgctcagatttggcgcgtggcggaacagctggaggtgggtatggtgggtgttaatgagggcctcatcagtagtgtcgaatgccccttcggcggagtcaaacaatccggcctcggaagagaaggatcgaagtatggtatagatgaatacctggagttaaaatacgtctgctatggtgggctctag

SEQ ID NO: 214032 - DNA, 1608 bp, Artificial Sequence
  Description of Artificial Sequence: Synthetic coding sequence
atggcaacatgtatttggttgagaagttgtggggcacgacgcttggggtccactttcccaggctgtcgtttgcggcctcgggcaggaggcctggtaccagcatccgggcctgctcccggacctgcccagcttagatgctacgcgggacggctggcaggcctgagcgccgctctactgcggaccgacagttttgtggggggacgatggcttcccgctgccgctaccttccccgtgcaggatcccgcaagcggagcggctctgggaatggtggcagattgcggcgtgcgtgaagcccgtgccgctgttcgggctgcatatgaagctttctgccgttggcgggaggtctccgctaaagaacgttcatcattgctgaggaagtggtacaatctgatgatccagaacaaagatgatctcgccagaataattaccgcggaaagcggcaaacccctgaaagaggctcatggtgagattctttatagcgcatttttcctggagtggtttagcgaggaggccagaagagtatatggggacatcatccacacaccagcaaaggataggcgagcactcgtgcttaagcagcccataggggttgccgctgtgattacaccttggaatttcccctcagcaatgataacgagaaaggtaggtgctgccctggcagctggatgcacagttgtggtgaagcccgctgaagataccccattttctgcactggccctcgctgagctcgcctcacaggccggaattccttcgggtgtttataacgtcatcccatgctcgcggaaaaatgccaaagaggtcggagaggcaatatgcactgatcccctggtgagtaagatttcgtttaccgggtcaacaaccactggtaagatcctgttgcaccatgcggctaatagcgtgaaacgggtgagtatggagctgggtggactcgctccatttattgtcttcgactcagccaacgtagatcaggctgtcgctggggctatggcctctaaatttaggaacacagggcaaacatgtgtctgttctaaccaattcctcgtccagcggggtatacacgacgccttcgttaaagcattcgcagaagcaatgaagaagaacctccgagtggggaacgggttcgaggaaggcacgacacaggggccactgatcaacgaaaaagccgtcgaaaaagtggagaagcaagtaaacgatgccgtctcgaaaggggcaaccgtcgtgacaggaggcaagagacaccagctgggtaaaaatttctttgaacccaccctgttatgcaacgttactcaggacatgctctgcactcacgaggaaacgttcggccctctagcccctgtgatcaaattcgatacagaggaggaagcaatcgctattgcaaatgccgctgacgtgggattggcaggctacttctatagccaggatcctgcacagatatggcgtgtagctgaacaactcgaggtggggatggttggagtgaacgaggggttaatctccagcgtggagtgtcccttcgggggtgttaaacagagtgggctcggtcgcgaaggatctaagtatggcattgacgaatatctggagctgaaatatgtgtgctatggagggctgtag

SEQ ID NO: 214033 - DNA, 1344 bp, Artificial Sequence
  Description of Artificial Sequence: Synthetic coding sequence
atggtggccgattgtggagtgcgcgaagcacgggctgccgtgcgagccgcatatgaggctttctgtagatggagggaagtgtctgctaaggaaagaagttcattgctccgcaagtggtataacctgatgattcagaacaaagacgaccttgcacggattatcacggctgaaagtgggaaaccgctgaaggaggcccacggtgaaattttgtacagtgcattctttcttgaatggttcagtgaggaagcccgacgagtctacggtgacattatccatacccctgcgaaagacagaagagcactcgttttgaaacagccaatcggagtcgccgcagtcataactccctggaactttccctctgccatgatcacacgcaaggttggagctgccctagctgcaggctgcacagtggtcgtgaaaccagctgaggacactcccttcagcgcacttgcactcgcggaactggcgtcccaggccggtatcccatctggtgtttataatgtgataccttgtagtcgaaagaacgctaaagaggtgggcgaggccatctgtacagatcctttggtatcgaagataagctttacgggaagtaccaccacaggcaaaatactgttgcaccacgctgcaaattcagtaaagagggtctcaatggaattgggtggcctcgcgccttttatcgttttcgacagtgccaacgtggatcaggccgttgctggtgctatggcctccaaatttcgcaataccgggcagacctgtgtttgttccaaccagttcctcgtgcagcgcggaatacatgacgccttcgtaaaggcctttgcagaggccatgaagaagaaccttcgggtgggcaacggctttgaggaaggcaccactcaggggcctctcattaatgaaaaggccgttgagaaggtcgagaagcaggtcaacgatgccgttagtaaaggtgccactgtggtcacgggtgggaagaggcaccaactggggaagaacttcttcgaacccaccctcctctgtaacgtgacacaggacatgctctgcactcacgaggagacttttgggcctttggccccagttatcaagttcgatacggaagaggaggccatagccattgccaacgccgcagatgtcggtctggccggttatttttactcccaggacccagctcagatctggagagttgcagaacagctggaggtgggcatggtgggagtaaatgagggattaatctcctccgtggaatgcccctttggaggcgtcaaacagagtgggctgggccgagagggctcaaagtacggtattgacgagtacctggaacttaaatacgtgtgttacggaggcctttag

SEQ ID NO: 214034 - DNA, 1608 bp, Artificial Sequence
  Description of Artificial Sequence: Synthetic coding sequence
atggctgccctgctagctgccgctgctgtacgggctaggatcctgcaggtcagctctaaggtgaaaagttcgccgacctggtatagcgctagtagttttagctcctcagtacctacggtgaaactctttatcggaggaaagttcgtcgagtccaagtccgataagtggatagacattcataaccctgcaaccaatgaggttatcggccgagtgcctcaggccacgaaagctgagatggatgcagcaatcgcctcctgcaaacgggctttcccagcctgggctgatacatctgtcctttctcgccagcaagtgctgctgcggtatcagcagctgatcaaggagaatctgaaagagatcgccaaactgattacactggagcaggggaagacactcgccgacgctgaaggagacgttttcagaggactgcaagtggtcgaacatgcctgcagcgtgacgtctctgatgatgggtgaaaccatgccttccataacaaaagatatggatctgtattcatacaggctgccactcggtgtgtgtgccggaattgcgcctttcaacttccccgctatgatccccctgtggatgttccccatggccatggtgtgtgggaacaccttcctaatgaagcccagcgaaagagtgcccggagccacaatgctgctggccaagctcctgcaagactccggagctccagatggaaccttaaatatcattcatggccagcatgaggccgtgaacttcatctgtgatcacccagacattaaggccatatccttcgttggtagcaacaaagccggtgagtacatctttgaacgcggttctaggcacgggaagcgagtgcaggccaacatgggagccaaaaatcacggggtggtgatgcccgatgccaataaagaaaataccttaaaccaattggttggagcagcttttggggctgctggtcagaggtgcatggctctgtctaccgccgtccttgtcggcgaggcaaagaagtggttacctgaattggtcgagcacgcaaaaaaccttagggtcaatgcaggtgaccagccaggggcagacctgggacctttgatcaccccgcaagctaaggaaagagtgtgcaatctgattgattccggcactaaagagggagcttcaatcctgcttgatggcaggaagatcaaagttaaaggctacgagaatggcaactttgtcgggcctaccattatctctaatgtgaagcccaatatgacctgctacaaagaggaaattttcggaccagttctcgttgttttggaaactgaaaccctggatgaagctatccagatcgttaacaacaacccatacggaaatggaacagccatctttaccaccaatggcgcaacagccaggaaatatgcccacctcgtagatgtgggtcaagtgggagtgaacgtgccaattcccgtccctttacccatgttctcattcactggatcaagatcaagctttaggggggacaccaacttctatgggaagcagggcatccagttctatacccagctgaagacaatcactagtcagtggaaggaggaagatgctaccctgagctcccctgccgtagtcatgcccacaatgggccgttag

SEQ ID NO: 214035 - DNA, 1620 bp, Artificial Sequence
  Description of Artificial Sequence: Synthetic coding sequence
atgtggcgactgcctagggcactgtgcgtgcacgcagcaaaaacatctaaactaagtggaccatggtcccgcccagcggcattcatgtctacccttctaatcaatcaaccccagtacgcctggttaaaagaattaggcctaagagaagaaaatgagggcgtgtacaatggcagttgggggggacgaggggaggtgatcaccacatactgccctgctaataacgagcccatcgctcgcgtgcgccaggcttccgttgccgactacgaggaaactgtgaaaaaagctagggaggcgtggaaaatctgggcagacattccggctcccaagcgaggtgagatcgttagacagattggcgatgccctgcgcgagaaaatccaggtgctcggctcactcgtctccctggagatgggaaagattttagtggagggtgtgggggaggtgcaagagtatgtggacatttgtgattacgcagtaggtctgtctagaatgatcggcggacctatcttaccttctgagcgctcagggcacgcactgatcgagcaatggaaccctgtgggcctggttgggataattactgcattcaatttccctgtggccgtgtatggatggaataatgctattgccatgatctgtggcaacgtatgtctctggaaaggggctccgacgaccagtctcatctctgtggcagtcacaaagattattgccaaagtgctcgaggataacaaactgccaggcgctatttgcagccttacatgtgggggtgctgacatcggtaccgccatggccaaagatgaacgggtgaaccttttgtccttcaccggaagcacacaggtggggaaacaggtcggactgatggttcaagaaagattcggaaggtccctgcttgagctcggaggaaacaacgctattatagcattcgaggatgccgatctgtcattggtcgtgccctccgccctgtttgccgctgtcggaaccgcgggacagagatgcacgacggctaggcgcctgttcatccatgagtcaatacacgatgaagtggtgaatagactgaaaaaagcctatgctcagatacgcgtgggtaacccatgggacccgaacgtactttatggcccactgcacactaagcaggccgtgtcaatgttcctcggcgcagtagaggaagcaaaaaaggagggcggaactgtggtctacggaggcaaagtcatggaccgaccagggaactacgtggagccaacaatcgtgacgggactgggccacgatgcgagcatagcccatactgagacatttgccccaattctatatgtgtttaagttcaagaatgaagaagaggtcttcgcttggaacaacgaggtaaagcagggcctctcttctagtattttcactaaagatttgggacgcatttttcggtggctaggccctaaaggatcagactgcggcatagtcaacgtgaacatcccaaccagcggggcagagatcgggggagctttcggaggagaaaagcacaccggcggaggcagagagtcaggttccgacgcctggaagcaatatatgcgcaggagcacttgtactattaattactctaaggacttgcccctggctcagggtatcaaatttcagtag

SEQ ID NO: 214036 - DNA, 1044 bp, Artificial Sequence
  Description of Artificial Sequence: Synthetic coding sequence
atgtggcgactcccacgggctctatgcgttcacgcagcaaaaacatcaaaattgagtggaccgtggagtcgacctgctgccttcatgtctacttctcttatttccgtggccgtcactaaaattatcgccaaggtgctggaagataataagctgccaggggctatttgttctcttacctgcgggggtgccgacatagggacagctatggccaaggacgaacgggttaatctactttctttcactggtagtacccaggtgggaaagcaggtcggtcttatggttcaggaacggttcggccgatcactcctggagctggggggtaataacgccatcatcgcatttgaggacgcagacctgtccctcgtggtcccctctgccttgtttgcagccgtggggacggcagggcaacgctgcaccacagcgaggagactcttcatccacgaaagcatccacgacgaggtcgtgaaccgccttaagaaagcatatgcacagattcgcgtgggaaatccgtgggatcccaacgtgctctacgggcctctgcatacgaagcaggcggtgagtatgttcctgggcgcagtggaggaggcgaagaaggaggggggaacggttgtgtacggtggcaaggtgatggataggcccggaaattatgtggaacctactatcgtgacgggccttggccacgatgcctcgattgctcacacagagaccttcgcgcctatcctgtacgtgtttaaattcaaaaacgaggaagaagtctttgcttggaataacgaagttaagcagggactgtcttcatctatcttcacgaaagacctggggaggatcttcagatggcttggaccgaagggctctgactgtggcattgtgaacgtcaacatccccacctccggagcggagataggtggagcgtttggaggtgagaaacatactggcggaggccgagagtcagggtcagacgcctggaagcaatacatgcgccgatcaacctgcacaatcaactatagcaaggatttgccactggcccaggggattaagtttcagtag

SEQ ID NO: 214037 - DNA, 1509 bp, Artificial Sequence
  Description of Artificial Sequence: Synthetic coding sequence
atgggatctcccggtagaggggctggcctttatttcagcagctcacaaggattaggcctcattccctctcccggactttccatgtggcggctgccacgcgctctctgtgttcatgccgcaaaaactagtaaactgtccggaccctggagtaggccagcagccttcatgtcaacattgttaatcaatcagcctcagtacgcatggctgaaagagctgggtctgcgggaggaaaacgaaggcgtatacaatggctcttgggggggaaggggggaagtaattaccacctactgtccagctaataatgaacctatagcgagagttcgccaggcatctgttgccgactatgaggaaacagtcaaaaaagcacgcgaggcctggaaaatttgggccgacataccggctcctaagagaggcgagattgtgagacagattggtgacgctcttcgcgagaagattcaggtgctaggtagtttggtgtcactggagatgggaaagatcttggtggaaggagtgggcgaagtgcaggaatacgtggacatctgcgactatgctgttggcctttcaaggatgattggtggtcccatcctaccttcagaacggtccggccacgccctgatagagcagtggaatcctgtgggccttgtgggtatcatcaccgcatttaattttcctgtagctgtgtacgggtggaacaacgcgattgctatgatttgcggtaacgtctgtctttggaagggggcacccacaaccagcttaattagtgtcgccgttacgaaaatcatagcaaaagttcttgaagataataagctgccaggcgcaatctgcagtctaacttgtggaggagctgacatcggcactgcaatggccaaggatgaaagggttaacctgctgtcatttaccggatccacgcaagtcggcaaacaagttgggcttatggtgcaggagaggtttgggaggagccttcttgagttaggagggaacaatgcaattatcgccttcgaggatgccgacctgtccttggttgtacccagtgctctctttgcagccgtgggcaccgccggacaacgctgtacaaccgccagacgcctggttatggatagaccaggtaactacgtggaaccaacaatcgtcacaggtctcggacacgatgcctccatcgctcatacagagacatttgccccaattctttatgtgtttaaatttaagaacgaagaagaggtgtttgcttggaacaacgaagtgaagcaaggcctctcctcttccatattcacaaaggatctgggccgtatctttcggtggttaggtcccaagggatccgactgtggtatcgtgaatgtcaatattcctaccagcggagcagaaatcggtggtgcattcggcggtgagaagcatactggaggcggacgcgagtctggatctgatgcctggaagcagtatatgcgtcgctctacttgcaccatcaattattctaaagacctacctctcgctcaggggatcaagttccagtag

SEQ ID NO: 214038 - DNA, 1314 bp, Artificial Sequence
  Description of Artificial Sequence: Synthetic coding sequence
atggctggcacaaatgctcttctgatgctggagaattttatagacggtaaattccttccctgttcctcatatatcgacagttacgaccccagtactggggaagtgtactgtagggtccccaactccggcaaagatgagatagaagccgctgtaaaggctgcacgggaggcattcccaagttggtccagtaggtccccccaggagaggtcccgagtactcaaccaggttgctgatctgctggagcagagcctcgaagagtttgctcaggctgaaagtaaagatcaaggcaaaaccctcgctctcgctcggacaatggacattcccagatccgtgcagaactttcgtttctttgcatcaagtagcttgcatcacacctccgagtgcacacagatggaccacctcggctgtatgcactacacagtccgggctcctgtaggcgtgggggtccctcccggagtcgtgaacattgtgttcggcaccggccctagggtaggcgaggcactggttagccatccagaagtgcctctcatctcctttaccggcagccagccaactgctgaacggatcacgcagctatctgccccacattgtaagaagcttagtctggaactgggcggaaagaatcccgctattatctttgaagatgcaaatcttgacgaatgcatccccgctactgtccgttccagttttgcaaatcaaggcgagatctgtctttgcacctcccggatctttgtgcagaagagcatatattccgaatttctgaagagattcgtggaagcaactagaaaatggaaggtcggtattccctccgaccccctggttagtataggagccctgatttctaaggcccacctcgagaaagtgaggagctatgtaaaaagagccctggccgagggggctcaaatttggtgtggggaaggagtggacaagctcagtctccccgctaggaaccaagctgggtatttcatgctgcctactgtgatcaccgacattaaagacgagtcctgttgcatgaccgaagagatcttcgggccagtgacttgcgtggtgcctttcgattccgaggaggaggtgatcgaacgcgcaaataacgtaaagtacggcctagcagccactgtctggtcttctaatgtgggcagagtgcacagagtggctaaaaagctacagtccggtctcgtttggactaactgttggcttattcgggagctgaacctgccgttcggtggaatgaaatcttcggggatcggtagggagggcgctaaggactcttacgactttttcaccgaaatcaagacgatcactgtgaaacattag

SEQ ID NO: 214039 - DNA, 1464 bp, Artificial Sequence
  Description of Artificial Sequence: Synthetic coding sequence
atggctgggaccaacgccctcctcatgctcgagaacttcatagacggcaagttcttgccatgtagctcttatatcgacagttatgatccctcaactggagaggtgtattgtcgagttcccaatagcggtaaggacgagatagaggctgccgtaaaggccgcaagggaagcgttcccttcgtggagctccaggtcaccacaagaaagaagccgggttttgaatcaggtcgctgatctgcttgagcagagcttagaagaattcgctcaggctgagtcgaaagatcagggaaagactctggccttagcacgaacgatggatattccccgatctgtgcagaacttccggtttttcgccagttcatccctgcatcatacttctgagtgcactcagatggatcacctcgggtgtatgcactacactgtgcgggctcccgtgggtgtggccggacttattagtccgtggaatctgccactatacttgttgacatggaagatcgcaccagcgatggcagccggtaacaccgtgatcgcaaagccatccgagctcacttccgtgacggcttggatgctatgtaagttgttagacaaggccggtgtgccacctggagttgtgaacatcgttttcggtacaggaccaagggttggagaggcactggtctcacatcctgaggtgccgcttatctctttcactggctcacagccaactgcggagcgcataacacagctctccgcccctcattgtaagaaactgtcccttgagctcgggggaaaaaaccctgccatcatttttgaggatgctaatttagatgaatgtatcccagcaactgtgcgctcatcattcgcaaaccagggggagatctgcctttgcactagccgtatcttcgtgcagaaatccatctattcagaattccttaaaaggtttgtggaggctacgcgcaagtggaaagtgggcattcccagcgacccactcgtttcaatcggagcactgatttccaaggcacacctcgaaaaagttagatcctacgtgaagcgggctctggcggagggtgctcagatctggtgtggggagggtgtggataaactatctctgccagcccgaaatcaggccggttatttcatgttacccacggtgattaccgacattaaggatgaaagctgttgcatgactgaagagattttcggcccagtgacttgcgtcgtaccctttgatagtgaggaggaagtgattgagcgggcaaacaacgtcaagtatggacttgcagccactgtttggtcatcaaatgtaggaagagtgcaccgagtcgctaagaagttacagtctggtctggtttggaccaattgctggctcattcgcgagctcaaccttcccttcgggggaatgaaaagcagtggcattgggcgagagggggcaaaggactcatacgactttttcacagaaataaagacaatcactgtgaaacattag

SEQ ID NO: 214040 - DNA, 1302 bp, Artificial Sequence
  Description of Artificial Sequence: Synthetic coding sequence
atggccggtacaaacgccttgttgatgttagagaatttcatcgacggtaaatttttgccttgcagctcttatatagacagctacgatcccagcacaggcgaggtctattgtcgagtgccaaattctggaaaggatgagatcgaggctgccgtgaaagctgcgagagaagcgtttccctcatggagctccaggtccccgcaggagcgctccagagtactcaatcaggtcgccgatctcctcgaacagagtttagaagaattcgcgcaggccgaatccaaggaccagggtaagactttggctttggctaggaccatggatataccgaggtctgtccagaatttcaggtttttcgcctcaagttctcttcaccacacttcagagtgtacccagatggatcatctaggctgtatgcactataccgttagggcaccggtcggggtggctgggcttatatctccctggaatctgccactgtatctcctgacatggaagatcgctcccgcaatggccgcaggtaacaccgtcatcgctaaaccatcagagcttacgagcgtgactgcctggatgctctgtaaactcctcgacaaagctggagtccctcccggagtcgtgaacattgtcttcggcaccggacccagggtgggggaggcactggtttcgcatccagaggtgccactcatctccttcacaggtagccagccaacggctgagcgaataacccagctatctgctccacattgtaaaaagctaagccttgaactcggagggaagaatcccgctatcatctttgaggacgcgaatctggacgaatgcattcctgcgacagttcggagctcattcgccaaccaggtcagatcatatgtgaagcgcgctttagccgagggggctcagatctggtgtggtgagggtgtggacaagttgagtcttccggctcgcaatcaggccggttattttatgctgcccacagtgatcacagacataaaggatgaatcctgctgtatgaccgaggaaatcttcgggcctgtgacttgtgttgtccccttcgactccgaagaagaggtgatcgagcgcgcaaacaatgttaagtatgggctggcggctactgtgtggtcctctaacgtagggagggtacaccgggtggctaaaaagcttcaaagtggtctcgtctggaccaactgttggttgattcgggagcttaatctgccctttggcggtatgaagtcatccggaatcggaagagaaggagctaaggactcttatgacttcttcacagagataaaaaccatcaccgtgaaacactag

SEQ ID NO: 214041 - DNA, 1557 bp, Artificial Sequence
  Description of Artificial Sequence: Synthetic coding sequence
atgtttttacgcgctgggctcgctgcactgtctcctctgcttaggagcctccggccatcacccgttgcggctatgagtactgggacctttgtggtttctcagccccttaattatcggggtggagccagggtcgagcctgcggacgccagcggaacggagaaagctttcgaaccggcaaccggacgtgtgatcgcaactttcacttgctccggagagaaagaagtaaatctcgctgtacagaacgctaaagccgctttcaaaatttggtcgcaaaagagcggcatggagcgatgtagaattcttctggaagcggcaaggattattcgcgagagagaggacgagatcgccactatggagtgcattaataacgggaagtcaatctttgaagctcggctcgatatcgatatcagctggcaatgcctggaatactacgccggtttagctgcaagcatggcaggggagcacatacagttgcctgggggaagcttcgggtatactagacgggaacctctgggcgtttgcgtcggcattggggcatggaactatccctttcagattgctagctggaaaagtgcccctgcgctagcttgtgggaatgccatggtatttaagccgagcccttttacccctgtgagtgccttactcctggcagagatctactccgaggcaggggtccctcccggactgttcaatgtggtgcaggggggagctgctactggccagttcctctgccagcatccagatgtcgcaaaggtgagcttcacaggtagtgtgccgactggaatgaaaatcatggagatgtccgcgaaggggatcaaacccgtgaccctggaattggggggaaagagccccctcatcatcttttccgactgcgacatgaacaacgctgtgaaaggggcactcatggcaaattttctgacacagggccaggtgtgctgtaacgggactagggtgtttgtgcagaaagagatcctggacaaattcactgaggaggtggttaagcaaacccagcgtataaagattggagaccctctactcgaggacacgcgcatgggacctttgataaaccgccctcacctggagagggtgctgggatttgtgaaagtggcaaaagaacagggcgctaaggtcctgtgcggcggagatatctacgtacccgaggaccctaaattgaaggacgggtactacatgaggccctgcgttctgaccaactgtcgcgacgacatgacatgcgtgaaagaagagatcttcggaccggttatgtctatcctgagcttcgacacagaggccgaagtgcttgagcgggctaacgacaccacctttggactggctgccggtgtgtttactcgggacatccagagggcccacagggtggtcgcagaactgcaggccggtacctgctttatcaacaattataacgttagccctgtagagctccctttcggcggatacaagaagtccggcttcggacgcgaaaacggacgagttacaattgaatactactcacagctgaagaccgtgtgtgtggaaatgggagacgttgagagcgccttttag

SEQ ID NO: 214042 - DNA, 1275 bp, Artificial Sequence
  Description of Artificial Sequence: Synthetic coding sequence
atggagcggtgccgtatcctgctggaggctgcccgaataattcgggagcgcgaggatgagatcgcaactatggagtgtatcaataacggaaagtccatattcgaggccagactggacattgatatctcctggcagtgtcttgaatactatgcaggactcgccgcttcaatggctggcgaacatattcagttgccaggaggtagcttcggttacaccaggagggaacccttaggtgtctgcgttgggataggcgcatggaactacccgtttcagattgctagttggaagtctgctcccgctctggcctgtggcaatgctatggtcttcaaaccttcaccctttacccccgtgtcagcactcctacttgccgagatctacagcgaggctggtgtcccgccaggactgtttaacgtagttcagggaggagccgctaccggacagttcctgtgccagcacccggacgtggccaaggtctcctttacagggagtgtgcctaccgggatgaaaattatggagatgtcagctaaaggtatcaagcctgtgacattggagttggggggtaaaagccctctcatcattttcagcgattgcgacatgaacaacgcagtgaagggagcactcatggccaattttctaactcagggccaggtgtgctgcaatggtacaagggttttcgtccagaaagaaatactggacaagttcactgaggaggtcgtgaagcagacccagcgcataaaaatcggggatcctctgctcgaagatacccgcatgggacccttgattaaccgaccacatctggaaagagtactgggctttgtcaaggttgctaaggaacagggagctaaagtgttgtgtggaggggacatctacgttccagaggatccaaaactgaaggatggctattacatgcggccatgcgtgctgactaactgcagggacgacatgacatgtgtgaaggaagagatttttgggcctgtcatgtccattctgtctttcgacaccgaggctgaagtcctggaacgcgcaaacgacaccaccttcggcctcgcagccggagtgtttactcgagacattcagagagcgcacagagtagtggcagagctgcaggccggaacctgtttcattaataactacaacgtgtcacctgtggaactccccttcggcggttataagaagagtggcttcggcagggaaaatggcagagttaccatcgagtattactcacagttgaagacagtttgcgtggagatgggtgacgttgagtccgccttctag

SEQ ID NO: 214043 - DNA, 4017 bp, Artificial Sequence
  Description of Artificial Sequence: Synthetic coding sequence
atggatagggcctccgagctgctgttctacgtgaatggcagaaaagttattgagaagaacgtcgaccccgagacaatgctgctgccatatctccgcaaaaagttgagacttactggcaccaaatacggttgcggcggaggtggctgcggcgcatgtactgtcatgataagtaggtataatcctatcacgaagcgaatccgccatcatccagcaaacgcatgcctgatacctatctgctcactttatggtgccgctgttaccactgtggaaggcattggatccacacataccaggattcatccggtccaagagcggatcgccaaatgtcatgggactcagtgcgggttctgcacccccggaatggtcatgtccatttacacccttcttagaaaccacccagaaccaacattagatcaattgacagacgcgctgggtggcaacttgtgtaggtgcaccggatataggcctatcatagatgcttgtaagaccttttgtaagactagcggatgctgtcagtccaaagaaaacggcgtttgctgcctcgaccaggggattaatgggctgcccgaatttgaagagggatccaagacaagcccaaaactgtttgccgaagaggagtttctcccactggatcccacgcaggagcttatctttccacctgagctgatgatcatggctgaaaaacagtcacaaaggacccgcgtgttcggttctgagaggatgatgtggttttctcctgtcacactcaaggaattgcttgagttcaagttcaagtacccgcaggccccagtcattatggggaatacgtccgttggccctgaggtaaaattcaaaggagtgtttcatccagtgatcataagccctgatcgaatcgaggaattgtctgtcgtgaatcacgcgtataatggtctcacacttggggctgggctgagcctggctcaagtaaaggatatattggcggacgttgtccagaagctccctgaggagaagacccagatgtaccacgctcttctgaagcacttgggaaccctggcaggatcacagatccggaacatggccagtctgggtggacacatcatcagcagacacccggattccgacctgaatcctatactggccgtaggcaattgcacccttaacctattgagcaaggaaggcaagcgtcaaatccctttaaatgaacagtttctttctaagtgcccaaacgctgatttgaagcctcaggagattcttgtcagcgtcaatattccctactctcgcaagtgggaatttgtatctgccttcagacaagctcagcgccaggagaacgctcttgccatcgttaactcaggaatgcgcgtcttttttggggagggagatgggattatcagagagctctgcatctcatacggcggagttggccctgccactatctgcgccaaaaacagctgtcagaagctcatagggagacactggaacgagcagatgttagatattgcctgtcgcttaatccttaatgaggtgagtttgcttgggagcgctcccggaggcaaggtcgagttcaagagaacccttatcatctcatttctgttcaaattttacctggaggtatcgcaaatcctgaagaagatggaccctgtgcattaccctagtctggctgataaatacgagtcagcattggaggatctgcactcaaagcaccactgttcaacactcaagtaccagaacattggtcccaagcagcatcctgaggacccaataggacatccgatcatgcatctctctggagtgaagcatgcaactggcgaagctatctattgtgacgatatgccccttgtggatcaggaactgtttctgacattcgtgacttccagcagagcgcacgctaagatcgtgtccatagacctgtctgaagcattgagtatgcccggagtggttgacatcatgacagctgagcacctgtccgatgtcaacagtttttgcttcttcacagaagcggaaaagttcctggccactgacaaggtattttgtgtaggccaactcgtttgtgctgtgttagccgactcggaagtccaagccaagcgggcagccaaaagagtgaagattgtgtaccaggatctggaacctctaattttgaccattgaggagagcattcagcataattcgagctttaagcctgagcgcaaactggaatatgggaatgttgatgaggcattcaaggtggtcgaccagattctagagggcgaaatccatatggggggacaggaacatttttacatggaaacccaatccatgctggttgtgccgaagggggaggaccaagagatggatgtatacgtgagcacgcagttccccaaatatatccaggatatcgtagcttctactctgaagctacctgccaacaaagtgatgtgtcacgtgcggagagtgggtggagcatttgggggaaaagtgctcaagaccggcataatcgcagctgtaaccgcctttgccgcaaataaacacggacgcgctgttagatgtgtcctcgagagaggggaggacatgctgatcacagggggtcgccatccttatctcgggaagtacaaagcaggcttcatgaatgatggaagaatcttggcactcgatatggagcactattctaatgctggcgcatctttggacgagtccctgttcgtaatcgaaatggggctgctcaagatggacaacgcttataagtttccgaacttgcgatgtagggggtgggcatgtcgcaccaatctgcccagtaacaccgccttccgcggatttggcttccctcaagcagccctcattacagagtcctgcattactgaggtcgctgctaagtgtggactttcccctgaaaaagtcaggattattaacatgtataaggagattgatcaaacgccgtataaacaggaaattaatgcgaagaacttgatccagtgttggagggagtgtatggcgatgagctcttattccctccgcaaagtggcagtggaaaaatttaatgcggagaactactggaagaagaaagggttagcaatggtgccactcaaattcccagtaggtctggggagccgtgctgcaggacaggctgccgcactcgtccatatctatttagatggcagcgtgctggtcacccatggcggaatcgagatgggccaaggcgtacacacaaagatgatacaggtagtttctcgagaactccgaatgcccatgtcaaacgtgcacctccgcggaacctccacggaaactgtacccaatgccaatatatcgggaggtagcgtcgtggccgacctgaatggcctggctgtaaaagacgcatgtcaaacccttcttaaacgcctggagcccataataagtaaaaatccaaagggtacgtggaaagactgggcacagaccgcatttgatgaaagcataaatctttctgctgtcggctacttccggggatatgagtctgacatgaactgggaaaaaggggagggccagccatttgaatatttcgtctacggcgctgcctgctccgaagtcgagatcgactgtctgacgggggaccacaaaaacattaggaccgacattgtcatggacgtaggctgctcgatcaatccagctattgacatcggccagattgaaggcgcattcattcagggaatgggcctgtatactattgaggaactgaactattccccacagggcatattgcacacacgtggtccagatcagtataagatacctgccatctgtgatatgcccacagaactgcacattgctctgctgccaccaagccaaaattcaaacaccctgtacagttccaaaggacttggcgagtccggagtgttcttggggtgcagtgtgttttttgccatccacgacgctgtgtccgccgcaaggcaagaaagaggactccatggtcccctcacgcttaattctccactgaccccagaaaagatcagaatggcgtgtgaggataagttcacaaaaatgatccctcgcgacgagccaggcagctacgtgccatggaatgttcctatctag

SEQ ID NO: 214044 - DNA, 456 bp, Artificial Sequence
  Description of Artificial Sequence: Synthetic coding sequence
atgctgctgccatatctacgtaagaagctgcggcttactggaactaagtatggctgtggtgggggtgggtgtggtgcctgcacggtcatgatttcaaggtataaccccataacaaaaaggatcagacatcatcctgcaaatgcatgcctcatacctatctgtagtctgtacggggcagccgtgaccacggtagaaggtatcggaagtacacacaccagaatccatcccgtacaagagaggatagccaaatgccatggtacacaatgtggtttttgcacccccggtatggttatgtctatctatacattgctgcgaaaccacccagaacctacactcgaccagttgactgacgctttaggcggaaacctatgtaggtgtaccggctaccgcccaatcattgacgcctgcaaaacattctgcaaaacctctgggtgttgccaatcaaaggagaactag

SEQ ID NO: 214045 - DNA, 858 bp, Artificial Sequence
  Description of Artificial Sequence: Synthetic coding sequence
atggatctttcagcagccagtcacagaatcccactgtcagacggtaattctataccaatcatcggcctcggcacttattctgaacccaaaagtacccccaaaggagcctgcgccaccagcgtgaaagtagctattgacactggttacaggcacatagatggggcttacatctatcagaacgaacatgaagtcggcgaggccattcgcgaaaaaatagcggaaggtaaggtgcgcagagaagatatattctactgtggcaaactgtgggccaccaatcatgtgccagaaatggtgagacctaccctcgagcggacacttagggttctccagctggactacgtagacttgtacatcatcgaggttccgatggcttttaagccaggcgatgaaatttaccccagagacgagaatggaaaatggctatatcacaagagcaacctgtgcgctacctgggaagttgagtgtcacccgtactttacgcagcctaagctgctaaagttctgtcaacagcacgatatcgtgattacagcttattctcctctgggcacttcgcgaaatcctatctgggttaacgttagtagcccgccattgctcaaggatgctctgctaaactcccttggcaaaaggtataataaaacggctgcccagatcgttctgagattcaacatacagcgtggggtggtggtcatccctaaaagcttcaatctggagaggatcaaagagaatttccagattttcgacttttccctaactgaggaggaaatgaaagacatcgaggctctcaataagaacgtccgttttgtagaactgctgatgtggcgcgaccatcccgagtaccccttccacgatgagtactag

SEQ ID NO: 214046 - DNA, 873 bp, Artificial Sequence
  Description of Artificial Sequence: Synthetic coding sequence
atggacctgagcgccgcaagccaccggatcccccttagtgacggtaatagcatccctatcatagggcttggcacttacagcgagccaaagtccacaccgaagggagcatgtgcaacatctgttaaagtggcaatcgacactgggtataggcacattgacggcgcttatatttaccaaaatgaacacgaggtaggtgaggcgattagggagaagatcgccgaaggtaaggtacgaagagaagatattttttactgcgggaagctatgggccacgaaccacgtcccagaaatggtgcgaccaaccctcgaacggacacttagagttcttcaattagactacgtggacctctatattatcgaagttcctatggcgtttaagccgggagatgagatataccctagagatgaaaatgggaagtggctgtaccacaagtcgaacctgtgtgctacttgggaggcaatggaggcctgtaaggacgccggtctcgtcaagagtctgggcgttagcaattttaaccggcgtcagctcgaactgattctgaataaacctggcctcaagcacaagcctgtttctaaccaggtggaatgccacccctacttcacgcagccaaaactactgaagttctgccaacagcatgacatcgtgattactgcctatagcccgctgggtaccagtcgtaatcctatttgggtaaacgtgtcaagcccccctttgctaaaggatgctcttttgaatagcctcggaaagcgctataacaagaccgctgctcagattgtcttgcgttttaatatccagagaggagtagtcgtgattcccaagtctttcaatctggaaagaattaaagaaaacttccaggtcgctcgcagctcttag

SEQ ID NO: 214047 - DNA, 978 bp, Artificial Sequence
  Description of Artificial Sequence: Synthetic coding sequence
atggctgcttcttgcgttctgctccatacagggcagaaaatgccactgatcggattaggaacctggaaaagcgagcccggacaagtcaaagcggcagtgaaatacgccctgagcgtgggatacagacatatcgattgcgctgccatctacggtaacgagcccgaaatcggggaagcactgaaggaggacgtggggccaggtaaggccgtgccacgggaagagttgtttgtcacgtcaaaactgtggaacacaaaacaccatcctgaggacgttgagccggcacttcggaaaactttagccgatctgcagttggaatacttggatctgtatctcatgcactggccatatgcgttcgaacgcggtgacaatccttttcccaaaaacgccgacggcacgatctgttacgactccactcactacaaggagacctggaaagccctggaggccctggtcgccaaggggctggtgcaggccctgggcctgtctaattttaactcacgacaaattgatgatattctgtccgtggcaagcgtccgaccggctgtgttgcaggtcgagtgccatccctacctggctcaaaacgaacttattgcccactgccaggctcgcggactggaggtgactgcctactccccactgggatctagtgaccgggcatggcgcgaccctgacgagccagtgctgctcgaggagcccgtggtgctggcccttgcagaaaagtacggcaggagccctgcgcagatcctgctgcggtggcaggtacagagaaaagtcatttgcatccccaagagcattacaccttcgcgaattttacagaacatcaaggtgttcgactttaccttttccccggaggaaatgaagcagcttaacgctcttaacaaaaattggcgatacatagttcctatgctgactgtggacggcaagcgcgtgcctcgagatgcaggccacccattgtaccccttcaacgacccttattag

SEQ ID NO: 214048 - DNA, 978 bp, Artificial Sequence
  Description of Artificial Sequence: Synthetic coding sequence
atggccgcttcatgtgtgctgctccataccgggcagaaaatgccactgatagggctgggcacctggaaaagtgagcctggccaagtgaaagctgccgttaagtacgcactctcagtaggctatcggcatattgactgcgccgcaatttatggcaacgaaccggaaatcggcgaggcactaaaggaagatgtgggacctggcaaagccgtacccagggaggagctctttgtgaccagcaagctctggaatacaaaacaccatccggaggacgtggaacccgctctccgcaagaccctggccgatctgcaactggagtatcttgatctgtacttgatgcattggccctatgcctttgagagaggcgacaacccattccctaagaatgctgacggtacaatctgctatgacagtacacactataaagaaacttggaaggccttagaggccctggtcgccaagggactggttcaggcccttggcctcagcaatttcaattcaaggcagatcgacgacatactgtctgtggcctccgtgcggccagcagtgttgcaggtcgagtgtcatccctacctcgctcagaatgaactgatcgcccactgtcaagcacggggactggaggtcaccgcatacagcccccttggttcttccgatcgcgcatggagggacccggatgaacccgtgttgctagaagaacccgtggtgctggccttggccgagaagtacggcaggagtccggctcagatattgctgcgttggcaagtgcagagaaaggtgatttgcattccaaagtcaatcacgcctagcaggatcctgcagaatattaaggtgttcgatttcaccttctcccccgaggaaatgaagcagctgaacgcgctgaataaaaattggagatatatagtgcccatgctcacggtggatgggaagcgggtgcccagagatgccggacatccattataccccttcaatgatccctattag

SEQ ID NO: 214049 - DNA, 444 bp, Artificial Sequence
  Description of Artificial Sequence: Synthetic coding sequence
atggcggcatcgtgtgtattgctgcacaccggccaaaagatgcccctcattggcctcgggacctggaagagcgaacctggacaagtgaaagccgctgtcaagtacgctctgagcgtggggtacagacatatagactgtgctgctatctatggtaacgagcctgagatcggcgaggcactcaaggaggacgtcggcccaggtaaggcggttcctcgggaggagttatttgtcacctccaagttgtggaacacgaaacaccatcctgaagatgtagagccagcgctcagaaaaaccctggccgaccttcaacttgaatacctggatctgtatctcatgcattggccttatgctttcgagcgtggtgacaaccccttcccaaaaaatgccgacggcacaatctgttacgactccacacactacaaggagacctggaaggctttgtag

SEQ ID NO: 214050 - DNA, 951 bp, Artificial Sequence
  Description of Artificial Sequence: Synthetic coding sequence
atggcgtcacgactgctcctgaacaacggcgcaaaaatgcccatcctggggctggggacgtggaagagcccccctggacaggtaacagaggctgtgaaagttgcgatagatgttggataccggcatatcgactgcgcccacgtttaccagaatgaaaacgaggtgggcgttgcaatccaagagaaactgcgggaacaggtggttaagagggaagaactgttcattgttagtaagctgtggtgtacttatcatgaaaaaggtttggtgaagggcgcttgccagaaaacactttcagacctgaaactggactatctggacttgtaccttatacactggcccaccggatttaaaccaggcaaagaattctttccactcgacgaatcaggaaatgtggttccctctgataccaatattctggatacgtgggctgccatggaagagctagtggatgaaggccttgtcaaggccatcggcatctctaatttcaatcacctgcaggttgagatgatcctgaataaacccggtttgaagtacaaacccgctgtgaaccagatcgagtgccacccctacctgactcaagagaaactgatccagtactgtcagagcaaaggtatagtggtcactgcatatagcccccttgggagtcccgacaggccctgggctaagcccgaggatcctagtctgcttgaagaccctaggataaaagctatcgctgcaaagcacaacaagacaaccgcacaggtactgatccggtttcccatgcagagaaacttagtggtcatccctaaaagcgtgactcccgaaagaatagctgagaactttaaggtgttcgacttcgagctgtcctcccaggacatgaccacactcctgagctacaacagaaattggcgcgtttgcgctctgctgtcttgtactagccacaaggattacccattccacgaggagttttag

SEQ ID NO: 214051 - DNA, 618 bp, Artificial Sequence
  Description of Artificial Sequence: Synthetic coding sequence
atgggagtcgtttcgcttttcctttgtattgtcgaacagatatttacttcgagcaaaaaaattcagttcagaggcatatttatggcaaaagtgcctaagtccaaggcattggaggcaaccaagctggcaatcgaggctgggtttcggcatattgactctgcacatctgtataacaacgaagagcaggtgggtctggctatcaggtcgaaaatcgctgatggatcagtgaaacgcgaagatatcttctatacctccaagctctggtgcaactcacaccgccctgagctggtgagaccagccctcgagcgcagcctgaagaaccttcaactggactatgtggatctctatctgattcacttccctgtctctgtgaaacccggagaagaggtgatcccaaaagatgagaatgggaagattcttttcgataccgtcgatctctgcgccacctgggaggcagtggagaagtgcaaggacgccggactggccaaaagtattggagtgtcaaattttaataggcgccaacttgagatgatcctcaataagcctggcctgaagtacaagcccgtctgcaatcagcctcgtgacaattctatttttagcctgtccccagactggtag

SEQ ID NO: 214052 - DNA, 972 bp, Artificial Sequence
  Description of Artificial Sequence: Synthetic coding sequence
atggattcaaaatatcaatgcgtgaaactcaacgatggacatttcatgccagtactgggctttgggacttatgcgcctgctgaggtcccaaagtccaaggccctggaggctaccaagctggctatcgaagccggatttaggcacattgattccgcacacttatacaacaatgaagagcaggtgggtttagcgatcagatcaaaaatagcagacggatccgtgaagcgagaggatatcttttacactagtaagctatggtgtaattcgcatcgaccagagctcgtgaggccggcactggaacgatcattgaagaacctccagctggactatgtggacctgtatcttatacactttccagtgtcagtgaaaccaggggaggaggtcatccccaaagacgagaacggcaaaatcctgttcgacaccgtggatctttgcgccacatgggaagccgtggagaagtgtaaggacgccggattggccaagtctatcggcgtttctaatttcaatcgcagacagctagagatgatccttaataagcctgggcttaagtacaagccagtatgtaatcaggtggaatgtcacccctacttcaatcagcgtaaattattggatttctgtaagtcaaaagatattgtgttggtagcttattctgccctcggttctcacagagaagaaccttgggttgaccctaattcacccgttctgctggaggaccctgtgctgtgcgctctcgctaagaaacacaaaagaactccggctttgatagccttacgttaccaactgcaacgaggcgtcgtcgtgctggctaaatcctacaacgagcagcgcattagacagaacgtacaggtcttcgaatttcagctgacctctgaagagatgaaagcgattgatggcttgaaccggaatgtgcgctatctaacccttgatattttcgctggcccacccaactatccattcagtgacgaatattag

SEQ ID NO: 214053 - DNA, 972 bp, Artificial Sequence
  Description of Artificial Sequence: Synthetic coding sequence
atggacagcaagtatcagtgcgtcaaactgaatgatgggcacttcatgcccgtcttgggatttggcacctacgccccagcagaggtcccaaagagcaaggccctggaagccacaaagctggctatagaggctgggttcaggcacatcgactccgcccacctttacaacaacgaagaacaggtgggtttggccattcgcagtaagattgctgatggcagcgtgaagagggaagatatcttttacacatccaaactgtggtgcaattcccaccggcctgaactggtccgccctgctctcgagaggtccttgaagaatcttcagctggactacgtggacctgtatctgattcacttcccagtttccgttaagccaggtgaagaggtgatccccaaggatgagaacgggaaaatcctctttgacacagtggatctgtgcgcaacctgggaagccgtggagaaatgcaaagacgctggccttgctaagtcaataggagtcagtaatttcaaccggcgacagctagagatgattttgaacaagcccggattgaagtacaagcccgtatgcaaccaagttgagtgccacccatatttcaatcagcgcaagttacttgacttttgcaaaagcaaggatattgtgttagtggcatattcagccctagggtcccaccgggaagaaccttgggtcgacccaaatagtcccgtgctcctggaagacccagttctgtgcgccttagcaaagaaacacaaacgcacccccgctctcattgccctaagataccagttacagcggggagttgtcgtgcttgcgaaaagttacaacgagcaacggatcaggcagaatgtccaggtcttcgaattccagttgaccagcgaagagatgaaagcgatcgatgggctgaatcgaaatgtgcggtaccttacactcgacatctttgccggaccacctaattatccattctccgatgagtactag

SEQ ID NO: 214054 - DNA, 747 bp, Artificial Sequence
  Description of Artificial Sequence: Synthetic coding sequence
tagtccaaataccagtgtgtgaaactcaatgatggccacttcatgcctgtgttgggttttggaacgtacgccccagccgaggtaggcctagccatccggagcaaaattgctgatggcagtgtgaagagggaggatattttttatacctcgaaattgtggtgtaatagccatcggccagaattggttcgcccagctcttgagcgctcgctgaaaaatctacagctagactacgtggatctgtaccttattcacttcccagtctcagtgaagcccggtgaagaagtcattcccaaagacgagaatgggaagattctctttgacaccgttgatctctgcgcaacatgggaggcagtcgaaaaatgcaaagacgccggtctggctaagtctatcggagtgagcaattttaatcggagacaacttgagatgatactgaacaagcctggcctcaagtacaaacctgtgtgtaaccaggttgagtgccatccgtatttcaaccagagaaagttgctagacttctgtaaaagtaaggacattgtcctcgttgcttactcagcccttggatcccacagggaagaaccatgggtagatccgaactccccagtacttctggaggatcccgtcctttgcgcgcttgctaagaaacataaacgcacacctgctttaatcgctctacgctaccagctgcaaaggggagtcgtggtgctcgcaaaaagctacaacgagcagagaatccggcagaatgtgtag

SEQ ID NO: 214055 - DNA, 972 bp, Artificial Sequence
  Description of Artificial Sequence: Synthetic coding sequence
atggacagcaagtatcaatgcgtcaagttaaacgacggtcatttcatgccagtacttggctttgggacctacgccccagcagaggtcccaaagtccaaggcccttgaggccgtcaagttagccattgaagcaggtttccaccacatagactccgcgcatgtctacaacaatgaggagcaggtgggcctggccatcagatccaagattgctgacggatccgtgaagagggaagatattttttacacaagcaagctgtggagtaactcccataggccagaattggtaaggcccgctttggaacgttctctcaagaatctgcaactcgactacgtagacctatacttaatccactttcctgtttcggtgaaaccaggcgaagaggttattcccaaggacgaaaacggcaagatcctgtttgatacagttgatctgtgtgccacgtgggaggccatggaaaagtgcaaggatgccggactggccaaaagcattggggtgagcaactttaatcatcggctgctggaaatgatactcaacaaaccaggccttaaatacaagcccgtgtgtaaccaggtggagtgtcatccctactttaaccagagaaaactgttagacttttgtaagtccaaggacatcgtgcttgtagcctattccgcactgggcagccacagagaggagccgtgggtggacccaaattctcctgtgctgttagaagatcctgtgctgtgtgcattggctaaaaaacacaagagaacacctgccctgatcgccctcaggtaccagttgcagcggggtgtagtcgtgttggcgaagagctacaatgaacagagaattcgccagaacgtgcaggtttttgaatttcagcttacaagcgaagagatgaaggccatagacggattgaaccggaatgttaggtatttgacattggatatttttgcgggacccccaaactatccattctctgacgaatactag

SEQ ID NO: 214056 - DNA, 972 bp, Artificial Sequence
  Description of Artificial Sequence: Synthetic coding sequence
atggattctaagtaccagtgcgtgaagctcaatgacggacatttcatgccagtcctaggtttcggtacatatgcaccagcagaggtccccaaaagtaaagcactcgaggcagtcaagcttgccatcgaagccggttttcaccacatagactcggcccatgtctacaataacgaagagcaggtcgggctggccatccgctcgaagatcgctgatggctcagtgaaaagggaagacattttttatacatcaaagctttggagcaacagccacagaccagaattagtgcggccagcactggagcggtctctgaagaatctgcagctggattacgttgatttgtacctgatccacttcccagtctcggttaagccgggagaggaggtcatacccaaggacgagaacggcaagatcctcttcgacacagtagacctatgcgccacatgggaggccatggagaagtgtaaagatgctgggctcgcaaaaagcattggagtgagtaactttaaccatagactcctggagatgattttgaacaagcctgggttgaagtacaaacctgtatgtaatcaggtggagtgtcatccctattttaaccagagaaagctgttagacttttgcaagtctaaagatattgtgctagttgcctattctgcccttggatcacaccgggaggaaccttgggtagatcccaacagtccagtgctgctcgaggatccggtgttatgtgccctcgcgaaaaaacacaagagaacacctgccttgatcgccctgcgctaccagctgcagagaggcgtcgtcgtgcttgccaagtcctataacgaacaaaggatacggcagaatgtgcaggttttcgagtttcagctcacctccgaggaaatgaaagctattgatgggctgaatcggaatgtacgctatctgactcttgacatttttgccggacccccaaattaccccttttccgatgagtactag

SEQ ID NO: 214057 - DNA, 894 bp, Artificial Sequence
  Description of Artificial Sequence: Synthetic coding sequence
atggattcaaaatatcagtgcgtcaaactcaacgacggacattttatgcccgtcctcggattcggcacctatgcacccgcagaagtccctaagagcaaggctctcgaagcagtaaaattggccatcgaagccggatttcatcatattgacagcgcccacgtgtataataatgaggaacaggttggattggcgatcaggtcaaaaatcgccgatggttctgtaaaaagagaagacatcttctacacctccaaactgtggagtaactctcaccggccagagcttgtacggccagccctcgaaaggtcactcaagaatttacagttggactacgtcgatctctaccttattcacttcccagtgtcagttaaagccatggagaaatgtaaagatgccggtttggcaaagtccatcggcgtttccaatttcaatcaccgcttactcgagatgatattgaacaagcccggacttaaatacaaacctgtgtgcaatcaggtggagtgccacccctacttcaaccagcgtaaactgctggatttctgtaaaagtaaagatattgtactggttgcctacagcgccctgggatctcatcgcgaggaaccatgggttgatcctaatagtccggtgctgctggaggacccagtcctctgcgccttggctaagaagcacaagcgcactccggcactcatcgcattacgctaccaacttcagaggggcgtcgtggtgttagctaagagttacaacgagcagaggattagacagaatgttcaggtattcgaattccaactaaccagcgaagaaatgaaggcaatcgatggccttaaccgcaatgtgcgctacctgactctggacatattcgccggtcccccaaattatcctttttcagacgagtactag

SEQ ID NO: 214058 - DNA, 420 bp, Artificial Sequence
  Description of Artificial Sequence: Synthetic coding sequence
atggacagcaaataccagtgtgttaaactgaacgacggccacttcatgcctgtgctgggattcggtacttatgcgcctgccgaggtccccaaaagtaaagccctggaggcagtaaagcttgccatcgaagccggatttcatcacattgatagtgcccatgtgtataacaatgaggagcaggttggtctcgccattaggtcgaaaatagctgatggatctgtgaaacgtgaagatatattctatacatccaaattgtggtccaatagccaccgtcctgaactggtccgccctgcgcttgaacgctcactgaagaaccttcagctggactacgttgacctgtacctgatccacttccctgtgagcgtgaaagaagacataggcattctcacctggaagaaaagtcccaaacataattcttag

SEQ ID NO: 214059 - DNA, 972 bp, Artificial Sequence
  Description of Artificial Sequence: Synthetic coding sequence
atggactccaagcaccaatgcgtgaagctgaatgacggacacttcatgccagtgttaggttttgggacttacgctcccccagaagtcccccgatccaaagctctggaggtaaccaagctcgcaatagaagcagggttccgacacatcgactcggctcacttatacaacaatgaagaacaggtgggcctggcaatccgaagcaagattgctgatgggtctgtgaagagggaggatattttctacactagcaaattatggtccacatttcatcggccagaattggtccggcctgccttagagaattctcttaaaaaggcccaactggactacgtggatctctacctgattcatagtccaatgtccctcaaaccaggcgaggagttatcaccaacagacgagaacggaaaagtgattttcgatatagtggatctgtgcactacctgggaagccatggagaagtgtaaggatgcagggcttgcaaagtccataggcgtgagtaattttaatcggaggcagctcgagatgattctcaacaagccagggttgaagtacaaacctgtgtgcaaccaagtagagtgccacccatattttaacagatccaagcttttggacttttgtaaatccaaagatatcgtgttagtcgcctactccgccctggggagccagcgcgataagagatgggtggatcccaacagcccagtgctgcttgaggacccagtcttgtgcgctctggctaaaaaacacaagagaacgcccgctctaatcgctctgcggtaccagctgcagaggggtgtcgtggtcttagcaaagagctataacgaacagaggatccgccagaacgtgcaggtttttgagttccagctgactgctgaggatatgaaggccattgacggcttggataggaacttacactattttaacagtgatagtttcgcatctcatcccaactacccttactcggatgagtactag

SEQ ID NO: 214060 - DNA, 615 bp, Artificial Sequence
  Description of Artificial Sequence: Synthetic coding sequence
atgtcactgaagccaggagaggaactctcccctacagacgagaatgggaaagtgatttttgatatcgtggacttatgtacaacctgggaagcaatggagaagtgtaaggacgctggcctggcgaaatcaataggcgtgagtaacttcaatcggagacagctggagatgatcctcaacaagccaggtctgaagtacaagcccgtctgcaaccaagtggagtgtcacccttattttaaccgatccaagttgctcgatttctgtaaaagtaaagacatcgtcctggtggcatattcagcattgggcagccagcgagacaaacgttgggtggaccctaacagcccggtgctgctggaggaccctgttctgtgcgcattggctaagaagcacaaacgcacccctgcactgattgcactgcgatatcagcttcaacgcggagtagtggtactagccaaaagctacaacgaacagcggatccggcagaatgtgcaggtgtttgagtttcagctgaccgctgaggacatgaaggccatcgatggtcttgaccgtaatctccactacttcaactccgattccttcgcctcccaccccaactatccttattcagatgagtactag

SEQ ID NO: 214061 - DNA, 972 bp, Artificial Sequence
  Description of Artificial Sequence: Synthetic coding sequence
atggacccaaagtaccagcgggtcgaacttaatgacggccacttcatgccagtcttgggttttggcacgtacgccccaccggaagtaccgaggaaccgggcagttgaggttactaagttggcgattgaagctggttttaggcacatcgactccgcttatctgtacaataacgaagagcaggtgggcttggctatccgtagcaaaatcgccgatgggtccgtcaagcgggaggacattttttatactagtaagctgtggtgtacgttctttcagccccagatggttcagccggcactggagtctagcctgaagaagctgcagctggattatgtggacctatatttgctgcatttccccatggccctgaaacccggtgagactcccctgccaaaagatgaaaatggcaaagtcatttttgacacggtggacctgagtgctacttgggaggttatggaaaaatgtaaggacgcaggactggccaagtcaatcggcgtcagtaatttcaactgcagacaattagaaatgattctgaataagccaggactaaagtataagccagtgtgcaatcaggtggagtgtcacccctatctaaaccagtccaagctgctggacttctgtaagagcaaggacattgtgctcgttgcccactccgccctcgggacgcagcggcacaagctgtgggtcgaccccaacagtcctgtgctcctggaggatcccgtcctttgcgccctggccaaaaaacacaaacagacccccgctctgatcgccctgcgttaccaattgcaacggggagttgtcgttttggccaaaagctacaacgagcagaggataagggagaatatccaagtatttgagttccagctcacaagtgaggacatgaaagtactagacggcctcaaccggaactaccgttatgtggtgatggactttctgatggatcatcccgattacccattctcagatgagtactag

SEQ ID NO: 214062 - DNA, 972 bp, Artificial Sequence
  Description of Artificial Sequence: Synthetic coding sequence
atggatcctaagtatcagcgcgtggagctgaacgatgggcatttcatgcctgtgcttggatttggtacttacgcaccaccggaggtgcctcgcaatagggccgttgaagtgactaaattggcaatcgaggcgggattcaggcatatcgacagtgcttacctatataacaacgaggaacaagttggcttggcaatacgatcgaaaatagctgacggaagcgtcaagcgggaggacatcttttacacctccaagctctggtgcaccttctttcagccacagatggtccagcccgcactagaatcttctcttaaaaaacttcagttggactatgtggatctctacttgctccatttccccatggcactgaaacccggagagaccccactccccaaggacgagaatgggaaggtgatatttgataccgtagatctctcagccacatgggaggtgatggaaaagtgtaaggatgcaggccttgccaaatcaatcggggtgtctaacttcaactgtcgccaactagagatgatccttaacaagcctggactcaaatataaaccggtctgtaaccaggtcgaatgccacccctatctcaaccaatcaaaactgctggacttctgcaaatcaaaggacattgtgcttgtggcccattccgccctgggcactcaaaggcataagctctgggtggaccccaattcccctgtcctcctcgaggaccccgtcctgtgcgctcttgccaagaaacataagcaaacccctgcacttatcgccctgcgctatcagctgcaaagaggcgtggtggttctggccaagtcttacaatgagcagaggatccgggagaacatccaggtttttgagtttcagctgacctcagaagatatgaaggttttagatggactgaataggaattacagatacgtggtgatggattttctcatggaccaccccgactatccattcagtgacgaatattag

SEQ ID NO: 214063 - DNA, 381 bp, Artificial Sequence
  Description of Artificial Sequence: Synthetic coding sequence
atggaccccaaatatcagcgcgttgagttaaatgacggtcatttcatgcccgtgcttggctttggaacgtacgctcccccagaggtgccaaggaatcgggctgttgaagtaacaaagcttgctatcgaggccggtttcaggcatatcgactcagcgtatctctacaacaatgaagaacaagtaggtctggctatacggtctaagattgccgacgggtcagtaaagcgagaagacatcttttatacttccaagctgtggtgcacgttcttccaaccgcagatggttcaacctgcgttagaatcatcacttaaaaagctgcagctggactatgtagacttgtatcttctccactttccaatggctctgaaatcaacaacatag

SEQ ID NO: 214064 - DNA, 981 bp, Artificial Sequence
  Description of Artificial Sequence: Synthetic coding sequence
atggatctgtcagcagcgtcgcaccggatacctctgtcagatggcaactctatacccataataggactggggacctatagcgagcccaagtcaacacccaagggggcttgtgcgaccagcgttaaggtggctatagacactggctatcggcatatcgatggtgcatacatttaccaaaatgagcacgaggtgggggaggcaatccgggagaagatcgctgaaggcaaagtcagacgtgaggacatattctactgtggcaaactttgggcaactaatcatgtcccggagatggtgagacctaccctcgagaggactctccgggtgcttcagctcgactatgtggatttatatatcattgaggtccctatggcctttaaaccaggcgacgaaatttatcccagagatgagaacggcaagtggctctatcacaagagcaacctgtgtgctacgtgggaagccatggaagcttgtaaagatgctgggctggtgaaatcgctcggcgtgtctaatttcaatcgcaggcagctcgagctcatcctgaacaagccgggactaaaacacaaacctgtctcaaatcaggttgagtgtcatccctatttcacccagcctaaactgctcaaattctgccagcagcatgacatcgtcatcacggcttatagccctctaggtacttctaggaatcctatttgggttaatgtgtcaagcccacctcttcttaaagatgcgttacttaactcccttgggaaaagatacaataaaacagccgcacagatcgtgttaaggtttaacatccaaaggggtgtagttgttatccccaagagctttaacctcgagcggatcaaagagaacttccagatctttgactttagtttgactgaggaggaaatgaaggacatcgaggctctgaataaaaacgtcaggtttgttgagctgctgatgtggcgtgaccatcccgagtacccttttcacgatgagtattag

SEQ ID NO: 214065 - DNA, 441 bp, Artificial Sequence
  Description of Artificial Sequence: Synthetic coding sequence
atggccttcaagccaggcgatgaaatataccctcgggacgagaacggaaagtggctgtaccacaaatctaacttgtgcgctacctgggaggctatggaggcttgtaaggacgccggactcgtgaaaagtctgggggtgtctaattttaatagacggcaactggagttgatcctgaataagccaggactgaaacacaaaccagtgagcaaccaggtggagtgtcacccctatttcacccagcccaagctgctcaagttttgtcagcaacacgatatagtcatcaccgcctactcccccttgggcacatctaggaaccccatctggcgacagctgcacaaacttgcactgctggaccttcctatcctccgggtgacacttcactcggtgcataccttgcattcggaaaagctggtaaccggtgacctgcaatgcccaggatag

SEQ ID NO: 214066 - DNA, 672 bp, Artificial Sequence
  Description of Artificial Sequence: Synthetic coding sequence
atggcacaccggtttcccgcactgactcaggagcagaagaaagattcccaggggaaactttttcggaacattttgaaggaaaagggcatcgttgtcggtatcaaactggaccagggcggagccccactcgccggaactaataaggagaccacaatacaggggctcgacggcctgagtgaacggtgcgcgcaatacaagaaagatggcgtagatttcgggaaatggagagccgtcttacgcatcgctgaccaatgtcctagctctctggcgattcaggagaatgctaacgccctggcccgatacgcttctatctgtcagcagaacggactcgtaccaattgtggagcccgaagttattcctgatggggaccatgatttagagcattgccaatatgtgacagagaaggtgctggcagctgtgtataaggctttaaacgaccaccatgtgtaccttgagggtaccctgttgaaaccaaatatggtcacggctggacacgcatgtacaaagaagtataccccagagcaggtggccatggcaacagtgactgccctccaccggaccgtccctgctgcagtgcccggtatttgctttctgtctggtggtatgtctgaggaagacgcaacgctgaacttgaacgccattccaactcgggtgcaatgtccaccagcttag

SEQ ID NO: 214067 - DNA, 1095 bp, Artificial Sequence
  Description of Artificial Sequence: Synthetic coding sequence
atggctcataggtttccagccctgacacaggagcaaaaaaaggagctgagcgaaattgctcagagcattgttgccaacggcaagggaatactagcagctgatgagagcgtgggaacaatgggcaacagattacaacggataaaggtggagaacaccgaggagaacaggcgtcaattcagggaaatcctcttttctgtcgactcaagcatcaatcagagcatcggaggagttattctgtttcacgagactttgtatcagaaggactctcagggaaaactgtttcgcaatatcctcaaagaaaaaggtatcgtggtcggcatcaagctggaccaggggggtgcaccactggcgggtactaacaaggagacaacaattcaaggactggatgggttgtcggaacgctgcgctcagtataaaaaggatggggttgactttggcaaatggagggcagtcctacgaattgcggatcagtgcccatcctcattggcaattcaagaaaacgctaacgcccttgctcggtacgcatccatttgtcaacagaacgggctcgtgcccattgttgagccagaggtgattccagatggcgaccacgacttggagcactgtcaatatgtgaccgaaaaggtcctggccgcagtctataaggccctgaacgaccaccatgtgtacctggagggaacattgctgaagcccaacatggttacagctggacacgcatgcactaaaaagtacaccccagagcaggtggccatggcaacggtcactgcccttcatcggactgtccctgctgccgttccagggatttgttttctgagcggcggtatgagcgaagaggacgccacgctgaacttgaatgctatcaacctctgccccctccccaaaccatggaaactctccttcagttacgggagagccctccaggcttcagccttggcagcttggggaggcaaggccgctaataaggaagcaactcaggaggccttcatgaaacgcgcaatggctaattgccaagccgcaaaagggcagtatgtgcacacgggctctagtggggctgcctctacacagagcctcttcacagcatgttacacctactag

SEQ ID NO: 214068 - DNA, 951 bp, Artificial Sequence
  Description of Artificial Sequence: Synthetic coding sequence
atggctcaccgatttcctgccctcacccaggagcagaaaaaagagctcagtgaaattgcgcagagcatcgtcgccaatggcaaggggattctggcggctgatgagtccgtcggcacgatgggtaaccgcctgcaaaggataaaagtggagaacacggaggagaacaggcgacagttccgggagatcctatttagcgtagatagttccattaaccaatcaattggaggggtcattttatttcacgagactctctaccaaaaggacagccagggcaagctattcaggaatatactaaaggagaaaggcatcgtggtagggatcaaactggaccagggcggagctcctctggccggtaccaacaaggagacgacaatccaagggctcgatggcttgagtgaacggtgtgcgcagtataagaaagacggagtagacttcggtaagtggcgcgcagtgctccgcatcgccgatcagtgcccctcctcactggccatacaggaaaatgccaacgccctagccagatacgcatctatttgccaacaaaacggcttagtgcccatcgttgaaccagaggtcatacccgacggagaccacgatctggaacattgccaatacgtgacagaaaaggttctcgcagctgtatataaggctctgaacgaccaccatgtctatctcgaaggaacgttgctgaaaccgaatatggtgaccgccggacatgcctgcacaaaaaagtacacccccgagcaggtggccatggcgactgtaaccgctttacaccgcacagtgcccgctgcagtgcccggaatatgctttctcagtggcggaatgtcagaagaagatgctaccctgaatttgaacgctatcaacctgtgtcccttgccaaaaccatggaagctgagcttttctggagtggccaggcttcagacgcgaaggcagccccgtcgcttgctgtag

SEQ ID NO: 214069 - DNA, 1947 bp, Artificial Sequence
  Description of Artificial Sequence: Synthetic coding sequence
atggtaagcctcccgcctccgcagagtgatgtgacattaccagggcctacacgcctggagggcgagcgtcaaggagatctgatgcaggcccctgggctgccagggagcccagcgccacagtcaaaacacgccggtttcagctgttctagcttcgtatctgatgggcctcccgagaggaccccatcgttgcctccgcactctcctcgaatcgcctctccaggcccagaacaggtacagggtcactgtcccgcagggcctggtccaggacctttccgtctatcaccttccgataagtatcctggatttggtttcgaggaggctgcagcctcgtctccagggagatttctgaaaggatcccatgcaccctttcatccttacaaacgaccattccatgaggacgtgttcccggaggctgagacaacactggctctaaaaggtcatagttttaaaacaccaggcccacttgaggcgtttgaggaaatccccgtcgatgtagctgaagcagaggcctttctgccagggttctcggcagaggcatggtgcaatggcctaccatatccttctcaggagcatggtccacaggttctgggctccgaggtgaaggtcaaaccacccgtgttggaatcaggagcagggatgttctgttaccagccgcctctgcagcatatgtactgtagctctcaacctcctttccaccaatactcgcctggcggtggctcgtacccgataccctacttgggcagttcccactaccagtatcaaagaatggctcctcaagcttcaacagatggccaccagcctttgttccctaagccgatttactcttattccatactgatattcatggccctcaagaatagtaaaaccggcagtctgcctgtctcagagatctataatttcatgaccgagcactttccctactttaaaactgctcccgacggatggaaaaattccgtccgccataatctgtcgctgaacaagtgctttgagaaggtcgagaacaaatctggttctagctcacgtaaaggctgcctatgggcccttaaccccgctaaaatagataaaatgcaggaggaactgcagaagtggaagcgaaaggatcctatcgcagtccgaaaatccatggccaaaccagaagaactggatagtctgatcggcgacaaacgggagaagctgggctccccattgctggggtgccctcctccaggtctttcaggctctggaccaattcgcccactcgcccctccggcagggctgagcccacccctgcactctctgcatcccgctccaggtcctatacccggtaagaatcccctacaggacctcctcatgggacacacaccaagctgttatggacagacttatttgcacctaagcccgggtctggcgcctccgggtccgcctcagccattgttcccacagcctgacggacacttagagttgcgagcgcagcctggcactcctcaggacagtcctctccctgctcatacaccaccttcccattcggctaaactactggctgagccctctcccgcaaggacaatgcacgatacacttctgcctgacggagacctgggcactgacctggatgccatcaacccatcactgacagacttcgatttccaggggaatctgtgggagcagcttaaggacgactccttggcattggatcctttggtcctggtgacctcttcgccaacttcttcaagcatgcctcccccacagcctcctccacactgcttccctcctgggccatgcttaactgagacaggtagcggtgcaggcgatctggccgcacccggaagtggcggtagtggcgcactgggcgacttacatctaaccacactgtactccgcctttatggaactcgagcctacccccccaactgcacctgctggaccctcagtctatttgtccccctcttctaaaccagttgcccttgcttag

SEQ ID NO: 214070 - DNA, 1095 bp, Artificial Sequence
  Description of Artificial Sequence: Synthetic coding sequence
atgccgcactcttaccctgctttaagcgccgagcagaaaaaagagctcagcgacatcgcactgcggatcgtggcgcctggaaaggggatccttgcagccgacgagtcagtgggatctatggccaagcgtcttagtcagataggcgtagagaacactgaagagaaccggcgactatatcgccaggtgctgttcagcgctgatgatcgagtgaagaaatgcattggaggcgtgattttcttccacgagacgctttatcaaaaggacgacaatggagtgcccttcgtccgtacaattcaggacaaaggcatcgttgtgggcatcaaggtcgacaagggggtagtgcccctagccggtacagacggggagacaaccacacagggactcgacggactgtctgagaggtgcgcccagtacaagaaggatggggcagatttcgccaaatggaggtgtgtgctgaaaatttctgagagaactccctctgccttggcaatactcgagaacgccaacgtgcttgcccgatatgcttccatttgccagcagaacggtattgtgcctatagtagaaccggaaattttgcctgacggtgatcacgatctgaagcgctgtcagtacgttacagaaaaagttctggccgcagtttacaaggctctcagcgaccatcacgtttacttggaggggactctcctaaagcccaacatggtcacaccgggtcatgcttgcccgatcaaatatacaccagaagagatagcgatggccaccgtgactgccctgaggaggaccgtcccacctgccgtgcctggagttacctttctgtcaggcggtcagtcagaggaggaagcctcattcaaccttaatgctatcaatcgctgcccattaccacggccttgggcccttacattcagctatggcagagccctgcaggcgagcgccctcaacgcgtggagagggcagagagataatgcaggcgcagcaaccgaagagttcataaaaagagccgaagtcaacgggttagcagcacagggcaaatacgaaggctccggagaggatgggggagctgcagcccagagtctctatattgctaaccacgcttactag

SEQ ID NO: 214071 - DNA, 450 bp, Artificial Sequence
  Description of Artificial Sequence: Synthetic coding sequence
atgccacacagctacccggctttgagcgcagagcagaagaaggagctttctgatatagccctgaggatagtggcacctggcaagggcattctggcggctgacgaaagcgttggcagcatggccaagaggctttcccagatcggcgtggagaacaccgaggagaatcggcgactgtatcgccaggtcctgttttccgctgatgacagggtcaaaaagtgtattggaggggtaatattcttccacgagactctatatcagaaagacgacaacggtgtgcccttcgtgcgcactatccaggataaggggattgtcgtgggcatcaaggttgacaaaggggtggttccactggccggaaccgacggcgaaacaaccacacagggcttagacggcttgagcgaaaggtgtgcccaatacaaaaaggacggagcagacttcgctaagtggcgatag

SEQ ID NO: 214072 - DNA, 795 bp, Artificial Sequence
  Description of Artificial Sequence: Synthetic coding sequence
atgccatcaatcttcgcttaccagtcgtcagaggttgattggtgtgaatccaattttcagtactccgagcttgtggcagagttttacaacacgttttcaaacattcccttcttcatttttggccctttgatgatgctgcttatgcacccctatgcacagaaaagatctagatacatctacgtggtgtgggtgctttttatgataatcggcctctttagtatgtacttccacatgaccctatcctttctcggacaactgctggatgagattgccattttatggttgcttggttccgggtatagtatttggatgccaagatgttatttcccatccttcctgggtggcaaccgcagccagtttatacggctggtgtttatcaccaccgtagtcagcacactcctgagctttctccgccctaccgtgaacgcgtacgctttaaacagcatagcgcttcacattctttacatcgtgtgccaggagtatcgtaagacaagtaataaggaacttagacatttaatcgaagtgagcgtcgtcctgtgggcagttgccctgacaagctggattagtgacaggctactgtgcagtttctggcagagaatccattttttttatctgcattcgatttggcatgtgctcatcagcatcacattcccctacggtatggtaaccatggctctggtagacgcaaactatgagatgccgggtgaaactttgaaagtaagatactggcctcgggatagctggccagttggtctgccttatgtagaaattcggggtgatgataaagactgctag

SEQ ID NO: 214073 - DNA, 828 bp, Artificial Sequence
  Description of Artificial Sequence: Synthetic coding sequence
atgggagccccacattggtgggatcaactacaggccggatcctccgaggtcgactggtgcgaagacaactataccatcgtcccagccatcgcagagttttataacaccatctccaatgtgttattctttatcctcccacctatctgtatgtgcctgtttcgccagtatgctacatgcttcaatagcggcatttacctaatctggacactgcttgtggtggtcggaatcggatcagtctattttcatgcaacactgagcttccttgggcagatgctggacgaactggccgtgctctgggtcctgatgtgtgctctggctatgtggttccccaggagatacctgccaaaaatctttaggaacgatagaggcaggttcaaagtggttgtaagtgtcctctcggcagtgaccacctgcctcgcttttgtcaagccagctattaataacatcagcctgatgactctaggcgtgccttgcaccgccctcttgatcgccgagctgaagaggtgtgacaatatgcgagtgttcaaattgggtctattcagcggactctggtggacactggcactgttttgctggatatccgaccgggcattttgtgaactgctttcttctttcaacttcccatatctgcactgcatgtggcacatactgatctgtctggcagcctacctcgggtgcgtgtgctttgcatatttcgacgccgcaagcgaaattcccgagcagggcccagttattaagttttggccgaacgagaaatgggcctttattggagtgccatacgtgagccttctgtgtgcaaataagaagtcctctgtcaaaattacttag

SEQ ID NO: 214074 - DNA, 423 bp, Artificial Sequence
  Description of Artificial Sequence: Synthetic coding sequence
atgtgcctgtttagacagtatgctacgtgtttcaactctggtatttacttaatctggacattgctggtggttgtgggcattggatcagtgtacttccacgcaacgctttccttcctgggccagatgctggacgagcttgcagtcctatgggtgctcatgtgcgctcttgcaatgtggttcccccgacggtacttaccaaagattttccggaacgaccggggacgcttcaaagtggttgtgtctgtgctgtctgctgtgaccacatgtctagcttttgtgaagcccgctatcaataacatcagtctcatgactctgggcgttccttgcactgcattgctcatcgcagaactgaagcggcacgagagaaaccagcgtcgacgccaccgtaagggcggtcagcaggggggtggagataaagtatag

SEQ ID NO: 214075 - DNA, 1587 bp, Artificial Sequence
  Description of Artificial Sequence: Synthetic coding sequence
atgcagggtccatgggttctgctgttgctaggccttaggctccaactgagcttgggcgtcataccagctgaggaggaaaacccagcattctggaaccgccaagccgcagaagccctggacgccgctaagaaactccaaccgatccagaaggttgccaagaatctgatactatttctcggcgacggattgggagtacctaccgttaccgcgaccagaatcctgaagggccagaaaaatggaaaactaggccctgaaactccacttgcgatggatcgcttcccttacctggctctctctaagacttacaatgtagacaggcaagtgccagacagcgccgcaacggctaccgcatacctgtgtggcgtgaaggccaatttccagacgatcggccttagcgctgctgcgaggttcaatcagtgcaatacgacaaggggaaacgaagtgatctccgttatgaaccgagctaagcaggctggcaaaagcgttggcgttgtcactactaccagagtccaacacgcatcaccagccggaacctacgctcacaccgtcaaccgaaactggtacagcgatgccgacatgccagcttccgctaggcaagaaggatgtcaagatatagctactcagctgatcagcaatatggacatagacgtcatattggggggaggacgcaaatacatgtttcccatgggaacaccagacccggaataccccgcagacgcgtcgcagaatggaattcgattagacgggaaaaatctagtgcaagagtggttggccaaacaccagggcgcttggtacgtgtggaatcgcactgagctgatgcaggcctccctggatcaatcagttacacatctgatgggtctctttgaacccggagatactaaatatgagatccaccgcgaccctacacttgacccatccctgatggagatgaccgaggccgctctgagacttctgtccaggaatcctcgtggattctatctgttcgtagaaggcggaagaatcgaccacgggcatcacgaaggcgtggcatatcaggctctcaccgaagccgtaatgttcgatgatgcaatcgaaagagccggtcagttaacaagtgaggaggacacgctcaccctggtaaccgcagaccactcgcatgtcttctcctttggtggatatacattaagaggatcaagcattttcggtctagccccatccaaggctcaggacagcaaagcttacacaagcatactgtacggtaatggccctggctacgtgttcaatagcggcgtgaggcccgacgtaaatgaatccgagtccggatcaccagactatcagcagcaggctgccgtacccctttctagtgagacccatggaggtgaggacgttgctgttttcgcacgcggtccccaggcacacctcgtccacggcgtgcaggagcagtcctttgtcgcccacgtgatggcgtttgccgcttgcctagagccctacacagcttgtgatctggcaccccctgcatgcaccacagacgcggcacaccccgtggccgcttccttacctttactggcaggaacactcctgctgctgggcgcaagtgcagccccttag

SEQ ID NO: 214076 - DNA, 513 bp, Artificial Sequence
  Description of Artificial Sequence: Synthetic coding sequence
atggatagggccatcggacaggcaggcagcttgacatcaagcgaagatactctgactgtggttacggctgaccattcacacgtgtttaccttcgggggatacactcctcggggtaactctattttcggactagctcctatgctgtctgacaccgataaaaaaccattcacagctatcctatacggcaatggacccggatataaggtggtggggggagagagggagaatgtctcaatggttgattatgcacacaataactatcaggcgcagtcagcagtgcccctcaggcacgaaacccacgggggtgaagatgtagccgttttctcgaaggggccaatggcgcatctactgcatggggtgcacgagcagaactacgtccctcatgtaatggcttatgccgcttgtatcggagcaaatctcggccactgcgcacctgcaagctctgccggatcactggccgcagggccactgctcctcgcgctcgcactgtacccactgtcagtgctgttttag

SEQ ID NO: 214077 - DNA, 513 bp, Artificial Sequence
  Description of Artificial Sequence: Synthetic coding sequence
atggaccgtgcgattgggcaggctggaagcttgacgtcatctgaagatacactgacagtggtcacagctgatcattctcacgtgtttaccttcggcggatatactccccgaggcaattctattttcggactggcccctatgctctcagacaccgataaaaaacctttcacggcaatactgtatggtaacggaccaggctataaggtggttggaggtgagcgggagaatgtgtccatggtggattatgcccacaacaattatcaggcacagtccgcggttccgttgcggcacgagacccatgggggagaggatgttgcagttttctccaaaggcccaatggcgcacttactgcacggagtgcatgaacagaattacgtccctcatgtgatggcttatgctgcctgtatcggtgccaatctcggacactgtgcccctgccagttctgcgggttcactcgccgctggacccttattgctggcgctggccctataccccctgagcgtgttgttctag

SEQ ID NO: 214078 - DNA, 1575 bp, Artificial Sequence
  Description of Artificial Sequence: Synthetic coding sequence
atgataagcccttttttagtcctggctattggaacatgcctaaccaatagcctggttcctgaaaaagaaaaggatccaaagtattggcgggatcaagcacaagaaactctgaaatacgccctagagttacaaaaactgaataccaacgtggccaaaaatgtgatcatgttcctcggcgacggtatgggcgtttcaaccgtgaccgcagcgagaatcctaaaagggcaactccaccataaccccggtgaagagactcgtctggaaatggacaagtttcccttcgtcgctctgtccaagacctataatacaaatgcacaagtgccagattccgcagggaccgcaacggcgtatctgtgtggtgtgaaggctaacgagggaacagtgggggtatctgcagcaactgagcgatcccgctgtaatactactcagggaaatgaggtcaccagtattctgcggtgggcaaaggacgcaggaaagagcgtgggcatagttacgacaactcgggtaaaccatgccacaccctcagccgcatacgctcactccgcagacagagactggtactctgacaatgagatgccccctgaggcactctcccaagggtgcaaggacatcgcgtatcagctgatgcacaatattagggatatcgacgtgataatgggaggcggaaggaagtatatgtaccctaagaacaagactgacgtcgaatatgagtccgatgagaaggcgagaggcactagactcgatgggttagaccttgttgacacttggaagtcttttaagcctcgctacaagcattctcacttcatctggaatcgcacagaactactcacactagaccctcataatgttgattatcttctggggcttttcgagccaggggatatgcagtatgaactgaataggaataatgtgactgatccctcgctttcggagatggttgtggtcgctattcagatcctgcggaaaaaccctaaaggttttttcctgcttgtggaaggtggtcgtattgatcatggacatcacgaagggaaagcaaagcaggctcttcacgaagccgtggaaatggacagggctatcgggcaggcgggaagcctgacaagtagtgaggacaccctcaccgtcgtaacggcagaccactctcatgtgtttacctttggagggtacactcctcgaggcaacagcatctttggactcgcgcctatgctatctgataccgacaaaaagccattcaccgcaatcctctatgggaacggacccggatataaggtcgttggcggagagagggagaacgtgtcaatggtggattatgcacacaataattaccaggcccaatccgcagtgcccctacggcacgaaacacatgggggagaggacgtggctgtgttttccaaaggtcccatggcgcacttattgcatggtgtgcacgagcagaattatgtgccacacgttatggcatatgcggcatgtatcggcgctaacctcggacactgtgcgccagcttcatccgcaggctcattagcagcaggccctctgttgctggccttggccctttaccccctcagcgtcctcttctag

SEQ ID NO: 214079 - DNA, 1575 bp, Artificial Sequence
  Description of Artificial Sequence: Synthetic coding sequence
atgatctccccattcctcgtgctggctattgggacttgccttaccaactccttggtccctgaaaaagagaaagacccaaaatactggcgagaccaggcccaggagacactcaaatacgcattagagctccaaaagctgaacacaaacgtcgctaagaatgttatcatgttcctaggcgacggtatgggagtttccacagtcacagctgcgcgtattttaaagggccaactgcatcacaacccaggcgaggaaacacgtctggagatggacaaattcccatttgttgcactctctaaaacgtacaacacaaatgctcaggtgccggactccgctggcacggccactgcctacttgtgtggggttaaggctaacgaggggaccgtcggggtcagcgcggctacggagcgttcacgttgtaatactacacagggcaacgaggtgacatccatcttgcggtgggccaaggacgcgggaaagtctgtcggaatcgtaacaacaaccagagttaatcacgccacaccatctgcagcttacgcgcacagcgcagatagagactggtattcagataatgagatgccccctgaagcactttctcaggggtgtaaagacatcgcataccaactgatgcataacataagggacattgatgtgataatgggtggaggcaggaagtatatgtaccctaaaaacaagacagatgttgaatacgagagcgacgaaaaagcccgtggtacccgcctggacgggctcgacctggtggacacatggaagagtttcaaacctagatacaaacattcacacttcatctggaatcgaaccgagctgctgactcttgacccacacaatgtggactaccttctgggactttttgagccgggagatatgcagtatgaattgaaccggaacaatgtgacagatccgtctttgagtgaaatggtggtcgtggctattcagattcttcgaaaaaatccaaaaggattcttcctgctggtagaaggcggaaggattgaccatggtcatcacgaggggaaggccaagcaagcccttcatgaggcagttgaaatggacagagccattggccaggcgggaagcctgacatcatctgaggacacactaacagttgtgaccgcagaccacagccacgtattcaccttcggcggttacacgcctagaggtaattcaatcttcggactggctcctatgctttcagacacggataagaaacccttcaccgccattctgtacggcaacggccctggatacaaagtggtgggcggtgaacgcgaaaatgtgtccatggtggattacgcacataacaattatcaggcacagtctgctgttccactaaggcacgaaactcacggaggcgaggatgtcgcagtcttttctaaaggcccaatggcccacctgttacacggtgttcacgagcagaactacgtcccacatgttatggcatacgcagcgtgcataggagccaacctcggtcactgcgcaccagcctcatccgcaggctctctcgccgcaggcccattgttactggccctggctctgtacccgctctcagtcctcttttag

SEQ ID NO: 214080 - DNA, 1575 bp, Artificial Sequence
  Description of Artificial Sequence: Synthetic coding sequence
atgatcagcccttttcttgttctggcaatcgggacatgccttacgaattcacttgtccctgaaaaggaaaaggatcccaagtattggcgggaccaggcgcaagagactttaaaatatgccctggagctccagaagctgaatacgaacgtggccaaaaatgtgattatgttcctgggagatggcatgggggtaagcacggtgactgctgctcgcatcctgaagggacagctacatcacaatccaggtgaggagacccgcctggaaatggataagttcccgttcgtggctttgtcgaagacttacaacacaaacgcccaagtgcctgatagtgcagggacggcaactgcctacctgtgtggggtgaaggctaatgaagggacagtgggcgtgtcagccgcaactgaacgcagcaggtgtaacacaactcaggggaatgaggtcacatccattctgcgctgggctaaagacgccggtaagtcggtgggaatcgtgacaacaacaagggtgaatcacgcaacaccaagtgccgcttatgcacattcagctgatagagactggtacagcgacaacgaaatgcctccggaagccctgagtcagggctgtaaggatatcgcatatcagcttatgcataatatcagagatatcgatgtgattatggggggaggcagaaagtacatgtacccaaagaacaaaaccgacgtggaatacgagtccgatgagaaggctaggggaacgagattggacggactggaccttgtcgacacatggaagtcatttaagcctagatacaaacattctcatttcatatggaatcggaccgaactgctgaccctggacccacataatgtggattatcttctcggcctttttgaacctggagatatgcagtacgagctgaaccgcaataacgtcactgatccctctctgtctgaaatggtggtggtggcaatccagatcctcaggaaaaacccaaaaggattctttcttctggtggaaggcggtaggatcgatcatggtcaccatgagggaaaagccaagcaagcgctacatgaggccgtggaaatggatagggctattggccaggccggatcactcacgtcttccgaggacaccctaaccgtggttaccgccgatcactctcacgtcttcacatttggtggatacacaccaagaggcaattccatcttcgggctggccccaatgctcagcgatactgacaaaaaaccgtttaccgctatcctatacggcaatggcccaggctacaaagtcgtgggtggtgaaagggagaacgtgtctatggtggattacgctcataacaactaccaagcccagtctgcagttccactccggcacgaaactcacggcggagaggatgtggcagtcttctctaaagggcctatggcccacttacttcacggtgtccatgagcaaaactatgtaccccacgttatggcctatgctgcgtgtattggcgcaaacctcggccattgtgcccctgcctcatcagctggctccctggcagctggtcccctccttctggctctggcactgtatcctttgagcgtactgttctag

SEQ ID NO: 214081 - DNA, 1344 bp, Artificial Sequence
  Description of Artificial Sequence: Synthetic coding sequence
atgccctggtccttcagaagctctactcctacctggcttaggatgtccagttgctcatgggagatgacctataacaccaacgcacaagtaccagactccgctggcaccgccactgcctatctgtgtggcgtgaaggcaaatgaaggaaccgtgggagtatccgccgcaaccgaacgctccagatgcaacacaacacaaggaaatgaggttacaagcattttaaggtgggctaaggacgcgggaaaaagcgtcggaattgtgaccacaacccgcgttaaccacgcaacaccatctgcggcttatgctcactcagcggatcgcgattggtattcggacaatgagatgcccccagaggcgttatctcagggatgtaaggatatcgcttaccagttgatgcataatatacgggacatcgacgttatcatgggcggtggcagaaagtatatgtatccaaaaaataagactgacgtcgaatatgaatcagatgaaaaggcaagggggacacggctggacggactggatctcgtggatacatggaagagttttaaacccagatacaagcactcccactttatatggaataggacagaacttctgacgctcgatccacataacgtggactacctccttggactgttcgagccaggtgatatgcagtacgagcttaatcggaataatgtgaccgatccctcactcagcgagatggtggttgttgcaattcaaattcttcgcaaaaaccccaaggggttcttccttctggtggagggtggcaggatagaccacgggcatcatgaggggaaagctaagcaggcattgcatgaggcggtggaaatggaccgggctatagggcaggccggaagcttgacatcgtcagaggatacactcactgtcgtaacggctgatcactctcacgttttcactttcgggggatatacccctaggggaaacagtattttcggcctggctccgatgctgtccgacacagacaaaaagcctttcacggcaatcttgtatgggaacggccctggttacaaggtggttggaggcgaaagagagaacgttagtatggtagactacgcccataacaactaccaagcgcagtctgccgttccactccggcacgaaacccacgggggtgaggatgtggcggttttcagcaaggggccaatggcacacctattgcacggagtccacgagcaaaactacgtaccacatgtcatggcctatgcagcctgtatcggagcaaatcttgggcactgtgcgccagcaagttccgcgggatctctggctgccggaccgttgctgctagccctcgcactgtacccgctgagtgtcttgttttag

SEQ ID NO: 214082 - DNA, 1410 bp, Artificial Sequence
  Description of Artificial Sequence: Synthetic coding sequence
atgttcttaggagacggtatgggcgtgagcacagtgactgcagcgcgtattctgaagggacaacttcaccataatcctggagaagaaactcgactcgagatggataagtttcccttcgtggccctatcgaagacatataacacaaacgctcaagtccccgattcagccggaacagccacagcctacctctgtggagtgaaggctaacgaaggaacggttggagtttctgccgctactgagcgatcaaggtgcaatacaactcagggcaatgaagtgacttcaattcttagatgggctaaagacgccggtaagtcagtgggcatcgtgactacaactcgagtcaaccatgctacgcctagcgcagcatacgcgcatagcgccgatcgggattggtacagtgataacgaaatgcccccagaagcgctctcgcagggatgtaaggatattgcttatcagctcatgcataatattcgggatatcgacgtgatcatgggagggggacgcaagtacatgtatccaaagaacaagaccgacgttgaatatgagagtgacgagaaagcccgaggcaccaggcttgacgggctggatctggtggatacgtggaagagttttaagcctcgctacaaacatagccacttcatctggaacaggaccgaattacttactctagatccccacaatgtggattatcttctggggctgtttgagcctggcgacatgcaatatgaattgaatcggaataatgtgactgatccatctctgagcgaaatggtggtggtagcaatacagatcctgcgaaagaaccccaaggggttttttctgctggtggaagggggacggattgatcacgggcaccacgagggcaaggccaaacaagcactgcacgaagcagtcgaaatggatcgggcaatcggccaggcaggctccctcacttcatcagaggacaccttgactgtcgtgacagcagaccattcgcacgttttcactttcgggggttatacccctcggggaaacagcattttcgggttggccccaatgctttccgataccgataaaaaaccttttactgctattctctacggcaacggccctggatacaaagtcgtgggtggggaacgtgaaaacgttagcatggtggactacgcgcacaacaattaccaggcccagtccgctgtccccctgagacacgaaactcacggaggggaggacgtcgccgttttctctaaaggacccatggcgcacctccttcatggagtacatgagcaaaattacgtcccacacgttatggcgtatgccgcatgcattggggctaacctggggcattgtgctccagcctctagcgcaggttctttagctgctggaccgttactgttagctctggcactctatccgctctcagtccttttttag

SEQ ID NO: 214083 - DNA, 1608 bp, Artificial Sequence
  Description of Artificial Sequence: Synthetic coding sequence
atgctaggcccatgcatgctgctgctgctgctccttctcggcctcaggttacaactaagcctgggtattatacctgtagaagaggagaatcctgacttctggaatcgggaggcggcagaggcattgggcgctgccaagaaattgcagcccgctcaaacagctgccaaaaatctgatcatcttcttaggcgacggcatgggagtctccaccgtcacagcagccagaatcctcaaagggcagaaaaaagataagctgggtcctgaaattcccctggccatggacaggtttccctacgtggctctgtccaagacgtataacgtggataaacacgtgcccgattccggagccaccgccactgcttatctctgtggcgtcaaggggaatttccaaacaattggcctgagtgcagcagcacggtttaaccagtgtaataccactcgaggaaacgaggtaatctccgtcatgaaccgcgctaagaaagctggcaagtcagtgggtgtcgtcaccaccacgagagtgcagcatgcctctcctgctggcacctatgcacacaccgtgaatagaaattggtattccgacgccgatgttcccgcttccgcccgacaagaaggttgtcaggatattgccacacagctgatttctaacatggacatcgatgtcattctggggggaggtaggaagtatatgtttagaatgggcacaccagatccagaataccccgatgactattcacagggcggtaccaggctggacggaaagaacttggtgcaagagtggctcgccaaacgacagggagcaaggtacgtttggaacagaactgaactcatgcaagccagcttggatccatccgtcacacacttaatgggtctatttgagccaggtgacatgaagtacgagatccacagagattccactctcgatcctagtttgatggaaatgactgaagccgctcttcggctgctgagcaggaaccccaggggcttcttcctcttcgtagaaggcggtcggatcgatcatggccatcatgagagccgcgcttaccgggcactcacagagacaataatgttcgacgacgccattgaacgcgctggccagcttacgagcgaggaagataccttaagcctcgtgactgcggaccactcccatgttttcagctttggaggctatcctcttcgcggaagcagtatattcggacttgcgcctgggaaagccagagataggaaggcgtacactgtcctattatacggaaatggacccggatacgtgcttaaagatggcgctcggcctgatgtgacggaaagtgaatcagggagtccagagtacaggcaacagtcggccgtccccctggatgaagagactcacgccggtgaggacgtggcagtatttgccaggggaccacaggcccatttggtgcatggtgtgcaagaacagacttttatcgctcacgtgatggccttcgctgcatgtcttgaaccctacacagcctgcgacctagccccaccggcaggaaccacagacgccgcacacccagggaggtctgtggtgccggcactcctgcccttgctcgctggcactctactcctcttggaaacagcaactgctccatag

SEQ ID NO: 214084 - DNA, 1599 bp, Artificial Sequence
  Description of Artificial Sequence: Synthetic coding sequence
atgcaaggaccgtgggtgttgttgttgctggggttgcgtctgcagcttagcctgggcataatacccgtcgaggaagaaaatcctgacttttggaaccgacaggctgccgaggccctgggagctgccaaaaagctgcaaccagcgcaaacagcagcaaagaatctgatcatttttctcggtgacggcatgggtgttagcactgtgactgcagctcgtatcctgaaaggtcagaagaaggacaagcttgggcctgaaacctttctggcaatggacaggtttccctacgtggctttatccaaaacatactccgtggacaagcacgtcccagatagcggagctacagccaccgcttatctctgtggcgtgaaggggaacttccagactattggcttgagtgccgcagccaggttcaaccagtgcaatacgacccggggtaatgaggtcatctctgtcatgaaccgcgctaagaaagccggaaagtccgtcggcgtcgttaccacaacgagggtgcagcacgcatcgccagcaggggcttacgcccacaccgtaaatcgcaattggtattccgacgctgacgtacccgcttcggccagacaggaaggatgtcaggatatcgctacacagttgatctccaacatggacatcgatgtgatactgggtgggggacgaaaatacatgtttcccatgggcaccccagacccagagtacccagacgattattcccagggcggtacaaggctcgacgggaaaaatttggttcaggagtggctggcaaagcaccagggggctcggtacgtgtggaacaggactgaattgcttcaggcttccctcgacccatccgtaacgcacctgatgggactctttgagcctggagatatgaagtacgagattcaccgtgactccactctcgacccgtcactgatggaaatgacagaagctgccttactcttactgagcagaaaccccaggggatttttcctgtttgttgaggggggtagaatcgaccatggtcatcacgagtcacgggcatatcgagcgctgaccgaaactattatgttcgacgatgccattgagagagcaggtcagctcacctctgaagaagacactctctctctggtaactgctgatcattcccatgtgttcagttttggtggctacccccttagagggagcagtattttcggcctggccccaggtaaagcacgtgatcggaaggcctacacggtcttgctatacggcaacggtcccggttacgttttgaaggacggcgctaggcctgacgttacagagtccgagtccgggagcccagagtaccggcagcagagtgcagtgccactcgatggcgagacacatgccggagaagatgtggcggtgtttgccagagggcctcaggcacacttagtccatggcgtgcaggagcagactttcattgcccacgtgatggccttcgctgcttgcctggaaccgtatacagcctgcgatctagcccctagggccggaactactgatgccgctcaccctggcccttctgtcgttcccgcactcctaccactgcttgctggaacgctcctcctgctcggcacagccaccgcaccgtag

SEQ ID NO: 214085 - DNA, 474 bp, Artificial Sequence
  Description of Artificial Sequence: Synthetic coding sequence
atggacaggttcctcgtgaaaggagcccagggcggactcctgcggaaacaagaagagcaagagcccaccggtgaagagcctgccgtcctgggcggagacaaagagagcacccgcaagaggcctcgcagagaggccccaggcaatgggggacactcagcgggacctagctggaggcatatccgtgcggaagggttggactgcagctacacagtgctctttggcaaagccgaggcagatgaaatttttcaggaactggaaaaggaggtggagtacttcacagggatcaaaatggctgttacgaccagtggcagtacagagatgatgaaggagaactggccactcggagctccattgccattgtcaccttccgtgccagcagagacgctgagttccggaatcaggattcctgtgggaaaggcccctcctggtgggtggaggtggagtggctgcagatggcctacaggggcttactag

SEQ ID NO: 214086 - DNA, 2958 bp, Artificial Sequence
  Description of Artificial Sequence: Synthetic coding sequence
atgatcaggcatgctggtgccccagctcgaggcgacccaactggccctgtgcccgtcgtgggaaaaggcgaagaggaagaggaagaggatggcatgcgcctttgtctgccggcaaatccaaaaaactgcttaccccataggcgaggcatctccatccttgagaaactgattaagacgtgcccggtgtggctgcaactgagcctgggacaggccgaagtggcgcgtatcctgcatcgagtggtggcaggaatgttcctagtgagacgggatagctcctccaagcaactggtcctctgcgtccactttccttctctgaacgaatcctcagctgaagtgctggaatacactataaaggaagaaaaatccatcctgtacctggagggcagtgctctcgtgttcgaagatatattccgactgatagcgttctactgcgtgagccgtgaccttctgcctttcactctcaggctgccccaggctattcttgaagcctctagctttactgatctggagactattgcaaacctcggccttgggttttgggactcttctctcaacccgccacaggaacgaggcaaacctgcagagcctccaagagatagagctcccggattccctttggtttccagcttgaggcccaccgcacatgatgccaactgcgcgtgcgagatagaactgtccgttggtaacgatagactgtggttcgtgaatccgatctttattgaggactgcagctccgccctccccacagaccagccccctctgggcaattgcccagccaggcctctcccccctacaagcgacgccacctctccgacctcgcggtgggcccctaggcgccctccaccgccaccacccgtgctaccgctccagccatgctcccctgcccagcccccagtccttcccgctcttgcccctgcacccgcatgtccgctgcctacaagtcccccagttcctgctccccacgttaccccacatgcccctgggcctcctgaccaccccaatcagcccccaatgatgacgtgtgaacgcctaccctgccctactgccggactcggacccttacgcgaggaggctatgaaaccaggcgcagcctccagtcctctgcaacaagtgcccgctccgcctcttcctgcgaaaaaaaacctgccaaccgcgcctccccgaaggcgggtgagcgagcgggtgtctctcgaggaccagtcccccggtatggcggcagagggcgatcagctgtctctgccaccccagggaacctctgacggcccagaggatacacctagagagtccacagagcagggtcaggacaccgaagttaaagccagcgatccccacagtatgccggagcttcctcgaacggcgaagcaaccccctgtcccaccgcctcggaaaaagcgaatctcaaggcagctcgcaagtacacttccagctccgctcgagaacgccgagttgtgtactcaggctatggctctggagaccccaacccctggcccacccagggaagggcagagccccgcttcgcaggccggaacccagcatccgcctgcgcaggcaactgcccattcccagtcttcacctgagttcaaaggctctctagcttctttgtctgattcactcggggttagcgtgatggcaactgaccaggattcttattctacctcctctactgaggaggagctggagcaattttcgagcccctctgtgaaaaagaagccaagcatgatcctgggtaaagccaggcaccgtttatccttcgccagtttcagctctatgttccatgctttcctgagcaacaatcggaagctctacaagaaggtggtcgaactggcccaagacaagggatcttattttgggtctttggtgcaggattacaaggtctatagcttggagatgatggcacggcaaacgtccagcaccgagatgctgcaagagatcagaactatgatgacacagctcaagtcatatcttctccagagcacagagctcaaagctctagtcgaccctgctttgcactccgaagaggagttagaagccatagttgagtccgcgctgtataagtgtgtactgaaaccactcaaggaagccatcaattcttgtcttcaccagattcattctaaggacggaagcctacagcaactgaaggaaaatcagctggttatcttggctacaacaaccacggatctaggggtgactaccagtgtccccgaggttcccatgatggagaagattttgcagaaatttacttctatgcacaaagcctactccccagagaagaagattagcatcttgctaaaaacatgcaagcttatctatgatagcatggcattagggaatcccggaaagccgtacggagccgacgatttcctgcctgtgcttatgtacgtgctcgccaggtccaacctgacagaaatgctccttaatgtcgagtacatgatggaactcatggatcccgctctccaactcggcgagggctcttactacctcacaaccacctacggcgctttggagcacattaagagttatgataaaattacagttactaggcagttgtctgttgaggtgcaagacagtatacatagatgggagcgcagacgcaccctgaataaagcacgcgcaagccgttcctctgttcaggattttatctgcgtgagctatctcgagcccgagcagcaggccagaactctggcctctcgcgctgatactcaggcccaggcattgtgcgctcagtgcgccgaaaagttcgcagtcgagagaccccaggctcacaggctgttcgtcctagtggatggtaggtgcttccaactggccgacgacgccttacctcactgcattaaaggctacctgctccgtagcgagccgaagagggactttcacttcgtgtataggccgcttgacgggggagggggagggggtgggggttcaccgccttgtcttgtagttcgcgagcccaacttcttatag

SEQ ID NO: 214087 - DNA, 786 bp, Artificial Sequence
  Description of Artificial Sequence: Synthetic coding sequence
atggaccggtttctcgtaaagggtgctcagggtgggcttctgaggaagcaggaggaacaggaacctacgggtgaagaaccggctgtccttggaggcgataaagagtcaacgcgtaagaggccacgaagagaggcacccggtaacggaggtcacagtgccggtccttcttggagacatatcagggcagaaggcctcgattgctcatacactgtcctcttcgggaaggccgaggccgacgagatatttcaagaactagagaaagaggtggagtacttcaccggggctctagccagagtgcaagtctttggaaaatggcattcagtgcctaggaaacaggctacctacggagatgctggcctcacctacaccttcagtgggctgacactgtcacctaagccttggattcctgtgctcgagcgaatccgagatcacgtgtcaggcgtcacagggcagacttttaactttgtcctcatcaatagatataaagacggttgcgaccatattggcgaacaccgcgacgacgagcgcgagctggcaccagggagccctattgcctccgtttcattcggcgcatgccgcgatttcgtctttcgccacaaggattctagagggaagagcccctcccgcagagtggctgtggttcgcctaccactggcacatggctctctgttaatgatgaaccaccccactaacacacattggtaccactcactgcccgtccgaaaaaaggtattagcacccagagtaaacctgacatttcgaaaaattcttttaaccaagaaatag

SEQ ID NO: 214088 - DNA, 786 bp, Artificial Sequence
  Description of Artificial Sequence: Synthetic coding sequence
atggacagattcctggtgaagggagcccaaggtggcctgttgagaaagcaggaggagcaggaaccaacgggcgaagagcccgctgttcttggaggagacaaagagtccacccgcaagagaccgaggagagaggcacctggtaatggcggacactctgccggaccatcatggaggcacatccgcgctgaaggattggattgttcatataccgtattattcggaaaagcagaagcagacgagatcttccaggaactggagaaagaagtcgagtattttacaggcgcactggccagggtgcaagtatttggtaagtggcactcagttccgagaaagcaagctacctacggggatgcaggccttacatacaccttctcgggactcactctctccccaaaaccctggattcctgttctggaacggatccgcgaccatgtctctggtgtgaccggccagacctttaatttcgttctgataaacagatataaggacggctgtgatcatatcggcgagcatagagacgacgaacgcgagctggctcccggaagccccatcgcctctgtctcatttggagcttgccgcgactttgtttttcgccataaggactcacgaggtaagtctccaagtcggcgagtcgccgtggtgcgtctgccactggcccatgggagcctgctgatgatgaatcatcccacgaacacccattggtaccactccctccccgtcagaaaaaaggtcctggctcccagagtcaatttaacattcagaaagatcctgctgaccaaaaagtag

SEQ ID NO: 214089 - DNA, 786 bp, Artificial Sequence
  Description of Artificial Sequence: Synthetic coding sequence
atggaccgctttctcgtcaaaggcgctcagggaggtttgttgagaaaacaggaagaacaggagcccacgggtgaagagccggcagtgttagggggagacaaggaaagcacacgcaagcgccctcgaagggaggcaccgggtaatggcggacattccgcgggacctagctggagacatattcgggcagaggggttagactgctcctacacagtgctgttcgggaaagcagaggcggatgagatcttccaggaactcgagaaggaagtcgaatatttcacgggcgctcttgcccgagtccaggtgtttggtaagtggcatagcgtgcctcgcaaacaagccacttatggggatgccggtctcacctacaccttcagtggccttactttaagtccaaaaccttggatccccgtgcttgagcggatccgggaccacgtgtcaggcgtcacgggccagaccttcaactttgtattaatcaatcggtataaagacgggtgcgaccatattggtgagcatagagacgatgaaagagagctggctcctggttctcccatcgcgagtgtgtcttttggggcatgtcgcgactttgtctttcgccacaaggacagccgtggtaagtccccaagccgaagagtggctgtggtgcgcctccccctcgctcatgggtcgctcctgatgatgaaccatccaacgaatacacattggtatcactctctcccagtgcgcaagaaagtgctcgctccgagggttaatcttacctttagaaaaattctactgaccaagaaatag

SEQ ID NO: 214090 - DNA, 453 bp, Artificial Sequence
  Description of Artificial Sequence: Synthetic coding sequence
atggatagattcctggtgaaaggagctcagggaggactcctgcggaagcaggaggagcaagagccaaccggagaggagcccgctgtgctgggaggcgacaaggagtccactaggaaaagaccacgtagggaagccccaggaaacggtggacacagcgccggtccaagctggcgacatattcgggctgaaggcctggattgttcttataccgtcctcttcggtaaggcggaggctgacgagatttttcaagagctagagaaggaagtggagtatttcacaggcgctttagccagagtgcaagtgtttggtaagtggcactcagtccctagaaagcaggccacctacggagacgcaggtctgacctacaccttcagtgggctgacactgtctccaaagccgtggatacctgttctcgaacggattagggatcatgtcagcggcgtgaccggatag

SEQ ID NO: 214091 - DNA, 366 bp, Artificial Sequence
  Description of Artificial Sequence: Synthetic coding sequence
atggacaggttcctggtgaaaggggctcagggcggactcttaagaaagcaggaagagcaggagcctaccggggaggaacccgcagtgctgggaggcgataaggagagcactcgaaaaaggccaaggcgcgaagccccaggcaacggcggtcactccgccggtcctagctggaggcacattagagctgagggattagattgctcgtataccgtgctctttgggaaagcagaagcagacgagatcttccaagagctggagaaagaagtcgaatactttacaggggcactcgctcgagtgcaggtgtttggtaagtggcattccgtcccaagaaaacaggcaacttacggtgacgccggtctcacctag

SEQ ID NO: 214092 - DNA, 483 bp, Artificial Sequence
  Description of Artificial Sequence: Synthetic coding sequence
atggatcggttcctggtgaagggggcacaaggaggccttctaagaaagcaggaagagcaagagccgacgggggaagaacccgctgttcttgggggagataaggagagtactcgcaagcgcccacggagagaggcccctggtaatggaggacacagtgcaggtccttcctggcgacatatccgtgctgagggattggactgcagttacactgttctgttcggaaaggcagaagccgacgagatcttccaggagctcgaaaaagaagtggaatacttcaccggcgcactggctcgtgtacaagtgtttggtaaatggcactcagtgcctcgaaagcaggcaacatatggtgatgcaggcctgacctatacgttctctggtttaacactttctcccaagccatggattcccgtccttgagcgcattcgcgatcacgtttcgggggttactggccagacctttaacttcgttctgatcaataggtag

SEQ ID NO: 214093 - DNA, 861 bp, Artificial Sequence
  Description of Artificial Sequence: Synthetic coding sequence
atggaagaaaagcggagacgagccagggtccagggtgcctgggcagctcccgtcaaaagtcaggcgatcgcccagccagcgaccaccgcaaagagccatttgcaccagaaacccggtcagacatggaagaacaaagaacatcatttgagcgaccgggaattcgtcttcaaggagcctcagcaggtggtgcggagggctccggagccgagagtgattgatagggagggagtgtacgaaatttcattgagccctacgggggtatcacgcgtatgtttataccccggttttgtggatgtcaaagaggctgactggatcctcgagcaactctgccaggacgtgccctggaaacagcggacgggaatccgcgaagacatcacttaccagcagcctaggctcactgcttggtacggagaattaccatatacttattccagaattaccatggagccgaatccccattggcatcctgtcctccggactctgaagaataggattgaagagaatactggccataccttcaactctttactgtgcaacctgtaccgaaatgaaaaagattctgtagactggcacagtgatgacgaaccctccctcggacggtgccctataattgccagcctgtccttcggggcaacgcggacatttgaaatgcgtaagaagccaccaccagaagagaatggggattatacctatgtggaacgagtgaaaatccccttagatcacggcaccctgcttataatggaaggcgcaacccaggcggattggcagcaccgcgtgcccaaagagtaccattcacgcgaaccgagagttaatcttacattccgtaccgtgtatccagaccccagaggcgctccatggtag

SEQ ID NO: 214094 - DNA, 513 bp, Artificial Sequence
  Description of Artificial Sequence: Synthetic coding sequence
atggaagaaaagcggaggcgcgcaagagtgcagggagcatgggcagctcccgtcaagtcccaggctatagcccagcctgccactacggccaagtctcacttacaccagaagcctgggcagacctggaaaaataaggagcatcaccttagtgacagagagttcgtttttaaggagccgcagcaggtggtgcgccgagccccagagccaagggtgatagaagagggggtttacgagatcagcctgagcccgactggggtgtcaagagtttgtctctaccctgggtttgtggacgtaaaggaagccgattggatattggagcagctgtgtcaggatgtgccttggaagcaacggaccggcatcagggaggactcaatcctgcaattgacatttaagaaatccgccccagtctctggaactgctaccgcccctcagtcctgctggtacgaacgaccgtccccccctcacattcccggtccagcaatcttgactcgcaccagactgtgggcaccttag

SEQ ID NO: 214095 - DNA, 183 bp, Artificial Sequence
  Description of Artificial Sequence: Synthetic coding sequence
atggaggagaaacggagaagggctcgcgtacagggggcatgggcagctcccgtcaaatcccaggcgatcgctcaacctgcaaccacggccaagtcccacctgcatcagaagccaggccagacgtggaaaaacaaggaacatcacctgagcgatcgcgaatttgtcttcaaggagccacagtag

SEQ ID NO: 214096 - DNA, 909 bp, Artificial Sequence
  Description of Artificial Sequence: Synthetic coding sequence
atggccgctgccgcagccgaaacgccagaagtcctccgcgagtgcgggtgcaaagggatcaggacctgtttaatttgcgagcgccaaagaggctccgatccaccttgggagctgccccctgcaaaaacgtacaggttcatttactgctctgatacaggctgggccgtgggaacagaggagtcagatttcgaaggctgggcgttcccgttcccaggcgtcatgttgatcgaggactttgttacacgggaggaagaagccgagttggtacggctcatggaccgtgatccatggaagctgtcccaaagcggcagacggaagcaggattatggccctaaagtgaattttcgcaagcagaaactgaaaactgagggcttttgcggactgccttcctttagcagagaggtggtccggagaatggggctttaccccggactcgagggtttcagaccagtggaacagtgcaatctcgactattgccctgaacgagggtcagctattgatccccatttagatgacgcgtggctgtggggagagcggctcgtaagcctgaatttactgtcacctacagtccttagtatgtgtcgggaggctcccggtagtctcttgctgtgctctgcccctagtgctgctccagaagcattagtggattcagtgatagcgcctagccgaagcgtgttgtgccaggaggtggaggtcgccattcccctacccgctagaagtctgcttgtcctgacaggagccgctcgacaccaatggaaacacgccatacaccggagacacattgaagctaggagggtgtgcgtcacttttagagaactgagcgccgaattcggcccaggcggaagacagcaggagctggggcaggagcttcttaggatagcactttcctttcagggcaggccggtgtag

SEQ ID NO: 214097 - DNA, 1377 bp, Artificial Sequence
  Description of Artificial Sequence: Synthetic coding sequence
atggcagccgcttccggatatactgatcttagggaaaaactgaagtccatgacttctagagataattacaaagctggcagccgagaagctgctgcagcggctgccgcagccgtggcagctgctgccgctgcagcggctgcagccgagccttacccagtttccggggctaaacggaaataccaagaagacagcgatccagagcggagcgactacgaggagcagcagctgcagaaggaggaagaagccagaaaagtgaaatcagggatccggcagatgcgactcttctcccaggacgagtgcgctaagattgaggctcgaatcgacgaagtagtctctagggctgaaaagggactgtacaacgaacatacagtggatagagcacccttaagaaacaagtacttcttcggggaaggttatacctacggcgcacaactgcagaagcgcggacccggtcaggagcgactctaccccccaggcgacgtggatgagattccagagtgggttcaccagcttgtgattcagaagctggtggagcatagagtgatccccgaggggttcgtgaatagcgccgtgatcaacgactatcagccaggtggatgtatcgtgagccacgtcgaccccattcatatattcgagaggccaatcgtgtccgtaagtttcttttcagactccgctctgtgcttcggctgcaagtttcaatttaaaccgatccgcgtgagcgagcctgtcttatcgctacccgtgcgacgcggatctgttaccgtgctgtctgggtatgcggctgacgaaatcacccactgcatccgcccacaggacattaaggagagaagggcagtgatcattctgcgcaaaacccgtctggatgccccacggctggaaaccaaatcgttgagtagtagtgtgttgcctccatcgtatgcgtctgatcgcctgagcggaaataacagggatccagctctgaagccaaagcgctcccataggaaagcggaccccgacgctgcacataggccacgcattctcgaaatggataaggaagagaaccggagatccgttctgctgcctacacaccgaaggcgtgggagtttcagtagtgagaactattggcgcaagtcatatgaaagctctgaagattgttcagaagcagcgggatctccgggaaactctggctctagcttgagaagctgtcctagtttctgtttcgaaggatttgtgttcgtgcactggggggtgtttgtgttctgcttcttgttttttctgatactttacatctttccctggttctgctgccttttgggcttgaagaataggataggtcaggatctcggcagccatatcctaggtattccacctggatggaaagggtgttggcaccaatag

SEQ ID NO: 214098 - DNA, 1185 bp, Artificial Sequence
  Description of Artificial Sequence: Synthetic coding sequence
atggccgcagcttcgggctatacggacctccgggaaaagctcaagtccatgacatcacgagataattataaagccggaagcagggaagcggcagctgccgctgccgcagcagttgccgctgccgctgcagcagcggcagctgcagaaccctacccggtgagtggcgctaagcgcaagtaccaggaggactctgaccccgagaggagcgactatgaggagcagcagctccagaaggaagaggaggctcgaaaggttaaatcaggtattagacagatgcgtttgttctcgcaggatgaatgcgccaagattgaggccagaattgacgaggtggtgagccgggctgaaaaaggcctgtataacgagcatacagtcgaccgggcacctttgaggaataaatatttcttcggagaagggtacacttacggggcacagctacagaagcgagggccaggacaggagagactttaccccccaggtgacgtggatgagatccctgaatgggtccatcaattagttatccagaaactggtcgaacaccgggtgatcccagagggctttgtaaacagcgccgtcatcaatgactatcagccagggggatgtatcgtctcacatgtagacccgatccacatctttgaaagaccaatagtgtccgttagtttctttagcgactccgcactatgttttggctgcaagttccagtttaaaccaattcgcgtgtccgagccagtactgagcctgccggtgaggaggggtagcgtgactgttctgtcgggttacgcagccgatgaaatcacccactgtatacgacctcaggatattaaggaacgccgtgccgtgataattttacgcaagactcggctcgacgcaccaagactggaaactaagagcctgtccagttctgtgctgcccccatcctatgcttcagacagattaagcgggaataatcgggaccccgctctcaaacctaaacggtcgcaccgaaaggcagatcccgatgctgcccatcggccacggatcctcgaaatggataaggaggagaataggcggtcagttctgcttcctacccatcgcagaagagggtcttttagttccgagaactattggcgcaagtcatatgagagctcagaggattgtagcgaggcggctggttcgcccgctcgcaaagtcaaaatgagacgacactag

SEQ ID NO: 214099 - DNA, 1152 bp, Artificial Sequence
  Description of Artificial Sequence: Synthetic coding sequence
atgcgacgctgtcggagaccgtgccccgcaggcagaggggagggtggtggcggacgctcccccgcagccgctgctgcagtagcggctgccgcagcagctgcagcggcagcagaaccataccccgtgtccggggcaaagcgtaagtaccaagaagatagcgatcctgaaagatccgactatgaagaacaacaactgcaaaaagaggaggaagctcggaaggtcaagtccggcatcagacaaatgcgcctcttttcccaagacgagtgcgcgaagatcgaggcacggattgacgaggtggtgtcgcgcgctgagaagggcctctataacgagcatacagttgaccgtgctcctctgcgcaacaaatacttctttggcgaaggctatacctacggggctcagcttcaaaagcgtgggccaggtcaagagaggctgtaccctcctggtgatgtggacgagattcccgagtgggttcatcagctggtaattcagaagctggtggaacacagagtaatccccgagggattcgtaaactctgcagtgatcaatgattatcagccagggggatgtatcgtgagccacgtagatcccattcacatctttgagcgtcctattgtttctgtctccttcttctccgactcagccctttgctttggctgcaagtttcagtttaagccaatccgtgtctctgagccagtgttaagcttacccgtacggagaggatcagtgaccgtgctatccggctacgcagctgacgaaatcacccactgcattcggcctcaagacatcaaagagcgaagggcagttatcattctgcgcaaaacgcggttggacgccccacgcctcgaaacgaaatcattgtcaagctcagtccttccaccctcatacgcctccgatagattaagcggaaataatagggaccccgctctgaagcccaaacggtctcatcggaaagctgacccagacgccgctcatcgccctcggatcttagagatggacaaagaggagaacagaaggtcagtcctgctcccaacccaccggaggcggggaagtttttcctccgagaattattggcggaaatcttatgaatcgtccgaggattgcagtgaagctgctggatcaccggcacgaaaggtgaagatgagaagacactag

SEQ ID NO: 214100 - DNA, 717 bp, Artificial Sequence
  Description of Artificial Sequence: Synthetic coding sequence
atggaggagcaggatgccagggtgcccgcattggaacctttccgagtagaacaggcacctcctgtgatctactatgtgcccgactttattagcaaagaggaagaggagtacctcttgcgacaggtgtttaatgcacccaagcctaagtggacccaactttctggcaggaaactgcagaactggggagggctgccacatcctagggggatggtccctgagcgacttcccccttggctccaacgatatgttgataaggtttcaaatctgagtctgtttggaggattgccagcaaaccatgtgctggtgaatcagtacctacctggggagggcatcatgccgcatgaagatggacccttatactatcctacagtttctacaattagtttggggtctcacaccgttctggatttttacgagccccgtcggccagaagatgatgaccctaccgagcagccgagacccccacctcggcctacaacctcacttctccttgaaccccgttctctcttggttctgcgaggcccagcttacacaagactgttgcacgggatcgcagcggcacgggtggacgcactcgatgccgcttcttcccctccaaacgcggctgcctgccctagcgctagaccaggagcatgccttgtgagggggacacgcgtctccctgaccatacggcgagtcccacgcgttctgagagccggtctgctgctggggaagtag

SEQ ID NO: 214101 - DNA, 801 bp, Artificial Sequence
  Description of Artificial Sequence: Synthetic coding sequence
atggccggaagagggatgggaatgctaaacttggagattggaggcgatgcaggagggaggattggctgcaaagaactcgtgctgatggaggagcaggatgctcgagtgcctgccctggagccattccgggttgagcaagcccctccagttatctactacgtccccgactttatcagcaaggaggaggaagagtatttgttgcgacaggtctttaacgctccaaagcccaagtggactcaactcagcggtagaaagctgcaaaactgggggggtctcccacacccacgaggaatggtgccagaacgacttcctccatggctccagcgctatgtggataaagtgagtaacttatcgctgtttggcggtctgccggctaaccatgtcctcgtgaatcaatatctgcctggtgaggggatcatgcctcacgaagacggccctctttactaccccaccgtgtcaacaatatcactgggttcacatacagtgctcgatttctatgaacccagaaggcccgaagatgacgatccgacagagcagcctagacctcctccaagacccactactagcttactacttgagccgaggtcgctcctcgtactgcggggtcccgcatatacaagactgctgcatgggattgcagctgccagagtggatgccctagatgcagcgagctctcccccaaacgccgcagcttgtccatctgctcgccctggggcttgtctggtccgcggaacgcgagtgtccctgacaataagaagggtaccccgtgtcctacgagccggacttctgttggggaagtag

SEQ ID NO: 214102 - DNA, 717 bp, Artificial Sequence
  Description of Artificial Sequence: Synthetic coding sequence
atggaagaacaggatgctagagtgcccgcactggaaccctttcgtgtggaacaggccccacctgtgatatattacgtgcccgatttcatctcgaaagaggaagaagaatatttgcttcggcaagtctttaacgccccaaagccaaaatggacgcagcttagcgggagaaaattgcagaactggggagggctccctcaccccagaggtatggtgcctgagagacttcccccttggcttcagcgatatgtagataaggtttcaaacttgtcacttttcgggggattacctgctaaccatgtgctcgtaaatcagtacctgcccggagagggtatcatgccacatgaagatggtcctctatattacccaactgtatccacaatctccctgggcagccacacggttctggacttctatgaacctcgcaggcctgaagacgacgaccccacggagcagcctcgacctcccccaagaccgacaacaagcctgctcctggaacctagatccctcttggtgttgagaggtccagcctacaccagattgttgcacgggattgctgccgctcgggtggacgctctggatgccgcttctagcccccctaacgccgctgcgtgccctagcgccaggccaggcgcttgtcttgtgcgcggtactcgcgtatctctcacgatccgaagagtacctagagttcttagggctggcctgttgctcggaaagtag

SEQ ID NO: 214103 - DNA, 666 bp, Artificial Sequence
  Description of Artificial Sequence: Synthetic coding sequence
atggctggcactggattgctcgcactgcgcactctgccaggtccatcttgggtgagagggagcggaccgtctgtattgtctcgtcttcaggacgctgccgtggttcgcccaggcttcctgtcgaccgccgaagaggaaaccttatcgcgcgaacttgaacctgagctccgcagacgaagatatgaatatgaccattgggacgccgcaatacatggctttagggaaacggaaaagtcccggtggagtgaggcctccagggctatactccagagagtgcaggctgccgctttcggccctggacagaccttgctctctagcgtgcatgtcctggatctagaggcaaggggatacataaaaccccacgtggatagtatcaaattctgcggagctaccatagcaggactgagtctgctctcacccagtgtgatgcgccttgtgcatacgcaggaacccggagagtggctggaattgctgttagaacctggctctttatatattctacgaggtagcgccaggtacgacttctcccacgaaatcctcagagacgaggagtccttctttggggagcgcaggattcccaggggccgtcgtatctcggtgatctgtaggagtctccctgaaggcatgggaccaggggaaagcggccagccgcctcctgcatgctag

SEQ ID NO: 214104 - DNA, 1995 bp, Artificial Sequence
  Description of Artificial Sequence: Synthetic coding sequence
atggatagcaatcatcagagcaattataagctgtcgaaaacggaaaagaagttcctgagaaagcagatcaaggccaagcacaccctgctgagacacgaggggattgaaacagtgtcttatgcgactcagagcttagtggtggctaacggtggcttaggcaatggggtgagcaggaatcagctgctgcccgtgctcgagaaatgcggcctcgtggatgcactcttgatgccacccaataaaccttactctttcgcacggtaccgaacaactgaagaatcaaaacgcgcatacgtcacactgaatggcaaagaggtcgttgatgatttgggacagaagataactttgtacctgaattttgtggaaaaagtgcagtggaaagagttacgaccacaggcactgccgccaggtctgatggtggtggaggagatcatctcatccgaggaagagaaaatgctcctcgaatccgtggattggacagaagatactgataaccagaacagccagaagagcctgaagcaccgcagggtgaaacattttggctatgagtttcattatgagaataataacgtggataaagacaagccactttccggaggcctgcctgacatctgtgaatcatttctggagaagtggctgcgcaaaggttatattaaacacaagcctgatcagatgaccattaatcagtacgagcctggccagggcatccctgctcatatagatacacacagtgcattcgaggacgagattgtgagcctgtcactgggatccgaaattgtcatggatttcaaacatcccgatggcattgctgttcctgtcatgctccccagacggtctctactggttatgacaggcgagagtcggtatctgtggacgcacggaatcacttgtcgaaagttcgatacagtacaagccagcgagagcttgaagtcaggcataattacaagcgacgttggcgacctcacactgtccaaaaggggactgagaacctcatttaccttccggaaagtaagacagactccttgcaactgctcttatccactggtctgtgattcccagcggaaggaaacaccacctagtttccctgagtccgataaagaggctagccggctcgagcaggagtatgtccatcaggtgtatgaagagatcgcgggtcatttttcctctacacgtcatacaccatggcctcatattgtggagttcctcaaggcactcccgtccggatctatagtggcagatataggttgcggcaatggcaagtacctgggcatcaataaggaactgtacatgattggttgtgacagatcccagaacctggtggacatttgtagagagaggcagttccaagccttcgtctgtgatgcattggctgtcccagtgcgcagcggttcctgtgacgcatgcatctcgatcgcggtgatccatcacttcgccacggctgaacgccgagttgcggctttgcaagagattgtaagactactgcgtcccggaggcaaggctctgatctacgtgtgggcaatggaacaggaatataacaaacagaagtccaaatacctccgaggaaatcgaaacagccaaggtaagaaagaagaaatgaacagcgacacctctgtgcaaagatccctcgtagagcaaatgagagatatgggtagtcgggactccgctagctccgtccctcggatcaatgactctcaggaggggggatgcaacagtcgacaggtcagcaactcaaaactgcccgtgcatgtgaatcggacttccttttatagtcaggatgttctggtcccttggcacctcaaggggaacccagacaagggaaagcccgttgagccattcggtcccattggatcccaagatcctagcccggttttccaccggtattatcatgtcttccgggagggtgaactggagggagcttgtagaaccgtctccgatgtccgtatcctgcagagttattacgaccaggggaactggtgtgtgatcctgcaaaaggcttag

SEQ ID NO: 214105 - DNA, 2004 bp, Artificial Sequence
  Description of Artificial Sequence: Synthetic coding sequence
atgtttgccatggattccaaccatcagagcaactacaagctaagcaagacagaaaaaaagtttctgaggaagcagattaaagccaagcacacattgctaaggcacgaagggatcgagaccgtctcctatgcgacgcaatccctcgttgtcgctaacggcggactcggtaatggagtttcgcgcaaccaactgctacccgttctggagaagtgcggcttggtagacgcgctgctaatgccaccgaacaagccctactccttcgcacggtaccgaacaaccgaggaaagcaagcgagcatacgtcactctgaatggcaaagaggtggtggatgacttaggacagaaaatcacactgtatctgaactttgtcgagaaggttcagtggaaagaacttcgtccccaggcgctccctcctggactcatggtggttgaggagatcatttcctcagaagaagaaaagatgctgctggaatctgtggattggacggaagacaccgacaaccagaatagccagaagtcgttgaaacaccgcagagtcaaacatttcggttacgaattccactatgagaataataatgtcgataaggacaagccactctctgggggtcttccagacatatgcgagtcctttctggagaagtggctcaggaagggatacattaagcacaagcccgaccagatgactatcaatcaatacgaacctgggcaagggatccccgctcacattgatactcattcagcattcgaggacgagattgtatctctctctctcgggtccgaaattgtgatggattttaagcacccagacggaatcgccgttccagtgatgttgccacggagaagcttgctggttatgacaggagagtctcggtacctgtggacccacggtatcacctgccggaagttcgacaccgtgcaggcctcggagtctttaaagtcaggaatcatcacaagtgacgtaggggacctcaccctttccaaacgcggactccggacaagtttcacctttaggaaagtccgacagaccccttgtaattgcagctatcccctggtgtgtgactcacagagaaaagagactcctcccagttttcctgaatccgataaggaggcctctcggctggaacaggagtacgtgcaccaggtgtacgaagaaatcgcaggtcatttcagcagcacacggcacacaccttggcctcacattgtcgaatttctgaaggcgctcccttcaggctcaatcgtcgcagacattggatgcgggaacggcaagtacctgggcataaataaagaattgtacatgattggctgtgatcggagtcaaaatctggtggacatttgcagagagaggcagttccaagctttcgtgtgcgacgctctcgcggtccctgtgagatccggctcgtgtgacgcatgcatttccattgccgtgattcatcactttgcaacggccgaacggagggtggcggctctgcaggagatcgttcgcctcctgagaccaggcggaaaagccctgatttatgtgtgggccatggagcaggagtacaacaaacaaaagtcaaagtatctgagaggtaaccgaaattctcagggaaagaaggaggaaatgaattccgacactagcgtgcagcgctctctcgtggagcagatgcgggacatgggatcaagggattcagcctccagcgttccaaggatcaatgacagccaggaagggggttgcaattcccggcaggtgtctaattcaaaacttcccgttcatgttaaccgcaccagcttctatagccaggacgtgcttgtgccctggcacctgaaagggaatcccgataagggaaaaccggtcgaacccttcggcccaataggctctcaagacccctcgcccgtgtttcataggtattaccacgtgttccgagagggtgaattagagggggcttgccgcaccgtgtcagacgttagaatactgcaatcgtactacgatcagggcaactggtgcgtcatacttcagaaggcatag

SEQ ID NO: 214106 - DNA, 1995 bp, Artificial Sequence
  Description of Artificial Sequence: Synthetic coding sequence
atggactctaatcatcaaagtaactacaagctgagcaaaacagaaaagaagttcctaagaaaacagatcaaggccaagcataccctcttgcgtcatgagggtatcgagaccgtctcatacgctactcaaagcctggtggtcgccaacgggggactgggcaacggcgtttcacgtaatcaactgctaccagttctggaaaaatgcggcctcgttgacgctttgctgatgccacctaacaaaccctattccttcgctagatatcgtacaacagaggagtccaaacgggcttatgtcacgctgaatggtaaagaagtggttgatgatctgggtcagaaaattactctgtacctgaattttgtcgaaaaagtccagtggaaggaactcagacctcaggcccttccccctggactgatggttgtggaagaaattatcagctccgaagaggaaaaaatgctgctggaatcagtagactggaccgaggatacagataaccagaactcgcagaagtcactgaagcaccgcagagtaaaacacttcgggtacgaatttcactatgaaaacaataacgtagacaaagacaaaccgttgagcggtggactgccagatatttgcgagtcttttctggaaaagtggctgcggaaggggtatattaaacacaagccggaccagatgacaattaaccagtatgagccagggcagggcattcccgctcatatcgatacccatagcgctttcgaagacgaaatagtttccctgtctcttgggagcgagattgtcatggactttaaacatccagacggtattgcagtcccagtaatgctgccaagacgctcactgctcgttatgactggggagagtagatacctgtggactcatggtatcacatgcaggaaattcgacacagtgcaggcgtccgagtcactgaaatccgggatcattaccagcgatgtcggtgatcttaccctgagtaagcgaggactgcggacctctttcacttttcgaaaagtgagacagaccccgtgcaattgttcgtaccctctcgtctgcgattcccagcgaaaggaaacccctccctcatttcctgaaagcgacaaggaggcgagtaggttggagcaagaatacgtccaccaggtgtatgaggagatagcaggtcacttttctagcacccggcacacgccctggcctcacattgttgaattcctgaaagccctgccatctgggagtatcgtggccgatattggctgtggcaatggcaaatacctgggtatcaataaggaactgtacatgatcggctgcgatcgcagccaaaatctggtggatatttgtagggaaaggcagtttcaggcttttgtgtgcgatgctctggcagtgcctgtcaggtccggatcttgcgatgcttgtatttcgatcgctgtgattcaccattttgctacagctgagcggagggtagcagctctgcaagaaatcgttaggctactccggcctgggggaaaggcactgatttacgtatgggctatggagcaagagtataataaacaaaaaagcaaatacctccggggtaatcgcaactctcagggcaaaaaagaggagatgaattcagacaccagtgtgcaacggagcctggtggaacaaatgagggacatggggagccgggattcagcttcttccgtccctagaatcaacgactctcaggagggaggctgtaatagtagacaggtatcaaactccaaactacctgtacatgttaatagaacgtcattctattcccaggatgtgttggtcccttggcaccttaaaggcaatcccgacaaaggaaaaccagtcgaacctttcggccctatcggctcacaggatccaagtcctgtcttccataggtattaccacgtctttcgggaaggcgagctggagggcgcttgtaggaccgttagtgatgtgagaattctgcagagctactacgaccagggtaactggtgtgtgattctccaaaaggcctag

SEQ ID NO: 214107 - DNA, 675 bp, Artificial Sequence
  Description of Artificial Sequence: Synthetic coding sequence
atggatagcaatcatcaatctaactacaaactgagcaagacggagaagaaatttctgcgaaagcagattaaggccaaacatactctccttcggcacgagggcatcgaaactgtgagctatgcaactcagtccctggtggtcgccaatgggggacttggcaacggggtaagcagaaatcagctccttcccgtgctggagaagtgcgggctggtggatgctttacttatgcctcctaacaagccttattcgtttgccaggtaccgcactactgaggaatctaaacgggcatacgttacccttaatggcaaagaagtggtggacgatctgggacaaaaaatcaccctgtatctgaattttgtggaaaaggtccagtggaaggagttacgccctcaggccctgcctcccggactgatggtcgtggaagagattatttccagtgaggaagaaaagatgctgctggagagtgtcgattggacggaagacaccgataaccaaaactcacaaaagtcactgaaacatagacgcgtgaagcacttcggttatgagtttcattacgaaaacaacaacgttgataaggacaagccgctgtccgggggtttgcccgacatttgcgagtctttcttggaaaagtggctcaggaaggccgagaaaaacctcgaggtaggcattcactag

SEQ ID NO: 214108 - DNA, 1338 bp, Artificial Sequence
  Description of Artificial Sequence: Synthetic coding sequence
atgaaaaatccagaggcccagcaggatgtttctgtgagccaaggattccgcatgctcttttacactatgaaaccttccgagacaagttttcagaccctggaggaggtcccagactacgtcaagaaagctacccctttttttatatcacttatgctgctggaactcgttgtgagctggattctgaagggaaagcccccaggccgtctagacgacgctcttacttcaattagcgccggagttctgtccagactgcctagcctctttttccggtcgatcgagctgacttcttatatttatatttgggaaaactataggctgttcaaccttccctgggatagtccgtggacctggtattcagctttcctgggggtagactttgggtattactggttccatcgcatggcccatgaggtgaacattatgtgggccggacaccaaactcaccactcctctgaagactacaatttatcaactgcactacgtcagagtgtcctgcaaatatatacttcatggatcttctatagcccactcgctttgttcattcctcccagcgtctacgccgttcatctgcagtttaacctgctgtatcagttttggatccacactgaggtgattaacaatctaggcccactggagctgatacttaacacaccatctcatcatcgagtccaccacgggagaaaccgctactgtatagacaaaaactatgcaggagtgctgatcatttgggataaaatctttggcacctttgaggcggaaaacgaaaaggtggtttacggattgacgcaccctattaacacatttgagccaatcaaggtccaattccatcatctgtttagtatatggaccacattctgggctacacctgggttctttaacaagttcagcgtaatttttaaagggccaggatggggtcccggaaagccaaggctgggcttgagcgaggaaattccagaggtcacagggaaggaggtgcctttctcctcctcttccagccagctgctgaagatttacaccgtggttcagttcgctctaatgttggccttttatgaagaaacattcgctgatacagccgctctgtcacaggtgacactgctgctgagagtatgttttattattttgactctgacaagtatcggttttctgctggatcagcgtccaaaggctgcaattatggaaacccttaggtgcctgatgtttttgatgctctacagattcggtcacttgaaacccctggtgccgagcctgtcgagtgccttcgaaatcgtcttctccatctgcattgcattctggggcgtccgctccatgaagcagttgactagccatccctggaagtag

SEQ ID NO: 214109 - DNA, 1977 bp, Artificial Sequence
  Description of Artificial Sequence: Synthetic coding sequence
atggcagaagcggctgctgcagccggtgggaccgggttaggagcaggtgcctcatacggttcagccgcagatagagatcgcgacccagacccagaccgggctggcagacgcttacgcgtcctgtcaggtcacctgctgggcagacccagggaagccctcagcaccaatgaatgcaaggcacgccgagccgcttctgctgctacagccgctcctacagctacccccgcagcacaggagtctggcactatcccaaagaagcggcaggaagtgatgaagtggaacgggtggggctataacgacagcaagtttatctttaataagaaaggacagatagaactcaccggaaagaggtatcccctgagcggcatggggttgcccacgttcaaggagtggatccagaacaccctgggagttaatgtggaacataagaccacctccaaggcatccttgaacccgagcgacactccgcctagcgtggtgaatgaggattttctgcatgacctgaaagagaccaatatctcttacagccaggaggcagatgacagagtctttcgcgctcatggacactgcctgcatgaaatatttctgttaagagaaggcatgttcgaacgtatccctgatattgtactgtggccgacatgccacgacgacgtggttaaaattgtcaacttagcatgcaaatacaatctgtgtatcatcccgatcgggggaggaacaagtgtaagctatggcttgatgtgtcctgcggatgaaacaaggactatcattagcctggatacaagtcagatgaacaggattctgtgggtagacgagaacaacttgacagctcatgttgaggcgggtatcaccggccaggaattggagagacagctgaaggaatcgggctattgcactggtcacgagccagactctctggaattctccaccgtaggaggctgggtctccacccgagccagcggcatgaagaaaaatatctatggtaacattgaagatttggttgttcatatcaaaatggtaacgccccgaggtattatcgaaaaaagctgtcaggggccacgcatgtcaacaggacctgatatccaccactttattatgggcagcgagggcacgctgggggtcatcaccgaggccaccatcaagattcgtcctgtacccgagtaccagaaatacgggagcgtcgcgtttcctaacttcgagcagggggtggcctgccttagggagattgcaaagcagcggtgcgcccctgcatctatccggttgatggacaataaacagtttcaattcggccacgcacttaagcctcaggtatccagtatcttcacttctttcctagatgggcttaagaagttttacatcaccaagttcaaaggcttcgaccccaatcagttgagtgtggccaccttgttattcgagggggaccgtgagaaggtgctgcagcacgaaaagcaggtatatgatatagcagccaagtttggcggactggctgccggtgaggacaacggacagcgaggatacttgttgacctacgtgatcgcctatatcagggacctggctctcgaatactacgtgctcggtgagtcattcgagacttccgccccttgggatagagttgtggacctctgtcggaatgtgaaggagcgcattaccagggaatgtaaggaaaagggcgtccagtttgcaccattcagcacttgtagagtgacacagacatacgatgcaggtgcctgcatttatttctatttcgcctttaattataggggaatctcagatccgctcacggtttttgagcaaaccgaggctgccgctagggaggaaatcttagcaaacggcggatccctatcgcatcaccacggtgtgggtaagttgcgcaagcagtggcttaaggagtctatcagtgacgtgggattcgggatgctgaaaagcgttaaagagtacgtggacccaaataacatctttggcaaccgaaatctcctgtag

SEQ ID NO: 214110 - DNA, 966 bp, Artificial Sequence
  Description of Artificial Sequence: Synthetic coding sequence
atggatcccaagtatccttggtccaaatgtgggcacaaaactacctctaaggcgagtttaaatcccagcgacaccccacctagcgtggttaatgaagatttcctgcatgatctgaaggagacaaatatctcatactctcaagaggctgatgatagagtcttcagggcccacggccactgtcttcacgagatatttttattgagagaggggatgttcgagcgcatccccgatatcgtcttgtggccaacctgtcatgatgatgttgtgaagatagtaaacctggcatgcaaatacaacctgtgtataatcccaatagggggaggaacaagtgtctcctatgggctgatgtgtcctgctgatgagacgcggacaataatcagccttgacacttcccagatgaataggatcctgtgggttgacgaaaataacttgacggcccatgtggaagccggaataaccgggcaggagctcgagaggcagctgaaagagtcaggatattgcactggccatgagcccgattcactggagttctctaccgtcggcggttgggtgtcaaccagggcaagcggcatgaagaagaacatctacggcaacatcgaggatctagtggtgcacattaagatggtaactcctaggggcatcattgaaaagtcatgccagggtcctagaatgtcaactggtcctgacattcaccactttattatgggttcggaaggcactctgggtgtgatcactgaagccaccataaagatcagacccgtgccagagtaccagaaatacggatctgtcgctttccctaacttcgagcagggggtcgcatgtcttcgtgaaatcgccaagcaaaggtgcgcgcctgcaagcatacgtctgatggataacaagcaattccaatttggccacgctttgaagccgcaggtatcctcaatcttcaccagcttccttgacgggcttaagaaattctactag

SEQ ID NO: 214111 - DNA, 1176 bp, Artificial Sequence
  Description of Artificial Sequence: Synthetic coding sequence
atggatatggcctcagagtctgtaggcggaaagattctgttcgccactgacgatttctttgctcctgccgaaaacctcatcaagtcagatagcccttgtttcaaggaacatgagtatacagagttcggcaagtggatggacgggtgggagactcggagaaagcgaatcccaggacatgactggtgcgtgttgcggttgggtattcagggggtcattagggggtttgacgtcgatgtgtcttatttcaccggggattacgcaccgagagtgtcaatccaggctgcaaacctcgaagaggacaagctgccagagatcccggagcggggtacacgcactggagcagctgcaaccccagaggagttcgaggcgatcgcagagctgaagtcagatgactggtcctacttagtgcccatgacagaactaaagcctgggaatcccgctagcggacataattacttcctcgtgaattcccaacagagatggactcacatccggctgaacatctttccggacggcggaatcgctcgacttagggtctttggtacaggacagaaggattggacagctacagatccgaaggagcctgctgatttggtggcaatagcctttggaggggtgtgcgtcggcttctccaacgccaagttcgggcaccctaacaatataatcggggtgggcggtgccaagtctatggccgatggctgggagaccgcccgaagacttgatagaccaccaatcttagaaaatgatgaaaatggaatcttgttggtgcccggttgcgagtgggccgtttttcgcctcgctcaccccggtgtgatcactagaatcgagatcgacactaagtattttgagggaaacgcgccagacagctgcaaagtggatggctgcatcctcacaacacaggaagaggaggccgtgattaggcagaagtggatcctgccagcccacaaatggaaacccctcctcccagtgacaaaactttccccgaaccaatcccacctgttcgattctctgaccctagaacttcaggatgttataacccacgctcgtctgaccattgttccagatggtggggtgagtaggttacggttgagaggtttcccaagctcaatttgtctcctccgaccaagagaaaagccaatgttgaagttttcggtgagcttcaaggcaaatccatag

SEQ ID NO: 214112 - DNA, 486 bp, Artificial Sequence
  Description of Artificial Sequence: Synthetic coding sequence
ggaaggaaggcctccgagaaaacaggaggcagggagggggagcctgccgaccggggattgcagctgggaggtaaggcctttgggctactgaaagcccagcaggaggagcgattggatgaaatcaacaagcaattcctagatgaccctaagtactctagtgatgaagatctgcccagcaagctggaaggtttcaaggagaagtatatggaattcgatctgaatgggaacggtgatattgatatcatgagcctcaaaagaatgctcgagaagctgggggtgcccaagacccacctcgagctcaaaaagctaattggcgaggtctcgagcggctcaggcgagactttttcatacccggattttctgaggatgatgttgggcaagagatccgctattcttaagatgattctaatgtacgaggagaaagcaagagaaaaagagaagccaacaggacctcctgctaaaaaggctatatctgagctaccctag

SEQ ID NO: 214113 - DNA, 282 bp, Artificial Sequence
  Description of Artificial Sequence: Synthetic coding sequence
atggagttcgaccttaacgggaacggcgacatcgacatcatgtccttgaagaggatgcttgagaaactgggagtccctaaaacccacctggagctcaaaaagctcatcggtgaggtgtcttcggggtctggagagacattctcctacccagactttctgaggatgatgctgggaaagagaagtgccatccttaagatgatcctgatgtacgaggaaaaggccagagaaaaagaaaagcccaccgggcctccagccaagaaggccattagcgaattaccctag

SEQ ID NO: 214114 - DNA, 444 bp, Artificial Sequence
  Description of Artificial Sequence: Synthetic coding sequence
atgagccaaacacgcgaccttcagggaggcaaggccttcggcctgctgaaggctcagcaggaggagcgcctcgacgagatcaataagcagttccttgatgacccaaagtattccagcgatgaggatcttcccagcaagctggagggatttaaggagaagtatatggagttcgatctaaatggcaacggagatattgacatcatgtcccttaaacgcatgctggagaagctgggtgtgcctaaaacccacctggaactcaagaaactgatcggcgaggtttcctcggggagcggtgaaaccttctcctaccctgatttcctgcgcatgatgcttggcaagcgtagtgcgatcctcaaaatgatccttatgtacgaggaaaaggccagagagaaagaaaagcccaccggaccacctgccaagaaagctatcagcgagttaccatag

SEQ ID NO: 214115 - DNA, 282 bp, Artificial Sequence
  Description of Artificial Sequence: Synthetic coding sequence
atggagttcgacctcaacggcaacggcgacatcgacattatgagcttaaagcgcatgctcgagaagctaggcgtgcccaaaacgcacttggaactcaagaagctgatcggcgaggtgagtagcggctctggcgagacattttcttacccagactttcttcggatgatgctgggaaaaaggtcagccattcttaagatgattctaatgtatgaggaaaaagccagggagaaggaaaagccgacggggcctcccgctaagaaggcaatctcagagctcccttag

SEQ ID NO: 214116 - DNA, 444 bp, Artificial Sequence
  Description of Artificial Sequence: Synthetic coding sequence
atgtcacagactcgagacctgcaagggggaaaagcattcggactgctaaaagcccagcaagaagaacgtctggacgaaatcaacaagcagttcctggatgaccccaaatacagcagtgacgaggacttaccatccaagctggagggcttcaaggaaaaatacatggagttcgatctgaacggtaacggcgatattgacatcatgtccctcaagcgcatgttggagaagctgggggtgccgaagacacaccttgagcttaaaaaactgattggcgaggtgtctagcggttcaggggagactttctcctatccagattttcttcgaatgatgctggggaaacggagcgctattctcaaaatgattctgatgtacgaagaaaaggcacgcgaaaaggagaagccaaccggcccacccgcaaagaaagcaatctccgaactgccatag

SEQ ID NO: 214117 - DNA, 486 bp, Artificial Sequence
  Description of Artificial Sequence: Synthetic coding sequence
ggacgaaaagcgagcgagaagacaggtggaagggagggcgagccggctgaccgcggactgcagctcggcggaaaggcgttcggtctgctgaaagcacaacaagaagaacgccttgatgaaataaacaagcaattcctcgatgatcccaagtattcgagcgatgaagacctgccttcaaaactggaggggttcaaggagaaatatatggagtttgacctaaacggaaatggcgacatcgatattatgtcacttaagagaatgctggaaaaactcggggttccgaagactcacctcgaactgaagaaactgataggggaagtgtcctcaggctctggggagacgttttcgtacccggatttcctgaggatgatgctaggaaaacgaagtgccatcctgaagatgatactaatgtatgaggagaaagccagggagaaagagaagcccacaggccctcctgccaagaaggcaatctcagaactcccttag

SEQ ID NO: 214118 - DNA, 444 bp, Artificial Sequence
  Description of Artificial Sequence: Synthetic coding sequence
atgtcccaaactagggatttgcagggcggaaaggcttttggcttactgaaagcccaacaggaggaacgtctggatgaaataaataagcagtttctcgatgatcctaaatatagcagtgacgaagacctgccctccaagcttgaaggttttaaggaaaagtacatggaattcgacctgaatggcaatggcgatattgacattatgtcactcaaaagaatgctggaaaagctgggtgtgcctaaaacacacttggaactgaaaaagctgataggagaagtgtcgtctgggtcaggcgaaactttctcataccccgattttctacgcatgatgcttggaaaacgatctgccattttgaagatgattctaatgtacgaggagaaagcaagggagaaggaaaaacccactgggccaccggctaaaaaggccatctccgagctgccttag

SEQ ID NO: 214119 - DNA, 444 bp, Artificial Sequence
  Description of Artificial Sequence: Synthetic coding sequence
atgtctcagacgcgcgacttacagggaggcaaagcttttgggctgctgaaggcccaacaagaagagaggttggacgagatcaataagcagttcctggatgaccctaaatacagtagtgacgaggatttgccctcgaaactcgagggcttcaaggaaaagtacatggaatttgacctcaacggaaacggagacattgatattatgagcctcaagcgtatgttggagaagctgggcgtgcccaagacacatctagagctgaagaagctgattggcgaagtgagctccgggagcggcgagacgttctcataccctgactttctgcgtatgatgctcggaaagaggagcgcaattctgaagatgatcctaatgtatgaggaaaaagccagggagaaggagaagcccacgggacctccagctaaaaaagctatctcagagctgccctag

SEQ ID NO: 214120 - DNA, 282 bp, Artificial Sequence
  Description of Artificial Sequence: Synthetic coding sequence
atggaattcgatttgaatggcaacggagacattgatataatgagcttaaaacggatgctagagaagctgggcgtgccgaaaacacatctagagctcaagaagctcattggcgaggtgtcatctggctcgggggagaccttcagctaccccgatttcttgagaatgatgctgggaaaaagatccgcaatccttaaaatgatcctgatgtatgaggaaaaagctcgcgaaaaggaaaaacccaccggaccccctgccaagaaggcgatttcagaactaccttag

SEQ ID NO: 214121 - DNA, 282 bp, Artificial Sequence
  Description of Artificial Sequence: Synthetic coding sequence
atggagttcgacctgaacggtaacggagacatcgatataatgtccttgaagagaatgctagaaaaactgggtgtcccgaagacccatctagagcttaaaaaactcataggcgaggtctccagcggctccggggagacgttttcatatcccgattttctgcgaatgatgctggggaaaaggagtgcaatcctcaagatgatcctaatgtatgaggaaaaggccagggagaaggaaaaacctaccggtcctccagccaagaaagccattagtgagttgccatag

SEQ ID NO: 214122 - DNA, 486 bp, Artificial Sequence
  Description of Artificial Sequence: Synthetic coding sequence
gggagaaaggcctcagaaaaaactgggggaagggagggcgaaccagcggatagagggctacagctaggaggtaaggccttcgggctacttaaggcccagcaggaagagagattggacgagattaataaacagttcctagacgaccccaagtatagctccgacgaggacctccccagcaaactagaggggtttaaggagaagtatatggagttcgacttgaacgggaacggagatatagatatcatgtcgctgaaaaggatgctcgaaaaactgggcgttcctaaaactcacctcgagctaaagaaacttattggagaggtgtcctcgggaagcggcgagaccttctcttatcctgatttcctgcggatgatgctgggcaagcgctctgcaatcctcaagatgatcttgatgtacgaggagaaagcacgcgagaaggagaagccaactggtcctccagcaaagaaagcaatcagtgaactgccctag

SEQ ID NO: 214123 - DNA, 282 bp, Artificial Sequence
  Description of Artificial Sequence: Synthetic coding sequence
atggagttcgacctgaatggtaatggggatatcgatatcatgagtctgaagagaatgcttgaaaaactgggcgtcccaaagacccacctggagttgaagaaactcataggggaagtctcctcgggcagcggcgagaccttcagctacccagacttcttgagaatgatgctaggcaagagatccgcaattctgaaaatgatcttgatgtacgaagagaaggcccgtgagaaagagaagcccactggccctcccgctaagaaagccatctcagaactgccgtag

SEQ ID NO: 214124 - DNA, 282 bp, Artificial Sequence
  Description of Artificial Sequence: Synthetic coding sequence
atggaattcgacctcaacggcaatggtgatatcgatattatgtctctgaagcggatgctggagaaactcggagttccgaagactcacctggaactgaagaagctgatcggcgaagtctctagcggcagcggcgagacattttcttatccagattttctgcggatgatgttgggtaaacggagcgcgatccttaagatgattctcatgtacgaagaaaaggccagagagaaagagaaacccactgggccaccagccaaaaaggcaatcagcgagttgccatag

SEQ ID NO: 214125 - DNA, 444 bp, Artificial Sequence
  Description of Artificial Sequence: Synthetic coding sequence
atgtcacaaactagggacttacaggggggtaaggcctttgggcttctgaaggcgcaacaagaagagcgactggacgaaatcaataagcaattcctcgacgacccaaaatactcctcagacgaggacctcccttctaagcttgaggggtttaaggagaagtatatggagtttgacctcaacggcaacggtgacattgacatcatgagtctcaagagaatgttagaaaagttgggcgtcccaaaaacccatctagagcttaaaaagctgataggtgaagtctcaagcggctctggtgagacattctcctaccctgatttcctacgcatgatgctaggaaagcggagtgccatcttgaagatgatcctcatgtacgaagaaaaggcccgagagaaagaaaaacctacaggtccacccgcaaaaaaagcaatatctgagcttccctag

SEQ ID NO: 214126 - DNA, 486 bp, Artificial Sequence
  Description of Artificial Sequence: Synthetic coding sequence
ggtcgtaaagcctctgagaagacgggcggacgggaaggggaaccggctgacaggggattacaactgggcggtaaggctttcgggctcctaaaggcccagcaggaggaaagattggacgaaattaacaagcagtttctcgatgaccctaagtactcaagtgatgaagaccttcctagtaagctggaaggttttaaggagaagtacatggaattcgacctgaacggaaacggcgatattgatatcatgtccctgaagaggatgctggagaaattaggcgtgcctaagacccacctggagctcaagaaactgatcggagaggtgtctagcggaagcggtgagactttctcgtaccctgacttcctgcgcatgatgctgggcaagcgctccgcaatattgaagatgatcctgatgtacgaagaaaaagcacgcgaaaaggaaaagccgaccggcccaccagccaagaaagccatctccgagttaccctag

SEQ ID NO: 214127 - DNA, 444 bp, Artificial Sequence
  Description of Artificial Sequence: Synthetic coding sequence
atgtcccagaccagagacctccagggcggaaaggcgttcgggctgctcaaggctcagcaggaagagcggctggacgagattaataagcagttcctggacgatccaaagtacagtagtgacgaggatctaccttccaagctcgaggggtttaaggagaaatacatggagttcgacttgaatggaaatggagatatcgacattatgagcctgaagcgaatgttggaaaagctcggagtgcctaaaactcaccttgagttgaaaaagctaatcggggaagtatcgagcggaagcggggagaccttcagctatcctgatttcctccgtatgatgctcggtaagagatccgctattctcaaaatgatcctgatgtacgaggaaaaggccagagaaaaagagaagcccacaggccctcccgcaaagaaagcaatttcggagctgccttag

SEQ ID NO: 214128 - DNA, 486 bp, Artificial Sequence
  Description of Artificial Sequence: Synthetic coding sequence
gggaggaaggcctctgagaagactgggggtagggagggtgagccggctgaccgtggactccaattgggcggtaaagccttcgggctgttgaaggcccagcaggaggaaagattggacgaaatcaataaacagtttttggatgaccctaagtattcatctgacgaagaccttccctccaagctggagggttttaaggagaaatatatggaattcgacttaaatggcaacggggacattgacattatgtcattaaagagaatgttggaaaagctgggggttcccaaaacccatctggagctcaagaagctgattggcgaagtcagttctggaagtggtgagacattctcttatcctgacttcctccgaatgatgctaggaaaacgcagtgcaattctaaagatgattctgatgtatgaggaaaaagctcgagaaaaagagaaacctactggccctcccgctaagaaggctatcagcgagctgccctag

SEQ ID NO: 214129 - DNA, 486 bp, Artificial Sequence
  Description of Artificial Sequence: Synthetic coding sequence
ggaagaaaggcttctgagaagaccgggggacgtgagggcgagccggctgatagaggactgcagcttggcggtaaggcatttggcttgctcaaggcacagcaggaggagcgattagacgaaatcaacaaacagtttctggacgatcccaagtactcttctgacgaagacttgccaagtaagctggaaggatttaaggagaaatacatggagtttgacctaaacggaaacggcgatatcgatatcatgagtctcaaacggatgctggagaagctgggggtgccaaagacccatcttgagcttaaaaagctaataggtgaggtcagtagcggcagcggagagacattctcttatcccgatttcctcagaatgatgcttggcaagcggagcgccatcctgaaaatgatattaatgtatgaggagaaagcacgcgagaaagaaaagccgactggcccacctgctaagaaagccattagcgaacttccgtag

SEQ ID NO: 214130 - DNA, 282 bp, Artificial Sequence
  Description of Artificial Sequence: Synthetic coding sequence
atggagtttgacttaaatggcaacggagacattgacataatgtctttgaagaggatgctcgagaaactgggcgtgccaaaaacacacttagaactgaaaaaactcataggcgaagtctcatcaggttcgggagagacgttttcctatcccgattttctgcgcatgatgctgggaaagcgcagtgcaatccttaaaatgatcttaatgtacgaagagaaggctcgagaaaaggaaaaacctactggcccacctgccaagaaagcgatcagtgaattgccttag

SEQ ID NO: 214131 - DNA, 1062 bp, Artificial Sequence
  Description of Artificial Sequence: Synthetic coding sequence
atgagtaagccgcctgatctgctgctcaggttgcttagaggggctcccaggcagagggtatgtacactgttcattattggcttcaaattcaccttctttgtgtcaattatgatctactggcatgttgtgggcgagcccaaagagaaaggacaactctataaccttcctgctgagataccttgcccgaccttgacgccgccaactccccctagccatggacccaccccgggtaacatctttttcctcgagacttctgatcgcactaatccaaattttctcttcatgtgcagcgtcgagtctgcagcaaggacccatcctgagagtcatgtcttagtgcttatgaagggacttcccggagggaatgcctccctcccgcgacacctaggaatctcgctgcttagttgttttcctaatgtgcagatgttgccgctggatttgagggaactgttcagggacacccccttagccgattggtatgccgcagtccagggcaggtgggaaccatacctgctgccagtactatccgatgctagccgcatagccctcatgtggaaatttgggggaatttacctggacacggatttcatcgtgcttaagaatctgcgcaacctcacaaacgtgctgggcacccagtcccggtatgtattgaacggagcttttctcgcctttgagcggcgtcatgaatttatggcattgtgcatgagggacttcgtagaccactacaacggttggatttggggccatcagggtccacagctgctaacccgagtttttaaaaagtggtgctcaatccgctcacttgccgaaagtagggcctgccgaggtgtcactaccctacccccagaggccttctatcctataccatggcaggattggaagaaatatttcgaggatattaatcctgaggaattacccagactgctctcagccacatacgctgttcatgtgtggaacaaaaagtcacaaggcacccgattcgaagccacttctcgtgcactccttgcacagctgcacgcaaggtactgccccaccactcacgaagcaatgaaaatgtacctgtag

SEQ ID NO: 214132 - DNA, 1062 bp, Artificial Sequence
  Description of Artificial Sequence: Synthetic coding sequence
atgtccaaacctccagaccttctattgcggctcctgagaggagccccacgccaacgtgtttgtaccctattcatcatcggatttaagttcacttttttcgtatcaatcatgatttattggcatgtcgttggggaacccaaggagaagggccagctctataatctccctgcagaaatcccatgtcccacactcacccctccaacaccaccgtcccacggacccacgcctggaaacattttttttctggaaacctctgaccggaccaatccaaattttctctttatgtgttctgtggaaagcgcagcacggacacaccctgagtcgcatgtgctcgtcctgatgaaggggcttccagggggaaatgcttctctgccccgacatcttggcatcagcttgctgagctgcttccccaacgtacaaatgctccccctcgacctccgggagctctttagggacacccccctggcggattggtacgcggctgtgcagggccgatgggagccgtacctcctgccggtcctgtcagatgctagccggatcgctttaatgtggaagtttggcggaatctacctggatacggattttatagtgcttaagaatttgagaaacctcactaacgttctcgggacccagagccggtatgtccttaatggcgcatttctggccttcgaaagacggcatgaattcatggccctctgtatgcgagatttcgttgatcattataatggatggatctgggggcaccaagggccacagctcctgactcgcgtattcaagaagtggtgcagcatcagatcactggccgagtcccgagcctgccggggtgtgaccacattgcctccagaggcattctaccccatcccatggcaggactggaaaaagtactttgaggatattaacccagaagaattgcctaggttactgtctgcaacatacgctgtgcatgtctggaacaaaaagtctcaggggacacgatttgaggccacaagcagagccctgcttgcccaattgcatgccagatactgcccgacaacgcacgaggccatgaaaatgtatttgtag

SEQ ID NO: 214133 - DNA, 1062 bp, Artificial Sequence
  Description of Artificial Sequence: Synthetic coding sequence
atgtccaagccccctgacctgctgctgcgattgttgagaggtgccccaaggcaaagagtctgcacgctcttcataattggcttcaaattcacgtttttcgtcagcataatgatatattggcacgttgtgggggaacctaaggagaaggggcagttgtataatctgcctgcagagataccctgtcctacactcaccccacctaccccaccctcacacgggccaactcccggtaatatattttttctcgagacctcagacagaacaaacccaaacttcctcttcatgtgctccgtcgaatccgccgcacgtactcacccggaaagccacgtcttagtcctgatgaaaggcctgcccggaggaaatgcttcactgccacgacacctcggcatctctctcctgagttgctttcccaacgtccagatgttgcctcttgatctgagggagctcttccgcgatactcccctggccgattggtatgcagccgtacagggcagatgggagccatacctgctgcctgtactctcggatgcaagccgcatcgccctgatgtggaaattcggaggcatctatctagataccgatttcatcgttctcaagaatctgaggaacttaacgaatgtcctgggtactcagtcaaggtacgtgctaaatggtgcttttttggcttttgaacggaggcacgaatttatggccttgtgcatgcgcgacttcgtggaccactacaatggatggatctggggtcatcaaggaccacagctcctgacacgcgttttcaaaaaatggtgctctatccgttcactcgcagagtccagagcatgtcgaggcgtgacaacactccctcccgaggctttttacccaatcccctggcaagactggaaaaagtattttgaagacatcaatccggaggagttgcccaggctgctctccgcaacctatgccgtccatgtgtggaacaagaaatctcaaggcaccaggtttgaagcgacctctagagcgctgctcgctcagctgcatgcgagatattgtcccacaacccatgaggcaatgaagatgtacctttag

SEQ ID NO: 214134 - DNA, 1311 bp, Artificial Sequence
  Description of Artificial Sequence: Synthetic coding sequence
atgtctaaacccccagacctcctgttgcggttattgcgaggagctcctaggcagcgcgtttgcaccctgttcattataggttttaagttcacctttttcgtctctattatgatttattggcacgtagttggggagcctaaagaaaaggggcagttgtacaatctgcctgcagagattccgtgtcctaccttaacgcccccaacccccccttcacacggcccaacccctgggaatatctttttcctggagacaagcgaccggaccaatcctaattttcttttcatgtgttctgtggagtccgctgccagaactcatcccgaaagccatgtgttagtgctgatgaaggggctgcccggaggcaacgcgagcctccccagacacttggggattagccttctatcttgttttccaaacgtccaaatgctcccattggacttgcgcgaacttttccgcgacacccccctggctgactggtacgctgcagtgcaaggcaggtgggagccgtatctcttaccagtgttgagtgacgcctcaaggatagctctgatgtggaaattcggcggaatttacctcgacaccgacttcatcgtgctgaagaaccttcgaaatctcactaacgtcttagggactcaatcccggtacgttctgaatggggcttttctggcatttgaacgcaggcatgaatttatggctctgtgcatgcgggattttgtggatcactataatggatggatttggggtcatcagggaccccagctgctgacaagggttttcaagaagtggtgttccatccggtcactggccgaaagccgcgcttgcagaggtgtgacaacactacctccagaagcattctaccctataccttggcaggactggaagaaatatttcgaagatataaatcccgaggagctccctcgcctgctgagcgccacatacgccgtgcacgtctggaataaaaaatcccagggaacagccggtccagctgcatgcccactgcttccccatgacgcaagaggccacgagaacgtccttgtaaggggacctccaggtcatctgcctaatctcttactgatgggccactgggccgctctgcctggggaggccaggctccgcgcaagagaaagggaagccagggctgcgaccgggctcaggcaggcagtagaagaactctgggagcaggcccaatgggaagcggttgacacaccacgtaccgtctcctgcttagaagcgggactgactcacggggctatcgcaagcgggggacggagtgtgtctgccccaggcctcctcgacaatcggcaggagggatag

SEQ ID NO: 214135 - DNA, 309 bp, Artificial Sequence
  Description of Artificial Sequence: Synthetic coding sequence
atggctctactgaaagcaaataaggacctcattagcgctgggctgaaggagttttctgtacttctcaatcagcaggtcttcaacgatccgcttgtgagcgaagaagatatggtgaccgtggtggaggactggatgaatttttacataaattactatagacagcaggtcactggcgagccacaggaacgggataaagctctgcaggagttacggcaggagctgaatacgctcgccaaccccttcctcgctaaatacagagacttcctcaagtcccacgagttgccaagccaccctccgcctagctcatag

SEQ ID NO: 214136 - DNA, 1488 bp, Artificial Sequence
  Description of Artificial Sequence: Synthetic coding sequence
atgtccatgctggtcgtttttttactgctctggggcgttacctgggggcctgtcacggaggctgcgatcttttacgagacacagccctctctgtgggcggagtcagagagcctccttaaacccttagcgaacgttaccctgacctgccaagcacacctggagacccctgatttccaactctttaaaaacggagtggcacaggagcctgtacacctcgatagtccagccatcaagcaccagtttctgctgaccggagatacacagggccgatatagatgtcggtccgggctgagcacgggttggacccagctctcgaagttgttagagttaacggggccaaagtcacttcccgcaccctggttgagcatggcacccgtttcatggattactcctggcctgaaaactacagcagtgtgccgtggtgttctgcgcggagttacattcctgctcaggagagagggagatcacgaatttctcgaggttccagaggcccaagaggacgttgaggccactttccccgttcaccagcccggaaactactcatgcagttaccgtacagatggtgaaggcgctctgagtgagccttcagccactgtgacaatcgaggagttagcggcacccccaccccctgtgctcatgcaccacggagagtctagccaggtgctgcaccccggtaacaaagtgaccctgacttgtgttgctccgctgtccggagtggactttcaattgcggaggggggaaaaggagctgctggtgcccagatcttccaccagcccagaccgaattttcttccatttgaatgcagtggccctgggcgatggcggtcactacacatgtcgatacaggctgcatgacaatcagaatgggtggtccggtgacagtgccccagttgagttgatccttagcgatgagacacttcccgctccggagttcagtcctgaacccgaatccggccgtgccctccgtctccgatgccttgccccattagagggggcacgctttgcactagtccgggaagacagaggcggacgtcgagtgcatagatttcagtcacctgccggaactgaggccctctttgagctccataatatcagcgtcgcagattcagctaactactcctgcgtgtatgttgatttgaagccacccttcgggggttctgccccatctgaaagattggagctacatgtagacgggcctcccccaaggccccagctccgggcaacatggtctggagccgtgctggctgggagggacgccgtgctacgatgcgaaggccctatcccagatgtcacattcgagctgctcagggagggagagacgaaggccgtgaagactgtccggaccccaggagctgccgcaaatctggagctcatctttgtaggccctcagcacgctggcaattatcgatgcaggtacaggtcctgggtccctcataccttcgagtccgagctgtcggaccctgtcgagctgctcgtggcagaatcgtag

SEQ ID NO: 214137 - DNA, 1059 bp, Artificial Sequence
  Description of Artificial Sequence: Synthetic coding sequence
atgcgtagccttggggcactacttctcttactctcagcctgtctggccgtaagcgccggacctgtgccgactcccccagataatattcaagtccaggagaacttcaatattagccggatttatggtaagtggtataacctagctattggaagcacctgtccttggctgaaaaaaatcatggatcgtatgaccgtgtctactttggtattgggggagggagccacagaggccgaaattagtatgacatctactcgctggagaaagggggtttgcgaagagaccagtggcgcttatgagaaaaccgataccgatgggaagttcctataccacaaaagcaagtggaacataactatggaatcttatgtggtacacaccaactacgacgaatacgcgatcttcctgactaagaagttttctaggcaccacgggccaacaattaccgccaaactctacggtcgcgcaccccaactgcgtgagaccctcctccaggatttcagggtggtggctcagggcgtgggcattcctgaagattctatttttaccatggctgatcgcggagagtgcgtaccaggagagcaagaacctgaacctattctcatcccgcgagtacggagagcggtactgccacaggaagaagaaggcagcggcggagggcagctggtgactgaggtgacgaagaaagaggatagctgtcagctgggctactcggccggtccctgcatgggtatgacgtcccgatacttctacaatggaaccagtatggcctgcgagaccttccagtacgggggatgtatgggcaacggcaataattttgtgacggagaaagagtgcttacagacatgtcgtaccgtggccgcatgcaatctaccaattgtgagaggcccatgtagagcctttattcagctttgggccttcgacgctgtcaaagggaaatgtgttctgttcccctacggcggatgccaaggcaacggcaacaagttctactcagagaaggaatgccgggaatattgtggggtcccaggtgatggtgatgaggagctactgaggtttagcaattag

SEQ ID NO: 214138 - DNA, 813 bp, Artificial Sequence
  Description of Artificial Sequence: Synthetic coding sequence
atggatcgtatgaccgttagcacgctcgttttaggcgaaggcgctacagaagccgagataagtatgacatctacacggtggaggaaaggcgtgtgcgaggagactagtggggcatacgaaaagacagataccgatgggaagtttctgtaccacaaatctaaatggaacatcactatggagagctacgtagtgcacacgaactacgacgagtatgccatctttctgacaaaaaaattcagtcgccaccacggcccaacaatcacagcaaaactgtacggtcgggcaccccagttaagagaaactcttctgcaggattttcgggtcgtggctcagggggtgggaataccggaagattctatctttacgatggccgatcggggagagtgcgtcccaggagaacaggagccggaacctatcctaataccccgtgtccgtcgggcagtgttgcctcaggaggaggagggaagcgggggtggtcagctggtaactgaggtgacaaagaaggaggactcgtgccagctcgggtattccgctggaccttgcatggggatgaccagccggtatttttacaatggtacttcaatggcttgcgagacatttcagtatggaggatgcatggggaatgggaataactttgtgacagagaaagaatgccttcagacctgcagaaccgttggggagtgtggatcaccgcctctgtgcgccctccacccacaggacccagtcccacctgttaatcacctcagaattgaaaaagttgccaaccgtggtcactcatcaggcagaaccccaggaggatttttaaagtcttag

SEQ ID NO: 214139 - DNA, 897 bp, Artificial Sequence
  Description of Artificial Sequence: Synthetic coding sequence
atggtgcgcatggtgcctgttctgttgtctcttctgcttctgctgggtcctgccgtgccccaggagaaccaggatggacgctacagcttaacctacatctatacaggactgtccaagcatgtggaggacgtcccggcttttcaggcactggggtcactaaacgatttacagttttttaggtacaatagtaaggataggaaatcgcagcccatggggttatggaggcaagtcgagggaatggaagactggaaacaggacagccaactgcagaaggcaagagaagacatctttatggagacactcaaggacatagtagagtactacaatgatagcaacggctcccatgttctgcaggggaggtttggatgcgagattgaaaacaacaggagttctggtgcattctggaagtattactacgatggaaaagactacattgagttcaataaggagatccccgcatgggtgccctttgacccagctgcacagatcaccaaacagaagtgggaagctgaaccggtgtatgtccagagagccaaggcctacctggaagaggaatgtcccgctactctgcgcaaatacctgaaatactccaagaacattctggataggcaggacccgccttcggtggtggtgacctcacaccaagcccctggagagaagaagaagctaaagtgcctggcatacgacttttatccagggaagatcgatgtgcattggacacgcgcaggcgaggtccaggagcccgaactccgtggtgatgtcctccacaacggcaacggtacttaccaaagctgggttgtggttgcagttcctccacaagatacagcgccatactcctgtcacgttcaacactcctctctagctcagcctcttgtagtcccctgggaagcgtcctag

SEQ ID NO: 214140 - DNA, 1104 bp, Artificial Sequence
  Description of Artificial Sequence: Synthetic coding sequence
atgaagtccttggttcttctgctttgtctcgcccaactctggggatgccacagcgccccacatggacccggtttaatatacagacaacccaattgcgatgacccagagaccgaggaagccgctctggtggccatcgactacattaatcagaatctgccctggggctacaaacatacactgaaccagatagatgaagtcaaagtatggcctcaacaaccttctggcgagctgttcgagattgaaatagacaccctggagaccacatgtcacgttttagatccgacccccgtcgcacgctgtagcgttaggcagctgaaagagcacgccgtagagggtgattgcgacttccagctactaaaactggacgggaagttctccgtggtttatgccaaatgtgattcaagccccgattcagccgaagatgtcagaaaggtttgtcaagattgtcctctgctagcaccgctgaatgatacccgggtagtgcacgctgccaaggccgcattagcagccttcaatgcccagaacaatggatccaactttcagttagaggaaatttcccgggctcaactggtgcctctacctccctctacttatgttgagttcactgtgagcggtacggactgtgtggccaaggaagccaccgaagcagctaagtgcaatcttttggccgagaaacagtacggattttgtaaagccacacttagtgaaaaactcgggggagccgaggtagccgtaacgtgtatggtcttccagacacagcccgtgagttcccagccacaaccagaaggtgccaacgaagccgtgccaactcctgtagtggaccccgatgctccaccttcgccccctttgggtgcgcctggcctccctcctgcgggaagtccccctgattcacatgtcctcctggctgccccacctggccaccaactgcaccgagcgcattatgatttgagacacacgtttatgggagtcgtaagtttaggaagcccaagcggcgaggtatcgcatccaagaaagactaggacagtagtgcaacccagtgtgggcgctgcggctggtccagtggtgccaccgtgccctggacgcattcggcacttcaaagtgtag

SEQ ID NO: 214141 - DNA, 1302 bp, Artificial Sequence
  Description of Artificial Sequence: Synthetic coding sequence
atgttcgccggatgcttctttttcctgctgaatcagagtcggaatcaccctgtttctctttgcaatagctcagggcgactgcaacagattaataaggctcaccatccgccatgggtctatctgtctcagcagtccacttgggttggtccggaagctagtaatcatttacatgcatgccaggggctgtccggcgcagccatgaagtctttggttctccttctgtgtcttgcccaactctggggctgccacagcgcacctcatgggcctggcttaatatacaggcagcctaactgcgatgatcccgaaacagaagaggccgcactggtggcaattgattatataaatcagaatcttccttgggggtacaaacacactctgaatcagattgatgaggtgaaggtttggccccagcagccaagcggtgagctgttcgagatcgagattgacactctagaaactacctgccacgttcttgatccgactccggtagcgaggtgttctgtgcgccagctgaaggaacatgcagtcgagggcgactgtgatttccagttgctcaagctggatggcaagttcagtgtagtgtatgcaaaatgcgattcctcacccgactccgccgaagatgtgcgtaaagtgtgccaagattgtcccctcttggctcctcttaacgacaccagggtggtccacgccgctaaagctgctttagccgcattcaatgcccagaacaatggttctaatttccagctcgaagaaatttcccgggctcaactggtgcccctgcctccatcaacctatgtcgagttcactgtgtcaggtacggactgcgtggcgaaggaagccactgaggccgctaagtgcaatcttctcgccgaaaagcagtacggcttttgtaaagccactttatccgaaaagcttggcggagcagaggtggccgtcacttgcatggtgttccaaactcagcccgttagttcccagccacagccagaaggcgcaaatgaggctgtgccgacaccagtcgtggatcctgacgctccccctagtcctcctttgggagccccaggattgccgccagcgggatctcctccggactcgcacgtactcctggccgctccacctggccatcaactgcacagagcccactacgacttacggcatacttttatgggcgttgtgtcactgggctccccgagcggcgaggtgtcccacccaaggaagacacgaactgtcgtgcagccatcagtcggggcagcagcaggaccagtggtccccccttgtccgggacggattaggcacttcaaggtatag

SEQ ID NO: 214142 - DNA, 4425 bp, Artificial Sequence
  Description of Artificial Sequence: Synthetic coding sequence
atgggaaagaataagttgctgcacccctctttagtgttgcttctgcttgtgctgctgcccacggatgccagcgtctccgggaagccccagtacatggtccttgtcccttcgctcctgcacaccgaaaccaccgagaagggctgtgtccttcttagctacttaaacgaaacagtaacggtttcggcttctttggaaagtgttcgaggcaatcgatcgctgtttacagacctagaggctgagaatgatgtactccattgcgtggccttcgcggtcccaaagtcgagcagcaatgaagaagtgatgtttctcacggtccaggtgaaaggaccgactcaggagtttaaaaaaagaaccacagtgatggtaaagaacgaggacagccttgtattcgtgcaaacagacaagagcatttataagcctggccagaccgtgaagtttcgggtggtgagtatggacgagaatttccacccgctaaatgaactgatccccctcgtgtacattcaagatcctaaagggaacagaatcgcccaatggcagtcattccaattggagggcggacttaaacagtttagcttccccctgtcctccgagcccttccaaggctcttacaaggtcgtggtccagaaaaagtctggcggtcgaactgagcacccatttacagtcgaggagttcgtcctacccaagttcgaggttcaggtcaccgtgccaaagatcatcaccattctggaagaagaaatgaatgtctccgtgtgcgggctctacacctacggcaagcctgtcccaggccatgtgacggtgtcaatatgccggaagtattccgacgcctccgattgccatggggaagactcccaggctttttgtgagaagttctctgggcaactcaattcccacggttgcttttaccagcaggtgaagaccaaggtcttccaactcaagaggaaggaatacgagatgaagctgcacacagaagcgcagatccaggaagagggcacagtggtggagctcactggccgacaatccagcgagattacgcgcacaatcaccaagcttagcttcgttaaggtggactcacacttcaggcagggcattcctttcttcggtcaggttcgactggtggatggaaagggcgtacctatccctaataaggtgattttcattaggggcaatgaggctaactactactcaaacgccaccaccgatgagcacggcctcgtgcagttctctattaacactacaaacgtgatggggaccagcctgacagtaagagttaactacaaggaccggtcaccgtgctacgggtaccagtgggtgagcgaagagcacgaagaagctcatcacactgcttacctggttttctcaccaagcaaatcttttgtacatctggagcccatgtcgcacgagctgccctgcgggcacacacagaccgtccaggcccactatattctgaatggagggaccctcctgggcttaaaaaaactcagtttctactaccttatcatggcaaaaggaggcatcgtgcggactggaactcacggcctccttgtgaagcaggaagatatgaagggacacttctccatctcaatcccggtgaaaagcgatatcgctcctgtggccagactgctcatttacgctgtccttcctactggggacgtgatcggcgatagtgcgaagtatgacgtagagaattgcttggctaacaaggtggatctgtcatttagccctagccagtcgctgccggctagccacgcccacctcagggtaacagcagctcctcagtctgtttgtgcactgcgggcagttgaccagtctgttcttctaatgaaacccgacgccgaactatccgcctcttccgtatataatctcttacccgaaaaggacctcactggctttccaggaccccttaatgaccaagacaacgaagattgtatcaacagacataatgtgtatatcaatgggataacttatactcccgtatcttctaccaacgaaaaggacatgtacagcttccttgaagatatgggcctgaaggcttttactaactctaagataaggaagcccaaaatgtgccctcaactccagcagtatgaaatgcacgggcctgagggacttagagtaggattctacgaaagtgacgttatgggcaggggccacgctagactcgttcacgtcgaggagccccatacagaaacggtgcgcaagtacttccccgagacgtggatttgggatctcgtagttgtgaattctgccggtgtggccgaggtaggcgtgactgtccccgatacaattaccgaatggaaggctggtgctttttgcctgagcgaggacgccggacttggaataagctccaccgctagcttacgtgcatttcagccgttctttgtggaattaacaatgccttatagcgtcatacgtggcgaggcttttaccctcaaagcaactgtacttaactatttacctaaatgcatccgggtgtctgtacagctggaggcttctccagctttcctggcagtacccgtcgagaaggaacaagctccgcattgcatctgcgcgaacggtcgacagacggtcagctgggccgtgacacccaagtccctaggcaacgtcaacttcacggtgtctgccgaagccttggagtctcaggagctgtgtggtaccgaagtgccttctgtacctgaacacgggagaaaggacacagtgattaagcctctgctcgtcgaacccgagggacttgaaaaggagactacatttaactccctgttatgcccttctggcggagaagtatctgaagagctgtctcttaaattgccccctaatgtagtggaagagtcagcacgggcatccgtgtcagtgctcggcgacattcttggatctgccatgcagaacactcagaacctgctgcagatgccttacgggtgcggggagcagaacatggtacttttcgcccctaacatttacgtgctggattacctgaatgagactcagcagctgacccctgaaataaaaagcaaggcaatagggtatttaaacaccggctaccaaagacagctcaactacaaacactacgacgggtcgtacagtacctttggcgaacgatatggtagaaaccaagggaacacgtggttgacggctttcgtcctaaagacttttgcccaggccagggcctacatctttatagacgaggcccacattacccaggctctcatctggctgtctcagagacaaaaggacaacgggtgtttcagatctagcgggtctctgttgaataacgctatcaaaggcggagttgaagatgaagtcaccctcagtgcttatattacaattgccctcctagagattcccttgactgtgacccaccctgtcgtccggaacgcgctcttctgcctggaatctgcttggaagacggcccaggagggggatcacggttcacacgtgtacactaaggctctcctggcttacgcattcgccctggcaggaaatcaggacaagcgcaaggaggtgttaaagagtctcaatgaagaggccgtgaagaaagacaattctgtccactgggaacgccctcagaagcctaaagcccctgtgggccacttttatgaaccacaagctccttctgcagaagtggagatgacctcttacgtactactggcataccttacagcccaaccagccccaacctctgaggatctgacgtctgccactaatatcgttaaatggattactaagcagcaaaatgctcaggggggattttccagtacccaagataccgtggtggcactccacgctctatcaaagtacggggcagcaacctttacccgaaccggtaaagccgcacaagttaccatccagtctagcggaacattctcttctaagttccaggtggacaacaacaacaggctgctcctgcaacaggtcagtctacccgagctgccaggcgagtactctatgaaggtcactggcgagggatgtgtctacctccagacatctcttaaatacaacattcttcctgagaaggaggagtttccatttgccctaggcgtgcagaccctaccacagacatgtgatgagcctaaggcccacaccagcttccagatttccttgtcagtgtcatacaccgggtcccgaagtgcttccaacatggcaatcgtggacgtaaaaatggtgtctgggtttattccattgaaaccaacagtcaagatgctggaacggtcaaaccacgtatctaggaccgaggtctcgagtaatcatgtacttatctacctggacaaggtgagcaatcagactttgtctttgtttttcactgtgctacaggacgttccagttcgagacctcaaacccgcaatcgttaaagtctatgactactacgaaactgacgagttcgccattgccgagtacaatgcaccatgttccaaggatctgggaaacgcttag

SEQ ID NO: 214143 - DNA, 507 bp, Artificial Sequence
  Description of Artificial Sequence: Synthetic coding sequence
atgggaaaaaacaagctgctgcatccgagtttagtcctgcttcttctggtgttgctgcctacagacgcctccgtgtcgggaaagccacaatatatggtcctcgtgccctccctgctacacactgaaactaccgagaaaggctgtgtgcttctgtcctacctgaacgagaccgtcacagtctcggctagtttagagtctgtgcgagggaatcgtagtctctttacagacctggaggccgagaatgacgtgctccattgcgtggcattcgctgtgccgaagagcagttccaatgaggaagtgatgttcctcacggtgcaggttaagggccctactcaggagttcaaaaaacggacaacagtgatggtgaaaaatgaggattcgctggtgtttgtgcaaaccgataaaagtatttataaaccgggacaaaccgttaagttccgcgttgtgagcatggacgagaactttcatcccctcaacgaacttattccgctcgtgtatatacaatag

SEQ ID NO: 214144 - DNA, 4470 bp, Artificial Sequence
  Description of Artificial Sequence: Synthetic coding sequence
cgggtgcagtatgtgtgttccccacctgctccaagtttctgtaacatgggaaagaataagctccttcaccctagtttggttcttctcctgctggttctccttcccaccgatgcaagtgtgtcgggtaaaccacagtatatggtgctggtccctagcctcttgcatacagagaccactgagaaaggttgcgtgttattgagttaccttaacgaaacggtcaccgtgtctgcctctctcgagtctgttagaggcaatagatcgctctttactgacctggaagcggagaacgatgtcttgcactgcgtcgcatttgccgtgcccaagtcctcttccaacgaagaagtgatgtttctcacggtacaagtgaaaggacccacccaggagttcaaaaaacgcacgaccgtaatggtgaaaaatgaagacagtctggtcttcgttcagaccgacaaatccatctacaaacctggtcaaaccgtgaaattccgggttgtttcaatggacgaaaactttcatccactaaatgagctcataccactggtttacattcaagacccaaagggcaataggatagctcaatggcagagcttccagctggaaggtggcttaaaacagttctctttcccactctcttccgagcctttccaaggctcctataaagtggttgtgcaaaagaagtcaggtggccgtacagagcatccctttacagtcgaggagttcgtcttaccaaaatttgaagtgcaggttacagtccccaaaatcatcactatcctggaggaagagatgaatgtcagtgtttgtggactttacacttatgggaaacctgtgccaggacatgttacagttagcatctgcagaaagtactcagacgcgtccgactgccacggcgaagattcgcaggcattttgtgagaaattttcaggccaactgaatagccatggatgcttctatcaacaggtgaaaaccaaggtgttccagctgaagagaaaggagtacgaaatgaagctgcacaccgaggctcagatccaagaagagggcacggttgtcgaactgactgggaggcagtctagtgagatcacaaggactattaccaaactttcctttgtcaaggttgactcccattttcgccagggtatcccctttttcggccaggtccgactagtggacgggaagggggtgcccatcccaaacaaagtgatcttcattcggggaaatgaggccaactactatagcaacgccacgaccgatgaacatggccttgtgcagttttccattaatactactaacgtgatgggaacctccctgacagttcgggtgaattataaggataggagtccctgttacggctaccagtgggttagcgaggagcatgaggaggctcaccacaccgcctacctcgtgttctcgccaagtaaaagctttgtgcacttagaacctatgtcccacgagttaccgtgcggccacacccagacagtgcaggctcattacatcctgaatggcggtacactgcttggcctgaagaagctctccttctactatctgatcatggccaagggtgggatagtgcgaaccggcacacacgggcttctggtcaaacaggaggacatgaagggccacttctccatcagcatccctgtaaaatctgacatcgcacctgtggctcggctcttgatctatgctgtgctcccgaccggtgacgtgataggcgattctgctaagtacgatgtcgaaaactgcctggccaataaggtcgatctcagcttctctccttcccagagccttccggctagccatgcccatctacgagttaccgccgctccccaaagtgtttgcgctctaagagcagtggatcagagtgttctgcttatgaaaccggatgccgaattaagcgcctcatcagtctacaatctactccccgagaaagacttgacaggatttccaggacccctgaacgaccaggataatgaggattgtatcaaccgtcacaacgtgtatatcaacggtattacctacacaccagtttctagcaccaatgagaaggacatgtacagcttccttgaagatatgggcctgaaagcgtttacaaacagtaaaatccgcaagccaaagatgtgccctcagctgcaacaatacgaaatgcacgggccagaaggtcttagagtgggattttacgaatccgacgtgatgggacggggacacgcacgactcgttcacgttgaagaaccccatactgagaccgtcagaaagtacttcccagagacctggatctgggatttggtcgtggtcaattcagcgggagttgcagaagtgggcgttacagttccagacacaattaccgagtggaaggcaggcgctttctgcctgtccgaggacgccggtctcggtattagttcgacagccagcttaagggcctttcaacccttcttcgtagagctgaccatgccatactccgtcataagaggggaagcttttacgttgaaggcgactgtgctcaattatctccctaagtgtatacgcgtgagtgtgcagcttgaggcttccccagctttcttggctgtgccagtcgagaaagagcaagcccctcattgtatttgcgcgaatgggcgacaaacagtgtcatgggccgttaccccgaagtcgctgggcaacgtcaatttcacagtgtccgcggaagcccttgagtcacaggagctctgcggaactgaggtgccttccgtaccagaacatggcagaaaggataccgttatcaaacccctattggtagagcctgaggggttagagaaagaaacaacttttaattcactgctgtgcccatccggaggagaggtgtccgaggagttgtcattgaaattgccccctaacgtcgtagaagaatcagcccgagcgtccgttagtgtgctgggtgacatactggggtcggccatgcaaaatactcagaacttgctccagatgccatacggatgcggagaacagaacatggtactgttcgcacccaatatatacgtgcttgattacctgaacgagactcagcaactgacgccggagatcaagtctaaagctataggttaccttaacaccggttatcaaagacaactaaactataagcactatgatggcagttactccacctttggggagcgctatggtcgcaaccaggggaacacgtggttaactgctttcgtgttaaaaacttttgcccaggcccgtgcgtacattttcatcgacgaggcacacattactcaggccctgatctggctgtctcagcggcagaaggataatggatgtttccggagctctggatcacttctgaataatgcaataaagggcggagtggaagatgaggtgacgctatctgcatatattaccatagccctcctggagatccccctgactgttacccatcctgtcgtgaggaacgctttgttctgcttggaatcggcctggaaaacagcccaggagggggatcatggatcacacgtgtatacaaaagccttgttggcttatgctttcgcgctggcgggtaaccaggataaaaggaaagaagttttaaaaagtttgaatgaggaagctgttaagaaggacaattctgtgcactgggagcggcctcagaaaccgaaagcgccagtgggacacttctatgaacctcaggcccctagcgcggaagtggagatgacaagctacgtgttgctcgcatatttgacggcacagcctgccccaacgtccgaagatctaactagtgccactaatatagtgaaatggataacgaagcagcaaaacgctcagggagggttctcatctactcaggacacagtcgtggctctgcacgcactcagcaaatacggtgctgccaccttcactcggactgggaaggcagctcaggttaccattcaaagctctggcactttttcctccaagtttcaggtcgacaacaacaatcgtctactgttgcagcaggtgagtctgcctgagttgccaggagagtactcaatgaaagtaaccggtgagggctgcgtttacttgcagacatctctcaagtacaatatcttgcccgaaaaggaggagttccccttcgctttaggggttcaaaccctaccccagacctgtgacgagccaaaagcccatacgtccttccagatcagcttgagtgtctcatacacaggatcaaggtcagcaagtaatatggctattgttgatgtcaaaatggtaagcggattcatcccgctaaagcccaccgttaagatgcttgagagaagcaaccacgtgtctcgtaccgaagtgagctccaatcacgtcctcatctatctcgataaagtcagcaaccaaacacttagtctgttctttacggtcctccaggatgtaccagtaagggacctgaaaccagcaatcgtgaaggtatacgactattatgagacagatgaattcgccatcgccgaatacaatgctccttgctccaaggacttggggaatgcctag

SEQ ID NO: 214145 - DNA, 4365 bp, Artificial Sequence
  Description of Artificial Sequence: Synthetic coding sequence
atgtgggctcagcttcttttgggaatgcttgctctctcccctgccatcgccgaagagctgccaaattacctggttacacttcctgctaggctgaacttcccaagcgtgcagaaagtgtgtctcgacctttcccccggatacagcgacgtcaaattcactgttaccctcgaaaccaaggacaaaactcaaaagctgctagagtatagtgggctcaaaaagcgccatcttcattgcatttccttcctggtgcccccaccagcgggaggaaccgaggaagtagccacaatacgcgtttccggcgtgggcaacaatatctcttttgaagaaaagaagaaagtactaattcaacgccagggaaatggcacctttgtgcaaactgacaaacccctctacacccctggtcaacaggtctactttaggattgtaacaatggacagcaactttgtccctgtgaatgacaagtattctatggttgagttacaggaccctaatagcaatagaatcgcgcaatggctcgaggttgtgccagagcagggaattgtcgatctctcctttcagctcgcccctgaggcaatgttagggacttatacagtggctgtggccgaaggcaaaacatttggaacattctcggtggaagagtatgtcctgcccaagtttaaggtagaggtcgtggaacccaaggagctctccaccgtgcaagagtccttcttggtaaaaatctgctgtaggtacacctacggcaaacctatgctcggggcagttcaagtcagcgtgtgtcaaaaagctaatacctattggtaccgagaggttgagcgggaacagttgccagataagtgccggaacctgagtggtcagactgacaagactggctgtttttccgccccagtcgatatggccaccttcgacttgattggctacgcctacagtcatcagattaatatcgtggccaccgtcgtagaagagggaaccggagtcgaagccaacgccacccagaacatctacatttctccacagatggggagcatgacatttgaggacactagcaacttctaccatccaaattttcctttcagtggcaaaatcagggtgcgtgggcacgacgactcattcctcaagaatcatctggtgttcttagtgatttatgggactaacgggacgtttaatcagactcttgtaactgataacaacggcctggcaccgtttaccctggagacctcggggtggaatgggactgacgtctccctggaggggaagtttcagatggaagaccttgtgtataatcccgaacaggtccccagatactatcagaacgcatatctccacctgcggcctttttattcgacgacacgaagtttccttgggatccaccggttaaacggcccactcaaatgcggacagcctcaggaggtccttgtggattactatatagatcccgctgatgctagtccagaccaagaaatctccttttcttattaccttataggcaagggttccctggttatggaggggcagaagcatctgaatagcaaaaaaaaggggctgaaggccagcttttctctgtcattaactttcaccagccgcctcgcacccgatccaagtctagtgatttatgcgatctttccgtctggcggtgttgtggctgataaaatccagttcagtgtggagatgtgctttgataatcaggtcagccttggcttcagtccgagccagcagctccctggggctgaggtggaactgcagctgcaggcagcgccaggtagcctttgtgccttgagagccgtagatgaatcagtgctgctgctgagacctgacagggagttgtcaaacaggagcgtctacggcatgtttcctttttggtacggacactacccttaccaggttgcggagtacgatcagtgtcctgtgtcagggccatgggactttccgcaaccactgattgatcccatgccccaagggcattcaagccaaagaagcattatctggaggccctcattcagcgaaggaaccgacctctttagcttcttccgtgatgtagggcttaagatcctgtcaaacgccaaaatcaaaaaacctgtggactgttctcacagatcacccgagtatagcaccgccatgggcgcagggggtggccatcccgaggcttttgagtcttcgacccctcttcatcaggcagaggattctcaagtcaggcaatattttcccgaaacatggctctgggacttgttcccgataggaaattctggaaaagaagcagtgcacgtcacagtgccagacgcgattactgagtggaaagctatgagcttctgtacctcccaaagcagaggctttggtctcagccccacggtaggtctcactgccttcaagccattcttcgttgacctgactctaccttactccgtggtgagaggggaatcattcaggttaacagctactatttttaattatctcaaggattgcattcgcgtgcaaacagatctcgcgaaatcgcacgagtatcaattggaaagctgggccgactcccagacgtcaagctgtctgtgtgccgatgacgccaagacacaccactggaatataaccgcagtaaaattggggcacatcaatttcacaatatcaaccaaaatcttggattccaacgagccatgtggaggccagaaaggttttgttccacaaaaggggagatcggatacactgataaaaccagtgctagtgaagccagagggggtgctggtcgagaagacacattcctccctactgtgccccaagggcaaggtggcaagcgagagcgtgtccctggaattgcctgttgatatcgtaccggatagcactaaagcttacgttactgtgctcggggacatcatgggcacagcgctacagaacctcgacgggcttgtacagatgccatccggatgtggagagcaaaatatggttcttttcgcgccaataatatacgttttgcagtacttggagaaggccggtctgttaacagaggagatccgctcgagagccgtgggatttctagagatcggatatcagaaagagttaatgtataagcactccaatgggtcgtattccgccttcggggaaagagatggaaatggtaatacgtggctgaccgctttcgtcaccaagtgttttgggcaggcccagaagtttatcttcatagatccgaaaaatattcaggatgcactgaagtggatggccggtaaccagctgcccagcggctgctacgccaatgtcggtaacttactacacactgccatgaaggggggagtagacgacgaagttagcctgactgcctacgtgaccgctgcacttttggagatgggaaaagacgtagacgatcccatggtcagccagggacttaggtgtctgaaaaattccgccacctcaaccacgaatctatatacacaggccctattagcctatatttttagcctggccggagagatggacattagaaacatcctgctgaagcagctggatcagcaggccattatctccggcgaatctatctactggtcacagaagcccacacccagttcaaacgcgtccccatggtccgagccagctgctgtagatgtcgagttgaccgcctatgctctgctcgcacagcttaccaaaccctccctaacacagaaagagatcgcgaaggcaacatctatagtggcatggcttgctaagcaacacaacgcctacggagggttttccagtacccaggacaccgtggttgctctgcaggccctggcaaagtatgcaacaaccgcttacatgccaagcgaggaaattaatctagtcgtcaagagtaccgagaattttcagcgcacgttcaacattcagagcgtcaacagactggtgttccagcaggacacactgccaaatgttccaggcatgtatacgctcgaagcctcagggcaggggtgcgtgtatgtgcaaaccgtgttgaggtacaatattcttcccccaaccaatatgaaaacgttcagccttagcgtagagattggcaaagcacggtgtgagcaacccacatctcctcgttccttaacccttactatccacactagttacgtgggctctcgctcgtcctccaacatggccatagtggaagtgaaaatgctcagcggcttctctccaatggaggggactaatcaactgcttttacaacaacctttggtcaagaaggtcgagtttggaaccgacacacttaacatctacctcgatgagctgataaaaaacactcagacatatacatttacaatcagtcagtccgtgctggtgaccaatctaaaaccagctaccattaaggtgtatgactactatttaccagacgagcaggcaaccatacagtactccgacccgtgtgagtag

SEQ ID NO: 214146 - DNA, 4365 bp, Artificial Sequence
  Description of Artificial Sequence: Synthetic coding sequence
atgtgggctcagctgctcctggggatgcttgctctgagtcctgctattgctgaggaattgccaaactatctggtcaccttgccagcgaggctcaactttccttcagtgcagaaggtctgcctggatctgagtccagggtattcagatgtgaagtttactgtcacgctcgagacaaaggacaagacccagaagttactggaatactcaggcctgaagaaaaggcacctgcactgtatcagttttctcgtcccacctccagctggtggaaccgaggaagtggcaactattcgcgtgtccggtgtgggaaacaatatcagctttgaggagaagaaaaaagtgctgatccagcggcagggtaacgggacattcgtccagaccgataaacccctctataccccaggccaacaggtctatttccgaattgttacgatggattccaacttcgtcccagtgaatgataaagtatcatgggaggaaggccaggaccccaactctaaccggattgctcagtggctcgaggtggttcccgaacagggaatcgtcgatttgtctttccagctggctcccgaagctatgctgggtacttatacggttgccgtggccgagggcaagacctttggaactttcagcgtggaagaatatgtgctccctaagttcaaggtggaggtcgtcgagccaaaggaattaagtacagtgcaggaatccttcctcgtgaagatctgttgcagatacacatacggcaaacccatgttaggagctgtgcaggtttccgtgtgccagaaagccaacacctattggtatagggaggtggaacgtgagcagcttcccgataagtgtcggaatttaagcggccagactgataagactggttgttttagtgcgccagtagatatggccactttcgacttgattggatacgcctatagccatcagattaacattgtggctacagtcgttgaggagggcaccggggttgaagccaacgctacacagaacatttacatcagccctcagatgggtagtatgacttttgaagatacatctaatttctatcatccaaacttcccattctccgggaagattcgggttagaggccacgacgactctttcttaaagaaccatctggtcttcctggtcatctatgggacaaatgggacattcaaccagaccctggtaacagataataacggccttgccccttttaccctcgagacttcggggtggaatggtaccgatgtgagtttggagggaaaatttcagatggaggatctggtgtataatcccgaacaggtgcccaggtactaccagaacgcctatctgcatcttaggccgttttattctacaacacgcagtttcctgggtatccaccgcctgaatggaccgttgaaatgcggacagccacaggaggtgctcgtggattattatatcgatccagccgatgcaagcccggatcaagaaatttcttttagttactacttaatcgggaaggggagtttggtgatggaggggcagaaacacctgaattctaagaaaaaggggttaaaagcaagcttctcattatctctcacattcacctcaaggctcgcaccggacccttcattagtgatctacgcaatcttcccaagtggaggggtggttgcagacaagattcaattcagcgttgagatgtgcttcgacaaccaagtatcgctaggttttagccccagccagcagctccccggagctgaggttgagcttcagttacaagcagctccaggcagcctgtgcgccttgcgggcagtggacgaaagcgttctgctcctgcggcctgatagggaactctccaatcgcagcgtctacggcatgttccccttttggtacggacattacccttaccaggttgccgaatacgatcaatgtcccgtcagcgggccatgggattttcctcagccgcttatcgatcccatgccccagggacatagcagccaacggtcaattatttggagacccagcttcagcgaggggaccgacctgttcagcttttttcgagacgtcggccttaagattctttctaatgcgaagatcaaaaagcccgtggattgcagccacaggagccccgaatactcaaccgccatgggggcaggaggcggtcaccccgaagccttcgagtctagtacccccctccaccaggctgaggactcccaggttagacaatacttcccggaaacatggctttgggacctgttcccaattggaaactctgggaaggaagccgtgcacgtcacagtaccagatgcgattactgagtggaaagcgatgtcgttttgcacaagccaatcccgaggattcggactgtcccccacggtcggccttacagcattcaagccgtttttcgtggacctaacactgccttactccgttgtgagaggcgaaagttttaggcttactgccacaatcttcaattatctgaaggactgcatcagagtccagactgaccttgcaaagagtcacgaataccagcttgagagttgggcagattcccagactagtagctgtctctgtgccgacgacgctaagacacatcactggaatatcaccgccgtaaaattagggcacataaattttacaatctcaaccaagattctcgactccaacgagccatgcggcggacaaaagggtttcgttccccagaaagggcgttctgacactctgatcaagccagtgctggtcaagccagaaggtgtcctggtggaaaaaacacacagttccctcctttgccccaagggcaaagtcgcatcagagtccgtgtctttggaacttcccgtcgatattgtcccggatagtacaaaggcttacgtgactgtactcggggacattatgggcacagcactgcagaatctggatggactcgtccaaatgccaagcggatgcggagaacagaacatggtactcttcgccccaatcatctacgtgctgcagtacctcgaaaaagccggattgttgacagaggaaataagatcaagagcagtcgggttcctggaaatcggataccagaaagaactgatgtacaaacactcaaatggatcttactcagcttttggagaacgggatggaaacggcaatacgtggttgacggcattcgttaccaagtgctttggtcaggctcagaaatttattttcatcgacccaaagaatatccaggacgcccttaagtggatggctggcaatcaactgccctccggatgttacgccaatgtcggaaatctgttacacacggcaatgaaaggtggcgtagacgacgaggtttctctcaccgcatatgtgacagccgcactgctcgagatgggtaaagatgttgatgatcccatggtgagccaaggcctgcggtgtctgaagaactccgccacttccacgacaaatctgtatacgcaggccttactggcatacatcttcagtcttgccggtgaaatggacatcagaaacatactgctgaaacagctggaccaacaggctataatctctggtgagagcatatattggagccaaaagcccactccaagcagcaatgcttctccgtggagtgaacccgcagccgtagacgtggagctgaccgcttacgcactcctcgcgcaactgactaaaccttccctgacacaaaaagagatcgccaaagccacttccattgtcgcttggctcgcaaagcagcacaacgcttatggcggttttagctcaactcaagataccgtggtcgccttacaagctcttgctaagtatgccacaactgcttacatgcctagcgaggagatcaatctggtggtgaaaagtaccgaaaacttccagcgaacattcaacatccagtctgtgaaccgcctcgtcttccagcaggacaccttgcctaatgtgcctgggatgtacactctagaggcaagcggccaggggtgcgtgtacgttcaaactgttctgaggtacaatattctgccacccactaacatgaagacttttagcttatctgtcgagatcgggaaagccaggtgcgagcagccgacctcacctcgttccctcaccctgaccatacatacctcttacgtcgggagccgcagctctagcaatatggccatcgtggaggtaaaaatgctgtccggtttctcaccaatggaagggacaaaccagctactactccaacaaccactggttaaaaaggtagaattcggcaccgacactctgaacatctatctcgacgagctgataaaaaacacccaaacctacaccttcaccatctcacagtccgtgcttgtgacaaacttaaagcctgccacgatcaaggtctatgactactatctgcccgatgagcaggcaacaatacagtactctgacccctgtgagtag

SEQ ID NO: 214147 - DNA, 3015 bp, Artificial Sequence
  Description of Artificial Sequence: Synthetic coding sequence
tctttcctcggaattcataggttgaacgggccacttaaatgcggccagccccaagaagtgctcgtcgactactacatcgatcctgcggacgcctctcctgaccaggagatcagtttttcatactacttgatcgggaaaggaagcctggtgatggaaggacagaagcatttgaattccaagaagaaaggccttaaggccagcttctccctctctttgacctttacctcccgcctcgcgccagacccttcccttgtgatttatgcgatttttcctagtggaggtgttgtcgcggataaaatccagttctccgtggagatgtgctttgataaccaagtgtcactgggattctctccttcccagcagttgcccggagccgaggtggaactccaactacaggcggcaccaggcagcctgtgtgctcttagggcagtcgacgagtctgtccttttactacgcccagatcgtgaactgtcaaaccgctctgtgtacgggatgttcccgttttggtacggccattacccttatcaggtggcggagtacgatcagtgtcccgtgagtgggccttgggactttcctcaacccctgatcgaccctatgccccaaggccattcatcacagagatcaatcatttggaggccctccttctctgagggtaccgacctcttcagtttcttccgagatgtggggttgaaaatcttatccaacgccaagatcaagaagccagttgactgtagccaccgctcccctgaatattccaccgctatgggcgcaggcggaggtcatccggaagccttcgagtccagtacacccttgcatcaagccgaagactctcaggtgcgtcagtatttccccgagacatggttatgggacctgtttccgataggcaattcgggtaaagaagctgtacatgtcacagttccagacgcgatcacggagtggaaggcgatgtcgttctgtacctctcagtcgagggggtttggactgagtcctacagttgggcttaccgcattcaaacccttttttgtggatctgaccctgccatattctgtggtgagaggcgagagcttccgtctgacagctacaatattcaactatcttaaagactgtattagagtccagactgaccttgctaagagccacgaataccagctagagtcctgggcggacagtcagacaagtagctgcctttgcgctgacgacgccaaaacacaccattggaatatcacagctgtgaagctcgggcatatcaactttacaatctcaacgaaaattctggattccaacgaaccctgcggagggcagaagggttttgtgcctcagaaaggcagaagcgataccctgataaagcctgtcctggtgaaacccgagggcgtcctggtcgagaaaactcattcctcactcctgtgcccaaaaggcaaagtagcttccgaatccgtgagccttgaactgccagtggacatcgtgccagacagcaccaaggcctatgtcacagtgctgggcgacattatgggaacagcacttcagaacttggacggcctcgtccaaatgcctagtgggtgtggggagcagaacatggtgcttttcgctcctattatctatgtcttgcaatacctggagaaggccggtctgctgaccgaagagatcagaagtagagccgtgggatttctggaaattggatatcagaaggaactgatgtacaaacacagcaacgggtcttactcagcattcggagaacgggacgggaacggcaacacctggttgactgcctttgtgacgaaatgtttcggacaggcccagaagtttatcttcatcgacccaaagaacatccaggacgcgctcaaatggatggctggtaatcagttgcctagtggatgctacgccaatgtgggtaatctgctccacacggccatgaaagggggtgtcgacgacgaggtgtccctgactgcctacgttactgccgcacttctggagatgggaaaggatgtggatgatcccatggtaagtcaggggctgcgttgcctaaaaaacagcgccactagcacaacgaatctttacacccaggccctgctggcttacatcttctcactagccggtgaaatggatattcgtaatatactgctgaaacagctggaccagcaggctataatcagcggcgagtcaatctactggagccaaaagcccaccccgagctccaatgcctcaccatggtccgagcctgctgccgttgacgtggagttaacagcctatgctctattagctcaactaacgaagccttcccttacccagaaggagattgctaaggcgacaagtattgtggcatggttggcaaaacagcacaacgcctatggaggctttagttctacccaagacactgtcgtggccctgcaggcacttgctaagtatgctacaaccgcatacatgcctagtgaggaaatcaatctggtggttaaatcgactgaaaattttcagcgcacctttaacatccagagcgtaaatcggctagtgtttcagcaggatacactgcccaatgtgcccggtatgtacaccttagaagcttccgggcagggatgcgtgtacgtgcagacagtcctaagatataacatactgccaccgaccaatatgaaaaccttcagtctttctgttgagataggtaaggccaggtgtgaacagcccacctccccgaggagcttaaccctcacaatccataccagctacgtgggatctaggagcagttctaatatggccattgtggaggtcaagatgctatctggcttttcccctatggagggcacaaatcaactgctcttacagcagccacttgtgaagaaggtggagttcgggactgacactcttaatatctacctggatgagctaatcaagaatacgcaaacttatacgtttaccatatcacaaagcgtcctggtcaccaacctgaagccggctactattaaagtttacgattattacctcccggacgagcaggctacgatacaatattctgacccatgtgagtag

SEQ ID NO: 214148 - DNA, 1830 bp, Artificial Sequence
  Description of Artificial Sequence: Synthetic coding sequence
atgaagtgggtggagtctatctttttaatcttcctgcttaattttacagagtcccggactctccaccgcaacgaatacggcatcgctagcatccttgattcttaccaatgtaccgccgagatctccttagccgatcttgctacaattttcttcgcgcaattcgtccaggaggcaacctacaaagaggtgtctaaaatggtgaaggatgccttgactgctatcgagaagccaacgggtgacgagcagtcttcagggtgtctggaaaatcaattgcccgcatttttggaggagctgtgtcacgaaaaagaaatactggagaagtatggccactcagactgttgttcacagagtgaggaggggaggcacaattgtttccttgctcataagaaaccaacccccgcatctatcccattgttccaggtgcccgagccggtcacatcctgcgaagcctacgaggaggaccgcgaaacctttatgaataagttcatctacgaaatcgccaggcgtcacccatttctgtatgcacccaccatccttctttgggccgctcggtacgataagattatcccctcttgctgcaaagcggagaatgcggtcgaatgctttcagactaaagccgctacagtgactaaggaacttcgcgagtcttctctgctgaatcagcacgcctgtgcagtgatgaagaacttcggaacccggacattccaggcgattactgttaccaagctgtcccagaagttcactaaggtgaattttaccgagattcaaaaactggtgctggatgtcgctcacgtgcacgaacattgttgcagaggcgacgtgctggattgcctacaggacggtgaaaaaattatgagctatatttgttcgcaacaggataccctgtccaacaagatcaccgagtgctgcaaactcacgaccctcgagcgcggacagtgtattatccatgccgagaacgatgagaagcccgaggggttgtctcctaatctgaaccgttttctgggagatagagacttcaaccagttttcctctggggagaagaacatctttctcgcctctttcgtccacgagtacagtagacgacatccacaattagcagtgtccgtaatactgagagtggcgaagggctatcaagaacttctcgagaagtgcttccaaactgaaaatccactggaatgccaggataaaggagaagaagagctgcaaaagtacatccaggagtcgcaagccctcgccaaacggagttgcggcctattccaaaagctaggagaatattatctgcaaaatgcctttttggttgcatacacaaagaaggcgccacaactaacctcttctgagctaatggccattacacgcaagatggcagctactgctgcgacatgttgccagctgtcagaggataaactcctggcctgtggagaaggcgcagctgacatcatcatcggacacctgtgtatacgccacgaaatgactcctgtgaatcccggagtgggccagtgttgcacatcaagctatgccaacagaaggccctgtttttcatcactagtggtcgacgaaacctacgtaccacctgctttctctgacgacaagttcatttttcataaggacctttgtcaggctcagggtgtcgcactccagaccatgaagcaagaattcttaatcaacctggtcaagcagaagccccagataaccgaggagcagttagaagcggtgatcgctgacttttccggtctacttgagaagtgttgccaggggcaggagcaggaggtttgctttgccgaggaaggccagaagctaattagtaagacaagggcagcccttggcgtctag

SEQ ID NO: 214149 - DNA, 3735 bp, Artificial Sequence
  Description of Artificial Sequence: Synthetic coding sequence
atgaataatcagaaggtggttgccgtgctcctgcaagaatgcaagcaggttcttgatcaactcctcctagaggctcccgatgtcagcgaagaagacaaaagcgaggatcaacgctgcagggcgctgctgccatctgaattgaggacccttatccaggaagcaaaggagatgaaatggccctttgtacctgagaagtggcagtataagcaggccgtcggtccggaggataaaacaaacttgaaggacgttattggagccggtctccaacaactgctggcctccctgagggccagtattttggcgagggactgtgccgcagccgctgcaatcgtctttctcgtggaccgatttctgtacggactagatgtttcgggcaagctcctccaagtcgccaagggcttacacaaactgcagcctgctacccccatagcccctcaggtagtgattaggcaggccagaatttccgtgaacagtggcaaacttttgaaagccgagtacatcctctccagtctgataagtaacaacggagctacaggcacctggctgtacagaaatgaatcagataaggttctggttcagtctgtttgtattcaaattcgaggccagattttgcagaaactcggtatgtggtatgaagcagcagagctaatctgggcaagcattgtgggataccttgcgctcccccagccagacaaaaaaggactgagcacgagcttgggcattctggccgacattttcgtatctatgtctaagaatgattacgagaagtttaagaataacccacaaattaacctgtctctgttgaaggaattcgaccaccatcttctgagtgccgcagaagcttgcaagctggccgctgccttcagcgcctacaccccattgttcgtcctgaccgccgtgaatataagggggacatgtctactatcatacagttcctcgaacgactgtcctcctgagttgaaaaatttacacctgtgcgaggccaaagaagccttcgagataggactgttaactaagcgcgatgacgaacctgtgacaggcaagcaggagctgcacagttttgtgaaggcggcttttggtctgacgaccgtacaccgaagacttcacggtgagaccggtacagtgcacgcggcatcacagctgtgcaaggaggccatggggaaattgtacaacttttcaactagctcccgttcccaggatcgagaagccctcagccaggaggtcatgagtgtgattgctcaggtcaaggaacatttgcaagtccagtcgtttagcaacgtggacgacaggtcctatgttccggagtcatttgaatgccgcctggataagctaattctccatgggcagggggacttccagaaaattctggacacatacagtcaacaccacacgtcagtgtgcgaggtcttcgaatcagattgtggaaataataaaaatgagcagaaggatgccaagacgggggtctgtattacagccctgaaaactgaaatcaaaaacattgataccgtcagcacgactcaggagaagccacactgtcagcgagatactggcatatcatctagcctgatgggtaagaatgttcagcgggaactgcgcagaggtggtcgccgtaattggactcactccgacgcattcagagtgagcttggaccaggacgtggaaacggaaacagagcccagtgactattccaacggcgaaggcgcagtgtttaacaagtctctgtctggaagtcaaacttcctcagcttggagtaatctgagcggattcagctcttcagcatcatgggaggaggtgaattaccacgtggacgatcgaagtgcacgaaaagaacctggcaaggaacatctggtcgatacgcagtgctctactgctctatccgaagagttagagaatgatagggaaggccgtgctatgcactcactccattcccaactgcacgatctctcactccaggaaccaaacaacgataacctggagcctagccaaaatcagcctcagcaacagatgccattgaccccattcagtccccacaatactccaggcattttcctggcacctggggctgggttactggagggtgcccctgagggaatccaggaagtgcgcaacatggggccaagaaataccagcgctcactcccggccttcctacagaagtgccagctggtcttccgattcaggacgtcctaagaatatgggaactcacccttctgtgcagaaggaggaggcttttgaaataatcgtggagttccctgagaccaactgtgatgttaaggataggcaaggaaaggagcaaggtgaagagatcagcgaacggggagctggcccaacattcaaagcgtccccatcttgggttgaccccgagggcgagaccgcagaaagcactgaggatgccccactcgatttccacagggtattacacaacagcttaggcaatatatctatgctgccttgctcatcgttcacaccgaattggccagtgcagaaccccgacagccgcaagtccggtggcccagtcgccgagcagggcatcgacccagatgcgagcacagttgatgaggaaggccagcttctggatagcatggatgtgccctgcacgaacggccacggtagccacaggctgtgtatcctgcggcagccgcctggacagagggcagagacacccaactcatcagttagtggcaacattcttttccccgtgctgtcggaggactgcaccactacggaagaaggtaaccagcctggcaatatgcttaactgttctcagaattctagcagcagttcggtctggtggttaaagtctcccgctttcagctcagggtcctcggagggagactcaccatggagttatctgaactcatcaggctccagctgggtgtccctgccaggaaagatgcgtaaggaaatactggaggccagaacccttcagcccgatgatttcgagaaactcctggcaggggtaaggcatgactggttgttccagaggctagagaacaccggtgtctttaagcccagccaattgcatagagcccatagtgcccttctgctgaaatattcaaaaaaaagcgaactctggacagcccaggaaacgattgtatacctcggggactacctcacggtgaaaaagaaagggagacagcgcaacgccttctgggtgcatcatttacatcaggaggaaattttaggcagatacgtgggaaaagattacaaggaacaaaaaggattgtggcaccattttacagatgtcgagcgccagatgacagcccaacactacgtcaccgagtttaacaaaaggctgtacgagcaaaacattcccacgcagattttctatatcccctccaccattctgcttatattagaagacaaaactatcaagggatgtatctcggtggagccttacatactgggagaattcgtcaagctaagtaacaatactaaggtggtaaagacagagtacaaagccaccgagtacggcctggcctacgggcatttttcttatgagtttagcaaccacagggatgttgtcgtggaccttcaaggctgggtcactggaaatggcaagggtctgatctatctaaccgatcctcagattcacagtgtagaccagaaggtgttcactactaactttggtaagagaggaatattttacttttttaataaccaacatgtagagtgtaacgagatctgccatcggctgtctctgacccggccatctatggaaaagccttgtacttag

SEQ ID NO: 214150 - DNA, 429 bp, Artificial Sequence
  Description of Artificial Sequence: Synthetic coding sequence
atgaataaccagaaagtcgtggccgtgctgctacaggagtgcaaggcccttttgccctcggagctccggaccctgattcaggaagctaaggagatgaaatggccttttgtgccagaaaagtggcagtacaagcaggcagttggcccagaggataagacaaacctgaaggatgttatcggggctgggctccagcagctgctggcctccctgcgcgcatccatcctcgctcgagattgcgcggctgccgcagcaatcgtcttcctagttgaccggttcctctatggcctggatgtgtcgggaaagctgttgcaagtcgctaagggactgcacaaactccagccagccacaccaattgccccacaggtggtcatacgacaagccaggatctctgtgaatagtggctcacatccggctaagcattccatgtag

SEQ ID NO: 214151 - DNA, 3735 bp, Artificial Sequence
  Description of Artificial Sequence: Synthetic coding sequence
atgaacaaccagaaagttgtcgccgtgctgctgcaagaatgcaagcaggttctcgatcagctcctgcttgaagctccggacgtctcagaggaggataagtctgaggatcagcggtgccgagccctgctacccagcgaactgaggaccctcatccaggaggccaaggaaatgaagtggccattcgtgccagaaaaatggcagtacaagcaagctgtgggacctgaagataaaactaatctgaaagatgtgatcggagccggtctgcaacaactgctggcctccttgcgcgcaagtatcctggccagagactgcgctgccgcagccgctatcgtgtttctggtcgataggtttctgtacgggcttgacgtttctggtaagctgttgcaggtcgccaagggcctccacaagctacaacccgctacgcctatcgcccctcaggtcgtgataagacaggcccgaatcagcgtgaatagtggcaagctactaaaagcagagtatattttaagcagtcttataagtaacaacggagctactggcacttggttgtatcggaacgaatcggataaggtgctggtccagtcagtctgcatccagatccgtgggcagatccttcaaaagctgggcatgtggtacgaggccgcagagctaatttgggcctctatcgtcggctatctcgctctaccccagcctgataaaaaaggcctgagtacatcccttggaattttagccgacatttttgtttcaatgtccaaaaatgactacgaaaaatttaagaacaatccccagatcaatttgagcctcctgaaggagttcgaccatcaccttctgtccgctgctgaggcgtgtaagcttgcagccgctttctctgcttatactccgttgttcgttcttaccgcagtaaatatccgaggcacttgcctactttcgtattcctcgtctaacgattgccctcctgaactgaagaaccttcacctgtgtgaggccaaagaagccttcgaaattggtttgctaacgaagcgggacgatgaacctgtgactggaaagcaggaactgcattctttcgtgaaagcagcctttggactcactaccgtccaccgcagactgcacggggaaacaggtacggtgcatgccgcatcccagctgtgtaaggaggccatgggaaagctttacaactttagtaccagctcccggagccaagaccgggaagctctgagccaggaggtaatgtccgtcattgcacaagtgaaggagcacctgcaggtgcagtccttctccaacgtggacgatagatcttacgtgcctgagtcttttgagtgccgactagacaagctgattttgcacggacagggagacttccagaaaatcctggatacttatagccagcatcacacatctgtgtgcgaagtcttcgagagcgactgtggaaacaacaaaaatgaacagaaagatgccaaaaccggggtgtgcatcactgccctgaagaccgaaatcaagaacattgatactgtcagtaccacacaggaaaaaccacactgtcagagggatacagggatttcaagctctttgatgggcaagaacgttcagcgggagctgaggcgcggtgggagaagaaactggacacactctgacgcattcagggtatcactggatcaggacgtggaaacagagaccgaaccttccgattatagcaatggcgagggagctgtctttaataagtcccttagtggtagtcagacaagcagcgcctggagcaatttgtctggattctcctcttcagcctcctgggaagaggtcaattatcacgtggacgaccggtccgcccgtaaggagcccggtaaggaacacctggtggatacgcagtgttccacagccctttccgaggaattggaaaatgatagagaaggtcgagctatgcactcacttcacagtcagctccacgatttatcacttcaggaacctaataacgataaccttgaacccagccaaaatcagccacaacagcagatgcccttgacccccttcagcccacataacacacctgggatatttctagcacctggtgcaggccttctcgagggagcgccagaagggatccaggaggtgaggaatatgggtccgaggaacacgtcagcacactcccgcccttcatacaggagcgcctcctggtcttccgactccggaagaccaaagaatatgggtacgcaccctagcgtgcagaaagaagaagcattcgagattatcgtggagtttccggagacaaactgcgatgtaaaagaccggcagggcaaggagcagggggaggagattagtgagcgtggcgctggccctacatttaaggcatccccatcatgggtggaccccgagggtgaaaccgctgagtctacagaagacgccccactggacttccatcgcgtcctgcacaattccttaggaaacatcagcatgttgccctgttccagctttacacccaactggcctgtgcagaatccggactctcgcaagagcggcggacctgtcgccgagcaggggatcgaccccgacgcctctaccgtcgatgaggagggccagctgttggattcgatggatgtgccgtgcacaaatggccacggtagtcacaggctctgcatcctgcgccaaccccctggccaaagggccgagacacccaattcttccgtctcagggaacattctattcccagtgttgagtgaggactgcactaccacggaggaaggcaaccagcccggaaatatgctgaattgctcacagaatagttcgagcagcagtgtatggtggctgaaaagtccagccttctcttccggcagctccgagggcgacagcccctggtcctatcttaatagttccggttcctcctgggtttctctccccggaaaaatgcgaaaagagattttggaagccagaaccctccagcctgatgacttcgagaaattactggctggtgtgcgacacgattggttattccagcggcttgaaaataccggggtctttaaaccctcacagttgcacagggcccactcagccctgcttctgaagtatagtaagaagtccgagctctggacagcccaagaaactatcgtgtatctaggagattatctcacagtgaaaaagaaaggtcggcagaggaatgcattctgggtgcaccacttgcatcaggaggaaatcctcggacggtacgtcggaaaggactataaagaacagaagggtctctggcatcacttcacagatgtcgaaaggcagatgaccgcacagcactatgtaactgaattcaataagcgcctgtatgagcagaacatcccaactcagattttctatatcccttccactattcttctaattctggaggacaagacaataaaggggtgcatttctgtggagccctacattctaggggagtttgttaagctgagtaacaacacgaaggtagtcaaaaccgaatacaaagcgacagaatacgggctcgcttatggtcacttcagctacgaattcagcaatcacagagacgtcgtggtcgatcttcagggttgggtaactggaaacggtaagggattaatctacttaaccgatccacagatccattcagtggaccagaaggtcttcaccaccaattttggcaagcgaggcatcttctactttttcaacaaccagcacgtggagtgtaacgaaatttgccacagactgagcctaacaaggccgagcatggagaaaccctgcacgtag

SEQ ID NO: 214152 - DNA, 3501 bp, Artificial Sequence
  Description of Artificial Sequence: Synthetic coding sequence
atgtgcaggaagaggacacgggctagaaccagcgcagcagaagctagcctgagggcgagcatcctagcacgcgattgtgctgccgcagctgccatagtgtttctcgttgatcgcttcctgtatggcctcgatgtctcaggaaaactcctacaggtagctaagggacttcacaagcttcagcccgcaactccaatcgccccacaggtcgtcatccgccaagctaggatttcagtgaattccggcaagctgttgaaagcagaatacatcctctcgtcccttatctcgaataacggggcaacaggcacatggctttataggaatgaaagtgataaagtgctggtgcaaagcgtgtgcatacagattaggggtcagatcctgcagaagttgggaatgtggtacgaggcagctgaactgatctgggcctccattgtggggtacctggctctgcctcagccagacaagaagggattaagcacctcattaggaatcttggccgacatcttcgtaagtatgagcaagaacgactacgaaaagttcaaaaataatccccagatcaacctgtctcttctgaaggaattcgatcaccatctactgagcgccgctgaggcttgtaaactggccgctgccttcagtgcttacactcccctcttcgttctgacagctgttaacataagaggcacatgcctgctctcatactctagcagtaacgattgtccaccagagctgaagaatctccatctgtgtgaagctaaagaggcatttgaaataggcctgctcacaaagcgcgatgatgagcctgtgaccggtaagcaggaactgcatagcttcgtcaaggcggcttttggactgacaacagtgcatcgccgactgcatggggagacaggtacagtgcacgctgcaagccagctttgcaaagaggccatgggaaaactctacaacttcagcacatcatctcgaagccaggaccgggaggccctctcacaagaggtgatgtcagtgatagcccaggtcaaggagcacctgcaagtgcaatccttcagcaatgtggatgatcggtcctacgtccccgagagctttgaatgccgtttagacaagctaatccttcatgggcagggcgactttcagaagatcctggatacatattcccagcatcatacctcagtttgcgaagtgttcgagagtgactgtgggaacaataaaaatgaacagaaggatgcgaaaacaggcgtgtgtatcaccgcgctcaagaccgaaattaagaatatagacaccgtatccaccactcaggagaagccacattgccagcgagacaccgggatcagcagtagcttgatgggaaaaaatgtccaaagagaactgaggagaggtgggcgaaggaattggactcattccgacgcctttcgcgttagtttggatcaggacgtcgaaaccgaaactgagccctcagactacagcaatggtgaaggggcagtgttcaataaatctctgagcggttctcagaccagctcagcctggtcaaatctatctggcttcagttccagcgctagctgggaggaagtgaattaccatgtggatgatcggagtgcaagaaaagagccaggtaaggagcacctggtcgatacccagtgttccaccgccctgagcgaggaactagagaacgaccgggagggaagggccatgcactcactccattctcagttgcatgacctctctctgcaggaaccgaacaatgataatctcgagccctctcaaaatcagccgcagcaacaaatgcctctgacccctttttcccctcacaacacgcccggtattttcttggcgccaggtgccggactccttgaaggcgctcctgagggcattcaagaagtgcgaaatatgggccctaggaacacttctgcccattctcgccctagctaccgctctgctagttggagctctgatagcggtagaccaaagaacatggggacccatccatccgtacagaaggaagaggcgttcgaaatcatcgtagagtttcccgaaacgaattgcgacgttaaggatagacagggaaaagaacagggtgaggagatctcagagcgtggcgcaggacccaccttcaaagcttccccttcctgggttgacccggaaggagaaaccgctgagtcaactgaggatgcccctctcgacttccaccgggtgctacataattctctggggaacatctcaatgctcccttgttcctcattcaccccaaattggccggtacagaatcccgattccaggaaaagcgggggtcctgtggctgaacaaggtatcgacccagatgcatctactgtagacgaggaaggccagctgttagatagtatggatgttccatgtacgaacggtcacggatctcataggctgtgcattctgcggcagccaccaggccagagagccgagaccccgaacagctctgtctccggtaatattctatttccagttctatccgaagattgtactaccactgaggagggcaatcagcctgggaacatgctgaattgcagccagaattcctcatctagctcagtgtggtggcttaaatctccggctttctcttccggctcaagcgaaggagatagtccctggtcctaccttaacagctccggctcttcatgggtaagcctgccaggaaagatgagaaaggagatcctcgaagcaaggaccctgcagcctgacgacttcgagaaactcctggccggtgtgagacacgactggctgtttcagagactggagaacactggggtgttcaaaccatcccaactgcatagggcacatagcgcgctgttgcttaaatactcaaagaaatccgaattgtggacagcacaggaaaccatcgtttatctgggagactacctgactgttaaaaaaaagggacggcagaggaacgccttctgggtgcaccacctgcaccaggaggaaatcctgggtagatacgtgggcaaggactataaagagcagaaggggctctggcatcactttactgatgtggagcgccaaatgacagcccagcattacgtgacggaatttaacaagagactttacgagcagaatatccctacccagattttttacataccgagtacaatcctgctgattctagaagataagactataaagggctgtatttctgtcgaaccttatatcctgggcgagttcgtgaaactctctaataatacaaaggttgttaaaacggagtataaggccacggagtatggactggcgtacgggcacttctcctacgagttctcaaaccacagggatgtggtggttgatcttcagggctgggtcaccggcaatggaaaaggcttaatttatctgacggacccccagatacattccgtggatcagaaggtcttcaccaccaactttgggaaaaggggcatcttctacttctttaacaatcaacatgtggagtgcaacgagatatgccacaggttgtcattgaccagacccagtatggagaagccctgtacttag

SEQ ID NO: 214153 - DNA, 1149 bp, Artificial Sequence
  Description of Artificial Sequence: Synthetic coding sequence
atggctttgcagggtatatccgttgttgagctatcaggtctggcccctggccctttctgcgcaatggtgctggccgactttggcgctagggtagtgagagtggatcggcctggctcccgatacgatgtgagccggttgggcagaggaaaacggtcattggtcctcgacttgaagcagcctagaggtgcagccgttcttcgaagactgtgcaagcgcagcgatgtgctgctggagccgttccgacggggagtaatggagaaattgcaactcggtccagaaatcctgcagagagaaaacccgagactgatctacgcacggcttagcgggttcggacagtccggaagcttctgcagacttgccggacacgacatcaactatctggccctctcaggtgtattgtccaaaattggaaggtcaggggagaacccttatgcacccttgaacttgctagccgattttgccggaggcggattaatgtgtgcgctggggattatcatggctctgttcgaccgcacacgtacaggcaagggacaagtgatcgacgctaacatggtggagggtactgcttatttatctagcttcctctggaagactcagaaactgtctctgtgggaggccccaagaggacaaaatatgctggacggtggcgctccattttacaccacatatagaacagctgacggtgagttcatggctgtgggggctattgagcctcaattctacgagttactcataaagggcctcggcctgaaatctgacgagttgccaaatcaaatgagtatggacgactggccagaaatgaagaaaaaatttgctgatgtgttcgcagagaagaccaaggccgagtggtgtcagatctttgacgggactgacgcttgcgtcacgccagtcctgacgtttgaagaagtggttcatcacgaccataataaggagcgcggatcgttcataaccagcgaagaacaagacgtgagccccagaccggcacctttactactgaacacccccgcaattccctcctttaagcgggacccattcattggcgagcacacagaagaaatccttgaggagtttggattcagccgcgaggaaatttaccaattgaattcagacaaaatcatcgagtcaaataaggtcaaagcttccttgtag

SEQ ID NO: 214154 - DNA, 597 bp, Artificial Sequence
  Description of Artificial Sequence: Synthetic coding sequence
atggcactgcaggggattagtgtggtggagctgtccgggctggccccagggcctttctgtgctatggtgctggccgactttggtgctcgggtcgtcagagtagacagacctggaagtagatacgacgtgtctaggctggggaggggcaagcgatcgctggtgcttgacctgaaacagcctaggggagcggctgttcttcgtcgtctgtgcaaacggtctgacgtgctcctggaacctttcagacgaggggtcatggagaagcttcaactgggcccagagattttacagcgcgaaaaccccagattgatctacgccagactaagcggatttggtcagagtggctcgttctgcagacttgccggtcacgatatcaattacctggccctatcgggtgggcgaaattctatatttaaatttttcagtgtcgagaattcagagatagagagtgtgggttccacctctcggactgagcacgtaggttggtggtccaccttcctgtacgatcttcaagattccagatggggcatccatgggtgctggtcaaatcggacgcctgttctgagggcagcagatcagcggacctggaccaaggtgtag

SEQ ID NO: 214155 - DNA, 690 bp, Artificial Sequence
  Description of Artificial Sequence: Synthetic coding sequence
atggctttgcagggtatctcagtcgtcgagctctctggtcttgccccaggccctttctgcgctatggtcctggccgacttcggggcacgcgtagttcgggtagacagacctgggagcagatacgatgtctcccggctggggagaggaaagcgatctttggtgctggacctgaaacagccaagaggtgccgcagtgcttcggcgtctctgcaaaaggagcgatgtgctgctagaaccttttagaagaggagtaatggaaaaattacagctgggacctgagattcttcagagagaaaatccacgcctgatctacgctcgactctcaggctttgggcaatctggctctttctgtcgcctagctggccacgacatcaactatttggctctgtctggaggacggaactccattttcaaatttttctctgtcgagaactctgagatcgagtctgtgggcagcaccagcaggaccgagcacgtcggatggtggtctacctttctgtacgatctgcaggatagccgctggggaattcacggatgctggagcaaccgaacaccagtgttacgggcagcagaccaacggtctcttataccgtactttaatctttatctgcagtttctgaacatttcgatgcagaacctttttaaggttcacaccctgctgcgaccctgttacttccttggtcaaaaatag

SEQ ID NO: 214156 - DNA, 1185 bp, Artificial Sequence
  Description of Artificial Sequence: Synthetic coding sequence
atggcacttcagggtatctctgttgttgaactgagcggactcgcacctggacctttttgcgccatggtcttggccgatttcggcgctcgtgtagtgcgggtggatagaccaggcagtcgttacgacgtgtctagattaggaagaggcaaaaggtcattggtgttggatctcaaacagccaaggggggctgcggtcctgagacggttgtgcaaacggtctgatgtactgctggagcctttcagaagaggagtgatggaaaaacttcagttaggaccagagatcctgcagcgcgagaacccaagactgatctacgctaggttgtcaggcttcggtcagtccggctctttctgtagactcgctggtcacgatatcaattatctcgcactaagcggcgtgctctctaaaatcggccgatctggcgagaatccctacgctcccctcaatctactcgcggactttgctggagggggtctgatgtgtgctctgggcataatcatggcactctttgaccgcacccggactgggaagggccaagtaatcgacgccaacatggtagagggcaccgcatacctgtcctcgtttttatggaagacccaaaaactctccttgtgggaagcccctcgcggacaaaacatgttagacggaggcgctcctttttacaccacctatcgtaccgcagatggcgaatttatggcggttggtgccatcgagccccagttctacgaactcctcatcaaaggcttaggcctgaagtccgacgagctgcctaaccaaatgtccatggatgactggccagaaatgaagaagaaatttgccgacgtttttgcagaaaagaccaaagccgagtggtgccagatctttgacggaaccgacgcctgcgtgacacctgtgctgacatttgaggaagtggtacaccacgaccacaacaaggagcgaggatctttcatcaccagcgaggaacaggacgtgagccctaggcccgcacctttgttgctcaacacgcccgctatcccatccttcaagcgcgacccttttatcggggagcatacagaggaaattctcgaggagttcggattttcccgagaggaaatatatcagttaaacagtgataaaatcatcgagtccaataaggctggctcaaaattctggatcctgtatccgacgcactccaacatacaaaaatag

SEQ ID NO: 214157 - DNA, 1002 bp, Artificial Sequence
  Description of Artificial Sequence: Synthetic coding sequence
atggcggcaggttgctgtggcgttaagaagcagaagctatcgtccagccccccttctggctctggcggtggcggtggcgcatcgtcatctagtcactgctcgggtgagtcccagtgcagggcgggagagcttgggctgggtggggcaggaactcgtctaaacggtttggggggattaacagggggaggatcaggcagtggatgcacgttaagtccacctcaaggctgcgggggagggggtgggggtattgcactgagcccaccgcctagctgcggggtcgggactctgctgtcaacacctgctgccgcaacgagctcctctccttcctcctcaagtgccgctagcagttctagcccgggtagtaggaaaatggtggtaagcgctgagatgtgctgcttttgcttcgatgtgttgtactgccacctatacggctaccagcaacctagaacaccacgatttacgaacgaaccatacccactgtttgtgacttggaaaattggcagggacaagagactgagaggctgtataggtaccttttcagctatgaatttacacagcggattaagagagtatacattaacatccgctttgaaagactcaagattcccaccaatgactcgggacgagctgcctagactgttttgtagcgtgtcattgctgaccaatttcgaagatgtgtgcgactatctggattgggaggtgggcgtgcacgggattaggatagagttcatcaacgagaagggcagcaagaggacagccacttatctcccggaggtcgcaaaggagcagggatgggaccacatccagacgattgactcgttactgcggaagggaggatacaaagctcctattacaaatgagttcaggaagacgatcaaactgaccagatataggtctgaaaagatgacccttagctatgcagaatacctggcacaccgccaacatcaccatttccagaatggaatcggacacccccttccaccctataatcattattcatag

SEQ ID NO: 214158 - DNA, 633 bp, Artificial Sequence
  Description of Artificial Sequence: Synthetic coding sequence
atggtagtatctgccgaaatgtgctgtttctgcttcgatgtactgtactgccatttgtacggctaccagcaacctagaacccccaggttcactaatgagccctatcccctgttcgtaacgtggaagatcggtagagacaaaagactgcgtggttgcattgggactttttccgcaatgaatttacattctggattgcgcgagtatactcttacttccgcactgaaggattctcggttcccgcctatgacgcgagacgaactgccaaggcttttttgctccgtttccctgttgactaacttcgaggatgtttgcgattacctggactgggaggtgggagttcacggtatcaggatcgagtttataaatgaaaaggggtcaaaacgcacagcaacatatctgcccgaagtggccaaagaacaggggtgggaccacattcaaaccatcgatagcctccttcgaaaaggcggatataaagcccctattacaaatgaattcagaaaaacaattaaactcacaagataccggtctgagaagatgacattgagttacgccgagtatctcgcgcatcgccagcatcaccacttccagaatggtattggccaccccttgcccccttataatcactattcttag

SEQ ID NO: 214159 - DNA, 891 bp, Artificial Sequence
  Description of Artificial Sequence: Synthetic coding sequence
atggctgccggatgttgtggtgtgaaaaagcagaagctctcctcctctcctccctctggctcgggtggcggaggcggagcaagctcctcatcccactgctctggggaatctcagtgcagagccggagagcttgggctgggtggcgctgggactcgattgaatggcctggggggattaactggtggagggagtgggtctggatgtacactctctcctccccagggctgcggcggaggaggagggggtatcgcactgtcgcccccaccttcctgtggcgtgggaactttgctgtctacacctgccgctgcaacgagttctagcccctcctcatcatccgccgctagtagcagcagccccggttcccggaagatggtggtgagcgccgaaatgtgttgcttctgcttcgatgttctgtattgccacctctatggctatcagcagccacggacaccacggtttaccaacgagccctatgccttgaaagactcacggtttcctccgatgactcgtgacgagctcccacgcctcttctgctcggtttctctgttaactaacttcgaagacgtgtgtgactatttggactgggaagtcggtgtgcacggaattcgaatcgagtttatcaacgagaagggctctaaacgtacggccacttacctgcccgaagttgcgaaagagcagggttgggatcatatacagaccatcgactcactgctcagaaagggagggtacaaggcaccaatcacaaacgaattccggaagaccatcaagctgacacggtatcggtcagagaaaatgacgctgtcttacgctgaatacctcgcacaccgtcagcatcaccactttcaaaacgggataggacaccccctgccaccctacaatcactattcctag

SEQ ID NO: 214160 - DNA, 2862 bp, Artificial Sequence
  Description of Artificial Sequence: Synthetic coding sequence
atgtgtaacccagaagaggctgccctgttgcggctagaggaagtgttttccgccaccttagcccatgtcaattcgctcgtgcttcagcctctgctcccagctgcgccagatcccagtgatccttgggggagagagtgcctccggctcctgcaacagttacacaagagctcacagcagttatgggaggtcacggaagaaagcttgcactctctccaggaacggctgcgctatccggattccaccggcctggagtctctgctcttgctgcggggagcggatagggtattacaggcccacattgaatacatcgaaagttatacttcctgtatggtggtacaggctttccagaaggcagctaaacgcaggtcagaatactggcggggacaacggaaagcactcaggcaattactcagcggagtatcttccgaggggtctgtgggtgcttccttgggccaagccctccaccagcccctggcgcatcatgtccagcagtatgtgctgctgcttctgtcgttgggggacaccataggggaacaccaccctacaagggagttggtagtcaatgccgtgacactgttcggtaatttacagagctttatgaagcaagagttggaccaggccgtcgcgacccaggccctctggcacacacttcgagggcgtctgcgggatgtactctgcactcctgcccataggctgttgcaggatagccaggatgtacccgtgactgtggcacccctgagagctgagagggtgttattgtttgatgacgctttagtgcttctacagggacacaatgtccacacgtttgacctgaaactggtctgggttgacccaggtcaagatgggtgcacattccaccttcttaccccagaggaggagttcagcttctgcgccaaagattctcagggccaagctgtgtggcagtggaaagttacatgggctgtccatcaggctctccacggaaagaaggacttccccgtgctgggcgctggcctggaaccctctcaaccccctgactgtcgctgtgctgagtataccttccaggcggagggcagactatgccaggcaacttacgaaggcgagtggtgccgtggcaggccacacgggaaggggactctcaagtggccggatggacggaatcacgtgggaaatttctgtcaaggtttggagcacgggttcggaattcgcctcctgccccaagcgtcggaggataaatttgattgttacaagtgtcattggagagaggggagcatgtgcggttacggcatctgcgagtattccacggacgaggtgtacaagggatacttccaggaaggactccgccacggttttggggtactagaaagcggccctcaggcaccacagccgtttaggtacactggacattgggagaggggacaacgcagcggctatggcatcgaagaagatggagataggggggaaagatacattggcatgtggcaggccggtcaacgacatggccctggagtcatggtcacccaggcaggggtgtgttaccaaggtaccttccaggctgacaagaccgtgggccctggtatacttctgtcagaggatgactccttatatgaaggaaccttcacacgcgacttgaccctgatggggaagggcaaggttactttcccaaatgggtttaccctggaagggagctttggaagcggggcaggacgcggactgcacacccagggggtcttagataccgcagcacttcccccagatcccagcagcacatgcaagcgtcaactcggagttggtgcctttccagtcgaatccagatggcagggcgtctacagtcctttccgggacttcgtgtgtgctggctgtccacgggatctgcaggaggccttgctggggtttgacgtccagagttcccgggagctacgccgatcacaggattatctgagctgcgagagaacccaccctgaggattcagtcggctcaatggaggacattctggaggagctgttacagcacagggagcccaaagccttgcagttgtacttaaggaaggctctgtctaactctctgcacccgctaggcaagttactgcgcaccttgatgctcacattccaggccacttatgctggagtgggagctaataaacacctccaggagcttgcgcaagaagaagtcaagcaacatgctcaggagttgtgggccgcttatcgaggtcttttgagggtcgctctggagcgaaaaggccaggcactggaggaggatgaagataccgaaacacgagacctgcaggtccatggcctcgtactcccacttatgctaccctctttttactccgagttgtttaccctctatctccttctgcacgagcgcgaagacagtttttattcccagggtattgccaacctatccctgttccctgacactcagctcctcgaatttctagacgttcagaagcatttatggccccttaaggacctcactcttacgtctaatcagaggtactcgctggttagagataagtgcttcttatcagccaccgagtgcctgcagaagattatgacaacagtggaccccagggaaaaactggaggtgctcgaacggacatacggagaaatcgagggaacggtgtcccgtgtgctcgggagagaatataagctccccatggatgacctactgcccctgctgatttatgtggttagtcgggctagaatccagcatttaggggctgaaatccacctgataagggacatgatggacccgaaccatacaggtggtctgtacgactttctgctgactgcacttgagtcatgctatgagcatatccagaaggaagatatgcgactgcatagactgcctgggcattggcactcacgagaactgtggtag

SEQ ID NO: 214161 - DNA, 903 bp, Artificial Sequence
  Description of Artificial Sequence: Synthetic coding sequence
atggaggacatcctggaggaactgctacagcaccgggagccaaaggctcttcaactgtatctgaggaaggctttgtccaatagtttgcacccgctgggcaaacttttgagaactttgatgctgacttttcaggccacatatgccggagtgggggcaaacaagcatctgcaagagctggcacaggaagaggtgaagcagcatgcacaggagttgtgggcagcatacagagggctgttgcgggtggctctggagcggaaaggccaagccctcgaggaggatgaggatacagaaactcgagacttgcaggtgcacggcctggtgctgccactcatgctgccctccttttactccgagctgtttacgctgtacctgctgttacacgagagagaagattctttttacagccagggcatcgcaaacctgtctctcttccctgacacacagttactcgagtttttggatgtccaaaagcacctgtggccactgaaggatcttaccctgactagtaaccagagatattcactggtcagagacaagtgttttttgtctgccacagaatgtttacagaagattatgaccactgtggatccccgagagaagctggaagtgctcgaacgaacctatggggaaatagaggggacagttagtcgcgtgctcggtcgtgaatataaattacccatggacgacttgctacccttgctgatttatgtggtgtcacgagctcggattcaacatttaggagcagagatccacctcatcagagatatgatggaccctaatcacacagggggattatatgacttcctcctgacagctcttgaatcctgctacgaacacatccagaaagaggacatgagactccaccgtttaccagggcattggcatagccgggaactatggtag

SEQ ID NO: 214162 - DNA, 2862 bp, Artificial Sequence
  Description of Artificial Sequence: Synthetic coding sequence
atgtgcaatcccgaggaagcagcactccttaggttggaggaggtgttcagtgcaacactagcacatgtgaactctctcgtcctccagccgttgttacccgctgcaccagaccctagtgatccgtggggccgtgagtgtctaagactcctgcagcagttacataagtcctcacaacaactgtgggaggttacagaggaaagcctccactccctgcaggaaaggttaagatatccagacagcactgggttagaaagcttgctcctcctcaggggcgctgacagagtcctgcaggcccatatcgaatacattgagtcctacacctcttgtatggtcgtgcaggctttccagaaagctgccaagcgtcgatctgaatattggaggggccaaaggaaagccttacggcaactgctgagcggcgtttcgtcggaaggtagcgtgggcgcttcactgggacaagcgctgcaccagcctttagcacaccatgtgcagcagtatgtcttgcttctgctttctcttggagatactataggggagcaccatcctacacgagaactggtcgtcaatgcagtgaccctgttcgggaacctacagagtttcatgaagcaggagctggaccaggcggtagcaactcaagcgctgtggcatacacttcgcggacgcctccgggacgttctatgtacgcccgcacataggctcttgcaggacagtcaggatgtgcccgtcaccgtcgcacctctcagagccgaaagagtactccttttcgacgatgccctggtgctcctccaaggacacaacgtgcacacattcgatctgaaactcgtgtgggttgacccagggcaggatgggtgtactttccacctcctcactccagaagaagaattttcgttttgcgctaaggattcgcagggccaagctgtgtggcagtggaaggtgacgtgggctgttcatcaagctctgcacggaaagaaagattttcccgttctgggcgcaggactcgagccctctcagccacctgactgcaggtgcgccgagtacaccttccaggctgagggaaggctgtgccaggccacgtacgaaggagaatggtgtcgcggacggccacatgggaaggggacactgaagtggccagacggccgaaatcacgtcggaaacttctgccaggggctggagcacggattcggtatccgactgctgccccaggccagtgaggataaattcgattgctacaagtgccactggagggaaggaagcatgtgcggttatggtatttgtgagtactccacggacgaagtgtacaaaggctatttccaagagggcctaagacacggattcggtgtgctggaaagtggcccacaggcaccccagccctttcgctacactgggcactgggaaagaggccagaggagtggatacggtattgaggaggatggtgatcgcggtgagcgatatataggtatgtggcaggccggacaaaggcatggccctggcgtgatggtgacacaggcaggtgtatgctaccaagggaccttccaggccgacaagaccgtgggtccaggcatactgctgagcgaggacgattccctttatgaggggactttcacccgggacctgactttaatgggaaaggggaaggtgacatttcctaacggcttcaccttggagggtagttttggctcgggcgcaggaaggggcttgcatactcagggcgtcctcgacacagccgctctcccaccagacccctcatcaacgtgtaaacgccaactgggggtgggagcctttccggtggagtcaaggtggcagggggtttatagcccctttcgggacttcgtgtgcgccggttgtcctagggacctgcaggaggctctgctcggcttcgatgtgcagtcctcccgcgaactacggcgttcccaggactacctgtcttgtgagcgcacacatccggaggactcagtcgggagcatggaggacattctggaggaactactgcagcaccgagagccgaaggctctgcagctctacctccgaaaggcactcagtaatagcttacaccccctcggtaaactcctgaggactctgatgctgacatttcaggccacctacgctggagtgggagccaacaaacatctacaggaactcgctcaggaagaggttaaacagcacgcccaggagctctgggctgcatatagaggattgctgcgcgtcgctcttgagaggaaggggcaggcccttgaggaagacgaggacactgagacacgggacctgcaagtccatgggctcgttctccctttgatgctcccaagcttttactccgaattgttcacactgtatctcctgctacacgagagagaagatagcttttactcgcagggcatcgccaacctttctctgtttccagacacccagctcctggagttcctggatgttcagaagcatctctggccactaaaggatcttaccttaacgtcgaaccaacggtactcactggtccgtgacaaatgttttctgtcagctactgagtgtctacaaaagatcatgaccacagtcgaccccagagagaagttggaagtgctagaacggacttacggcgaaatcgagggtaccgtgagccgagtactgggcagggagtacaagttgcctatggacgatctgctcccactgttaatctacgtcgtgtcacgtgcacgcatccagcacctcggcgcagagatccacctcataagagatatgatggacccaaaccatacaggaggactgtacgactttcttctcacggcactagaatcgtgttacgaacatatccagaaggaggatatgagactgcacaggcttccgggtcattggcactccagggaactgtggtag

SEQ ID NO: 214163 - DNA, 12504 bp, Artificial Sequence
  Description of Artificial Sequence: Synthetic coding sequence
atggagccagaggacctgccttggcctggggagcttgaagaggaagaagaggaggaagaagaagaagaggaggaggaggaggaagccgcagcagccgcagctgctaatgtcgacgacgtggtggtggtggaagaggttgaggaggaggcgggtagggaactcgatagcgatagtcattatgggccacaacatctcgagtcaattgacgatgaagaagacgaagaagccaaggcatggctgcaagcgcacccaggacgcattttaccccctctgtcccccccacagcataggtattcagagggagagaggaccagtctcgaaaagatcgtgcctctcacctgtcacgtgtggcagcagatcgtgtatcagggaaatagcaggacccagattagcgacaccaacgttgtttgtctggagactacagcccaaaggggctccggtgatgatcaaaagacagaatcatggcactgtctcccacaggaaatggacagctctcaaactctagacacttcccagacacgctttaacgtgcgtaccgaggacaccgaggtgaccgatttccccagcctcgaggaaggaatccttacccagagcgaaaaccaagtgaaagaacctaatcgggatctattttgtagtcctctgctggtaattcaggacagttttgctagcccagaccttccgctgttgacctgtctgactcaagatcaagaattcgctccagactcattgtttcaccagtcagagctgtccttcgcaccgctcagaggaattcccgataagtctgaagatactgagtggagcagcaggcctagcgaggtttcagaggccctctttcaggcgactgctgaagttgccagcgacctggcatcgagtcgattctcagtttctcagcatccactgatcggcagtaccgccgttggctcccaatgcccgtttctgccctctgagcagggtaataatgaagaaaccatatctagcgttgatgagctaaaaatccccaaagactgcgatagatacgacgatctctgtagctacatgtcatggaaaacacgcaaggacactcagtggcccgaaaataatctggcagacaaggaccaagtttccgtggctactagctttgatattactgatgaaaatatcgctacaaagaggagcgatcactttgacgctgcccgatcttacggacagtattggacccaggaggattcaagtaaacaggcagagacctatctaaccaagggactacaggggaaagtcgagagcgatgttattacgctcgatggactgaacgagaacgccgtggtgtgttctgagcgcgtcgcagagctgcaacgcaaaccaacccgtgagtccgagtatcacagctcagaccttcggatgctacgcatgagccctgataccgtccccaaggctccgaagcacctgaaagcaggagatacgtccaaaggcggtatagcaaaggtcacccagtcaaatctcaaatccggaatcactacaacccctgtcgacagcgacattgggtcgcacctgagcttgagtctggaggatctctctcagctggccgtgagcagccttgaaactacgacaggccagcacacagatactctcaaccaaaaaacgctcgctgacacccacctgactgaagagacgctgaaggtgaccgctatccccgagccggcagaccagaagactgccactccaaccgtactttccagcagccatagccacagaggcaagccatcgattttctatcagcaggggttacctgactcacacctcaccgaggaagccttgaaggtttccgccgctccgggactggccgatcagacaacaggcatgtcaaccttgacctctacttcctatagccaccgtgagaaacctgggactttttatcagcaggaactgcctgagtctaacttgacggaggaaccactggaagtgtcagctgctcctggcccagtagagcagaaaaccggcattcccactgtttccagcactagtcacagccacgtggaagatctcctatttttctatcgtcagacattaccggacggacacctaactgatcaggcactcaaggtgtctgcagtttctggcccagctgaccaaaaaaccggcactgcaacggtacttagcactccacacagccatcgggagaagcctgggatattttaccagcaagaattcgcagactcccaccagactgaggaaaccttaaccaaagtgtcggcaacacctggccctgccgaccagaagacggagatccctgcggttcaaagtagctcctatagccagcgcgaaaagccttcgatcctgtatccacaggatctcgccgattcccatcttccagaagaagggctaaaagtgagtgcagtggcaggccctgccgatcagaaaacaggcctaccaactgttccatccagtgcttacagccatcgcgaaaagctcttggtgttctaccagcaggcactgctagattctcatctccctgaagaggctctgaaggtgagtgcagtctcaggcccagcagacggaaaaacggggacacccgctgtcacctctacctcgagcgcaagttcttcactgggtgaaaagccatccgcattttatcagcagacattacccaatagtcacctaaccgaagaggcgctcaaggtaagcattgtgccgggaccaggcgatcagaagacaggaataccatctgccccaagctcattctattcccatcgagaaaagccaatcatcttctcacagcaaacccttcccgactttttgtttccggaagaggccctcaaggtttccgctgtcagtgtcctggctgcgcagaaaacaggaaccccaaccgtctcgagcaatagccattcccattctgaaaaatcaagtgtcttctaccagcaagaattgccagattccgacctccctcgggaaagcctcaagatgtccgccatccctggacttacagatcagaagaccgtgcctacacctactgtaccctccgggagcttctcccacagagagaaacctagcattttctaccaacaggagtggccagattcttacgctacagagaaagcactcaaagtgtccaccgggcctggcccagcagaccagaagacagagatacctgcggtgcagtctagcagttatccccagcgggagaagcctagcgtgctgtatcctcaggtgcttagtgacagccacctgcccgaggaatcccttaaggtcagcgccttccctggaccagccgatcagatgactgacactccagcagtacccagtactttctactcacagcgcgaaaagccaggcatcttctaccagcaaactctccctgaatcccatctaccgaaagaagccctcaagattagcgtggccccaggcctggcggatcagaagacggggaccccaacagttacgtcaacgtcatactcccagcaccgtgagaagccctccatcttccatcagcaggctctgcccggtactcacattccagaggaggcccagaaggtgtcagcagtgaccggacctgggaaccaaaaaacctggatcccacgggtgttgtctactttctactctcagagagagaaacctgggatcttctatcagcagacactgccaggatctcacatccctgaggaggcccagaaagttagcccggttttgggcccagccgatcagaaaacgggcaccccaaccccaacatccgcctcctactcccacacagaaaaacctggaatcttctaccagcaagttctgccagataatcatcccacagaagaggcacttaagatcagcgtagcttccgagccagtcgatcagaccactggaactcccgcagtgacttcaacctcctactcccagtatcgggagaaaccatcaatattttaccagcagtcactgccttcaagtcatctaactgaggaggcaaagaatgtgtctgccgttcccggtcccgctgaccagaaaacggtgattcccattctgccatcaacattttactctcatacagagaaaccaggagtgttttatcagcaggtgctgccacatagccatccaacagaggaggcgcttaagatctccgttgcgtccgaacctgtggaccagaccactggcacaccaaccgtcacatctactagttattcccaacacacagagaaacctagcatattctaccagcagagccttcccggaagccatctcaccgaagaggccaagaatgtgtcggccgtccctgggccaggcgatcggaaaaccggcataccaactctgccaagtactttttacagtcacaccgagaaaccgggaagcttttatcagcaggtgttaccacatagtcatctgcctgaagaggccttggaggtgtccgtcgccccaggcccagtggatcagacgattggcaccccaactgtgacatctccctcatcatccttcggagagaagcccatcgtcatctataaacaggcattccctgaaggtcacctgccggaggaaagcttgaaggtttctgtggctccagggcctgttggccagaccaccggggcaccaactattacgagtcccagctattctcaacatcgtgctaagagcggctcattttaccagctggcccttcttgggtcccagattccagaagaagcactgagggtcagtagtgctcccggacccgctgaccagactaccggcattccaaccataactagcacctcctattccttcggtgagaagcctatcgtcaactacaagcaagcgtttccggatggccatcttcctgaagaggctctaaaggtctcgatcgtgtccggtcctaccgaaaaaaaaacggatattcccgctggccctcttgggagctcggcactaggggagaaacccattaccttttacaggcaggcccttctagatagtcccttgaataaagaagttgtgaaagtgtcagccgctccgggacccgctgatcaaaaaacagagaccctccctgtgcatagtacgtcttactcaaaccggggaaaacccgtgatcttttatcagcagaccctctcagacagccacctacccgaggaagcactgaaggttccacccgtccccggtcccgacgcccaaaaaactgagaccccatccgtgtcgagcagcctgtatagttatcgcgaaaaacccattgtgttctatcagcaggcactgcccgacagcgaacttacccaggaggcactgaaggtgtctgcagtcccccagcccgcagatcagaagacaggccttagtacggtaacatctagcttttattctcatactgagaaacctaacatctcttaccagcaggagttgccagattcacacctcacagaagaggctctgaaggtgtccaatgttcccggaccagcggatcagaagaccggagttagcaccgttactagtacctcttatagccatagagaaaagccaatcgtgtcataccaacgcgagctgccccacttcaccgaggcaggccttaaaatccttagggtccccggaccggcagatcagaaaaccggaatcaatattctcccctctaacagttacccccaacgtgagcacagcgtgatctcgtacgagcaggagctcccagatctgactgaggtgacccttaaggctattggcgtaccaggtcctgctgatcagaagacgggcattcagatcgcatcttcttccagctactctaaccgtgagaaagcctcaatttttcaccagcaagaactgccggatgtcacggaagaagcacttaatgtgtttgtggtgccaggacagggagataggaagacggaaatcccaaccgtacccctttcttattattcccgacgtgagaagccttctgtgatttctcagcaggagctgcccgacagtcatctgacagaagaagcgctcaaggtctcccctgttagcatcccagccgaacagaagaccggcatccctatcggcttgtccagtagctattcacactctcataaagaaaagctgaagatttccaccgtgcacattccggatgatcagaagaccgagtttcctgcagccactctgagtagctactcccaaattgaaaagccaaagatctcaacagtaattggccctaacgaccagaagacacccagccagaccgcatttcattcatcatattctcagaccgtcaaaccgaacatcctcttccagcagcagctgcctgatagggatcagtccaagggcatccttaagatttcagcggtgcccgagctgacggacgtcaacacaggaaagcctgtgagtctgtccagttcctacttccaccgcgagaagtcaaatatcttcagtccacaggaattgcctgggagtcacgtcacagaggacgtactcaaagtgagcacgatcccaggtcccgctgggcaaaagactgtcctgcccacagcactgccatcctcattctcacatagagagaagcctgatatattttatcagaaggatctgcccgatagacacctgactgaggatgcactaaaaatctcttctgcgctggggcaagccgatcaaattacaggattacaaaccgtgccctcaggtacctacagtcacggtgaaaatcacaaactggtttcggaacacgtgcagcggctcatcgataacctgaacagttctgattccagcgtgagttcaaataatgttctgctgaattcacaggcggatgacagagtggtgattaataaaccagagtctgccggtttcagggacgttggttcggaagaaatccaggatgccgagaatagcgccaaaacgctgaaggaaatccgaacactcctgatggaggccgagaacatggccctgaagaggtgcaattttccagcacctttggccaggtttagggacatatccgatatttcttttattcaaagcaagaaggttgtgtgcttcaaggagccttcgagcaccggcgtcagcaatggcgatctgctccaccggcagccattcacagaggagagccccagctcgcggtgtattcaaaaggatatcgggacgcaaacaaaccttaagtgccgtcgcggaatcgagaattgggagtttatatcctctaccacagtaagaagtccattgcaggaagcggaatctaaggtatctatggccctagaagagactctgcgacagtaccaagcagccaaaagtgttatgcggtcagagcctgagggctgtagcgggacgataggaaataagattattatcccgatgatgacagttataaaatcagactccagttcggacgcctctgacggtaacggctcttgctcttgggacagcaatttaccagagtcactcgagtcagtctcagatgtcttactcaatttttttccgtatgtgtcgcccaaaactagcatcacggattcccgggaggaggaaggagtctcagagtctgaagatggaggcggaagctccgtcgatagtttagctgcccatgttaaaaaccttttgcaatgtgagagcagtttaaatcacgcgaaggagatcttaaggaatgccgaggaggaggagtcacgcgtgcgcgcacacgcctggaacatgaagttcaacctggcccatgactgtggatatagtattagcgaacttaatgaggacgacagacgaaaggttgaggagatcaaggccgagctctttgggcacggcaggactactgacctgagtaaaggcctgcagtcacccagaggaatgggctgcaagccagaggcagtctgttcccatattatcattgaaagccatgagaaggggtgttttcgcactctgacttctgagcatccacaacttgacaggcatccctgcgccttcaggagcgccggtccaagcgaaatgacccggggacgccaaaatccctcttcttgccgagctaaacatgttaacctgagtgcttcccttgatcaaaataacagccactttaaagtttggaattccctgcagctgaagtcacacagtccctttcagaacttcatacccgatgagtttaagattagcaaaggcttacgcatgccctttgatgagaaaatggacccatggctcagcgagcttgtcgagccagccttcgtacccccaaaagaggtggactttcattcctcgagccagatgcccagcccagagccaatgaaaaagttcactacatctataaccttcagctcacaccggcatagcaagtgcatcagcaattcaagcgtggtcaaggtgggggtgacggaggggtcgcagtgcacaggcgcttcggtcggtgtcttcaacagccatttcactgaagagcagaatcccccacgtgatcttaagcagaagacttcttccccatctagcttcaaaatgcactcaaattcccaggataaagaggtcacgatcctcgctgaaggaaggcgccagagtcagaagctccctgtcgatttcgagagatcattccaggaggaaaagccactggagcggagcgattttaccggctcacatagcgagccttccacgagagctaattgctcgaatttcaaagagattcaaatctcagacaatcacaccttgattagcatgggccgaccgtccagtactctcggagtcaaccgctcaagctcccggcttggcgtgaaggaaaagaatgttacaatcactcccgaccttccatcctgcatcttcttggagcagagggaactatttgagcaatctaaggcaccacgggctgacgaccatgtgcgaaagcaccattccccttcaccacagcaccaggactatgtggctccagacttgccttcctgcatattcctggaacagagagagctgttcgaacagtgcaaagctccgtacgttgaccaccagatgcgggagaatcacagccctctgccacagggtcaggacagcatcgcatcggatcttccctcaccaatcagtctggaacagtgtcaatcaaaagcccctggcgtcgacgatcaaatgaacaaacaccactttccactgccgcagggtcaagactgtgtcgtcgagaaaaacaatcagcataagccaaagtcccatatctccaacataaatgtcgaggctaagtttaacaccgtcgtcagtcagtcagcccctaaccactgcactttggccgcttctgcatcaactcccccatccaatcggaaagcgttatcttgtgtgcatattacattgtgccctaagactagtagcaagcttgactccggaaccttagatgagcgctttcactccttggacgccgcatcaaaggcccgaatgaactcagagtttaattttgatctgcacactgtctcatctcggtcactggagcctacgtccaagttgttgaccagcaagccggtcgctcaggaccaggaaagcttaggtttcctaggacctaagtcctcactggactttcaggtggttcagccatccctccctgactccaataccatcacgcaggatctgaagacgattccaagccaaaacagccagatcgtgacctctcggcagatccaggtgaacatcagcgatttcgagggtcattccaaccccgaagggacacccgtttttgccgatcgactgcctgaaaagatgaagacaccattatccgctttcagtgaaaaactttcctccgacgctgtcacccagattaccactgagagccccgagaagaccttattcagtagtgaaatcttcattaacgccgaggatcggggacacgaaattatagaacccggtaatcagaaattacgcaaggcacccgttaagttcgccagttcaagctcagtccagcaggtgaccttttctcggggtactgacggccagcctctgctactcccctacaaacccagtggatctactaagatgtattacgtgcctcaactccgccagatacctcctagccctgattccaaatctgatacgaccgtggagtctagccactccggctcaaatgacgcgatagcacctgattttcctgcccaagtgctagggacccgcgacgacgatctgtcagctacggtgaacataaagcacaaagaaggaatatacagcaaaagggtggttaccaaggcgagtctgcctgtcggcgagaaaccattgcagaacgagaacgcagatgccagcgtgcaggtgctgatcaccggcgacgagaacctcagcgataagaagcagcaggaaattcattcaactcgagccgtcaccgaggcagctcaagcaaaagagaaagaatcacttcagaaggacacagccgactctagtgccgcagcggcagccgagcactctgcccaggttggagatcccgagatgaagaacctgcccgacacgaaagcgatcacgcagaaggaggagatccacaggaaaaagactgtgccggaggaggcttggccaaataataaggagtctctgcaaattaacattgaggaatctgagtgtcatagcgaatttgaaaataccacccgatccgtgtttagaagtgccaaattttacattcatcatcccgtacatttgcccagcgaccaggatatctgccacgagagcctgggcaaaagcgtatttatgaggcactcatggaaagatttctttcaacatcacccagacaagcaccgagagcatatgtgtctgcccctgccttaccagaacatggacaagaccaagacagattacacgcgaattaaaagcctcagcatcaacgttaacctgggaaataaggaggtgatggacaccactaagtcgcaagtgagagattaccctaaacataacggacagatttcagacccccagcgagatcagaaggtgacccctgagcaaaccacccagcatacagtttcccttaacgaactatggaacaagtacagagaaagacagaggcaacaacggcagccagagctaggcgaccggaaggaactgtccctggtcgaccggctcgataggctcgcaaagatcttgcaaaaccccattacacattcgctgcaggtcagcgaaagcacgcatgatgacagtcggggtgagcggtcagtgaaggaatggagtggtcggcagcagcagcgtaacaaattacaaaaaaagaaaagatttaaaagcctggaaaaatcccacaagaacaccggcgagctcaaaaagagtaaagtactgtcacaccacagggccggaagatctaaccaaataaagattgaacagatcaagttcgacaagtacatcttgtccaagcagccaggattcaactatatatcaaatacctccagcgattgccgaccaagcgaagagtcagagctgttaaccgacactactactaatattctgtccggaaccacgagcacagttgagagcgatatcctcacgcagaccgacagggaggtagccctccacgaaagatcatcaagtgtgtctactatcgataccgcacggctgatccaggcattcgggcacgagagggtgtgtctgtccccgagaaggatcaaactctactcatctataacgaaccagcaacgcaggtatctggaaaaacgctccaagcactcaaagaaagtccttaacaccggacaccctttggtgacatccgagcatacgagacgacgccacattcaggtcgctaaccacgtgatttcatccgactctatcagtagctccgcctcctcattcctgtcttctaatagcaccttctgtaacaaacagaatgttcacatgctgaataagggaatccaagcagggaacctggagattgttaatggcgctaagaagcatacgcgcgacgtcggcataaccttccccacaccctcctcttccgaagcaaagctggaagaaaacagtgatgtcacgagttggtccgaagaaaaacgggaggagaaaatgctcttcacagggtaccccgaggatcggaagctgaagaagaacaagaaaaattctcacgaaggcgtcagttggtttgtccctgtcgaaaatgtggagagcaggagcaaaaaggagaatgtacctaacacttgcggacctggaatctcttggtttgagccgattaccaaaacccgcccatggcgcgaacctctgagagagcagaattgtcagggtcagcatctggacggtaggggttacctggctggacctggaagagaagctggcagggacctgctacgcccattcgtgcgtgccacgttgcaagagagtctacagtttcatagacccgattttatcagccggagcggggagcgaatcaaaagattaaagctgatcgtgcaggagcgcaaactccagtccatgctacagactgagcgcgacgctctattcaatattgaccgggaaaggcaagggcaccagaatcgcatgtgtcccctgcccaagcgcgtctttctcgcaattcagaaaaataagccaatcagcaaaaaagaaatgatccagcggtctaagaggatatacgagcaactccctgaagttcagaaaaaaagagaagaagagaagcggaaaagcgaatacaagtcctatcgactcagggcgcagctctacaagaaaagagtgacaaaccagctactgggaaggaaagtgccatgggattag

SEQ ID NO: 214164 - DNA, 7685 bp, Artificial Sequence
  Description of Artificial Sequence: Synthetic coding sequence
atggagcctgaagacctgccctggcccggagagctcgaggaggaagaggaagaagaagaagaagaggaggaagaggaagaggaagccgctgccgctgccgcagcaaacgtcgatgacgtcgtggtggtggaagaggttgaggaggaagccggacgtgaacttgactcagattcccattacggcccacaacatctcgaatctatcgatgatgaagaggatgaggaggccaaggcctggttgcaggcccacccgggaagaatactcccaccgttgtccccacctcagcaccgctacagcgaaggggaacgtaccagcctcgagaaaatcgtccctctgacatgtcatgtctggcaacagattgtgtaccagggtaacagccggacccagatctcggacactaatgtagtgtgcctggaaaccactgcacagagagggtcgggcgacgaccagaagaccgagagctggcattgtctcccgcaggaaatggacagtagtcagaccctggatacttcccaaacaagattcaatgttcgcaccgaggataccgaggtcacagattttccatcccttgaggaaggtattctgacacaatctgagaaccaggtcaaggagcctaatcgagaccttttttgttcacccttactcgtgatacaggatagttttgcatcccctgatctgcctctgcttacctgcctaacccaggaccaggagttcgcacctgattcactgtttcatcagtcagagcttagtttcgccccactcagaggcattcccgacaaatcagaggataccgaatggagctcccgcccttctgaggtgagtgaagcactgttccaagccaccgctgaagtcgcatcagatttagcaagttcaaggttcagcgtatcccagcatcccctaatcggcagtactgccgtgggatcccaatgccccttccttccttcggagcaagggaacaacgaagaaacgattagcagtgtggatgaactgaaaatacccaaggactgtgacagatacgacgacttatgctcctacatgagctggaagacccgcaaggacactcagtggcctgagaacaacctggctgacaaagatcaggtgtccgtggcgacttcatttgatattaccgatgagaacattgccacaaaacggagtgaccacttcgatgctgctcgaagttatggccagtactggacacaggaagattcttccaagcaagccgagacttacttgacgaaaggtctccagggtaaagtggaatcagatgtgataactttggatggattgaacgagaatgccgttgtatgttcagagagagtcgcagagttacagcgaaaaccaacccgggaatccgagtatcacagctccgacctgcgaatgcttagaatgtctccggacaccgtccccaaagcccctaagcacctgaaggctggggacacatctaaaggcggaatagctaaagtgacacaaagcaatctcaagtcaggcataacaaccacaccagtagattcggacattggaagccatttgtccttatcgctggaggatctgagccaacttgcggtcagcagtctggaaacgaccactgggcagcacaccgatacgctgaatcaaaagacacttgccgacactcacctaaccgaggaaactcttaaggttaccgctattcccgagcccgctgatcaaaagaccgccacacctacagttctctctagctcacattctcacaggggaaaacctagcattttttaccagcagggactgccagactcccatttgactgaagaggccctgaaagtgtccgccgcacccggacttgctgaccagaccactgggatgagtactctgacaagtactagttacagccaccgagaaaagccaggaacattttaccagcaagagctgcctgagagcaatcttactgaagaacctctggaggtgtcagcagccccaggaccagtggagcagaaaacaggaatccccaccgtgagctccaccagtcactcacatgtggaggacctgttgttcttctaccgccagacactacctgacgggcacttgacagatcaggctttaaaggtttccgccgtttctgggccagccgaccaaaagacggggaccgctaccgttctttcaactccccacagtcatagagaaaaacccggtattttttatcagcaagaatttgccgactcacatcagacagaagagacgctaacaaaggtgagcgctacacctggccctgcagatcaaaaaacagaaatccctgctgttcagagctcgtcctacagccagcgggagaaaccatccatcttatatcctcaggacttggctgacagccacctgccagaggaggggctgaaagtcagcgcagttgccggaccggcagaccagaaaactggtctgcccacggttcctagcagtgcatactcccaccgagaaaagctcctggtcttttatcagcaggctttgctggactcccacctgccagaggaggcactgaaggttagcgcggtatccggtcctgccgacgggaagaccggtacccccgctgtcacatccacctcctccgcatcttcatcactgggcgaaaagcctagtgctttctaccagcagaccctgcctaatagtcacctcaccgaagaggcgctcaaggtatcaatagtcccaggtcctggcgaccagaaaacaggaatccccagcgccccatcaagtttctatagccaccgcgagaagccaattatattttctcagcagacactgcccgacttcctttttccagaggaagcactgaaggttagcgccgtatccgtgctcgccgctcagaaaacaggtactccaacagttagcagtaattcacacagccacagcgagaaaagcagtgtgttttatcagcaggagctgcctgacagtgaccttccgcgagaaagtctgaagatgagcgccatccccggactcactgaccagaaaacagtgcccacccctaccgtgccgtcaggtagcttctcccaccgggagaaaccgagtattttctaccaacaagagtggcccgacagctacgcgacagagaaggcgttgaaagtttccactggccctggacccgcagaccagaaaacagagatacctgccgtccaatctagttcctacccgcagcgcgagaagccaagcgttttgtatccacaagtgctgtccgactcacatctgcccgaggagtccctaaaggtgtcggccttccccggacccgcagaccagatgacggacaccccagccgttcctagcacattttattcacagagggaaaagccgggaatattctaccagcagaccttaccggagtcgcacctaccgaaggaggccttgaaaataagcgtagcacctggcttggcagatcaaaagaccggaacgccaacagtgacatccacttcctactcacagcatagggagaagcccagcatctttcaccagcaggccctacccggaacccacatccctgaggaggcgcagaaggtgagcgcggtcactggacccggtaatcagaagacatggattccccgagttctatcgacgttctattctcagagggagaaacccggaattttctatcagcagacgctgccgggaagccacatccctgaagaggcgcagaaggtgagtcccgtcctgggtcccgctgatcagaagactggcacgccgactcctacttcggcatcctactcgcacacagagaaacctgggattttctaccagcaagtgctccctgacaaccatccaaccgaagaagctttgaagattagtgtggccagcgagccagtggaccagactacaggaactcctgctgtgaccagcacatcctactctcagtatcgtgaaaagcccagtatcttctaccagcagagcctgccatctagccaccttacggaggaggccaaaaacgtgagtgcagtcccaggacctgctgaccagaagacggtgataccaatcctgcctagtacattttactctcatactgaaaaaccaggtgtgttctaccaacaggtgttgccccattctcatcctacagaagaagcgctcaagatctcagtcgccagtgagcccgtcgatcagacaaccgggactccgacggtaactagcacaagctattcccagcatacagagaagccgtccatcttttaccagcagtctctgccaggatcgcacctgactgaagaggctaaaaacgtcagcgccgttcctggccctggggaccgcaaaaccggcattccgactcttccttctactttctatagtcacaccgagaagcctggtagtttctaccaacaggtgctgccccatagccatttgcccgaggaggccctggaagtatcagtcgctccaggtcctgtggatcagacgatcggtacacctaccgtgacatccccaagttcttcttttggcgagaaacccatagttatctacaagcaggcctttccggaaggccatctgccagaggagtccctgaaagtaagtgtcgcccctggaccagttggccagaccacgggcgcaccaaccataacttctccctcctattcacagcaccgggctaagtccggaagtttctaccaacttgccctgctgggtagtcagatccctgaagaggcactgagagtgagcagcgccccaggcccagcagaccagactaccggtataccgactattacatcgacgagctattcattcggagagaaaccaatcgtcaactataagcaagcttttccagatggccacttacctgaggaagcacttaaagtctccatcgtttcaggccctacagaaaagaagactgatattcctgcgggtcctttggggagttccgccctgggcgaaaaacccattaccttctacagacaggcactgctggattcaccactgaacaaagaggtggttaaggtgtctgcagcccctggcccagcagatcaaaagacggagaccctccctgtccactccacgagctacagtaaccgcggaaagcctgtgattttctaccagcagaccttatccgacagtcacctccccgaggaagcccttaaagtgccccctgttcccggacctgacgcccagaaaacggaaacgccatcagtgtcaagctccctgtactcctaccgggagaaacccattgtgttctatcagcaagctctgccagactccgagctgacccaggaggccctgaaggtgtcagccgttcctcagcctgctgaccagaagactggactgagcacagtgacgtctagcttttattcacataccgaaaaacccaatatctcataccagcaggagctccccgactcacatctcactgaggaagccctcaaggtttccaatgtgcctgggcctgcagatcagaagactggcgtctcaaccgtcacttcgaccagttacagtcatcgcgaaaagcctattgtttcttatcaaagagaactcccacacttcactgaggcgggtctgaagattctgcgagtacccggtccagcggatcagaaaaccggcattaatattcttccatccaattcatatccacagcgagaacactcggtcatcagctacgagcaggaactgccagacttgacagaggtgactctaaaagctattggggtccctggcccagccgatcagaagacaggtatccagattgccagctcttcctcctacagcaatcgggaaaaggctagtatcttccatcagcaagaactgccagatgtcaccgaggaagccctgaatgtgtttgtcgtccctggccaaggcgatcgcaagaccgagataccaacagtccctctaagctactattctcgacgggaaaagccttcagtgatatcccagcaggaactcccagattcacatctcacagaggaagctctgaaggtttcccctgtatcgatacccgcagagcagaagacaggtatccctatcggcctcagttcatcatacagtcactctcacaaggaaaaactcaagatttccacagtgcacatacccgatgaccagaaaacagaattccctgctgcaacattgtcttcctacagccaaatcgaaaagcccaagattagtacagtcatcggaccaaatgatcagaaaacaccttctcagacagccttccattcatcctacagtcagaccgtgaagccaaatattctcttccagcagcagttaccagatagagaccagtccaagggtatcctaaagatctctgcggtcccagagctgactgatgttaatacaggcaagcccgtgagtctctcctctagctatttccacagagaaaagtctaacattttctctccccaagagctgccagggagccacgtcacggaagacgtcctgaaggtatctacaattccagggcctgccggacaaaagacagtcctaccaaccgcgttgccaagctcattctcccaccgagaaaaacccgatatcttctatcagaaggatctaccagaccgtcatctgaccgaagacgcgctcaagattagctcggctttgggtcaggctgaccagatcactggcttacaaactgttccatctggaacatactcgcacggcgaaaatcacaaactggtctcagagcatgtgcaacgtttgatcgataacctaaacagttcagacagctccgtgagttcaaacaatgtgctgctgaacagtcaggcggacgacagagtggttattaacaaacctgaatctgctggtttccgagatgtcggatctgaggagatacaggatgcagaaaactctgccaaaacgttgaaggaaatacggaccctcctgatggaagctgagaatatggcactcaagcgctgcaattttcctgctcctctcgctcgttttcgcgacatatcagatatcagcttcatacagagtaagaaagtagtctgctttaaggaaccatcctcaacaggagtgtccaacggggatctgctccacaggcagccatttaccgaggaatccccctccagtcgctgcatccagaaggacatcgggacccagacaaatttgaagtgcaggcgcggtatcgaaaactgggaatttatttcaagtaccactgtcaggtctccactccaggaggctgaaagcaaggtgtccatggctcttgaagagacactgcggcagtaccaggccgctaaaagcgtgatgcgaagcgaacctgaggggtgttcagggacaattggcaataagatcatcatccctatgatgaccgtgattaaatcagattctagctccgatgcttctgacggaaatgggagctgctcctgggatagtaacctgcccgagtccctggaaagcgtaagcgacgtgctgctgaacttttttccctacgtgagccccaaaacaagtatcactgatagccgcgaggaagagggggtctcagagtccgaggacggcggaggctctagcgtggacagcctcgctgcccacgtaaaaaacctgttgcagtgtgagtcttctctgaaccatgctaaggaaatcctccgaaacgctgaggaagaggaaagtagagtcagggcccacgcctggaatatgaagttcaacctggcacatgactgcgggtattctatctccgagcttaatgaggatgatcgccgtaaggtcgaagaaatcaaagccgagctgttcggccacgggagaactactgatttgtcaaaggggctgcagtcata

SEQ ID NO: 214165 - DNA, 1944 bp, Artificial Sequence
  Description of Artificial Sequence: Synthetic coding sequence
atggctgcgcctgccggagggggaggaagcgcggtcagcgtgctggcacctaatgggagacgacacacggtgaaagttactccttcaaccgttttgctccaggtactcgaggatacatgtcgaaggcaggacttcaatccctgtgagtatgacctcaagttccaacggtctgtgttggacttgagcctgcagtggcggtttgctaacctgcctaataatgcaaagctagagatggtgccagcgtcacgctccagagagggtcctgagaacatggtccgtatcgcccttcaactggacgatgggtctcgtctgcaggatagtttctgcagcgggcagacgctgtgggagctcctcagtcattttccacaaattagagagtgccttcagcacccaggtggcgcaacccctgtgtgcgtgtatacgcgtgatgaggtcactggcgaagctgctctgcgcggaactaccctacagtcacttggcctgacaggaggcagtgccaccatccggtttgttatgaagtgctacgacccagtggggaagactccaggttctttagggtctagtgcctctgctggtcaggcagcggcttcagctcccctgccattagagtcgggcgaattgtccagaggagacctctcgagacccgaagatgctgacacctcaggaccatgttgtgagcacactcaggaaaagcagtcaactcgcgctcctgctgcagcacctttcgtgccattctccggagggggtcaacgtctgggcggaccccctgggccaacccggccattgacatcctcaagcgctaagctgcctaagagtctgagctcccccggtggcccatctaagcctaaaaagtctaagtctggacaggatcctcagcaggagcaagagcaagaaagagagagagatccgcagcaggagcaagagagagagcgacccgtggatcgggagccagtggacagggagccagtcgtgtgccacccagatctagaggaacgcttacaggcctggcctgccgagttgcccgacgaattctttgagcttactgttgacgacgtgagacgaagactcgctcagctaaaaagcgagaggaaaaggctggaagaagccccactcgtaaccaaggcttttcgcgaagcccagatcaaggaaaagctcgagcgttatccaaaagtcgcattgcgcgtcctgttccctgatcgatacgtgcttcaaggcttttttcgcccttctgaaacggttggtgatctccgcgacttcgtccgcagccacctgggcaacccagaactgtctttctatctcttcattactcccccaaaaacagtgctcgatgatcacacccaaacactcttccagccccaactcggtgacagggtggcaccttttacacttggtcccagtctgaagcgctgcttggggcctgaacaacgtacacggctccctgttgtcggggatggaggggacgtggatagcggcaggttgctgttctggggcccttcaagaggccgagcttccccctctaccggccagccaccctgccaccctgtgtgccggcctagctcccctccctctccaaggccctccagtggtgatccgtcccgcgtcaaggcgggtcacaagcacgtgggcactggtagagccaatcttttccctgccgctcttgtacaccttggggctgaggagccagcaggggtgtacctagaacccggtctgctagagcacgcaatatcaccgagcgcagccgatgttctggtggccaggtacatgagccgggcagctgggtcacctagtccgttacccgctccagaccccgctcctaagtccgaacccgcagctgaagagggcgcactagtgcccccagaaccaatcccagggaccgctcaaccagtgaagcgctctcttggaaaggtgcctaaatggctgaaactccctgcctcaaagcgatag

SEQ ID NO: 214166 - DNA, 1662 bp, Artificial Sequence
  Description of Artificial Sequence: Synthetic coding sequence
atggctgctccagccggaggtgggggatctgcagtgagcgtcctggcccctaatggcagacggcatactgtgaaagtgactccttcgaccgttctgcttcaagtgcttgaagatacctgcagacgccaggatttcaatccatgcgagtacgatctcaagttccagcgtagcgtcttggacctgtcgcttcagtggcggtttgcgaacttgccgaacaacgccaagctcgagatggttcctgctagccgtagccgcgagggtcctgagaatatggttcgtattgctttgcagctagacgatgggtctaggctgcaagactcattctgtagcgggcagaccctgtgggagctattatcccatttcccgcagatccgcgagtgtctgcaacaccccggtggcgcaacacccgtttgcgtgtacaccagggacgaagttacaggggaagcagctctgaggggtaccacccttcagtccctcggcttgaccggtggatccgctaccatccgattcgtgatgaagtgctacgaccccgttggcaaaactcctggatccctcggaagctcagctagcgccggacaggcggcagcctcagctccattgccgctcgagagtggagagttgagcagaggggacctgtccaggccagaggacgccgacacttctggcccatgctgcgaacatactcaggaaaaacagtctacgcgggctcctgccgctgccccatttgtccctttttcagggggagggcagagactgggcggaccccctgggcctactagacccctgacaagtagcagtgccaaattacctaaatctctctcctccccaggcggtccatccaagccaaaaaagtctaagtcaggacaggacccccaacaagagcaggaacaggaacgcgaaagggatccgcagcaagaacaggaacgcgagagaccagtggatcgcgaacctgtggaccgcgaaccagttgtatgtcatcccgatcttgaagaacggcttcaggcatggcctgctgagttgccggacgaattctttgagcttactgttgacgacgttcggcgtcggttagcccaactgaagtcagagcggaaaagactagaggaggctccccttgtaaccaaggccttcagagaggcccagattaaagagaagttggaaaggtatcccaaagttgccctgcgtgtgctgttcccagatcggtacgtgttacagggcttctttcgccctagcgaaacggttggagatctcagagattttgtgcgctcccacctgggtaaccccgagctgtcgttctacttgttcatcaccccccctaagaccgtgttggacgatcatacccagactctgtttcaggcgaacttgttccccgcagccctggttcacctgggcgcagaagaacctgctggcgtttatttggagcctggattgctcgaacatgccatcagtccttctgcagccgatgtcctggtggccagatatatgtcgagggccgctggttcaccttcacccctgcccgcacccgatccagcccctaagtccgaaccggcagcggaggagggggctctcgtacccccagaacccatcccagggaccgcccagccagtcaagcgctccttgggaaaagtgcccaaatggcttaagctgcctgctagcaagaggtag

SEQ ID NO: 214167 - DNA, 1050 bp, Artificial Sequence
  Description of Artificial Sequence: Synthetic coding sequence
atggttcctgcctctagaagtcgcgaaggcccagaaaatatggtgagaattgcgcttcagcttgacgacggaagccggctgcaggactcattctgcagcggacaaacactgtgggagctgctgagtcacttcccccagattagagagtgcttgcagcacccgggaggcgctaccccagtctgcgtgtatactcgggacgaggtaaccggggaggccgcactccgcggaactaccctgcagagcttaggtctaactggcggttccgccacaattcggttcgtgatgaagtgctatgatccggtgggaaagactcctggctcactgggtagctcagcgagcgcgggtcaggctgcagctagcgccccactgcccttagaatcaggtgagctgtcgagaggagatctgtcacgaccagaagatgctgataccagcggaccgtgttgtgagcacacacaggagaagcagagtactagagctcccgcagccgctccttttgtccctttctccgggggtggccagagattgggcggacccccagggcctacccgcccactgacatccagttcagcgaagctccctaagtctttgtcgtctcccggagggcctagcaaaccaaagaaatccaaatcagggcaggatccccagcaggaacaggagcaggagcgagaaagagatcctcaacaagagcaagagcgcgaacggccagtggacagagaaccggtggatagggagccagtggtctgccaccccgatcttgaggagcggttacaagcctggcctgctgagctgcctgatgaattcttcgagctgaccgtggacgacgttagaagaagactcgctcagctgaaaagcgaacgcaaaaggctcgaggaggccccactggtgacaaaggcctttcgcgaggcgcagatcaaggagaagctggaaagatatcccaagcggagaagcctctccctgtctccaaggctggagagtgtcgtcccttcccagttgacggcatcatcagcctcccgcgtccaagtggttttacttccgcagcctccaaaatag

SEQ ID NO: 214168 - DNA, 981 bp, Artificial Sequence
  Description of Artificial Sequence: Synthetic coding sequence
atggaattcctgtccgagaaattcgcactgaaatcgccaccaagtaaaaattctgatttttatatgggggctggaggccctctcgagcacgtgatggagacactggacaatgaatccttttattcaaaggcctctgcaggtaagtgtgttcaggccttcggtccccttccgagggccgaacaccatgtgcgtctggaacgcacctccccgtgccaggatagcagtgtgaattacggtatcaccaaagtggaaggccagccccttcacaccgagctcaatagagccatggataactgcaatagcttaaggatgagtccggtcaaggggatgcaggagaaaggagaactggacgagctgggggataagtgcgacagtaatgtaagctccagtaaaaagcggcgtcaccgcaccacgtttacaagtctccagctggaagagttggagaaagtttttcagaagacccactacccggatgtgtacgtgcgcgagcagctcgccttgagaacagagttgacagaagcgagggtgcaggtttggttccagaatcggagggctaagtggcggaaacgggaacgctacggccagatccagcaggccaaaagccactttgccgctacctatgatatttcagtgcttccgaggacagactcatacccacaaatacagaacaacctgtgggctggtaacgcaagcggcggatcagtggtcacttcttgcatgttgccgagggatacttcatcctgcatgaccccttactcacatagtccaaggaccgattcatcttacactggcttttctaatcaccaaaaccagttttcgcacgtgccactgaacaacttctttaccgattcactgctgacaggagcaactaacggccacgccttcgagacaaagcctgagttcgagcggaggtcttcttcgatcgcggtgctgcgtatgaaggcgaaggagcatactgccaatatttcttgggctatgtag

SEQ ID NO: 214169 - DNA, 1032 bp, Artificial Sequence
  Description of Artificial Sequence: Synthetic coding sequence
atggaccccgagcactgtgccccattcagggtcggccctgcccctgggccttacgttgccagcggcgatgaacctccgggacctcagggaacaccagccgcagctccgcatcttcatcctgcccctcctagggggccacggcttacaagatttcctgcctgtggtcctttggaaccctaccttccggaaccagccaagcctcccgcaaaatacttgcaggacctgggcccaggccctgccttaaatgggggtcatttttatgaggggccagcggaagcagaggagaagactagtaaggctgcatccttcccccaactgcctctggactgtcggggaggacccagggacgggccttctaatctccagggcagccccggtccctgcctggcttcactgcacctgccactgtcgccgggtctaccggacagtatggaactggcgaaaaacaagtccaaaaaaaggcgcaacaggactactttttccacattccaactggaagagcttgagaaagtgtttcagaagacgcactatcctgacgtttacgccagggaacaactcgcccttcgaacagatctgactgaggcccgtgtgcaggtgtggtttcagaatagacgggcaaagtggcgaaagcgggagcggtacggcaagatccaggaggggaggaatccatttacagcagcttacgatatcagtgttctaccccgtaccgacagtcatccacagttacagaattcactgtgggccagtcctggtagcggatcccctggcggaccttgcctcgtgtccccagaaggaatcccctcaccctgtatgtctccttactcgcatccacacggctcagttgcaggctttatgggagtcccagcccctagtgcagctcatcccggtatatactccatccacgggtttcccccaacactgggagggcacagtttcgaacctagctcagacggcgattataagtcccccagcctggtgagcttgagagtaaaacccaaggagccaccaggacttctaaactggaccacatag

SEQ ID NO: 214170 - DNA, 1236 bp, Artificial Sequence
  Description of Artificial Sequence: Synthetic coding sequence
atgaatgctgagacttgcgtgtcctactgtgagagcccagctgccgctatggatgcctactacagcccagtgagccagagtagggagggttccagtccattcagggccttcccaggcggagataaattcggcaccaccttcctgtctgcggctgcgaaagctcagggatttggagatgccaagagccgagctcggtacggcgcagggcagcaagacctagctacacctctggagtctggcgcaggggctaggggtagcttcaataaattccagcctcagccgtcaaccccacaaccgcagcctccaccacagccacaaccacagcagcaacagcctcagccacaaccaccggcacaaccccatttgtacctgcagcgcggagcctgtaaaacgccccctgacggctcactgaagctacaggaaggatcatccgggcactccgcggcactacaggttccttgctatgctaaagagtcttccctgggcgaacctgagcttcctcccgattccgatacagtgggcatggattctagttatctctctgtaaaggaggctggtgtgaaggggccacaggacagggccagcagcgatttgcccagcccactcgagaaggccgattcggaaagcaacaaaggaaagaaacgcagaaatcgtacgactttcacgagctaccaattggaagaattggagaaagtcttccagaaaacccactatccggacgtttacgcacgagagcagctcgcgatgcggaccgatctgactgaggctagggtgcaggtgtggttccagaatagaagagcaaagtggcggaaaagggaaaggtttggccaaatgcagcaggttcggacgcactttagcacagcatatgaactccctttactgacccgggctgagaattatgcgcagattcagaacccttcttggctgggcaacaacggcgcagcctcccctgtgccagcttgcgtggtgccctgtgaccccgtgcccgcttgcatgtccccccacgcacaccctccaggatctggagcttccagtgttactgacttcttgtcagtgtcaggggctggctcacacgtagggcagacccacatgggatctctcttcggagctgctagcctgtctccaggacttaatggatacgaactgaacggcgaaccagaccgcaagacaagttcaatcgccgcactgcgcatgaaagccaaagaacacagtgcggctatctcttgggcaacgtag

SEQ ID NO: 214171 - DNA, 630 bp, Artificial Sequence
  Description of Artificial Sequence: Synthetic coding sequence
atgagatccaccatcctgcttttttgcctgctgggttctactagaagcctcccacagcttaaacctgccctgggactgccccctacgaagctcgctccagatcaggggaccctgccaaaccagcagcaatctaatcaggtctttccttctctctcactaatccccttgacacaaatgctgacactgggacccgacctccatctcttgaatcctgccgcaggcatgacacccggtacccaaacccatcccctcacactgggcggactaaatgtgcagcagcagctccacccccacgtcctgccaatttttgttactcagcttggagcccaggggacaattctttctagcgaggagctgcctcagattttcacctccctgatcatacatagtctgtttccgggaggcatcctgccaactagccaggccggagcaaatccggatgttcaggacggatcgctgcccgctgggggagccggagtcaaccctgccactcaaggcacccccgcaggtcgactgcctacccctagtgggacagatgacgatttcgccgtgacaaccccagctggtattcagagatccacacatgctatcgaggaggcaactaccgaaagcgcgaatgggattcagtag

SEQ ID NO: 214172 - DNA, 627 bp, Artificial Sequence
  Description of Artificial Sequence: Synthetic coding sequence
atgcgctccaccatcctgcttttctgccttctgggatcaacgcggagcctcccactcaaaccggcactcgggctgcctcccacaaagctcgcacccgaccaggggactcttccaaatcagcagcagtcaaaccaggtatttcctagtctgagtctgattcccttgactcagatgctgactttaggcccagatctgcatttgcttaacccagcagcgggaatgaccccaggcactcagacacatcccttgaccctgggtggtctgaatgtccagcagcaattgcacccccatgtgctgcccattttcgtcactcaactgggagcccaagggacaattctgagcagcgaggaactaccacaaatctttacctccctgatcatccactccctctttccgggaggcatcctgcccacaagccaggccggagctaaccccgacgttcaggacgggagcttgcctgccggaggtgctggtgtgaaccccgcaacacagggaacgccggcaggacgcctgcctacaccctctggtaccgacgatgactttgcagtgaccacacccgctgggatccagaggagcacacacgcaatagaggaagcaactaccgaatccgctaacggcatacagtag

SEQ ID NO: 214173 - DNA, 2256 bp, Artificial Sequence
  Description of Artificial Sequence: Synthetic coding sequence
atgccagctctggggtgggctgtggcagctatcctcatgctgcaaactgccatggctgagccttctccaggaactcttcctagaaaagcgggtgttttttccgatttatcgaaccaagagctgaaagcggtgcatagcttcttatggagcaaaaaagagcttcgcctccagccctcctccacaaccactatggccaagaacaccgtattcctgatcgaaatgctgcttcccaagaagtaccacgtcttaaggtttcttgacaaaggagagcgccaccccgttcgggaggcgcgtgccgtgatttttttcggcgatcaggaacatccaaacgtcaccgagtttgctgtgggaccactgcccggaccctgttacatgcgggcattgtctcctcgaccaggctatcaatcgtcctgggctagtagaccaatctcgactgccgaatatgccctcctctaccacacgctgcaagaagcgaccaagccactgcatcaattttttctgaacacaacgggcttttcttttcaagattgtcatgatagatgtctggccttcacggatgtcgcccctagaggcgtggcaagtggtcaaagaaggtcctggctgattattcagagatatgtagaaggctatttcctgcacccgacgggcctcgagcttttggtcgatcatggcagcactgatgctggccactgggcagtggagcaggtctggtacaatgggaagttttacggcagtcccgaggagctcgcgagaaaatacgcagatggggaggtggatgtggtggtattggaagaccctttgcccggaggtaagggacacgacagtactgaggagcctcctctgtttagttcacacaagccaaggggggacttcccttccccgatccacgtctccggcccacgccttgtgcagcctcatgggcctaggttccgacttgagggcaacgcagtgctgtacggcggttggtccttcgctttcagactccgcagttcctccgggctgcaggtacttaacgtccacttcgggggagagcgtatagcctatgaggtgtctgttcaggaggccgtggccttgtacggcggtcacacccccgctgggatgcagacgaagtatcttgacgtgggctggggattgggatcagtcacccacgaattggcacccggaattgactgccctgagactgccaccttcctggacacttttcattattatgacgccgacgatccagtccattatcccagggcactttgcctgtttgaaatgcccactggagtgcctctgcgcagacacttcaactccaacttcaagggcggattcaatttctacgcaggtcttaaggggcaggtgctggtactacggactacttctaccgtgtataactacgattacatttgggactttatcttctaccctaatggcgtgatggaggccaagatgcacgccacgggttacgtgcacgcgactttctacaccccagaaggcctgcgtcatggaacgaggctccacacacacctaattgggaacatccatacacacctcgtccattacagagtggatttggacgttgctggaactaagaattcctttcagacactgcagatgaagctggaaaatatcacaaacccatggtctccaaggcacagagttgtgcagcccacactcgagcaaacacagtactcctgggaaaggcaagctgctttccggtttaagagaaagctccccaaatacttacttttcacaagtcctcaggagaatccctggggacacaagcgcacttatcggctacaaatacatagcatggcagatcaggtgctgcctcccggatggcaggaggaacaggccattacatgggcgaggtacccactggctgtgacaaagtatcgcgagtcagaactgtgttcctcctcaatttaccaccagaatgacccatggcatccccctgtagtgtttgagcaatttctgcacaataatgaaaatatcgagaatgaggatcttgtggcgtgggttaccgtgggcttccttcacattcctcactccgaagatatccctaacacagccacgcccggaaactccgtggggttcctgctgagaccgtttaatttctttcccgaagacccatccctggcaagccgggatactgtaatcgtttggccaagagacaacggtcccaattatgtgcagaggtggatccctgaagatcgcgattgttctatgcccccaccttttagctataacgggacttataggcccgtgtag

SEQ ID NO: 214174 - DNA, 2313 bp, Artificial Sequence
  Description of Artificial Sequence: Synthetic coding sequence
atgcccgcactgggctgggccgtggctgctatattgatgctgcaaactgcaatggccgaaccttcccctggaacattaccccgaaaggccggagtgtttagcgacttgagcaaccaggagcttaaagccgtacactcattcctgtggtccaaaaaggagttgcgcttacagccctcaagcaccactaccatggcgaagaacacagtgttcctaatcgaaatgctgttaccaaagaagtatcatgtcctcaggttcttggacaagggagagcgtcatccagtgcgagaagccagagccgtgatatttttcggcgaccaggaacacccgaatgtcaccgaattcgccgtggggcctctccccggtccttgttacatgcgggctttgagtcctagaccagggtatcagagctcttgggccagcagacccatcagcactgctgaatacgcccttctctaccataccctgcaggaagcgactaagccgcttcaccaattcttcctcaatacaactggattcagctttcaggactgccatgatcgctgcctggccttcactgatgttgcgcctcgcggagtcgcgtctggacagaggcggagctggctgatcatccagcggtacgtagagggatactttttacacccaaccggactagagttgctggtagatcacggcagtactgacgctggccactgggctgtggaacaagtgtggtataatggaaaattttacggatcacccgaagaactggcgagaaagtacgccgatggggaggtcgacgtagtcgttctggaggaccccctgccgggtgggaaaggccatgacagtaccgaggagccacccctgttttcttcacataagcccagaggagattttccatctccgatacatgtgtctgggcctaggctggtacagccccatggccctagattccgcctggaaggcaacgccgtcctgtacggtggttggtcttttgccttccgactgaggtcttcctccggcctgcaagtcttaaatgtgcacttcgggggagaaagaatcgcatatgaggtgtcagtgcaggaagccgttgccttatatggaggccacacacctgcgggtatgcagactaagtatctcgatgttggatggggattgggatctgtcactcacgaattagctcctggaatcgattgccctgagacagccacgtttttggacacattccattattacgacgccgatgatccagtgcactatcctcgagccctttgtcttttcgagatgccaactggcgtccctctgcgaaggcacttcaattctaacttcaaggggggattcaacttttatgcaggtcttaaagggcaggtccttgtgttgcgaactacttccaccgtgtacaattatgattatatctgggatttcattttctatcctaacggagtgatggaggccaaaatgcacgccacaggctacgttcatgccaccttttatacgcctgaggggctgcggcacggcactaggctgcacactcatctgatcggcaatatccacacccatctagtgcattacagggtggacctcgatgttgcgggaaccaaaaactcctttcagactttgcagatgaaactcgaaaatattactaacccctggagccctaggcacagggtggtgcagcccacactggagcagacgcagtattcatgggagcgtcaggccgcatttcggtttaagcggaagctgccgaagtacctgttattcaccagcccacaggagaatccctggggtcacaaacgcacttatcgtctgcaaatccattcgatggctgatcaggttctgcccccaggatggcaagaggagcaggctatcacatgggctcggaccgaagggggacagccacgcgctctgtctcaggccgcttctcccgtgcctggcagatatccactggctgttacgaagtatagagagtccgagctgtgttcttcatccatttaccaccaaaatgacccatggcatccccctgttgtgtttgagcaatttttacataacaatgagaacattgagaatgaagacctggtggcctgggtaacagtaggtttcttgcacatccctcatagcgaagacatacccaacacagccactcccggaaactcagtggggttcttgctgcgaccctttaacttctttccagaggatccatcccttgcatccagggataccgtgattgtgtggccaagagataatgggcctaactatgtccagagatggattccagaggatcgggattgttcaatgccacctcctttcagctataacggaacgtatcgccctgtttag

SEQ ID NO: 214175 - DNA, 1884 bp, Artificial Sequence
  Description of Artificial Sequence: Synthetic coding sequence
atgcgggctctgtcacctcggcctggctaccagagctcctgggcctcgcgaccaatttccaccgctgagtacgcgctcttatatcatacactccaggaagccacaaagccattacaccagttcttcctgaacaccactggattttccttccaggattgccacgaccgctgcctggccttcacagacgtggccccaagaggggtggcgtctggccagcggcgaagttggctcatcatccagagatatgttgaaggctacttcctccatcctactggccttgagctcctcgtggaccacggtagcaccgatgctgggcactgggctgtagagcaagtctggtataatggcaagttttatggctctcctgaggagcttgccagaaaatacgccgatggagaggtcgacgtggtcgtccttgaagaccctctgccgggtggcaaagggcatgacagtacagaagaacctcctctgttcagtagccataagccaagaggcgatttcccctcacccatccacgtttctggaccccgtttggtgcaaccgcatggcccacggtttcggctggaaggcaatgctgtactatatggcggatggtcattcgctttccggctacggtcttcgagtggcttgcaggtgctgaacgttcacttcggcggagagcgcattgcctacgaagtcagcgttcaggaggccgtggcactttatggcggacacacacccgcaggtatgcagaccaaatacctcgatgtaggctgggggttgggaagtgtgacgcacgagctcgcgccaggaatagactgcccagagacagcgacattcttagacacatttcattactatgatgctgatgatccggttcactaccctcgggcactgtgtctgttcgagatgcctacgggagtgcccttgcggagacactttaactccaacttcaaaggtggcttcaatttttacgcgggacttaaggggcaggtcttggtcctgcgaaccacctccacagtttataactatgattacatctgggatttcatcttttatcctaatggagtgatggaggcgaagatgcatgctacagggtatgttcacgccactttctacacgccagaaggtttgcggcacgggaccagactgcacactcatctaattggaaatattcacacacaccttgtccactatcgcgtcgatttggatgtcgcaggcactaagaattccttccagactcttcagatgaaactcgagaatatcaccaatccttggtctcctagacacagagtggtacaaccaacgctggagcagacacaatacagctgggaacgccaagcagcctttaggttcaaacggaagctgcccaagtacctgttgttcacaagtccacaggagaacccctggggacataagaggacctaccgcctgcagatccacagcatggctgatcaggtcctcccccctggctggcaggaagagcaggcaattacatgggcaaggtatcccctggccgtcactaagtatcgggaatccgagttatgctctagcagtatataccaccagaatgatccctggcatccacctgtggttttcgagcaatttctgcacaataacgagaatatagagaacgaagatctggtggcttgggtaacagtagggttccttcacattcctcattctgaggatattccaaacacagcaacccccggaaactccgttgggttcctcctgagaccattcaatttcttcccagaggatccttctctggcctcacgggacacagtcatcgtctggcccagagataacggacctaactacgttcagagatggatccccgaggaccgggactgctctatgccccctccctttagttacaatggaacataccggcctgtctag

SEQ ID NO: 214176 - DNA, 750 bp, Artificial Sequence
  Description of Artificial Sequence: Synthetic coding sequence
atgcctgctctggggtgggccgtggcagcaattttaatgcttcaaacagcgatggccgagccttcgccagggactctgccgcgtaaagccggagtattttctgatctatctaaccaagagctgaaggctgtgcattcttttctttggtccaagaaagagcttcgcctacagccttctagcactaccacaatggcaaagaataccgtgttcctgatagaaatgctcctgcctaagaagtatcacgttcttcgattcttggacaagggcgaaagacacccagtgagggaagcacgtgccgttatatttttcggcgatcaggaacacccaaacgtgactgagtttgccgtcggacccttacccggtccttgttacatgagagctctgtctccccgacccggataccagagtagctgggccagcaggccaattagcaccgccgaatatgccctcctttatcatactttgcaggaggccaccaagccccttcatcaatttttcttgaatacaacaggtttctcgtttcaagactgtcatgatagatgtctcgctttcacagacgtagcacctagaggtgtggcaagcgggcagcgccgatcttggttgatcattcaaaggtacgttgagggttacttcctgcacccaacaggcctagagctccttgtggatcacgggtccaccgatgcgggacactgggcagtggagcaggtctggtacaacggaaagttttacggatcaccggaggaattatag

SEQ ID NO: 214177 - DNA, 2256 bp, Artificial Sequence
  Description of Artificial Sequence: Synthetic coding sequence
atgcctgcgctcggatgggctgtggcagccatactgatgcttcagacagccatggccgagccctcacccggaacactgcccagaaaggccggagttttttctgacttatcaaaccaggaattaaaagcggtgcattccttcctctggtctaagaaagagctgcgtctgcagcctagcagcactaccacaatggctaagaatacagtgtttctcattgagatgctgctccctaagaaataccacgttctaaggttcctggataagggagaaagacatccagtcagagaggcaagggctgtgatctttttcggcgaccaggagcacccaaacgtcactgagtttgccgtgggccctttgccgggtccgtgctatatgagagcactgtccccacgccctggataccagtcatcatgggcttcgcgcccaatctccacagccgagtatgccttgctgtatcacacactacaggaggccaccaagcctctgcaccagttcttcctgaacaccacaggtttctccttccaagactgtcatgaccgttgcctggctttcacggacgtcgcaccaaggggagtggcctctggacagcgcaggtcctggctgatcattcagcggtatgtagaaggatattttttacacccaacaggtctagagctcctcgtggaccacggttcaaccgacgccggacattgggctgtggagcaagtgtggtacaacggcaagttctatggctctcccgaggagctggccaggaagtatgcagacggtgaggttgacgtggtcgtattggaggatccgcttcccggtgggaaggggcacgatagtacagaagaaccccctctgttcagctcccataagccccgaggcgactttccgtccccaatccacgtttctggacccagacttgtgcagcctcacggtcctcgctttcggcttgaaggcaacgccgtgctctacggtggctggagtttcgcatttcgattaaggtcctcttctggcctgcaagtgctgaacgtgcactttggcggtgagagaattgcgtacgaggtaagtgtgcaggaggccgttgctctttatggcggacacacccccgctggaatgcagactaaatatctggacgtaggttggggtttgggttctgtaactcacgagcttgccccaggaattgactgccccgaaactgcaacctttctggatacttttcattattatgatgcagacgaccctgtccattacccacgagccctctgccttttcgaaatgcccaccggagttcctttgaggagacacttcaacagtaattttaagggcggatttaatttttacgccggactgaagggacaggtgcttgtactcagaacaacctccaccgtgtataactacgattatatctgggatttcatcttttaccctaacggggtgatggaggcgaagatgcatgcaaccggctacgtgcatgcgactttctatacaccagagggtttgcgccatggtactagactgcacacacacctgatcggcaatatccacacccatctggtgcactatcgcgtggaccttgatgtcgccggtactaagaacagctttcagaccttgcagatgaagcttgagaacattaccaatccctggagccccagacaccgtgtcgtccagccaactctcgagcagacccaatactcttgggaacggcaggctgctttccggtttaagaggaagttacctaagtacttgctattcacgtccccacaggagaacccctggggtcataaaaggacttaccgactgcaaattcattccatggccgaccaggtgctgccacccggatggcaggaagagcaagccatcacctgggccagataccccctcgccgtgaccaaatatagagagtcagagctttgcagctcaagcatctatcaccagaacgacccctggcatcctcctgtggtctttgagcagtttctgcacaataacgaaaacatcgagaatgaagacctcgtggcatgggtgaccgtgggttttctgcacatacctcattctgaggatattcccaacaccgccacacccggtaactctgtgggattcctcctgcgcccattcaacttcttccccgaagatccttctctcgcaagcagagatactgtcatagtttggcccagagacaacggcccaaactacgtccaacggtggataccggaagacagagactgtagcatgccccctccattctcatataacggcacctataggccagtgtag

SEQ ID NO: 214178 - DNA, 1014 bp, Artificial Sequence
  Description of Artificial Sequence: Synthetic coding sequence
atgccggcattgggttgggccgtggctgcaattctgatgctccagaccgcaatggcagagcctagcccaggcactctgccgaggaaagctggggtctttagtgacttgtctaaccaggagctgaaagcagttcactcatttttgtggtctaagaaagaacttaggcttcagccgtcctccacgacaactatggccaagaacaccgtgtttctaatcgaaatgctgctcccaaagaagtatcacgtgttgaggttccttgacaagggcgaacgacatcccgtgagggaagcccgagccgtgatattttttggcgaccaggaacaccccaatgtcactgagtttgcagttggccctctcccgggaccctgttacatgagggctctgtcccctaggcccggataccagtcctcttgggctagtcgccctatctcaaccgcggagtatgcactgctctatcacactctccaagaggctaccaaacccctgcatcagttttttctgaacacaacaggattcagcttccaggactgccacgaccgctgtctcgcttttacagacgtagccccaaggggggttgcctcaggccaacgcaggtcttggctgattattcagaggtacgtcgaggggtactttttacacccaactggcttagagctgctcgtggatcacggtagcacagatgccggtcattgggcagttgagcaagtctggtataatggcaaattctatgggtcccctgaggaactggctcgtaagtatgcagacggggaggtagacgttgtggtgctggaagatccgttgccaggcggaaaagggcacgatagtacagaagagccccctctattttcgtctcacaagccaagaggcgacttcccgagcccaattcacgtatccggaccacgcttggtgcagccacatggacctaggttcagactcgaaggaaatgcagttctgtatggtgggtggtccttcgcattccggctgagaagctcttccggcctgcaagtgctgtag

SEQ ID NO: 214179 - DNA, 582 bp, Artificial Sequence
  Description of Artificial Sequence: Synthetic coding sequence
atggaggccaaaatgcacgccaccggctacgtgcacgccactttttacacccctgagggattgcgtcatgggaccaggctgcacacacatttgatcggaaacatccacactcacttggttcactatcgggtcgatctggacgttgccggaacaaaaaactcattccagaccttacagatgaagctggaaaacatcacaaacccttggagccccaggcacagagtcgttcaaccaaccctcgagcaaacccagtactcctgggagcggcaggcggctttcagattcaaaaggaagcttcccaaatatttgctcttcacctccccgcaggaaaatccttggggccacaaacgcacatatcggctgcaaatccattccatggccgaccaggtgctgcccccaggatggcaggaggagcaagctatcacgtgggcacgctatcctttggccgtgaccaagtacagggagagtgaactgtgcagcagttccatctatcaccagaacgacccctggcacccgtggtcactgagttctttcttcactaccacgcgcacgctcaaaatgaggacgtggtggcctggctag

SEQ ID NO: 214180 - DNA, 2256 bp, Artificial Sequence
  Description of Artificial Sequence: Synthetic coding sequence
atgcccgcattgggttgggcagtagccgctattcttatgcttcagactgcaatggcagaaccatccccgggtactctgcctagaaaggctggagtttttagcgacttgagcaaccaggagctgaaagccgtccattcatttctgtggtctaagaaagaattaaggcttcagccgtcctctactacaacaatggctaaaaataccgtgtttcttatcgagatgctgctgccgaagaagtaccacgtgctgcgctttctcgataaaggcgagcgccacccagttagagaggcaagggccgttatttttttcggcgatcaagagcaccccaacgtgaccgagtttgccgttggccctttgcctgggccatgttacatgcgcgctttgagcccccgtccgggttaccagagctcgtgggcatcccgcccaattagcacggccgagtatgccctgctctaccacaccctgcaggaggctactaaaccactgcaccagttcttccttaacaccaccggtttcagtttccaggattgccacgacaggtgtttggcctttaccgatgttgctccccgtggggtggctagcggtcagcggcgatcgtggctcataatccagcgctatgtcgagggttactttctgcaccccaccggcctcgagctgttagtcgatcacggttccacggacgccggtcactgggcggtggagcaggtctggtacaacggcaaattttatggctcgccagaagagctcgcgaggaagtatgcggacggcgaggttgatgtggtagtgctggaagatccactccccggagggaaaggacacgacagcaccgaagagccccctctgttcagtagccacaagccccgaggtgactttccctctccgattcatgtaagcggcccacggctggtgcaacctcatggaccccgattcagactcgaagggaacgccgtgttgtacggcggttggagtttcgcattcaggctcagaagctcctctggtcttcaggtacttaacgtccacttcggaggggaacgtattgcctatgaagtatcagtacaggaggccgtggccctatatggtggccatacccctgcgggaatgcaaacaaaatatctcgatgtaggctggggcctgggctccgtgacgcatgagctggctccaggtatcgactgccccgagacagcaacgttcctcgacactttccattattatgatgcagatgatccagtccactatccacgcgctttatgtctgtttgaaatgccaacaggcgtgcctctgcgtaggcacttcaactctaattttaagggtgggtttaacttttacgcaggtcttaagggccaagtcctggtgttgcgcacaacttccacagtgtacaattatgattatatctgggactttatcttttatcccaatggggtgatggaggccaaaatgcacgcaaccggctatgtgcacgccacgttctataccccagaaggtctgcggcatggcactcgattgcacacccacttgatcgggaacattcatacccaccttgttcactaccgggtcgatctggacgttgcaggtactaaaaacagcttccaaacactacaaatgaagctagaaaacattaccaatccttggtcaccaaggcatcgagtggttcagccaacactggaacagacacagtactcctgggaaagacaggctgcgttccgttttaaacggaagctccctaaatatctgctcttcactagcccacaggagaatccttgggggcacaaacgtacatataggctgcagatacacagcatggcggatcaagtgttgcctcccggatggcaggaggagcaggcgatcacatgggcccgttatcctctggccgttaccaaatatcgagagagtgaactgtgtagctcaagtatttaccatcagaacgatccctggcacccccctgtggtgttcgaacagtttttgcataataatgagaatatagaaaacgaagacctggtggcgtgggtgacagtgggcttcttgcacatccctcactcagaggacatccctaataccgctaccccaggaaacagcgtgggatttctgctgcgccctttcaatttcttcccagaagacccctctctcgcgagcagggatacagtgatagtatggcctagagataatggtcccaactacgtgcagagatggatccccgaagatagggactgttcaatgcctccacctttttcctacaatgggacttataggccagtatag

SEQ ID NO: 214181 - DNA, 1191 bp, Artificial Sequence
  Description of Artificial Sequence: Synthetic coding sequence
atgctgccaagtctgcaagaatctatggacggcgatgagaaggaattggagtccagtgaggaggggggttccgccgaagaaaggcggctggagccaccatcctcaagtcactattgcctctatagttaccgtggtagcagattagcacagcaacgaggggattccgaggacggttccccgagcggaactaatgcagagaccccctcaggtgatgacttttcactttccctggcggataccaaccttcctagtgaggttgagcctgaactgagatctttcatcgcaaagcgacttagtagaggcgcagtttttgaaggactcggaaacgtggcctcagtggaactaaagatcccaggctaccgcgttgggtgctactattgcttgtttcaaaacgagaagcttctccccgaaaccgtgaccatagatagcgagaggaacccgtccgagtatgtagtatgttttttagggggatccgaaaaaggcctggagaccttccgcctggagctcgacaagtatatccagggcctgaagaataacatgaactgtgaggctcgaggactggagagccatattaagagctatctttctagctggttcgaggatgtcgtctgccccatacagcgggtggttctcctgttccaagagaagcttactttcctgctgcacgcggcactctcatacacaccagtggaagttaaagagtctgatgagaagacaaagagggatattaaccgtttcctcagcgtggcctccctccaaggcttgatacacgagggcacaatgacctccttatgtatggcgatgacagaagaacagcacaaaagcgtggtcatcgattgcagtagctcacagcctcagttttgcaacgccggatctaatagattctgtgaggactggatgcaggcgtttctgaatggcgctaagggcggtaaccccttcctctttaggcaggttctcgagaattttaaactaaaagccattcaggacactaataacctgaaacgctttatccgtcaggccgagatgaaccactacgctctcttcaaatgctacatgttcctaaagaactgcgggagtggcgatatactgctcaaaattgtcaaagtggaacacgaagagatgcccgaggccaagaatgtaatcgccgtgcttgaagagtttatgaaggaggcattggaccagtctttctag

SEQ ID NO: 214182 - DNA, 1539 bp, Artificial Sequence
  Description of Artificial Sequence: Synthetic coding sequence
atggatctgaaagaatccccatccgaggggtcattacagccttcatctatccagattttcgcgaatacttctaccctgcacgggattagacacatcttcgtgtatggtccactgaccattcggagagtgctgtgggctgtggctttcgtaggatctctgggtctcctactcgtggaatcttccgagagagtctcttattatttttcttaccagcatgtgacaaaggttgatgaggtggtcgctcagagcctggtctttcccgcagtcacattgtgtaatttaaacggattccgattcagccgtctgaccaccaacgatctgtatcacgctggcgaattgctcgccctattggacgtgaatctccagattccagacccccatctcgcagatccctcagttcttgaagctcttcgccagaaggccaactttaagcactacaagcctaagcagttctccatgctggagttccttcacagagtgggtcacgacttaaaagatatgatgttgtactgcaagttcaaaggccaagaatgtggacatcaggactttacaaccgttttcacaaaatatggcaagtgctacatgtttaattcaggtgaagacggaaaacctctcctgactaccgtgaaagggggtactggcaacggactcgagatcatgctcgacattcagcaagatgagtatttgccgatctggggggagactgaggagacaacttttgaggctggtgttaaagtgcagatccacagtcaatccgaacccccatttatacaagaacttggatttggtgtggcccctgggttccagacatttgtagcgactcaggaacagagactgacctacctgcctcctccctggggagaatgtcgaagctccgagatgggactggattttttccccgtttacagcattacagcctgtagaattgattgcgagactcgatatatcgtagaaaactgcaactgtcggatggtccacatgcctggagacgccccattctgtaccccagaacaacacaaagaatgtgcagagccagctcttggactgctggctgagaaagattctaactactgcttatgcagaactccatgcaacctgacacggtataataaagaactctccatggtcaaaattcctagcaagacctctgcaaagtacctagagaaaaagttcaataagtctgagaagtacattagcgagaacatactcgtccttgatattttttttgaagccctcaactacgagaccatcgaacagaaaaaagcctacgaggtggccgctctgctgggtgacatcggaggccagatggggcttttcataggcgcatccatcctaacgatactcgagctgttcgactacatctacgagctgattaaggaaaagctcctggaccttttggggaaggaggaggacgagggatcccacgacgagaacgtctcaacttgcgacacaatgccaaaccactcagagaccatctcccacacagtcaatgtgccactacagaccaccctggggactctcgaagagatcgcctgctag

SEQ ID NO: 214183 - DNA, 612 bp, Artificial Sequence
  Description of Artificial Sequence: Synthetic coding sequence
atgttcaactcaggcgaagacggcaagcctctcctgaccaccgtgaagggtgggaccggcaacggactggagatcatgctggatattcagcaggacgagtacctgcctatctggggcgagacagaggagacaactttcgaggccggtgtgaaggtgcagattcatagtcagtccgagcccccatttattcaggaactggggttcggcgtggccccagggtttcagacattcgttgccacacaggaacaacggctcacctatctgccgcctccatggggcgaatgccggtcatctgaaatgggcctggatttttttccagtttactcaatcaccgcatgtcgtatcgattgcgagacgagatatatagttgaaaactgtaattgtcggatggtacacatgccaggggacgctccattctgtacccctgaacagcacaaggagtgcgctgagccagcccttggcctcctggccgaaaaagacagcaactactgcctgtgtcgtactccatgcaaccttacccgatacaacaaggagctcagcatggttaaaattccgagtaaaaccagcgctaaatacctagagaaaaagttcaataaatcggagaaatactag

SEQ ID NO: 214184 - DNA, 1287 bp, Artificial Sequence
  Description of Artificial Sequence: Synthetic coding sequence
atggccgtgggagcctctggcctagagggagataaaatggctggcgctatgccgctgcagttattgcttctgctgatcctactgggcccaggcaacagtctccagttgtgggacacctgggccgatgaggcggagaaggccctggggcctctgttggcccgagataggcgccaggcaacagagtatgaatacctggattatgacttcctccccgagacggaacctcccgagatgctccgcaactctaccgacacaacgccactgaccgggccaggaaccccagaatccaccacagtggaaccagccgctagacgttccacaggcctggacgctgggggagcggttaccgagcttacaaccgagctggctaatatggggaacttgtctaccgactcagctgctatggaaattcagacaacacaacccgcagcaacagaagcacagaccacccagccagtgcctacagaagcccagactacacctctcgccgcaactgaggcccagactactagactgaccgcgacggaagcacagacaaccccacttgccgctaccgaggctcagacaactcctcccgcagccaccgaggcccagactactcaacccaccggacttgaagcccagacaactgccccagctgctatggaggcacaaaccacggccccagccgcaatggaagcacagaccacaccaccggctgctatggaggcgcagactacccaaactaccgctatggaggcacagacgaccgcccctgaagcaacggaggcgcagaccacacagcccactgcaacagaggcacagacaactcccctggccgctatggaggcactgtccacagagccgtcagccaccgaggccctctcgatggagcccaccacaaagcggggactttttatcccgttcagcgttagtagcgtgacacacaaaggcattcctatggcagcaagtaacctgtctgtcaactaccctgtcggcgctcctgaccacattagcgtgaagcagtgtctgctggccattctgatcctggcgctcgtggccaccatattcttcgtctgtacagtcgtgcttgctgtccgactgtctagaaaaggacatatgtatcccgtgaggaattattcccctactgaaatggtatgcatttccagcctgctccctgatggcggtgaaggaccaagtgcaaccgctaacggaggactgtcaaaggccaagtcgccaggcttaactcctgaaccacgcgaagaccgggaaggagatgatctgaccttacactcgtttttgccctag

SEQ ID NO: 214185 - DNA, 1587 bp, Artificial Sequence
  Description of Artificial Sequence: Synthetic coding sequence
atggaactgaaggcagaagaagaggaagtcggaggggtgcagcctgtgagtattcaggcatttgcctcgtcctctactctccacggactggcccacatattctcttacgaacgactttccctcaaacgggcactttgggctctttgctttctcggttccctggcagtcttgttatgcgtttgcaccgagcgggtccagtactacttccattaccaccatgtgactaaacttgatgaagtcgctgccagccagctgacattcccagctgtgaccctctgtaacctgaacgagtttaggttctcacaggtgagcaagaatgatctgtaccacgctggcgagctgctggcactcctgaacaacaggtacgagatccctgatacccagatggctgatgagaaacagctggagatcctccaagataaagcaaattttcggtccttcaagccgaagccattcaatatgcgcgagttctatgaccgtgccggacatgacattagagacatgctgctttcctgccactttcgaggcgaggtgtgctcagccgaggatttcaaggttgtgttcacacgatacgggaagtgctatacttttaattccggcagagacggcagacctagactgaaaacaatgaaaggcggaaccggaaatggcctggagataatgttagacattcagcaagatgagtacctccctgtgtggggagagaccgacgaaacctcctttgaggcgggaataaaagtgcagattcacagccaggatgaaccaccattcattgaccaactgggtttcggagtggcccctggcttccagacgtttgttgcctgccaagaacagagactgatttatctaccacctccatgggggacatgcaaagccgttaccatggattccgaccttgatttcttcgattcctattcaatcacggcttgtaggatagactgcgaaacaagatatcttgtggaaaattgcaattgccggatggtccatatgccgggagacgcaccttattgtacccccgagcagtacaaggagtgtgctgacccagccctggatttcttggtagagaaagaccaggaatattgcgtttgcgagatgccctgcaaccttactcggtacgggaaggaattgtctatggtgaaaatcccgagcaaggcttcagctaagtacttagctaagaagttcaataaaagcgagcaatacataggtgagaacattttggtgcttgacatttttttcgaggtgctgaactatgaaacaattgaacagaagaaagcgtacgaaatcgctgggctgctgggagacatcgggggtcagatgggtctgttcattggcgcatctattttaactgttctggaactctttgattatgcctacgaggtgattaagcataagttatgcaggaggggcaagtgccaaaaggaggccaagagaagttcagccgacaaaggcgtagccctgtccctggatgacgtgaagagacacaatccttgtgagtccctaagaggacatcccgctggtatgacatacgccgcaaatatccttccacaccaccccgctcggggaacctttgaagacttcacttgctag

SEQ ID NO: 214186 - DNA, 1689 bp, Artificial Sequence
  Description of Artificial Sequence: Synthetic coding sequence
atgccaatccaaattttctgttctatgtctttctcctccggagaggaagcgccaggccctcttggagacatctggggcccacaccaccaccaacaacaacaggacatctccgagtcagaggaagaagaggaggagaaggagaaggaagcggtaaggaaggaggccagtgagggtcatagccccatggacctagtggcctttgccaattcgtgcacacttcatggaactaaccacatctttgtggaggggggacccggtccacggcaagtgctttgggccgttgcattcgtgctggccttgggagccttcctttgccaggtgggcgacagagttgcctattacctttcttatccacatgttacattgctgaacgaagtggccactacagagcttgcatttcctgcagtgaccctgtgcaacacaaatgctgtccgcttgtcccaactttcttatcccgaccttctgtatctggccccaatgttggggctcgatgagtctgatgatcccggtgtaccactcgctcctcccggacctgaagcgttcagtggggagccctttaaccttcatcgattttacaacagatcatgtcataggctggaggacatgctcctttattgttcgtatcaaggcggaccgtgcggaccccataacttttcagttgtgttcacgaggtacggaaaatgctatactttcaatagcggaagagacggtaggcccagattgaaaacaatgaaaggcggaacaggtaatgggctagagatcatgcttgacatccagcaagatgagtacctacccgtctggggggagaccgatgaaacctcctttgaggccggaattaaagtccagatccactcccaggatgagcctccctttatagatcagctggggtttggagtcgcccctggtttccagacttttgtcgcgtgtcaggagcagcggttgatctacttaccccctccttggggaacctgcaaagccgtgacaatggatagcgaccttgactttttcgacagctatagcatcacagcctgtcgaatcgactgcgagacccggtacctagtcgaaaattgcaattgtcgcatggtccacatgcctggagacgctccttactgtactccagaacagtataaagagtgtgcagacccagccctggatttcctagtggagaaagaccaggaatactgtgtctgtgagatgccgtgcaacctaacccgatacgggaaggagcttagcatggtgaaaataccaagtaaagcatcagccaagtatctagctaaaaaatttaacaagtcggaacaatacatcggagagaatatcctcgtgctggacattttctttgaagttttaaactacgagactatagagcagaagaaagcctatgaaatcgcaggcttactgggggacatcggcggtcagatgggactgttcattggagcatccatactaaccgtccttgaattattcgattatgcctacgaggtaattaagcacaagctgtgtaggagggggaagtgtcagaaagaagccaagcgatccagcgctgataaaggagtcgcattaagcctggacgatgtaaaaagacataacccatgtgaatcactaagaggtcatcctgctggaatgacttatgcggcaaacatcctgcctcaccacccggctagagggaccttcgaggatttcacttgttag

SEQ ID NO: 214187 - DNA, 1650 bp, Artificial Sequence
  Description of Artificial Sequence: Synthetic coding sequence
atgaagcccacatccggcccagaggaagcaaggaggcctgccagcgatatcagagttttcgctagcaactgctcgatgcatggacttggccatgtctttggtccaggctctctcagcctcaggagaggcatgtgggcagccgctgtggtgcttagcgttgctacattcctttatcaagtcgccgagagggtcaggtactacagggagttccaccatcagactgctttggacgagagagagtcacaccgtcttatcttcccagcagtgactctctgcaatattaaccccttgcggagatctcggctgacacccaatgacctccactgggctggtagcgcccttctggggctggaccccgctgagcacgctgccttcttgagggctctgggtaggccgcctgcgccaccaggatttatgccatctcccaccttcgacatggcacagttgtatgccagagcaggccattccctagatgatatgcttctcgattgccggtttcgcggtcagccctgcgggcctgagaattttaccacaattttcacccgaatgggcaaatgttataccttcaattcaggagcagatggcgctgagctcctcacaacaactagagggggaatgggaaatggactggacattatgcttgatgtgcaacaggaggagtacttacccgtctggagagacaatgaggagactccatttgaggtgggaattagagttcaaatccacagccaggaggaaccaccaattatcgaccaacttggactaggagtgagccccggataccaaaccttcgtttcctgccagcaacagcagctatccttcctgcctccaccctggggggactgctcaagcgcaagcctcaatccgaactacgagcctgaaccaagtgatccactgggttcccctagtccctctccctcccctccttataccctcatgggctgtcgactggcctgtgagactagatacgtggctaggaaatgtggatgtagaatggtgtacatgccaggtgatgtgcctgtgtgttctccccagcagtacaaaaactgtgcccaccctgcgatcgacgccatgctgcggaaggactcatgtgcctgtcctaacccgtgcgctagcaccaggtacgccaaggagctgtctatggtccgcataccgtcccgagcggcagctcgcttcctggcccgaaaacttaatcgcagcgaagcttacatcgctgagaacgtgcttgctcttgatatcttcttcgaagccttaaactatgagacggttgaacagaagaaggcttacgagatgtccgagctgctcggcgacattggcggtcagatggggctgttcatcggggctagcctgttaactatcctggaaattctggattacctttgcgaagttttcagggacaaggtactggggtacttttggaatcggcagcactctcagcgtcacagctccactaatctcttgcaggaaggactgggcagccacagaacccaggttccccatctgtcactgggaccctcaactttgctctgcagtgaagatttacctcctctcccagtgccatccccccgacttagtcctcccccaaccgcgccagctacactgagtcattccagccgccctgccgtgtgtgtgctgggagccccaccatag

SEQ ID NO: 214188 - DNA, 1596 bp, Artificial Sequence
  Description of Artificial Sequence: Synthetic coding sequence
atgaaaccgactagtgggcctgaggaggcgaggcgaccagcctctgatatcagggtgtttgcctctaactgttccatgcacgggctgggacatgttttcggacccggtagtctatcactgagacgtggaatgtgggcagccgctgtggtactgagcgtagctacttttctgtatcaggtggccgagcgggtccgctattacagagagtttcatcaccagaccgccctcgacgagcgagagagccacaggttgatctttcctgcagtgactctctgtaacatcaatccgctccgccgttcgcgtttaactccaaatgatttgcactgggcagggtctgcgttgctgggcctggaccctgctgaacacgctgccttcctaagagcactgggtagaccgcctgccccaccaggtttcatgcccagcccgacattcgacatggcccagttgtatgcccgagccggacacagcctggacgatatgctgctggactgccggtttagaggacagccatgcggcccagaaaatttcacaactatttttacccgcatgggaaaatgttacacattcaacagcggtgcagacggagccgaattgttaaccacgactcggggtggaatgggcaacggcctggacataatgctggatgttcaacaggaagaatacctcccagtctggagagataatgaggaaaccccgttcgaggttggcataagggttcagatccactcccaggaggagccccctatcattgatcagctgggtttaggtgtttctcccggataccagactttcgtcagctgccagcagcaacagctctcgtttttgccacccccttggggggattgcagttcagcttctctcaatcctaactatgaacctgaaccctctgacccacttggctctcccagcccctcacctagtcccccttatactctgatggggtgccgcctagcttgtgaaacccgctatgtagcccgtaagtgtggttgccgcatggtgtacatgcctggcgatgtgcctgtctgttccccacagcagtacaagaactgtgcccaccctgcaatcgacgcgatgctccggaaggatagctgtgcgtgtccaaacccatgcgcaagtactaggtacgctaaggagctttccatggtgaggattccttcacgcgcagcagcacgattcctcgccaggaagctaaatagatcagaggcgtatattgccgagaatgttcttgctctggatattttttttgaagctttgaattacgagacggtcgaacaaaaaaaggcctacgagatgtcagagctgcttggggacatagggggtcaaatgggtctttttatcggggcatctctgctgacgattctggaaattctcgattatctgtgcgaagtgtttcgagacaaggtcctgggctatttctggaatcggcaacactcccagcgccacagttctaccaacctgctgcaggagggtctcggaagccatagaactcaggtaccacacctatctctgggcccaaggccaccaacgccaccatgtgctgtgaccaaaacactatcagcttcccaccgcacatgttacttagttacacagctatag

SEQ ID NO: 214189 - DNA, 1632 bp, Artificial Sequence
  Description of Artificial Sequence: Synthetic coding sequence
atgaaaccaactagcggcccagaggaagcaagaagaccagcctctgatattcgggtgtttgcaagtaattgtagtatgcatggcttggggcatgtcttcggaccgggtagcctgtcactaagacgcggaatgtgggcggcagcggtcgtgctttcggtggctacctttctgtatcaagttgctgagagggtcagatactatcgggagtttcaccatcagacagctctggatgaaagagaaagccaccggctaattttccctgccgtcacattgtgcaacatcaaccccctgcggagaagtaggctgactcctaatgatttgcactgggcaggctctgccctgctgggcttggacccagctgagcacgccgcattcctccgagcattggggagacctcctgcaccgcctgggtttatgcctagtccaactttcgacatggctcagttgtacgccagggccggacactccctggacgacatgctcctcgactgccggtttcgcggacagccttgcgggccagagaattttaccactattttcactagaatggggaaatgttacacctttaactcaggtgccgacggggctgagctcttgacaactacacgaggcggaatgggtaatggactcgatattatgcttgatgtgcagcaggaggagtacctgcccgtttggcgagacaacgaagagacacctttcgaggttgggatccgagtgcagatccactcgcaggaggagcctccaattattgaccagctcggtctcggggtatccccgggatatcagacctttgtgagctgtcagcagcagcagctgagtttcctcccaccaccttggggagattgctcttccgcctctctcaacccgaattatgagcccgaacccagtgacccgttgggttccccatccccctccccttcccctccttacaccctcatgggctgccgcctggcttgtgagactagatacgtggccagaaagtgcggatgtaggatggtgtacatgccaggcgacgtcccagtatgcagtccacaacagtacaagaactgtgcacatcccgcaatcgatgccatgctccgcaaggactcttgcgcatgccccaatccctgtgcatccacaagatacgcaaaggagctgtctatggttcggatcccttccagagccgctgccaggtttctagcacggaaactcaaccggtcagaagcctatatagcggaaaatgttttagcgcttgatattttctttgaggccttgaactacgagacagtggagcaaaaaaaggcatacgagatgtcagagttactgggggatattggcggacaaatgggactttttattggagcaagcttactgacgattctggagatcctggattacttgtgtgaggttttccgggacaaagtcttgggctatttctggaaccggcagcactctcaacgccactcaagcacaaacttgaccagccacccctccttatgccgtcaccaagattctctgcgtctgccacctcaccttctaccatgtcataccgcgctggaccttctgtcggtttcctctgaacccaggcctgatattctagatatgccttcccttcacgtggcctttccatcttccccacaaattaagtcttag

SEQ ID NO: 214190 - DNA, 1944 bp, Artificial Sequence
  Description of Artificial Sequence: Synthetic coding sequence
atgctgtcaggagcagccggagctgccaggcggggaggcgcagccctggcaccatcattaacgaggagcctggcgggaacccatgccggtgctgattcatgcgcaggtgctgacaaaggcagccacaaggagaccatcgaggagagggacaaacgacagcaacggcagcagagacagagacagcatcagggatgcggtgctgctggatcaggcagcgatagcccaacatctggccctcaccccgtaccagtgctgttccctctcgccctgtcattagaagaacaacctttacctccgctaccgctggggagagccccaggcctgttggcacgggagggccagggaagggaagcgttggcgtctcctagcagtcgcggtcagatgcccattgaaattgtctgtaagatcaagttcgccgaggaggatgccaagcctaaagaaaaagaggcgggtgacgagcagtcgctgctaggcgctgtggccccaggcgctgctcccagggatctggctacatttgcatccacctctactctacacggactcggtagagcttgcggcccaggtccacacggtttgagaagaaccctgtgggctctcgcactgctgacttcgctggctgcgttcctgtatcaggctgccggactcgctcggggatatctaacgcggccacatttagtggcgatggaccctgccgctcccgctcccgtggccggttttcctgccgtcaccctatgcaacattaatagatttcgccatagcgccttaagcgacgcagatattttccacttggccaacctcacaggtttgcctcccaaggaccgcgatggacacagagccgcaggcttgcgctaccctgaacccgatatggtcgatatcctgaaccggacaggtcaccagctcgctgatatgcttaagagttgcaacttttctggtcaccactgtagcgcctccaatttcagtgttgtgtacacaaggtatggcaagtgttacacatttaatgcggatccacgcagtagcttgccttctcgggcaggcggaatgggctccggattagagattatgctcgatatccaacaggaggagtacctgcccatatggcgagagactaacgagactagctttgaggccggaattagagtgcaaatccattcacaagaagaaccaccatacattcatcagctcgggttcggagtgagcccaggattccagaccttcgtgtcttgccaggagcagcggctgacttacttaccgcagccatggggaaattgcagggccgagagtgagctccgtgaacccgaactgcagggttattcagcttactctgtgtccgcttgccggcttagatgtgagaaggaagccgtgctccagcgctgccactgccggatggtgcatatgcctgactctcttgggggtgggcctgagggtccttgtttctgccccaccccatgtaacctgacaagatatgggaaagaaatttcaatggtacggattccgaacagaggttcagctcgctatctagcacgaaagtataacaggaatgaaacctacatccgcgagaatttccttgtcttagacgtctttttcgaagctttgacaagcgaggccatggaacagcgcgcagcttacggactttccgcgcttttaggtgatctcgggggtcaaatgggacttttcattggcgctagtattctcacccttctggaaattctggactacatctacgaagtcagctgggatcgcctgaaacgtgtgtggaggagaccaaagacgccactgcgcacttctaccggaggcattagcacactgggcctgcaggagctgaaagaacagtcaccctgcccaagccgagggcgtgtcgagggcggtggggtctcatccttgctgcctaaccaccaccatcctcacggacccccaggagggctttttgaggactttgcctgctag

SEQ ID NO: 214191 - DNA, 2001 bp, Artificial Sequence
  Description of Artificial Sequence: Synthetic coding sequence
atgctgtccggcgctgcaggcgctgcccgaaggggtggagctgcccttgctccctctctgacaagatcactcgcgggaactcacgctggcgcagatagctgcgcaggcgctgacaaaggatctcacaaggaaaccattgaagagagagacaaacggcagcagcgccagcagagacagcgacagcaccagggctgcggcgctgcgggatccggcagcgatagccctacctccggtccccaccccgtgccagtcctgtttcccctggcgctgtccctggaggaacagcctctgccaccattgcccctgggcagagccccaggtctgcttgctcgggagggccagggcagagaggctttggcatccccgagcagcaggggccaaatgcccatcgagattgtatgcaagattaaatttgctgaagaggatgcaaagccgaaggagaaggaagccggagacgagcagagcctgctgggagccgtggcccctggagcagcccctcgggacctggctacattcgccagtacttcaaccttgcacgggctgggacgggcatgcggacccggtccccatgggcttaggagaactctgtgggcccttgcgctgttgacttcgttggcagcatttttatatcaggctgcaggcctagccaggggttatctcaccagaccacatctggtggctatggatccagccgcacctgctccagtcgccggttttcccgcagtaacactctgtaatatcaatcgcttcagacattccgcactatctgacgcagacattttccacctggccaatttgaccggactgccacctaaagaccgggatggccatcgagcagccggattgcgttatcccgaacctgatatggtcgacattctcaatcggacagggcatcaactcgccgatatgctcaagagttgcaatttctccgggcatcattgcagtgcgagcaacttcagcgttgtatataccagatacgggaaatgttatactttcaatgcagacccacggtccagcctgccttccagggcaggcggtatgggcagtggattggagattatgctggacatacagcaagaagaatacctccctatttggagagagacaaacgagacgtcattcgaagccggaattcgcgtacaaattcatagccaggaggagccaccatatattcatcaacttggatttggcgtcagtccaggctttcagacatttgtgtcatgtcaagagcagaggcttacatacctccctcagccctggggcaactgccgggctgaatctgagctgagggaaccagagctgcagggttactccgcatattccgtgtctgcttgtaggttgcggtgtgaaaaagaggccgtgctccagcggtgtcactgtcgcatggtacacatgcccggaaacgaaacgatctgccccccaaatatttatatcgaatgcgccgatcatacactggattctctgggcggtggacctgaggggccatgcttttgtcctacaccgtgtaacctgacacgatatggcaaggaaatatcaatggtccggatacccaaccggggttccgctcgctaccttgcccgtaaatataaccgcaatgagacctacattcgcgaaaactttctcgtgctcgatgttttcttcgaagctctaacctcagaagcgatggaacagcgggctgcgtacggcctatctgccctgttaggagacctcggcggtcagatgggactgtttattggagccagtatattgaccctgctggaaatcctcgattacatctacgaagtgagctgggaccgccttaaacgtgtttggaggcgcccaaagactcccctccgaacctccacaggagggataagcacactggggctgcaggagctgaaagagcagtccccatgtccaagtcgagggagggtggagggtggtggtgtgagctcccttctgccgaatcatcatcatcctcatggtccccctggcggactgttcgaggactttgcttgctag

SEQ ID NO: 214192 - DNA, 2271 bp, Artificial Sequence
  Description of Artificial Sequence: Synthetic coding sequence
atgcacctcaagattgtccttgcctttctggctttgtcactgatcaccatcttcgctcttgcatacgtgttgttaacaagccctggcggatccagccagccaccccattgtccgtccgttagccatagagcccagccgtggccccaccccggacagagccagttgttcgcagatttgtctcgcgaagagttgacagctgttatgagatttctaacacagagactgggtcccggtctcgtagacgccgctcaggcgcagcctagcgataattgtatcttttcagtagagcttcagctgcccccaaaagccgctgctctggcccaccttgatcgaggctccccgcctcccgctcgcgaggcgcttgctatcgttctgtttggtgggcagccccaaccaaatgtgtcagagctggtagttggtcctttaccacatcctagttatatgcgggacgtcacagtcgaaagacatggcggaccactcccatatcataggcgacctgtgctgcgggcagaattcacccagatgtggcgccacctgaaggaagtagaacttccaaaagccccaatcttcttatcgagcacttttaattataatgggtcgacgctggcagcagtgcacgccactcccagggggcttcgaagcggggaccgggctacctggatggctctctaccataatatcagcggggtggggctgtttttacatcccgttgggctggaacttctgcttgatcacagggctctcgatcccgctcactggactgtccaacaggtgttttatttaggacattactacgccgatctgggccagctagaaagagagtttaagtcaggtcgtttagaagtggtgcgggttccactgccaccaccgaacggcgctagctccctcaggtcaagaaactccccaggcccactgccacccttgcagttctcaccccaagggtctcaatattccgttcaggggaatctcgtggtgagttccctgtggtcgtttactttcgggcacggggtcttcagcgggctgcgcatttttgacgtgagattccagggagaacgtatcgcttacgaggtgtcggtgcaggaatgcgtcagcatctacggggcagactctcccaagacaatgctcacaaggtatttagactcatcatttggcttgggcaggaacagccgtgggctggtgagaggggtggattgcccctaccaggcaacaatggtggacattcacatactggtgggaaaaggcgctgtacagttgctgcccggtgccgtgtgcgttttcgaggaggcccaagggctccctctaaggagacatcacaattacctgcagaatcacttctatgggggacttgcctcaagcgctctggtagttcgtagcgtcagtagtgttgggaattacgactacatttgggacttcgtgctctaccccaacggagccctggagggcagagtgcacgccactggttacattaacactgcttttctgaaaggaggcgaagaggggctgctcttcggaaacagggttggcgagcgggtccttggaactgtgcacacacacgcctttcactttaaacttgacctggacgttgctggtctcaaaaactgggtggtggcagaggatgtggtgttcaagccagtggctgccccatggaacccggagcactggttgcagcggccacagctgacacgacaggtccttggaaaagaggacttgacagccttcagcctgggctcccccctacccagatacctgtacctggcgagcaaccagaccaacgcctggggccaccagagaggatacaggatccagatccacagccctctggggatccacatccctcttgagtcagacatggagcgagccctatcttggggcaggtaccagctggttgtcacccagaggaaagaggaggaatctcaatccagcagtatttatcaccagaacgacatctggacaccaaccgttacattcgctgattttatcaataacgagacactgctaggagaggatctcgtggcatgggtcacagcaagtttcctgcatataccacacgctgaggacattcccaataccgtgactctcggaaacagagtcgggtttctcctccgaccatataattttttcgacgaagatccatctatctttagtcccggtagtgtttatttcgaaaaggggcaggatgctgggctgtgcagcataaaccccgtggcctgtttgcctgatctagccgcttgcgtacccgacctcccacccttctcttatcacggcttttag

SEQ ID NO: 214193 - DNA, 2190 bp, Artificial Sequence
  Description of Artificial Sequence: Synthetic coding sequence
atgcacctcaaaatcgtgttggcgttcttggccctgagcctgataacaattttcgctctggcctatgtcctcctaaccagccctggcggatcctctcagcccccacattgccccagtgtttcacatcgcgcacagccctggccacatccaggccagagccagttattcgcggacctctcacgcgaagaacttactgcagtgatgcgatttcttacacagagactggggcctgggctggtagacgcagcccaggcacagcctagcgataactgcatcttcagcgtggagctgcagctgcccccaaaggccgcagcactggcccacctggaccgtgggagtccacctccggctcgtgaagccctggccattgtgctgtttggagggcagcctcagccaaatgtgagcgaacttgttgtggggccactgccacacccatcttacatgcgggacgtcactgtggaaagacacggcggaccactgccatatcataggagacctgtcctgcgggcagagttcacacaaatgtggaggcacctaaaggaggtggaactccctaaagctccaatctttctgtcctcaacattcaactacaacggaagcaccctcgctgcagtgcacgccacgcccagaggcttgcggtccggcgaccgggcaacctggatggccctgtatcacaacatttctggggtgggcctctttttgcaccctgtgggactggagctcctgctggaccaccgcgcactggaccctgcacactggacggtacagcaggtcttttatctcggtcactattatgcagatctcgggcagctggaaagagagtttaagtctgggcgtctagaggtggtaagggtgcctctgcctccaccgaatggcgcatcatcattgcgctctcgtaattcccccggacccctaccgcctctgcaattcagcccccagggatcccagtattccgtccaggggaacctcgtagtaagttccctctggtctttcacatttggccatggtgtcttctccggcctgcgaatattcgacgtaagattccagggggagcgcatcgcatacgaggtgtcagtgcaggaatgtgttagcatatacggagctgattcccccaagaccatgctgactaggtatttagactcgagtttcggacttgggcgaaattcaagggggttggtcaggggtgtggattgcccctatcaggctactatggtggacatacatatcctcgtgggaaagggagctgtgcagttactgccgggagccgtctgtgtgttcgaagaagctcagggattgccactgcggaggcaccacaactacttacagaaccacttttatggagggctggccagcagtgctctggtggtacgcagcgtgagttctgtcggtaactacgactacatttgggactttgttctgtatcctaatggcgcactggagggacgggtgcacgcaacgggctatatcaatactgcttttctgaaagggggagaggagggattgcttttcgggaatcgagtgggcgaacgggtgctcggaaccgtgcacacacatgctttccattttaagttagatcttgatgtcgcagggctcaaaaactgggtagtggccgaggatgtcgtcttcaaacccgtagccgcaccatggaatcccgagcactggcttcagcggccacagctcacaaggcaggtccttggcaaggaggatctcactgctttttcacttgggtctcctcttcccagatacttgtacctggcctccaaccagacaaatgcctgggggcaccagagagggtaccagttggtggtgactcaacggaaggaagaagagtcccagtcgtcgagtatctatcaccagaacgatatttggacccccacagtaactttcgccgacttcattaataacgagactctcctcggggaagacttggtggcgtgggtgactgcaagctttcttcacatcccccacgcggaagatatcccgaacacagtcacacttgggaacagggtggggttcctgctccgcccatataacttttttgacgaagatccctcaatcttctcgccagggtccgtatatttcgaaaagggtcaagatgcaggactctgtagcatcaaccccgtggcctgcctgcccgatctcgccgcttgtgtccctgacttaccccctttcagctatcacgggttctag

SEQ ID NO: 214194 - DNA, 2292 bp, Artificial Sequence
  Description of Artificial Sequence: Synthetic coding sequence
atgaatcaaaagacgattctggtattgctgatcttggccgtgatcacaatatttgccttggtatgtgtcctgctagtagggaggggtggagacggcggagaaccttcacagttaccccattgcccgtccgtgtctccatcagcacagccatggacgcaccctggccaatcacagctctttgcagacctgagtagagaagagttgaccgccgtgatgaggttcctcactcagaggctgggtccaggactggtcgatgccgcacaggccaggccttccgacaattgtgtgttttcagttgagctgcaactcccccctaaggccgcagcgctggcccacctggatcgcggttcaccacccccagcgagagaagcacttgccatcgttttctttggaaggcaaccccagcctaacgtgagcgaactagttgttgggcctctgccccatccaagttacatgcgagatgtgacggtggaacgtcatggcggacccctgccctaccaccgtaggccagtgctctttcaagaatatttggatattgaccaaatgatatttaatcgggagctcccccaggccagcgggctgctacaccactgctgcttctataaacacagaggtaggaatcttgtgaccatgacaacagctcctcggggtttgcagagcggggatcgagcaacttggttcggcctgtactacaacatctctggcgcaggctttttcctccaccatgtcgggttagaactccttgtgaaccacaaggctctcgatccagcgcgttggacaattcaaaaggtgttctaccagggtagatactacgacagccttgcccagttggaggcccagtttgaagctgggctagtgaacgtcgttctgataccagataacgggactgggggaagctggtcactaaagtctcctgtccctcccggtcccgctccacccctccagttctaccctcaagggcctcgcttcagcgttcagggatcccgagtggcctcaagcttgtggactttttcttttggactgggagccttttcaggcccacggatctttgacgtaaggttccagggcgagaggcttgtatatgaaatctccttacaggaggccctcgccatatatggtggcaatagcccggcagcaatgacaacacggtacgtagacgggggatttggaatgggaaagtataccacccccttgaccagaggagttgattgtccataccttgcaacttatgtggattggcatttcctcctcgaaagccaggctcctaagaccataagagatgccttctgtgtattcgagcagaaccagggattgcccctccgacggcaccactcagacctgtatagtcactacttcgggggtctggctgagaccgtgctggtcgtgcggtccatgtcaactctcctgaattacgactacgtgtgggataccgtgtttcatcctagcggcgctatcgagatcaggttctacgccaccggctatattagcagcgcatttttgttcggcgcaaccggtaaatacgggaatcaagtttcagagcacaccctagggacagtgcatacccattccgcccattttaaggtggaccttgacgttgctggactggagaactgggtgtgggctgaggatatggtgttcgtgcctatggcggtcccatggagccctgagcaccagctgcagcgactgcaggtgacccgtaaactgcttgaaatggaagagcaggctgctttcctggtgggctctgcaactcctagatacctctatctcgcatcaaatcatagcaataagtgggggcacccccgtggttatagaatccagatgctgagctttgcaggagagcccctaccccagaactcatccatggcccgaggattttcctgggaacgttatcaattggcagttactcagcgtaaagaggaggagccctcctcttcaagcgtttttaatcagaatgacccttgggcgccaactgtggacttttccgatttcatcaacaatgagacaatagctggcaaagacttagtagcttgggtgactgccggttttctgcatattccacacgcagaggacattccgaacactgttacagttggtaatggtgtcggcttcttcctgaggccatataatttctttgacgaggaccccagcttctattcagctgacagcatctacttccgaggcgatcaagacgcaggcgcttgtgaggtgaatccactcgcctgcctgcctcaggcagctgcttgcgcgcctgacctgccagcttttagccacggcggatttagccacaattag

SEQ ID NO: 214195 - DNA, 939 bp, Artificial Sequence
  Description of Artificial Sequence: Synthetic coding sequence
atggccaacaatgacgccgtcttgaaaaggctggagcagaaaggagcggaggccgaccagattatagaatatcttaaacaacaggtatcactcttgaaggagaaagcgatccttcaagccacccttagagaagaaaagaaattgagggtagagaatgctaagctgaagaaggaaatagaggagctgaagcaagaactcattcaggctgaaatacaaaatggcgtgaagcaaatcccattcccaagtggaactcctttgcacgccaattccatggtttctgaaaatgttatacagtctaccgcagttactacagtgagcagcggaacaaaggagcagataaagggtgggacgggggatgagaaaaaggccaaggagaaaattgaaaaaaagggggagaagaaagagaagaagcaacagtcgattgctggatctgccgattccaagccgatcgatgtcagcaggctggatctgaggatcgggtgcattattacagcaagaaagcatccagatgccgacagcctctacgtggaagaagtcgatgtcggggaaatcgctcctcgcaccgtggtctccggcctggtcaatcatgtccccttagaacagatgcaaaacaggatggtgattctgctttgcaacctcaaacccgcaaaaatgagaggggtgctgtctcaggctatggtcatgtgtgcttcttccccagagaagatcgagatcttagcgccacctaacggaagcgtgccaggggacagaataacatttgacgcattccccggtgagcccgacaaggaactaaatccgaagaaaaaaatctgggagcagatccagcccgatctccacactaatgatgaatgtgttgccacctataaaggggtcccctttgaagtcaaaggcaagggtgtttgccgggctcaaactatgagtaactccggcattaaatag

SEQ ID NO: 214196 - DNA, 1011 bp, Artificial Sequence
  Description of Artificial Sequence: Synthetic coding sequence
atgctgccagctgtggcagtgagcgaaccagtagtccttcgcttcatgatattttgcaggctgcttgccaagatggctaataacgatgccgttttgaaaaggctagaacaaaagggagccgaagccgaccagattatcgagtacctgaaacagcaagtaagcctgctgaaagaaaaagccattcttcaggcgaccctgcgggaggagaaaaagctgagagttgagaatgctaagctgaagaaggagatcgaggaactgaagcaggagctgatccaggccgagatccaaaacggggttaagcagatccccttcccgagtggtacccccttacatgctaattcaatggtgtctgagaatgtcatccaaagcacagcagttacgacagtttcatccggcacaaaagaacaaattaaagggggaacaggtgacgagaagaaggctaaggaaaagatcgagaaaaaaggcgagaaaaaggagaaaaagcagcaaagtatcgccggttctgccgattcgaagccaatcgatgtgtccagattagatctgcggataggctgcataataactgctagaaaacacccagatgctgattccctctatgtggaggaagttgatgtcggcgagattgcgccacgcacggtcgtttctggcctcgtgaaccacgtgcccttggagcagatgcaaaatcgaatggtgatcctgctgtgtaacctcaagcccgcaaagatgcgtggcgtccttagtcaagccatggtgatgtgcgcttcatctccagagaagatcgagattctggcacccccaaatgggagtgttcctggcgatcgtataacctttgatgcttttcccggagagccagataaggaactcaatcctaagaagaagatttgggagcagatccagccagatttgcacaccaacgatgagtgtgtagctacatataaaggagtgccatttgaggttaagggcaagggagtctgtagggctcagactatgagcaattcaggtatcaaatag

SEQ ID NO: 214197 - DNA, 810 bp, Artificial Sequence
  Description of Artificial Sequence: Synthetic coding sequence
atggccaacaatgacgctgtgcttaaacgacttgagcagaagggcgcagaggccgaccagatcattgaataccttaagcagcaggtgtcgctgctcaaagagaaagctatactgcaggccactctgcgggaagaaaaaaagttacgggtagagaacgctaaactaaaaaaggaaatcgaggagctgaagcaggaacttatccaggctgagattcagaatggagtcaaacagataccttttcccagcggaacacctttgcatgctaacagcatggtgtcggagaatgtgatccagagcaccgcagtgaccactgtcagctctgggaccaaggagcagatcaaaggcggaacaggtgatgagaaaaaagcaaaagaaaagatcgagaagaaaggagagaagaaagagaagaagcagcaaagcattgcgcctcggactgttgtgtctggcctcgttaatcatgtacccttggagcagatgcaaaacaggatggtgatcctgctgtgcaacttgaagccagctaaaatgcgaggagttcttagtcaggccatggtaatgtgtgcatcttcacccgagaagattgaaattcttgcaccccctaatgggagtgtgccgggagatagaatcacttttgatgcctttcctggggaacccgacaaagagctcaatccgaagaaaaaaatttgggagcagatccagcctgacctgcacaccaatgatgagtgcgttgccacatacaagggcgttcccttcgaggtaaaagggaaaggtgtttgccgcgctcagacaatgtccaacagtggaatcaaatag

SEQ ID NO: 214198 - DNA, 939 bp, Artificial Sequence
  Description of Artificial Sequence: Synthetic coding sequence
atggccaacaatgatgccgtgctgaagcgtctggaacagaagggtgccgaggcagaccaaattatcgaatatttaaaacagcaggtatctcttctgaaagaaaaggcaattctacaagccactctgagagaggagaagaaacttcgggtggagaacgcaaaacttaagaaggagatagaggagctgaagcaggaattgattcaggctgagatccagaatggcgtcaagcaaattccatttccctcgggcacgccattacatgctaattcaatggtgtcagagaacgtcattcagtccacggccgtaaccaccgtgtcctctggaactaaggaacagatcaaagggggtaccggagacgagaagaaagcaaaggagaagatagagaagaaaggagagaagaaagagaaaaagcagcagagcatcgccggatcagctgactcaaagccaatagatgtgagccggctggacttgagaattgggtgtatcatcactgcaaggaagcaccccgacgctgacagtctctatgtggaggaagtagatgtcggcgaaatcgcgcctagaaccgttgttagtgggctggttaatcacgtgccattggaacagatgcaaaatagaatggtgattttgctgtgtaacctaaagccagcgaagatgcggggtgtcctatcccaagcaatggtaatgtgcgcttcctcacccgagaaaatcgagattcttgcaccacctaacggctcagtcccgggtgatagaatcacgttcgatgccttccccggtgaacctgacaaggaacttaatccaaaaaagaagatttgggaacagatccagcctgacttgcatacgaacgatgagtgtgtggccacatataaaggggtaccctttgaagtgaagggaaagggcgtgtgccgagctcaaaccatgtccaacagtggaatcaagtag

SEQ ID NO: 214199 - DNA, 453 bp, Artificial Sequence
  Description of Artificial Sequence: Synthetic coding sequence
atggctaacaacgacgctgtccttaaacgcttggaacagaagggtgccgaagctgaccaaatcatagaatatttaaaacagcaagtaagcttgcttaaggaaaaagctatcctccaagctacgctgcgtgaggaaaaaaagctgagggtggagaacgctaaactgaagaaggagatcgaggagttaaagcaggagctaatccaagccgaaatacagaatggagtaaaacagattccgttcccaagcggcactcccttgcatgctaacagcatggtcagcgagaatgtgatacagtctactgctgtgaccaccgttagctccggcacaaaggagcagattaaaggcggtacgggagacgaaaaaaaggcgaaggaaaagattgaaaaaaaaggcgagaagaaggaaaaaaagcagcaaagtatcgccggatccgcggactcgaaacctatctag

SEQ ID NO: 214200 - DNA, 1227 bp, Artificial Sequence
  Description of Artificial Sequence: Synthetic coding sequence
atgacaagcaaaggtccggaagaggaacaccctagcgtcaccttgttccgtcagtacctgcgaatacggaccgtgcagcctaaacccgactacggtgcggcagtggccttttttgaggaaaccgctcggcagttgggattggggtgccagaaagtcgaagtggcacctggttacgtagtaaccgtgctaacctggcctggaacgaatcctactctctcttcaatcctattaaacagccacaccgatgtggtgcccgtgttcaaggagcactggtctcatgaccccttcgaagcatttaaggacagtgagggttacatctacgcaaggggggctcaggacatgaagtgtgtaagcatacagtaccttgaggcggtaagacgactgaaagttgaaggccacaggttcccgaggaccattcatatgacattcgtgccagatgaggaagttggaggacatcaagggatggaactgtttgttcagaggccagagtttcatgcactgcgtgccggtttcgccctggacgagggtatagcaaaccccaccgatgccttcacagtgttctatagcgaacggtcgccctggtgggtcagagtgacatctaccgggaggcccggacacgcctcccgttttatggaggacacagccgctgaaaagctgcataaggttgtgaacagcattctggctttcagagagaaggagtggcagaggctgcaatctaacccccacttaaaggagggctcggtgacatccgtcaatcttacaaaactggagggtggagtggcatacaatgtgatcccagcaacaatgtctgcttcatttgatttccgagtcgccccagacgtcgactttaaggcgtttgaagagcagctccagagctggtgtcaggccgcaggcgaaggtgtgacactggagttcgcccagaaatggatgcatccccaggtcacccctacagatgactccaacccgtggtgggccgcattctcaagagtgtgtaaggatatgaacttgacattggaacccgaaattatgccggctgctaccgacaatcggtatataagggccgttggtgtgccggctttggggttcagtccaatgaataggacacctgtgctactgcatgaccatgatgaacggctgcatgaggctgtgttcctgcgtggggtggatatttataccagactattgccagccctggccagcgtgcctgcgctgccttcagactcatag

SEQ ID NO: 214201 - DNA, 1497 bp, Artificial Sequence
  Description of Artificial Sequence: Synthetic coding sequence
atgtggggttgccaggccccactgtcaaggctcccagccagcggtgaaacaccaatgagtcagagttggctggtctcgccgctggctacgaggccatcctttaccgctcgatgtagtcactccacccgccataccgggtggcggtggtgctgctttatggagcggcctcttacccttactcggggttcttcatgggctcattgctcttactgtcatagaggtgcgaccggcccatggccgctcacatttcagctcactacaaggtcagcaatgacatccaagggaccggaggaagaacacccaagcgtcacgctgttcagacagtacttgagaatccgaacagttcagcctaagccagattatggcgcagccgtggcttttttcgaggaaactgcaaggcaattgggcctcgggtgtcagaaagtggaagtggctccaggttatgtggttaccgtgctgacttggcccggaacaaatcctaccttgtcatctatcctgctgaattcccacaccgatgtggtcccagtcttcaaagaacactggagtcatgacccgtttgaggctttcaaagattccgaggggtatatatatgccagaggcgctcaggatatgaagtgtgtgtcgatccagtacctggaagcagttcgcaggttgaaagtggagggccaccgtttccccaggactattcatatgacttttgtccccgacgaggaagtaggcggacaccaaggaatggagctgttcgtccagcgtcctgaattccacgctttgcgggcaggcttcgccctggatgaaggaatcgccaaccctaccgacgccttcacagtcttctatagcgaacgatccccctggtgggtacgggttacaagcaccgggcgtcccggacatgctagccggttcatggaggatactgcagccgaaaaactgcataaggtggttaattcaattctcgcgtttagggaaaaggaatggcagagactgcagtctaacccgcatctcaaggaggggagtgtgacctcagtgaacctcacgaaacttgagggcggtgtggcatataatgtcattcctgctaccatgtccgcctcatttgattttcgggtcgcaccagatgtggactttaaggcatttgaagagcagctccagtcttggtgccaagctgccggagagggcgtgaccctcgagtttgctcagaagtggatgcatccgcaggtcacaccaacagacgacagcaatccatggtgggcggctttctcaagggtgtgtaaagacatgaacctaacgctggagccagaaataatgcctgcagcaaccgataatagatacatacgcgcagttggcgttcctgccctgggatttagtcccatgaatcgaacccctgtcttgttgcacgatcacgatgagcgacttcatgaggcagtgttcctcaggggcgttgacatctacacgcgactgttgcccgctcttgccagcgtcccagctctaccctctgattcttag

SEQ ID NO: 214202 - DNA, 1122 bp, Artificial Sequence
  Description of Artificial Sequence: Synthetic coding sequence
atgacttctaagggtcccgaggaggagcacccttctgtaacactctttaggcagtacttgcgcatccggacggtgcaaccgaagcccgattatggaaccaatcccactcttagttccattctgctgaatagccacactgacgtggttccagtgttcaaggagcactggagccacgatcccttcgaagctttcaaggacagtgaaggatatatctacgccagaggcgctcaggacatgaagtgcgtgtctattcagtaccttgaagcagtgaggaggttaaaggtggagggacaccgctttccgcgaacaatccatatgacgttcgtacccgatgaggaggtcggaggccatcagggaatggaactttttgtgcagcgaccggaattccatgccttaagggctggattcgctctggacgagggcatcgcaaaccccactgatgcttttaccgtgttctattcggaaagatccccatggtgggtgagggtgacctccaccggccgacccggtcacgcatccagatttatggaagatactgcagccgaaaaactgcacaaagttgtaaactctatcttggcttttagggaaaaagaatggcagagattgcagtccaatccgcaccttaaggaggggtcagtgacctctgtgaacctgactaagctcgagggcggtgtggcatataacgtcatcccagcgactatgtcagctagtttcgactttagagttgcacccgacgttgattttaaggcatttgaggagcagctccagagctggtgtcaggctgcaggggagggcgtgaccttggagttcgcacagaagtggatgcatcctcaagtgaccccgacagacgatagcaacccttggtgggctgcattttcaagagtctgtaaagacatgaacctcacccttgaacctgaaattatgcctgcagcgaccgataatcggtatatacgcgctgtgggggtgcccgcactcggcttctcacccatgaaccggacaccagtgcttctacacgaccacgatgaaaggctgcacgaggccgtctttctgcgaggtgtggatatttacacccggttactaccagcacttgcctcagtgcctgctctccccagtgattcctag

SEQ ID NO: 214203 - DNA, 1032 bp, Artificial Sequence
  Description of Artificial Sequence: Synthetic coding sequence
atgactagtaaaggtcccgaggaagaacatccctctgtgaccctgtttcggcaatacctgcggatcagaactgtccaacctaagccagattacggggctgccgtagcctttttcgaggaaactgcgagacagctcggactgggctgccagaaagtagaggtggcacccggttacgttgtgaccgtactgacatggcctggcactaatcctactctgtcctccattctactcaacagccacacagatgtggtgcccgtgttcaaagaacattggtcacatgaccccttcgaggcttttaaggactccgaagggtacatatacgcacggggtgcacaggacatgaagtgcgtgagcatccagtatctcgaggctgtcaggcgactgaaggtggagggccataggttccccaggacgatccacatgacgttcgttcccgacgaagaggtgggaggacatcaaggaatggaactcttcgtgcaacgtcccgaatttcacgccctgagagctggcttcgcattggacgagggcattgcaaaccccaccgatgcctttactgtcttctatagcgagcgatctccatggtgggtgagggttactagcacgggacggcctggtcacgcatctcgttttatggaggacacagccgctgagaagctcgctttcgaggagcaactccagtcctggtgccaggccgcaggcgaaggggtgacccttgagttcgcacagaagtggatgcacccccaggtgactcctacggatgactccaatccttggtgggctgcgttcagcagggtgtgtaaagatatgaaccttaccctagaaccagagatcatgcccgctgctacagacaacagatacattcgcgctgtgggtgtgccggcattgggattctccccgatgaacagaacgcccgtcctattacacgatcatgatgaacgcttacacgaagctgtgttcctgcgaggggtcgacatctacactaggctgttgcctgcattagctagcgtgccggctcttcccagcgattcgtag

SEQ ID NO: 214204 - DNA, 1011 bp, Artificial Sequence
  Description of Artificial Sequence: Synthetic coding sequence
atgacctccaagggaccagaggaagagcatccaagcgtcacgctcttcaggcagtatcttcgcataagaaccgtccaacccaagcctgactatggtgccgctgtggcattcttcgaggagacggctcgccaactcggtctgggatgtcaaaaagtggaagtggcacccggatatgtggtcacggtcttgacttggccaggcacaaatcccaccttgagcagcatcttactgaatagccacactgatgtcgtgcctgtgttcaaagagcactggtctcatgacccttttgaggccttcaaagacagcgaaggaatcgccaaccccactgacgccttcaccgtgttctactccgaacgatcgccgtggtgggtgagggttacctctaccggtcgtcctggacacgcctccagattcatggaggacacggctgcagagaaactgcataaggtggtcaattctatcttagccttccgggagaaggaatggcagcgactacaatcaaaccctcatctcaaggagggttctgttacaagtgtcaatcttactaagttagagggtggcgttgcctataacgtcatccccgcaaccatgtccgcctctttcgacttcagagtggctcctgatgtagatttcaaagctttcgaggagcaactgcagtcctggtgccaggcggcaggcgagggcgtgacactcgaattcgctcagaaatggatgcatcctcaggttacgccgacagacgactccaatccgtggtgggctgccttcagccgcgtgtgtaaggatatgaacctgacgctcgaacctgaaattatgcctgccgcaactgacaaccgctacattagggcagtcggcgtccccgcacttggcttctcgcctatgaataggacccccgtgctacttcacgatcacgacgagcgattacatgaggctgtatttctccggggtgttgatatctacacccgcctgctaccagccttggctagcgtaccagccttgccctctgacagttag

SEQ ID NO: 214205 - DNA, 1278 bp, Artificial Sequence
  Description of Artificial Sequence: Synthetic coding sequence
atgaattacgcaagattcatcacagcagcaagtgccgcacggaatccatctcctataagaacaatgacagatatcctgagcagggggccaaaaagcatgatctccctggcaggaggactgcccaatccgaacatgtttccctttaagacagcagtcataacggttgagaatgggaaaacaattcagtttggcgaggagatgatgaagcgggctctgcagtatagcccttccgccggaatcccggagctgctgtcctggttaaaacagctgcagatcaaactccacaaccccccaaccatccactaccctccctcccaggggcagatggatctgtgcgtgactagtgggtcacagcaaggtctgtgtaaggtcttcgagatgatcatcaatcccggtgataacgtgctcctggacgaacccgcatattccggcacattgcagtcgctgcatcccctgggctgcaacatcatcaatgtggcctccgacgagtccggaatcgtgcctgactctctccgcgacatcctttcacggtggaaacctgaggatgcaaagaatccccagaagaatacgcccaagtttttgtataccgtgcccaatggtaataaccccactgggaattcgctgactagtgaacgcaaaaaagagatttacgaactggccaggaagtacgattttcttataatcgaggacgacccttactactttctgcagtttaacaaattccgggtgcctacatttctctcaatggacgtcgacggccgtgtgatccgggcagacagcttttccaaaataataagctcgggactgcgtataggtttcttaacaggacccaagcccctgattgaaagggtgatattacacatccaggtaagtactctgcacccttctacttttaaccagttgatgatttcccaactgttgcacgaatggggcgaggagggctttatggcccacgttgatagagtgatagacttctactctaaccagaaggacgctatcttggccgcagcagataagtggctgactggcctggctgaatggcacgtgcccgcagcgggtatgtttctgtggatcaaggtgaaaggtatcaatgacgtgaaagaattgattgaagaaaaggctgttaaaatgggcgtgctgatgctccctggcaatgctttctacgttgattcatccgcgccttccccatatctccgcgcatctttcagctccgctagcccagaacaaatggacgttgctttccaggtccttgcccagctgataaaggaatccttgtag

SEQ ID NO: 214206 - DNA, 1278 bp, Artificial Sequence
  Description of Artificial Sequence: Synthetic coding sequence
atgaattatgccagatttatcactgcagcgtcagccgctaggaacccctcccctattaggactatgacagatatcctcagccgcggacctaaatctatgattagtctggctggcggtctgcccaaccctaatatgttccccttcaagaccgctgtaattacagttgaaaacggcaagacaattcagtttggcgaagagatgatgaagcgggcattgcagtactccccaagtgcgggaattcccgagctcctgtcttggcttaaacagctgcaaatcaagcttcacaatcccccaaccatacattatccacccagtcagggacagatggatttgtgcgttaccagcgggagtcagcagggactgtgcaaagttttcgaaatgatcattaaccctggggacaacgtgctcctggacgaaccagcttacagcggcactctgcagagccttcaccctctaggctgtaacattattaacgttgcttcagacgaatcaggcattgtgcccgatagtctgagggatatcctatcaaggtggaagccagaggacgctaagaaccctcagaagaatacccccaagttcctctataccgtgcctaatggtaataacccaactgggaattctctgacttctgagaggaagaaggagatttacgaactggccaggaaatacgactttctgattatcgaagatgacccttattacttcctacaattcaataagtttcgggttcctactttcttgagcatggatgtggatggacgcgtcatccgcgcagatagttttagtaagatcatcagctcaggactccgcatcgggtttcttactggcccaaagccccttatcgagcgcgtgattctgcatatacaggtaagcaccctccacccttcaacattcaaccagttgatgatttcccaactattgcacgagtggggggaggagggctttatggcacacgtggacagagtgatcgatttttatagtaaccagaaagatgcaatactggccgctgctgataaatggctgaccggacttgcggagtggcacgtgccagcggcaggtatgtttctgtggattaaagtgaagggcatcaatgacgtaaaggaactcatcgaggagaaagccgtcaaaatgggcgtgttgatgttgcccggaaacgccttttacgttgactcttctgcaccaagcccctatctccgggcttctttttcgtctgcctctcccgaacagatggatgtagcatttcaggtattggctcagctgatcaaggaaagcctatag

SEQ ID NO: 214207 - DNA, 543 bp, Artificial Sequence
  Description of Artificial Sequence: Synthetic coding sequence
atgaattatgctaggtttatcacagcagccagcgctgctcggaacccgagtcctattcgcacgatgacagacattttgagtagaggtccaaagtctatgatttcccttgccggaggccttccgaatccaaacatgttccctttcaagaccgcagtgattaccgtggagaacgggaaaactatacagttcggtgaagaaatgatgaagcgagcgctgcagtacagtcctagtgcagggatcccagaactgctttcttggctgaagcagcttcagattaaattgcacaatcctcccacgatacactaccctcccagccagggccagatggatctctgtgtgacttccggctcacagcaagggctctgcaaagttttcgaaatgattatcaacccaggggataacgtactactggacgaacctgcctactcgggcaccttacaatccctccaccccctgggctgcaacataattaatgttgcaagcgacgaaagcggaatagtgcctgactccctcagagacatcttaagtcgctggaaaccctag

SEQ ID NO: 214208 - DNA, 630 bp, Artificial Sequence
  Description of Artificial Sequence: Synthetic coding sequence
atgaattatgcacggttcattacagctgcaagcgcggctcgcaatccatcccctatcagaacaatgacagacatactgtcacgaggaccgaagtcaatgatatctctggcaggtggactgccaaacccaaacatgttccccttcaaaacagccgtaatcaccgtggaaaacggcaagaccattcagttcggtgaagagatgatgaaaagggcgttacagtactcaccaagcgccggaattccagagctgcttagctggctcaagcaactgcaaatcaaattgcacaatcctcccacgattcactatcccccttcccaaggccagatggatctgtgtgttacttccggctcacagcagggcctctgtaaggtatttgagatgatcataaatcccggagacaacgttttgctggacgagcccgcatattccggaacactacaatccctgcaccccttggggtgtaacatcatcaacgtcgcctcggacgaatctgggatcgtgcctgacagtctcagggacatcctaagtcgctggaagccagaggatgccaagaatccccagaaaaacactcctaagttcttgtacaccgtgcccaacgggaataacccaacgggcaattcactcacatag

SEQ ID NO: 214209 - DNA, 1290 bp, Artificial Sequence
  Description of Artificial Sequence: Synthetic coding sequence
atgaactatgccagatttatcacagctgcctctgccgcaaggaatccttccccgatcagaactatgtctgagaagcgcgcagatattctgtctagagggcctaagtcaatgatcagcctagccggtggacttcctaatccaaatatgtttccgttcaagactgctgtgatcactgttgagaacggaaagactattcagtttggggaggaaatgatgaagcgagctctccaatacagcccctcagcaggcatccctgaactgctctcgtggctaaaacaactacagataaagctacacaacccaccaaccattcattacccaccttcccagggacagatggacctgtgcgtcacctccggcagtcaacaggggctctgcaaagtttttgaaatgatcatcaatcccggagataacgtcttactcgacgagcccgcatattctggtactctgcagagcttgcacccattaggatgtaacattatcaacgtggcaagcgatgaaagtggtatcgtgccagactcactaagagatatactctcaaggtggaagcccgaagatgctaagaatcctcaaaaaaatacccctaaattcctctataccgtcccaaacggaaacaatcctaccggcaatagcttaacatcggagagaaaaaaggagatctacgagctggctagaaagtatgactttttgattatcgaggatgatccctattactttttgcagtttaataaattcagagttcctacatttctgtcgatggatgtggacggtcgcgtaatacgggcagacagtttctcgaagatcatcagttcagggttaagaattggtttcctcactggacccaagcccctgattgagcgcgtgatccttcatatacaggtgagcaccttgcaccctagcacctttaatcagctgatgataagccagctcctccacgaatggggcgaggaggggtttatggcccatgttgatagagttattgatttttacagcaaccaaaaggacgccatcctcgctgccgctgacaagtggttgactgggctcgccgagtggcacgtgcccgctgctggcatgttcttgtggatcaaagttaaagggatcaatgacgtgaaggaactgatcgaagagaaggccgttaaaatgggggtgctcatgctccctggaaatgcattctacgtggatagttcggccccttctccttatctcagggcatctttttcaagtgccagtcctgagcagatggacgtcgcatttcaagtgctcgctcagctaataaaggagtctttgtag

SEQ ID NO: 214210 - DNA, 1278 bp, Artificial Sequence
  Description of Artificial Sequence: Synthetic coding sequence
atgaactacgccaggttcattactgctgcgtcggccgctcggaacccttcacctatacggacaatgacagatatcctgtcaaggggtccaaaatcgatgatttctctggccggaggattaccaaatccaaacatgtttccctttaagacagccgtcatcactgtggagaacggcaaaacaatacagttcggggaggagatgatgaagcgcgcactccagtacagccctagtgccggaatccctgagctcttgagctggctcaagcagttacaaatcaaattacacaaccctccaaccatccattatccgccttcccagggtcaaatggacctgtgcgtcacgtccggctctcagcaaggcctgtgcaaggtgtttgagatgatcatcaacccaggtgacaatgtccttctagatgaacctgcttattccggaaccctgcaatccctgcaccccctggggtgtaacattatcaacgtggcctctgacgagtcggggattgtgccagatagcctccgagacattctcagtaggtggaagcctgaggatgccaaaaatcctcagaagaatacccccaagttcctatatacagtgcccaatggtaataatcctacgggcaatagtctgacttctgagaggaaaaaagagatctacgaactcgctcgcaaatacgatttcttaatcatcgaggatgacccatattatttcttgcagtttaacaaattcagggtgccgacatttttatcgatggatgtggatggacgcgtcatcagagcagactcattctctaaaatcatctcatccgggctgaggattgggtttttaaccggcccaaaacccctgattgaacgggtgatactgcatatccaagtatccactctgcatcccagtacatttaaccaactaatgattagccagctgctgcacgagtggggcgaggaaggttttatggcacacgttgaccgtgtgattgacttttacagcaatcagaaggatgccattctggcagcagccgacaaatggctcaccggcttagccgagtggcacgtaccagcagctggaatgtttctctggattaaggtcaaggggattaatgatgttaaggaactgatcgaggaaaaggccgttaaaatgggtgttctaatgctccccggaaatgcattctacgtggatagctctgcccctagtccttatcttcgagccagcttcagttccgcctccccagagcagatggacgttgccttccaagtactcgcgcagcttataaaagagtctctttag

SEQ ID NO: 214211 - DNA, 621 bp, Artificial Sequence
  Description of Artificial Sequence: Synthetic coding sequence
atggccccttcccacctttccgtcagggagatgagggaagatgaaaaacccctcgtgttggagatgctaaaggccggagtcaaagacacagagaatagagtcgccctgcatgcactaacccggccacctgccctgctgctgctggccgcagcgtcctcagggctgaggttcgtgctcgccagtttcgccctcgctctgctcctccccgtattcctcgcggtggccgctgtgaaactgggtctgcgcgcacggtgggggagtttaccccctcccggtggcctgggtggcccttgggtagccgttcgtggctctggggatgtttgtggagttctagcactggccccagggacaaatgctggggacggcgcacgggtaacaaggctgagcgtgagcaggtggcacaggcgtcggggagtgggcagaaggctcctggcctttgccgaggcacgggcacgagcatgggcagggggaatgggagagcccagggccaggctggtagtgccagtcgccgtagcagcctggggtgtgggcggaatgctggaaggatgtggatatcaggcggagggcggatgggggtgtctcggatacaccctggtgcgcgagttctctaaggatctatag

SEQ ID NO: 214212 - DNA, 1842 bp, Artificial Sequence
  Description of Artificial Sequence: Synthetic coding sequence
atggtcagtaaggatgcaagcgtcaaggagtatatttttaaagaacttcagaaatacttgcccagtcacgcggtcccagacgagctggtcctaatcgattccctgccttttactagtcacggaaagatcgacgtgtcagagctaaacaaaatatacttaaactatatcaaccttaagagcgaaaacaagctttctggcaaagaagacctctgggaaaagctacaatacctttggaaatctactcttaacctgccggaagacctactgagagtccctgacgagtcactgtttctgaattccggtggagactctttgaagtctattagactgctttccgagattgagaaactcgtgggaacaagcgttccagggctcctcgaaataatactgtcttccagtatcctggaaatttacaaccacatccttcagacggtagtgccggacgaggatgttaccttcagaaagagctgcgcaactaagagaaagctgtcagacatcaaccaggaggaagcttctggcacttccctgcatcaaaaagccatcatgacctttacctgccataatgaaatcaatgccttcgtagtcctctctagagggagccagatcctgtcgctcaattctaccagattcctgaccaaactgggccactgctcatctgcatgcccctccgacagtgttagccaaactaacatccagaatctgaagggccttaatagccctgttctcattggaaagagtaaggatccctcttgtgtggcaaaggtgtctgaggagggcaagcccgctatcgggacacaaaagatggagctacacgtaaggtggaggtctgataccggaaagtgtgtggatgcatcaccattagtagttatcccaacattcgataaatcaagcaccacagtgtatattggaagtcactcccaccggatgaaggcagtcgatttttattcagggaaagttaaatgggaacagattttgggggaccggatcgagtcctccgcctgcgtctcgaaatgtggaaatttcattgttgtcgggtgttataatggtctggtgtatgtcctcaagtccaactccggggaaaagtactggatgttcacaacggaggacgctgtgaagagttccgcaactatggaccccacgaccggactcatttacattggaagccacgaccagcacgcttacgccttggacatctacagaaaaaaatgtgtctggaagtccaaatgcggcggaacagtgttttcatctccctgcctgaacctcataccccaccacctctatttcgctacgctaggcggattgctcctggcagtgaatccagctaccggcaatgtaatctggaaacatagctgcggaaagccgttgtttagttccccacagtgttgcagccagtacatttgcattgggtgcgtggatgggaatctgctctgtttcacccatttcggagagcaggtgtggcagttttcaacatctgggccaatattttcttctccttgtacttccccttcagagcagaagatctttttcggctctcacgactgctttatatattgctgtaatatgaagggacacttacagtggaagttcgaaaccacaagcagagtgtatgccactccgttcgccttccacaattataacggctcaaatgaaatgctcttggctgcagcatctacagacgggaaggtgtggatactcgagtctcagtccgggcaactgcagagtgtatatgagctgccaggagaggttttttcttctcctgtcgtgctggagtccatgttgattataggctgccgggataactatgtgtactgcctggatctgttggggggaaatcaaaaatag

SEQ ID NO: 214213 - DNA, 2574 bp, Artificial Sequence
  Description of Artificial Sequence: Synthetic coding sequence
atgacgctgcaagaactggtccacaaggcagctagctgctatatggatcgcgtagcagtctgcttcgatgagtgcaacaatcagctacctgtgtactacacctacaagacagtcgtgaacgctgccagcgaactcagtaactttctcctattacactgtgatttccaaggaattagagaaattggactgtattgtcagccgggaattgacctgccttcttggatcctcggcattctgcaggtcccagcggcatatgttccaatcgaacccgactcacctccttccctctcaacacatttcatgaagaagtgcaatctaaagtacatcctggtcgaaaaaaaacagattaataaatttaagagcttccacgagactctcctgaactacgacactttcacggtagaacataacgatcttgtgctatttaggctacactggaagaacaccgaagtaaacctgatgcttaacgatggcaaggagaagtatgagaaggagaagataaagtctatcagtagtgagcacgtcaacgaggagaaggcggaggaacatatggacttgagattgaaacattgcctagcttatgtgcttcatacatcgggaacaactggtattccaaagatcgtccgcgtacctcataagtgcattgtacctaacatacagcatttcagggtcctgttcgatatcactcaggaagatgtattgttccttgcgtctcctctcacgttcgatccttcggtcgttgagatcttccttgctctttcttccggcgctagcttgctgattgttccaaccagcgtcaaacttctccctagcaaactggcctcggtgctgtttagccaccatcgcgtcacagtgctccaggccacacccaccctgttaagacggttcggcagccagctgattaagagtaccgtgctctccgctacgactagtctaagggtgttggccctgggtggtgaagcgtttccatccctaacagtgttgcggtcctggaggggggagggaaacaagacacagatttttaatgtgtacgggataaccgaagtgagctcatgggcaactatttataggattccggagaagaccctaaatagtaccttgaaatgtgagctgcctgtgcagctgggattcccactgcttggtaccgttgtggaggttcgggacaccaacgggttcaccattcaggagggtagcgggcaggtttttttgggaggaagaaatcgagtctgtttcttagacgacgaggtcacagttccactggggaccatgagggcaacgggtgactttgtcactgttaaggatggggagatctttttcctgggtaggaaagactcccaaatcaagcgacacggcaaacgactgaacatcgagttagtccaacaggtagcagaggagctccagcaggtcgagtcatgtgcagtcacgtggtacaatcaggagaagctgatcttgttcatggtatcgaaggatgcatctgttaaagagtacatcttcaaagagctccagaagtacttgccttctcatgccgtccctgacgagctagtgctgattgactccctgcccttcacgtctcacgggaagattgacgttagcgagttgaacaaaatttatctcaactacattaatctgaagtccgagaacaagctttctggtaaggaggacttatgggagaagctacagtatctgtggaaaagtaccctgaatctccctgaggacttacttcgggtgccagacgagtccctttttctgaactctgggggagacagtctcaagtccattcgactgctaagcgaaatagaaaagcttgttggtacttccgtcccgggtcttctggagatcatcttaagcagttccattcttgaaatttacaaccatatattgcaaactgtggtaccagacgaggatgtgactttccgaaagtcgtgtgccactaagcgcaagttatctgatattaatcaagaggaggcatctggtacatcccttcatcagaaggccatcatgaccttcacgtgtcacaacgagatcaacgcgtttgttgtgctgtcccggggaagccagattctaagtctgaatagcactcgatttctgaccaaattagggcattgctcaagtgcgtgtccatccgactctgtaagtcagactaacattcagaaccttaagggcctgaactcacccgtgctcattggtaaatcaaaggaccccagctgtgttgccaaagtgtctgaagaaggcaagcccgcaatcggaacacagaagatggaattgcacgtaagatggcggagtgacaccggcaaatgtgtggatgccagtcctctggttgttattcctacttttgataagtcttccacaactgtgtatataggcagtcatagccaccgaatgaaagcggtggacttttatagcggaaaagtgaagtgggagcagattcttggtgatcgcattgagtctagtgcttgcgtgagtaaatgcgggaacttcatcgtggtgggcctggccgtcttataccagtggaccaacctgtttattccagtgtatctgactattagagccaaaaacattttttggttcccttag

SEQ ID NO: 214214 - DNA, 2526 bp, Artificial Sequence
  Description of Artificial Sequence: Synthetic coding sequence
atgactctgcaggaactagtccataaagccgcttcttgttacatggaccgagtcgccgtgtgcttcgacgagtgcaacaaccaactccccgtgtactacacatacaagaccgtggtaaacgctgcctccgagctgagtaatttcctgctgctacactgcgacttccaagggattagggaaatcggattgtattgccagcccggaattgacctgccatcttggatccttggtattctccaggtgcccgctgcttacgtacctattgagccagatagccctccatcactttccacccattttatgaaaaaatgtaaccttaagtatattcttgtcgagaaaaagcagatcaataaattcaagtcctttcatgaaacgttactcaattacgacacctttacagtggaacataatgatctggtgttgtttagactgcactggaagaataccgaagtgaacctgatgctgaacgatggcaaggagaaatatgagaaggagaaaatcaagtcaatctcaagcgagcatgtcaacgaagaaaaggcagaagagcatatggacctgagattaaagcattgtctcgcttacgtgctgcatactagcgggacaacgggcattcccaagattgtgcgcgtcccgcataaatgcatcgtacccaacattcagcatttcagagttctattcgacatcacacaggaggatgttctgtttttggcatctcctttaacatttgacccctccgtcgtggaaattttcctcgccctttcatctggggcttcattgctgattgtgccgacgagcgtgaaacttctcccaagcaagctcgcctcagttctgttttctcaccatagggtgactgtcctacaagccaccccaactctgctaagacgttttggcagtcaactcattaaaagtactgttctctccgccacaacctcactgcgggttctggccctggggggagaggcttttccctctctcaccgtcctccggtcttggagaggagagggcaataagacgcaaatatttaacgtttacggaatcacagaggtctcttcctgggctactatctaccgcataccagagaagaccctcaatagcacccttaaatgtgaacttcctgtgcaactgggctttcccttgctgggtacggttgttgaggtgagagataccaatggtttcaccattcaggagggctctggacaagtgtttctgggtgggagaaatcgggtgtgcttccttgacgatgaagtgacagtgccactaggtaccatgcgtgctaccggggattttgttacagtgaaagatggcgagatcttttttttggggagaaaggattcacagataaaaaggcacggaaagcgattgaatatcgaattggttcaacaggtggctgaggaactgcagcaggtagagtcgtgtgctgtgacctggtataatcaggagaaattaatcctgtttatggtgagcaaggacgcctccgtgaaggagtacatctttaaggagctgcagaaatatcttccaagtcacgccgtgccagacgagcttgttttgattgacagccttccttttacttcccatggcaaaatcgatgtttcagagcttaataaaatttaccttaattacattaacttgaagagcgaaaacaagcttagcgggaaggaagatctgtgggagaaattacagtatttgtggaaatctactcttaatctccccgaggatctcctgcgcgttcctgatgagagtctgtttcttaactccggaggcgatagtctgaagagtattcggctcctctcagagatcgagaagttggtcggtacatctgtgcccggacttctagaaatcatcttgtcgagctccattctagaaatttataaccatatcttgcaaactgtggttccagacgaagacgtgacttttaggaaatcctgcgcaactaagaggaagctgtccgatatcaatcaggaggaagccagcgggacatcactccatcagaaggctattatgacatttacctgccacaatgagataaatgcctttgtggttcttagcagagggtcacagattctcagtctgaacagcactcgatttctcacaaaactaggccactgcagcagcgcatgtccttccgattccgtgagccagacaaacatacagaacctcaaaggactgaactcccccgtcctcataggcaagtcaaaagatccaagttgcgtagcaaaagtttccgaagagggaaaacccgcaatcggcacccagaaaatggagttacacgtgcggtggagatcagatacagggaagtgcgtggatgcaagcccactggtagtgatccctactttcgataaatccagcactaccgtgtacattgggtctcattctcatcgtatgaaggccgtggatttctattctggcaaggtaaagtgggagcagatccttggcgatcggattgaaagctcagcatgtgtgagcaagtgcggcaatttcatcgtcgtcggcaaattcctgaacctgcggtttgtggaattaaactag

SEQ ID NO: 214215 - DNA, 2997 bp, Artificial Sequence
  Description of Artificial Sequence: Synthetic coding sequence
atgaagaagtgcaatctgaaatatattttagtcgaaaaaaaacagatcaacaaatttaaatcttttcatgagaccctgctgaactacgacacattcacagttgaacacaatgatctggtccttttcaggctgcactggaaaaataccgaggtaaacctgatgcttaatgatggtaaagaaaagtacgagaaagagaagattaagagtatctcatctgagcacgtaaatgaggaaaaggcggaagaacatatggacctccgcctgaagcactgcctggcttatgttcttcacaccagtgggacgaccggcatccctaagattgtgcgggtacctcacaaatgtatcgtgccaaacattcagcactttagagttttatttgatattactcaggaggacgtcttgtttcttgcttcccctctgaccttcgatccaagtgtggtggagatcttcctggcgctgtcttcgggcgcatcattgttaattgtacctacctccgtgaagctgcttccctccaagctcgcctctgtcctttttagtcaccaccgggtgaccgttcttcaggcgacccctaccctcctaaggcgatttggcagtcagctcatcaaaagcaccgtgctgagtgccacgaccagtttgcgcgtgctcgcgctcgggggagaggccttcccgtctctcacggtgttaaggagctggaggggagagggcaataaaactcaaatcttcaacgtatacgggatcactgaggtctcatcgtgggccacgatttatcgcatccctgagaaaactttaaactcgaccctgaaatgcgagttacctgttcaacttggtttccctctgctcggtacagtagttgaagtcagggataccaatggctttacaatccaggaagggagcggacaggttttcttgggcggacgcaatcgcgtgtgcttcttggacgacgaggtcactgtaccattggggacaatgagagctaccggtgatttcgtgacagttaaagatggtgaaatcttcttcctagggagaaaagactcccagataaagagacatggaaaacgtctaaacattgagctggtccagcaagtggccgaagagctgcagcaggtggaatcctgcgccgttacctggtacaatcaggaaaaactcattctgttcatggttagtaaggacgcgtcagtgaaagaatacattttcaaggagctgcaaaaatatctcccatctcacgctgttccagacgagctcgtccttatcgatagcctgccttttacgagtcacggtaaaattgatgtgagcgagttgaataaaatatacctcaattacattaacctgaaaagcgaaaataagcttagtgggaaagaggatctgtgggagaagctgcagtacttgtggaagagcactctcaacctccccgaggaccttctgagagttcctgatgaaagtctgttcttgaatagcggtggtgactcactgaagagtatacggctgttgagcgagattgagaaattggtcggcacttcggttccgggactgttggagattatccttagttcaagcattctggagatatacaatcatatacttcagacggtcgtccctgacgaggacgtaaccttcagaaaaagctgtgccaccaagcgtaaattatccgatatcaaccaggaggaagctagcggtacatctttgcatcagaaggctatcatgacattcacctgccataacgaaatcaatgcattcgtggtcctgagccggggatcccaaattctgagcctgaactcgacaagatttctgactaagttggggcattgcagctccgcctgtccctccgatagtgtcagtcagacaaatattcagaatcttaaggggctgaattcacctgtgcttatcggaaagagcaaggacccctcttgcgtggccaaagtgagtgaagaaggcaagccagcgatcggcacccagaaaatggagttacatgtccgctggaggagcgatactggcaagtgtgtcgacgccagtccactcgttgtgattcccacatttgacaagtcaagcaccacagtctacatcggatctcattcccatcgaatgaaggcggtggacttctacagtggcaaggtgaaatgggagcagatcctgggggaccgcatcgagtccagcgcctgcgtctcaaagtgcgggaatttcatagttgtgggctgttataatggactggtttacgtgctgaaatctaactcaggcgagaagtattggatgttcaccactgaagatgccgtcaaatcaagcgcaacgatggatcccacaactggtctcatctacattggaagtcatgatcaacacgcctacgccctcgacatctacagaaagaagtgcgtgtggaaatccaagtgcggtggaaccgtgttcagttcaccttgcctcaacttgatcccgcaccacctttactttgcgactctggggggactgctgctcgctgtcaacccagccactggaaatgtaatttggaaacattcttgcggcaaacccctattcagttcacctcagtgctgtagccaatacatttgtattggctgtgtggacggaaatctcttgtgcttcacacactttggcgagcaagtctggcaattctcaacttcgggacccatcttctcctctccctgcacctctcccagcgaacagaagattttttttggttcacatgattgctttatctactgctgcaacatgaagggacatctccagtggaaattcgagacgacaagccgcgtatacgcgacccctttcgcctttcataattataacggcagtaatgaaatgctgctggccgcagctagtaccgacggcaaggtgtggattctcgagtcacagtccggccagctgcagagcgtttatgagcttccaggagaagtattttcatctcccgtggtccttgagagtatgttgatcattgggtgccgcgataactatgtgtactgcctggatctgctcgggggtaatcaaaaatag

SEQ ID NO: 214216 - DNA, 2781 bp, Artificial Sequence
  Description of Artificial Sequence: Synthetic coding sequence
atgctgcaggtgcacaggacggggcttggtcggctcggagttagcctatccaaaggtctgcaccacaaagccgttctggcagtgagacgagaagacgtcaatgcctgggagcggagagctcctctggctcccaaacatatcaagggaatcactaacctgggctacaaagtgcttattcagccttctaatcgaagggcaatccatgataaggattatgtaaaggccggaggcatattacaggaggacatctctgaggcttgcctcatcttgggagtgaagagaccgcctgaggagaaattaatgagccgtaagacctacgccttcttctcacacacaataaaagcgcaagaggccaacatgggcttgctcgatgaaatcttaaagcaggagatcaggcttatcgattacgaaaagatggtggaccaccgaggggtacgggtggtggcctttggtcaatgggcgggagtcgcgggtatgattaatatcttgcacggtatgggtctgcgtctgctcgcgttgggacatcatacgccattcatgcacataggaatggctcacaactatagaaattctagtcaggccgttcaggcagtccgtgatgccggttacgagatatctctggggttaatgccaaagtccattgggcctctgactttcgtgttcaccggaacaggaaatgtatctaagggagcccaggccatatttaacgagcttccttgcgaatacgttgagcctcacgaattgaaagaagtctctcaaacaggtgatttgcgtaaggtttacggtactgtattgtcacgacaccaccacctcgttcggaaaaccgacgcggtgtacgaccctgctgagtacgataagcaccctgagcgctacatatcacgtttcaataccgatattgctccatatacgacatgcctgattaatggcatctactgggagcagaacaccccacgactactgactcggcaagatgcccagtccctgctggctccgggaaagttctcaccggctggggtggagggctgccctgccctgccacacaagctagtcgccatttgcgatatctctgcagacaccggcggttcaatcgagttcatgacagagtgtacaactatagagcacccattttgcatgtacgatgccgatcagcacataatccatgatagcgtggagggaagcgggatactaatgtgcagcatcgataacctccccgcacaactgccaattgaggccacagaatgttttggggatatgctgtacccttacgttgaagaaatgatactgtccgacgcgacacagcctctggagagccaaaatttcagccctgtcgttcgagacgcagttattacctccaacgggacacttccagacaagtataaatacatacagactctcagagagtcccgcgaaagggcccaatctctgagtatgggtacccgacgcaaagtactggttttaggctctggatacatttcagagcccgtgctagagtacctttcgcgtgatggtaacattgaaatcaccgtagggtcggatatgaagaatcaaatcgagcagcttggcaaaaaatacaatatcaacccagtgtctatggacatctgcaagcaggaggaaaaactagggtttcttgtggctaagcaggacctggtaatctccctgttgccatacgtcttgcacccactggtggccaaagcatgcattaccaacaaagtcaatatggtcacagctagttatatcactcctgccttaaaggaactcgaaaaatctgtggaagacgccggaatcaccataatcggcgaactcggactggatcctgggctggaccacatgttggcaatggaaaccattgataaggcgaaagaagtcggcgcaaccatagagtcatacatttcttattgcggtgggttacccgctccagagcattccaacaacccattgcggtataagttctcgtggagcccagtgggagtgttaatgaatgttatgcagagcgccacctacctacttgatggcaaggttgttaacgtcgccggaggcatctcttttttggatgccgtgaccagcatggacttcttccctggattgaaccttgaaggctatcctaatagagactccaccaaatacgccgaaatctatggaattagctccgcccatactctgctcagaggaaccttaaggtacaaaggctacatgaaagctctcaatgggttcgtcaaactgggacttattaatcgagaggctctgcccgctttcaggccggaggccaatcccctgacttggaagcagctcctgtgcgacctcgtgggtatcagtcccagtagcgaacatgacgtgctgaaggaggcggtgctgaaaaaactgggaggcgacaatacgcagctcgaggcggctgagtggctcgggctgctgggggacgagcaggtacctcaggccgaaagcattttagatgcgctgagcaagcacctcgtcatgaaattgagttacggcccagaagaaaaggacatgatcgtgatgcgtgacagctttgggatccgacacccaagcggccacttggaacacaagactatcgatcttgttgcctacggagacattaacggatttagtgctatggcgaaaacagttgggctccccactgccatggccgctaaaatgttactcgacggggaaattggagcaaagggcctgatgggaccattttcaaaagaaatctacggtcctatcttggagaggatcaaggccgaagggataatttataccactcagtctaccattaagccctag

SEQ ID NO: 214217 - DNA, 2781 bp, Artificial Sequence
  Description of Artificial Sequence: Synthetic coding sequence
atgctgcaggtgcacagaaccgggctcggcagactcggggtgagcttgtccaaaggccttcaccataaagccgtcctagctgtaaggagggaagacgtaaatgcttgggaaagacgagcccctcttgcacctaagcatatcaaaggaatcacaaatctaggatacaaagtgctgattcagccatccaatcgccgagctattcacgataaggattatgtcaaggcaggtggtatcctgcaggaagacataagtgaagcttgtctcatcctcggtgtgaagcggcctcccgaagagaaactgatgtctcgtaaaacatacgcatttttttcccacacgattaaagcgcaggaggccaatatgggattgctggatgagatcctgaaacaagaaatcagactgatcgactatgaaaaaatggtggaccaccgaggcgttcgcgtggtggccttcggccaatgggcaggcgtcgccggaatgatcaatattcttcacggtatggggctccgactccttgctctcgggcatcatacaccgtttatgcatataggcatggcccataattataggaactcaagccaggctgtacaggcggtcagggatgccggatatgaaatttccttgggcttgatgccaaagtccatcggacctctgaccttcgtgtttaccggtacggggaacgtaagcaagggagcccaagcaatattcaacgaactgccttgcgagtatgtcgaaccccatgaactcaaagaggtgtctcagaccggagatctgcgtaaggtgtatggcacggttttgagccgccatcaccatcttgtgcggaaaaccgacgccgtctatgatcctgccgaatacgataaacacccggaaaggtacattagccggttcaacacagatattgctccatatactacctgcttgattaacggcatatattgggagcaaaacactccaaggctactgacccggcaggatgcacagtcgctgttagcccctggtaagttctcgcccgcaggcgttgaaggttgccctgcactgcctcacaagctcgtggccatctgtgatatatctgccgacactggaggctctattgaattcatgactgaatgtacgacgatcgaacatccattttgtatgtacgatgcagatcagcatattattcacgattccgtggagggaagtgggatcctgatgtgcagcattgataaccttccagcgcaactccctatagaggctactgaatgttttggggatatgctctacccctatgtcgaagagatgattctaagcgatgccacacagccgttggagtctcagaacttttcacccgtcgtccgggatgccgtaatcacctctaacggcaccctgccagataaatacaagtatatccaaacacttagagagtcacgtgaaagggcccagagtcttagtatgggcacaaggcgaaaagtcctagtgttgggcagtggctatatctccgagcctgtgctggagtatctcagccgagacgggaacatagaaattaccgtaggctcagacatgaaaaatcaaatcgaacagctaggaaagaagtataatatcaatccggtgagcatggatatctgcaaacaggaagagaaactaggattcttggtggccaaacaggacctcgtgatctctcttcttccttatgtgttgcaccccctggttgccaaggcatgtatcactaataaagtgaatatggtgaccgccagctacattacccccgctctgaaggagctggagaagtccgtagaggacgcagggattacaatcatcggggagcttggtttagatccgggtctcgaccatatgctagccatggagacgatcgacaaggccaaggaagtgggcgctacaatcgagagctatattagctattgcgggggacttcccgcacccgagcattccaacaatcccttacgctataagttcagttggagccctgttggcgtgctgatgaatgtgatgcagagcgcaacatacttactggacggcaaggtagtgaatgtggcaggaggcattagcttccttgacgctgttacctccatggacttctttcccggactcaatctggagggctacccgaatcgcgactccacaaagtatgccgaaatctacggaatttcctccgcccatacactgttaagggggactttacgatataagggctatatgaaggccctaaacggattcgtaaagctgggtctgataaatagagaagcgttgcccgcttttcgacctgaggcgaacccactcacgtggaaacagctgctctgcgacttggtggggatctctccctcttcagaacacgatgtactgaaggaggcagtgctgaagaagctgggtggcgacaatacccaactggaggccgctgagtggttggggctgctgggggatgagcaggttccacaggcagagtccatcctggatgcactgagcaagcacctggtaatgaagttgtcatacggcccagaggagaaggatatgatcgtaatgagggatagcttcggcatcaggcacccctcaggccatctggagcacaagactattgatctggtggcatacggagacataaatggattctccgctatggcgaaaactgtcggtctgcctacggcaatggctgctaagatgctgctggatggggagataggagcaaaaggcttaatgggacccttttcaaaagaaatttatggccctatcctcgagcggataaaagccgaaggaatcatctatacaacacagagcacaattaagccatag

SEQ ID NO: 214218 - DNA, 942 bp, Artificial Sequence
  Description of Artificial Sequence: Synthetic coding sequence
atgcaaccccagtcagttctgcactctggctatttccacccactgttaagggcgtggcagacagccaccactactttaaacgcctccaatctcatttacccgatttttgtgacttacggcgtgaagaggcttgaggaaatgctccgtccccttgttgaagaaggtttaaggtgcgtcttgatctttggtgttccctcacgcgtgcccaaggatgagcgcggttcagctgcggactccgaagaatccccagccatcgaagctattcacctgctgaggaagaccttcccgaatctgcttgtagcttgtgacgtgtgtttgtgcccctatacctcgcacggccactgcggtttgttaagcgagaacggggctttccgggcagaggagtcacgacagcgcttggctgaggttgccttagcttacgcaaaagctggatgtcaggtggtggctccctcagatatgatggatggcagggtagaggctataaaggaggccctgatggcccacggtctgggaaaccgcgtttcggtaatgtcttacagtgctaaattcgcaagttgtttctatggtccattcagggacgccgctaaaagttccccggctttcggggatagaaggtgttaccagcttccgcctggagcaagaggattggcccttagggctgtcgatagagatgtgcgagagggagctgatatgctgatggtgaagccaggcatgccctacctagatatcgttagggaagtgaaggacaaacatcctgatttgccattggcagtctaccatgtcagtggtgagtttgccatgctgtggcatggcgcacaagcaggggcttttgatctcaaggccgctgtgcttgaggcaatgacggcatttagacgcgctggagccgacattatcatcacctattatactccccagttgctgcagtggctcaaggaggagtag

SEQ ID NO: 214219 - DNA, 993 bp, Artificial Sequence
  Description of Artificial Sequence: Synthetic coding sequence
atgcaaccacaaagtgtcctgcattcgggctacttccacccactgctgcgcgcatggcagacagctacaactacgctcaatgcttccaatctgatctaccctatcttcgttactgacgtgccggatgacatccaacccatcaccagcctccccggagttgccagatatggtgttaaacgcctcgaggaaatgctgaggcctctggtggaggaaggcttgagatgtgtcttgatcttcggggttccatcaagagtgccaaaagacgagaggggatccgccgctgactctgaagagagtccagccatcgaagccattcacctacttagaaagacattccctaaccttttggtggcatgtgacgtttgtctgtgtccctacacatcacacggtcactgtggcctcttgtccgagaacggcgctttccgtgccgaagaaagccggcagaggttggcagaggtggctctggcctacgctaaggcaggatgccaggtggtggcgccaagcgatatgatggacggacgggtggaagctataaaggaggctcttatggctcatgggttaggaaacagagtgtcagtaatgtcctatagcgccaagtttgccagttgcttctacggcccttttcgggacgccgcaaaatcatctcctgcattcggtgatcgcaggtgttatcagctgcctcccggtgccagagggctagctctgagagccgtggatcgtgatgtgcgggagggagccgacatgcttatggtgaaacctggaatgccctacctcgatatcgtgcgagaagtaaaagataaacatccagatttgccactggctgtataccatgtatcgggcgaatttgcaatgctgtggcacggtgcccaagctggcgcttttgatttgaaggccgcagtattggaggccatgaccgcattccggcgtgcaggcgctgacatcattatcacctactatactccacaactgctccagtggttaaaggaagaatag

SEQ ID NO: 214220 - DNA, 45 bp, Artificial Sequence
  Description of Artificial Sequence: Synthetic coding sequence
atgccactgtgtccgttggcccacgccatgcagccacagtcctag

SEQ ID NO: 214221 - DNA, 363 bp, Artificial Sequence
  Description of Artificial Sequence: Synthetic coding sequence
atgcccctctgtcctctggcacatgctatgcaaccccaatcagtgcttcatagtggttacttccatcccctgctgagggcctggcaaacagctacaaccactctaaatgccagcaatctcatctaccccattttcgttactgatgtaccagatgatatacaacccattacaagcctgcctggagttgccagatacggggttaagcgccttgaggagatgctgcgccctttagtcgaagagggcctgagatgcgtcttaatcttcggagttccaagcagagttcccaaagatgaaagggggagtgccgcagacagcgaggagagccctgccatcgaagcaatacacctcttgcgaaaaacctag

SEQ ID NO: 214222 - DNA, 180 bp, Artificial Sequence
  Description of Artificial Sequence: Synthetic coding sequence
atgccactatgccctctcgcgcacgctatgcaacctcagtcggtcctccactccggctattttcaccccctgctgagagcgtggcaaactgccactaccaccctgaatgcatccaatctaatttatcctatcttcgtgacagatgtacccgacgacatacagcctataacttccctgtag

SEQ ID NO: 214223 - DNA, 1923 bp, Artificial Sequence
  Description of Artificial Sequence: Synthetic coding sequence
atggagagcgtggtcaggagatgtccatttctgagcagggttccgcaggcctttttacagaaggcaggtaaatcactgctgttctacgcccaaaactgccccaagatgatggaggtgggggcaaagccagctcccagggcacttagcacagccgctgtccactaccagcaaattaaagaaacgcctccagcgagcgagaaagataagacagccaaagccaaagtgcaacagacacctgatggctcccaacagtctccagacggcacccagctgcctagtggacaccctctcccggcaacatcacagggcacagcctccaaatgcccctttctggcagctcagatgaatcagcgcggaagctccgtgttttgtaaagcatccctggagcttcaggaggacgttcaagagatgaacgccgtacgcaaagaggtcgctgaaacatctgctggaccttctgtggtgtccgttaagactgacggcggtgacccttccgggctactgaagaactttcaggatatcatgcagaaacagaggcctgaaagagtcagccatcttctccaggataacctcccaaagtcagtgagtaccttccagtatgaccggttcttcgagaagaagatcgatgagaagaagaatgatcatacttatagagtattcaagactgttaacaggcgcgcacacatatttccaatggccgatgactacagtgattcactgatcaccaagaaacaggtctccgtctggtgtagcaacgattaccttggaatgtcacggcacccgagagtgtgtggggctgtgatggacaccctaaagcagcacggggcaggggctggagggacgcgaaacattagcggaaccagcaagttccacgtagacctcgaaagggagctggccgacttacatggaaaagatgcggcactcttgttcagcagctgcttcgtggctaacgactctacactgtttactctagccaagatgatgcccggatgtgaaatttacagtgactccgggaaccacgcaagtatgatccagggaatcagaaattctagagtgcccaaatacatttttcgccacaacgacgtgtcccacttgcgagaactgctccagaggtccgatccgtcggtgcccaagatcgttgcttttgaaacggtccattccatggacggagctgtgtgccctctggaggaactgtgcgacgtcgcccacgaatttggtgctattacattcgtagatgaagttcacgccgtgggtctgtacggggcaagggggggtgggataggagatcgggatggagtaatgccaaagatggatattattagtggcaccctgggaaaggcctttggttgtgtggggggttatattgccagtacaagttcccttatcgacacagtgagatcgtacgccgcaggcttcattttcactactagcctaccccctatgttgctcgcaggggctctcgagagcgtccgaatcctgaagtcagctgagggcagagttctgcggaggcagcatcaaaggaatgtgaagctgatgcgacaaatgctcatggatgctggccttccagtggtgcattgcccttcgcacatcatccccgtaagggtggccgacgcagccaagaatacagaggtgtgcgacgagctaatgtcccggcacaatatttacgtgcaggctatcaactatcctaccgtccccaggggcgaggagctcctgcgcatagctccaacacctcatcacacaccgcagatgatgaattattttctggaaaacctccttgttacctggaaacaagtcggccttgaattaaagcctcattcatcagctgagtgtaacttttgcaggcgtccattgcattttgaagtgatgagtgagcgtgagaaatcctatttcagcggcctgtctaaactagtcagtgctcaggcctag

SEQ ID NO: 214224 - DNA, 1923 bp, Artificial Sequence
  Description of Artificial Sequence: Synthetic coding sequence
atggagtcagtggttaggagatgcccattcctctcccgagttcctcaggccttccttcagaaagctggaaaatctctgcttttctacgcccagaactgtcccaaaatgatggaagttggcgcaaagcctgctccaagggccctcagcacagcggcagttcattatcagcaaataaaagagaccccaccagcctccgaaaaggataagacagccaaggcgaaggtccagcagacaccagacgggtcacagcagtcccctgacggcacgcagttaccctctggccatccgttaccagccacgtctcaaggtaccgcttcgaaatgcccatttctcgcagcccaaatgaaccagagaggtagcagcgtattctgcaaggcctcactggaattacaagaagatgtgcaggagatgaacgctgtcagaaaggaagttgcagagactagcgcgggaccctctgtcgtgtccgtgaagactgatggtggcgacccctctggcctgttgaagaacttccaggacataatgcagaaacagcggccagagagggtgtctcatctactgcaggataacctccccaagtccgtatccacattccaatacgaccggttctttgaaaaaaagatcgacgagaagaaaaatgatcatacctacagggtgtttaagacggtgaatcggagagctcacatatttcccatggcagacgactactccgacagcctaattaccaagaagcaggttagtgtgtggtgctctaatgattacctcggcatgtctcgtcacccccgtgtttgcggggctgtcatggatacgctgaagcagcatggcgcaggggctggaggcacacgcaacatctccggaaccagcaagttccatgtggatctcgagagggagcttgctgacctacatgggaaggatgccgctcttctgttttcaagctgctttgtggccaacgactccactctattcacactagccaagatgatgccgggatgcgagatttatagcgactcaggaaaccatgcaagcatgatccagggcatcagaaatagcagggtgccgaaatacattttccgccacaatgatgtgtcccacctccgtgaactgttgcagcggtctgatccaagtgtacccaagattgttgcgtttgagaccgtccactcaatggacggagcagtttgcccactggaggagttatgcgatgtcgcccatgaattcggcgcaataactttcgtagatgaggtccacgcagtgggcctttacggagctcgaggcggtggcatcggcgaccgtgatggggtaatgcctaagatggatatcattagtggaacactggggaaggctttcggctgcgtggggggatatatcgcttcaacctcctccctgatcgacacagtacgcagctacgcggcaggcttcattttcactactagtctcccccctatgctccttgccggagcgctggaatccgttaggatcttgaagagcgccgagggacgcgtgctgcgcagacaacaccagagaaatgtaaaacttatgaggcagatgctgatggatgcaggactacccgttgtccactgtccctcccatataattcccgtgcgagtcgcagatgctgccaagaacactgaagtatgcgacgaactgatgagccgacataatatttacgtgcaagctatcaactacccaacagtgcctaggggtgaggagcttttgagaatagccccaacaccccaccataccccacagatgatgaactactttctggagaatctcctggttacatggaaacaggtaggtcttgagttgaaaccacactctagcgctgaatgtaatttctgtagacgacccctccatttcgaagtgatgagcgaaagagagaaaagctatttttctgggctgtcaaaactcgtgagtgctcaagcctag

SEQ ID NO: 214225 - DNA, 345 bp, Artificial Sequence
  Description of Artificial Sequence: Synthetic coding sequence
atggagtccgttgttcggcgatgtcccttcctttcccgtgtacctcaagcctttctgcaaaaagcaggaaagagcctgctgttttacgcccagaactgcccgaagatgatggaggtgggggctaagcctgcacccagagcgctgtcgaccgccgctgttcactaccaacagataaaagagactccgcctgcaagcgaaaaggacaagacagcgaaggctaaagtgcagcaaacccctgatgggagccaacaaagtcctgacggaacgcagttcaggctcgataccccatgtttgcctcaagccagggcgctgcaagctaatgccctttcatggcagcaccggtag

SEQ ID NO: 214226 - DNA, 1923 bp, Artificial Sequence
  Description of Artificial Sequence: Synthetic coding sequence
atggaatcagtcgttcgacgttgtccctttctcagccgggttccccaggctttcctccaaaaggctggtaaatcacttctgttctacgctcagaattgtcctaaaatgatggaggttggcgctaagccagctccaagggcgttatctaccgctgctgtccactaccagcaaataaaggagacacctcctgcatcggagaaagataagacggccaaagccaaggtgcagcagacacctgatggttcccagcaatcaccagacgggacccagctgccttctggacatcccctcccagccacgagccagggcaccgcaagtaaatgtccctttcttgctgcacaaatgaatcagcgaggaagttccgtcttctgtaaggccagcttggagctacaagaggacgtgcaagagatgaacgcagtgaggaaggaggttgctgaaacctcagcgggaccttctgttgtgtcagttaagaccgacggcggtgatcccagcggcctgttgaaaaattttcaggacatcatgcaaaagcaaagacccgaacgcgtatcacatctgctgcaagataatctgccaaaaagcgtttcgacatttcagtatgaccgtttctttgagaagaaaatcgacgagaagaagaacgaccacacgtaccgtgtcttcaagacagtgaatagaagagcacacatattccccatggcagacgactactctgactccctgatcactaagaagcaagtttcagtctggtgttctaacgactacctcggcatgtccaggcatcctagagtgtgtggcgcagttatggacactctaaagcaacacggggctggtgctggcggtaccagaaacattagtggtacgagtaagtttcacgtggacctggagagagaactggccgacctgcacggcaaggatgccgctctcctgttctccagctgttttgtggcgaatgattcaacactgttcactctggctaaaatgatgccagggtgcgagatctactccgacagtggcaaccatgcttcgatgatccagggcatcaggaactcgagggtaccaaaatacatctttcgacacaatgatgttagtcacctgcgggaacttcttcagcggagtgatccttctgtgccaaaaatagtggcattcgagaccgtgcactcaatggatggtgctgtctgcccactggaggagctttgtgacgtagctcatgaatttggagctattacttttgtcgatgaggttcatgctgtagggttgtacggggctcgcggtggaggaattggagaccgtgatggtgtcatgcctaaaatggatatcatcagcggcacattggggaaagcctttgggtgcgtaggtggttatattgcttctacctcttccttaatagacactgtgagaagctatgccgctggcttcatcttcactacgagcctgcccccaatgttgctcgccggtgcgctggagtcagtgcgtattctgaaaagcgcagagggcagggttctgcgaagacagcatcagcggaatgtgaagctgatgaggcagatgctgatggatgccggtctgcctgtagtccattgccctagccatatcattccagtgcgggttgccgacgcagcaaagaatacagaggtgtgcgacgaactgatgtcacgccacaacatatacgtgcaggccataaactacccaacagtgccacggggagaggaattgctaaggatcgctcccacccctcatcacaccccacaaatgatgaattatttcctggaaaatctccttgtgacctggaaacaagtagggctggagctcaagccacactccagcgctgagtgcaacttctgtaggagacccctacacttcgaggtgatgagtgaacgggagaaaagctatttcagtggactgtccaagctggttagtgcccaggcttag

SEQ ID NO: 214227 - DNA, 1923 bp, Artificial Sequence
  Description of Artificial Sequence: Synthetic coding sequence
atggaatccgtggttcgtcgctgtccctttctgtctcgggttccacaagccttcctgcagaaagccggaaaatccctactgttctacgctcagaattgtccgaagatgatggaggtgggtgccaagccagctccaagggcgctgagcacagcggcagtccactatcaacagattaaagaaacccctcccgcatccgagaaggataagactgcaaaggcaaaggtccaacagacgcccgatggatcacaacaatctccggacggcacccagttgcctagtggccaccctctcccggctactagtcagggcactgccagtaaatgtcccttcctagctgctcagatgaatcagcgaggaagcagtgtgttttgcaaggcctccctggagttgcaagaggatgttcaggagatgaacgcagtgagaaaggaagtggctgaaacttctgcgggaccatctgtggtgtccgttaaaaccgacgggggtgacccgtcggggctcctgaaaaatttccaggatataatgcagaagcagcggcctgaaagggtgagccaccttttgcaggacaacctgccgaagtcggtcagtacttttcagtatgatagattttttgagaaaaaaattgatgagaaaaagaacgatcatacatacagagtatttaagactgtgaacagacgagctcacatttttcccatggcagatgactacagtgattctcttatcacaaagaagcaagtctcagtctggtgctctaatgattatctgggtatgtcaaggcaccctcgggtctgcggagcagtcatggacaccttgaaacaacacggcgcaggggctgggggtacgcgaaacatcagtgggacgtctaagttccacgtggatttggagcgcgaactcgctgacctccacggaaaagacgcggctctcctcttctccagttgctttgtcgccaacgatagcacactctttacacttgctaaaatgatgcccggatgtgaaatttatagtgatagcggaaaccatgcctcaatgattcaaggaatccggaactctcgggtccccaaatatattttccggcacaatgacgtgtcccaccttcgtgaacttcttcaaaggtccgacccctccgtgccaaagatagttgcgttcgaaaccgttcattcaatggatggggctgtgtgccccctggaagagttgtgcgatgtggcacatgaattcggcgctatcacattcgtcgacgaggtgcacgctgtgggcctgtatggggctcgtggaggcggaatcggcgaccgagatggcgtgatgcccaagatggatatcatctctgggactttgggtaaggcattcggctgcgtcggcggatacatagcgtcaacatcctcacttatcgacactgtgcgcagctatgccgctggctttatcttcacgacaagcctgccccctatgctcttggctggagccctggagagcgtccgcatcctgaaatctgctgaggggagggtcctgcgacgacagcaccagcgaaacgtgaaactaatgaggcaaatgctgatggacgccggactgcctgtggtgcattgtccgagccacatcatccccgtacgggttgcagacgccgctaagaacaccgaagtctgcgacgagctcatgagccgccataatatctatgttcaagctatcaattatcctacggttcctaggggagaggagcttctgaggatcgcacctacaccccaccacaccccccagatgatgaattacttcctggaaaatcttttagtgacatggaaacaggtcgggctggaactgaaacctcatagctcggctgagtgtaatttctgtcgccgacccctgcacttcgaagtgatgagcgagcgcgagaagtcatacttctccggactttctaagctagtctcagcgcaggcatag

SEQ ID NO: 214228 - DNA, 1764 bp, Artificial Sequence
  Description of Artificial Sequence: Synthetic coding sequence
atggttactgccgctatgctgctgcagtgctgccccgtgctggcacggggtccaacaagtttactgggcaaggtggtgaaaacccaccagtttctttttgggatcggccgttgtcctattctcgctacccagggccctaactgctcccagatccaccttaaagccactaaagcagggggagactcacctagctgggccaagggccattgtccctttatgctgagtgagttgcaagacgggaaaagtaagatcgtccagaaggctgcaccggaggtgcaggaagatgtgaaagcctttaagactgacctgccttcatctttggtgtctgtctcattacggaaaccattttctggacctcaagagcaagaacagatttctggaaaggtcacacatcttattcagaataacatgccagggaattatgtgttctcttacgaccagttttttagagataagattatggagaaaaaacaagatcacacttatcgagtttttaaaaccgtaaataggtgggcagatgcctaccccttcgcccagcatttttccgaggcctccgtggcgtccaaagacgtgagcgtatggtgtagcaatgattacctcggaatgtctcgacaccctcaggtgctgcaagctacacaagaaacgctgcaacggcacggcgctggtgctggcggaacccgcaacatctccggcaccagtaagttccatgtagagctggagcaggagctggctgagctgcaccagaaggattcggctctgctctttagttcatgcttcgtggctaatgattctacgcttttcacactcgctaagatcttgcctggctgcgagatctacagcgatgcagggaaccatgcctccatgatccagggcatccgaaacagcggagcggcaaaattcgtttttaggcacaacgaccctgatcatttgaaaaagttgcttgaaaagtctaaccctaaaatcccgaaaatcgtagcattcgaaaccgtgcacagcatggatggcgctatttgccctctcgaggaactatgtgacgtttcgcaccagtatggagcccttacattcgttgacgaggtccacgccgtcgggctgtacggatcacgcggagccggaataggggagagggatgggatcatgcacaagatcgatatcattagcggcacgctgggcaaagccttcggttgtgtaggcggttacattgcgtctacgagggatctcgtggacatggtccgtagttatgctgcaggctttatctttaccactagtctacctcccatggtgctgagcggggcactggagtcggtgcggttgcttaaaggagaggaaggccaagcgctcaggagagcccaccaacgtaatgtcaaacacatgagacagctgttgatggatcgagggctgcccgttattccatgtcctagccatatcatacctattcgcgtgggtaacgctgctcttaactccaagctgtgcgatcttcttctgtccaagcatggtatctacgttcaggccataaactaccctacagtcccacgtggggaagagttgcttcggctggccccaagcccccatcactctcctcaaatgatggaagactttgtggaaaaactacttctcgcttggaccgcggtcggactccccttgcaggacgtgtcagtggccgcatgtaatttctgccggagacctgttcattttgagctgatgtcagagtgggagcgatcctactttggcaacatggggccacaatacgtgacgacctatgcttag

SEQ ID NO: 214229 - DNA, 1653 bp, Artificial Sequence
  Description of Artificial Sequence: Synthetic coding sequence
atggtgacagctgctatgctgttgcagtgttgtcctgtactggccaggggacctacctcattgctaggaaaagttgttaaaacgcaccagttcttgttcggaatcggcagatgtccaatcttggccacgcaagggccaaattgttcgcaaatccatctgaaggcaacgaaggcgggaggcgattctccaagttgggcaaagggacactgccctttcatgcttagtgaactgcaggacggtaaaagcaagatcgtccagaaagctgccccagaggtgcaggaggatgtcaaagcttttaagactggcaactacgtgtttagctatgaccagtttttccgagacaaaattatggaaaagaaacaggaccatacgtacagggtattcaaaaccgtgaacaggtgggctgatgcgtacccattcgcccagcacttcagcgaggcttctgtggcttccaaggacgtctccgtgtggtgcagtaatgattaccttggtatgtcacggcatccacaggttctacaggcaactcaggaaactcttcagagacacggcgcaggggcaggaggcactagaaatatttctggcaccagtaagtttcatgttgagttggaacaggagcttgcagagctccaccagaaggattcagccttactgttttcaagctgtttcgtggcaaacgattccacactctttacactcgccaaaattctcccgggttgtgagatttactctgacgccggaaatcatgcatccatgatccaaggtatcagaaactcaggggcagcaaagtttgtgttccggcacaacgacccggaccaccttaagaagctcctggaaaagagcaatccaaagatccctaaaattgtggcctttgaaaccgtgcacagtatggatggcgcaatctgccccttggaagagctctgcgatgtgagccaccagtatggtgccttaacattcgtagacgaagtgcacgccgtgggcttgtacggcagcagaggcgcaggaatcggcgagcgagatggaatcatgcacaaaatcgacataatttcgggcactttggggaaggcttttggctgcgtgggtgggtatattgcttccacgcgggatctggtcgacatggtcaggtcttatgctgcaggcttcatatttacaaccagtttgcctcccatggtcctatctggggctctggagtcagttagactgctgaagggcgaagagggccaggccctccgaagagcccatcaaagaaacgttaagcatatgaggcagcttctcatggacaggggcttacctgtgatcccttgcccatcccacatcattcctatccgcgtgggcaatgccgctctgaatagtaagctttgtgatctgttactgagcaaacacggcatctatgtccaagctattaattaccccaccgttcctcggggagaggaactcctaaggctggctcctagcccccaccacagccctcagatgatggaagactttgtcgaaaaattgcttctggcctggacagccgtcggccttcctctccaggacgtttctgtggcagcttgcaacttctgtcgtaggcctgttcactttgagctgatgagcgaatgggaacggtcctatttcggcaatatggggcctcagtacgtaaccacctatgcctag

SEQ ID NO: 214230 - DNA, 1725 bp, Artificial Sequence
  Description of Artificial Sequence: Synthetic coding sequence
atgcgcggaggcgaggtagccctgggttggaataagaaaaagcgcttattttgtgaggatttccgctttaagatggttacggcggctatgcttttacaatgctgccccgtgcttgctaggggccctacttcactcctagggaaagtggttaaaacgcaccagtttctctttggaatcggacggtgccctatactggctactcaggggccaaactgtagccagattcatcttaaggctacgaaagcaggcggagactcaccctcatgggcgaagggccactgtccctttatgctgtctgaactacaggacggcaagtcgaagattgtgcagaaggccgcacctgaagtgcaggaggatgtgaaagccttcaagactgggaactatgtcttctcttatgatcagttttttcgagataaaataatggagaaaaagcaagatcacacctatcgcgtgttcaagaccgtcaacaggtgggctgacgcctatcccttcgcacagcactttagtgaagcttcagtggcctcaaaggatgtctccgtctggtgtagcaacgactacctaggtatgagcagacacccccaggtactgcaggcaacacaggagactcttcaacgacacggtgccggagccggaggaaccaggaacatttccggaacctccaagttccatgtggaattagagcaagaactggctgaactgcaccagaaagactctgctctgctgttttcatcttgttttgtcgccaacgacagcacgctcttcactctcgccaagatccttcctggatgcgagatatatagcgatgcgggtaaccacgctagcatgatccaaggaattcgaaacagcggcgctgccaagttcgtattccgccacaacgacccggatcacctcaagaagctcctcgagaagagtaatcccaaaattccgaaaatcgtcgctttcgaaacagtgcattctatggatggagccatttgtccactggaagaactttgcgacgtgagccatcagtatggcgcacttaccttcgtcgacgaggtgcacgccgtggggctatacggctctagaggcgcaggaattggtgaacgcgatggaatcatgcataaaattgacatcatctcaggcaccctgggaaaggcctttgggtgcgtcggcggatatatcgcgtctacccgggacttggtagatatggtgcgctcctacgctgcaggcttcatcttcactacttctttgcctcctatggtattgtctggagctttggagtccgtgcgactgctgaagggggaggagggtcaagcccttcggagggcgcatcagagaaacgtgaaacacatgagacagcttctcatggaccggggactaccagttattccatgtcctagtcacatcatacccattagggtgggaaacgcagcgctcaacagtaagctgtgcgacctgctgctttctaaacatggcatctatgtccaagcaatcaactaccccacagttcccagaggggaggagctgctgcgtttggctccaagccctcaccatagtccacaaatgatggaagattttgtagagaaattgctgctcgcttggaccgcagttggtctaccactgcaggacgtatcagttgccgcatgcaatttttgtcgccgacctgtgcactttgagctaatgtctgaatgggagcgcagttattttgggaatatgggtcctcagtacgttactacatacgcctag

SEQ ID NO: 214231 - DNA, 669 bp, Artificial Sequence
  Description of Artificial Sequence: Synthetic coding sequence
tgactgtcctttgtccgtccacagtgcagggccactgatagcccgtcctgggccaagggtcactgccccttcatgctgagcgagttgcaggacggtaagtcaaaaatcgtgcaaaaggccgctcctgaagttcaggaagatgtgaaggccttcaagaccgacttgccttcgtctcttgtaagtgtgagcctgagaaaacctttttcaggaccccaggagcaggaacagatctccggtaaggtgacacaccttatacagaataacatgcccggtaattacgtgttcagttacgatcaatttttccgagacaagataatggaaaaaaaacaagatcatacctatcgagtgttcaaaacagtgaacaggtgggccgatgcttatcccttcgcccagcattttagtgaggctagtgtagcaagtaaagacgtcagcgtgtggtgctccaatgactatcttggaatgagccggcaccctcaggtgctgcaagctacccaagaaactctgcagcgccacggtgcgggagcaggcggaactaggaacatcagtggaacctcgaaattccacgtcgaattagaacaagaattggccgaactccatcaaaaggactctgcacttctcttctcctcctgcttcgtagccaacgactcaacgctatttactcttgcctag

SEQ ID NO: 214232 - DNA, 1212 bp, Artificial Sequence
  Description of Artificial Sequence: Synthetic coding sequence
atgcagcgggcagtgtctgtggtggctcgcctggggttccggctgcaggccttcccccctgcgctttgcagaccactatcgtgtgcccaagaagttcttagaaggacacccctatatgacttccatctggcccacggcggaaagatggtggcatttgcaggatggagcctccccgtgcagtatcgggactcacacactgactcccacctccacactcgccagcattgctctttattcgatgtgagccacatgctccagaccaagatacttggtagtgacagggtgaagcttatggagtcccttgtagtgggagatattgcagagctgcggccaaatcaggggacgctctctttattcactaacgaagccggagggatcctggatgatctcattgtgacaaacacatctgagggtcatttatacgttgtttcgaacgctgggtgttgggagaaagacctagcgcttatgcaggacaaggttcgggaacttcagaaccaggggagggacgtaggcctggaggtgttggataacgctttgcttgccttgcaggggcctacggctgctcaagtactacaggcgggtgtggccgatgatctccgtaaacttcccttcatgaccagcgcagttatggaagtgtttggcgtctctggatgccgggttacccgctgcggctatactggtgaggacggcgtggaaatctcagttcccgtagctggggcagtgcacctggctaccgcaattctaaagaatcctgaagtcaaactggctggattggccgcacgggattccttacgattggaggcgggtttgtgtttatatggaaacgacatcgatgagcataccacccccgtggaagggtccttgtcatggaccttggggaaaaggaggagagccgctatggattttccaggggctaaggttattgttccacagctgaagggacgggttcaacgtaggcgggtgggccttatgtgtgagggtgcgccaatgagggcgcatagccccatcctcaatatggaagggaccaagatcgggaccgtcacgagcggctgcccctcccccagccttaagaagaacgttgccatggggtacgttccttgcgagtactcccgtcctggaactatgcttctggtcgaggtcagacgtaagcagcagatggccgttgtgtcaaagatgcccttcgttcctactaattactacactcttaagtag

SEQ ID NO: 214233 - DNA, 1161 bp, Artificial Sequence
  Description of Artificial Sequence: Synthetic coding sequence
atgcagagggccgtttcagtggtggcccgactcggctttagactgcaagctttcccacccgctctgtgccgccctctgtcgtgcgctcaggaggtgctgcgacgcacacccctctacgacttccacttggctcatgggggaaagatggtggcctttgccggatggtccttgcctgtgcagtatagggattcccacactgactcccaccttcacacccgccaacactgctctttattcgatgttagccacatgctgcagaccaagattcttgggtcagatagggtgaaactgatggagtcactggtggtcggcgatattgccgaattacggcctaatcaggggaccctctcactcttcacaaatgaagcaggaggcattctggacgatcttatcgtgaccaataccagcgaaggccatctttatgttgtcagcaacgccggttgctgggaaaaggacttggcacttatgcaagacaaagtaagagaactgcagaatcaaggtcgggacgtggggcttgaagtgttggacaacgccttgctggccctccaaggacctactgccgcacaggtgttacaggctggcgttgctgacgaccttaggaagctgcctttcatgactagcgccgtgatggaagttttcggagtgtcaggatgcagagtcacgcggtgcggttacaccggcgaggacggagtcgagatcagtgtgcctgtggctggcgcagtgcacttagccacggccatccttaagaatccggaagttaagctagcgggtctcgcggcaagggacagtttgcgactcgaagctggtctgtgcttgtatggaaatgatattgacgagcacaccacgccggtggagggatcgctgtcctggactctgggtaagagacgtcgagctgccatggatttccctggagccaaggtgattgtgccccagcttaaggggagggtgcaaagaaggagggttggcttgatgtgtgaaggagcaccaatgagagctcattcgcctatcctcaatatggaaggtaccaagattggaactgtcaccagcgggtgcccttcgccttctttgaaaaagaatgtggctatgggatatgtcccctgtgaatactcaagacctggcactatgctgctggttgagttgccaagtggtccctgtttctag

SEQ ID NO: 214234 - DNA, 1155 bp, Artificial Sequence
  Description of Artificial Sequence: Synthetic coding sequence
taggccgtgtctgtagtggccagactgggcttccgtctccaggccttccctcccgctctttgtaggcctctgagttgcgcccaggaggttctccggaggactcctttatacgactttcatttggcccacggtggtaagatggtggcctttgctggctggtctctccctgtgcagtacagggattctcatacagacagtcacctacacacacgtcaacactgctccctttttgatgtttctcatatgttgcagaccaagatattgggttccgaccgtgttaagctaatggagtccctcgtggtgggggacatcgccgaactacgcccaaaccaggggacccttagcttgttcacaaacgaagccggaggtattctagacgatctcatcgtgacaaatacttctgagggccatctatacgttgtgtctaacgcgggttgctgggagaaagaccttgccctaatgcaggacaaagtcagggagttgcaaaatcaggggagagatgtgggcctggaggtgctggataacgctctcctggctcttcaaggccctacagctgctcaggtgctgcaggccggagtggcagacgacctgagaaaactgcctttcatgacatcagctgtgatggaagtgttcggtgtgagcgggtgccgggttactaggtgcggctatacaggtgaggacggagtggagatttccgtgcctgtggccggtgccgtgcacctcgcaacagccatcttgaagaatccagaagtaaagctggctgggcttgccgctcgcgacagcttgcggcttgaagctggactgtgtctgtacggaaatgatatcgatgagcatactaccccagtggaaggaagtctttcctggaccttgggcaagcggagacgcgcagccatggacttccctggcgcaaaagtgatagtcccacagctcaagggcagagtacagaggaggagggtgggtctgatgtgcgagggagccccaatgcgagcccactcccctattctgaacatggaaggcaccaagattggcaccgttacgtccggatgccctagcccctcattaaagaagaacgtagccatggggtacgtgccctgcgagtatagtcggccaggcacgatgctccttgtcgagttgccgagtggaccatgtttctag

SEQ ID NO: 214235 - DNA, 1080 bp, Artificial Sequence
  Description of Artificial Sequence: Synthetic coding sequence
atgcagagagctgtgtcagtagtcgcccgtctgggctttagattgcaggctttccccccagccctgtgccgaccactgagttgtgctcaggaggtgttgagaaggactcccctctacgatttccaccttgctcacgggggaaagatggtagccttcgctggttggtcgctgcctgtgcaatacagggattcacataccgattctcaccttcatacacggcaacattgtagcctctttgacgtttcccacatgctccaaaccaaaattcttggctccgatcgcgtgaaactgatggaaagcttagtggtgggtgatattgccgagctcaggccaaaccaggataaggtcagggaactgcagaaccagggcagagacgtcggtctagaagttctggacaatgctttgctcgcgctgcaaggccctactgccgcacaggtgttgcaggcgggagtcgccgatgatctacgcaagcttccctttatgacctcagctgtgatggaagtctttggcgtcagcggctgtagggttacaagatgcgggtacacaggagaggacggcgtggagatttccgtccctgttgcaggcgcagtacacctcgccacggccattctgaaaaacccagaggtcaaactggcaggtctggcagcgagggacagcctgcgcttggaagctggactctgcctctacggcaacgatattgatgagcatacaactccggtggaggggtcactctcctggacactcggaaagagacgccgtgctgcgatggacttccccggagccaaagtcattgtgcctcaactcaaaggcagggtgcagcgcaggcgtgtgggcctgatgtgcgagggagccccaatgcgcgctcattcccctattctgaatatggagggaactaagataggcaccgtgacatcagggtgtccatcccctagcttaaagaagaacgttgccatggggtatgtgccctgcgaatatagcagacctgggaccatgttactggtcgaggtgcgcagaaaacagcaaatggcggtggttagcaagatgccctttgttcccaccaattactacactttgaaatag

SEQ ID NO: 214236 - DNA, 1044 bp, Artificial Sequence
  Description of Artificial Sequence: Synthetic coding sequence
atgcagcgagcagtttcagtcgttgccagattgggattcagactgcaggccttcccgccagctctatgcagaccactctcttgcgcccaaacaaagatactaggctctgacagggtaaaacttatggaatcgttagtggtgggcgacatcgccgagctgcggcctaaccagggcacattgtcgttatttaccaatgaagcaggaggcatcctcgacgatctgatcgttaccaatacaagtgagggtcacctgtacgtcgtgtcgaacgccggatgttgggagaaagatcttgccctgatgcaagataaggtgagggagctccagaatcaaggtcgagacgtgggccttgaagtgcttgataatgctttgctggcccttcaggggcctactgccgctcaggtgctgcaggccggagtggccgacgatctgcgcaaactcccctttatgactagcgcagtgatggaggtgttcggcgtgtctgggtgcagagtgactagatgcggatacactggggaagatggagtggaaatatccgttcccgtagccggtgcagtgcatctggccacggctatcctgaagaaccccgaagtgaagctggccggattggccgcaagagactccctccgcctcgaagctggcctgtgtctttacggcaatgatatcgacgagcacactactcctgtggagggatcgctgagctggaccctcggaaagcgcaggcgagccgctatggactttccaggcgctaaggttatagtacctcaactgaagggccgagtccagcggaggagggttggcctaatgtgcgaaggcgctccgatgagagcccacagcccaatcctgaacatggagggtactaagataggcactgttaccagcggctgtccctcaccctccctcaaaaagaacgtcgcaatggggtatgttccctgcgaatattccagaccagggaccatgcttttagtggaggtaaggcggaaacagcaaatggcggtcgttagtaagatgcccttcgttccaacaaactattataccctgaaatag

SEQ ID NO: 214237 - DNA, 921 bp, Artificial Sequence
  Description of Artificial Sequence: Synthetic coding sequence
atggaaagcctagtggtcggcgatatcgccgagctgagacccaaccagggaactctgtcattgttcactaatgaggctggaggaatcctcgacgatttgatcgtgacaaatacgtccgaggggcatctgtacgttgtcagcaatgctgggtgctgggaaaaggatctggctctcatgcaagacaaagtgcgggaacttcagaaccaggggagagacgtgggattggaagtgctggataacgctctcctagcattgcaggggcctaccgctgcccaagtccttcaggccggagtagctgacgatttgcggaagctccccttcatgacaagcgccgtcatggaggtgttcggtgtgagcggctgcagagtcacgaggtgcggttatacgggcgaagacggagtggagatctccgtgccagtggcgggagcagtccacctggctaccgcaatactgaaaaatcccgaagtcaagctcgcgggtctcgccgctagggactccttgcgcctggaggcaggactgtgtttgtacggtaatgatattgacgaacatactacccccgtagagggcagtttgtcctggactctgggaaagcggaggagggccgctatggactttccgggagccaaggtgatagtccctcagttgaagggccgagttcagagacgccgagttggactcatgtgtgagggcgctcctatgagggcccacagtccaattctaaatatggagggaacaaagatcgggactgtgaccagcggctgtcctagtccttcgctcaaaaaaaatgttgctatggggtacgtaccatgtgagtactccaggcccggaacaatgttgctggttgaggtgcgaagaaaacagcagatggccgttgtcagtaagatgccctttgtcccaaccaattattatacgttaaagtag

SEQ ID NO: 214238 - DNA, 2760 bp, Artificial Sequence
  Description of Artificial Sequence: Synthetic coding sequence
atgtggttagcagctgccgcacccagcttggccaggcgcctcctgttcttaggaccaccacccccacccctcctgctcctcgtattttccagatctagtcgcaggagactgcactctttggggttggctgccatgcccgaaaaacgcccatttgagcgtcttcccgcagatgtatctcccatcaattactccttgtgcttaaagcccgaccttctggatttcacatttgaaggaaagctggaggccgctgcccaagtgagacaagccactaaccagatcgtgatgaactgtgcagatattgatattattaccgccagctacgccccagagggagatgaagaaattcatgctactggtttcaattaccagaacgaggatgagaaggttactttaagctttccttctacactacagaccgggactggaaccctgaaaatcgactttgttggtgagctcaacgacaagatgaaggggttttacagaagtaaatacaccactccatcaggagaagtgcgatacgctgccgttacccagttcgaagctaccgatgcgagacgagctttcccctgttgggatgagccagcaattaaagcaactttcgacatctcattagtggtccctaaagatcgcgtggcactcagcaacatgaatgttattgaccggaagccatacccagatgacgagaacctcgttgaggtcaaatttgctaggaccccagttatgtccacctacttagtagcgttcgtagtcggtgagtatgatttcgtggagacccggagcaaagacggcgtctgtgttagagtgtataccccagtgggtaaagccgaacagggcaagttcgcgctggaggtagccgctaaaaccctcccattttacaaagattatttcaacgtgccctaccccctgcctaagatcgacctgatcgctatcgccgatttcgccgcaggagccatggaaaactggggtctggtcacctaccgggagactgccctgctgattgatcccaaaaacagttgcagtagttctcggcaatgggtagcactcgtggtgggtcacgagctagcccaccagtggtttggaaaccttgtaacgatggagtggtggacccacctgtggctgaacgagggatttgcaagctggatagaatatctgtgtgtggatcactgcttccccgaatacgatatctggacacagttcgtgtccgccgattataccagggctcaagagctggacgcacttgacaacagtcatccaatcgaggtatctgtgggtcacccaagcgaggttgatgaaatcttcgatgccatttcctactctaagggcgcttcagtcatacggatgctacatgattacatcggggacaaagattttaaaaaaggcatgaacatgtacctcacgaaattccagcagaaaaatgcagctactgaagacctttgggagagcctggaaaatgcaagcggcaagcccatcgctgccgtcatgaatacatggacgaagcagatggggttccctcttatttatgtggaggctgagcaagttgaggatgatagattgctaagactgtctcagaagaagttttgcgctggcggatcttacgttggggaagactgcccccagtggatggtccccattacaatcagcacatcagaggaccccaatcaagcaaagctgaagattctgatggacaagcccgaaatgaatgtcgtactcaagaatgtgaagcctgaccagtgggtaaagctcaatctcggcaccgttggattttacaggacacaatattctagcgccatgctggaaagtcttctgcctgggattcgggacctttccctcccacccgttgaccggttaggattacagaatgacctcttcagcctggcccgagctgggatcattagcaccgtcgaagttcttaaagtgatggaggccttcgtgaatgaacccaattacacagtctggagcgatctctcttgcaatctcggcatactgagcaccttgctgtcacacactgacttctatgaggaaatccaggagtttgtgaaagacgtgtttagccctataggtgagcgcctcggatgggatcccaaacctggcgaggggcatctggatgcactgctgcgcggacttgtgctcgggaagctagggaaagccggacataaggctacactcgaagaggcgcgtaggcgcttcaaagatcatgtggaaggaaaacaaatactgtcagccgatttaagaagtccggtgtatctcacagtcctgaagcatggggacggcacgacactggatattatgctgaaattgcacaagcaggctgatatgcaggaggagaagaacagaattgaacgtgtcctaggcgcaacgctgctccccgatttgatccagaaggtgctgacatttgccctgagcgaggaagtgagacctcaagacaccgtctccgtcatcggcggagtcgcaggtgggtccaaacacggccgaaaagctgcatggaaatttatcaaggacaactgggaagagctctacaatcggtatcagggaggatttctcatttcccgtttaattaagctttccgtggagggctttgccgttgataaaatggccggtgaggtaaaggcgttcttcgagtcacaccccgcacctagtgcagagaggacaattcagcaatgttgtgaaaacatcctgctgaacgccgcttggctgaagagggatgcagagtccattcatcagtatctactccaaaggaaagctagcccgcctacagtgtag

SEQ ID NO: 214239 - DNA, 1884 bp, Artificial Sequence
  Description of Artificial Sequence: Synthetic coding sequence
atgtggctggccgctgccgctcctagccttgctcgtcgactactgttcctggggcctcctcctcccccactgctccttttggtgttctccaggtcatcaaggagaagactgcactccctgggtctcgccgatgtgagcccaatcaattatagtctatgtttgaaacctgacttgctggacttcaccttcgagggcaaactggaggctgccgcacaagttcggcaggccacaaatcagattgtcatgaactgcgcggatatcgacattatcacggcttcatacgcccctgagggcgatgaggaaattcacgctaccggcttcaattaccagaatgaagatgagaaagtgactttgtcctttcctagcacactccagacaggcactggcactcttaaaatagatttcgtaggggagctcaatgataaaatgaagggattttacaggagcaaatataccactccgagtggcgaggtcagatacgccgctgtgacacagttcgaggcaaccgatgcaagaagggcatttccctgttgggatgagccagccataaaggccacgttcgacattagtttggttgtgcccaaagacagagtggcactcagtaatatgaacgtgatagaccgtaagccctaccctgatgacgagaatctggttgaggttaagtttgccaggacccccgtgatgagtacttatctggtggcctttgtggtcggtgaatacgatttcgtcgagacccggagcaaagacggggtgtgcgtcagggtttatacaccagtcggaaaggcggaacagggaaaatttgcgctggaggtggccgcaaagactctgccattctacaaggattactttaatgtgccctacccactgccgaagatcgaccttatcgctatcgccgactttgcggctggggcaatggaaaattggggactggttacctatcgagagaccgccctgttaatagatccaaaaaactcctgcagttcgtcaaggcagtgggtcgcattggtcgtcgggcacgagctggcgcaccagtggtttggcaaccttgtcacaatggagtggtggacacatctgtggctcaatgaaggattcgcctcatggatagagtatttgtgcgtcgatcactgtttcccggaatacgatatttggacacaatttgttagtgctgattatactagggcacaggaacttgacgctttagacaacagccacccgattgaagtgagcgtcggccacccctctgaagtagacgagatcttcgacgcaatctcatactcaaaaggtgccagcgttattcgcatgctgcacgactacatcggagataaggacttcaagaaggggatgaatatgtacttaaccaagttccagcaaaaaaacgccgcaacagaggacctctgggagagcctagaaaacgcctcaggaaagcccatcgctgctgtgatgaatacgtggaccaagcagatgggatttcccctgatttacgtggaagccgagcaggtcgaggatgacaggttacttaggcttagccaaaaaaagttttgcgcaggaggtagctatgtgggcgaagattgtccacagtggatggttccaatcactatttcgacctccgaggaccctaaccaggcaaagttaaaaattctaatggacaaaccagagatgaatgtcgtgttgaaaaatgttaaaccagatcaatgggtgaaactaaatctgggcactgtggggttttatcgcacacagtattcttctgctatgttagagtccttactgccagggatcagggacctgtccttgcccccagtagatcggctcggtctccagaatgacctgttttccctgttcatcctgtgcgttcgcgaggtgtccggaaattgctgtagagcctag

SEQ ID NO: 214240 - DNA, 2520 bp, Artificial Sequence
  Description of Artificial Sequence: Synthetic coding sequence
atgcccgagaaacgcccattcgagcgactccctgccgatgtaagccctattaactattccctttgcttaaagccagatctgctggatttcaccttcgagggcaaattagaggctgcggcacaagtgcgacaagccacgaatcagatcgtgatgaattgtgcagatattgatatcattacggccagttacgcccctgagggggacgaggaaatccatgcgacgggtttcaattaccagaatgaagacgagaaagtcaccctgagctttccatcaacccttcagacgggaaccgggacacttaagattgattttgtgggcgagctcaatgataaaatgaagggattctaccggagtaagtataccactccatccggtgaggtccggtacgccgcagtgacacaatttgagaacgtgatcgatagaaaaccctacccagatgacgaaaacctggtagaagtgaaattcgccagaacaccagtgatgagcacgtacctcgtggcttttgttgtgggagagtacgactttgtggagactcgttccaaggatggcgtatgtgtccgcgtctacaccccggtggggaaggccgaacagggcaaatttgccctagaggtggccgctaaaactcttcccttctacaaggattactttaacgttccttacccgttgcctaaaattgaccttattgccatagctgacttcgccgctggggcaatggaaaattggggcctcgtgacatacagagagacagcactgcttattgatcctaaaaactcatgctcctcatcccgccagtgggtagcactggtggttggccatgagttggctcatcagtggtttggaaatctggtaacgatggagtggtggactcacttgtggctgaacgaaggcttcgcatcctggatcgagtacctgtgtgtggaccattgtttcccagagtacgatatctggacacagttcgtaagcgctgactacacccgggcacaggagctagatgccctcgataactcacaccctatcgaggtgtctgtgggtcacccttctgaggtggatgagatcttcgatgcaatatcatatagtaagggcgcatccgtcataagaatgcttcacgactatatcggcgataaagattttaaaaagggaatgaatatgtacctgaccaagttccagcaaaaaaacgctgctaccgaggatctttgggaaagtctggagaatgccagcggcaagccgatcgctgctgtcatgaatacttggactaaacaaatgggattccccctcatttatgttgaggccgaacaagtggaggatgacagactgttgagactgagccaaaaaaaattttgcgccggagggtcctatgtcggcgaagattgcccccagtggatggtacccattactatcagcacaagcgaggatcccaatcaagcaaaactcaagatactgatggacaagcctgaaatgaatgtggtgctgaaaaatgtgaaacctgatcaatgggtgaagttaaacttaggaaccgtggggttttataggacacagtatagttcagctatgctagagagcctgctgcctggtattagagatttgagcctgccccctgtggacaggctggggttgcaaaatgatctctttagtctggctagggccggtattatctctaccgttgaagtgctcaaggtaatggaggccttcgttaatgagccgaattatacagtgtggagcgacttgtcctgcaacctggggatcttgtctacgttgctgagtcacacggatttttacgaggagatccaagagttcgtaaaggacgtgttttcacctataggcgagaggctaggatgggatccgaagcctggagaggggcacttagatgcattgttgcgcggactcgtgcttgggaaactgggtaaggccggacacaaagctaccttggaagaggctcgcagaaggttcaaggatcatgtcgaaggaaaacagattctgagcgctgatttgcgctctccagtctatctaacagtgctgaagcacggagatgggacgaccttggatatcatgctgaaacttcataagcaggctgatatgcaggaagaaaaaaacagaattgagcgagttctgggcgctactctcttgcctgacctaatccagaaggtgctgacattcgcactttcggaagaggttagacctcaggatactgtgtccgtgattgggggagtggccggaggcagcaaacatggccgaaaggcggcttggaaatttattaaggacaactgggaggagctgtacaaccgataccaggggggtttccttatatctcgccttatcaagcttagtgtggagggcttcgccgttgacaagatggcgggagaagtgaaggcttttttcgagagccatccagcaccttcggcggagaggaccatacaacagtgttgcgagaatattctgttgaacgcggcttggctcaaacgggatgccgaaagtatacatcagtatctcctgcagcgcaaagcgagcccacccacagtgtag

SEQ ID NO: 214241 - DNA, 1125 bp, Artificial Sequence
  Description of Artificial Sequence: Synthetic coding sequence
atgcgatccccggcagtgcctaccccggcacgtggacaactgggtgtcgcatttgtgctgttgcctccccattcagaaggggcacgggtattcggggctttaggacccatcggcccttcaagcccaggcttgacactaggcggactcgcagtttccgagcatagattatccaacaaattgctggcctggtcaggtgtgcttgagtggcaggagaaaagacggccatactctgacagcaccgccaaattgaaacgaacacttccatgtcaggcctatgtgaaccagggcgagaacctggagactgaccaatggcctcagaagctgattatgcagttaatcccgcaacagttactcacaacgctgggtcccctctttaggaatagccagctcgctcagttccacttcaccaacagggactgcgacagtttgaaagggctgtgcaggataatggggaatggcttcgcgggatgtatgcttttcccccacatctctccttgtgaggttcgcgtgctcatgttactttactcttctaaaaaaaagatctttatggggctcatcccctatgatcagtccggtttcgtctccgccattaggcaggtcattacgaccaggaagcaggccgtagggccaggtggcgtgaattctggaccggtccaaatcgtcaacaacaaatttctcgcctggtcaggtgtgatggagtggcaggaacctaggcccgaacccaattcccgatctaagcgctggctaccttcccatgtttacgtcaaccagggcgaaattcttaggactgagcaatggcccagaaagctgtacatgcagctaattccccagcagctgctcacgacactggtaccccttttccgcaactcacgactggtccaattccactttactaaggatctcgagaccttaaaaagtctgtgccggattatggacaatggattcagaaggaaatcctcgcttgcctcatcacccatgaccagagccacactaagtactgcctccggcgtcagcctccccacttcttcgagatcatgcagcggtacgtggagccgctctaactctaatgagggctggggagggagcggctatcccggactggggccatcccgttcccacagatag

SEQ ID NO: 214242 - DNA, 594 bp, Artificial Sequence
  Description of Artificial Sequence: Synthetic coding sequence
atgatgttccctcagagcagacactcagggagctcccatctgccacagcaactgaaattcacaacatccgactcctgcgatcgcattaaggacgagttccagttgctgcaagcccagtaccatagtttgaaattagaatgtgacaaactggcctctgaaaagagcgaaatgcaacgacattacgtcatgtactacgaaatgagttatgggttgaatattgagatgcacaagcaggcagagatcgtcaaaagactaaatggaatctgcgcgcaggtgctgccatatctgagccaagagcaccagcagcaggttcttggggcaatcgagcgcgctaagcaagtgactgcgcctgaactcaactctataatcagacagcagctgcaggcacatcagctgagtcagctacaggctctggcgcttcctctcacaccactccccgtgggtctgcagcccccttctttgccagcggtgtccgccggtaccggcctgttgtccctgtctgctctgggctcccaggcgcaccttagcaaggaggacaaaaacgggcatgacggcgacacccatcaagaagacgacggagagaaaagcgactag

SEQ ID NO: 214243 - DNA, 1362 bp, Artificial Sequence
  Description of Artificial Sequence: Synthetic coding sequence
atgggggtcctgggcagggtgcttctgtggttgcaactgtgcgcactgacacaggctgtttcaaaactgtgggtgccaaacacagattttgatgtggctgcgaattggagccagaataggacaccttgtgccggaggcgcagtggaatttccagcagacaagatggtgagcgtgctcgttcaggaggggcatgccgtcagcgatatgcttttaccgcttgacggcgaattggttctagcatccggcgctggttttggggtgagcgatgttggctcacacctcgattgtggagcgggagaacccgcagtgttcagggactcagaccgtttttcttggcatgatccacacctgtggagaagcggcgacgaggccccagggctttttttcgtggacgctgaacgggttccgtgcaggcacgacgacgtgttcttccctccttctgcttcatttcgcgtagggctgggacctggcgcatcgcctgtgcgagtgagatctatttccgccctcggcaggacttttactcgggatgaggatctggccgtttttctggcctccagagccggaagactcagatttcatggcccaggcgctctatctgtggggccagaggactgtgctgatccatccgggtgtgtctgcggaaatgctgaagctcaaccatggatctgcgcagccctcctccaacctctgggagggaggtgtcctcaggcggcatgtcatagcgccctcaggcctcagggccaatgctgtgacctgtgtggggcagtagtgttactgacgcacggcccagcattcgaccttgagagataccgtgccaggatcctcgataccttcctggggctgcctcagtaccatggcctgcaagtcgcagtgtccaaagttccacgatccagcaggctcagggaggccgatacagagattcaggtcgtgcttgtagagaatggtcccgagaccggcggtgctggacgcctcgccagggctcttcttgcggatgtggctgaaaacggggaggccttgggtgtactggaggccacaatgagggaatccggagctcatgtgtggggaagcagcgctgccggacttgctggcggagtggcagctgccgtactccttgccctcctagtgctgttagtcgccccacctttgcttcgcagggcaggacgcctgaggtggcgcagacatgaagcggctgcacccgcaggcgcacctctgggtttccgcaatccggtgttcgacgtgactgcctccgaagagctgcctcttcccagaagactaagtctggtgcccaaggcagcagccgatagcacttctcattcatactttgttaacccactgttcgcaggagccgaggctgaggcttag

SEQ ID NO: 214244 - DNA, 1962 bp, Artificial Sequence
  Description of Artificial Sequence: Synthetic coding sequence
atggcagatattaaaactgggatcttcgcgaaaaacgtacagaaacgactgaatagagctcaggaaaaggtgctccaaaagctcggtaaggccgacgagaccaaggatgaacagtttgaggagtacgtgcaaaactttaagcggcaggaagcagaaggtacccgactgcaaagagagctacgcggataccttgcagcaattaaaggaatgcaggaagcaagtatgaagttaactgaatcactgcacgaggtctacgaacccgattggtacggaagagaagacgtgaagatggtcggcgagaaatgcgatgtcctatgggaggactttcaccagaagcttgtggatggttcactcctaacactggatacttatctggggcaattcccagacattaaaaaccgcattgctaaaagaagtagaaaactggtggattatgacagcgcccgacatcacctcgaagccttgcagagcagtaaacgtaaggacgagtcaaggatcagtaaggccgaggaggaatttcagaaggctcagaaggtatttgaggaattcaacgtggacctccaggaggagttacccagtctttggagccggagagtaggattttatgtaaatacgttcaagaatgtatccagtctcgaggcaaaattccacaaggagatagccgtgttgtgtcataaactctatgaagtcatgacgaaactcggcgatcaacacgccgacaaggcgtttacaattcagggggctccttctgacagtgggcctctgcgcattgcaaagacaccaagcccgcctgaagagccatcacctctacccagccccacagctagtccaaaccatactctggccccagcttcgcccgctcccgcacgaccaagatcaccaagccaaacgagaaaaggtcctccggtgccacctttacccaaagtaactcccactaaagagctccagcaggagaacatcataagcttctttgaagataactttgttcctgaaatctccgtcactacgccctcacagaacgaggttcctgaggtaaagaaggaggagactttactcgacctagacttcgacccttttaagcctgaggtcacccctgcaggcagcgccggagtcacgcactctcctatgtctcagaccctgccttgggatctctggaccacttcaaccgatctggtacagccagcatctggagggagtttcaacgggttcacacagccccaggacactagcctgttcacaatgcagacagatcaatcaatgatctgcaacctaatcataccaggcgctgacgccgatgctgctgttgggacactcgtgtctgccgcagaaggagctcctggagaggaagccgaggcagagaaagctacagtacccgctggagagggggtgtctctcgaggaggctaagattgggaccgagaccacagagggagccgagagtgctcaaccagaagcagaggagctggaagcaactgttccacaggaaaaagtaatccccagtgtcgtcatcgagcctgcttcaaaccacgaagaagaaggagagaacgaaattacaattggagccgagccaaaagaaaccaccgaagacgcagctccacctggtccgaccagtgagacacctgagctggctacagaacaaaagcccatccaggatccccagcctaccccttctgcacctgcaatgggtgcagccgatcaactcgcaagtgcaagagaggcgtcacaagaacttccacctggtttcctttacaaagtggaaacactgcacgactttgaggctgccaatagcgacgaactgacgctgcagcgaggggacgtggttctcgttgtgcccagcgatagtgaggccgatcaagatgcaggatggctcgtcggcgtgaaagagtcagactggctccagtatagagacctggcaacatataagggattgttccctgagaattttacacggcgactggattag

SEQ ID NO: 214245 - DNA, 1794 bp, Artificial Sequence
  Description of Artificial Sequence: Synthetic coding sequence
atgaccaaactgggcgaccagcacgctgacaaagcatttacgatccaaggcgctcctagcgactccggaccactgagaatcgccaagaccccttcaccccctgaagaaccgagtcccttgccttccccaactgcatctccaaaccacactttagcaccagctagccccgcacctgctcgccctcggagccctagtcagacccgcaaaggacccccagtgccacccctgcccaaggtcacgccgacgaaagagctccagcaggagaacatcatttcctttttcgaagataacttcgtgcccgagatatctgtcactaccccctcccagaatgaagtcccagaagtcaagaaggaggagaccctgctggacctggatttcgacccctttaaacccgaggtgacccccgctggaagtgcaggagttacgcatagccccatgtcccagaccctgccgtgggacctttggacaactcacactttcaacgacgatattactgacagcagcgaatcactctctttgtgtaacttgatcatggaggagactcccgacagcggtctggctgaagagatccaacggtcccaaaacgacatcggtgcctttacatggggacctgatgccagcaccgatagagtgagccaggaggttacctccggcggtttcggcgaagactctgcatgcccgtctgagactgagcaggatatcaggctgagtacttcccttctgagcagtgcagattggcccaccgtcgccgaagaatcagagcatgccccaggccctgctttccccggtgggaacgagcaactcccacctaagccagccccagaggcgggagttgcgattgccgcatgcgtggaaatggagcagctgtatgatcctctcgacagcgatatgccggctatggatactgcgggactttttaaggaatcacatgaggatatgaagaagtccgacgaagaggaggaaaagcagaagatggaggacagcctatgggcgggagtggaagcctgccaaaaggctagtggtggctctttcaacggctttacacagccacaggacacttcactgtttactatgcagactgaccagtcaatgatctgcaatctaattatcccaggggcagacgcagatgctgcagtcggaacacttgtaagcgctgccgagggtgcccctggtgaagaagccgaggctgaaaaggctactgtcccagctggcgagggggtctccttggaggaagcaaaaattggaacagagaccactgagggggctgagtcagcacagcccgaggctgaggagttggaggcaacagtgccacaggagaaggttatacccagtgtcgtcattgagccggcaagtaaccacgaagaggagggcgagaacgagataaccataggtgcggagccaaaggaaactactgaagacgccgctccccctggcccaaccagcgagacaccggagcttgccacagagcaaaagccaatccaggatccacagccaacaccctcggcaccggcaatgggcgcagccgatcagctggcatcggcgagagaggcctcccaagaactgccaccagggttcctgtataaagtcgagactctacacgactttgaggcagcaaatagcgatgagctgaccctacagcggggtgacgtagtgctggttgtgccttccgattccgaagccgaccaggatgctggttggctggtgggcgtcaaggagtccgattggctccagtaccgggacctggccacctacaaggggctgttccccgaaaacttcacccgaaggttagactag

SEQ ID NO: 214246 - DNA, 2088 bp, Artificial Sequence
  Description of Artificial Sequence: Synthetic coding sequence
atggctgacattaaaacaggtatctttgcaaaaaatgtacagaagcggctgaatagagcacaggaaaaggttcttcagaagctaggaaaggccgacgaaactaaggacgagcaattcgaggagtatgtgcaaaacttcaagcggcaggaggccgagggaacccgactgcagagggagctgcgaggttacctggccgctattaaggggatgcaggaggctagtatgaagctgaccgaaagcctccacgaggtgtatgaacctgactggtacggacgggaagacgtcaaaatggtgggtgaaaaatgcgacgttttgtgggaggactttcatcagaaactggtagatggaagtttgctcacactagatacttacctgggccagttccccgacatcaaaaatcgcatcgcaaagaggtcgcgcaaactggttgactatgattcagccaggcaccacttggaggcccttcagagcagcaagcgcaaagatgagtcccgcatcagtaaagctgaagaggagtttcagaaggctcaaaaagtgtttgaagaattcaatgttgacctccaagaggaattgccgtctttatggagccgacgggttgggttttacgtcaacacttttaaaaacgtgagctctttggaagctaagtttcataaggagattgctgtgttgtgccataagctgtacgaagtgatgaccaagttgggagaccagcatgcggacaaggcctttaccatccaaggtgcaccaagcgactctggcccacttcgcatcgccaaaacgccttctccacccgaggagccaagtcccctgcctagccctactgcgtcccccaatcatactttggctcctgctagcccggctcctgcaaggccgagatccccgtcacaaacacgaaagggccctcctgttcctcctctccccaaagtgacacccacaaaggaactccaacaggaaaacatcatctccttctttgaagacaattttgtgccagagatttccgtgaccaccccatcccagaacgaggtgcccgaggtaaagaaggaggaaaccctgcttgacttggactttgatccctttaagcctgaagtaacccctgctggcagcgccggagttacgcattcaccaatgtctcagacacttccctgggatttgtggaccacatctacagaccttgtgcagccagccagcggcggatccttcaatggatttacacagcctcaggacacaagcctctttaccatgcagaccgatcagtcaatgatttgcaaccttgccgaaagtgaacaagcccctcctactgaaccaaaagctgaggaacctctggccgctgtgactcccgctgtggggctcgatctaggcatggacacacgtgccgaggagccagtcgaggaggccgtcatcattcccggagccgatgccgacgcggctgtgggaacactggtaagtgctgctgagggggcaccaggggaggaagcggaagcggagaaagctacagtgcccgctggagaaggtgtgtccttagaggaggccaagatcggcacagagacaacggagggtgctgaaagcgctcaacccgaggcagaggaattggaagctaccgtccctcaggagaaggtaattccgtcagtggttatagaacccgcaagtaaccacgaagaagagggtgagaatgagatcacaattggagctgagccaaaggagaccacagaggacgcagccccaccgggacctaccagcgagactccagaactcgctaccgagcaaaaacctattcaggatcctcaaccaaccccaagcgcccctgccatgggagctgctgaccagttggcctcggcaagagaagcttctcaagaacttcctcccggatttctgtacaaggtggagactctgcacgactttgaggccgctaattccgacgagctcactctccagaggggagatgtcgtgctggttgtaccgagtgactcagaggcagaccaggatgcagggtggcttgtgggcgtgaaagagagtgattggctacagtacagagatctcgcaacctataagggcctctttcccgagaatttcacccgcaggttggattag

SEQ ID NO: 214247 - DNA, 591 bp, Artificial Sequence
  Description of Artificial Sequence: Synthetic coding sequence
atggaggagaccccagactctggattggcagaggaaatccagcggtcccagaacgatatcggagcctttacttggggtcctgacgcttccacagatcgcgtgtcccaggaggtcacaagcggtgggtttggtgaggacagtgcatgcccctctgaaaccgagcaggatatacgccttagtacatcacttctgagcagcgcagattggcccactgtcgctgaggagagtgagcacgctcctgggcctgccttccccggaggaaatgagcaattgccccctaaaccagcccctgaagcaggggttgcgattgctgcctgtgtggaaatggagcaactctacgatcccctcgatagcgatatgccggctatggacacagccggattatttaaggagagtcacgaagacatgaagaagagcgacgaggaggaggagaaacagaaaatggaagactctttgtgggccggtgtagaagcttgtcaaaaggccagtggcggtagctttaacggctttacacagcctcaggatacctccctctttactatgcagacagatcagtctatgatctgcaatctggaaattacagtcaactag

SEQ ID NO: 214248 - DNA, 1962 bp, Artificial Sequence
  Description of Artificial Sequence: Synthetic coding sequence
atggccgacattaaaaccggcatctttgccaagaacgtgcaaaagaggttaaatcgggctcaagaaaaggtcctccagaagcttggaaaggcggacgaaaccaaagatgagcagtttgaggagtacgtgcagaacttcaaacgtcaggaggcagagggtacccgactccagagagagcttcggggttacctggccgctatcaagggtatgcaggaagcatccatgaagctgactgagagcttgcacgaagtctacgagcccgactggtacggcagagaagatgtgaaaatggtgggagaaaagtgcgatgtgttgtgggaggattttcaccagaagcttgtcgatggttcactgctgaccctagacacatacctcggacagttcccagatatcaagaataggattgccaagagatctagaaaactcgtagactatgattctgcgcgacatcacctcgaggcattacagtcgtcaaaacggaaagatgagtctaggatttccaaggcagaagaagagtttcagaaagcccaaaaggtgttcgaagagtttaacgtggatttgcaagaggaactgccgagcctctggagccggagagttggcttctacgtgaataccttcaagaatgtgtcctccttagaagccaagtttcataaggagatcgccgtgctctgccacaagctatatgaggttatgactaagcttggtgatcagcacgccgataaagctttcaccatacagggtgctcctagcgacagcggtccccttcgcattgctaaaactccatctccgccagaggaaccctccccgctccctagcccaaccgctagccctaaccacaccttggctccagcaagtcccgctccagctcgcccaagaagcccttcccagaccaggaaaggcccaccagtgcccccactcccaaaggtgacgccgaccaaagagctccaacaggagaacatcatctccttcttcgaagacaactttgtgccagagatcagtgtgaccacgccatcgcagaatgaagttcctgaagtgaaaaaagaagaaacgcttttggatctcgacttcgacccctttaagcctgaggtcacacccgctggatcagcaggtgtgacccatagtcctatgagccagaccttaccctgggatttgtggacagccggagtggaggcatgtcagaaagcttcagggggttcattcaatggattcacccaacctcaggatactagcctgttcacaatgcagactgatcagagtatgatatgcaacctaatcattcctggggcagacgcagacgctgcagtggggactttggtgtccgctgctgagggcgcaccaggcgaagaagccgaggccgagaaggcgacagtgccggcaggtgagggcgtgtctttggaggaggccaaaatcgggacagaaaccacagagggagcagaatcagcacagcccgaagcagaggaacttgaagccaccgtcccacaggaaaaagttatcccgtccgtggtgattgagccagccagcaaccacgaggaagagggtgagaatgagatcactatcggagccgaacctaaagagacaaccgaggacgcagctcctccagggcctacctccgaaacccctgagctggccacagaacagaaacccatccaggatccgcagcccaccccatctgcccctgcgatgggcgctgcagaccagttagcctcagccagagaagcttctcaagagctacccccagggttcctgtataaagtcgagacactgcatgattttgaggccgctaattccgacgaacttacactgcagaggggagatgtggtgctcgtggtaccgtctgactctgaagccgaccaggacgctggatggctggtgggcgtaaaggagagcgactggctgcaatatcgagatctggcaacgtacaagggtcttttccccgaaaattttacccgacgtttggattag

SEQ ID NO: 214249 - DNA, 1158 bp, Artificial Sequence
  Description of Artificial Sequence: Synthetic coding sequence
atggctgacataaagactgggattttcgccaaaaatgtccagaagagactgaaccgcgcacaggaaaaagtcctgcagaagctgggtaaggctgatgagactaaggatgagcagtttgaagagtatgtgcaaaacttcaagagacaggaggctgagggcactcggctgcaaagggagcttagagggtatttggctgcgattaagggaatgcaggaagcatctatgaaacttaccgaatctcttcacgaggtgtacgaaccagactggtatgggagggaggacgtcaagatggttggcgaaaagtgtgatgtactgtgggaggattttcatcagaagctagtcgatggcagtctgctcacactcgatacctacttaggccagtttccagacatcaaaaataggatagctaagcggtctcggaaactcgtcgactatgacagtgcacgccaccatctcgaggctttgcagagctccaaacggaaagacgaaagccgaatttcaaaagctgaagaagagttccagaaggctcagaaagtgtttgaggagttcaacgtggatcttcaggaagagctccctagtctgtggtcgaggcgcgtgggattttacgtgaatacattcaaaaatgtttcttccctcgaggctaagtttcataaagagatcgctgtcctgtgccataaactgtacgaggtgatgactaaactcggtgatcagcatgcagacaaggcatttacaatacagggcgctcctagacagtacttagatagtggacctctgagaatcgccaagacaccctctccccctgaagagccctcgcctctgcctagccccaccgcttcccccaaccacaccttagcgccagcatcccccgctccagcaaggccacgttccccttcccagacaaggaaaggaccacctgtgcccccactgcctaaagtgacacctaccaaggagctgcagcaagagaatattatctcgtttttcgaggataactttgtgcctgagattagcgtcacaacccctagtcagaatgaagttcccgaagtcaaaaaggaagaaactttgctggacctggacttcgatccttttaagccagaggtgactcccgctggctcagccggagtgacccattccccgatgtcccagacggtcggatggtag

SEQ ID NO: 214250 - DNA, 759 bp, Artificial Sequence
  Description of Artificial Sequence: Synthetic coding sequence
atgcgggcaccgctgctgcctcctgcccctgtagttttgtcgctgctgattctgggaagtgggcactacgctgccggtctggacctgaacgatacctactcagggaagagagaacccttctctggagatcatagcgctgacggattcgaagtcaccagccgcagtgagatgtccagcgggtctgagatttctcctgtctcagagatgccctcaagttcagagccgtcctccggagctgactatgattactccgaggaatacgataacgagccacagattccaggctatatcgtcgatgatagtgttcgggtggagcaggtggtcaagccccctcagaataagactgaaagcgagaatacctcggataaacccaaacgcaagaaaaagggcggaaagaacggcaaaaatagacggaatagaaagaaaaagaatccttgcaacgccgagttccagaacttttgtatccacggcgagtgcaaatatattgagcacctggaagcggtcacctgtaaatgccaacaggagtatttcggagaaagatgcggcgagaaatccatgaagacccatagcatgatcgacagctccctgtccaaaatcgctttagcagcaatcgccgcattcatgagcgctgtcatcctgacggctgtggctgtgatcaccgtgcagctgaggagacagtacgttcgcaagtacgagggggaggcagaagaaagaaagaaacttagacaggagaatggaaatgtccacgcaatcgcttag

SEQ ID NO: 214251 - DNA, 759 bp, Artificial Sequence
  Description of Artificial Sequence: Synthetic coding sequence
atgcgcgcaccccttctcccccctgccccagtggtattgagtctcctgattctgggatctggccactacgccgctggccttgatttgaacgacacatactccggaaagagagagcctttcagcggggatcacagcgccgacggatttgaggttacctcccggtccgagatgtcttccgggagcgagatctctccggtatcagagatgcccagctcctccgagccatcttctggtgctgactatgattactccgaagaatatgacaatgagccacagatcccaggatacatcgtagacgattcggtcagagtagagcaggtagtcaaacctccacaaaataagactgagtctgaaaatacctctgataaaccgaaacgtaagaaaaaaggcggaaagaacggaaaaaatcgccgtaatcgcaaaaaaaaaaacccatgcaatgccgagtttcagaatttttgcattcatggggaatgcaaatacatcgagcatttggaggcagtgacgtgcaagtgtcagcaggaatacttcggtgagagatgcggagagaagtctatgaaaactcacagcatgatcgacagcagtcttagcaagatcgcattggcagccatagcagcatttatgagcgccgtcatcctaaccgccgtcgccgtgataaccgtgcaactgcggcgacagtatgtgaggaagtacgaaggggaggccgaagagcgcaagaagctgcggcaagagaacggaaacgtgcacgctattgcatag

SEQ ID NO: 214252 - DNA, 1536 bp, Artificial Sequence
  Description of Artificial Sequence: Synthetic coding sequence
atgaagcttttttggctgcttttcactattgggttttgctgggcccagtattcttcaaatacacaacaagggagaacctctatcgtgcatctctttgagtggcgctgggtagatatcgccctggagtgtgaacgctaccttgcaccgaaaggcttcggaggcgtgcaggtgtcccccccaaacgagaacgtggctatccacaatccgtttaggccttggtgggaacgctaccagccagtgtcatataagttgtgcacccgatccgggaacgaggacgagttcagaaatatggtgacccggtgcaacaacgtgggagtcagaatctatgtcgacgctgtgattaaccacatgtgtggaaatgccgtgagcgctggcacttcttcaacatgcggctcttactttaaccctggtagcagagattttccagccgtcccctatagcggatgggacttcaacgacgggaagtgcaaaactgggtcaggcgatatcgaaaactataatgatgccactcaggtgagggattgccgactgtcaggcctgctcgacctggcactgggcaaggactacgtgaggagcaaaattgcagaatatatgaaccatctcatcgacatcggagtcgcgggattccggatcgatgcctccaagcatatgtggcccggagacatcaaggccattctggataaactgcacaacctgaacagtaactggtttcctgaaggcagtaagcctttcatttaccaagaagtcatcgacctgggaggagaacctataaaatcatccgattactttggcaacggcagggtaaccgagttcaagtatggtgcaaaactgggtaccgtgatcagaaagtggaacggagagaaaatgagttacctgaagaactggggcgaaggatggggcttcatgccaagcgatcgggctctcgtgttcgttgacaaccatgacaatcaaagagggcacggtgcaggtggtgcctccattctgacattttgggatgccagactctataaaatggccgtcgggttcatgcttgcgcacccatatggtttcacgagagtaatgtcttcctataggtggccaaggtatttcgagaacggaaaagacgtgaacgactgggtggggccacccaatgacaacggcgttacaaaggaggtcaccatcaaccccgataccacatgcggcaatgactgggtttgcgagcatcgctggaggcagattagaaatatggtgaacttcaggaacgtagtcgacggacaaccgttcacaaactggtacgacaacggtagtaaccaagtggccttcggacgcggaaaccgtggattcatcgtcttcaacaatgacgattggacgtttagccttactttgcagacaggccttcctgccggaacctactgcgatgtgatctcaggcgacaagattaacggaaattgcactggtattaaaatatacgttagtgacgacggaaaggcccacttttccataagcaacagtgcggaggaccccttcatcgccatccatgccgaatctaagctctag

SEQ ID NO: 214253 - DNA, 318 bp, Artificial Sequence
  Description of Artificial Sequence: Synthetic coding sequence
atgaaactcttttggctattattcaccatcgggttttgttgggctcaatattcaagcaatacacagcagggacgaaccagcatcgttcacctttttgaatggcggtgggtggacatcgctctggaatgcgaaaggtatttagctcctaagggtttcggaggcgtgcaggtgtcccccccaaatgagaatgtcgctattcataatccttttcgaccttggtgggagcggtaccagcctgtgagttataagttgtgtaccaggtctggaaacgaggacgaatttcggaacatggtgacccgctgcaacaatgttggctag

SEQ ID NO: 214254 - DNA, 681 bp, Artificial Sequence
  Description of Artificial Sequence: Synthetic coding sequence
atgaagctgttctggctcctgtttacgatcggcttttgttgggcccagtattcaagtaacacccagcagggacggaccagtattgtacatttgtttgaatggcgctgggttgacatcgcacttgagtgcgaaagatatctcgcccctaaaggctttggcggagtccaggtgagtccgcctaacgagaatgttgccattcataatccattcaggccctggtgggagcgctaccaaccagtttcgtacaagctttgtactcgatccggcaatgaggatgaattccggaatatggttaccagatgcaacaatgtgggtgtgcggatctacgtcgacgccgtcattaatcatatgtgcggcaacgcagtgtccgctggaactagttccacttgtggatcatacttcaatcccggttctagggatttccctgctgtaccatactccgggtgggattttaatgacgggaagtgtaaaactgggagcggagacattgaaaattataacgacgccacccaggtgcgcgattgtcgactttctggcctcttagatttagctctgggaaaggactacgtgcgaagcaagattgctgagtacatgaatcacctgattgacattggggtcgcaggattccgcatcgatgcctctaagcatatgtggcccggagacatcaaagcgattctttag

SEQ ID NO: 214255 - DNA, 1536 bp, Artificial Sequence
  Description of Artificial Sequence: Synthetic coding sequence
atgaagctgttttggttgctgtttaccattgggttttgttgggcgcaatattcatccaatacccagcaggggaggaccagcattgtacatctgttcgaatggcgttgggtagacattgctctggaatgtgagaggtatttggccccaaagggattcggcggagttcaagtatctcccccaaatgagaacgtggcaatccacaacccatttcgaccttggtgggaaaggtaccagcccgtgtcctataagctgtgcacccgcagtggaaatgaggatgaattccgcaatatggttactcgctgcaacaatgtgggggtaagaatttatgtggacgcagttattaaccacatgtgtggaaacgccgtgtctgcaggaaccagctccacctgtggcagctattttaatccagggagtcgagatttcccggctgtgccctactctggctgggacttcaacgacggtaaatgtaaaacagggagtggtgacatcgagaactacaacgatgctacgcaggtacgggattgccgtctctcgggcctgttggacctcgccttgggaaaagactatgtccggtcaaaaattgctgaatacatgaaccacctcatagatatcggggtcgcaggatttaggatcgatgccagtaagcacatgtggcccggagacattaaggcaatccttgacaagctgcacaacctcaatagtaactggttccctgagggctcaaaacccttcatctatcaagaggtcattgatctcggtggagagcccataaaatctagtgattactttggtaacgggagggttaccgagttcaaatatggtgccaagctgggtaccgtaatccgtaaatggaacggtgaaaagatgtcatacttgaagaactggggcgaggggtgggggttcatgccatcagatcgggctcttgtgttcgtagacaaccacgataatcagcggggtcacggtgcgggtggggcttccattttgactttctgggacgcgagactgtataaaatggccgttggattcatgctggcccacccatacggctttacccgggttatgtcctcgtacaggtggccacgatactttgaaaatggcaaggatgtaaacgattgggtagggccacccaatgataatggagtgacgaaggaggttactataaaccctgacactacttgtggtaacgattgggtgtgtgaacatcggtggaggcagatacgcaatatggttaattttcgaaatgtagttgacggccaacccttcacaaactggtatgataacggctccaaccaggtagcttttggtagagggaatagaggattcatcgtgtttaacaacgacgattggaccttctctttgactctccagacggggctcccagcaggtacctactgtgacgtgatctctggcgacaagattaatggtaattgtacaggaattaagatctacgtctccgatgacgggaaagctcacttcagcatatccaattctgctgaagacccgtttatcgccatccacgccgagagcaagctctag

SEQ ID NO: 214256 - DNA, 1536 bp, Artificial Sequence
  Description of Artificial Sequence: Synthetic coding sequence
atgaagctcttttggctcctttttacgatcggcttttgttgggcacagtacagcagtaacacccagcaggggagaacttctatagtgcacctgtttgagtggcgatgggtcgatattgccctggagtgcgagcgatatctagcccctaaaggctttggaggcgtgcaggtcagtccacccaacgagaatgtcgcaatccacaatccgtttaggccatggtgggaaagatatcagcccgtatcgtacaagctgtgtacccgctccggcaatgaggatgaatttcgtaacatggtaaccagatgcaacaacgttggagtgaggatatatgtcgacgcggttatcaatcatatgtgcgggaatgcggtgtctgcgggaacgtcttccacgtgcggctcttacttcaaccccggaagcagggactttcctgctgttccctactccgggtgggacttcaacgacggaaaatgcaagactggatctggcgacattgaaaactacaacgatgccactcaagttcgagactgcaggttaagtggcttgctggatctggccctcggtaaagactacgtccggtccaagatcgctgagtacatgaatcacctgattgacattggcgtggctggattccggattgatgcctcaaagcacatgtggcccggtgatataaaagcgatcctggataaactgcataatttaaactccaattggttcccagaagggtctaagcctttcatctaccaggaggtcattgatctgggcggtgagcccatcaaatcctccgattactttggtaatggacgggttaccgaatttaagtacggcgcaaagttgggcacagtgattaggaaatggaacggggaaaaaatgagttacctgaaaaattggggcgagggatggggcttcatgccttcagaccgtgcgctcgtgtttgttgataaccacgacaatcagagagggcacggcgcaggaggggcatctatccttacgttctgggacgctcgcctatataaaatggccgtgggcttcatgctcgcacacccttacggcttcacacgtgtcatgagttcgtaccggtggcctcggtactttgagaacgggaaggacgtgaacgactgggttggacccccaaatgataatggcgttactaaggaggtaacaatcaatccagatacaacttgcggcaacgattgggtgtgcgagcaccggtggagacaaattcgtaatatggtcaactttagaaatgtagtggacggacagccattcaccaactggtacgataatggttccaatcaagttgccttcggcaggggcaacagagggttcattgtgtttaataatgatgactggaccttttccctgacgctacagacaggacttcccgcaggtacatactgtgacgtgatcagcggggacaaaattaacgggaattgcactggaattaagatctatgtatctgatgacggcaaggctcacttctccatatccaactcagctgaagacccattcatagccattcacgcggaatctaaactttag

SEQ ID NO: 214257 - DNA, 318 bp, Artificial Sequence
  Description of Artificial Sequence: Synthetic coding sequence
atgaagctcttttggctgctgttcacaatcgggttctgttgggcgcaatattcaagcaacacacagcagggacgaaccagtatcgtgcacctttttgaatggcggtgggttgatatcgctctcgagtgcgaaaggtatctggctccaaaaggtttcggaggagttcaggtctcacccccaaacgagaatgtggctatccataacccgtttcggccatggtgggagcgctatcagcccgttagctacaagctgtgcactcgcagcgggaatgaggacgagttcaggaacatggttactcgctgcaataatgtcgggtag

SEQ ID NO: 214258 - DNA, 681 bp, Artificial Sequence
  Description of Artificial Sequence: Synthetic coding sequence
atgaaactgttctggttactatttaccataggattctgctgggcacagtacagcagtaacacccaacagggccgtacttcaattgtccatctgttcgagtggagatgggtggatattgccctcgagtgcgaaagatacctggcccctaagggttttggcggagtacaggtgtccccccctaatgagaatgtcgccattcacaacccttttagaccatggtgggagaggtatcaacctgttagttataagctgtgcacgaggagcggcaacgaggatgaattccggaacatggtgacgcggtgtaataacgtgggcgtgcggatttatgtggacgctgtgataaatcacatgtgcggcaatgcggtcagcgccggtacctccagtacctgtggctcctatttcaacccaggttccagggattttcccgctgtgccatatagtggatgggactttaacgacggcaagtgcaagactggcagtggtgatatagaaaactataatgatgctacccaggtgagagactgtaggctgtccggactgctggacctggctttagggaaagactacgtgcggtctaagatagcagagtatatgaaccacctgatcgacatcggcgttgcgggatttagaatcgatgcgagtaagcacatgtggccaggggacataaaagccatcttatag

SEQ ID NO: 214259 - DNA, 1536 bp, Artificial Sequence
  Description of Artificial Sequence: Synthetic coding sequence
atgaagctgttttggctcttgtttacaatcgggttctgctgggctcagtactcaagcaacacccagcagggtaggacctcaatcgtgcatctgttcgaatggcggtgggtagacattgccctcgagtgcgaaagatacctggccccaaagggctttggcggagtccaagtgtccccacccaacgaaaatgtagccatccataatccctttcggccatggtgggagaggtaccagcccgtgtcatacaaactgtgtacacgcagtgggaatgaagatgagttcaggaatatggtaacccggtgcaataacgtaggcgtgcgcatctacgttgacgcagtgatcaaccatatgtgcggaaacgctgtgtctgcaggcacaagctccacttgcgggtcctattttaatccgggatcccgagacttcccggctgtcccatacagcggttgggacttcaatgatggcaaatgcaagaccggatccggcgacatcgaaaactataacgacgctacacaggtacgcgactgccgcctcagcgggctgctggaccttgccttaggaaaagattatgtgcgaagcaagattgcagagtatatgaatcacctgatcgatattggggtcgccggatttcgaatcgacgctagcaagcatatgtggccaggcgatatcaaagccatcctggacaagcttcacaacctcaacagtaactggtttcccgagggatctaaaccttttatctaccaggaggtgatcgatcttggcggtgaaccgatcaagtcctctgactattttggcaacgggagagtcactgaattcaaatatggcgctaagcttggaactgtcataaggaagtggaatggtgaaaaaatgtcttacctgaaaaattggggtgaaggatggggattcatgccaagcgatagagctctggtatttgtggataatcacgacaaccagagaggccacggagccggaggggctagtatcctgacattttgggacgccagactgtacaagatggctgttgggtttatgcttgcccacccatatggctttacacgcgttatgagcagctatcggtggcctcggtacttcgagaacggaaaggacgttaacgattgggtgggccctcccaacgacaatggggtgacaaaggaagtgactattaatcccgatactacttgcggaaacgattgggtttgcgaacaccgctggcgacagattcgaaatatggtgaactttcggaacgttgtggacggccaaccttttacgaactggtatgacaacgggagcaatcaggtggctttcgggcgtgggaatcgcggtttcattgtcttcaataatgatgactggaccttctctttgacattgcagaccggcctgcccgcaggtacatactgcgacgtgatatccggggataaaatcaatgggaactgtactgggatcaaaatatacgtaagcgatgacggaaaagcccacttcagcatctctaattcagcagaggatccatttatagccatccacgcagaatctaagctctag

SEQ ID NO: 214260 - DNA, 1536 bp, Artificial Sequence
  Description of Artificial Sequence: Synthetic coding sequence
atgaagttttttcttttactctttaccatcggcttctgttgggctcagtattcacctaatacccaacaaggacggacatctatagtgcatctgttcgagtggcgctgggtggatatcgccctagaatgtgaaaggtacctggccccaaaaggattcgggggagtgcaagtgtcccctcccaacgagaacgtggctatctataatccattccgtccctggtgggagaggtaccagcccgtcagctacaagctttgtactaggtccggtaatgaggatgagttccgaaatatggtcacccgctgcaataacgtgggagtgcgcatctatgtggatgccgtaatcaatcacatgtgtggcaatgctgtatcagctggtaccagttcaacttgcgggagttacttcaatcccggttcccgcgacttccctgccgttccttattctggatgggattttaacgatggcaagtgcaaaactggtagcggcgatatcgaaaactacaacgatgcaacgcaggtgcgcgattgtaggcttaccgggctgctagaccttgccctggaaaaagactacgtccggagcaagatagccgagtatatgaatcacctgatcgatatcggcgtggccggattcagattagacgcctcaaagcacatgtggcccggtgacataaaggctatcctcgacaaactacacaacctaaacagcaactggttccctgctggcagcaaacccttcatctatcaagaagtaattgaccttggtggggagccaatcaaaagctccgattattttggcaacggcagggtgactgagttcaagtacggagctaaactgggcaccgtaataaggaaatggaatggtgagaagatgagttatttgaagaactggggtgaaggatgggggttcgtgccttctgatcgtgccctggtgttcgtggataatcacgacaatcagagaggccacggcgcaggaggtgcgtcaatcctgacattttgggacgcccgactctacaaaatggccgttggattcatgctcgcgcacccctacggcttcacccgagttatgtctagctataggtggcccagacagttccagaacggaaatgatgtgaatgattgggttggtccccctaataataacggtgtgatcaaggaggtcaccatcaacccagacacgacctgtggcaatgactgggtgtgtgaacacaggtggcgacagatccggaacatggtcatcttcagaaacgtcgtcgacggacagccctttaccaattggtatgacaacggcagcaatcaggtggcatttggccgtgggaatcgaggattcatcgtcttcaacaacgacgactggtcattctcgcttacattacagactggtctccctgccggtacctattgcgatgtaatcagtggcgataagatcaacggtaattgcactgggattaagatctacgtgtcagacgacgggaaagcgcacttctccatcagtaatagcgctgaggacccatttatcgccattcacgcagaatcgaagctttag

SEQ ID NO: 214261 - DNA, 1536 bp, Artificial Sequence
  Description of Artificial Sequence: Synthetic coding sequence
atgaaattttttttgctactgtttacaatcgggttttgctgggcccagtatagcccgaatacacaacaggggagaacatccattgtccacctcttcgaatggcgttgggttgacatcgccctggaatgtgagcgttacctcgcaccaaaggggtttggaggcgtccaggtctctccccctaacgagaatgtggctattcacaaccccttcagaccttggtgggagcggtatcagcctgttagttacaaactttgcactagatccgggaacgaagatgaattcaggaacatggtgaccagatgcaataacgtcggtgtacgcatatatgtggatgctgtgatcaaccacatgagcggcaacgccgtttcagctggaacttcttctacttgtgggagctattttaacccaggttcccgcgactttccagccgtgccttatagtggatgggacttcaacgacggaaagtgcaaaacaggttccggggacatcgaaaattataatgacgcaactcaggtgcgtgattgtagactggtgggactgcttgatctggcccttgaaaaggattacgtgcgctcaaagattgcagaatatatgaaccatctgatcgatattggcgtcgccggattccggctcgacgcctcaaaacatatgtggcctggcgatatcaaggctattcttgacaagcttcataatttgaactcaaattggtttcccgctgggtcaaaacccttcatttatcaggaggtgatagatttaggcggagaacctataaagagcagtgactactttggaaacggtcgtgtcactgagtttaagtacggagctaagctgggcaccgtcatccgaaaatggaacggggagaaaatgagttacctaaagaactggggggagggttggggcttcatgccgagtgaccgcgctttggtattcgttgacaatcatgataatcaacgtggacacggagcaggaggcgcaagcattctgacgttttgggatgcacgcttgtataagatggctgtgggctttatgctggctcacccctacgggtttacccgggtgatgtctagctaccggtggcccaggcaattccagaatggcaatgacgtaaatgactgggtgggaccccctaacaataacggagttataaaggaggtaacgatcaaccctgacactacgtgtggaaacgactgggtttgcgagcaccgttggcgacagatcaggaatatggtcaactttcgaaatgtggttgatggtcaacccttcactaactggtatgataatggcagcaaccaggttgcctttggccgagggaacagaggcttcatagtattcaataacgatgattggacattctccctgacactgcagaccgggctccctgcgggaacttactgcgacgtgataagcggcgataaaattaacggtaactgcaccgggatcaagatttatgttagcgacgacggaaaggcgcactttagcatttcaaatagtgccgaagatcccttcatcgcaatacacgccgaatccaagctttag

SEQ ID NO: 214262 - DNA, 291 bp, Artificial Sequence
  Description of Artificial Sequence: Synthetic coding sequence
atgaagttctttctacttctgttcaccatagggttttgctgggcacagtattcgcccaatactcagcagggcagaaccagcattgttcacctgttcgaatggagatgggtggatatagctcttgaatgtgagcgatatttagcacctaaaggtttcggcggtgttcaagtgagcccacccaatgagaacgtcgcgatacataatccattcagaccttggtgggagcgataccagcccgtcagttacaagctctgcacccgctccggaaacgaggacgagtttagaaactag

SEQ ID NO: 214263 - DNA, 261 bp, Artificial Sequence
  Description of Artificial Sequence: Synthetic coding sequence
atgaagttctttctccttctttttactatcgggttctgctgggcacaatatagccccaacactcagcagggtagaactagcattgttcacctgttcgaatggaggtgggtggatattgctctggaatgtgaaaggtatcttgcaccgaagggctttggaggcgtacaggtctcacctccaaatgaaaacgtggcaattcacaatcctttccgtccttggtgggagaggtatcaaccagtgagctacaaactttgcacctag

SEQ ID NO: 214264 - DNA, 2313 bp, Artificial Sequence
  Description of Artificial Sequence: Synthetic coding sequence
atgctacccggtctagcccttctgcttctggccgcttggactgcacgtgccctcgaggttccaacagacggtaatgctggactgttggccgagcctcagattgctatgttctgcgggcgtctgaacatgcatatgaatgtacaaaacggaaagtgggacagcgatcctagcggcaccaaaacttgtattgataccaaggagggtattctccagtactgccaggaagtctaccccgagctccagatcacaaatgtcgtagaagcaaaccagcccgtaaccatacagaactggtgtaagcgaggcagaaaacagtgcaagactcacccacattttgtgatcccctaccggtgcctcgtgggagagttcgtgtccgatgccctgttggtgcccgacaagtgtaagtttttgcatcaggagcgcatggacgtctgtgaaacccacctgcattggcatactgtggccaaggagacttgtagtgagaaatcaacaaacttacacgactatggtatgctgcttccctgtggcatcgataaatttcgaggggttgagttcgtctgttgcccgctcgctgaggagtctgacaacgtggactcagcagacgctgaagaagatgactctgacgtgtggtggggtggcgctgataccgactatgcggatggatccgaggacaaggtggttgaggtcgccgaagaggaggaagtagccgaagtggaggaggaggaggccgatgatgatgaagatgatgaggatggagacgaggtggaggaagaggccgaagaaccttatgaggaagctactgaacggacgacatcgattgctactaccacaacaactaccaccgagtctgtcgaagaggtggtgagggaggtgtgctccgagcaagcagagactggtccatgcagagccatgatctcacgatggtacttcgacgttacagagggtaagtgcgccccattcttttacggagggtgcggagggaataggaacaacttcgacacagaggaatattgtatggctgtgtgcggaagcgcaatgagccagagcttgctcaaaactacccaggagccactcgcacgcgacccggtgaagctgcctaccacagcagcctcaacacccgatgcagttgacaaatatctcgaaacccccggtgacgagaatgagcacgctcatttccagaaggcaaaggagcgcttggaggcaaagcacagagaacgcatgagccaggtgatgcgggagtgggaggaggccgagagacaagcaaagaacttgcctaaggccgacaaaaaagccgtgatccagcactttcaggaaaaagtggagtcccttgagcaggaggccgctaatgagcgccagcagctggtggagacacacatggcccgtgtggaggcaatgctgaacgatcgcagacgtctcgccctggaaaattatattaccgccctccaggcagtgcctcctcggccaaggcatgttttcaatatgctgaagaaatatgtgagggcagagcagaaggatcggcagcacaccctgaagcacttcgaacacgtgcgcatggttgaccctaaaaaggccgctcaaattaggtcccaggtgatgacacacttacgcgtgatttatgagcgaatgaatcagagcctatccctcttatacaatgtccctgccgtagctgaagagatccaagatgaggtagacgagctcctgcaaaaagagcagaattattccgacgatgttctggctaacatgataagtgaaccaagaatttcctatgggaacgacgccttgatgccctccctgacagaaacgaaaacaacggtagaattgctgccggtgaatggagagttttctctggatgacctgcaaccttggcatagcttcggagctgattcagttcccgcaaacaccgagaacgaggtcgagcccgtagacgcccgtccagctgccgacagagggctaaccacaaggcccggatccggtctgaccaatatcaaaaccgaggagatctccgaggtcaagatggatgctgaattcaggcatgactctggatacgaagtccaccaccaaaaactggtgttcttcgccgaagacgtgggttcaaataagggcgcaatcatcggcctaatggtcggaggggtcgtaattgccacagtgatcgtaatcacattagtaatgctcaaaaaaaagcagtacacctcaatccatcatggggtggtggaagtggacgccgcagtgacccctgaggaacgccacctctccaaaatgcaacagaacgggtacgagaacccgacttataaattttttgaacagatgcagaattag

SEQ ID NO: 214265 - DNA, 2088 bp, Artificial Sequence
  Description of Artificial Sequence: Synthetic coding sequence
atgttaccaggactggctctgctacttctcgctgcttggaccgctcgggcactggaggtcccaacggacggcaacgccggtctactggcagagccccaaattgccatgttctgtggaagactcaatatgcacatgaatgttcaaaatggcaagtgggactctgatccttctggcactaagacttgtatcgatactaaagaaggcatactgcaatactgtcaagaagtctacccggagctgcagatcactaacgtggtggaggctaatcagccagttactattcagaactggtgcaagcgcggacgaaagcagtgcaagacccatccccactttgtgatcccatacagatgcctcgtcggtgaatttgtgtccgacgctctgttagtgcccgacaaatgcaagtttcttcaccaggaaagaatggacgtatgcgagacacacctgcactggcacacagtggcaaaggagacgtgcagtgagaagtctaccaacctccacgactatggaatgttgctgccttgtggcattgataagttccggggtgttgaattcgtatgctgtcctctggccgaggagagcgataatgtggacagtgcagacgcggaggaagacgattcagacgtctggtggggtggcgctgacacagactacgcggatgggtccgaagacaaggtggtggaagtcgcggaagaagaggaggtggcagaagtcgaggaggaggaggccgacgacgacgaggatgacgaggacggtgacgaagtcgaagaagaagccgaagaaccttatgaagaggctaccgagagaacaacaagtatcgccaccacaactactactactaccgagtccgtggaggaagttgtgagggtgcctacgacagccgcatcaactccggacgccgtggacaagtatctggaaacacccggtgatgagaacgagcacgcacatttccagaaggccaaagaacgattagaggcaaaacatcgcgagcgcatgagccaagtgatgagggaatgggaagaagctgagcggcaggctaaaaacctgcccaaggcagacaaaaaagctgtcatacagcactttcaggagaaggtggagtctctcgagcaggaggctgccaacgagcgccagcaactcgtggaaactcatatggctcgggtcgaggcaatgcttaatgaccggcgacggttggctctggagaattacatcactgctttacaggcagtgcctcctaggccaaggcacgtgtttaatatgctgaaaaagtacgtccgcgctgagcagaaagatagacagcacacgcttaagcatttcgaacatgttcgaatggtcgacccaaagaaggccgcacaaattaggtcacaggttatgacacacttgcgggtcatctatgaaaggatgaaccagtcattgtctctactctacaatgtgcctgcagtcgccgaagaaatccaggatgaggtggatgagctgttacagaaggagcaaaattacagcgacgatgttttggcgaacatgattagcgaacccagaatcagctacgggaacgacgcgctcatgcccagtcttaccgagacaaaaactacggtggaactattgcccgtaaatggagagttttccctcgacgaccttcagccttggcattcattcggggcagattctgtcccagccaacacagagaatgaagtggaaccagtcgatgcgcgacctgcagcagaccgaggtctgaccacaaggccgggtagtggactgaccaacatcaagaccgaggagatttcggaagttaagatggatgccgagttccgccacgattcgggatacgaggtgcatcatcaaaaactggtttttttcgccgaggacgttgggagtaacaaaggcgcaatcattgggttgatggtggggggagtggttatagcaacagtgatagttattacccttgtcatgcttaagaagaaacaatatacaagcatccaccacggggtcgtggaagtggatgccgctgtgacacctgaagaacggcacctgtccaaaatgcaacaaaacggttacgagaacccaacttacaagttcttcgagcagatgcagaattag
